United States Patent 9,283,287 (MODIFIED POLYNUCLEOTIDES FOR THE PRODUCTION OF NUCLEAR PROTEINS) - sequence listing, part 8

SEQ ID NO: 12844 - DNA, 2154 bp, Artificial Sequence
  Description of Artificial Sequence: Synthetic coding sequence
atgcacggcgctgccagagctcccgcgacatcagtctcagcagattgctgtatcccagcgggacttcgcctgggacccgtgccaggaaccttcaaacttggaaaatacctgagcgatcgaagggagccgggacccaagaagaaggttcttacaattcagacttctgcccaccaagtccgcatggttcgaggggaattagtcgacgaaagcggggggagccctctggaatggatcggactgattcgggccgctcggaacagccaggagcagactttggaggccattgccgatcttcccggaggacagatcttctaccgcgccttgagagacgtgcagcccggcgaggagctgaccgtgtggtattccaatagcctggcacagtggtttgacatcccaaccacggccacacccacacatgatgagaagggcgaggaacggtatatatgctggtactgctggcgcactttccgctaccccaattcactgaaggcgcatctgcgctttcattgtgtattttctggcggaggcggaggtgcttttctgcatcacgagcacgctgccaggcaaggggcagtgcccgctgcagacgggctgggcttgtcccctaagccacccgctcctgacttcgcagccccctcacaggcagggacactcagacctcatccacttggaccgccaccggtccaggcctgtggcgctcgagagggcatcaagagggaagcatcgagtgccccatcggctacttccccaacaccagggaagtgggggcagccaaaaaaaggaaaggagcagcttgacagagctttagatatgtctggcgctgctcgcggacagggccatttcctgggtatcgtgggcggctcatccgctggtgttgggtctcttgctttctatcctggagttcggtccgccttcaaaccagcaggcctcgctcgtgcagccgctgcggcacacggcgatccttatcgagaagagagtagcagtaagcagggggcagggttagccctcgggcgcttgttagggggtggccgagcatgcggacgcccaggatcaggagagaatagtgccgcagggggagcaggccatcaccaccaccatcacgcccaccaccatcaccaccccaaatgcctgctggccggagatccccccccaccacctccgccggggctgccatgttcgggcgccctcagggggttcccgctactaagcgtgccaccagaggaggcaagcgcgttcaaacatgtcgaacgggcccctcctgcagcagctgcgctgcccggagcacgttacgctcagctgcccccagcgccaggtctacccttagagcgatgtgcgctgcccccactggatcccgggggcctcaaggcctacccgggcggcgagtgttctcacctacctgccgtaatgcctgccttcacagtgtataacggcgagctgctttacggtagcccggcgacgacagcctactacccccttaaattacactttggtggcctgttgaagtacccagagtctatttcctattttagcggccctgccgctgcagcactctcaccggcagaattaggatccctcgcatctatagacagagagatcgcaatgcataatcagcagctcagcgagatggcggcagggaaagggcgagggcggcttgactcaggtactcttccgcctgcagtagctgccgcaggcggcactggaggaggaggctccggaggatccggagcagggaagcctaaaactggacacctgtgtttgtattgcggcaagctgtactcgcgtaaatatggtctgaaaattcacatgcgcacgcacaccggctacaagcccctcaaatgcaaggtgtgcctccgacctttcggggacccaagcaatctgaataaacacatccggctccatgcagaaggcaacacaccttataggtgcgagttttgtggtaaggttttggtcaggagacgggatctggagcggcacgtgaagagcaggcatcctgggcagtccttgctagccaaggcaggggacggacctggagccgagcccggctacccacctgaaccaggcgatccaaagtctgacgacagcgatgtagacgtttgcttcactgacgatcaatcggatcccgaggtgggagggggcggcgaacgggacctgtag

SEQ ID NO: 12845 - DNA, 2124 bp, Artificial Sequence
  Description of Artificial Sequence: Synthetic coding sequence
atgcatggggccgctagagccccggccacgtcagtctctgccgactgctgcattcccgctggactgaggttgggtcccgtgccgggtacattcaaattgggaaaatacctctcagataggcgtgagcccggaccaaaaaagaaggtccgtatggtcagaggagaactcgtagatgagagcgggggaagtccactggaatggatcggcctgatccgagcagctcggaacagccaagaacagacattggaagccatagcagacctcccgggggggcagatcttttatagagcgctcagggacgtccaaccaggggaggaactgactgtatggtactccaactccctagcccaatggttcgacatccctaccaccgccaccccgacccacgacgaaaagggtgaggagaggtacatctgctggtactgttggcgaacgttccgctacccaaactctctgaaggcccaccttagatttcactgtgtgttctctggaggtgggggcggtgctttcctgcatcacgaacacgccgccagacagggagctgtgccagctgcggacggcttgggtttgagcccgaaaccacccgcgcctgattttgcggcgcctagtcaggctgggactttgcgtcctcatccccttggaccacctcccgtccaagcctgtggcgcacgggagggaattaaacgggaagcttccagtgccccgagtgccacaagtcctacaccaggcaagtggggccaacccaagaagggcaaagaacaactggaccgggcgttagacatgtcgggcgccgcgagggggcagggacacttcttaggaattgtgggaggctccagcgccggagtgggatcactggccttctaccctggagtgagatccgcgttcaagcctgccggcctggcacgggccgccgcagcagcgcacggagatccatatcgggaggagtctagttcaaagcagggggccggtctcgcgctgggcagactactgggtggggggagggcctgtggccgtcctggctccggggagaattccgccgctggaggagccgggcaccatcaccatcaccacgcccatcaccatcaccatcctaaatgccttctggctggtgacccccccccacctcctcctcccggccttccatgttccggcgcgctgcgcggatttcctctgctcagcgtaccacctgaagaggcctctgcatttaagcacgttgagcgagctccacctgctgcagctgccctccctggggcccggtatgctcagttgccccctgcccccgggcttcccctcgaaaggtgtgctctcccgccgcttgaccctgggggtctgaaggcgtaccctgggggggaatgtagccacctaccagccgtgatgcccgcctttactgtatacaatggcgagcttttatacgggtctcctgcgacaaccgcttactaccctctcaaactccacttcggggggctgctgaaatatccggaaagcatcagctatttcagcggcccagccgccgcggccctgagtccagcggagcttgggtccttagccagcatcgacagagaaatcgccatgcataaccagcagctatccgaaatggccgccggtaagggtcgaggacgcctagacagcgggacgctgccgccagccgtggctgcggccggtgggacagggggcggcggatctggcgggtcaggggccgggaagccgaagactggccacctgtgcttatattgtggcaaactgtactccaggaagtacggattaaagatccatatgcggacacacactggatataagcctctaaagtgcaaagtgtgcctgcggcccttcggcgacccatctaacctgaacaagcacatcagactccatgccgaaggcaatacgccctatcggtgcgagttttgcggaaaggtgttggtgcgcaggcgggatctggagcggcatgtcaagtccagacacccgggtcagtcgctgttagcgaaggccggggacgggccaggggcagagccaggatatcctcccgaacccggtgaccccaagtccgacgattccgacgtcgacgtttgttttacagacgatcagtcggaccccgaggtgggtggcggcggcgagcgcgacctctag

SEQ ID NO: 12846 - DNA, 4524 bp, Artificial Sequence
  Description of Artificial Sequence: Synthetic coding sequence
atgcctcggaggaggcctccagccagtggggcagctcagtttcccgagcgaatcgccacccggagtccagaccccattccactgtgtacctttcagcgacagcctcgagcggctcctgtgcagccaccatgtcgtctgttctttgtgacgtttgcagggtgcggccaccgatggcgctccgagtctaaacccggatggatttcacgctcacgaagtggaatcgccctgagagcagcacgaccacctggctcatcacccccaaggcctgctgcgccacggccacctcctcccgggggtgtagtcgctgaagcaccgggagatgtggtgatcccccgccccagagtccagccaatgcgagtggcgaggggtggtccatggacaccaaatcctgcattcagggaggcagagagctggtcacaaataggaaatcagcgcgtaagtgaacagctacttgaaacctcattaggtaatgaggtgtctgataccgagcccctgtccccagcatccgccggcctgcggcggaatcccgccctgcctcccggaccctttgcacagaatttctcctggggcaatcaggagaacctgcctcctgcactgggcaagattgctaacggaggcggtacaggcgccggcaaggctgaatgcggatacgagacggagagccatctgctggaaccccacgagataccactaaatgttaacacacacaagttcagcgattgcgaattcccgtacgaattctgcacagtttgcttttccccttttaaactactgggaatgagcggcgttgagggagtgtggaaccagcattctagatcagcatcaatgcacaccttcctgaaccactcggcgaccggtataagagaagcaggatgccggaaagacatgcctgtgtccgagatggctgaagatgggtctgaagagatcatgtttatctggtgcgaggattgctcacagtaccacgactctgaatgtcctgagctaggccccgtagtgatggtgaaggactcatttgtgctatcccgtgctaggagctggcctgcatctggccacgtccacacccaggccggacagggcatgagggggtacgaggacagagaccgggcagacccgcagcagctaccggaagccgtgcccgcaggactggtgcgcaggctgagtggtcagcaactgccatgtagaagtacactcacctgggggcgcctctgtcatctggtcgcccaaggccggagttctttacctcctaacttggagattaggcgcttggaggatggggccgaaggtgtctttgctattactcaactggtgaaaaggacacaatttggtccgttcgagtctagaagagtagccaagtgggaaaaagagtccgcctttcctctcaaagtcttccaaaaggatggacatcctgtatgtttcgacacctcaaacgaggatgattgcaactggatgatgttggtcaggcccgccgcggaggccgaacatcagaatctgactgcctaccagcacggctccgacgtctacttcactacctcccgagatattccccccggaacagagctccgtgtgtggtacgccgccttctatgctaagaagatggacaagccaatgctcaagcaagcgggttcgggcgtgcacgctgccggcactccagagaactccgctcccgtcgaaagtgagccatctcagtgggcctgcaaggtatgctctgccaccttcctcgagctacagcttttgaacgaacatttgcttgggcacctcgagcaagcgaagtcccttccccctggaagtcagtctgaagctgccgcgcccgagaaagagcaggacacccctaggggtgagcctcccgccgttcccgagtccgagaacgttgctactaaagagcagaaaaaaaagccacggagaggcagaaaaccaaaggtgtccaaagcagagcagcctttggttatcgtggaagacaaagagccgactgagcaagtggctgagatcattaccgaggtcccccccgacgaaccagtgagcgccacacccgatgaaagaatcatggaacttgtcctggggaaattagctacaaccacaacagacacctccagcgttccgaaattcacccatcaccagaacaacaccatcactctaaaacgaagcctgatcctgtcctcacgccatgggatcagacgtaaattaataaagcaactgggcgagcataaacgcgtataccaatgtaatatttgcagcaagatattccagaactcatccaacctctccaggcatgtcaggtcccatggtgacaaattgtttaaatgcgaagaatgcgctaaacttttttccagaaaggagagcttgaaacagcatgtgtcttacaaacacagtcgcaacgaggtagatggtgagtaccggtacaggtgtggcacctgtgagaaaacatttcggattgagtcagccctagagtttcataactgtcgcactgacgacaaaaccttccagtgtgaaatgtgttttcgttttttttctactaattccaatctgagtaagcataaaaaaaaacacggcgataaaaagtttgcgtgtgaagtttgtagcaagatgttttatcgcaaggatgtgatgctggaccaccagaggcgtcaccttgaaggagttagaagggtcaagcgcgaggatcttgaggccggcggggagaatctggtaaggtataaaaaagaaccatccggctgccccgtctgtggaaaggtgttttcctgccgaagcaatatgaacaagcacctcctgacccatggcgataagaaatatacttgtgaaatctgtggaagaaaattttttagggtggatgtgctgcgggatcatatccatgtccacttcaaagacattgccttaatggatgaccatcagcgggaagagttcattgggaagataggaatcagcagcgaagagaacgatgacaactccgacgagtctgccgacagcgagccacataaatattcctgtaagcggtgtcagttgacattcgggcgtggtaaagagtatctgaagcacattatggaggtccacaaggagaaggggtacggatgttctatctgcaaccgccggttcgcactaaaggcgacttatcacgctcatatggtgattcacagggagaatctgcctgatccgaacgtgcagaaatatattcatccctgtgaaatttgtggcagaattttcaactccatcgggaatttagagaggcacaagcttatccatacaggcgtgaagtctcacgcttgcgagcagtgcggaaagagcttcgctagaaaggatatgctcaaggaacacatgagggtgcacgataacgtaagggagtacttgtgcgcagaatgtggcaagggcatgaaaacaaagcacgccttgaggcatcacatgaagttgcataaagggattaaggagtatgaatgcaaagagtgccataggcgctttgcacaaaaggtgaatatgttgaagcactgcaagaggcacactgggataaaggatttcatgtgcgaattgtgcggcaaaacatttagtgaacggaacaccatggaaacccacaaactgatccacacggtcggaaaacagtggacatgttccgtatgcgacaagaaatacgtcacagaatatatgttacagaagcatgtacagctgactcatgacaaagtggaggctcaaagctgccagctctgcgggacaaaagtaagcacaagagcttccatgagcagacatatgcggcgaaaacacccggaagttttagcagtgagaattgacgacctggatcacctccctgagactacaacgatcgatgcctcttccatcgggatagtgcagccagagttgacgctcgagcaggaagacctggcagaaggtaagcacgggaaagcggcaaaaagaagccacaaaagaaaacaaaaaccagaggaagaggccggtgccccagtcccagaggacgccacttttagtgaatacagtgaaaaagaaactgagttcacaggctctgtaggcgacgagaccaatagtgccgtgcagtcaatccagcaggtcgtcgtgactctcggcgatcccaacgtgacaactccttcatctagtgtcggtctcactaacatcactgttacaccgatcacaactgccgcagccacacagttcaccaatctgcagccggttgccgtgggccacctcaccactcctgaaaggcagctccagctagataattccatcctaactgtcacgtttgacaccgtcagcggatcagcaatgctgcataatcgacagaacgatgttcaaattcacccacagcctgaagcatcaaatcctcagtcagtggctcattttatcaatctcaccacactggtgaactctattacccccctgggtagccaactttccgaccagcacccgctgacctggagagccgtcccgcagacagacgttctcccacctagtcagccccaggcccctccccagcaggctgcacaaccccaggtccaggccgagcagcagcaacagcaaatgtacagctattag

SEQ ID NO: 12847 - DNA, 1557 bp, Artificial Sequence
  Description of Artificial Sequence: Synthetic coding sequence
atggccgaagacggcagcgaagaaatcatgtttatctggtgcgaagactgtagccagtatcacgacagcgagtgcccagaattagggcctgtcgtgatggtgaaagactcattcgtcttgagtcgcgcccgctcctcgctgcctccgaatttagagattcggcggttggaggacggtgcagaaggcgtgttcgccatcactcagctggtcaagcgaactcagtttggaccctttgagtctcgcagggtggccaaatgggaaaaggaaagcgccttcccgctgaaagtgtttcagaaagatgggcaccctgtgtgcttcgacacttccaatgaagatgattgtaactggatgatgctggtacggcctgcagcagaggctgagcatcaaaacctgactgcttaccagcatggctctgatgtctacttcacaacatctcgggatatacctccgggtaccgagttgagagtgtggtatgctgccttttatgctaaaaagatggacaaacctatgctgaaacaggctgggtcaggggtgcatgcagccggcactcccgagaatagcgcgccagtcgaaagtgagccctcacagtgggcctgcaaagtgtgttcagcaactttcctggagctgcagctcctgaacgaacaccttcttgggcacctggaacaggcgaagagccttcctccgggatcacagtctgaggcggctgctcccgaaaaggagcaagacaccccacgaggggagccaccggcggtccccgagtccgaaaatgttgctaccaaagagcaaaagaagaagccaagacggggacggaaaccgaaagtttcaaaagccgagcaaccgctggtaatcgtcgaggacaaagagcccacagaacaagttgccgaaattattaccgaggtgccacccgatgaacccgtcagcgccaccccagatgagaggattatggagctggtgctggggaaattggctactaccacaaccgacacttcttctgtgccaaagttcacccaccatcaaaacaacacaatcaccctcaaacggagtctgatactgtcttcgaggcacggaattcgccgaaagctgatcaagcagctgggcgagcacaagcgcgtttaccagtgtaacatctgttcaaaaatttttcagaattcctctaatctgtccagacacgtgcgttcccatggtgacaagttgttcaagtgcgaggaatgcgctaagctcttttcccgaaaagagtcactcaagcagcacgtgtcttacaagcattcacgtaacgaagtggacggcgaatatcgctacagatgtgggacatgcgagaagacctttcgcatcgagagcgcattggagttccacaattgtcgcactggtctgattgcacatcctggggagggaggccccggaggctccaggctgagagacctgccagcgacctctccatccactaggcgttccacggcaaccaggtcacttcctgtaagaagcgctgcgcggtgctccactgcacgcacatcttgttggactacatctgcaggtacttggaagacatgcgccgcatag

SEQ ID NO: 12848 - DNA, 3537 bp, Artificial Sequence
  Description of Artificial Sequence: Synthetic coding sequence
atgcctcggcgaaggccgcccgctagcggcgcagcccagtttccggaaaggatcgccacaagaagtccagatcccatccccctttgcactttccagagacaggtgtcagagatggccgaagacggctccgaagagatcatgttcatatggtgcgaggattgtagccagtaccatgatagtgaatgcccggaactgggtcccgtcgtgatggtgaaggacagttttgtgctctccagagctcggtcctcgttgccgcccaacctcgagattagacgcctggaggatggtgcagaaggggtgtttgctattactcagttagtcaagcgcacccagttcggaccttttgagagtagaagggtggctaagtgggaaaaggagtcagcttttccccttaaggtgtttcagaaagacggacatcccgtatgtttcgatacctcaaatgaagacgactgcaattggatgatgttagttcgtcctgccgcggaggccgagcatcaaaatttgacagcctatcaacatggctccgatgtctatttcactaccagccgtgatatcccccccggtaccgaacttcgggtttggtatgccgccttctacgcgaaaaaaatggataagcctatgttgaagcaggctggaagcggcgtccacgcagccggtacgcctgagaacagcgcccccgtggagtctgaaccatcccagtgggcttgtaaggtgtgctctgccaccttcctcgaacttcagcttttgaacgaacatctgcttggacatttggaacaagcaaagtccctgcctcccggttcccagtctgaagccgccgccccggagaaggagcaggatactcctagaggcgagcctccagccgtccccgagtccgagaatgttgcaaccaaagagcaaaaaaaaaaacctaggcgagggcgcaagccaaaagttagtaaggcagagcagcctctggtcatcgtggaggataaagagcccactgaacaggtcgcagaaatcattacagaagtgcctcccgatgagcctgtgtctgctactccggacgagcgcataatggagctggtgctaggtaaactcgccaccacgaccacggatacatcctccgttccaaagtttacccaccatcagaataataccatcaccctgaaacggtcgctgattttgtcttctagacacgggatccgcagaaagctgattaaacagttgggagagcacaaaagagtataccagtgcaatatctgttccaaaatctttcagaattcgtcaaatctttctagacatgttagatcccatggggataaactttttaaatgcgaagagtgtgcaaagctcttcagccggaaggaatcactgaaacaacatgtgagctacaagcatagccgcaatgaagtggacggcgagtatcgctatcgatgcggtacctgcgaaaaaaccttccggattgagtctgcattggaatttcataactgtaggactgatgacaaaacattccagtgtgaaatgtgtttcaggttcttttcgactaactccaacttgagcaagcataaaaagaaacatggcgacaaaaagttcgcctgcgaagtctgttccaaaatgttctatcgtaaagacgtgatgctcgatcatcaaagacggcaccttgagggcgtgaggcgggtgaagagagaggacttagaggccggcggggagaatctcgttcggtacaagaaggagccctcaggctgcccagtttgcgggaaggttttttcatgtcgcagcaatatgaataaacaccttctgacccatggagacaagaagtatacttgtgaaatctgtggaaggaagtttttccgagtcgatgtgcttcgggaccacattcacgtgcattttaaggatattgccctgatggacgaccaccagcgagaggaatttattggtaagatcgggatatcttccgaagaaaatgacgataactcggatgagagcgctgattctgagcctcacaagtacagctgcaaaaggtgtcaactgacctttggaaggggaaaagagtatcttaagcacatcatggaagtgcataaggagaaggggtacggctgttcgatctgcaaccggcgattcgcacttaaagccacttatcacgcccatatggttatccatcgcgagaacctacccgaccctaatgttcagaaatacattcatccttgtgagatctgtggcaggatcttcaattccatcgggaatttggagaggcataagctgatccacacaggagtcaagtctcatgcttgtgagcagtgcggtaagtccttcgcgcggaaggatatgttaaaagagcatatgcgcgtacacgacaacgtacgcgaatacctgtgcgccgagtgcggcaaaggtatgaagaccaagcacgctcttaggcaccacatgaagctacataaggggattaaagagtatgagtgtaaggaatgccatcgcagattcgcacagaaggtgaatatgttgaagcactgtaagaggcataccggcatcaaggacttcatgtgcgagctctgtgggaagacgttcagtgaaaggaacacgatggagacacacaaactgatccacacagttggaaaacaatggacctgttccgtctgtgataaaaagtacgtgacggagtacatgcttcagaaacatgttcagctcacacacgataaggttgaggcacagtcttgccaactatgcggcaccaaggtgtcaacgagagcctcaatgagtagacatatgagaagaaagcaccccgaagtactcgccgtccgaattgacgatctcgaccatttacctgaaaccactacaatcgacgccagctctattggtattgttcagcccgaactgactctcgaacaggaagacctggcggagggaaagcatggtaaagcagctaagcggagtcacaaacggaaacagaagcctgaggaagaggcgggcgcacctgtgcccgaagatgcgacattcagcgagtacagtgaaaaggagactgaattcactggtagcgtcggggatgagactaattctgccgtccaaagcatccaacaggtggtggtgactcttggggatcccaatgtcacgactccctcctcatcagtaggcctgacgaacatcaccgtgacgcccataactaccgcagctgccacccagtttaccaatctgcaaccagttgctgtcggccacctgaccaccccagagaggcagttacaactcgacaattcaattcttactgttacttttgacacagtctcaggctcagcgatgctgcacaaccgccaaaacgacgtgcagattcacccgcaacctgaagcaagtaatccccaatctgtcgcccatttcatcaatctcactacccttgtgaattccataacacccttgggcagccagttgagcgatcagcatcctcttacatggcgcgcggtgccccagacagatgtcttgccccccagccagccccaagcgccccctcagcaggctgctcagccgcaggtgcaggccgagcagcagcaacagcagatgtatagctattag

SEQ ID NO: 12849 - DNA, 4524 bp, Artificial Sequence
  Description of Artificial Sequence: Synthetic coding sequence
atgcccagaaggagacctccggcatccggagctgctcagttccctgagcggatcgctacaaggtcaccagacccaatcccattgtgcacctttcagcggcagcccagggccgctcctgtgcagcctccctgtagactattcttcgtgacgtttgctggctgcggccaccgttggagatcagagagcaaaccaggctggatttctcgcagtcgcagcgggattgcccttagggccgctaggcctcctggatcctctccgcctagaccggccgcaccaagacccccaccacctggcggcgtggttgccgaagccccgggtgacgtcgtgatcccccggcctagagtgcaacctatgcgcgtggcgagaggcggaccctggacccccaatcctgcctttcgtgaagctgagagctggtcacagatcggcaatcagcgcgtttctgagcagttattggagacttccctaggcaacgaggtgagcgatactgaaccactgagtccggccagcgctgggctccgaaggaatccagcgctccctcctggacccttcgcacagaacttttcatgggggaatcaggagaatctgccgccggcactagggaagatcgcaaacggaggaggcacaggcgcaggaaaagcggagtgcgggtacgagacagagagtcacctcctggagccacatgaaatacccctgaacgtaaatacacacaaattctctgattgtgaattcccgtatgaattttgtacagtgtgtttctcccctttcaaattactcggcatgtcaggtgtcgaaggggtgtggaaccaacacagtcggtccgcaagtatgcacacatttctgaaccattctgccactggaattagggaggccggctgtcgcaaagacatgcctgtaagcgagatggcagaggatggttctgaagagattatgttcatttggtgcgaagactgttcccagtatcacgattccgagtgcccggagcttggccctgtcgtcatggtgaaggactcctttgttctgtctcgcgctagatcatggccagcctccggtcacgtccatacacaagctggacaggggatgaggggctatgaagaccgggatagggcggatccccagcagctccccgaggccgtcccggctggactggtgagaaggctgtcaggtcagcaattaccttgtcgatctacactgacatgggggcgactgtgccatctggtggcacaagggcgatcgtcactgccaccgaacctggaaatacgacggctcgaggacggggctgagggagtgtttgcaatcactcagctggtgaagcggacccagttcggacccttcgagtcccgtagggtggcaaagtgggaaaaagagtccgcatttcctctgaaagtgtttcagaaggacggacacccggtgtgttttgacacctctaacgaagacgattgcaactggatgatgctcgtgcgcccggcagccgaggctgagcaccaaaacctaactgcctaccagcacggctcagatgtatattttacaacatctcgggatattccacctgggaccgagttgcgagtgtggtatgctgctttttacgccaagaaaatggacaaacccatgctcaaacaggctggtagtggggttcatgctgccgggacgccggaaaacagtgcccccgttgagagcgaacccagccagtgggcctgtaaagtctgctcagccacgttcctcgaattgcaactgctcaacgaacatctgcttggacatttagaacaggccaagagtttgccacccggttcgcaatcggaggcagccgctccagaaaaagagcaagatactcctcgaggggagcccccagctgtgcccgagtcggaaaatgtagcgaccaaagaacagaaaaaaaagcctagaagggggcgaaaaccgaaggttagtaaggccgagcagccgctcgtgatcgtcgaagacaaagaaccaaccgaacaggttgcagaaatcatcactgaagtgccacccgacgagcccgtatcagccacccccgatgagcgaatcatggaacttgttctcggcaagttggctacaaccaccacagacacatcttctgtgcccaaattcacgcatcaccagaataacacgatcacactaaaaagatccttaattctgagctccaggcatgggatccgtcgaaagcttataaagcagctgggcgaacacaaaagggtgtatcaatgtaatatctgctccaaaatctttcaaaattcctctaaccttagtcgtcatgtgaggagtcacggagacaagctgtttaagtgcgaggagtgtgccaagctgttcagccgcaaagaatccctgaagcaacacgtgagttataaacatagccggaatgaggtcgacggcgagtatcggtatcggtgcggaacgtgcgagaagaccttccgcattgagtctgcgttggaattccataattgtagaacggatgataaaacctttcagtgcgagatgtgttttaggttctttagtacaaattccaatctcagtaaacacaaaaaaaaacatggcgacaaaaagtttgcttgcgaggtatgctccaagatgttctatagaaaagatgtgatgctcgaccatcagaggaggcacctggagggtgtgagacgcgtaaagcgagaggatttagaggcaggcggcgagaatctggttaggtacaagaaagaaccctccggctgcccagtgtgcggaaaggtttttagctgtaggtcaaacatgaacaagcacctcctcacacacggtgacaaaaaatatacctgtgagatctgtgggcgcaagtttttccgcgttgacgtactgagggaccatatccatgtccatttcaaggacattgcactgatggatgatcatcaacgagaagaattcataggaaagataggtatatcaagtgaagagaacgacgataacagcgacgaatctgccgatagtgagcctcacaagtacagctgtaaacgatgccaactgacattcggtcggggtaaagaatatttaaagcatattatggaagtccacaaggagaaaggatacggctgctctatctgtaatcgcaggttcgcactgaaggccacgtaccatgcccatatggtgatccaccgcgaaaacctgccggaccccaacgtgcagaaatacattcatccatgcgagatatgtggccgaatttttaatagcattgggaatttagaacgccataagctgattcataccggagtgaaatcacatgcctgtgagcagtgtggcaagtcatttgcaagaaaggacatgttgaaggaacatatgcgggtgcatgacaacgtcagggagtacctctgcgccgaatgcgggaagggcatgaagacgaagcacgcactgcggcaccacatgaaactgcataagggaatcaaggagtacgaatgcaaagaatgccaccggagattcgcccagaaagtcaatatgttgaaacattgcaaacgccacacagggatcaaagattttatgtgcgagctgtgtgggaagactttctccgaacgcaacacaatggaaacacataaattgattcatactgtgggcaagcagtggacttgctcagtatgcgacaaaaaatacgtgactgagtacatgctgcagaagcatgtacagttgactcacgataaggttgaagctcagtcctgtcagctgtgtgggacaaaggtgtcaactcgagcatcaatgagccggcacatgcgcaggaagcatcccgaagtcctggccgttcgtatagatgaccttgaccatctacctgagacaaccacgatcgacgctagtagtattggtattgtgcagcccgaattaactctggagcaggaggacctggccgaaggaaaacacgggaaagccgccaagaggtcgcacaagcggaaacaaaagccggaggaggaagcaggggcacccgtccccgaagatgctactttcagtgaatacagcgaaaaggaaacggagtttacaggtagtgtcggggatgaaaccaacagcgcagtccagtctatccagcaagtggtcgtgacgttgggcgacccgaatgtaacaactccgtctagttcagtgggactaaccaacatcacggtaacccctattacaacggcagccgcgacccagttcactaatctacaaccggtcgctgtcggccacttaacaactcccgagcgccagctccaacttgataatagtattctgaccgtcacctttgacacagtgtctgggagtgcaatgctacataacaggcaaaacgacgtgcagatacatccacagcccgaagcttccaacccacagtctgttgcgcatttcataaatctcacaacgctggtcaactcaatcacacctctgggctctcagctctccgaccaacacccactcacctggagggcagttccccagactgacgtgttgccccccagccaaccacaggccccccctcagcaggcggcgcagcctcaggtgcaagccgagcagcagcaacagcagatgtactcctattag

SEQ ID NO: 12850 - DNA, 1437 bp, Artificial Sequence
  Description of Artificial Sequence: Synthetic coding sequence
atggctgaggatgggagcgaggagataatgtttatatggtgcgaggattgttcccagtaccacgattccgaatgccctgagctgggacctgttgttatggttaaggactcttttgtgctctcacgggcacggagctctcttccccctaatcttgagatccgcagactggaggacggcgcagaaggagtgtttgccataacccagcttgtaaagcgtacccaatttggtccctttgagagccgcagggttgccaagtgggagaaggagagtgccttccctctcaaggtgttccaaaaggatgggcatcccgtttgctttgatacctccaacgaagacgactgtaactggatgatgctggtgaggccagcagccgaagccgagcaccagaacctgaccgcataccagcacggctcggacgtctactttacaacatcccgcgatatcccccctggcactgagctcagagtgtggtatgctgctttctacgccaagaagatggacaaacctatgctaaaacaagccggaagcggggttcatgcggccggcacaccggagaatagcgccccagtggaaagcgagccatctcaatgggcatgtaaggtttgctcagctactttcctcgaactgcaactgctcaatgagcacttgctgggccacttggagcaagcaaagagccttcctccgggctctcagtctgaagccgcggctcccgaaaaagagcaggataccccccgcggcgagccacccgccgttccagaatctgagaacgtagcgacaaaggagcagaaaaaaaagccccgacgcgggagaaagccgaaagtatcaaaagctgagcagccccttgttatcgtcgaagacaaggagcccactgaacaggtggctgagatcattactgaagtgccgcccgacgagcccgtcagtgcgacaccagacgaacgcattatggagctggtacttgggaaactggcgactactacgaccgacaccagctctgtcccaaaacatggaatccgccgcaagttgattaagcagctcggtgaacacaaacgcgtctaccagtgcaacatctgttcaaagattttccagaacagtagcaacttgagtcgtcacgtgaggagccacggggacaaactgttcaagtgcgaagagtgcgccaaactcttcagtagaaaggagagtttgaaacaacacgtgtcatataaacatagcaggaacgaggtcgacggagaatatcgatacaggtgcggcacatgtgaaaagactttcagaatcgagtcagccctggaattccacaactgtcgaaccgctacctccccttcgacccggaggtcaactgccacaaggagcctgcccgtgcgaagtgcagcaagatgctcaacggcacgaacatcctgctggactacaagtgctggtacctggaaagagtgtggggagtag

SEQ ID NO: 12851 - DNA, 3426 bp, Artificial Sequence
  Description of Artificial Sequence: Synthetic coding sequence
atggccgaagacggctccgaagagatcatgttcatctggtgtgaggattgcagtcaataccacgattccgagtgcccagagttgggccctgtcgtcatggttaaggattcatttgtgttatctagagccagatcatcactccctcccaacctcgagataaggaggctggaagatggcgcagagggcgtcttcgctatcacccagctggtgaagaggacacagttcgggcccttcgaaagtcgcagagttgctaagtgggagaaagagtcggcttttccattgaaggtgttccaaaaagacgggcaccccgtctgcttcgacacttcaaacgaggacgactgcaattggatgatgctggttcgtccagcagcagaggccgaacatcagaacctgacagcatatcagcatggaagcgatgtctacttcactacatcccgggatattccacccggcaccgagctgcgcgtgtggtatgctgcgttttacgctaagaagatggacaagcccatgttgaagcaggcaggctctggtgtgcacgcagccggcacccctgaaaatagtgcgcccgtcgaatccgagccaagccagtgggcctgcaaggtgtgctccgccacattcctggaactccagctgttgaacgaacatctcctcggtcatctggagcaggccaaatccttacctcctggtagccagtccgaggccgccgctccggagaaggagcaagatacacccaggggagagccacccgcggtgcccgagtcagagaatgtcgcgacgaaggagcagaaaaaaaaaccgcggcgcggtcgaaagccgaaggtctccaaggctgagcaacctttggtgattgtcgaggataaggaacctaccgaacaggtagcagagatcattacagaggtaccaccggatgagcccgtgagcgccacccccgacgaacgcataatggagttggtgcttggcaaactggctaccacaactacagacactagtagcgtgcctaagtttacacaccatcagaacaacaccatcacacttaagcgaagtttgattctctcgtctcggcatggtataagaagaaaactgattaaacagttaggagagcataaacgggtttaccagtgtaatatctgttccaagatctttcagaacagcagcaaccttagtagacatgtaaggtcccacggggataagctctttaagtgcgaagagtgcgcaaaacttttttcccgaaaagagagcctgaagcagcacgtgtcctacaagcactcccggaacgaggtggatggtgagtacagatataggtgcggaacttgcgaaaaaaccttccgcatcgagtcagccctcgagtttcacaattgcagaaccgacgataagacgttccagtgcgagatgtgtttccgctttttctccactaacagcaatttgagcaaacataagaaaaagcatggggacaagaagtttgcctgcgaagtctgctctaaaatgttttacaggaaggacgtcatgctggaccatcagaggagacacctggaaggtgtgaggcgtgtcaaacgggaggatctagaagctggcggggaaaacttggtcagatataagaaagaacccagcggctgcccggtgtgcggcaaggtgtttagttgcaggtccaacatgaacaaacatctgcttactcacggtgataagaaatatacttgtgagatctgcggccgaaagttcttcagggtggatgttctgcgggaccacatacatgtgcactttaaggacatagcgctaatggacgatcatcagcgcgaggagttcatcggcaagattggcatatccagcgaggagaacgacgacaactccgacgagtcagcagattctgagccccacaaatacagttgtaagcgctgtcagttgacttttggccgcggcaaagagtatctcaagcacatcatggaagttcacaaggaaaagggctacggctgtagcatatgcaataggcgctttgcactcaaagccacataccacgcccacatggtcattcaccgggagaatctcccagaccctaatgttcagaagtatattcatccatgcgagatctgtggccgcatatttaattccatcggcaacttggagcggcacaaactgattcatactggcgtgaagagccatgcttgcgagcagtgcggcaaaagcttcgccagaaaagacatgctgaaggaacatatgagggtgcatgataatgtgcgagagtacttgtgtgctgaatgcggtaagggcatgaaaacaaaacacgcacttaggcaccacatgaagctgcacaagggtatcaaagaatacgagtgcaaggagtgccatcggagatttgcgcagaaggtgaatatgctaaagcactgcaaaagacacaccggaatcaaggacttcatgtgtgagctttgcggcaagaccttcagtgagcgcaataccatggaaactcataaacttattcatactgtaggtaaacaatggacctgctcagtgtgcgataaaaagtatgtgacagaatacatgctgcagaagcacgttcagcttactcatgacaaggtagaagcacagtcctgccagctctgcggaaccaaggtcagcacacgcgctagtatgtctcgccatatgaggagaaagcacccggaggtgttagctgtgaggatcgacgaccttgatcacctgcctgaaaccaccacaattgatgcctcgagcattggcatagtccagcccgagctgacactggaacaagaagacctagctgaaggcaaacacgggaaggccgccaagcgcagccacaaaagaaagcaaaagcccgaagaggaggcaggagcccccgttcccgaagatgccaccttttcggaatacagtgagaaggaaaccgaattcacaggtagcgttggggatgaaacaaattccgccgttcagagtatccagcaggtggtcgtcaccctcggtgaccctaatgtaactacaccctctagctctgtcggattaactaatattaccgtgaccccaattacgaccgctgccgccactcaattcacaaacctgcagccagtggctgtgggccacctgaccacccctgaacggcagctccagctggataactccatccttactgttacattcgataccgtgagtggtagcgctatgctccacaatcgccagaatgacgtgcagatacacccccagcctgaggcatccaaccctcagtccgtcgcccattttattaacctgaccacgctggtcaatagcatcacacccctgggatcccagctgtcggaccagcacccgctgacttggagagcagtgcctcaaacagatgtgctgccaccaagccagccacaggcacccccccagcaggccgctcagccccaggtgcaggcagagcaacaacagcagcagatgtacagctactag

SEQ ID NO: 12852 - DNA, 1668 bp, Artificial Sequence
  Description of Artificial Sequence: Synthetic coding sequence
atgccccgtcggcgtccccctgcgtcgggggctgcccagttcccagagaggattgccaccaggagtcccgatccgatcccactgtgtacctttcagcgacaggtatcggaaatggctgaagatggttccgaggaaatcatgttcatctggtgtgaggactgttctcagtaccatgattccgaatgtcccgagctcggacccgtggtgatggtgaaagattcatttgttctgagccgcgccagaagctcgctcccacccaacctggaaatccgccgcctagaggacggggccgagggggtatttgcaattactcaacttgtgaagcggacccagttcggcccttttgagagccgcagagtggccaagtgggagaaggagagcgcctttccattaaaggtctttcaaaaagacggccatccagtgtgtttcgacactagcaatgaggacgactgcaactggatgatgctagtccggccagctgcagaggccgaacatcagaacctgacagcatatcagcacggctccgatgtgtacttcactacctcgcgtgacatcccccctggaactgaattgagggtttggtacgccgctttctacgccaaaaaaatggataagcccatgctaaagcaggcaggctccggcgtgcacgcggccgggaccccggagaactccgcccccgtcgaatctgaaccaagccagtgggcctgcaaagtgtgcagcgcgactttcctggaactacaacttctgaacgagcatttgttgggtcacctggaacaagctaagagcctaccacccggatctcagtctgaggctgccgcccccgaaaaagagcaggatacaccgcggggtgagccacccgcagtccccgaatcggagaacgtcgcgacaaaggagcagaaaaagaagcccagaaggggtaggaaaccaaaagtgtctaaggcggaacagccattagtgattgtggaggacaaggagcctaccgagcaggtagccgaaattatcacagaggtgccaccggatgagcccgtatcagcaactccagatgagcgcattatggaactcgtcttgggcaagctagcgaccaccacgactgacacctcttcagtacctaagttcacacatcaccagaataatacaatcactctgaagagatccctcattctgtccagtaggcatgggatcaggcgaaagctgataaaacagctgggggagcacaagagggtctaccagtgcaacatatgtagcaaaatttttcagaatagctctaacctcagccgacatgtcagatctcacggcgacaagctcttcaagtgtgaggaatgcgccaagctgttctcgcgcaaggaaagcctgaaacagcacgtttcttacaaacattcacggaacgaggtcgacggagaatacagatataggtgtggtacgtgcgaaaagacgttcaggatcgaatctgcgctggagttccacaactgtcggacaggtctgatcgcccaccctggtgagggcggacccggtggatctcggttgagagatctgcctgctacttcaccatccactagaagaagtacagcaacccgctccctgccggtgaggtctgcggcccggtgcagcactgctagaacttcatgctggactacatctgcgggcacgtggaaggagtgtggggagtag

SEQ ID NO: 12853 - DNA, 3486 bp, Artificial Sequence
  Description of Artificial Sequence: Synthetic coding sequence
atggctgaggatggatcggaggagatcatgtttatttggtgcgaagattgtagccaataccatgactctgaatgtcccgagctcgggcccgtggtcatggttaaggactccttcgtcctctccagggctcggtccagcctgccaccgaacctggagattcgccgtctagaggacggtgccgagggggtctttgctattacacagcttgtcaaacggacccagttcggcccttttgagtctcgtagagtggccaagtgggagaaagaatcagcctttcccctgaaggtgttccagaaagacggccacccagtttgttttgataccagtaatgaagacgattgtaactggatgatgctcgtaagacccgccgctgaagcggagcaccagaacctgaccgcctaccagcatgggtcagacgtttactttactacctctcgagacattcctcccgggacagagttgcgcgtttggtacgccgccttttacgccaagaaaatggataagccaatgctgaaacaagctggttctggagttcatgccgccgggacacccgaaaactctgctcctgtcgagagcgagcctagtcagtgggcttgcaaagtatgctcggctacttttttggaactgcagttactgaacgagcacctgctggggcatcttgaacaagccaaatctctacctcctgggtcccagtctgaagccgccgcgccagagaaggagcaggatacccctaggggcgaacctcccgctgtgcccgagtccgagaatgtcgccaccaaggaacagaagaaaaagcctaggaggggaaggaaacctaaggtctcgaaagctgagcagcccctggtcatagtggaggataaagaacctaccgagcaggtggccgagataatcacggaggtcccccctgacgagcctgtgagcgccactcccgatgagagaattatggaactggtgttaggcaaattggcaaccactacaactgacaccagttcggtgcccaagtttactcaccaccagaacaatacaattacccttaagagatcactgatcctgagctctcgtcacggtataagacgcaagctgatcaagcaactgggtgagcacaagcgggtgtatcagtgtaacatctgctcgaaaattttccagaacagcagcaacctttctaggcacgtccgctcacatggtgataagcttttcaagtgcgaagagtgcgccaaactcttcagccggaaagaatcacttaaacagcatgtgtcctacaaacacagtcgtaatgaagttgacggcgagtatcgatatcggtgcgggacctgtgaaaaaacctttaggattgagagtgcccttgagttccataattgtagaaccggtctaattgcccaccctggggaaggcggccccggaggttcccgcctccgggatttgcccgacgacaaaacgttccaatgcgagatgtgcttcagattcttctccacaaactctaacctatctaaacacaagaagaaacatggtgacaagaaattcgcctgtgaggtgtgttctaaaatgttttacaggaaggacgttatgctggatcaccagcgtagacacttagagggtgtccgcagagtgaaacgcgaagacctggaagccggcggcgagaacctcgtgaggtacaagaaagagccctctggatgcccggtgtgcggcaaggtgtttagttgtaggtccaatatgaacaagcaccttctgacccacggagataaaaagtatacctgtgaaatttgcggtcggaagttcttccgggtcgatgtactgcgggatcatatccatgtgcactttaaggacattgcactgatggacgaccatcagcgagaggagttcatcggaaaaattggcatctctagcgaagagaatgacgacaacagcgacgagtccgccgatagtgagccccacaaatacagctgtaaacgatgtcagttgacgttcggtcgggggaaggaatatctaaaacatataatggaggtgcataaagaaaaggggtacggctgttcgatttgtaacaggcgctttgcactgaaagcaacctaccatgcccatatggtaatccacagggaaaaccttcccgaccctaacgtccaaaagtacatccacccttgtgaaatctgtgggcggatcttcaattccattggaaacttggagcggcacaagttaatccacacgggcgttaaatcccacgcctgtgagcagtgcgggaagtcctttgctcgcaaggacatgctgaaggaacatatgcgggtccatgacaatgtgagagaatacttatgtgctgagtgtgggaaaggaatgaagacaaaacatgcccttcgacatcatatgaaactgcataaaggaattaaagaatatgagtgtaaggagtgccaccggcgcttcgcccaaaaagtgaacatgcttaagcactgtaagcgccatacaggtatcaaggatttcatgtgcgagctgtgcgggaagacattcagcgaacggaatactatggaaactcataaactgatccatactgtgggaaaacagtggacctgcagcgtgtgcgacaagaaatacgtgactgaatatatgctgcagaaacacgtgcagcttacacacgataaagttgaggcacagtcctgtcagttgtgcggtacaaaggtgagcacaagagctagcatgagcagacacatgcgacggaaacaccccgaggtcctggctgttaggatagacgaccttgatcatttgccagagacgaccacgattgatgccagcagcatcgggatcgtacagcccgagctaaccctggaacaagaagatctggctgaggggaaacatggcaaggccgctaagaggtcacacaagcgcaaacagaagccggaggaggaggccggcgcgccagtccccgaagacgcaaccttcagtgaatactctgaaaaagagaccgagttcaccggcagtgtcggcgacgagacaaacagtgccgtccagtctattcaacaggtggtggtgactctgggtgatccaaacgttaccactccgagctcgtctgttggcctgaccaatatcactgtcaccccgattacgactgccgcagccactcaattcaccaatttgcagcctgttgccgtgggacacctcaccacccccgagcggcagctgcagctcgataactccattctcactgtcacctttgatacagtatccggcagtgccatgcttcataacaggcagaatgacgtacaaatccacccacagcccgaggcatctaatcctcagagcgtggctcatttcatcaacctgacaacactagttaatagcataactcctctgggctcacagctgtctgaccaacaccctctcacctggcgggcagtgccccagacagacgttctgcctccttcccaaccccaggcccccccacaacaggccgctcaacctcaagtgcaggccgaacagcaacagcaacagatgtattcttactag

SEQ ID NO: 12854 - DNA, 1788 bp, Artificial Sequence
  Description of Artificial Sequence: Synthetic coding sequence
atgctaaagccgggagacccaggaggatctgctttccttaaggtggaccctgcctacctgcaacattggcagcaactgttccctcacgggggagccgggcctctcaaagggtccggtgccgctggcctgttatcagccccccagcccctccagccacctcctccacctccacctcctgaaagggctgaacccccccctgacagcctcagaccgcgccctgctagcctctcatctgccagttctacacctgcctccagctccacctccgcctcctccgcatctagctgtgcagccgcggctgccgccgctgcccttgccggtctgtccgctcttccagtgagtcagctgcctgtctttgctccactggcagccgccgcagtcgccgccgagcccttgccccccaaggaactgtgcctgggcgccacctctggacccgggcccgttaagtgcggcggtggcgggggtggcggcggcgagggaagaggagcccccaggtttaggtgctcagcggaggaattggactattatctgtacgggcagcagcgcatggaaattatcccactgaatcaacacacctccgatcctaacaatcgctgcgatatgtgcgccgacaatcgcaacggcgaatgccctatgcacggccctctgcacagtctgaggaggttagtcgggaccagtagtgctgctgctgccgctccccctcccgaactccctgaatggcttcgggatctgccccgagaagtgtgcttgtgcactagcactgttcccggtctagcatacggtatctgcgcagcccagcgaattcagcaaggtacatggatcggaccttttcagggagtcctgttgccacccgagaaggtgcaggccggcgctgttcggaatacgcagcatctttgggaaatctacgaccaggatggcaccctccaacactttatcgacggaggcgagccctccaagagctcgtggatgaggtacattaggtgcgcccggcactgcggcgaacaaaacctgacagttgtccagtacaggtctaacattttctatcgagcttgtatagatattccccgaggcaccgaattactagtatggtacaacgatagctacactagcttcttcggaatcccacttcagtgcatcgcgcaggacgagaatctaaacgttcccagcacagtgatggaggccatgtgtaggcaggacgccttgcagccctttaataaaagtagcaagctcgctccgactactcagcagagatccgtagtgtttccacagactccatgttccagaaacttctctcttctcgataagtccggccctatagaatcgggattcaaccagattaacgttaaaaaccagagagtgttggcatctcccacttcaacttcacaactgcatagcgaattctctgactggcatttgtggaaatgcggccagtgtttcaagactttcacccaacggatcctcctccagatgcacgtgtgtacacagaaccccgatagaccttaccaatgtggccattgctcgcagtctttttcacagccatctgaactaaggaaccatgtcgtcacacattcctctgaccgtccctttaagtgtggctactgtggacgggcctttgccggcgcgacaactcttaataaccacatccgcactcataccggtgaaaaaccctttaagtgcgagcggtgcgagcgttctttcacacaagctactcagctgtccagacaccaaaggatgccaaatgaatgtaagccaattaccgaaagcccggagtcgattgaggtggactag

SEQ ID NO: 12855 - DNA, 516 bp, Artificial Sequence
  Description of Artificial Sequence: Synthetic coding sequence
atgtgccaaaatttcttcatcgactcctgcgccgcacacgggcctccaaccttcgtgaaagactcagcagtggataaagggcacccaaatagatccgctctctcgttaccaccaggactccgtatcggccctagcgggataccacaggcaggcctgggcgtgtggaatgaggcttccgatctgccactcgggttgcattttggcccatatgaagggaggataacagaggatgaggaggctgctaactctggttacagttggctaatcaccaaaggcaggaattgttacgagtacgtggacgggaaagataagtcctctgctaattggatgcgcactaaggccagggatcccagcatgtccctgatgctgtcagggctcttcaaatcaaagatatcacaaagtacctgtggcactcagagcctgctgtctgagcttccacgtaccatctgcaagaaaacctcgccaacccgcgaatctctgcctcgtggatcagaatcaggcgccgcgattttttag

SEQ ID NO: 12856 - DNA, 516 bp, Artificial Sequence
  Description of Artificial Sequence: Synthetic coding sequence
atgtgccaaaatttctttattgactcttgtgcggcccacggtcctcctacatttgtaaaagactctgccgtagacaagggccaccctaatcggtccgctctttccctcccacccgggctgcggataggtccctcagggattccgcaggctggcttaggagtatggaacgaagcatctgacctgcctctggggctgcattttgggccatacgagggtcgcataaccgaagatgaggaggccgctaacagcggctattcttggctcatcactaaggggagaaactgctacgagtatgtcgatgggaaagataaatcctccgctaattggatgcgcactaaggcacgcgatcctagcatgtcattgatgcttagtgggctctttaagtcaaagattagccagagtacctgcggcacccaatccttactgtctgagctgcctcggacgatctgtaagaagacgtctccaacacgagagagcctaccccgtgggagcgagtctggtgccgctattttttag

SEQ ID NO: 12857 - DNA, 417 bp, Artificial Sequence
  Description of Artificial Sequence: Synthetic coding sequence
atgagtcctgaaaggtcgcaggaggaaagtcccgaaggagacaccgaaagaactgagaggaaacccatggtgaaggacgcctttaaagacatctccatatacttcactaaggaggagtgggctgaaatgggtgattgggaaaaaacgcgttacagaaatgtgaaaatgaactacaacgctttaatcacagtggggctgagggccaccagacccgcctttatgtgccatcgaagacaggctattaagctccaagtggatgacactgaggactcagatgaggagtggaccccacggcagcaggtcaagcctccgtggatggcctttcgaggtgaacagtctaagcaccagaaaatcgtgcggtgcgttcgcacaagctctcttaccgccgtgcttctgatgggaccactacacctatag

SEQ ID NO: 12858 - DNA, 1479 bp, Artificial Sequence
  Description of Artificial Sequence: Synthetic coding sequence
atgagcccggaaagatcccaggaggagagcccggagggggatacagagcgtactgagagaaagcctatggtcaaggacgcctttaaagatatttctatttatttcactaaggaagagtgggcagaaatgggtgattgggagaaaaccaggtatcgtaatgtaaaaatgaactataacgcccttatcactgtaggcctgcgcgcgactaggcctgcttttatgtgccacagaagacaagctatcaagcttcaggttgacgacactgaggatagtgacgaagagtggacacctcgccaacaggtcaagcccccatggatggcattcagaggcgaacagagcaaacaccagaagggaatgcccaaggcgagcttcaataatgaatctagcctccgcgaacttagcggcactccgaatctcctgaacactagcgactccgagcaggcccagaagccagtcagccccccaggcgaagcttccaccagcggacagcattcccggctaaagctcgaactgcggaggaaagagacagaaggcaaaatgtactctctgcgtgagagaaaggggcacgcttataaggagatatctgaacctcaagacgacgattacctctactgtgagatgtgtcagaactttttcattgactcttgtgccgctcacgggccccccacatttgttaaggattcagctgtggataaaggccatccaaatcgatcagccctgagccttccacctggcctgcgcatcggccccagcggaatcccacaagctgggctcggagtgtggaacgaggcctctgatcttcccttgggactgcacttcggcccctacgaaggaagaataactgaggacgaggaggcagctaatagcggctactcgtggcttatcacaaaaggaaggaactgctacgagtacgtggacgggaaggacaaaagttccgctaactggatgcggtatgtgaactgtgcgcgcgacgatgaagagcagaacttagtcgccttccaataccacaggcagatcttctacagaacgtgcagagtcatcagacctgggtgcgaactgttggtatggagcggtgatgaatatggccaggagctgggcatcagaagcagtattgagcctgccgaatccttgggacaggcggtcaattgctggtcgggtatggggatgtccatggctagaaattgggcttctagcggcgcagcttccggccgcaaaagttcgtggcagggagagaaccagtcgcaaaggtccatccacgtaccccacgccgtatggcctttccaggtgaagaatttctccgtgaacatgtggaacgcgattacaccattgagaacctcccaggaccatctgcaggaaaatttcagtaaccagcggatccccgcacagggcatccgcataaggtctggaaacatcctgatccacgccgccgtaatgacgaaaccaaaagtgaaacgcagcaagaaaggccccaacagctag

SEQ ID NO: 12859 - DNA, 2070 bp, Artificial Sequence
  Description of Artificial Sequence: Synthetic coding sequence
atggaggacaccggtatccaacgaggtatctgggatggggacgccaaggcggtgcagcagtgtctgaccgatattttcaccagcgtgtacacgacctgtgacatccccgagaacgctatttttgggccttgcgtgctctcacacacgtcactgtatgacagcattgcctttatcgccctcaaatcaacagataaacgcactgttccttacatcttcagagtcgatacaagtgctgcaaatggttcctctgaggggctgatgtggttaagacttgttcagagtgcccgagataaagaagagcagaacctggaggcatatatcaaaaatggacagctgttttaccggtcattgcggcggatcgccaaagacgaggagctgctggtctggtacgggaaggaactcaccgagctcctgctcctttgtccctcgcggtcacacaataagatgaatggttcttctccttatacgtgcttggagtgctcgcagcgatttcagtttgaatttccatacgtggctcacctgcggtttcggtgtccaaaacgcctgcactcagcagacataagtccgcaggacgagcagggtggtggggtaggaaccaaagatcacggcggagggggcgggggaggtaaagatcaacagcagcaacagcaggaggctcccctggggccaggtcctaaattctgtaaggcaggacctctacaccattatccctctccatccccagagagcagtaaccctagcgcagctgccggtggatcctcagcaaaaccaagtactgatttccacaaccttgcccgggagcttgagaattctagaggaggctcttcatgtagcccagctcagagcctgagttccggctctggctctggcggcgggggcggacaccaggaagcggagctgtcccctgatggtatagctaccggggggggtaagggaaagcgaaagtttcctgaggaggcggcagagggaggcgggggagctggattggtaggcggccggggacgatttgtagagagaccactgcccgcttctaaagaggacctcgtgtgtacgcctcagcagtaccgggcctctggaagttacttcgggctggaggaaaacggacgactgttcgctccgccctcacctgaaacaggagaagctaagaggtcagccttcgtggaagtgaaaaaagcagctcgtgccgccagcctacaggaggagggtactgctgacggggcaggcgtggcctctgaagatcaagacgcgggggggggaggggggagcagtaccccggccgccgctagtcctgtgggtgccgagaagctgcttgcacccaggcctgggggacccctgccctctagactcgaagggggcagtccagccagagggagcgcctttacctccgttccccagttgggaagcgcagggtcaacctcaggaggcggcggcacaggggcaggcgctgctggtggtgcaggtggaggacagggtgcagcatcagacgagaggaagagcgctttctctcagcccgcgcgaagcttcagccagctgtcccccctggtcctgggccagaaacttggagcccttgagccgtgccatcccgcagacggcgtgggcccgacacgcttgtaccctgctgccgcggatcccctcgctgtgaagttgcagggagccgctgatctcaatggcgggtgtggttccctgcccagcggaggcgggggactcccaaagcagagccccttcctgtacgctacggctttctggcctaagtcttccgccgctgcagccgccgccgccgccgcagctgcggcaggtcccctccagctgcagttgccctccgccttgaccctgctacctccgagcttcacgagcctttgtctgccagctcaaaactggtgtgccaagtgtaacgcttctttcaggatgaccagtgacctcgtttaccatatgcgaagccatcacaagaaagagtacgctatggagcccctggttaaacgacgacgagaagaaaagctgaaatgtccaatttgcaatgagtcgtttcgtgaacgacaccatctgtcacgacacatgacaagccacaactag

SEQ ID NO: 12860 - DNA, 2070 bp, Artificial Sequence
  Description of Artificial Sequence: Synthetic coding sequence
atggaagataccggaatccagaggggaatctgggatggtgacgcaaaagccgtgcagcagtgccttaccgacatattcacctcagtctacaccacctgtgatattcctgagaacgccatcttcggtccctgtgtgctgagtcatacatccctttatgactctatcgcctttattgccctcaagagcactgataagcgaaccgtgccgtatatcttccgcgtggatacatcagctgccaatggaagcagcgaggggctcatgtggttgagactcgttcaaagcgcacgtgacaaagaggagcagaacttagaggcctacataaagaacggacagctgttctatcgaagtcttaggagaatcgcaaaggatgaggaactcctggtgtggtacgggaaagagttgaccgagctccttttgttgtgcccgtcgaggtctcataataagatgaatggttcgtctccatacacttgtctggagtgcagccaacgcttccaattcgagttcccgtatgtggcacatctgagatttcgatgccctaaacggctacacagtgcagatattagtccgcaggacgaacagggcggaggagtgggaaccaaagatcatggaggggggggaggcggtggaaaagatcagcagcagcaacagcaagaggcgcccctggggcccgggcccaaattctgcaaagccggacccctgcatcactacccatctccaagtccagagagctccaatcccagtgcggccgctggaggttcatctgccaaaccttccactgactttcataacttagcaagagaattagaaaattcgcgcggggggagttcctgctcaccagctcagagcctgtccagtggatcgggtagcgggggtggtgggggccatcaggaagcagagctgtccccagatggcattgctaccggcggggggaaaggtaaacgaaagttccccgaggaggctgcagagggtggtgggggggcaggtctggtgggcgggcgtggccggtttgtagaacgtcccctccctgccagcaaggaagacctggtgtgtactccccagcaatatcgtgctagcggaagttacttcgggctggaggagaacggtcgcctgtttgcccccccatcccccgagaccggagaggctaaacgatccgcctttgtggaagtgaagaaggccgcacgcgccgcctccctgcaggaggagggcacagctgacggggcaggagtcgccagtgaggaccaggatgccggcggaggcgggggctcctctacacctgcggctgcctctccagtcggagcggagaagctgctagcgccccggcccggagggcctcttccgtctaggttggagggagggtccccagcaaggggctctgcttttacatctgtgccccagctgggttccgcaggtagcaccagcggaggcggagggacaggagcaggcgctgctggaggtgctggcggtggccagggcgcagccagcgatgaacgcaagagtgcgttttctcaaccagctcggtcattctcccagttgtctcctcttgttctgggtcagaaactaggtgccctcgagccttgccatcccgccgacggcgttgggcccactcgactttatccagccgccgctgatcctctggcggtgaagcttcagggagccgccgatcttaacggcggatgtgggtcactccctagcggtggaggcggcctcccgaagcagtctcctttcctctacgcaactgctttttggccgaaaagctcagctgcagccgctgccgcagcggccgctgctgcagccggtccactgcaactccagttgccttctgcacttaccctgcttcctccatcattcacatctctctgcctgccggctcaaaattggtgcgccaagtgcaatgcaagctttagaatgacatccgacttggtttatcacatgcggagtcatcacaagaaggagtatgctatggagccgctggtgaagcgtagacgtgaagaaaaactgaagtgtcccatttgtaacgagagtttcagggaacgacatcatttgtcccgccacatgacaagccataattag

SEQ ID NO: 12861 - DNA, 2070 bp, Artificial Sequence
  Description of Artificial Sequence: Synthetic coding sequence
atggaagacaccggtattcagcgtggcatttgggatggagacgccaaagccgtacaacagtgcctgactgacatttttacgagtgtgtatacaacttgcgacatccctgagaacgcaatcttcggaccgtgcgttctgtcacatacctcactttatgacagcatagcatttatagccctgaaatccacagataaacggacagtaccatatatctttagagtcgacacgagcgccgccaacgggagcagcgaaggactgatgtggttacgcttggtgcaaagcgcaagggacaaggaagagcaaaacctggaagcctatatcaagaatggacagttgttctaccgatccctgaggaggatcgcaaaggatgaggaactcctggtgtggtacggaaaggagctgaccgagctgttacttctctgcccaagtcgcagtcataacaagatgaacggtagttcgccttacacctgcctggagtgttcccagaggtttcaattcgaatttccatacgtggctcacttgagatttcggtgtcccaaacgcttgcatagcgccgatatctccccacaagacgagcaggggggcggcgtgggtaccaaggaccatggaggaggaggaggtggaggcaaagatcaacaacaacagcagcaggaggcccctctcggaccaggacccaaattttgtaaagccgggcccctccatcactatccatctccaagcccagaaagctcaaacccctctgcagctgccgggggcagctcggctaaaccaagtaccgatttccataatctggctcgagaattagagaacagtcgcggcggcagcagctgttctcctgctcagagcctctcttcaggatcgggctcaggcggaggtggaggtcatcaggaggctgaattatcacctgacgggattgccaccgggggtggaaaagggaaaagaaagtttcctgaggaagctgccgaaggcggcggcggtgccggattagtgggcggccgtggaagatttgtggagcggccactgcccgcctctaaggaagacctggtctgcaccccgcagcagtatagagcttctggcagctacttcgggctggaagagaacggacggctattcgcacctcccagcccagagaccggagaggccaaacgcagtgcgtttgtcgaggtgaaaaaggctgcgagagctgcttctttgcaggaggagggtaccgccgatggcgccggagtggcaagcgaagaccaggatgctgggggcggtggggggtccagcactcccgcagccgcgagtccagtcggagccgaaaaactgctggctccacggccaggaggtccactgccttcacgacttgagggaggcagtccagccagaggctctgcctttacctccgtgccccagctcgggagcgccgggtcaacatcgggtgggggcgggaccggcgccggagcagccggcggggcaggcgggggacagggggccgcatccgatgaacggaagagtgcgttcagccagccagccagaagctttagccaactgtcccccttagtgctgggccaaaagctcggtgctctcgagccatgtcatcctgcagacggcgtcggcccaactcgactatatcctgccgccgctgatccactggccgtcaagttgcaaggggcggctgatctcaacgggggatgcgggtccctgcctagtggtggaggcggcttacctaaacagtcccccttcctgtacgccacggcattttggcccaagtcatccgctgcagccgccgccgcagcagcagctgcagctgcaggcccccttcagctccagctcccttccgccctcactctcctaccacccagctttacttcactttgcctgccagcgcagaactggtgtgccaaatgtaatgcttcctttcgtatgactagcgatctcgtctaccatatgcgctctcatcacaaaaaggaatatgccatggagcccctggtgaaaagacgccgcgaggaaaaactcaaatgtccgatttgcaatgagtccttcagggagagacatcacctgtcgcggcacatgacaagccacaattag

SEQ ID NO: 12862 - DNA, 1287 bp, Artificial Sequence
  Description of Artificial Sequence: Synthetic coding sequence
atggaggacaccgggatccaaagagggatctgggacggcgatgccaaagccgttcagcagtgtctgaccgacattttcaccagcgtgtacaccacatgcgacatacccgaaaacgccatttttggtccatgcgtgctctctcacaccagtctgtatgacagtatcgctttcatagctctgaagtccacagataagcgaacagtcccgtacatctttcgggtggacactagcgccgccaacgggtccagtgagggactgatgtggctgcggctggtgcaatctgcgcgcgacaaagaggaacaaaacctggaggcctatatcaagaatgggcaattattctatcgatcactgcgtaggatcgccaaagacgaagagttgctcgtgtggtacgggaaggaactaaccgagcttctcctcctgtgcccaagccggtctcacaataagatgaacgggagttcaccgtacacgtgcctggagtgctcacagcgcttccagttcgaatttccctatgttgctcatctacgattcagatgtcctaaaagactgcatagtgcagacatatctccccaagacgaacaagggggcggggtcggaaccaaggatcacggaggaggcggcggaggcggcaaagatcagcagcagcagcaacaggaggctccacttggtcctgggcccaaattttgtaaagctggccctctacatcactatccttcccctagtccagagtcctccaatcctagtgccgcagccggcggaagtagtgctaagccctcaacagatttccataatttggctcgtgaactggaaaacagccgcggaggaagtagctgcagtcctgctcagtcactgtcctccggatctggaagcggtggtggcggtgggcaccaggaggccgaactgagtcctgatggaatcgctactggcggagggaaaggcaagcgtaaattcccggaagaggcggctgaaggaggaggcggagcagggctggttggcggtagagggaggtttgtggagcggcccctccccgcttcaaaggaagatcttgtctgtacaccccagcagtacagagcgagtggcagctattttggcctcgaggagaatggaagacttttcgctccaccatccccggagaccggcgaggcaaaacgctccgcctttgtagaggttaagaaggctgcgagagcggccagccttcaggaggaggggaccgccgatggggccggcgtggccagcgaggaccaggacgccggcggaggtgggggcagttcaacaccagcagctgcctag

SEQ ID NO: 12863 - DNA, 1125 bp, Artificial Sequence
  Description of Artificial Sequence: Synthetic coding sequence
atggccgcccctccacgacccgccccatccccgccagcccctcgaagactcgatacatccgatgtattacagcagatcatggcaataactgaccagtccttagacgaagcccaagccaggaaacacgccctgaattgccaccgcatgaagcccgcgctgttcagcgtcctgtgcgaaatcaaggaaaagactgtggtgagtatccgtggcatccaggacgaggatccgccagacgcccagctgctgaggctggacaatatgttactagccgagggtgtgtgtcggccggaaaagagggggcggggaggtgccgtggctcgagccgggaccgcgactcctggcgggtgtccaaacgacaattccattgagcatagcgactacagagcaaagttatcgcagatcaggcaaatatatcacagtgagctcgagaagtacgagcaggcatgccgtgagttcaccacacacgtaacgaaccttctccaggaacagtcgcgtatgcgcccagtgagcccgaaggaaatagaaagaatggtgggggccatccacggcaaattctccgcgatccagatgcagctgaagcaatccacttgcgaggccgtaatgaccctcaggagcagacttctggatgctaggcggaaacggcgtaatttcagcaaacaggctacggaagtgctgaatgagtacttctactctcatctgaacaatccataccccagcgaggaggccaaggaagagctcgcaagaaaaggcgggctgactatctcgcaagtttcgaattggttcggcaacaagcgaatacgttacaagaagaatatgggaaaatttcaggaagaggccactatttacaccggtaagacagccgtcgacaccaccgaagtcggcgtgcctggaaatcatgctagttgcctgagcaccccaagttcagggtcaagcggacccttccctctgccatccgctggtgatgccttcttaaccctgaggaccctggcctcccttcagccacctcctggtggtgggtgcctccagtcacaggcacagggatcgtggcagggtgccacaccacaacccgccactgcatccccagcgggtgatcctggctctatcaattcctctactagtaattag

SEQ ID NO: 12864 - DNA, 945 bp, Artificial Sequence
  Description of Artificial Sequence: Synthetic coding sequence
atgctcgttagcggtcgtcggaggctgctgacagtcctactccaggcacagaaatggcccttccagccaagcagggacatgcggctggttcagttcagagcaccccacctggtggggcctcatcttgggttggagactgggaatggtgggggggtgatcaacctgaatgcgtttgacccaaccctgcctaagacaatgacacagttcttagagcagggagaagctacgctctcagttgcgagacgtgcactggctgctcagctccccgtactgccacgtagtgaagtgacttttctcgcccctgtgactagacccgataaagtagtttgcgttggcatgaactacgtggaccactgtaaagaacagaatgttccggtccccaaagaacctatcattttctccaagtttgcctcaagcatcgttggaccgtacgacgaggtcgttcttcctcctcagtcccaggaagttgactgggaagtcgaacttgcagtcgtcatcggcaaaaaaggcaagcacatcaaagctacggacgctatggcacacgtcgccggtttcacggtggcgcatgacgtgagtgctcgggattggcaaatgcggagaaacgggaaacagtggttgttagggaaaacctttgatacattctgtcccttaggccctgccctggttactaaagattctgtcgctgatcctcataatctcaagatctgttgccgcgtgaacggtgaggtggtccaaagtggaaataccaatcagatggtattcaaaacagaagatcttatcgcatgggtgtctcaatttgtgacattttatcccggagacgtgattctgacaggcaccccccccggggtaggagtgttcagaaagccacccgttttcttgaagaaaggtgatgaagtgcagtgcgagattgaggaactgggagttatcatcaacaaagtggtgtag

SEQ ID NO: 12865 - DNA, 1059 bp, Artificial Sequence
  Description of Artificial Sequence: Synthetic coding sequence
atgagcgtacaaaattccggttggccacaccaagaggacagccccaagccccaggaccccggccccccagcgaacagcgacagtgattccggacaccttccaggcgaagatccggaggacactcacgcccaaggcccagccgtgctaagtttgggatccttatgtttagataccaatcaggccccgaattggaccggactccagactctgcttcagcagctcccacctcaagacattgatgagagatattgtctcgctctgggagaggaagaacgggccgaattacagctcttttgcgccaggagaaaacaggaggctctggggcagggcgtcgccaggctcgtgttgccaaagctggaaggccacacgtgcgagaagtgtcgcgaactcctcaaaccgggcgaatacggagtgtttgccgctcgagctggtgagcagcgttgttggcatcagccctgtttcgcttgccaggcgtgcggtcaggccttgatcaacctcatctatttctaccatgatgggcagctctactgtggacgccaccacgcagagctgctgagaccacgctgccctgcctgtgaccagctcatcttctcctggcgttgcaccgaagcggagggacaacgctggcacgaaaaccacttttgctgtcaggactgtgcaggccccctggggggtggacgctatgccctgcccggaggcagcccctgctgcccaagttgctttgaaaatcggtactctgacgcagggtcctcatgggccggggctttggaagggcaggcgtttctgggggcgccacctccccacccacccgacccctcactgggagcacgttcttcacatcgggcatctttggcaggcgcatttcaggggcctccagagcccacacctagacggggaaggggctgcggggcacgcttgcctccacggcggggaagaaggacgccctccgggggggggggcggaccttggagagggttatcagccgcagcggccgcccgaacggctcagggactgggtggagcgggtggctgggctagtccgccactggcagccgtgtag

SEQ ID NO: 12866 - DNA, 939 bp, Artificial Sequence
  Description of Artificial Sequence: Synthetic coding sequence
atgtcgccccagggccctgctgtgttgtccctggggtcgttatgccttgacactaatcaggcccctaattggacaggtttacagacactcctccaacagttgcccccccaggacatcgatgagaggtattgtctcgccctaggcgaggaggaaagggccgagcttcagttgttctgtgcccgcagaaaacaagaagccctagggcagggcgtagcacggctggtattaccaaaattagagggccacacatgtgaaaaatgtagggagctcctgaagcctggcgaatacggggtctttgccgctcgggccggggaacaaaggtgttggcaccagccttgcttcgcttgccaggcctgcggtcaagccctgatcaatctaatctacttttatcatgacgggcagctttattgcgggcgccatcacgccgagttgctgaggccgagatgccctgcctgcgaccagctcatcttttcctggagatgcactgaggctgagggtcaaagatggcacgagaaccatttctgttgccaggactgcgcgggccctcttggggggggccggtatgcactgcctggcggctccccctgttgccctagttgctttgagaacagatatagcgatgctggcagctcatgggccggcgccctggaaggccaggcttttctgggagccccaccaccccaccctcctgatccatctctaggtgctaggtcttcacatcgtgctagtctggctggagccttccagggtccgcccgagccgaccccccggcgggggagaggatgtggcgccagactccccccccgtcgggggaggaggacaccatctggcggcggaggcgggccatggcggggcctgtcagcagccgccgcagctagaactgcacaaggtctgggaggagccggcgggtgggccagtccgccactcgctgccgtgtag

SEQ ID NO: 12867 - DNA, 1035 bp, Artificial Sequence
  Description of Artificial Sequence: Synthetic coding sequence
atgagcccacagggtcccgcggttctttctcttgggtccctatgtcttgacaccaaccaagccccaaactggaccggactgcagacactcctgcagcagctccctccacaggacatcgatgagcgctattgtctggccctgggagaagaggaaagagccgagcttcagctgttttgcgctcggcggaagcaagaggcgctcggacagggagttgcacggctggtactgcctaagttggagggccatacctgtgaaaagtgtcgcgagctactcaagccgggagagtatggggttttcgccgctcgcgctggagagcagaggtgctggcaccagccttgcttcgcgtgccaggcgtgtggacaggccctgatcaaccttatttatttctaccacgatgggcagttatactgcggcagacaccatgccgaattattgcggccaagatgtccggcgtgcgaccagctgatattctcctggcgatgtacggaagccgagggccagcggtggcatgagaaccacttttgctgccaagattgtgcaggccctctcggcggtggcagatacgccttgcccggcggatccccctgttgtcccagctgcttcgagaatagatattcagacgcgggctcctcttgggccggagccctggagggccaggcctttttgggtgagacgggactggacaggaccgaaggccgggatcagacctcagtgaacagcgcaacactgtcacgtacgctgctggcagcagccggagggtcaagcttacaaacgcagcgcgggttgcccggtagtagcccccaacaggagaaccggccgggtgacaaggccgaggcccctaaaggacaggagcagtgcaggctcgagactatcagggatccgaaagacactcctttctctacgtgctcttcttctagtgactcggaaccagaggggttcttcctcggggaacggctgcctcagtcgtggaaaaccccaggaagcctccaggctgaagactcaaatgcgagcaagactcactgtacaatgtgctag

SEQ ID NO: 12868 - DNA, 1155 bp, Artificial Sequence
  Description of Artificial Sequence: Synthetic coding sequence
atgtccgtgcagaactcaggctggccgcatcaggaagattcccctaagcctcaggatccaggaccaccagctaatagtgattccgactcaggtcacctgcccggcgaggaccctgaggatacacacgcacagggtccagctgtgctgagcctaggctccctttgtctggacaccaatcaggcccctaactggacaggccttcagaccttgcttcaacagttgccgccgcaggacattgatgaacgctattgccttgcactaggcgaggaggagagagccgaattacagcttttctgtgcccgacggaaacaagaggcattaggtcagggtgtagctcggctggtgttaccgaaactcgaagggcacacctgcgagaagtgccgtgagctgctgaaaccaggagagtacggggtcttcgctgctcgtgcaggtgagcagagatgctggcatcaaccatgcttcgcgtgccaggcgtgcgggcaggcgctgattaatctcatctatttttatcatgacggacagctttactgtggacgccatcatgctgagttgttgagaccacgctgtcctgcatgcgaccagttgatttttagttggcgttgcacagaagctgaaggccagagatggcacgagaatcacttttgctgtcaggactgtgcggggcctctgggaggcggcaggtatgctttacccggcggtagcccctgctgcccaagttgtttcgaaaatagatactcggatgcggggtcttcatgggcaggggccttagagggacaggcattcctgggagagacaggcctcgataggacagaggggagagatcagactagcgtgaactctgcaactctgtcacgtacgctcctggcggccgccggaggaagctctctgcaaacacagcgcggcctccccggtagctcccctcagcaagagaacaggccaggcgacaaggcagaggcacccaaagggcaagaacagtgcagattggagaccataagggaccctaaggacacaccattttctacatgcagtagctcctctgattcagagcccgagggtttcttccttggcgagcggcttccacagtcctggaagactcctggaagcctccaggcagaagacagtaatgccagtaaaacacactgcaccatgtgctag

SEQ ID NO: 12869 - DNA, 213 bp, Artificial Sequence
  Description of Artificial Sequence: Synthetic coding sequence
atgtccgtacagaactcgggatggccacaccaagaagactccccaaaacctcaggatcccggtccacccgctaatagtgattccgacagcggccaccttccaggcgaggatcctgaagatacccacgctcaggaattcctttctctgcacctgctccggacatgggggtttgatttcaagctgattcatatgtctattcactacctgtcctag

SEQ ID NO: 12870 - DNA, 474 bp, Artificial Sequence
  Description of Artificial Sequence: Synthetic coding sequence
atgaaaaacccagataaggctgttccaatccccgagaaaatgtcggaatgggctcctcgaccaccccctgagtttgtgagagatgtcatgggcagctcagccggcgccgggagtggcgaattccacgtgtatcgacatctcaggagaagggagtatcagcgacaggactatatggacgctatggccgagaaacaaaagctggacgcggagtttcagaagagactggagaagaacaaaatagcagctgaagagcagactgcgaagcgtcggaaaaaacgtacacgctctgcccaaggcgccggcgtccagcaactgtgcgggggtatctggaaccgaggaggcggagggtccgcccagtttcaccacggcgcgatgacaatgtttgccaccgcatccgcctggaacctggcaagggccgtgaccaggagagaacgacgcttgtttggctctttctcacctgcccgcacaagatag

SEQ ID NO: 12871 - DNA, 555 bp, Artificial Sequence
  Description of Artificial Sequence: Synthetic coding sequence
atggctagccccgcagcctcctctgtgaggccaccccgaccaaaaaaagagccacaaactcttgttattccaaagaatgccgcagaggaacagaaactcaaacttgaacggctcatgaagaacccagacaaggccgtgccgatccctgagaaaatgtctgagtgggcccccaggccgcctcctgagttcgtcagggacgtcatggggagctctgcgggcgccggtagtggagagttccacgtttatcgacatttgcgcaggagagaataccagaggcaggattatatggacgctatggcagaaaagcagaaactggatgcggagttccagaagaggctggaaaaaaacaaaatcgccgcagaagagcagactgccaagaggcggaagaagaggcagaagttgaaagaaaagaagttactcgccaagaagatgaagctcgagcaaaaaaagcaggagggccctggccagcctaaagaacaaggctcctcatccagcgccgaggcatcaggtaccgaggaggaagaagaggtgccttccttcaccatgggaaggtag

SEQ ID NO: 12872 - DNA, 555 bp, Artificial Sequence
  Description of Artificial Sequence: Synthetic coding sequence
atggccagtccggcagcatcatccgttagaccgccgcgtccaaagaaggagcctcagacacttgttatccctaaaaacgctgctgaggagcaaaaactgaagctggaaagacttatgaaaaatcccgataaggctgtgcctatcccagagaagatgtctgaatgggcgcctcgcccgccacccgaatttgtgcgggatgtcatgggatcttctgctggggccggtagcggtgagttccatgtataccggcaccttagacgccgggaatatcagcggcaggactatatggatgccatggccgagaaacagaagctcgacgccgagtttcagaaacgcttggagaagaacaagatagccgccgaggagcagaccgccaagcgtcgcaagaagcgacagaaactcaaagagaagaaattgcttgccaaaaaaatgaagctagaacagaaaaaacaggagggcccaggtcagccaaaggaacagggctcttccagtagcgccgaggcctcgggaactgaggaagaggaagaggttccctcatttactatggggcgctag

SEQ ID NO: 12873 - DNA, 3075 bp, Artificial Sequence
  Description of Artificial Sequence: Synthetic coding sequence
atgtccaatgccaaggagcggaagcatgccaagaagatgcgcaatcagccaaccaatgtgacactcagctccggatttgtggcagatcgtggagtcaaacaccattcagggggagaaaaaccttttcaagcccaaaaacaagaaccacaccccgggacttcccgccagcggcaaacacgcgtgaacccccattcactgcccgatcctgaggtgaacgagcagagtagctccaagggcatgttccggaagaagggagggtggaaggccggccctgagggtactagccaggaaattcctaaatacatcacggcgtcaactttcgcacaggccagagctgcggagatcagtgctatgctgaaggctgtcacacagaagtcctccaattccctggtgtttcagactctgccacgccatatgcgacgccgagctatgtcacacaacgttaagagactgccccgaagattgcaggagattgcccagaaagaggccgagaaagcagtccatcaaaagaaagagcactcaaagaacaagtgtcataaggccagaagatgtcacatgaacagaaccttggaatttaataggcgtcaaaaaaagaatatttggctggaaacccacatttggcacgccaagcgtttccacatggtgaaaaagtgggggtactgtttgggcgagcgccctactgttaagtcccaccgggcatgttatagggctatgaccaatcgttgtctcctacaggacctgagctactactgttgtcttgagctcaaaggaaaagaggaagaaattctgaaggctctctccggcatgtgtaacatagacaccgggttaaccttcgcagccgtgcactgcctatcgggcaaacgccagggatccctggttctgtaccgcgtcaacaaataccctcgggaaatgctgggcccagtaacatttatatggaagtctcaacgtacaccaggcgaccctagtgagtctaggcagctttggatatggctgcatccaactctgaagcaggacatactcgaagagatcaaggctgcctgtcaatgtgtggaaccaataaaatctgccgtatgtattgccgaccccttaccaaccccttcccaagagaaaagccagactgaactgcccgacgaaaaaattggcaagaaaaggaagaggaaggacgacggggagaatgctaaacccattaaaaaaatcatcggtgatggtacaagggacccctgcctgccatacagttggattagcccaaccactggcattattatctcggatctgacaatggaaatgaatcggttcagactgataggccctctgagtcatagcattcttaccgaggctattaaagcagcctccgtccataccgtaggcgaggacacagaggaaaccccccataggtggtggattgagacgtgcaagaaaccagactctgtgtcactacattgccgccaggaggcaatcttcgagctcctggggggcataacctcccccgccgagatacccgccggaaccatactggggctgactgttggcgaccctcgcataaacctccctcaaaaaaaaagtaaagcactgcctaatcctgagaagtgtcaggataatgagaaagtgcggcaactgctcctggagggcgtgcctgtggagtgtacgcactcctttatttggaatcaggatatctgtaaaagtgtgactgagaataaaatcagcgatcaagatcttaacagaatgcggagcgaacttctggtgcccgggtctcagctgatcctcgggccccacgaatcaaagatacccattctacttattcagcagccagggaaagtaacaggagaagatcgcttgggctggggatcagggtgggatgtactgttacctaagggatgggggatggcattctggatccccttcatttaccggggagtgcgagtcggcgggctcaaagaatccgcagtgcactcacagtacaagaggtcacctaacgtacctggagatttccctgactgcccggctgggatgctttttgctgaggaacaggcaaagaatctcttagagaaatacaagcgccgcccccctgctaagcgtcctaactacgtaaaacttggcacactcgccccattctgctgtccgtgggagcagctgacccaggattgggaaagccgtgtgcaagcatacgaggaaccttcagtggcttcctcccccaatggaaaggagagtgatctgcgccgtagtgaagtgccttgcgctccgatgcccaagaaaactcaccagccttccgacgaggtaggcacctctattgagcaccctagggaggctgaggaggtgatggatgctgggtgtcaggagtcagctggcccagaacggattaccgaccaagaggcttccgaaaaccatgttgccgctacagggtcccacctgtgcgtgctacgcagtcggaaactccttaaacaattgagcgcgtggtgtggcccctcgtctgaagattctcgaggcggtaggcgggcccccggcagaggtcagcaaggtctcacacgtgaggcatgtctgagtatcctgggccacttcccgagagctctcgtgtgggtaagcttaagcctcctgtctaaaggtagtccagagccccacaccatgatctgtgttccagcgaaagaggacttcttgcagttgcatgaggattggcattactgcggtcctcaggaatcaaagcacagcgatccctttagatcaaagattctgaagcagaaagagaaaaagaaaagagagaagagacagaaacccgggagggccagtagcgacggacctgcaggggaggaaccagtggccggacaggaggcactgacgctcggcctttggtccggccccctccctcgtgtgaccctgcattgcagccggacactgctcggatttgtcacccagggagattttagtatggcagtggggtgcggtgaggctctgggctttgttagtcttactgggctactggatatgctgtcttcccagcccgcggcccaacggggtttggtcttactccggccccctgcttctctacagtatagatttgcccgtattgccatagaggtatag

SEQ ID NO: 12874 - DNA, 3075 bp, Artificial Sequence
  Description of Artificial Sequence: Synthetic coding sequence
atgagtaatgccaaagagcgaaaacacgccaagaaaatgagaaaccagccaaccaacgtgacactttcttctggattcgtcgctgaccggggagtcaagcaccacagcggtggtgagaagccgtttcaggcgcagaagcaggagcctcatccaggtacctctcggcaacgccagacacgcgtgaacccgcattctctgccggacccagaggttaatgaacagagctcatctaaaggtatgtttagaaaaaaagggggctggaaggcggggccggagggaactagccaggagattccaaagtacattacagcttctacatttgctcaagctagggctgcagagatatccgctatgcttaaggccgtcacccagaagtcttcaaactctttagtgtttcagacgctccccaggcatatgcgacggagggcaatgagtcacaacgtcaaacgccttccaaggcggttgcaagagattgcgcagaaggaagcagaaaaggcagtccatcagaaaaaggagcactcaaaaaataagtgtcacaaagcccgacgctgccacatgaataggacacttgagttcaaccgtcgacagaagaaaaatatctggctcgagacacacatctggcatgccaaacgatttcacatggttaagaagtggggctactgcctgggagagaggccaacagtgaaaagccacagagcgtgctaccgcgccatgaccaaccgctgcctgcttcaggatctgtcctattattgttgtcttgaactcaagggcaaagaagaagaaatcctgaaagcattgtccggtatgtgtaatatagacacaggacttaccttcgcagctgtgcattgtctctcaggaaaacgacagggctccctcgtgttgtatagagtgaataagtatccgagggagatgctgggaccagttacttttatctggaaaagtcaaaggacacctggggatccatcagaatcgcgacagttgtggatttggctacatcccacgctcaagcaagatattctggaagaaatcaaggcagcctgccagtgtgtcgagccaatcaagagcgccgtttgcattgccgaccccctgccgaccccatctcaggagaaatctcagaccgaactgccagacgaaaagattgggaaaaagagaaaaaggaaggacgacggtgagaacgcaaagcccattaaaaagataatcggggatggtacccgcgacccttgcctgccctattcttggatttcgcccacaaccggcatcattatatctgatcttacaatggaaatgaatcgtttcaggttgattggtcctcttagccacagcattctgaccgaggctatcaaggccgcttccgttcacaccgtgggggaggatacggaagagaccccccaccggtggtggatcgagacatgcaagaaacctgattcagtatccctgcactgccggcaagaagccatttttgaactcctggggggcattacctcacccgcggagattccggccgggaccatcttgggacttacggtgggagatccacgcatcaatctgcctcagaagaaaagtaaggctcttccaaacccagaaaagtgtcaagacaatgaaaaagttcgacagctattgctggaaggggtaccagttgagtgtacacactccttcatttggaaccaagatatatgtaagtctgttactgaaaataagatctctgatcaagatcttaacaggatgagaagcgagttgttggtccccgggtctcagctgatactgggcccacacgagtccaaaattccaatacttctgatccagcagccaggcaaggtgaccggcgaagacagactgggctggggaagcgggtgggacgtgctgttaccaaagggttgggggatggctttttggattcccttcatctatcgaggagtaagggttggcggcctgaaggaatcagctgtgcactcccaatacaagaggtcccccaacgtgcctggggattttcccgattgcccggccggcatgttatttgccgaagaacaggcaaagaacctgctggagaaatataagcgacgtccaccggccaaaagacctaactacgtcaagctcggaaccctggcccccttttgttgtccatgggaacagctaactcaggattgggagtccagggtccaggcctatgaagagccatccgtggcctctagccctaacgggaaagagtccgatctgaggaggtccgaggtaccatgcgctcccatgcctaagaaaactcaccaaccgagcgacgaggtgggaacctccattgaacacccccgggaggctgaggaggtgatggacgcaggatgtcaggaaagtgccggcccagagcgcataactgatcaggaggcgtccgagaatcacgtcgccgctacaggaagtcacctatgtgtcctcagatccagaaagctcctcaaacagttatctgcttggtgcgggccctcatcagaggactcccgaggagggcgcagagctccaggccgtggccaacagggccttacacgtgaggcttgtctgtccattttaggtcatttcccaagagcacttgtttgggtcagcctctccttactaagcaaagggtctcctgagccacacaccatgatttgcgtgcctgccaaagaggatttcctgcagctacacgaagattggcattactgtggtcctcaggagagcaagcactcagaccccttcaggagcaagattctcaagcagaaagagaaaaaaaagcgggaaaagagacaaaagcctggacgagcatcatccgatggacccgctggggaagagcccgtggcggggcaggaagctctgacgcttggactttggtccggtcccttgcctagagtgacgttgcactgctctagaaccctgctgggcttcgttacccaaggcgacttctctatggccgtcggctgtggagaagccttaggttttgtctcccttacaggtctgttagacatgctatcctcacaacctgcagcccagaggggactggtcctccttagacccccagcctcgttacaatatagattcgccagaattgccatcgaagtgtag

SEQ ID NO: 12875 - DNA, 552 bp, Artificial Sequence
  Description of Artificial Sequence: Synthetic coding sequence
atgtcgaatgccaaagaaaggaaacacgctaaaaaaatgaggaatcagcccactaatgtcactctgagttcagggttcgtggccgataggggcgtcaaacaccattctggtggggagaaaccttttcaagcccaaaagcaggaaccccatcctgggacatctcgccaaagacagactcgcgtaaatccacattccctgccagatccagaggtcaacgagcagtcctcttcaaaggggatgttccgtaagaaggggggatggaaggccggcccagaggggacatctcaggaaatccccaaatacataacagcgagcaccttcgcccaggctagggcagccgaaatctccgccatgttaaaagctgttacccagaagtcgtccaatagcctggtgttccagacccttccccgtcacatgcgacgtagggctatgtcccacaacgtaaagaggttaccccggaggctgcaagaaattgcgcaaaaggaggctgaaaaggctgttcaccaaaagaaggagcatagcaaaaacaaatgtcacaaagcaaggcggtag

SEQ ID NO: 12876 - DNA, 297 bp, Artificial Sequence
  Description of Artificial Sequence: Synthetic coding sequence
atgtggaatcccaacgcggggggacccccacacccagtccctcagcccggatatccaggctgtcaaccattgggcccttatcctcctccctacccacccccagctcctgggatccctcccgtcaaccctctcgcaccgggtatggtcggaccggcagtgattgtcgacaaaaagatgcaaaaaaagatgaagaaggctcacaagaaaatgcataagcatcagaagcaccataagtaccataagcacgggaagcattcaagtagcagctcctcctcttccagcagcgattcagactag

SEQ ID NO: 12877 - DNA, 447 bp, Artificial Sequence
  Description of Artificial Sequence: Synthetic coding sequence
atgtggaaccccaatgcgggccagcccggccctaacccctatcctccaaacatcggatgccctggtggctctaatcctgcccatcctccccctattaatcctcctttccctcccggaccttgcccaccaccaccgggcgcacctcatggtaatcccgcgttcccaccaggaggtcctcctcaccctgtcccacagccagggtatccaggatgtcaacccctgggaccttatccccctccttatccccctcctgctcctggaattcccccagtgaaccctttagcacctggcatggttggcccggccgtaatcgtcgataaaaagatgcagaaaaagatgaagaaggcacataagaaaatgcataagcaccagaaacaccataaataccacaagcacggcaaacactcttcctctagttccagcagcagcagcagcgactctgattag

SEQ ID NO: 12878 - DNA, 489 bp, Artificial Sequence
  Description of Artificial Sequence: Synthetic coding sequence
atgggctacctggattctattggatggcggacacacctcaatatgtggaacccaaatgctgggcaacctggcccaaacccctatccccccaatattggatgtcccgggggctccaatcccgctcatccacctcctataaatcctcccttccctccaggcccctgtccaccaccgcccggtgctccccacggcaaccccgccttcccgcccgggggacctccccatcccgtgcctcagcccggatacccagggtgccagcctctcgggccataccctcctccttacccccctcccgctccaggtatccctccagtgaatcccttagccccagggatggtgggtcctgccgttatcgtggacaaaaagatgcaaaagaaaatgaaaaaggcgcataagaagatgcacaagcatcagaagcatcacaaataccacaagcatggcaagcacagcagttccagttcgagctcctcatcatcagattccgactag

SEQ ID NO: 12879 - DNA, 447 bp, Artificial Sequence
  Description of Artificial Sequence: Synthetic coding sequence
atgtggaatcccaatgcaggtcagccggggcccaacccatatccacccaacatcggttgccctgggggatctaatccagcacacccaccccctattaatcctccattccccccagggccctgcccaccacccccgggcgcgccccatgggaatccagcgtttccccccgggggacctccgcatcccgttccacagccaggatatcccgggtgtcagccactaggcccttaccctccaccctatcctcctccagcccctggaatcccccccgtcaacccattggccccaggtatggtggggcccgcagtgattgtggataagaagatgcagaaaaagatgaaaaaggcccacaagaagatgcacaaacaccagaagcatcacaagtaccataaacacgggaaacattcatcctccagctcgagtagcagctccagtgacagcgactag

SEQ ID NO: 12880 - DNA, 447 bp, Artificial Sequence
  Description of Artificial Sequence: Synthetic coding sequence
atgtggaatcctaacgccggccagccaggccccaacccctacccccctaacatcggctgcccagggggaagtaacccggctcaccctccgcccatcaacccaccattcccacccggcccgtgcccccccccaccaggtgctcctcacgggaaccccgcctttccacccggaggacccccacaccccgtaccacagcccggttaccctggatgccaacccctgggtccttatcctccgccctatcctccccctgcccccggcatccctcctgttaaccccctggcacctggcatggtcggacccgccgtgattgtggataaaaagatgcagaagaaaatgaagaaggctcacaagaaaatgcacaaacatcaaaagcatcacaagtatcacaagcacggcaaacacagttctagctccagttccagctcttcctcagatagtgactag

SEQ ID NO: 12881 - DNA, 1779 bp, Artificial Sequence
  Description of Artificial Sequence: Synthetic coding sequence
atggaccccaatagcatcttgttgagcccccagcctcagatctgcagtcatttggccgaagcttgtacagagggagaacgatcttcatctcctcctgagttagatcgagattccccattcccgtggtcgcaagtgcccagcagcagccccaccgacccagaatggttcggcgatgagcatattcaagctaaaagagcccgtgtggagacgatcgtgcggggtatgtgtttgagccccaaccccttggtgccagggaatgcccaggccggtgtgagccccagatgtccgaagaaggcccgtgaaaggaagaggaagcagaaccttcctaccccacaaggtctcttaatgcccgctccagcatgggaccaaggcaatcggaagggaggcccacgagttcgagagcagctccatcttctcaagcagcagctccgacatctgcaggagcacattttgcaggccgcaaaacctcgggatactgcacagggccctggaggatgcggtacaggaaagggaccgctatcggcgaaacagggtaatggatgtgggccgcgaccttgggttgtggacggagaccatcagcaagggaccagcaaggatctgtcaggcgctgagaaacaccaagaatcagagaagccgagctttctgccgtcgggggcacctgctagtctggagatattacgaaaggagctgaccagagccgtctctcaggcagtagatagtgtgctgcagaaagtccttctagatcctcctggccacctcacacaattggggaggagcttccagggccaggtcgccgagggaagatctgagccttcacctcccgtgggaggggcttgcaaagaccccttagctctggcagcactgccacgccgcgtgcagcttcaagccggggtgcccgtaggcaacctcagcctggccaagcggctcgattctcctcgatacccaataccacctcgcatgactcctaagccttgccaggatcctccggccaactttcctctcactgctccttcacacatccaggaaaaccagattctaagtcagctgctgggccacaggtataataatggacactggtcaagttcacccccacaggacagtagttcacagagacaccctagcagcgaaccagcccttaggccatggagaactaccaaaccccagcctcttgtcctctctcagcagcagtgccctctgcctttcacatccgctcacctggagagcttgccactgctccccagtgtcaaaatggaacagcgaggtctccacgctgtcatggaagccctcccctttagtctggttcacatttccgagggtcttaaccccggacacctgaagaaggctaagcttatgtttttcttcactagatacccatcttcaaacctcctgaaggtttatttccccgatgttcagtttaaccggtgtatcacgagccagatgatcaagtggttcagtaattttagagaattctactacatacagatggaaaaatctgccagacaagccatttccgacggcgtcactaatccaaaaatgctggttgtcttacgaaattccgaactgtttcaagcccttaatatgcactataacaaaggaaacgactttgaagtgcctgattgtttcctcgaaatcgcatctctgacgctgcaagagttcttcagagctgtgtctgcaggtcgggactccgacccttcatggaagaagccaatatataaaatcattagcaagctagatagcgacattcccgagatcttcaaatcctccagctatcctcagtag

SEQ ID NO: 12882 - DNA, 1779 bp, Artificial Sequence
  Description of Artificial Sequence: Synthetic coding sequence
atggatccaaactcaattctgctatcacctcagcctcagatctgcagccatctggccgaagcctgcactgagggcgagaggtcatcttcaccgcctgaactggacagggattctcctttcccttggagccaggtgccttcatcttctcctacagatcctgaatggttcggggacgagcacattcaagctaagcgcgctcgagtcgagacaattgtaagggggatgtgtctctctcctaatcccctggtgcccgggaacgctcaggctggtgtgtctcctaggtgcccgaagaaggcaagggagaggaagagaaaacagaatctccctacacctcagggtcttctcatgcctgcccctgcctgggatcagggaaatagaaaagggggtcctagggtgcgagagcagctgcatctgctgaaacagcagctgaggcatcttcaggagcacatcttgcaggccgctaagccacgggacaccgcacagggtcctggtggatgtggcactgggaaaggacctttgagtgcgaagcagggcaatggttgcgggccacgcccttgggtggttgatggtgaccatcagcagggcacgtccaaggacctgagcggcgccgagaagcatcaagagagcgaaaaaccctcatttctcccaagtggggccccggcttcactggagattctgagaaaggagcttacacgtgcagtctcacaggccgtggattctgtgcttcagaaggtcctgctggatccgccaggacacctcactcagctgggcaggtccttccagggacaggttgcagaagggcgctccgagccgagcccccccgttggcggcgcctgtaaagatcctctggccttagcggcacttcccagacgggtccagcttcaggctggggtcccagtgggaaatctgtccttagcaaaaagactggatagtcctcgttatccgattcctcctcgcatgactcctaaaccctgtcaggatcctccggccaatttcccactcacagccccctcgcatattcaagaaaaccagatcctgtctcagctgttgggtcatcgctataacaatggacattggtcctcatccccccctcaggacagttcctcccagcgtcatccaagttctgaacctgctctacgtccatggcgaaccactaagccccagccactggtcctgagccagcagcaatgccccttgccgttcacttcagcccatttagagtccctcccccttctacctagtgtgaaaatggagcaacggggtttgcacgccgtaatggaagctcttccgttcagcctgcttcacatccaggaaggcttgaatcctgggcatctcaagaaagccaagctaatgttctttttcacaagatacccttcctccaacctcctcaaggtgtatttcccggatgttcagttcaaccgatgtattacttcccagatgatcaagtggttctctaacttccgcgagttctactacatccagatggaaaagtcagccaggcaagctattagcgatggcgtgaccaatcctaagatgctggtcgtgttgcgtaactctgagctctttcaggccctgaacatgcactacaacaagggtaatgacttcgaagtgcctgattgcttccttgaaatcgcctccttaaccttgcaggagtttttccgggcggtgagcgcaggtagagatagtgaccctagctggaagaaaccgatctataaaattatttcaaagctagattccgatatcccagagattttcaagtcttcttcctatccccagtag

SEQ ID NO: 12883 - DNA, 1779 bp, Artificial Sequence
  Description of Artificial Sequence: Synthetic coding sequence
atggacccaaattccatcctgctgagtccacagccccaaatctgcagtcacttagctgaggcatgcacagaaggtgagaggtcatcttctccacctgagctcgatagagacagcccttttccatggtcccaggtcccttcaagttcaccaacagaccccgagtggtttggcgatgagcatatccaggccaagagagctagggtggaaaccatagtcaggggcatgtgtctttcacccaaccctctggtccccggaaacgcccaggctggcgtgtccccacgttgccccaaaaaagcaagggagagaaagcggaagcagaacctgcctactccccagggtcttttaatgccggctcctgcttgggatcagggcaatcgcaaaggcggcccccgtgtgagagagcaattacacctgctgaagcagcagctccgacatttgcaggagcacatactgcaggcagctaaaccaagagatactgctcaggggccaggtggctgcggaactgggaaaggaccacttagcgctaaacagggtaacgggtgtgggccccggccttgggttgttgacggggaccatcagcaaggaactagcaaagacttaagcggcgcagagaaacaccaagagagcgaaaaaccctccttcctacccagcggagcccctgcatcactcgaaatcctgagaaaagaattgaccagagctgtctctcaggcagtcgatagcgtgctgcagaaggtgctacttgacccgcctggacacctgacacaattagggcgctcattccaaggccaggtagctgaaggccgctcagagccttcacccccagtgggcggagcctgcaaggatcccctcgcgttagccgcactcccacgcagagttcagctgcaggccggggttcctgtcggaaatctttccctggcaaaacgcctcgacagtcctaggtatccaattcctccccggatgacccccaagccttgtcaggatccaccagctaactttcctctcactgccccctcccacattcaagaaaaccagatattgtcgcagcttctgggccacaggtacaacaatggacactggagtagcagtccacctcaagattcctcctctcagaggcatccttcatctgaaccagcccttaggccatggaggacgaccaagccgcagccactcgtgttgagccagcagcaatgtcctctgccctttacaagtgcacacctcgagtccctgccgctgctgcccagcgttaaaatggagcagcggggtttacatgccgtcatggaagccctgccattctctttagtacatatacaggagggactcaaccctgggcatctgaaaaaggctaaacttatgtttttttttacacgatacccatcttctaatctgttgaaagtgtattttccagatgtgcaattcaaccgctgcatcactagccagatgataaaatggttctctaacttcagagaattttattacatacagatggaaaagtctgcgcggcaagccatctctgacggcgtgacaaatcctaaaatgttggttgtcctccggaactctgaactgtttcaggctctcaatatgcactataataagggaaatgactttgaggtgcccgactgcttcctggagattgccagtctgaccttgcaagagttctttcgagcagtgtccgcaggacgggactccgatccgtcatggaagaagcctatctataaaatcataagcaagctggattccgacattccagaaatcttcaagtccagcagctacccacagtag

SEQ ID NO: 12884 - DNA, 174 bp, Artificial Sequence
  Description of Artificial Sequence: Synthetic coding sequence
atgctatgcgcccatttcagtgaccagggccccgcccatttgactacctctaaatccgcttttttaagcaataaaaagacatctacgcttaaacatctgctgggagagacaaggtccgacggctctgcctgcaattcaggtataagcgggggcaggggtagaaagattccctag

SEQ ID NO: 12885 - DNA, 5439 bp, Artificial Sequence
  Description of Artificial Sequence: Synthetic coding sequence
atggctgttgactccgccatggagctcctttttctggatacatttaaacaccccagcgccgagcagtcctcccatatcgatgttgtgcgatttccatgtgtggtctacattaatgaagtacgagttatcccaccgggagtgcgggctcatagctctctgccagacaacagggcttatggtgagacttcccctcacacatttcagcttgacctgttctttaacaacgtctctaagccaagcgccccagtctttgaccggctgggatccctggagtatgacgagaatactagcataatatttcggcccaatagtaaagtgaacactgatgggttggtgctgagggggtggtacaattgtctgactctggctatttatggttccgtcgatcgtgttatttctcacgatcgggatagcccgccccccccgccaccaccgcccccaccgccacagcctcaacccagtctgaagcgcaatcccaaacacgccgacggggaaaaggaagaccagtttaatgggagcccccctcggccccagcctcgaggtcctcgaacccctcccggtccccctcctcctgacgacgatgaagacgatcctgtgccactccccgtaagtggcgacaaggaagaagatgcaccccatcgggaggactactttgagccgatcagtccagatcgcaattccgtgccccaggaaggacagtatagcgacgaaggagaagtggaagaagaacaacaggaggagggcgaagaagacgaagacgatgtggacgtggaggaagaggaagatgaagacgaggatgatcggagaaccgtggattcaatcccagaggaggaagaggaggacgaggaggaagaaggggaagaagacgaagagggcgaaggagacgatggctatgaacaaatatctagtgacgaggatggaattgccgatctcgagagggaaacttttaagtatcctaattttgatgttgagtacacagccgaggatcttgcctctgttccccccatgacctacgacccctatgatagagagttagtgcctctcttgtacttctcctgtccatacaagaccactttcgagattgagatctctaggatgaaagaccaaggacccgataaagaaaactccggagcaatcgaggcaagcgttaaattgaccgaactgctggacctttatagagaggacagaggtgcgaagtgggtcacagcgctagaagaaatcccgtctctcataataaaggggttatcttacctccaactgaagaatacaaagcaagacagcttgggtcagcttgtagactggacaatgcaggctctaaacctgcaggttgccctgcggcagccaattgcactaaacgtgaggcagctgaaggcaggcacaaagctagtttccagccttgccgaatgcggggcccagggcgtaactgggctactccaggcgggggtcatatctggtttgttcgagctgctgttcgctgaccatgtatcatccagtctcaagcttaacgctttcaaggccttggactctgttatttccatgacagaagggatggaagcctttctgagggggagacagaatgagaagtcggggtaccagaaattgctcgaactcattctcctcgaccaaacggtgcgcgtcgtcactgcgggctctgcaattctgcagaaatgtcatttctatgaggtgctcagtgagatcaagcggctgggggaccatttggcagagaaaactagctccctgcctaaccactccgagccggatcacgataccgacgctggcctggaacgcactaatcccgagtacgaaaacgaggtggaagcaagtatggatatggaccttctggaaagctctaacatctcggaaggggaaatcgaaagactgattaacctgctggaagaggtgttccatctgatggaaactgccccacatacaatgattcaacagcccgttaaatccttccctacaatggcccgcatcacaggcccccctgagcgggatgatccctatcccgtgctgtttcgctacctgcactcacaccattttctggaacttgttactctgctgcttagcatccctgtgacttcagctcaccccggcgtccttcaggccactaaagatgtcttaaaattcttggctcagagccagaaaggtttgcttttcttcatgtccgaatatgaggccactaatttactcatacgcgccctctgccacttctatgaccaggatgaagaggaggggctgcagagtgacggcgttattgatgacgcattcgccctgtggttacaagactctactcagaccctgcaatgcataaccgagttgttctcgcatttccagaggtgtaccgcctcggaagaaactgatcacagcgatctgctcggaacgctccataacctctacctgattaccttcaatcctgtgggtcgatcagccgtgggacacgttttttcgttggaaaagaatctgcaaagccttattacactgatggaatattattccaaggaggctcttggtgatagcaaatctaagaagtctgtggcgtacaattacgcctgcatcctcatcttggtggtggttcagagcagcagcgatgtacaaatgttggagcagcatgccgctagtctgttgaaactgtgtaaagccgacgagaacaatgcgaagttgcaggagttagggaaatggctggagcctctgaaaaatttacgctttgaaatcaattgtattcctaatctcatcgaatacgtgaagcagaatattgacaatttaatgacccctgaaggggtcggcctgacgaccgccctacgcgtgttgtgtaatgtcgcctgccccccacccccagtcgagggacagcagaaggatttaaagtggaatctcgccgtgatccagctcttctctgccgaaggcatggacacatttattagggtcctgcagaagctcaactccatcctgacacagccatggcgacttcatgtcaacatggggaccacattacaccgcgtgacaacaatttctatggccagatgcactctgacgctcctgaagacgatgctgacagagttactgagaggcggctcttttgaatttaaggacatgcgggtcccatcagccctggtgacactccacatgctcctgtgctctattcccctgtctggcagactcgactcagatgaacagaagatacagaatgacatcatcgacattctgctgaccttcacacaaggcgtaaacgaaaaactgaccatcagcgaggaaacactggcgaataacacatggagcctgatgttgaaggaagtgctttcaagcatcttaaaagtgcctgagggctttttcagcgggctcatactgctttcagagctgctccctctcccgctgcccatgcagaccacccaggtgatcgaaccgcacgacatcagcgtcgcccttaacactaggaagttgtggtctatgcacctacatgtgcaagccaaactgctccaggagatcgtgcgaagtttctccggcaccacatgtcagcccatccaacatatgttgaggcgcatctgcgttcagctttgcgacctcgcctccccgaccgcgttacttatcatgagaactgttctggacttaattgtcgaggatctccagtcgacaagcgaagacaaggaaaagcaatatactagtcagacgacacgcctgctggcactgttagatgcattagctagccataaagcatgcaagttggccatccttcacctcattaacggcacaattaagggggacgaacgatatgccgaaatttttcaagacctcttggctttagtgaggagcccaggagattccgttattcggcagcaatgcgtcgagtacgtcacctcaattctgcaatcattgtgcgatcaggacatcgctcttattctgcccagctcaagtgagggatccattagtgagctggagcaactgagtaactcgctgcccaacaaagaactcatgacaagtatctgcgactgccttctggctaccttggcaaacagcgagagttcatacaattgtctgctgacctgtgtacgaaccatgatgttcttggctgaacacgactacggactattccacttgaagagctcgctgcgcaagaactcctcagcactgcatagcctgttgaaacgagtcgtgagcaccttttctaaagacactggggaactcgcctcaagctttctcgagtttatgaggcaaattcttaattctgacaccattggttgctgcggcgacgacaacggtctgatggaagttgagggagcccacacgagccggactatgtccatcaacgcagccgaactcaagcagttgctgcagagcaaagaagagagccccgaaaaccttttcctggaactcgagaagttggttctggagcactcaaaagacgacgacaatctggactccctgctagatagtgttgtgggcctgaagcagatgctcgagagcagcggcgacccattgccactgtccgaccaggacgtcgaaccggtgctgagcgctcccgagagcttgcaaaacctgtttaataaccgtaccgcctatgttctcgccgacgttatggatgaccagttaaagtccatgtggtttacgccattccaggccgaagaaatcgacaccgacctcgacctagtgaaagtggatctcatcgaactttcagagaagtgctgctccgattttgatctgcactctgagttggaacgttctttcctctccgagccgtccagtcccggcaggacaaagacaacaaaggggttcaagctggggaagcacaaacacgagacattcataacatccagcgggaaatcagagtatatcgagcctgccaagcgggctcacgtcgtacctcccccccgtggtcgtggcagggggggcttcggtcaaggcattcgcccccacgatatattcagacagcgaaaacagaacacaagccggcccccttccatgcacgtagacgacttcgtggcagcagagagtaaggaagttgtgccgcaggacggtattccaccccctaaaagacctcttaaagtcagtcaaaagatatcttcccgcggtggattttccggcaaccgtgggggcagaggcgctttccattcccaaaatcgattctttacacctcccgccagcaaaggcaactactctcgccgcgagggaactagaggcagttcctggtctgcgcagaatactcctcgaggtaattacaacgagtcccggggggggcaaagtaattttaataggggacccctgcctccattgcgccccctgtcaagcaccggctaccggccttcccctcgggacagagcaagccggggccggggaggactgggcccatcatgggcatctgccaactcaggttctggtgggagccgcggtaagtttgtgtcgggcggaagtggccgcgggcggcatgtgcgatcatttacacgatag

SEQ ID NO: 12886 - DNA, 1038 bp, Artificial Sequence
  Description of Artificial Sequence: Synthetic coding sequence
atgaagcagttgaaacggaagcgcaagtcaaacttttcagtccaggagacccagacattattgaaagaaataacaaaacgtaaagaggtgatattttcaaaacagctgaacaccacaattaacgtgatgaagcgaatggcttgggaggaaattgcacagtgcgtcaacgcagttggggagggtgaacagcgcaccggtaccgaggtaaaacggagatatctagattggagggctttgatgaaaagaaagaggatgaaagcaaatatcaaattggtcggcagcggattccctttgccgagttcggacttagatgattcactgacagaggagatagatgaaaaaatcgggttccgtaacgacgccaacttcgactggcagaatgttgccgatttcagagatgcgggcggatccctcactgaagtaaaagtggaggaggaagaaagagacccccagtcgccagaatttgaaatcgaggaggaggaagagatgctgtcctctgtgattcccgatagccggagagagaatgagttgccagattttccccacatagatgagttcttcactcttaactctacccccagccggagtgcttatgatgagccacatttactggtcaacatcgaaaagcagaagcttgaactggaaaagcgccgtcttgatatcgaagcagaacggctgcaggtcgaaaaggaaagactgcagatagaaaaagagaggctaagacatctagacatggaacatgaacggttgcaactggaaaaggagagactgcaaatagaacgggaaaaattgaggctccagatcgtcaatagtgaaaaacctagcttagaaaacgaactgggtcagggcgagaagagcatgctccagccacaggacatagagaccgagaagctcaagctggagagagagaggctgcagctagaaaaagatcgactccagtttttaaaatttgagtctgaaaaacttcagatcgaaaaggagcggctgcaggtggagaaggaccgtctgcggatccagaaggagggccatcttcagtag

SEQ ID NO: 12887 - DNA, 6738 bp, Artificial Sequence
  Description of Artificial Sequence: Synthetic coding sequence
atgcctgagatgacagagaatgaaacaccaacaaaaaagcagcatcgaaagaaaaacagagaaactcacaacgcagtggagagacaccgcaagaagaaaattaatgccggcatcaacaggataggggaactgatcccttgcagccctgccttaaagcaaagtaaaaacatgatcctggatcaggcattcaagtacattacagagctcaagcgccaaaacgacgagctgttgctgaatgggggcaacaatgagcaggctgaggaaatcaagaagctgcgcaaacaactggaagagattcaaaaggagaacggtaggtacatcgagctcctgaaagcaaacgacatctgcctgtatgatgatcctaccatacattggaagggtaatctgaaaaattcaaaggtcagtgtggtaattccatcagatcaggttcagaagaaaattatcgtgtatagcaacggtaaccaacctggaggaaattcccagggaacggctgttcaagggatcacattcaatgtgtctcacaatctacagaaacaaaccgcaaacgtggtacctgtccagcgcacttgcaacctggtcaccccagtgagcatctctggcgtttatccaagtgagaacaaaccatggcaccagacaactgtgcctgccctagccactaatcagccagtacctctctgccttccagccgccatttcagcccagtccattctcgaactccccacttccgaaagtgagtctaatgtgctgggcgccacttctggtagtctgatcgcagtgagcatcgagtctgaaccccatcaacaccacagcttgcatacttgtctgaacgatcaaaactcatctgagaacaaaaatggacaggaaaaccctaaagtactgaagaaaatgacgccctgtgtgaccaacatcccccactctagctccgcgactgctaccaaggtccaccacggaaacaaatcttgtctgtccatccaggacttccgcggagactttcaaaatacatttgtggtgagcgtgaccacaacagtctgctcccaacccccccgtaccgcgggggactcctctccaatgtccatttccaagtcagcggatttaaccagcactgcaacagttgtggcttcgtctgcccccggggtcggcaaagctactatcccgatttccacattaagcggtaatccgctggataatggatggactttatcctgctctttgccaagctcctctgtctccacctccgatttaaaaaacattaacagtcttacccgaatatcatctgcaggcaatacccagacaacttggaccactctgcagctggcaggcaacacaattcagccactctcccaaactccatcttctgccgtgacacccgtattgaatgagtccggtacctccccaacaactagtaatcattctcggtacgtggcgacggatatcaacctgaataacagtttccctgccgatggacagcccgtggagcaggtagtggttaccctcccctcctgtccctcgctgcctatgcagcctctgattgctcagcctcaggtaaagtctcagccacccaaaaacatcctacccctgaattccgcgatgcaagtgatccagatggctcagccagtgggaagcgcagttaattccgcacctactaatcagaatgtgattattttgcagcccccctccactactccatgccccacggtcatgcgggcagaagtgagtaatcagacagtgggacaacagattgtcatcatccaagcagctaaccagaatccattgcccctgctccctgctcctccgccggggtctgtcagactgcctattaacggggctaacaccgtgattggcagcaacaatagtgtacagaacgtaccaaccccccagacatttggcgggaaacacctcgtccatatcctgcctagaccttcgtcactctctgcttcgaatagcactcaaacattcagtgttacaatgtcaaaccagcagccacagaccattagcctgaacggccagctcttcgccctgcagcccgtgatgtcctcaagcggtacaacaaaccagacacctatgcagatcattcagccgaccacttccgaagaccctaacactaatgtggcactcaacactttcggcgctttggcctccctcaaccagtctattagccagatggcaggtcagtcatgtgtacaactgagcatctcacagcctgctaattcccagactgccgctaatagccagaccactaccgcaaattgtgtctcacttaccacgaccgctgctccccccgtgactactgactccagcgccaccctggctagcacatacaatctggtcagtacaagtagtatgaacaccgttgcctgtctaccaaacatgaagtcgaagcggctcaacaagaagccaggcggccggaaacacctagctgccaacaagtccgcctgtccattgaactctgtgagagacgtctccaagctggattgccctaatacagaagggtctgctgagccaccctgcaatgatggtctgttggaaagcttccctgccgtgcttccatccgttagcgtttcgcaggccaatagtgtgtcagtctccgcctctcacagcctgggggtgctctcgtctgaaagcctgattccagagtccgtctccaaaagcaaatccgccgaaaagtcaagccccccctcacaagagtctgtcacaagcgaacattttgccatggctgcagccaagagcaaggatagtactccaaatctgcagcaggagacttcacaggataagccgcccagttctctcgctctctccgatgctgctaagccctgtgcctctgctaatgttcttattccgagtccatccgaccctcacatcttggtgtctcaagtgcctggacttagtagcaccacctcaacgactagcacggattgcgtcagcgaagttgaaatcattgccgaaccgtgccgggtagaacaggactctagcgataccatgcagacaacaggactgctgaagggtcagggcttaacaaccctcctcagcgacctcgccaaaaagaaaaatcctcagaagagtagcctctccgaccagatggaccaccctgatttttcctccgaaaacccaaagatagttgatagttctgttaatctgcacccaaaacaggaattgctgttgatgaataatgatgaccgcgacccaccgcagcaccattcctgcttacccgaccaagaggtgattaacggcagtcttattaatgggaggcaggcagactctccaatgtcaacttccagcggaagttcccgttcattctcagtagccagtatgttgcccgagacaacccgggaggatgtgacatctaatgctacaactaacacctgtgactcctgtacatttgtggaacaaactgatatcgttgcgctagcagcaagggcaatctttgatcaagagaatctggagaagggccgggtgggcctacaggccgacatccgtgaggtggcttcaaaaccctctgaggcctcccttttggagggcgacccgccctttaaatcacagatacctaaggaatccggcactgggcaggcagaggcaaccccaaatgagtttaactctcagggatcaatcgaggctactatggagcgtcccctggagaagccctcctgttccctgggcataaagacttccaatgcttccttacaggattctacctctcagcctccatccatcacttcactgagcgttaacaacctgatccatcaatcatccattagtcatcccctggcctcatgcgctggtttaagtcctacatctgagcagacgactgtgccggccacggtcaacttgactgtgtcctcttcctcctacggaagccaaccccccggacccagcctgatgactgaatattctcaggaacagttgaacacaatgacctccacgatacctaactcccagattcaggagccactgttgaagcccagtcacgaatctcggaaggattcagccaaaagagcagtgcaagatgacttgctgctgtcaagcgccaagagacaaaaacattgtcaacccgcccccctacggctggaatctatgagcctcatgagtcgaacccctgacaccatctccgaccagacccagatgatggtgagtcagatcccacctaactcttcaaactctgtagttcccgtgtccaaccccgcacacggggatggattgacgagactatttccacctagtaacaactttgtgacccctgctctgcgccagacggaagtacagtgcgggagccagccatccgtggcggaacaacagcaaactcaggcatctcagcacctgcaggcgctgcagcaacatgtgccagcccagggcgtgagtcacctccatagtaatcacctttacattaaacagcagcagcagcaacagcaacagcagcagcaacaacagcaacaacagcaggcgggacagctgagagaacgtcaccacttgtatcagatgcaacaccatgtgccacacgcggaatcctctgtacacagccagccccacaacgtccaccagcagcggactctgcagcaggaggtgcaaatgcagaagaagaggaatttggtgcagggtacgcaaactagccagctttccctgcagccaaagcaccacggaacggatcaaagcagaagtaagacggggcagccccatccacatcaccagcagatgcagcagcagatgcagcagcatttcggctcgtcacagaccgagaaaagttgtgagaacccctctacttcaagaaaccaccacaatcacccccagaatcacctgaaccaggatattatgcaccaacagcaggatgtgggatccagacaacagggaagcggtgtaagtagcgaacacgtctccgggcacaacccaatgcagaggcttctgacaagccgaggcctggagcagcaaatggtcagccagccaagcattgtgactagatcatccgacatgacctgtacacctcatagacccgaacggaatcgagtgtcttcgtactccgcggaagctctcattggcaagacatccagtaattcagagcagcgtatgggaatttccatccagggctctagggtcagtgaccagctggagatgaggtcgtatttggacgtgcccaggaacaagagtctggccattcataacatgcagggaagagttgaccatactgtggcaagtgatatccgcctctcggattgtcagaccttcaagccctccggggcttcccagcaaccacagtccaacttcgaggtgcagtcttcacgtaataatgaaatcggaaatcctgtctccagccttcgtagtatgcagagccaggcctttcgtatatcccagaatacaggtccacctcctatagataggcaaaagaggctaagttacccaccagtacaatctatcccgaccggaaacggaataccatctagggattctgaaaacacctgtcaccagagcttcatgcaaagccttctggcccctcatcttagcgatcaggtcattggatcccagagaagtcttagtgagcatcagagaaatacacagtgcggtccgtcatcggccattgaatataactgcccccccactcacgagaacgttcatattcggcgagaatcagagtctcaaaaccgggaatcctgtgacatgtctctgggcgccataaatacccgcaatagcacgcttaacattcctttctctagctcatcctcttccggagacatacagggacggaatactagcccaaacgtttccgtccaaaaaagcaatcctatgcggattacagagtcgcatgctacaaagggacacatgaacccacctgtcacaacgaacatgcacggagtggctcgacctgctctgccacaccccagcgtatcccacggtaacggtgatcagggtccagccgttaggcaggctaattcttcagtgccgcagagatctcgccacccactgcaggacagcagtggcagcaagattagacagcctgaacgtaacagatcaggtaaccagcgccaaagtacagtgtttgacccaagccttcctcacttgcctctttcaacagggggttccatgatcctggggcgccagcagccagccacagaaaagcggggctcgatcgtgcggtttatgcctgacagtccacaagttcccaatgataattccggccccgaccagcatactctgagccagaactttggcttcagcttcatccctgaaggcgggatgaatccacccattaacgccaacgcctcttttatacctcaggtgacacaaccatctgccaccagaaccccagcgttgatccccgtggacccccaaaataccctgccttccttttacccgccttattcccctgctcatccaaccctatcaaacgatatcagcatcccatattttccaaatcaaatgttcagtaatcctagcacagagaaggtgaactccggaagcctcaacaaccgattcggatctatcttaagtcctccccggcccgttgggttcgctcagcccagctttcctctgctccccgacatgccacctatgcatatgacaaattcgcacctatctaatttcaatatgacctccctgttccctgaaattgcaaccgtactgccagacggctccgccatgtcccctttgctgacgattgccaattcttccgcaagcgattctagtaagcaatcttcgaaccggcccgcacataatatcagtcatatcctcggccatgattgttcttctgcagtctag

SEQ ID NO: 12888 - DNA, 3444 bp, Artificial Sequence
  Description of Artificial Sequence: Synthetic coding sequence
atggccgtggatagtgcgatggagcttctgtttctggacaccttcaagcacccatcagcagagcagtcgagccatattgatgtcgttagattcccctgcgtggtgtatattaacgaggtgagggtcattcccccaggcgttagagctcactccagccttccagacaatagagcatatggcgaaacttctccacatacttttcagctggacctgttctttaacaacgtctccaagccttccgctcctgtcttcgatcggctgggttctctagaatacgacgagaatacctccattatattcagaccaaactctaaggtcaatactgacggtctggttctgcgcggctggtataattgtttaacgctggcaatttatggatctgtagatcgcgttatctcacacgaccgagatagccctccaccgccaccaccgccgcccccacccccccaaccacagccctccctcaaaaggaatcccaagcatgccgacggcgagaaagaggatcagttcaatggcagtccaccccggccacaaccgcgagggcccagaactccccctggcccgccacctcccgacgacgacgaagatgatcccgtgccattgcctgtgagtggagacaaggaggaagacgctccccaccgggaagactatttcgagccgatctctcccgacagaaattcggtcccacaggaggggcagtactctgatgaaggagaagtggaggaagagcaacaggaggagggtgaggaggatgaggacgatgtcgacgtagaggaagaagaagacgaagacgaagacgatcggagaaccgtcgactccatccccgaagaggaagaggaggatgaggaggaggagggggaggaagatgaagagggcgaaggtgatgatggatacgagcaaataagttccgacgaggacgggatcgcggatctggagcgcgaaacctttaagtaccccaatttcgacgtagagtatacagcagaggatctggcctccgtgccccctatgacctatgacccttacgacagggagctggtccctttactgtactttagctgtccctataagacgacattcgagattgaaatttctaggatgaaagatcaagggccagataaagagaattcaggcgccattgaggcgagcgtgaaactgacagagttactagatctgtacagagaagacagaggagccaaatgggttacagcgctggaggagatccctagtctgatcattaaaggcttatcctatctacagctaaaaaatactaaacaggactcccttggacagttagtggattggacaatgcaagctttaaatctccaagtggcactcaggcaacctatcgcccttaatgtgaggcagttaaaggccggcactaaactggtctcctcacttgcagaatgtggggcacagggggttaccggtctcctgcaggctggagtcatatccggcctgtttgagttgttgtttgccgatcatgtgtccagctccctgaagcttaacgcctttaaagccctggattccgtcattagcatgacagaggggatggaagcctttctcagaggccgacaaaatgaaaaatccggataccagaagctgctggagctgatacttcttgaccagacggtgcgagtagtcaccgcaggatccgccatcctacaaaaatgccacttttatgaggtgttaagtgagatcaagcgcctgggggaccatctagctgagaagacatcttctttgccaaatcatagcgagcctgaccatgacaccgatgctggactggagaggacaaatcccgagtatgagaacgaggtcgaggcatcaatggacatggacttactcgaatcctcaaatatcagcgaaggcgagattgaacggctgatcaacctgttagaggaggtcttccatctcatggagaccgctcctcatacgatgatccagcaacctgtgaagtcgttccccactatggctcgcattacgggcccacccgagcgcgatgacccttaccctgttctttttcgttatctccatagccaccatttcctcgagctggtgaccctgcttctctccattccagtcacctcagcacacccgggagttctgcaggcaactaaagatgtccttaaatttttggctcagtcccagaagggccttctatttttcatgtccgaatacgaggctacaaatttactgatccgagcgctgtgccacttctatgaccaagatgaggaggaagggctgcaatctgatggagttattgacgacgcctttgctctgtggctgcaggactctacacagactctgcaatgtattaccgagctgttctcccatttccagcgatgtaccgcgagcgaagagaccgatcattctgacttgctgggtactctgcataatctgtacttaattacttttaatccggttggccgcagcgctgtgggacacgttttctcgctagagaagaatctccagtctctcatcactcttatggagtactattccaaggaagcattaggagattccaagtccaaaaaatcagtggcatataactacgcatgcatcctcatcttggtcgtagtgcagtcctcctccgatgtgcagatgctagaacaacacgccgctagtcttttgaagctctgtaaagcggatgagaataacgccaagttacaggagctggggaagtggcttgagcccttgaaaaacctccgctttgagattaactgtattccgaatctcattgagtatgtgaaacagaatatagacaatctgatgacccccgaaggcgtggggctgaccaccgccctgagagtcctgtgcaacgtggcatgtcctccaccgcctgtggagggacagcagaaggacctgaagtggaatctggccgtaatccagctcttctctgctgaaggtatggatacctttattagggtcctgcagaaattgaactcaatcttgactcaaccctggcggctgcacgtgaatatgggaacgaccctacaccgagtgaccaccatctcgatggctagatgtaccctaacactgctgaaaacaatgctgactgagctgctgcggggggggtctttcgagttcaaggatatgagagtgcctagcgcactggtcactctacacatgctactgtgcagcattcccctatctggacggctggactccgacgaacagaagatacagaacgacattattgacattctgcttacattcactcagggcgtgaacgagaaactaaccatctccgaggagaccctggctaacaatacatggtcactgatgctcaaagaagtcctaagttctattctgaaggtgcccgagggtttcttcagcggcctgattctcctgtcagagttactcccattgccgctcccaatgcagaccacccaggtgtccttaccatataacatgcatctgatcaacgactgctctaataccttctag

SEQ ID NO: 12889 - DNA, 4134 bp, Artificial Sequence
  Description of Artificial Sequence: Synthetic coding sequence
atggctgtcgattccgcgatggaactgttgttccttgacactttcaagcacccttctgctgaacagtcctctcacattgatgtcgtcagattcccgtgtgtggtttatatcaatgaggtgcgtgttatcccacccggggtgagggctcacagcagtctccccgacaatcgggcatacggcgagacgagcccacacacattccaacttgacctttttttcaataacgtctcaaagccctccgcccctgtattcgacagactgggatcactggagtacgacgaaaacaccagtattattttcaggcccaatagcaaggtgaatactgatgggctggtgctcagggggtggtacaattgtctgaccctggctatctacgggtctgttgatcgggttatctctcatgaccgggactccccacctccccccccgccaccaccaccaccacctcagccccagcccagcctcaaacggaaccctaaacacgccgacggggaaaaagaagatcagtttaacggtagtcccccccgccctcagccgagggggccgcggacccctcccggcccccctccccctgacgacgacgaggatgacccagttcctctccctgtctccggggataaggaagaggatgcgccccatagggaagattattttgagccaattagtcctgatcgtaactcagttccacaggaaggccagtattctgatgagggtgaagtcgaggaggaacaacaggaggagggtgaagaggatgaagacgacgtggacgtcgaggaagaggaggacgaggatgaggacgacagacgcactgtcgactctatccctgaggaggaagaagaggatgaggaggaggaaggggaggaggacgaagagggcgagggcgatgatgggtatgagcaaatatcctccgatgaggatggtattgctgatttagagcgcgagacttttaagtaccctaatttcgacgtggagtacaccgctgaggatcttgcttctgtgccgcccatgacttacgatccttacgatcgtgaactcgtgcccctgttgtacttttcgtgcccctataagaccacttttgagatcgaaatcagccgcatgaaagaccaggggccagataaggagaactccggagctatcgaggcaagcgtaaagctgaccgaactgttggacctttaccgcgaagaccgcggtgccaagtgggttaccgcactcgaggaaatcccgtcattgatcatcaagggactgagctacctacagctgaagaacacaaagcaggactctctgggtcagctcgtcgattggacgatgcaagctctgaacctacaagtggcattgcgccaacctatagctcttaacgtaaggcagctcaaggctggtaccaaactcgtgagctcactggcagagtgtggggcccagggtgtcactggtctcttacaggctggggtgattagcgggttgttcgaattactcttcgccgatcacgtcagcagtagtttgaagttaaacgcatttaaggccttagattcagttataagcatgacagagggtatggaagcattcctgcgcggccgacaaaacgagaaatctggttaccagaagctgctggagcttatcctgcttgatcaaaccgtgagggttgttacagccgggtcggcaatactccagaagtgtcacttttacgaggtgttgtctgagatcaagcggctgggggatcaccttgctgagaagacatcatccctgccgaaccactctgagcccgatcatgacacggatgccggcctggagaggaccaaccccgagtacgagaatgaagttgaagcatctatggacatggacctgcttgagtcatcaaacatcagcgagggagagatcgaaaggctaataaacctcctggaagaggtgtttcatctgatggagacagcccctcatactatgatacagcaacctgtgaaatcgttcccaaccatggccaggatcactggccccccagagagagatgacccttaccccgtgctattccgttacctccacagccatcattttctggaattggtgaccctgctactaagcattcccgtgaccagcgctcacccgggagttttacaggccactaaagatgttttgaaattcttagcacaaagtcaaaagggtctactgttttttatgtctgaatatgaggcaaccaacctattgattcgcgcgctctgccacttttatgatcaagatgaggaagagggcttgcagagtgatggcgtaatcgatgacgcctttgcactgtggctacaggacagcacccaaacactccagtgtatcactgagctcttctcacactttcagaggtgtaccgcttcggaggagaccgatcactccgacttgctgggcacgctgcacaacctgtacttaatcactttcaacccagtgggaagatccgctgttggccatgtatttagccttgaaaaaaatttgcagtcattgattaccctgatggaatactactcaaaggaggccctgggggattccaagagcaaaaaatcagtggcgtacaactatgcctgtatcctcatactggtggtggttcaatcctctagtgatgtgcagatgctagagcagcacgccgcctccttgcttaaactgtgcaaagcagacgagaataatgccaaattacaggagcttgggaaatggctggagccactaaagaatctgcgatttgagattaattgtatccccaacctgatcgagtatgtgaagcaaaacatcgacaatctgatgactcccgaaggtgtcggattgaccaccgcactgagagttctctgcaacgttgcatgcccccccccgcccgtcgaggggcagcaaaaggacttaaagtggaatctggcagttatccagctgtttagcgcggaggggatggatacctttatccgagtgctccagaaactgaactccattctcacccaaccctggaggctgcacgtgaacatgggcactacccttcacagagtaaccacaatatccatggctagatgcacactcaccctacttaagacaatgttaaccgagctcctgaggggcggttctttcgagttcaaagacatgcgagtgcctagcgccctggtcacactccacatgttgctgtgctcaatcccgttgtccggcaggttggacagcgacgaacagaaaatccaaaatgacatcatcgatatacttctgactttcactcaaggcgtcaatgaaaagctcaccatctccgaggagaccctggcaaataatacttggtctctgatgctaaaggaggtgctgtcatccattctgaaggtaccagagggtttcttttccggtctcattctcctctccgagctactgccgttaccccttccaatgcagacaacgcaggtgatagagccccacgacatatcagtggccctaaacacaagaaaactgtggtcaatgcatttacacgtgcaggccaagctattgcaggaaatagtgagatctttctcaggcaccacatgtcagcccatacaacacatgctcaggcgtatctgcgtgcagttgtgtgacctggcatccccaactgccttactgatcatgcgtacggtacttgatcttattgtagaggatctgcaaagcacctccgaggataaggaaaagcagtacacatcacagactacaagacttctcgccctgctagacgccctcgcctcccacaaagcctgcaagctggccattctccacctgattaacggaaccattaagggtgatgagcgatatgcagagatttttcaggatctgctggcccttgtcaggtcaccgggggactccgtcattcggcagcaatgtgtggaatacgtgacgtccatcttgcagtccctgtgtgaccaggacatcgcactaatcctcccgtcatctagcgagggttccatctctgaactggaacaactaagtaactctttacccaataaagaattgatgacctctatttgtgattgcctcctggcaacgctggcgaactcagagtcctcatataactgcctgttgacctgcgttcgaaccatgatgtttctggccgagcatgactacgggctgttccacctgaaaagggacgccgtggagatgattatggtttcctggaagtag

SEQ ID NO: 12890 - DNA, 288 bp, Artificial Sequence
  Description of Artificial Sequence: Synthetic coding sequence
atggccgacgagaagccaaaagagggcgtgaagaccgagaataacgatcatatcaatctgaaggttgctggacaggacggttcagtcgtgcaattcaagatcaaaagacatacgcctctgtccaaactgatgaaagcgtactgcgagcgccagggtctgtcagtcaggcagattcgattccggtttgacgggcagcccatcaatgagactgacacaccggctcagcttgagatggaggacgaggacaccatcgacgtttttcagcagcaaaccggcggggtgtattag

SEQ ID NO: 12891 - DNA, 6738 bp, Artificial Sequence
  Description of Artificial Sequence: Synthetic coding sequence
atgcctgagatgactgagaacgagaccccgaccaagaaacagcaccggaagaagaaccgtgagacacataacgctgtggagagacaccggaagaagaagataaacgccggaatcaacaggatcggagagctgattccctgcagccccgctctgaaacaatcaaagaatatgattctagatcaggcatttaagtacattactgagctaaagcgtcagaatgacgagcttcttctgaatggcggtaacaatgagcaggcagaggagatcaaaaaactgcggaagcagttagaggagattcagaaggaaaatggccgttatattgagttgctaaaggctaacgacatctgcctgtacgatgatcccacgatccattggaaggggaacctcaagaatagcaaggtgtccgttgtcattccaagcgaccaggtacagaaaaagatcattgtatactccaatgggaatcagccaggagggaatagccagggtaccgctgtccagggtataacatttaatgtttcacacaatctccagaagcaaaccgctaacgtggttccagtgcagcgaacatgcaacttagtgacaccagtcagcataagcggagtttacccctcagaaaataagccctggcaccaaacaacggtcccagcccttgccactaaccaaccagtgccactctgtctgccggccgctatttcagcccagtccatccttgagctgcctacgagtgagtccgaatcaaatgtactcggagcaacctccggcagtctgatagccgtgtctattgagtcagagccgcatcagcaccattctctgcacacctgcttgaatgatcagaattcatcagagaataagaacgggcaggagaatcctaaggtgctgaagaagatgaccccctgcgtgaccaatatccctcacagcagttcagctaccgcaactaaggtgcatcatggaaataagagctgtctgagtatccaggactttcgaggcgatttccagaatacatttgtcgtttcagtgaccacaacagtgtgttcacaaccccctcgaaccgcaggtgattcatcacccatgtccattagtaagtctgccgatcttacctctactgcgaccgtggtcgcctcttctgcccctggcgtgggcaaagcaactattcctatttcgacgctctcgggcaacccccttgacaacggttggacactgtcatgcagcctgccgtcatcctctgtgagcacatccgacctaaaaaacattaactctctgacccgtataagcagtgcaggtaacacccagactacttggaccacactacaactggctgggaataccatccagcctctaagccagaccccttcatcagctgtgacgcccgtcctgaacgaatcaggaacctcacccacaacaagtaaccactcacggtatgtggccactgacatcaacttgaacaacagtttcccagccgacggccaacctgttgagcaggtcgtcgtgacactaccaagctgccccagtttgcccatgcagccactgatcgcccagcctcaggtgaagtcgcagccacccaagaatatactccccctgaatagcgctatgcaggtaattcaaatggcccagcccgttggcagtgcagtcaatagtgcccctaccaaccagaacgtcatcattctgcagcccccttccaccactccttgcccaacagtaatgcgggcggaagttagcaatcagacagtgggtcagcaaatcgtgatcattcaagccgccaaccagaatcccctgcccttgctcccagctccacccccagggagcgtcaggttacccattaacggcgcgaacacggtgattggatcaaacaactccgtgcagaacgtccctacgccacaaacattcggcggcaagcacttagttcacattctgcctcggccaagctcactctctgccagcaactctacccagaccttttcagtcactatgtcaaatcaacaaccacagacaatatcgctcaatggacagctattcgctctccaaccagtgatgtccagctcaggaaccacaaaccaaacccctatgcaaattatccaaccaacaaccagcgaagatcctaacactaacgttgcgctaaacactttcggggcacttgcatctctgaatcagtcgatttcccaaatggcgggccagtcttgtgtgcagctatctatcagccagcccgcaaatagccagaccgccgctaactcacaaacaactacagccaactgtgtgagcctgactactacagctgcgccacctgtgaccacagactccagtgcgacgctggcaagcacatataatttggtcagcacctctagtatgaacacagtcgcgtgcttgccaaacatgaagtccaagcgtcttaacaaaaaacctggaggcaggaagcaccttgctgctaataaatcggcatgcccccttaattccgttagggatgtttcaaagttagactgtcccaatacagaaggcagcgccgagccaccttgcaacgatggtctcctggagtcttttccagcggtgctcccgtctgtgtctgtgtcacaagctaactccgtgagcgtgagcgcctcacattcactaggtgtcttgagttccgagtccctcattcctgaaagcgtttctaaatcaaagagcgccgaaaaatcaagtccgccttctcaggagagcgtgactagcgaacacttcgctatggcagcagctaaaagcaaggactctaccccgaaccttcagcaggagacctctcaggacaaacccccctcctccctggcactttctgatgctgccaaaccttgcgcctccgcaaacgtgctgattccaagtccatccgacccccacatcttggtgtctcaggttcctgggctctccagcactacttctacgacgagcacagattgcgtgtcggaggtggagattattgcagagccctgcagagttgagcaggacagcagtgacaccatgcagactaccggactcctgaagggtcaagggctaaccactttgctgtccgatttagcaaaaaaaaaaaatcctcagaagtcctccttgtcagatcaaatggaccatcctgatttttcctctgaaaatcctaagatagtagactccagcgtgaacctgcatcccaagcaagagcttctactgatgaataacgatgatcgggatcctccacaacatcatagttgtcttcccgaccaagaggtgatcaatggcagtcttatcaacgggagacaggccgacagtcccatgtcaacttcaagtggatcctcccgatcgttcagcgtggcttcaatgctgccagagacaaccagagaggatgtcacctcaaatgcaactaccaacacgtgcgatagttgcactttcgttgaacaaaccgatatcgtggcacttgcggctcgagccatattcgaccaggagaatttggagaaaggccgtgtggggctacaggctgatattcgggaggtggcctccaagccatccgaggcctcgttgcttgagggagacccccctttcaaaagccaaattcccaaggagtcgggtaccggacaggcagaggccacccccaatgagttcaatagccaggggtcgatagaggctacaatggagaggccactggagaaacccagctgtagcctcgggattaaaacctccaacgccagcctgcaggactccacctcgcagccccccagcatcactagcctaagtgtgaataatttgatccaccagtccagtattagccatccactagcctcatgcgcggggcttagcccaacatccgagcagactaccgtcccggccactgtgaatctgaccgtttcctcctcttcatacgggagccagcccccaggtcccagcctgatgacagagtattctcaggagcagcttaatactatgacttccaccattcccaacagccagatacaggagccactgctgaagccaagccatgagtccaggaaggattcggccaagagggccgtgcaggatgaccttcttttgtcttccgctaaacggcagaaacactgtcagcccgctcctctcaggctggagagcatgagcctgatgtccaggaccccagataccatcagcgatcagacccagatgatggtctcacagattccccctaattcatcaaactctgttgtgccagtgagcaaccccgcacacggagacgggttaacccgactgttcccgccttccaacaactttgttactcccgccctgagacagactgaggtccagtgtggcagtcagccaagcgttgccgagcagcagcaaacacaggcctcccagcaccttcaggctttgcagcagcacgtgccagcccagggtgtaagtcacctgcatagtaaccacctgtacataaaacagcagcaacagcagcagcagcaacagcagcaacagcagcagcaacagcaagctggtcagctccgcgagcgccaccatttgtatcagatgcaacatcacgtcccacatgcggagagcagtgtgcacagtcaaccacacaacgtgcatcagcagagaacgttacagcaggaagtccagatgcagaaaaagagaaacttggttcagggaactcagacatcacagctgagtttgcagcctaagcatcacggcaccgaccagagccggagcaagacaggacaacctcatccccaccatcagcaaatgcagcagcagatgcagcagcacttcggaagttcccagacagaaaagtcatgcgaaaatccctcaacatctaggaatcatcacaaccaccctcagaaccatctaaaccaggacataatgcaccagcagcaggatgtcggatccaggcagcagggttcaggggtttcaagcgaacacgtctcgggccataaccctatgcagcgcctactgaccagccggggtttggaacagcagatggtgtctcaaccctcaatcgtcaccaggtcttccgacatgacttgtactccacaccgccctgaaaggaaccgtgttagttcttatagtgctgaggctcttatcggaaaaacatcatctaactccgagcagcgaatgggtatctccattcaggggtcaagggtttcggaccagctggaaatgaggtcctacctggacgtgccccggaacaagtcgcttgccatccacaatatgcagggacgagtagatcatacagtggcctctgacattcgcctttcagactgccagaccttcaaaccttcgggcgcttctcagcagccacagagcaattttgaggtccaaagcagtaggaacaacgagattggcaacccagtctcaagcctccggagtatgcaaagccaggcgttcagaattagccagaataccggcccgccacctattgataggcagaaacgccttagctatcctcctgtgcagagcattcctaccgggaacgggatcccttcaagggacagcgagaacacatgccaccagagcttcatgcaatccctgttggcaccccatctgtctgaccaggtgatcggatcacaacgcagcctgagtgagcaccagcggaatactcagtgtgggcccagcagcgcgatcgagtacaattgccctcctacccacgagaacgtgcacatcagaagggagagtgagtctcagaatcgggaatcatgcgatatgtctctgggtgccatcaatacaaggaactcgacattaaatatccctttctctagcagcagttcatctggtgacatccaagggaggaacacttcacccaacgtatctgtgcagaaatccaatcccatgcgcataacagaaagtcatgccacaaaagggcacatgaaccccccagttaccactaacatgcacggcgtggccagacccgctttaccacatccttcagtgtctcacggtaatggcgaccagggaccggccgttcggcaagccaactcttcggtgccacagcgctctcgacaccccctacaggatagctctgggtcaaagattcgacaaccggagcggaacaggtcagggaaccaacggcaaagtacagtttttgacccatcactgccacaccttcccttaagcactgggggcagcatgatcctaggcagacagcagcctgccaccgagaaacgagggtctatcgtccggtttatgcccgattcacctcaggtgcctaatgataactcaggacctgatcagcacactttgtcccagaactttggattcagtttcattccagaaggagggatgaacccacccatcaacgcaaacgccagttttatcccgcaggtgacacaaccctctgctacgagaactcctgcccttatccccgttgacccacagaacacgctcccttcattttaccccccctattcaccagctcatcccactctctcaaatgacatctccattccctactttcccaaccaaatgttcagcaacccatccaccgagaaggtgaactccggctctctcaacaacaggttcggatcaattctgtcacccccacgcccagtagggttcgctcagccttcattcccacttctccccgacatgccaccgatgcacatgacaaacagccatctctcaaatttcaatatgacctcattgtttccggagattgccacagtgctccccgatggaagtgcaatgagccccctgctcacaattgcgaatagttccgcttccgactcttccaagcagtcttctaacaggcccgcccataatatttctcacatattgggacacgactgctcatccgcggtatag

SEQ ID NO: 12892 - DNA, 216 bp, Artificial Sequence
  Description of Artificial Sequence: Synthetic coding sequence
atgaagcagcttaagcgtaagagaaagtcgaacttcagcgtgcaggagacacaaacacttcttaaagagatcaccaaacgtaaggaagtgatcttttccaaacaattgaacaccacaatcaatgtgatgaagcggatggcttgggaggagatcgcgcagtgtgtgaatgccgtgggagagggagagcagaggacaggaactgaagtaaaacggtag

SEQ ID NO: 12893 - DNA, 591 bp, Artificial Sequence
  Description of Artificial Sequence: Synthetic coding sequence
atgaaacagctcaaacggaaaagaaaatctaattttagtgtccaggagacccagactcttctgaaagagattaccaagagaaaggaggtaattttttccaagcaattgaacactaccatcaatgtaatgaagaggatggcgtgggaagagattgcccaatgtgtcaacgccgtcggtgaaggcgagcagcggacgggaaccgaggtgaagaggcggtaccttgactggagagccctcatgaaacggaagcggatgaaagcaaacattaagctggtcggctctggattccctttgccctcctccgatctggacgatagcttgactgaggagatagatgagaagatcggcttccggaacgacgctaatttcgattggcaaaacgttgctgattttagagatgccggagggtctttgaccgaggttaaagtcgaggaagaggagcgagatccccagtctccagagttcgagattgaagaggaggaagagatgctgtcatccgtgattcctgattcccgaagggagaatgagcttccagacttcccccatatcgatgagttcttcaccctgaactccaccccctcgcgatcctag

SEQ ID NO: 12894 - DNA, 336 bp, Artificial Sequence
  Description of Artificial Sequence: Synthetic coding sequence
atgaaacagctgaagaggaaaaggaagtctaatttttccgtgcaagagactcaaacactcttaaaggagatcacaaaaaggaaggaggtgatcttctctaagcagctgaatacaacaataaatgtcatgaaacgcatggcctgggaggagatcgctcagtgcgtgaatgctgtcggcgagggtgagcagcgtacggggacagaggtgaagaggcgctacttggattggagggccttgatgaagcgcaagaggatgaaagcaaatatcaaactcgtgggatcaggtttccctctgcccagtagcgatctcgacgactcgctcaccgaggaaatctag

SEQ ID NO: 12895 - DNA, 1158 bp, Artificial Sequence
  Description of Artificial Sequence: Synthetic coding sequence
atgcaagcctgcggcgggggagccgcaggaaggcgggccttcgacagcatttgccctaaccgtatgctggccctgccaggccgagcccttttatgcaagcctggtaagcctgaacggaaattcgccccaccacggaaattcttcccaggctgcacgggggggtctcccgtttcggtttatgaagacccccctgatgccgaaccgacagcactgccggccctcacgacgattgatttacaggacctggctgactgctcttcattgctgggtagtgatgccccgccagggggggatcttgccgcttcccagaaccacagccatcagacagaggccgacttcaacctccaggacttccgcgataccgtggacgacttaatttctgatagcagttcaatgatgagcccaactttagcaagcggcgatttcccattctctccgtgcgacatcagccctttcggtccgtgcctgtccccacccctggatccccgtgcactgcagtcgccgccactccggccccctgatgtaccacccccagagcagtactggaaagaggtggccgaccagaaccaacgggccctaggtgacgccctcgtggagaacaatcagctgcatgttaccttaacacagaaacaggaggaaattgcctcgctgaaagaacggaacgtccagttgaaggagttagcgtctcgtacgaggcacctagcatcagttctggacaagctcatgatcacgcaaagccgggattgcggcgcagccgcagaacccttcctcctcaaagctaaggctaagagaagcctggaagagctggtgagtgcggcggggcaggactgtgccgaagtggacgcaatcttgcgtgagatcagtgagagatgcgacgaggccttgcaaagccgtgatcccaagaggccacgactactgcctgagcctgccaatactgataccagacccggtaatctgcacggcgctttcagaggcctcagaacggactgctcccgcagtgccctcaatctctcccattccgagctcgaagaaggaggctctttcagcacacgcatccgaagtcattcaaccatcagaaccctcgcttttccacaaggaaacgcgtttactatcagaaccgccaacggcgggtacaaatttaggtgggttccctcttag

SEQ ID NO: 12896 - DNA, 1866 bp, Artificial Sequence
  Description of Artificial Sequence: Synthetic coding sequence
atggctgattttgaggagctccggaacatggtctcctcgttcagagtgagcgagttgcaagtcttattaggttttgctggcagaaataagtcaggacgaaaacatgacctactcatgagagccctgcatctgctgaaatcaggttgttcccctgctgtgcagattaaaatcagggagctgtacagacggcgatacccccgcacactggaaggcctgagcgacctgagtacaatcaagtcttccgtgtttagcctggacggtggcagcagcccagtagagcctgatctcgctgtcgctggtattcattccctaccctccacaagcgttactccccacagcccctcgagccccgtcggatccgtactactgcaggatacgaaacccacgtttgagatgcagcaacccagccctccaatccccccagtgcatcccgacgtacagcttaagaacctgccattctacgatgtgctagacgtgttaatcaaaccgacctcgcttgtgcagtcaagtattcagagattccaggaaaaatttttcatctttgcactcacgccccagcaagtacgggaaatctgtatttcccgcgactttctgcctggcggccgtagagactacacagtgcaggtacagctcagactctgcctcgcagaaacgtcctgtccccaggaggacaactacccaaactccttgtgcatcaaggtcaatggtaagctctttcccttgccagggtacgctcctcctccaaagaatggaattgaacagaaacgacccggcaggcccctgaacataacaagtcttgtgaggctgtccagcgctgttcccaaccaaatatctatttcctgggctagcgaaattggtaaaaattactctatgagcgtctatttggttaggcagttgacatccgcaatgcttctccagagactgaagatgaagggcatccggaatcccgatcatagtagagctctgattaaggaaaagctgaccgcagatcccgattccgagattgccaccacttcactgagggtctctctgatgtgccccctcggcaagatgcggctcactatcccctgcagggccgtgacctgtacccacctgcaatgctttgacgccgctctctacctgcagatgaacgaaaaaaagcccacatggatttgcccagtgtgcgacaaaaaagccgcctacgagtccctaatcctggatggattatttatggagatcctcaacgattgctctgacgtggacgagatcaagtttcaggaggacggctcttggtgtccgatgcgacccaaaaaggaggccatgaaggtttcctctcagccttgcactaagatcgaatcctcgtctgtgttgagcaagccatgttccgtaactgtggccagcgaagcatctaaaaaaaaagtggatgtgatcgaccttactatcgagtcctcatctgatgaggaggaagacccacctgctaaacgtaaatgtatatttatgtctgagacgcagagctcacctacaaagggggttctgatgtatcagccatcatccgtaagagttccctcggtcacttctgtggaccctgcagctattcctccctctctaaccgactacagcgtgccatttcaccacaccccaatatcatcaatgagctccgacctgcccggactcgacttcctatccctgattcctgtggacccccagtactgcccccctatgttcttggacagtctcacttccccccttacagcctcgagtacttcagttaccaccacctcaagccacgagtcctcaacacacgttagcagctcttctagtcggagcgaaacaggtgtgattacgtcatccggctcaaacattcctgacattatctccctcgactag

SEQ ID NO: 12897 - DNA, 1866 bp, Artificial Sequence
  Description of Artificial Sequence: Synthetic coding sequence
atggccaattttgaagagattatcaatatggtctcctcttttcgcgtctccgaactgcaagttctcttgggctttgccggaaggaataagagcggacgtaagcatgacctgttgatgcgtgctctgcacctgctgaagtccggctgcagtcctgctgttcagattaagattagggaactctacaggcgacggtatccccgaacgctcgagggcctgtccgacctgagtactatcaagagctcagtgttctccctggatggaggatcaagccccgtggagccagatctggccgttgctggcatccattccctaccaagcacctcggtaactccccactcccctagctctccggtgggatcagtcttactgcaggataccaaaccaactttcgagatgcaacagccgtccccccccattcccccagtccatccagatgtgcagctgaagaacctgccgttctatgacgtgctggatgtactcataaaacccacttcgctcgtgcagagcagcatccaacggttccaggagaagtttttcatctttgccctgactccccagcaggtccgcgagatctgtatcagtcgagattttttacctggcggtcgtcgagattataccgtgcaagtccagctgcggctatgtttagccgaaacatcctgcccccaagaagataattaccccaactctctgtgtatcaaagtgaatgggaagttattccccctgcccgggtacgctccgcctccaaagaatggcattgagcagaagcggccaggcaggccgctgaacatcaccagcttggtgaggctgtcatcagccgtaccaaaccagatctcaatcagctgggccagcgaaataggaaagaactatagtatgtccgtctatctggttcggcagctcacatcagcaatgctattgcagcgtctgaaaatgaagggtattcgtaatcctgaccactcacgggccctaatcaaggaaaaactcacagcggatccggactctgaaattgccacaacatccctcagggtgtctctgatgtgtccccttggaaagatgcgtctgactataccttgcagggcagttacatgcactcatctgcaatgcttcgatgccgctctgtatctccaaatgaacgaaaagaagcctacttggatctgccccgtgtgtgacaaaaaggctgcctatgaatcattgatactagatggtctcttcatggagatcttgaacgactgttctgacgttgatgagatcaaattccaggaagacgggtcttggtgccccatgcgcccgaaaaaagaggccatgaaagtttcctcccagccgtgcaccaaaatcgagtctagctctgtgttgtctaagccttgcagtgtaacagtcgcctctgaggccagcaaaaagaaagtcgacgtgatagatttgacaatcgagtccagcagcgatgaagaagaggaccccccagcgaagagaaagtgcatttttatgtctgaaactcagagtagtcctacaaagggggtgctcatgtatcaaccctctagcgtgcgagtgccttccgtgaccagtgttgatccagctgcaataccacccagcctgacagattattctgtgcctttccaccacacccctatttcatccatgtcaagtgacctgcccgggttggatttcctgagcctgattcctgtcgatccccagtactgccccccaatgttccttgattccttgacaagtcccctcactgcctcttcaacttccgtgaccacaacaagtagccacgaatcatccacccatgtatcgtcctcatcctctcggtcggaaacgggagtaatcacatcatctggttcaaacataccagacattatttccttggactag

SEQ ID NO: 12898 - DNA, 1719 bp, Artificial Sequence
  Description of Artificial Sequence: Synthetic coding sequence
atggctgattttgaggagcttcggaatatggtgagtagctttagagtgtccgagctccaggtactcttgggcttcgcagggcgtaacaaaagcggcaggaaacacgacctgttaatgagagcccttcatttgctaaaaagcggatgtagtcccgctgtacaaatcaaaattcgcgagctgtataggaggcggtatcctcgaacccttgaagggctttccgatctaagcaccatcaagagttcagtgttttcactggatggaggatcaagtcctgttgaacccgacttggccgtggcaggcatccacagtctcccaagtacttctgtgaccccccacagtccatcttcacctgtggggtccgtgttgttgcaggacactaagccaactttcgaaatgcagcagccaagtccacctattcctccagttcacccggatgtccaactaaaaaacctgccgttctacgacgtcctcgacgtcctgatcaagccaacaagcttagtccagtcttccatacaaaggttccaggagaagttttttatcttcgctctcacaccacagcaagtcagggaaatatgcatcagtagagacttcctgcctggaggccgaagagactacacagtccaggtgcagctgagactgtgcctggcggagacgagttgcccacaagaagacaactatccaaactctctatgtatcaaagtgaatggaaagctctttccactccccggatacgccccccctccaaaaaacggcattgagcagaagaggcccggaaggccactcaatatcacgtccctcgtcagactctcctctgcagtgccaaaccaaatcagcatctcttgggcttcagagatcggtaagaactactctatgagcgtttacctggtgcgccagttaacaagtgcaatgctccttcagcgattaaaaatgaaggggattagaaatcccgatcactcccgggcactgattaaggaaaagttgactgctgaccctgacagcgaaatagccaccacatccctgcgagtttcgctgatgtgcccgttgggaaagatgcgcctgacgatcccttgtcgggcggtgacctgtacacatctccaatgcttcgacgccgctctatacctgcagatgaacgaaaaaaaaccaacttggatttgccccgtgtgcgacaagaaagctgcgtacgaatctcttattcttgacgggttgtttatggagattctcaatgattgcagcgatgttgacgagataaagttccaagaagatggatcttggtgcccaatgcgaccaaagaaggaagccatgaaagtgtcctcccaaccctgcaccaaaatcgagagctcctccgtcctaagtaaaccttgttcagtcacggtagcctccgaagcttctaaaaaaaaagttgatgtgatcgacctaacaatcgaatccagctccgatgaagaagaggatcctcctgccaaacgaaagtgcattttcatgtctgagacacagtcgtctcccacaaagggagtattaatgtaccagccgagttcggtgagggtgccctcagtgacgtccgtggatcctgccgccattcccccatctctcaccgattattcggtccctttccaccacaccccaattagcagtatgagttcggacttacctggcgagcaaaggcgtaatgatatcaacaatgaactaaaactgggcacttcttcagacactgtccaacagtag

SEQ ID NO: 12899 - DNA, 1191 bp, Artificial Sequence
  Description of Artificial Sequence: Synthetic coding sequence
cggaacttgaacaatatggtatctagttttcgggtttcagaactacaggtgttgctcgggtttgcagggcggaacaaaagcggtagaaaacacgacctgttaatgcgggcgctccacctactcaagagtgggtgcagccccgccgttcagataaagatccgggagttgtatcggaggagatatccacggaccctggagggactcagcgatttgagcactatcaagtcaagtgtgtttagtctcgatggcggtagctctcctgtggaaccggacctggctgtcgcagggatccactctttgccctccactagtgtgactccgcattcacccagctctccggtggggagtgttctactgcaggacacaaaacctaccttcgagatgcagcagccgtcccctccaattccacccgttcaccctgacgttcaactaaaaaacctccccttttatgacgtgctagatgttcttataaagcccactagcctggtacagtcatctatccaaagattccaggaaaagttttttatctttgcactgaccccacaacaagtgcgcgagatttgcatctccagagacttcctccccggcggtagaagggactataccgtgcaggtacagttgaggctgtgtctagccgagacatcttgcccccaggaggacaactaccccaattctttgtgtataaaagtgaacggcaagctgttccccctgccaggatacgccccaccaccgaagaatgggatcgagcaaaagagacccggaagacccctaaatattacctcgcttgtgagactgtccagcgctgttcccaatcagatctccatcagctgggcaagtgagatcggaaaaaattattctatgtccgtttacttagttaggcagcttacaagcgctatgctcctgcagagacttaagatgaaggggatcaggaatccagaccactcccgcgcccttataaaggaaaaactgaccgctgaccccgacagcgagattgcgactaccagcctgagggtgtccttgatgtgccctctgggaaaaatgaggctgacgatcccctgccgcgccgttacatgcacacatctgcaatgcttcgacgccgccttgtatctgcagatgaacgagaaaaaaccaacctggatttgccctgtgtgtgacaagaaagcagcatatgagtctctgattctcgattag

SEQ ID NO: 12900 - DNA, 1866 bp, Artificial Sequence
  Description of Artificial Sequence: Synthetic coding sequence
atggcagattttgaggagctgaggaacatggtctcttccttccgggtctcagaacttcaagtgcttctgggttttgccggacgtaacaagagcgggaggaagcacgatctcttgatgagggcgctgcatcttctgaagtccggatgttcgccggccgtccagatcaaaattcgggaactgtatcgccgacgatatccaagaaccctggaagggctcagtgatctgagcacaatcaagtctagcgttttctcgctggacggcgggtcatctcccgtggaacccgaccttgctgtcgccggtatacactctctcccttccacaagcgtgacaccacactcccccagctcacctgtgggaagcgtgctccttcaagacaccaaacccaccttcgagatgcaacaaccttcaccccctattccacctgttcaccccgacgttcagctgaagaatttgccattttacgacgtcctggacgtgcttattaagcccactagcctggtgcagtcgtctatacagaggttccaggagaaattctttatctttgcattgacgccccagcaggttcgagagatatgtatcagtcgggactttctgcccggcgggcgccgcgactacactgttcaggtccagttgagactttgcttagcagagacctcttgcccacaagaggacaactatcccaacagcctgtgtataaaagttaacggtaagttgttccctctgccaggctacgctcccccccctaagaatggtatcgagcagaagcgtcccggccggccattgaatatcactagcctcgtgaggctgagctccgcagtgccgaatcagattagcatttcttgggcttccgaaataggcaagaactacagcatgagcgtgtatctggttagacaattgacatcagccatgctgttgcagagactgaagatgaaaggaatacgaaatcccgaccacagccgagctctcatcaaagagaagttgaccgcggaccccgattcagagattgccacaacatcactacgtgtcagcttaatgtgtcccctaggcaaaatgaggttgactataccctgcagggccgtcacctgcacccatctccaatgctttgatgctgcgctatacctccagatgaacgaaaagaaaccgacatggatttgcccggtgtgcgataagaaggcagcctatgagagtctgattctggacggtttgtttatggaaattcttaatgactgttctgatgtggacgagatcaagttccaggaagatggatcttggtgccccatgcgacctaagaaggaggcaatgaaagtgagctcacagccttgcacgaaaattgagagctcatcagtgctttccaagccttgctcagttaccgtagccagtgaggccagcaaaaaaaaggtcgacgtgatcgacctcaccatcgaaagttcctctgacgaggaggaggacccaccagcgaaaaggaagtgcatattcatgtccgaaactcagtcttctccaacaaagggggtactgatgtaccagccctccagcgtgagagtgcccagcgttactagcgtggatcccgccgctatcccaccttctttaacggactattctgtgccatttcatcatacccccatatcttcaatgtcctctgacctgcctggacttgacttccttagtttgattcccgttgatccgcagtattgtccaccaatgttcttagacagcctgacatcgcctctaaccgccagttctacctccgtgaccaccacatcctcacacgagagttctacacacgtttcttcttcttcctcgaggtcagaaaccggtgtcattacatccagtggctcgaacatccccgacattataagcctggattag

SEQ ID NO: 12901 - DNA, 849 bp, Artificial Sequence
  Description of Artificial Sequence: Synthetic coding sequence
atgtctgtatatctcgtcaggcagctcactagtgctatgttacttcagaggctgaagatgaagggcataaggaatcctgaccactctagagctctgatcaaggaaaaacttactgccgatcctgattcagaaatcgccaccacctccctgagggtatcgctgatgtgccccttgggcaagatgcgcctcacaatcccctgccgcgccgtcacctgtacccacctgcagtgcttcgacgccgccctgtacttacagatgaatgagaagaaaccaacctggatctgccccgtctgtgataagaaggcagcttatgaatctctgatactcgatggtctctttatggagatccttaacgactgttccgatgtggacgaaataaaatttcaagaggatggcagctggtgtcctatgaggcctaaaaaggaagcaatgaaagtaagctctcaaccatgtaccaagatcgagagtagttccgtgttgagcaagccctgttccgtgactgtagcttccgaggcctcaaagaaaaaagtggatgtgattgacctgaccatcgagagttcctcagacgaagaggaggaccccccagcgaagcgcaagtgcatctttatgtccgaaactcagagcagccccactaagggagtccttatgtaccagccttcctcagtccgtgtgcccagtgtgacttccgtggatcccgcagcaatcccacccagcttaacagattattcagtgcccttccaccacacgcctatcagttccatgtcatctgacctgccgggagagcagaggagaaatgatatcaacaatgagctcaaattgggaactagctctgatacagtgcagcagtag

SEQ ID NO: 12902 - DNA, 1023 bp, Artificial Sequence
  Description of Artificial Sequence: Synthetic coding sequence
atggagacagtgatatctagtgattccagcccggctgttgaaaacgagcatcctcaggaaactcccgaaagcaacaatagcgtatatacgtccttcatgaagagccataggtgttatgacttgattcccacctcttcgaagctggtagtttttgacactagcctgcaagtcaaaaaagcattcttcgcattggttacaaatggtgtccgcgccgctccattgtgggacagtaaaaagcagtcattcgtagtcctgagagccctgtcatgccccctcggcatgcttaccatcactgactttataaacatcttgcataggtactataagagtgccttagtgcagatttatgaactggaggaacacaaaattgaaacttggagggaggtgtatctgcaagactccttcaagcctttggtctgcatttctccgaacgccagtctgtttgacgccgtctcctcattaatcagaaataaaatacataggctgccagtgatcgaccctgagagtggaaacaccctgtatatactgacacataaaaggattctgaaatttctgaaactttttattacggaatttcctaaacccgagtttatgtctaagtcattagaagaactgcagatcggtacgtatgcgaatattgctatggtccgcacaactacacctgtgtatgtggctctgggaatattcgtgcagcatcgcgtgagcgccctgcctgtcgtggacgagaagggacgagtggtggacatctattctaaattcgacgtgataaacctggctgccgaaaaaacatacaataacctagacgtttccgtgactaaagccctgcagcacaggtcacactacttcgagggcgtgctcaagtgttacctccacgaaaccttggagaccatcattaaccgtctagtggaagctgaggtccatcgtcttgtcgtagtagatgaaaacgatgttgtgaaggggattgtgagccttagcgatattctccaggcccttgtcctgactggaggtgagaagaaaccttag

SEQ ID NO: 12903 - DNA, 900 bp, Artificial Sequence
  Description of Artificial Sequence: Synthetic coding sequence
atgaaaagtcataggtgttatgacctgatcccaacttctagcaagctcgtcgtttttgacacaagcctacaagtcaaaaaagcgttctttgctctcgttactaatggcgtgcgtgctgcccccctgtgggattccaagaagcagagtttcgtgggcatgttaacaattactgacttcataaacatactgcacagatactacaagtccgcgctggtgcagatctacgagcttgaggagcacaaaatagaaacatggcgagaggtctatttgcaggacagctttaagcctttggtctgcatctcaccaaacgcatctctgtttgacgccgtgtcctccctgattcggaacaagattcaccggctgcccgtcattgatccggagtccggcaataccctctatattctgacacataaacgcatcctgaaatttctaaaattattcattactgagttccctaagcccgagttcatgagtaaatccctggaagaattgcagatcggtacctacgctaatatcgcaatggtgagaaccacaacacccgtatacgtggccctgggtatctttgtgcagcatcgggtgagcgcgcttcccgttgtcgatgagaaaggccgtgtcgtagatatctacagcaagttcgacgtgatcaatctggcagccgagaagacttataacaatctggacgtcagcgtcacaaaagccttgcagcaccgctcgcattactttgagggcgtgcttaagtgctacttgcatgagacactggaaacgattatcaacagactcgtcgaagccgaggtccatcgccttgtcgtggtggacgagaacgacgtagttaaaggcatagtcagtttgagcgatatcctgcaggccctcgtactcacagggggcgaaaagaaaccttag

SEQ ID NO: 12904 - DNA, 2823 bp, Artificial Sequence
  Description of Artificial Sequence: Synthetic coding sequence
atgggcagcggcccaatcgatcctaaagagcttcttaaaggtctggatagcttcttgaaccgggacggagaggtgaaatccgtcgatggtatctcgaagatcttttccctgatgaaagaggcccgaaaaatggtgtcccgctgcacttatctcaatattctgctgcagacacgttcacccgagatcctcgtgaagttcatcgacgtgggaggatataaattgttgaacaattggcttacgtacagcaaaaccactaacaatattcccttactgcagcagatattgctaactttacagcatctgcccctaaccgtcgatcatctgaagcaaaacaatacagccaaattggtaaagcagttgtcgaagtcaagtgaagacgaggaactgaggaagctggcaagcgtgctagtcagtgactggatggcggtcatccgttctcagtcatctacgcagccggcagaaaaggacaagaaaaagcggaaggacgaaggtaagtcaagaactacactcccagagcgtccattgactgaggttaaggctgaaacccgagctgaggaagcacccgagaagaaacgggagaagcccaaaagtctgagaaccaccgctccatctcatgcaaagttcagatcgactggtttggagcttgagacgccctcactcgtccccgtgaaaaagaatgctagcacagtcgtggtgtccgataaatacaacctgaaacctatccccttgaaaagacaaagcaacgttgctgcacctggagacgccacacctccagctgagaaaaagtacaaacccctgaataccacacccaatgcaactaaagaaatcaaggttaagataatccctccacagcctatggaaggcttaggattcctggatgcattgaatagtgctcccgtgcctgggatcaagatcaagaaaaaaaaaaaggtgcttagcccaaccgccgcaaagccaagtcctttcgagggtaaaacatccaccgagccctctaccgccaaaccatcctcccctgagccagcccctccctctgaggccatggacgcggatcggccaggaacacctgtacctccggtagaggtaccggaactgatggacactgcctctcttgagccaggcgctctggatgccaagccagtcgagtctccaggggaccctaaccagttaacaaggaagggtagaaaacgtaaaagtgtcacttggcccgaggaggggaaattacgggagtatttctattttgaattggatgaaacagagcgagttaacgttaataaaattaaggacttcggcgaagccgccaaacgggagatcctatccgaccggcacgccttcgaaacagcccggcgtctgagccacgacaatatggaggaaaaggtgccctgggtgtgtccccgaccccttgtgctcccatccccacttgtgacaccagggagtaattcacaagagaggtatatccaggcagaacgcgagaagggaatccttcaggaactattcctcaacaaagagagtccacacgaacctgaccctgaaccgtacgaacctatccctcctaagctgatccctctagatgaagaatgcagtatggatgaaacaccctatgtcgagactctcgaaccaggtggcagcggcgggagccccgacggggccggaggcagtaaattgccgcccgtgctggccaatctgatgggcagcatgggggcaggaaaaggaccgcaaggccccggtggggggggaataaacgttcaagagattttaacatctataatggggtcaccgaatagtcatccatccgaggagttactcaagcagccagactattcagacaagatcaagcagatgctcgtacctcacgggctcctgggcccaggccccatagcgaatgggtttccccctgggggacctggcgggcccaaaggcatgcaacatttccctcccggaccggggggacccatgcctggcccgcacggaggtccaggtggacccgtaggtccgagactcctcggcccgccccctccgccaagagggggtgatcccttttgggacggacccggcgaccctatgcgcgggggtccaatgcgcggagggcctgggcccggccctggcccctaccacagaggacggggcggaagaggaggcaacgaacctccacccccgcccccaccctttcggggggcccgagggggtcgaagcggtggagggccacccaacggaaggggcgggcccggtggaggaatggttggaggaggcggacatagaccgcatgagggccctgggggcgggatgggaaactccagcgggcacaggccacatgagggcccgggcggtggtatggggagcgggcatcgcccgcatgagggtcctggcggatcaatgggtggcggcggaggacatagaccccacgaagggccgggcggaggcataagtggaggatccgggcatcggccgcacgaggggcccggggggggtatgggcgcaggaggtgggcacagacctcacgaaggacctggcggcagtatgggtggcagtggtggccaccgaccccacgagggacccgggcacggcggaccccacgggcatcgaccgcacgatgtgcctgggcataggggacatgaccacaggggaccacctccacatgagcacagaggccacgatggtcctggccatggtggcggcggccaccggggtcatgacggtggtcattcccacggaggtgatatgtccaaccggccggtatgccgccactttatgatgaagggcaattgtcgatatgagaacaattgtgcattttaccatcccggcgtcaacgggcctcctctgccatag

SEQ ID NO: 12905 - DNA, 2823 bp, Artificial Sequence
  Description of Artificial Sequence: Synthetic coding sequence
atggggtcaggcccgatcgaccctaaagaattactgaaaggattggattcatttttgaacagagacggggaagtcaagagtgtcgatgggatctctaaaatcttttcactcatgaaggaggccagaaaaatggtcagtagatgcacatatctcaacatcctcctgcagacaagaagccctgagattctagtaaagtttatcgacgttggtgggtataagttgctgaacaattggcttacttacagtaaaactaccaataacattcctctcttacagcagatccttctgactttgcagcatctcccactcaccgtggaccatcttaagcagaacaacaccgcaaaactcgttaagcagctgtcaaagagttcggaagacgaggaactacgcaaactagcctctgtgttagtctccgactggatggccgtgatccgatcccagtcctctactcagcccgctgagaaagataaaaagaagcgaaaagacgaagggaagtcgagaaccactctgcccgaaagacccttgactgaggttaaggccgagactagggcagaggaagccccggaaaaaaaacgggagaagcccaagtctctgaggactacagccccatctcacgccaagttccggagcaccggcctggaactagaaactccatctctggtgcccgtcaaaaagaacgcctcgactgttgtcgtcagcgataaatataatctcaaacctatacctctaaagcggcagtccaacgtcgcagccccaggcgatgccactcccccggcagaaaaaaaatacaaacctctgaacacaacccccaatgccacgaaggagattaaggtgaaaattattcccccgcagcctatggaggggctcggcttcctggatgccctgaacagcgcaccagtccctggcatcaagatcaagaagaagaagaaagtcctgtcaccaaccgccgccaaaccctccccctttgaagggaagacgtccaccgagccttcaacggcaaaaccgtcgagcccagagcccgctcctcccagtgaagccatggatgcggaccgccccggtacacccgttccgcccgttgaggtcccagagttgatggatactgccagcctggagcctggagccctcgacgccaagcccgtcgaaagcccgggagatcctaatcaattgactagaaaaggaagaaagagaaagagcgtaacttggcccgaagaagggaaactgcgggaatacttctactttgagttagatgagaccgagagggtaaatgtcaacaaaatcaaagactttggcgaggctgcaaagcgcgagattctttcggacagacatgctttcgagaccgcccggcgcctgtcgcacgacaatatggaggagaaggtcccttgggtgtgtccgagaccgttggttcttcctagccccttggtaacgcccggctctaattcacaggaaagatatattcaggccgaaagggaaaaggggatactccaggagctgttcctaaataaagaatccccccacgagcctgaccctgaaccgtacgagccgatacctcctaagctgatccccctcgatgaggagtgttccatggacgaaacaccatacgttgagactctggagccagggggtagcggtggatccccggacggcgccggagggtctaagcttccgcccgtgcttgcaaacctgatgggctccatgggggccggcaagggtcctcaaggccccggtggtggcggtatcaatgtgcaggaaattctaacatccatcatgggcagcccaaacagccacccaagcgaggagctgctgaaacagcccgactacagtgacaagattaagcagatgctggtgccacatgggcttctaggaccaggccccatcgcaaacggatttcctcccggcggtcccgggggccccaagggcatgcagcactttccacccggtcctggaggccccatgccaggtccgcacggtgggccaggcggcccagtcggccctagactgctgggcccccctccaccgcctagaggtggggaccccttctgggatgggcccggagacccaatgcggggtggtcctatgcggggcgggcctggtccaggccccggcccctaccataggggacgcggtggccgcggtggcaatgagccacctccgcccccacctcccttccgcggagcaagaggcggacggagtgggggcggccctccaaatgggaggggcggaccaggtggcggcatggtggggggaggaggccataggccacacgaggggcccgggggcggcatggggaactcttccgggcaccggcctcatgaaggaccaggtggtggcatgggatcgggccatcgaccacatgaggggcctggagggtccatggggggcggaggtggccacagaccccatgagggtcccggaggaggtataagtggaggcagcgggcacaggccccacgaaggacccgggggagggatgggcgcgggggggggccataggccacatgaaggccctggcggctccatgggtgggtctggggggcataggccacatgagggtcctggacatggaggccctcacggtcatagacctcacgatgtcccgggccacaggggacatgatcatcgcggacctccgccccatgaacacagaggacatgacggtccaggacatggagggggggggcatcgggggcatgacggcggccatagccacggtggcgacatgtctaatcggccggtttgtagacacttcatgatgaaaggtaactgtcgatatgagaacaattgtgccttctaccatcctggggtcaacggaccccctctcccctag

SEQ ID NO: 12906 - DNA, 2823 bp, Artificial Sequence
  Description of Artificial Sequence: Synthetic coding sequence
atgggaagtggacccattgacccaaaggaacttcttaagggactggattccttcctgaacagggacggggaggtgaaatcggtggacgggatcagtaaaatcttttcgctcatgaaggaggctcgcaaaatggtatctcgttgtacctacctgaatatactcctgcagacacggtctccagaaatcctggtcaagtttatagacgtagggggctacaaactacttaacaattggcttacttatagtaagacaacaaacaacatccccctactacagcagatcctcttaactttacaacacttacccttgactgtagaccatttgaagcaaaacaacaccgccaagcttgtgaagcagttaagtaaatcaagtgaggacgaagagttgaggaagctcgcctcagttctcgtttctgactggatggcagtcattcgctcacagtcttcaacccagccggctgagaaggacaagaagaagcgtaaggatgaggggaaatctaggacaaccctcccggagagaccacttaccgaagtgaaggccgagactcgcgcagaagaggctcccgaaaaaaagagagagaagccgaagagcttaagaaccacagctccgtctcatgctaagttcagatctacaggtttagagctcgaaacccccagtttggtgcccgtcaagaaaaacgccagtaccgtcgttgtgagcgacaagtacaaccttaaaccgattcccctgaaaagacagtccaacgtggccgcaccaggcgatgccaccccacccgccgaaaaaaaatataagccactgaataccaccccaaacgccacaaaagaaattaaggtcaaaatcattccccctcaaccaatggaaggactggggtttctggacgctcttaactctgcaccagtgcccgggataaaaatcaaaaaaaaaaaaaaggtactgagccctactgctgctaagcccagcccgttcgaaggcaaaacttctaccgagccttccactgccaagcccagctcccccgagcctgctccacctagcgaggctatggacgcggatcgacctggaacacccgtgccaccagtcgaagtgcctgaactgatggacaccgcgtccctggagcccggagccctagatgcaaagcccgtggaaagtcctggggatcccaaccagctgacccgcaaaggccggaaacggaagtccgtgacctggcccgaggagggtaaactgagagaatacttctactttgaattggatgagacggagcgggtgaacgtgaataaaattaaggatttcggtgaggctgcaaaacgggaaattttatctgacagacacgccttcgaaacagccaggcggctgtcccatgacaacatggaagaaaaggtaccatgggtctgtccgagacccctggttctgccctccccgcttgtgactcctgggagtaatagccaggagagatacatccaggcagaaagggagaaaggtatcctgcaagagctgtttctgaacaaagagtccccccatgaacctgaccctgagccctatgagccaataccacctaagctcattcctttggacgaggagtgctcgatggatgaaaccccatacgttgaaactttggagcctggaggctctggcggtagtccggacggggcaggagggagcaaattaccacctgtcctggccaatctgatgggctccatgggggccgggaaggggccccaggggcccgggggcgggggtattaacgttcaggagattttaacctcaatcatgggcagcccgaactcccatccgtctgaagagctgctgaagcaacctgactattcggataagattaagcagatgctcgtgcctcacggactgttaggaccaggccctatcgccaatgggttcccccccgggggtcctggtggccctaagggcatgcagcactttccgcctggccctggcggaccaatgccaggcccccatggggggcccgggggaccggtaggacctagactgttgggaccaccacctcctccgcgcggaggcgaccccttttgggatggacccggcgacccaatgagggggggcccaatgagaggcggacccggtcccgggccaggcccttaccaccggggcagaggcggaaggggcgggaacgaacctccccctcctcctcccccattcaggggcgctcgcggtgggcggtcaggcggaggccctcccaatggccgggggggccctggcggtggcatggtcggagggggcgggcacagacctcatgagggtccaggtggtggtatgggcaactctagtggtcatcggccacatgaagggcctggtggtggaatgggctccggacatcggccccatgaagggccaggtggttcaatgggaggaggcgggggtcaccgcccccacgagggaccaggcggtgggattagcggaggaagcggacaccggcctcacgaaggacctggcggcggtatgggggctggggggggccacaggccgcacgaagggcctggcggttccatgggtggcagtggtggccaccgcccccatgagggtcctggccatggggggcctcacgggcaccggcctcatgacgttcctggacacagaggccacgaccaccgtggacctcctccacatgagcacagaggacacgacgggcccggccacggaggcggcggccatagaggacatgacggcggccactctcatgggggcgacatgtccaataggcccgtttgtcgtcactttatgatgaaggggaattgcaggtacgaaaataactgtgctttctatcacccaggcgtaaatggtccccccctaccttag

SEQ ID NO: 12907 - DNA, 2823 bp, Artificial Sequence
  Description of Artificial Sequence: Synthetic coding sequence
atggggtccggacccatcgatcccaaagagctgctgaaaggcctggacagctttctcaatcgagacggcgaggtgaagagcgttgacgggatcagcaaaatattttcactgatgaaggaggctaggaaaatggtgtctagatgtacataccttaatatcctcctgcagaccaggtcccctgagattctcgtcaaatttattgacgttggcggatataaactgttaaacaattggctcacctactccaagaccaccaacaacattccgctcttacagcagattttactcacactgcaacacctgcctctgactgtggatcacctcaagcagaacaacaccgctaaacttgtaaagcagctgtccaaatcttctgaagatgaggagttgaggaaactggcaagcgttctcgtgagcgactggatggcggttattcgttctcagagcagtacacagcctgctgagaaagataaaaaaaagaggaaggatgagggtaaaagcagaaccacccttcccgaaagacccctgactgaagtgaaggcagaaacacgcgccgaggaagcaccggagaagaaacgtgagaagccgaaatcattacgcactacagcgcccagccatgcaaagtttagaagcacaggattggaactggaaaccccctccctggtgcctgtaaagaaaaatgcttctactgtggtggtctcagataagtacaacctgaagcccatccccctgaaaaggcagagcaacgtggccgcccctggagatgctacaccccccgcggagaagaaatataaacccctaaacacaactcccaacgctacaaaagaaatcaaggttaagattatcccacctcagcccatggaggggctgggatttctcgatgccttgaatagtgcccccgtacctgggatcaagattaaaaagaaaaaaaaggtgctttcccctaccgccgcaaaaccctcaccgttcgaagggaagaccagtaccgaacccagtacagctaaaccaagtagccccgagcctgccccaccaagcgaagcaatggacgcagacaggcccggtacccctgtgcccccagttgaggttcctgagctcatggataccgccagccttgaaccgggcgccttggacgcgaagcccgtggagagccccggcgacccaaatcagctgaccagaaagggtcgtaaacggaagagtgtaacttggcctgaggaaggtaagctgagggagtacttctacttcgagcttgatgaaaccgaacgggtgaacgttaacaaaatcaaggatttcggtgaagctgccaagagagaaattctttcagacaggcacgcattcgagactgcgagaaggctgagtcatgacaatatggaagaaaaagttccatgggtgtgccctaggcctctggtacttcccagccctctggtaacccccggcagtaattctcaggaacgctatatacaggccgaaagggagaaagggatcctgcaggagctgttcttgaataaggagtcgccacatgagcccgatccggagccctacgagcctatccccccgaagttgatccccctggatgaggagtgttctatggatgagactccctatgtcgaaacattggagcctggcgggagcggcggcagccctgacggggccgggggctcaaagctccctcctgtgctggccaacctgatggggtctatgggtgcagggaaaggcccccaggggcctggcggtggcggcattaatgttcaggagatcttgacgtccattatgggctctccaaactctcatccaagcgaggagctcctgaagcaacctgattactctgacaagatcaagcagatgctggtgcctcacggcctcctcggacctggcccaatcgccaacggcttcccaccaggaggcccgggggggcctaaaggcatgcagcattttccacccggccctggagggccgatgcctgggccacacgggggtcctggcggacccgtagggcctagactgctcggtccaccgccacccccgcgaggaggtgatccattctgggatggccccggagacccaatgcgcggtggtccaatgaggggcgggcctggtccagggccgggcccttatcacaggggtcggggcgggcgagggggtaacgagccgccacctcccccccctccctttagaggggctagaggagggagaagtggtggaggacctcctaatgggagaggtgggcccgggggcggtatggtcggtggcggcgggcataggcctcatgagggacctggcgggggcatggggaattcttccggccaccgtcctcacgagggccctgggggcggcatgggatccggacacagacctcacgagggaccgggcggctccatggggggggggggcgggcacagaccccatgaagggcccggtggcgggatctcaggcggctccgggcacaggccccacgaaggcccggggggagggatgggtgcaggcggcggacatcgcccacatgaaggcccaggtggatccatgggtggatcaggtggccacaggccacacgagggacccggtcacggggggccccacgggcatcgaccacacgacgtgcctgggcatagggggcatgaccatcgcggtcctccaccacacgagcaccgtgggcatgacggccctggccacggcggcggtggccaccggggccacgatggcggtcactcccacggcggggacatgtcaaatcgccctgtgtgccggcactttatgatgaaagggaactgccgctatgaaaacaattgtgcgttctaccatcccggcgtcaatgggcctccgcttccttag

SEQ ID NO: 12908 - DNA, 2823 bp, Artificial Sequence
  Description of Artificial Sequence: Synthetic coding sequence
atgggttcaggccccattgacccaaaggaactgctgaaggggttggactccttcctgaatagggatggcgaagttaaaagtgtagatggcattagcaagatctttagtttgatgaaggaggctagaaaaatggtgagccgctgtacctatttaaacattttattgcagactaggtcaccggaaatcttggtgaagtttattgatgtgggtggctataaactgttgaacaattggctgacctactctaaaaccaccaacaatattcctttgttgcagcagattctgctcacccttcagcatctgccccttaccgtggaccatctcaaacagaataacactgctaaacttgtcaaacaactgtccaaatcgagcgaagacgaggaactccggaagctcgcctctgttctggtttctgattggatggccgttattagatcccaatcctctacccaaccggctgaaaaagacaagaaaaaacgaaaggacgaagggaaatcaaggaccacgttacctgagcgacccttaacagaggtgaaagcggaaacccgggcagaggaggctcccgagaagaaacgtgagaagcccaagtctttgaggaccaccgctcctagtcacgctaaatttcggagcacggggctggagctggagactccaagtttggtccccgtgaagaagaatgcctccacagttgtagtctcagacaaatacaatcttaagcccatccctctaaagcgccagagcaacgtcgcggcacccggcgatgcgacaccccctgcggaaaaaaaatataaaccactcaacacaacccccaacgcaaccaaggaaatcaaggttaagattattcccccccaaccaatggaaggactgggttttttggacgcactcaacagcgctccagtacctggaattaaaattaaaaagaaaaaaaaggttctatcaccaaccgccgccaaaccatcccctttcgaaggcaagacctcaacagaaccgtcgacggcaaaaccctctagcccagaacctgccccaccatcagaggccatggatgccgaccggcctggaacaccagtgccccccgtggaggtgcccgaactgatggatactgcatcactcgaacctggagccctagatgccaagccagtggaatcgcccggggaccctaatcaattgacacgcaaaggaaggaagcgcaaaagtgttacatggcctgaagaaggaaagctcagagaatatttctactttgagttagacgaaaccgaaagggtgaatgtaaataaaatcaaagacttcggggaggcagcaaagcgcgaaattttatcggacagacacgctttcgagaccgctcgtaggctctcacacgataacatggaagaaaaagtgccgtgggtttgtccacgccctctcgtcctgccatctcccttggtcactccaggatcaaactcgcaagagcgatacatccaggcagaacgagagaagggcattctacaagagctcttcctgaataaagagagcccacatgagcccgacccagaaccatatgaaccaatcccgccaaaactgatcccgttggacgaggaatgcagcatggatgaaacaccgtacgtagagaccctggaacctggagggtccggtggatctcccgacggtgctggcgggtctaaacttccccccgtgctggccaacctgatgggatcaatgggggcgggtaagggcccacaaggccccggaggaggaggcatcaacgtccaagagatcctgacctcgatcatgggctctccgaattcgcaccctagtgaggaacttcttaagcagccagattattccgataaaattaagcagatgctcgtaccacacggacttctgggacctggcccgatcgcaaacgggttccctccgggtggccctgggggcccaaaaggaatgcagcactttcctccaggccctggcgggcccatgcccggaccccacgggggacccgggggaccagtcggcccacgattgctcgggccaccacctccaccacggggaggtgaccctttctgggatggacccggggatccaatgcggggaggtcctatgagagggggcccggggccaggacctggtccgtatcatcggggacgtggcggaaggggaggcaacgaacccccacccccgccacccccatttcgcggtgcaagggggggcagaagcggcggtggtcccccaaacgggaggggcggtcccggcggcggcatggtgggggggggtggacacaggccccacgagggccctggaggcggtatgggtaattcgagtggtcatcgaccgcacgaggggcccggtggaggcatggggagcggccaccgaccacacgagggccctgggggctccatgggaggcgggggcggccataggccgcatgaaggccctggcggtggcatcagtggtgggtccggccaccgccctcacgagggcccagggggcggtatgggcgccggcggcggccaccgaccccacgaggggccgggaggctctatgggtggctcgggcgggcacaggcctcacgaaggacccggacacggggggccacacggccaccgcccacatgacgtgcccgggcacagagggcacgatcatcggggccctcctccccacgagcatcggggtcacgatgggcctgggcacggtggagggggtcacagaggccatgatggtggccattcgcacggaggtgacatgtcaaataggcccgtctgtcgccattttatgatgaagggaaactgtagatacgagaacaattgcgctttttaccaccccggggtcaatggaccccctctgccttag

SEQ ID NO: 12909 - DNA, 2823 bp, Artificial Sequence
  Description of Artificial Sequence: Synthetic coding sequence
atgggatccgggcctatcgatcccaaggaactactcaagggattggactcgttcctgaacagagatggcgaagtcaagtccgttgatgggatcagtaaaatattctcgttgatgaaggaggccaggaaaatggtgagtcggtgcacatacctcaatatcctcttgcagacgcggtcaccagaaatcctggtgaagtttatcgatgtcgggggatacaaactgctgaacaactggcttacatattcaaagacaactaacaacattcctctgctccaacagatattactgaccttgcaacatctgcccctgaccgtagaccacttgaagcagaataacacggctaaactagttaagcaattatcaaaatcttcagaggacgaagaactaagaaagctggcttcagtacttgttagcgattggatggccgttatccgcagccagagctccacacagcctgctgagaaggacaagaagaaacggaaggatgaagggaagtcccggacaaccttgccagagagacctctaactgaagttaaggccgaaactcgggctgaagaggccccagaaaagaaaagagaaaagccaaagtctttgaggactactgcaccatcacacgcaaagtttcggtcaactggtctggaactggaaaccccatcgcttgtccctgttaaaaaaaacgctagtacggtagtcgtaagcgacaaatataacctcaagccgattccactcaaacgtcaatctaacgtggctgcaccaggggacgctacacctcccgctgaaaagaagtataaacccctcaacacaacaccgaatgcaaccaaggagattaaggtgaagatcattcctccccagcctatggaagggctaggattcctcgacgccctgaatagcgctccagtcccaggcatcaagattaaaaagaagaaaaaagtgctaagccctactgcagctaagccgtcccccttcgaggggaaaacatccacggagccttctactgccaagccatcttctcccgagcccgcgcctccttccgaagccatggacgcagatcgccccgggacgccagtaccacctgttgaagtgccagagctgatggacactgcctctttggagcccggcgcgctggatgcaaagccggtcgaatctccaggtgacccaaaccaactaaccaggaaaggccgtaaacggaaaagcgtgacctggccagaagaaggaaaactcagagagtatttctactttgaacttgacgaaaccgaacgggtaaacgtgaataaaattaaggacttcggcgaggctgcaaaacgcgaaatactttcagacagacacgctttcgagacagctaggcggctctcacacgacaacatggaagaaaaggtgccgtgggtgtgtccaaggccacttgttctgccgagcccgctcgttactcctggatccaattctcaagaacggtatattcaagccgagagggaaaaaggtatactgcaagagctgtttctgaataaagagagcccccatgaacccgatcctgagccttatgaacctattccccctaaattgattcctctggacgaggaatgtagtatggacgaaactccttatgttgagactctcgagccagggggcagcgggggcagccccgacggggcagggggctcaaaactgccaccagtattggccaacctaatgggatcaatgggtgcaggaaaaggacctcagggccccggaggtggaggcattaatgtccaggagattctgacatcaatcatgggaagtcctaacagccacccctcggaggagctgctcaaacagccagattattcagataagataaagcagatgctcgtgcctcatggcttgcttgggccaggcccgatcgcgaatggctttccacctgggggccctggtggtccaaaagggatgcagcacttccccccaggtccaggcgggcctatgcctggcccgcatggcggccctgggggcccagttggtccacgcctgctgggcccaccacccccccctagggggggcgatcccttctgggatggcccaggcgacccaatgaggggcggccctatgcgaggcggcccaggccctggacccgggccttaccaccgaggaagaggtggcagaggtggcaatgaaccaccgccacctccacccccattccgaggggcgcgcggaggcaggagtggcggcggccctccaaacggccggggaggtccaggaggaggcatggtcggaggcggaggacacagaccccatgaaggacccggcggtggcatggggaacagttcaggacaccgtccacacgaaggaccagggggcggcatggggagcggtcacagaccccatgaggggcccggcggcagtatgggggggggtgggggtcatagacctcacgaaggaccaggaggcggcatttcaggaggtagcgggcacaggcctcacgaaggacctggggggggcatgggtgctggaggaggacaccgaccccacgaagggcccgggggctctatggggggatctgggggacacagacctcacgaaggaccgggtcatgggggccctcatggccacaggccacatgacgtccctgggcatcgggggcacgaccacagaggacctccaccccacgagcatcgaggccacgacggaccaggccacggggggggtggccacaggggccacgatggaggacactcgcatggtggggatatgagcaacaggccggtatgccgacacttcatgatgaagggcaactgtaggtacgagaacaactgcgctttttaccacccgggagttaacggaccacccctgccatag

SEQ ID NO: 12910 - DNA, 2823 bp, Artificial Sequence
  Description of Artificial Sequence: Synthetic coding sequence
atgggaagcggaccaatcgatcctaaggaactgctcaaggggctggattcattccttaatcgggacggcgaggtgaagtctgtggacggtattagcaagattttcagcttgatgaaggaagcacgtaaaatggttagcagatgcacttacctaaatattttattacagaccaggagccctgaaattttagtcaagttcatcgacgtgggcggatacaaactcttgaataattggttgacttattctaagaccactaataacattcctctactgcagcagattttgttaaccctgcagcatcttccactcaccgtggaccatctcaagcaaaacaataccgctaagcttgttaagcagttgagcaaaagctcggaagatgaggaactgaggaagctcgctagtgtactagtgagtgattggatggcagtcattcgctctcagtcttccacacaaccagctgaaaaagataaaaagaagaggaaggatgaaggcaaaagcagaaccactcttcccgaacggccattgacggaggtgaaagctgaaacaagggccgaagaggcccccgagaaaaaaagagagaagcctaagtcactaagaactacggcccccagtcatgcaaagtttagaagcacgggcctggaactggaaaccccgtccttggtacctgtcaagaaaaacgcatcgacggtggtggtctctgacaagtacaatctcaaaccaatcccactgaaaaggcagtccaatgtcgcagctcctggagatgccactcctccggcagagaaaaaatataagccgctaaacactacccctaatgcaaccaaggagatcaaagtgaaaattatcccgccccagccaatggagggcttgggcttcttggacgccctcaacagcgccccagtgcctggaatcaaaatcaaaaaaaagaaaaaagtattgtcacctaccgcggcgaaacccagtccttttgaagggaaaacctccactgaaccatccaccgccaagcccagttcccctgagccagccccgcccagcgaagcaatggatgctgatcggccaggcacgccagtgcccccggttgaggtacctgaattaatggataccgcatccctggagccaggcgccctagacgccaagcccgtcgagtctcctggagaccccaatcagctgactcggaagggaaggaagcgcaaatccgttacttggccagaggagggaaagctcagagagtatttctattttgagttggatgagacagaacgcgtgaatgttaataagataaaggactttggcgaggccgctaaacgggagattctgagcgatcggcatgcatttgaaacggcccgcagactttcccacgataacatggaggaaaaggtgccgtgggtgtgccctcgccctctcgtactgccctccccacttgttactcctgggtcaaatagccaagagaggtacatccaggccgaaagggagaaaggtattctacaggagctgttcctaaataaagaaagcccccatgaacctgaccccgaaccttacgaacctatcccacctaagctgatcccacttgatgaagaatgttcaatggacgagacaccatatgtcgagaccctggaaccagggggctccggagggtcccccgatggagccgggggtagcaaactgcctccagttttagccaacctgatgggctccatgggcgctggtaaaggtcctcaggggccgggcgggggcggcatcaatgtccaggagattttaacatcaatcatgggatctcccaacagccacccatccgaggagctccttaagcagcccgattacagcgataaaatcaaacagatgctggtccctcacggcctccttgggcccggtccgatagcaaatgggttcccaccaggtggacctggcggaccaaaagggatgcagcactttcccccggggcctggaggtccgatgcccgggccgcatggaggccctggcggccctgtcgggcctcggttactggggcctcctcccccaccccgcggcggcgacccattctgggacggccccggtgacccgatgcgaggaggtccaatgcgcggcggccctgggcctggccccgggccataccaccgtgggcgggggggacgcggcggcaatgagccacctcccccaccgccacccttcaggggggcgagaggcggacggagcggcggtggcccacccaacggcagagggggcccaggcggagggatggtcgggggtggcggccaccgacctcacgagggaccgggggggggtatggggaactctagcggacaccggccccatgaagggcccggcggaggcatgggtagtggccaccggccccatgaaggacccggggggtctatgggaggtggcggtggccatcgaccacacgagggaccgggaggcggtatcagcggcggctcaggccaccgcccccacgaggggcctggcggcgggatgggcgccggggggggccataggccacatgaaggaccgggcggcagtatgggcggatcggggggacacagacctcacgaggggccgggccatggcggaccccatggacataggccccatgatgtccctggtcatcgcggacatgatcaccgaggaccacctccacacgagcacaggggacacgacggccccggccacggtggaggcggccatcgcgggcatgacggcggtcactcgcatggcggggatatgtccaatagacctgtttgtcgtcatttcatgatgaagggtaattgtcggtacgaaaacaactgcgccttctatcaccctggggtaaatggaccacctctaccatag

SEQ ID NO: 12911 - DNA, 939 bp, Artificial Sequence
  Description of Artificial Sequence: Synthetic coding sequence
atgggttctggccccatcgacccaaaggagcttctgaaggggcttgattccttcctgaacagggacggtgaggtcaaatcagtggatgggatatctaaaatcttttcattgatgaaggaggctcgtaagatggtcagccggtgtacttacctgaacattctgctccagacaagatccccagagatcttggtgaagtttattgacgtgggagggtataaattgctgaacaattggctgacctattccaagactaccaacaacattccattgttgcagcagattctgctaactctgcagcatcttcctctaaccgtggatcacttgaagcaaaataacactgcaaaattggtcaagcagctgtctaagtcttcagaagacgaagagttacggaagctggcgagtgtactggtgagcgattggatggcagtcattcggagccagagctccacacaacctgccgagaaggataagaaaaaacgcaaggatgaggggaagagtcggacaactctgcctgagaggcccctaacagaggtaaaggctgaaacacgggccgaggaggctccagagaaaaaaagggagaagccgaaaagtttgcgcacaacagccccgagtcacgccaagttcaggagtactggcctggagctggagacccctagcttagtgcccgtcaagaaaaatgctagcaccgttgtggtatctgacaagtacaacctcaaaccgatcccactaaagagacagagcaatgtggcggcccccggcgatgcaacaccaccggccgagaagaagtataagcccctgaataccactcccaacgcaacaaaagaaataaaagttaagatcataccgccccaacctatggaaggcctgggattcctcgatgcactcaattcagccccggtgcctgggattaaaatcaaaaaaaaaaagaagaagaagtag

SEQ ID NO: 12912 - DNA, 939 bp, Artificial Sequence
  Description of Artificial Sequence: Synthetic coding sequence
atggggagcggcccaattgatccgaaggagttactcaagggactggacagcttcttaaaccgggacggtgaagtaaaatcagtcgatggcataagtaagatcttttctctgatgaaggaggcccgcaaaatggtaagtcgttgcacgtacctgaatattcttttgcagacaaggtctccagagatcttagtaaaatttatcgatgtgggcgggtataaactactcaataattggttgacctactccaagacaactaacaatatccccctgctgcagcagattttgttgacgcttcaacatttgcccctgacagtggatcacctcaaacagaacaataccgcaaaactggtgaagcagctcagcaagtccagcgaggacgaagagttacgcaaacttgcctcggtactggtttcggactggatggccgtaatccgcagtcagagctccactcagccggctgagaaagacaaaaaaaaaaggaaagacgagggtaagtccaggacgacgttgcctgagcggcctctgaccgaggtgaaggcagaaacgagagccgaagaggctcccgaaaagaagagagaaaaaccaaagtcgttgcggaccacagcaccctctcacgccaaatttcggtccaccggcctcgagctcgagaccccgagcctcgtaccagtgaagaaaaacgcttcaacagtggtggtgtcagataagtacaacctgaaaccaatacctctgaaacggcagagcaatgtggccgcccctggagacgcgacgccaccagcggagaagaagtataagcctcttaatacaaccccgaatgccacgaaagaaattaaagtgaagatcattcctccccaaccaatggaggggctgggctttctagacgcactgaatagtgcaccagtgcccgggatcaaaattaaaaaaaagaagaaaaagaagtag

SEQ ID NO: 12913 - DNA, 939 bp, Artificial Sequence
  Description of Artificial Sequence: Synthetic coding sequence
atgggctccggccccattgatcccaaggaactgctgaaagggctggactctttcctgaacagagatggtgaggtaaagtccgtagatgggatatctaaaatcttcagcctgatgaaagaggcccggaagatggtgagccggtgtacatacttgaacatcttactccagacccggagccctgaaattctggtgaaatttatcgacgtgggcggatataagttgctaaacaattggctcacctatagtaaaaccactaataacatccccctgctgcaacaaattctgctgaccctgcagcatcttcccttaaccgtggatcacctgaagcagaacaatacagccaagctggtgaaacagttgtcgaaaagctctgaagatgaggaacttcggaagctggcatccgtgctggtctcagattggatggctgtgatacggtctcagtcctctacacagccagcagagaaagataagaaaaaaagaaaagatgagggtaaatcacgcacgactctgcctgagagacctttgactgaggtgaaagccgaaacacgggctgaggaggctcctgagaaaaaacgggagaaaccgaaaagcctgcgcaccacggccccatcgcacgcgaaattccggtctaccggtttagagcttgagacacccagtttggtcccggtcaagaaaaacgcctcgaccgttgtcgtgagcgacaagtataatctgaagcccatacctctaaaaaggcagagcaatgtagccgcccctggcgacgcgacccccccggcggaaaagaaatacaaacccctgaacactacaccaaatgccaccaaggagatcaaggtcaaaattatcccaccacagcccatggagggcctagggtttctggacgcacttaactctgctccggtgcccgggatcaagatcaaaaagaaaaagaaaaagaaatag

SEQ ID NO: 12914 - DNA, 939 bp, Artificial Sequence
  Description of Artificial Sequence: Synthetic coding sequence
atgggctctgggccaatcgaccctaaagagctgttgaaaggcttagattccttcctgaacagagatggagaggttaagtctgtcgacgggatctctaagattttttccctgatgaaagaggcacgtaaaatggtgtcgcgctgcacatacctgaacattcttctgcaaacccgttcacccgaaatcttggtgaaattcatcgacgtagggggctacaaactgctgaacaattggctgacatactcgaagacaactaataacatcccactgctccagcagattttgttgacgctgcagcacctgccgctgacggttgatcacctcaagcagaacaataccgccaaactggtcaagcagctgtctaagagctctgaagacgaagagttacgaaaactcgcaagcgtgctcgtgagcgattggatggcagtgatccggagtcaaagctcaacgcagcccgctgagaaggacaaaaaaaaaagaaaggatgagggcaagtcccgtacaacattgcccgagagacccctgactgaggtgaaggctgagacaagagctgaggaggcccctgagaagaaaagggaaaagcctaaaagcctacgcaccacagcacctagccacgccaagtttaggagcactggcttagagctcgagaccccaagtcttgtcccggtgaaaaagaacgcctctacggtggtggtttctgataagtataatctcaaaccaatccccttgaaaaggcagtcaaacgtcgcagctcccggagatgccaccccaccagctgaaaaaaagtacaagcctctgaatacaactccgaacgctacgaaggagatcaaggtgaagattatccccccacagccaatggaaggtttgggctttcttgatgctttgaactccgctcccgtgccaggaattaagatcaagaagaaaaagaaaaaaaaatag

SEQ ID NO: 12915 - DNA, 939 bp, Artificial Sequence
  Description of Artificial Sequence: Synthetic coding sequence
atgggttccggcccaatcgaccccaaggagctgctcaagggcctggactccttcctcaaccgtgatggggaggtgaaatcagtggacggcataagcaagatttttagtctgatgaaagaagcccggaaaatggtgtctcgctgtacatacttaaatattctgctacagactcggagccccgagattctcgtgaaatttattgatgttggcggatacaaattgctgaacaactggttgacttactctaagacaaccaacaacattccactgcttcaacaaatccttttaaccctgcagcaccttcccctgacggtggaccacctaaagcagaacaataccgcaaagctagtcaaacagctgtccaaaagttccgaagatgaagaactgcggaagctggctagcgtcctggtgtcagactggatggccgtgatacgctcacagagtagcacacaacctgcggagaaggataagaagaagaggaaagacgagggcaagagtcgcaccactctaccagaacgtcccctcacagaggtgaaggcagagacaagggccgaagaagcaccagagaagaaacgagaaaaaccaaagagcctccggacaacggctccatcacacgccaagttcagatcaactgggctggagttagaaaccccatcactggtacctgttaagaagaatgcatctactgtggtcgtgtcagacaaatacaatctcaaaccaattccgctgaagcgacagtcgaacgttgcagccccgggcgacgcgacccccccagccgagaagaagtacaaacccttaaacacaacgccaaacgcaaccaaggagatcaaggtcaaaataatccccccacaacccatggaaggattgggctttctggacgcactcaactcggcacccgtgcctggcatcaagattaaaaaaaaaaaaaagaagaaatag

SEQ ID NO: 12916 - DNA, 939 bp, Artificial Sequence
  Description of Artificial Sequence: Synthetic coding sequence
atgggctctggcccgattgatccgaaagagcttctcaagggattagactctttccttaatagggacggcgaagtaaagagcgtggatggcattagtaaaatcttttcattgatgaaggaggctcggaagatggtgagtcggtgtacatacctgaacatcctgttgcagactcgcagccccgagatattagtcaagtttattgacgtgggaggctacaaattacttaataattggctcacctattctaaaaccactaataacatacccttgcttcaacaaattctgctcaccctgcagcacctgccgcttactgtcgatcacctcaagcaaaataatacggccaaactcgtaaagcaactctccaagagcagcgaagacgaggaactaagaaagctagccagcgtccttgtaagcgactggatggctgtgattcgtagtcagagctctacccagcctgcagagaaggataaaaaaaagcgaaaagacgaggggaagtcaaggactaccttgcccgagagacccctgacggaagtcaaggcagagacacgagccgaagaggctcctgagaagaagcgcgagaaaccaaagtccctgagaaccaccgctccaagtcatgcaaagttcagatccacaggcctcgaacttgagacaccttccttggttcccgtgaagaaaaatgcctcaaccgtggtcgtctcagacaaatacaacttgaaacctatccccctaaagagacagagcaacgttgctgcccccggggacgcaacgcctcccgctgagaagaagtacaaacccctgaataccaccccaaacgcaacaaaggagatcaaggtgaagatcatacctccacagcccatggaaggcctcggctttctcgacgcactcaactctgcgcccgtccccggaatcaagattaagaaaaaaaagaagaaaaaatag

SEQ ID NO: 12917 - DNA, 939 bp, Artificial Sequence
  Description of Artificial Sequence: Synthetic coding sequence
atgggatctggcccaatcgacccgaaagaactgctaaagggccttgacagcttcctgaatagggatggagaagtgaaatcagtagatggcatatccaaaattttctcacttatgaaggaagcgcgcaagatggtttcccggtgcacctacctcaatatcctactccagacacggtctccagagatcctggtaaagtttatcgatgtcggggggtataagttactgaataattggctgacttattctaagaccactaacaacatacctcttctccagcagattctgcttaccctgcaacatctaccattgacagtggatcacttaaagcaaaacaatacagctaaactggtgaaacagctgtctaaatcaagcgaggacgaggagctgaggaaacttgcctccgtcctcgtgtctgactggatggctgtcattcgtagccagtcgtccacccagccggctgaaaaagacaagaaaaaaagaaaagacgaagggaaatcaaggacaacgctgcctgagcgcccgcttactgaggtgaaagcagaaacgcgcgcagaggaagccccggagaagaaaagagagaagcccaagtcattgaggacgactgcccctagccatgcaaaattccgctccaccggcctagaactcgagactccgagtctggtgccagttaagaagaatgcatccactgtggtagtctcagacaaatataacctgaaaccgataccccttaaacggcagagtaacgtcgctgcaccgggagatgctacaccgcctgcagagaagaagtataaacctttgaacaccaccccaaacgccacaaaggaaataaaagtcaagatcatcccaccccaacccatggagggtctgggtttcctcgatgcactaaattccgcccccgtgcctggcatcaagatcaagaaaaagaagaagaaaaagtag

SEQ ID NO: 12918 - DNA, 3630 bp, Artificial Sequence
  Description of Artificial Sequence: Synthetic coding sequence
atgtttctcatgaacgcctcccccgtggtagcactgcagagtaagtgggaagcttttgggccccctggctcatgtcgctttccccgatgctttagtgaagcagacgagggggtcgaaagtgcctcggtgagcgcccgggtgcaaatgcttatctctacactccagcgagatggcgcggccagaggaacctctgacgagcgggcagcccagcgcggccatcgagcagagggctgtcacgatgccagacccgctgccaaacctaccgttcataaggagcctcccgccctggcagtatgtggccttgttgccgacttcgacccaatgggagaggaggaaaccactgactttggccccctggttctggattcagattctgatgacagcgtagatagggatatcgaggaggcgatccaagaatatctgaaagccaagtctggagccgctcagcctggagctggaggcgcccagccgggagctgcccagcctagtagagccgccggaggcggttcaagatgtaaacccgaacctgcccatggcagcgctcccacagctctctgcccccccaagttggtgcccggatctggggggggtccggggagccaggtcggaagttcaaaggatcaaggtagcgccagcccagtctcagtgtcgagcgacgattccttcgagcaatcaatccgcgctgagatcgagcagtttctgaacgaaaaacggcagcacgagactcagaaatgtgacggatccgtggagaaaaagcctgacaccaacgagaattcagctaagtccttactgaaaagtcatcaggaaccacccaccaaagtagtccaccggcaggggctcctcggcgtgcaaaaagaattcgcctttcggaaacccccaaggctggctaaaatgaatgtgcagccccgcagtctgcgcagcaaggtgactacaacacaagagaacgaagggagcaccaagccagccactccatgccggccgtctgaagccgctcagaacaagggcggaatcaaaaggagcgcttccgcagcccgtaggggaaaaagggtgatgtccgccgcgcaggcctctgaagcatctgacagctctagcgacgacggaatcgaagaggcaatacagctatatcagcttcagaaaactagaaaagaagcggacggcgacctgccacagcgggtgcaattacgtgaagagcgtgcgcccgaccccccagcacatagcacctcatccgccacgaagagtgccttgccagaaactcatcgaaaaaccccctccaagaaaaaactagtcgctaccaaaacaatggatccagggccagggggcctcgatacagatcatgctcccaaattattgaaggagacgaaggcacctcctcccgcttctcccgctagtcgatccgaatttgttgagcggagttcttgtcgcgcggatactagcgccgaactcatgtgcgcggaggccatcctggacatctctaaaactattctgcccgctccggtcgagggatctgacgggtctcttagtgcctctcctctcttttattcccccaatgtcccctccagaagcgacggggacagctcctcggtagactctgacgactccatcgaacaagaaatccgtacctttcttgctcttaaggcgcaatcaggcagtcttctggccaggggggaatcgtgcccacaggctgcccagggccctctgctcccacccggactgaattctcagacaggcggccataaaacacctctcagcaagacaccagacccgctcctcggttgtaagcggaaacgaaggggagggggacacgtacgccccagcactcccaagaaaatgcaggaagttgttaaagacggatcacaagacgctgaccactcgcagggcagagctgagcccggtcacgagcgtagggacttgcccatccagggaaaggccagcgaggcacttggcggcgagggaacagcacgcggtcctggagatacacggatgtcgcaaggacagggcaagacagacgaagcacgccgcctcgacgagaaggagagttccgaggataagtcaagttctctcgattccgatgaagatctggatacagcgatcaaggacctactcaggtctaagcgtaagctaaagaaaaggtgtcgggagcctagagccgcgtgccggaagaaggtgagatttagtaccgctcagactcatttcttagagcagctgggcggtctgcggcgggattggaaggatcggggcccgcccgtgctcaagagttgcttatcgaagtctaaaagagactctggtgagggcccaggcaagaaaccaccatccgtcttcggcagcacagctgaaaggatgcggcaggagggagccgcctcccaggatgcagccctggcgttcagggtaagacggccagcatctgcgagcgcatccgaggggaaccccttcccacgtgagtcacagggtcccgccccctcaccagggtctctttctgatgacagttcttccgtcgacagtaacgactctattgagctggagatacggaagtttctggccgaaaaggctaaagagtccgtgtcgagttccgaggtgcaggccgaaggcccaacagcactgggaacgggtggccccgcccggcccgaagtcctgtgccgaaaagagccagccccaccccctggcgtgtgtaccagaagtcaaagagctagaggtgtacctcatttggcagaaggcctgagaggaaccgagagtgctggtgcgcaagggacggctggcctgttttctcagggtggtaaaggcctgcctgccgcccccgctcggggcgatcccgtgcccccacgatccactagcgggggcgtttcagccaaaggtctgtccgtgagcagaaggaatgtttacgtgcacaaggatcagtctcccagaggcgcagagccagctgccaagtcagcttttggccaacttccctcatgcgccaccgccgggacagaagctgggggcgctcgtggaacattccacatggggtgtgggagtccatcctttctcacgcctagtcccggagccgagcgggatgctggcgcccaggcggacagaacccccccctggtccgactttgctcatcagtcaagattgccaagcccttgggttctcagaagtgaggggagagacgccgtgtggcgtgggggagtggggtcagaacgtgacaaaggatccgaaggccccgcccgcggcctgccatccctgccactcgctggcttttctcctctcctctcaacccagctgttccacttcggtaaaggcgtgtcttggggtggcagacaagctggactgttctcgccccacttaggacttcctctgcaggggcctagcttttcagcatttcgagaggctcaggcaggcccttcacccgtatttgggtcccctcaccttttggctaagaaggacgggggcccgtggcctacccgtaaggcccaggccgggctgtcactgcacgatcgacgctcgagcggcagtgaagagtctatactggaccttagatacagacgacgcgtcaaccgggatgaccaggagcaggatgcccttggctctgatgcttccgacttttcggatacctccactgaggattctggcgggagtagtgttgtgaaggtgtag

SEQ ID NO: 12919 - DNA, 327 bp, Artificial Sequence
  Description of Artificial Sequence: Synthetic coding sequence
atgttcctgatgaatgccagcccagtcgtagctctgcagtctaagtgggaggctttcggccctccaggctcatgcagattccctcgttgcttctccgaagcagatgaaggggtcgaaagtgctagcgtctcagctcgtgttcagatgcttatatcaaccttgcagcgcgacggagcagctcgtggaaccagcgatgaaagggctgcgcagagagggcatagggccgaaggctgccacgatgcgcgcccagccgccaagccaacggtgcacaaagaaccaccagccctcgcggtctgcggcctcgtagccgatttcgacccgatgtag

SEQ ID NO: 12920 - DNA, 1728 bp, Artificial Sequence
  Description of Artificial Sequence: Synthetic coding sequence
atgccacctgggaaggtgctacagcccgtgctcaagatgaaagtagacgagctgttcctttactggctgtcagaggcgagcactcagcgtatgctgcaggactgtctgagacgaataaaggctcccggaagggaccaacctactcctggtgacggggagcagcctggtgcctggccaacagctccgctggcggcaccccggccctccggactagagcctccaggcacacctggcccgggtcccgccttacccctcggggcggccagcagccctcggaatgccccccatgtgagaggcacccggaggagcgcaggcaccagagtggtgcagaccagaaaggaggaaccactacctccagcaaccagccaaagcattcctacattctattttccacgaggccgaccacaggattcagtgaacgtcgatgctgtgatatctaagattgagtctacttttgcgagatttccacacgaaagagctactatggacgacatgggactggtggccaaggcctgtggatgcccactgtactggaagggcccactcttctacggagccgggggagaaaggacaggctcagtttccgttcataagttcgtggcgatgtggcggaagatcctacaaaattgccacgatgatgccgccaaatttgtgcacctgttgatgagcccaggctgtaactatctggtgcaggaggatttcgttccattcctgcaagacgtcgtcaacactcaccctgggctgtcatttctaaaagaagcaagtgaatttcattctcggtacattaccaccgtgatccagaggatattttacgcggtgaacaggagttggagtggaaggatcacctgtgccgaactgcggagatccagtttcctgcagaacgtcgcccttctagaggaggaagcggacatcaaccagttgacagagttctttagttacgagcatttttacgtcatctattgcaagttttgggaattagacacagaccatgatctgttgatcgatgcagatgacctggccagacataatgatcacgccctgtctaccaagatgatcgatagaatcttctccggcgccgtaaccagggggcgcaaggtacaaaaagaagggaaaatcagctacgccgactttgtgtggttcctcatctcagaggaggataagaaaaccccgactagtatcgagtattggttccgctgtatggacttggacggagatggcgcgttgtcgatgttcgagctcgagtatttctacgaagagcagtgccgcaggctggacagcatggctatcgaggctctgccgttccaagactgcctgtgtcaaatgctggatctcgtgaaaccacggaccgaagggaaaatcacccttcaggatcttaaaaggtgtaagctcgcaaacgtgttcttcgatacgttcttcaatatcgaaaagtatctcgatcacgaacagaaagagcaaatctcgctactgcgggacggagactccggcgggcccgaactgtcagactgggagaagtatgccgctgaggagtatgatatacttgtcgccgaggaaactgctggtgagccgtgggaggatgggttcgaggccgaactgtcaccggtagaacagaagttgtctgccttgaggtcccccttggcccaacgccccttttttgaagcccctagtcccctcggggccgtagacctctacgagtacgcctgtggcgacgaagatttagaaccactctag

SEQ ID NO: 12921 - DNA, 2286 bp, Artificial Sequence
  Description of Artificial Sequence: Synthetic coding sequence
atgcccaatttttgcgccgcacccaattgtacgcgaaaatcaactcagtccgatcttgccttcttccggtttccgagagaccctgctagatgtcaaaagtgggtcgagaactgtagacgggccgacctcgaggacaaaactccagaccagctaaacaagcattaccgcctgtgtgctaagcacttcgagacatctatgatttgtaggacctcgccatatcgaacagtgctgcgcgataacgcaattcccacaatcttcgacctgacttcccatctgaacaaccctcactccaggcaccggaagcggatcaaagagctgtctgaagatgagattcggaccctgaaacagaagaagatagacgaaacctccgagcaggaacagaagcataaagaaacaaataacagcaatgcccagaatcctagcgaggaggagggagagggccaggatgaggacatactgcctttgacactggaggagaaagaaaataaagagtatttgaaatcactctttgagatcctaatcctcatgggtaagcaaaacatccccctggacggacatgaagcagatgaaatccctgagggactttttacgcctgataattttcaggcactgttagaatgtagaattaacagtggcgaggaagtgctccggaagagattcgagacaacagccgttaacacattgttctgcagcaaaacacagcagcgccagatgctggagatttgtgaatcctgcatcagagaggaaacactcagagaggtgcgagactcacatttttttagcattataactgatgacgttgtcgacatcgctggagaggaacacctgccggtgttagtgaggtttgtagacgagtcgcataacctgcgtgaggagtttattgggttcttaccatatgaagccgacgccgaaatcctggctgtaaagttccacactatgattacggaaaagtggggactaaatatggagtactgtcgcgggcaggcgtacattgtctcctccggattcagttctaagatgaaggtggtggcctcacggctgctcgaaaagtatccgcaggcaatttacactctgtgcagcagctgtgctcttaatatgtggctcgccaaatccgtgcccgtgatgggcgtgagtgtagcacttgggacaatcgaggaagtgtgctccttttttcatagatcccctcaactactgctggagctggacaatgtgatcagcgttctattccagaattccaaggagagggggaaggaacttaaggagatttgccactcccaatggaccggcagacacgatgctttcgaaatcctggttgagctattgcaggctctggtactgtgtctggacggaataaactcagacaccaatattcgatggaacaattatatcgcgggtcgggcatttgttctgtgttctgcagtcagcgacttcgacttcatcgtaaccattgtggtcctcaagaatgtgttgtcgttcactagagcctttggcaaaaacctgcagggacagacctccgatgtgttttttgccgctgggtcccttaccgctgtactgcattctttaaatgaagtcatggagaacatcgaggtttatcacgaattctggtttgaggaagctactaatctggcaacaaaactggacatacaaatgaagctgcctgggaagttccgcagagctcaccagggcaatctagagtcacagctcacgtccgagagctactataaggagaccttatcggtcccaacagtcgagcacatcatccaggaactgaaggatatcttttcagagcaacatctgaaagcactcaagtgcctaagtctggtgccgtccgtcatggggcagcttaagtttaatacgagtgaagaacaccacgccgacatgtatcgttcagacctgccaaatccagacactctgtccgccgagctgcactgttggcggatcaagtggaaacaccgaggcaaggacatcgaactgcctagcacaatctacgaagccctccacctgcctgacattaaattctttccaaatgtgtacgcccttttaaaagtgttatgtatcctgccagtgatgaaggttgaaaatgagcgctacgagaacggaaggaaacgcctgaaagcgtatttgagaaacaccctcaccgatcagaggagctccaacctagcgctccttaacattaacttcgacatcaaacatgacttggatcttatggtggatacgtatataaagttgtacacttctaagtctgagctgcccactgacaactccgagacagtcgaaaatacttag

SEQ ID NO: 12922 - DNA, 1761 bp, Artificial Sequence
  Description of Artificial Sequence: Synthetic coding sequence
atgggcaaacagaacattcccttagatggccacgaggcagacgagatccccgagggactcttcacaccggacaatttccaggcgctcctggagtgtcggattaacagcggagaagaggtgctgcggaaacgctttgagactaccgcagtgaacacactcttctgtagcaaaacgcaacaaagacagatgctggagatatgtgagtcttgcatccgtgaggagacccttcgggaggtaagagacagtcacttcttctcaatcatcactgacgacgtcgtagacatagcgggagaagagcaccttccagtgctcgtcaggtttgtggacgagtcgcacaacttacgtgaggagtttataggcttcctgccatatgaggcagacgcagagatcctggcagtgaaattccacactatgattacagaaaagtggggattaaatatggagtactgtaggggccaggcatacatcgttagtagtggtttctcctcaaagatgaaggtcgttgctagcaggctgttggaaaagtatccacaggcaatttacacgctttgttcttcctgcgcactgaatatgtggctggccaaaagtgtccccgtgatgggtgtttccgtggctcttggaacaatcgaggaggtatgcagcttttttcatagatctccacagcttcttctggaactggataatgtgatctcagtattgtttcagaactcaaaagagcgtgggaaagagctcaaggagatatgccacagtcagtggaccggacggcacgatgcattcgagatcctcgtcgagctgttacaggccttggtgttatgcctggatgggatcaatagcgataccaacatccggtggaacaactatatagcagggcgggccttcgtgttgtgctctgcagtgtcggactttgatttcattgtgactatagtcgtactgaaaaacgtgctctcctttacacgggcctttggaaaaaacttgcaaggccaaacttctgatgtgttcttcgcagctggctcactgacggctgtgctgcactcgctcaacgaagtcatggagaatatcgaagtctatcatgaattttggttcgaggaagctacgaacctggccaccaaactggacattcagatgaagctcccaggtaagttcagaagggcccatcaggggaatctggaaagccagctgacatcagaaagttattacaaggagactctgagcgtaccaactgtcgagcacattattcaggaactaaaagacatcttctccgaacagcaccttaaagccctcaaatgtcttagcctggttccctccgttatgggtcagctcaagttcaatacatcagaggagcaccatgccgatatgtatcgctctgatctgcctaatcctgacacactgtctgcagagttacactgttggagaatcaagtggaagcatcgggggaaggacatcgagctgccctccaccatttatgaggcgctccacctgccagacattaagttcttccccaacgtgtacgccctgctgaaggtactttgtattttgcctgtcatgaaagttgagaacgagcggtacgagaatggcaggaagcgattaaaggcctatttgcggaacactctgactgaccagcggagcagcaatctcgcactcttgaatatcaacttcgacatcaagcatgaccttgatctcatggtcgacacgtatattaaactgtatacctcaaagagtgagctgcctaccgataactccgaaactgtagaaaatacgtag

SEQ ID NO: 12923 - DNA, 939 bp, Artificial Sequence
  Description of Artificial Sequence: Synthetic coding sequence
atggccaatcgtactgtgaaagacgcccactctatccacggcacgaatccacagtatctggtggagaagattatccgtacaaggatctacgaaagcaaatactggaaggaagagtgttttggtctcaccgctgaactggttgtcgacaaagcgatggagctgcgctttgtgggcggggtctatggcggcaacattaaacctaccccctttttatgcctgacccttaaaatgctgcagattcagcctgaaaaggacatcatcgtggaattcattaaaaatgaagatttcaagtatgtgcggatgctgggagcactgtatatgcggcttacgggaaccgccattgactgttataagtatctagagcccctctacaatgattatcggaagatcaagtctcagaatcggaacggagaatttgagctgatgcacgttgacgaattcatcgacgagctgcttcatagcgagagagtatgcgacattattcttccacgtctccagaagcgttacgtcctggaagaggctgaacagcttgagccacgcgtcagcgccctggaagaggacatggatgacgttgaaagctcggaggaggaagaagaagaagatgaaaaactagaaagagttccatccccagaccacaggagacggagctatcgcgatttggataaacctcggaggagtccgaccctcaggtatcgaaggagcaggtcacggagcccccggcgacgcagcagaagcccaaaacggagaagcccctcccctaggcgggaaaggcataggtccaaaagccctaggcgccatcgaagccgctcaagggatcgaagacaccgctccagatctaagagccccggtcaccacagaagccaccggcatcgtagccatagcaagtcccctgagcggagtaaaaagtctcataagaagtctaggagaggcaatgaatag

SEQ ID NO: 12924 - DNA, 1308 bp, Artificial Sequence
  Description of Artificial Sequence: Synthetic coding sequence
atgtgcgggggagtgcggggcgtgggtacagggggaattgtgagcactgcattctgccttctgtataaactcttcactctcaaactgaccagaaagcaggttatgggattgataacacataccgactcgccctatatcagggccttgggcttcatgtatattcggtatacacagcccccaaccgatctttgggattggttcgaatctttcctggatgatgaggaggacttggacgtgaaagcaggaggagggtgcgttatgacaattggtgagatgctccgaagctttttgaccaaattggagtggttctctaccctgtttccaagaatcccagtcccagtccaaaagaatattgatcaacagatcaaaaccaggcctaggaagatcaagaaagacggaaaggaaggggccgaggagatcgataggcacgtggagcgacgccgttctagaagcccccgcagatcactgagcccaaggcgcagtccacgccgttctagatcaagatcgcaccatcgcgagggccatggttcttcaagctttgacagagagctggagcgggaaaaagaacgccagagattggagagggaggccaaggagagggagaaggagcgcagaaggtctcgcagcatcgacagaggactggagcgaaggagatccaggagccgagagcggcacaggtctcggtctaggagcagggaccgcaagggagatcgtagggaccgcgaccgtgagcgcgaaaaagagaacgagaggggccgccgccgggaccgcgattatgacaaggagcgcggcaatgagagggagaaggaacgggagcggtcccgggaacggagcaaggaacagagatctcgaggagaggtcgaagagaagaaacataaggaagataaggacgaccgacggcatcgtgatgacaaaagagactcaaagaaggagaagaagcacagcaggtcacgcagtcgagaacgcaaacaccgctctcgatctaggtctcgtaatgccggcaagcggtctcgaagcagatccaaagagaaatccagcaagcataagaacgagagcaaagaaaagtcaaataagagatcaaggtccggcagccagggccgcactgacagtgtggagaagagtaaaaaaagggaacattcaccctctaaggaaaaaagtcgcaagcggagtagaagcaaagaacggtctcacaaacgagatcattctgacagcaaggaccaatctgataaacatgatcgacggcggagtcaaagcatcgagcaggagagccaggagaaacagcacaaaaacaaagatgagacagtctag

SEQ ID NO: 12925 - DNA, 573 bp, Artificial Sequence
  Description of Artificial Sequence: Synthetic coding sequence
atggcgaataacagcccagctctcacaggcaactcacagccacaacaccaggccgctgccgctgctgcacagcaacaacagcaatgcggcggagggggcgctacgaagccagccgtttccggaaagcaaggcaacgtattaccattgtggggcaacgaaaagaccatgaatctcaatcctatgatcctgacaaacattctgagttccccatactttaaggtgcagctgtatgaactgaaaacatatcacgaggtggtggatgagatctacttcaaagttacccacgtagaaccctgggagaagggtagccgcaagacggctggacagacaggtatgtgcggaggggtgcgtggcgtggggacaggcggaattgtgagcacagccttctgcctcctctataaactgtttacactgaagttgaccaggaaacaggtcatgggcctaatcacacatacagattctccatacatccgcgccctgggcttcatgtatattagatacacgcaacccccgaccgacctatgggattggtttgagagctttctggacgatgaggagttctttacactgtag

SEQ ID NO: 12926 - DNA, 1641 bp, Artificial Sequence
  Description of Artificial Sequence: Synthetic coding sequence
atggcaaacaactccccagctttgacaggaaactctcaaccgcagcatcaagccgctgctgctgccgcccagcagcagcagcaatgcggtggcgggggcgctacgaagcccgcggtgagcggtaaacagggaaacgtgctgcctctgtgggggaacgagaagacaatgaacctgaaccccatgatcctaacaaacattctgagtagcccttacttcaaagttcagctttatgagcttaaaacataccacgaggtggttgatgagatctatttcaaagtcactcatgttgaaccttgggaaaaaggtagccgaaagactgccggtcaaacaggtatgtgcgggggagtaaggggagtgggaaccggcgggatcgtgtccactgccttctgcctgctgtataagctgtttacactgaagctgactcggaagcaggtcatgggactgatcactcacaccgattcaccctatattcgggccctcggcttcatgtatattcgttacacacagccaccaaccgatctgtgggactggtttgaatcttttctagacgatgaagaggaccttgacgtgaaggctggcggcgggtgtgtaatgacaatcggcgagatgctgcggtcctttctgaccaagctggagtggttcagcacactgtttccgagaattccagtccctgttcagaaaaacatcgaccaacaaatcaagacacgcccaaggaagatcaaaaaggacggtaaggagggtgccgaggagatcgatcgtcacgtggaacgcaggcgtagccgctcaccacgacggtcccttagtccacggcggtcaccccgacggagccgttcacggtcacaccaccgcgaaggccatggatccagcagtttcgatcgcgagctagaacgggagaaagaacggcagcgacttgaacgcgaggccaaggagcgggagaaggagagaagacggagtaggagcatcgatcgcgggcttgaaagaagacgaagtcgatctagagagagacacaggtcccgatcacgatctcgcgatagaaaaggcgataggcgcgatagagatagggaaagagagaaagagaacgaacggggacggcgccgcgacagggattacgataaggaaagagggaatgagcgcgaaaaggaacgggagcggtccagagagcgaagtaaggagcaacgctcccggggagaggtggaggagaagaagcacaaggaggataaggacgatcgtcgacatcgtgacgacaagagggatagcaaaaaggagaagaagcactctcggtcccggtctagagagcggaagcacaggtcaagaagtaggtcccgcaatgccggcaagaggagccgatcccgcagcaaggaaaagagtagcaaacataaaaatgaaagtaaggaaaagagcaacaaacgatcacgatcgggatctcaggggcggaccgatagcgtagagaaaagtaagaaaagggagcactcaccatctaaagagaagtcccggaaacgctcccgcagtaaagaaaggagccataagcgtgaccattccgactctaaggatcagtccgacaagcatgacagacggcggtcacaaagtattgagcaagagtcccaggaaaaacagcataagaacaaggatgaaaccgtctag

SEQ ID NO: 12927 - DNA, 2010 bp, Artificial Sequence
  Description of Artificial Sequence: Synthetic coding sequence
atgcaaaacagtcatatggatgaatatagaaacagttcaaacggatcaaccgggaatagttccgaagtagttgtggagcaccccaccgacttcagcacagagatcatgaacgttacggagatggagcagtccccagacgattcgcccaatgttaacgcctccacagaggagactgaaatggcctcggcggtcgacttacccgttaccctgaccgagaccgaggccaatttccctccagaatacgaaaagttttggaagaccgttgagaacaaccctcaggattttactggatgggtgtatctgctccagtatgtcgaacaagaaaatcatctgatggcagcgcgcaaagctttcgatcgatttttcatccactacccctactgttatggttattggaagaaatatgccgacctggagaagaggcacgacaacatcaagccatccgacgaagtgtacagaagagggttgcaggctatcccactctctgtggacttgtggattcattatattaactttctgaaagaaaccctggaccctggagatccggagaccaacaacacaattcgggggaccttcgagcatgcagtgttggccgctggtacggatttccgcagcgatcgactctgggaaatgtacattaattgggaaaacgaacagggcaacctcagggaagtaaccgctatctatgaccgtattctgggaattcctacccagctgtacagtcatcactttcagaggttcaaggaacatgtgcagaataatttgcctcgcgacctactcactggtgagcaattcatccagctgagacgagaactcgccagtgtcaacggccactcgggagacgatggccctcctggagatgacctgcccagcggcatcgaggacatcacagacccagccaaactgattaccgagatcgaaaacatgaggcaccggatcatcgagattcatcaggaaatgtttaattacaacgaacatgaggtgagcaaaaggtggacgtttgaggagggcatcaaaagaccttacttccacgtaaagcccttagagaaagctcaactgaagaattggaaggagtacttagagttcgaaatcgaaaatggcacacatgagagggtcgtcgtgctctttgagaggtgcgtcatttcgtgtgctctgtatgaggagttttggatcaagtacgcaaaatacatggaaaaccatagcatcgaaggtgttcgccacgtgtttagcagagcctgtacaattcatctgcccaagaagccaatggtgcatatgctgtgggcggcctttgaagaacagcagggtaatatcaacgaagcacggaacatcttgaagacgtttgaagaatgtgtcttgggtttagccatggtacgtctgaggagagtgtccctggagcgtcgccatggaaacctagaggaagcagaacacttgttacaggatgccattaaaaatgctaagagtaataacgagagtagcttctacgccgttaagctcgccagacacctctttaaaatccagaaaaacctccccaaaagcagaaaggtcttgctggaagccattgagcgggataaagagaacaccaaattgtacctgaacttgctggagatggaatattccggcgacctgaagcagaacgaggagaatatactgaattgtttcgataaagccgtgcacggcagccttcctattaaaatgcgaatcactttctcccagagaaaagtggagtttctcgaagattttggaagtgatgttaataagttgctgaacgcatacgatgaacaccagacccttcttaaggagcaagactctctgaaaaggaaggcagagaacggcagtgaggagcccgaagaaaagaaggcacataccgaggatacaacctcgagcagtacccaaatgattgatggagatctgcaggccaatcaagccgtgtataattattctgcgtggtatcagtacaattaccagaatccatggaactacgggcagtattaccctcccccccctacctag

SEQ ID NO: 12928 - DNA, 723 bp, Artificial Sequence
  Description of Artificial Sequence: Synthetic coding sequence
atgcagggccttctgcgcttcgaggatcaggatagtgcacgaggtgatcagaacatcgccatgttctatcccactagcacccagatggtgtaccgccggggtctgcaagcaatacccctatccgtcgacctgtggatacactacattaacttccttaaggagactcttgatcctggggatccagaaactaacaatacaatccgcggcacatttgagcatgccgtcctggccgccggaactgatttcagatctgaccgactgtgggagatgtacattaactgggagaacgagcagggaaatctacgggaagtcacagctatctacgaccgtatcctggggatacctacccagctctattctcaccactttcagcggttcaaagagcacgtccagaataatttgccccgagatctgcttaccggcgagcaattcattcagctgagaagagaactggcgtctgtcaacgggcactctggagatgatgggcctcccggagatgacctaccttctgggattgaggatattactgaccctgcaaagcttattacggaaattgaaaacatgagacacagaatcatcgaaattcaccaggaaatgttcaactataacgaacacgaagtttcgaaaaggtggacattcgaagaaggcatcaagcgcccgtatttccacgtgaagcccttggagaaggcccagaagaaattagagagaatcctgcggatatag

SEQ ID NO: 12929 - DNA, 2577 bp, Artificial Sequence
  Description of Artificial Sequence: Synthetic coding sequence
atgcccccaccaggcatcccacctccattcccacccatgggtctgcctccaatgtcccagcgtcccccagccatacctccaatgccacccggaatcctcccacccatgcttccaccaatgggagcacctccccccctaacccagataccgggaatggtgccaccaatgatgccaggcatgctcatgcccgccgtgccagtgaccgccgccactgctcctggcgcggatactgcctctagcgctgtcgcgggcacgggtccgccccgtgcactgtggtctgagcacgtagcccctgacggaaggatatattactataacgccgacgataaacagtcggtgtgggaaaaaccctccgtcctgaaatctaaggctgagcttctgttatcacaatgtccttggaaggaatataagagcgatactggaaaaccttactactataacaaccagtccaaggagagcaggtggacgcggcccaaggacctggatgacttagaggtgctggtgaaacaggaggctgcaggcaagcagcagcagcaactgccacaaacgctgcagcctcaacccccacagcctcagcctgatcctccacccgtgccccctggacccaccccagtgccaaccgggctcctggagcccgagccaggcggttccgaggactgcgatgtgttagaagcgactcaaccactggaacagggctttctgcagcaactggaggaaggcccctccagtagcgggcagcaccaaccacagcaggaggaagaagagagtaagcccgaacctgaacgcagtgggcttagctggtccaaccgtgagaaggccaagcaggcctttaaggagctccttcgggataaggctgtgccctctaatgcgagttgggaacaggctatgaagatggttgtcactgatccaaggtacagtgctttgcccaagctgtccgaaaagaagcaggcttttaacgcgtataaagcacagagagagaaagaggagaaagaagaggctagacttcgcgccaaagaagccaagcagacattgcaacactttctggagcagcacgaaaggatgacaagtacgaccagatatcggagagcagaacaaacatttggtgaactggaggtatgggcagttgtgcccgagagggatcgaaaggaagtgtacgacgacgtgttgttctttctggcgaagaaagaaaaggagcaagccaagcagcttaggcggcgaaatattcaggccctgaagtccattctcgatggaatgagctctgtgaactttcagacaacttggagccaggcccagcagtacttgatggataatccaagcttcgcacaggatcatcaactgcaaaacatggacaaggaggacgcgctgatttgtttcgaagagcacatacgggcactcgaaagggaggaagaagaggagcgcgaacgtgctcgactcagagaaaggcgccagcagagaaaaaatcgcgaagccttccagaccttccttgacgaactacatgaaaccgggcagttacacagtatgtccacgtggatggagctctacccagccgtgtccaccgatgtccgcttcgctaatatgctcggccaacccggcagcaccccattagatctttttaaattctacgtggaagagctgaaagcaaggtttcacgatgagaaaaaaattatcaaagatattctgaaggtcaacaccgctttcgaagacttcgcccacgttatttcttttgacaaaagagccgccgctcttgacgccggcaacatcaagctcacattcaattccctgctcgagaaggccgaggcacgcgagcgggagcgcgaaaaagaagaggcccgcagaatgcggcgaagagaagcagctttcagatccatgcttagacaggcagtccctgccctcgaactgggcacagcctgggaggaggtgagggagaggttcgtttgtgattcagcattcgaacaaataaccttggaaagcgaaagaattaggctcttccgcgaatttcttcaagtcctcgagcagactgagtgtcagcacttgcacacaaaagggagaaaacatggcagaaaggggaagaaacaccaccacaagaggtcacatagtccaagcggctctgaatctgaagaggaggagctgcctcctccctccctccggccaccaaaacggcgaaggcggaatccaagcgaaagcggcagtgagcccagctcaagcctggacagtgttgagtctggaggggccgcgctaggaggtaggggatctccgtcttcccaccttcttggcgcggaccatggattgaggaaggccaagaagccgaagaaaaagaccaagaagagaagacacaagtccaatagccctgagagtgaaactgaccctgaggaaaaggccggaaaggaatctgatgaaaaggagcaagaacaggataaggatagggagctgcagcaagcagagctgcccaaccggagcccggggttcggaattaaaaaagaaaaaacagggtgggatactagtgagtctgagctgagcgagggagaacttgagcgaagacgcaggaccctgctccaacaactggacgatcaccagtag

SEQ ID NO: 12930 - DNA, 2616 bp, Artificial Sequence
  Description of Artificial Sequence: Synthetic coding sequence
atgatgccacccccatttatgcctccgcccggcataccacccccatttcctcccatgggcttaccccccatgagccaacgtccgccagcaatacctccaatgcctcctggtatcctgccccccatgctccctccaatgggagcccccccgcccctcacacagattccaggcatggtcccaccgatgatgccaggaatgttgatgcctgctgtacccgtgacagccgctacggcgccaggtgcggacaccgctagttccgcagtagccgggacagggcctcctcgcgcactctggagtgagcacgttgccccagacggacgtatatactattacaacgcggacgacaaacagagcgtctgggagaagcctagcgtgttgaaaagtaaggctgaactgctactgagccagtgcccctggaaggagtataaaagcgacacaggcaagccctattactataataatcagagtaaggagtctaggtggacacgaccgaaagatctggacgatcttgaagtgcttgtgaagcaggaagccgccggcaaacagcaacaacagctaccacagacactgcagcctcagccccctcagccgcagcccgaccccccccccgtcccaccaggcccgactccagtgccgacaggcctgcttgagcctgagccgggagggtccgaggattgcgatgttctggaggcaacccagccactggaacagggtttcctccagcagctggaggaaggaccttcatcctccggccagcatcagcctcaacaagaggaagaagaaagtaagcctgagcctgagcgcagtggcctctcatggagcaatcgtgagaaggcaaaacaggcattcaaggagctacttagagataaggctgtcccgagtaacgccagttgggaacaggccatgaaaatggtagtgactgatccaaggtactcggcgctgcctaagctgtccgaaaagaaacaggcattcaacgcatacaaagcccagcgggaaaaagaggagaaagaagaggcgcgtcttcgggctaaggaggccaaacagaccctgcagcattttttggaacagcacgagagaatgacatccaccactcggtatcgccgggcagaacagacttttggcgagctcgaagtctgggcagtagtgcctgaaagggaccgcaaggaagtgtacgacgacgtgctctttttcctcgctaagaaggagaaggagcaggccaagcagcttcgacgccggaacattcaggccttgaaaagcatccttgacggtatgagtagtgttaactttcagactacatggtctcaagcgcaacagtatctgatggacaacccatcatttgcccaggaccaccaactacagaatatggataaagaagacgccctgatatgctttgaggaacacattcgtgcgctcgagagagaagaggaagaggaaagggagcgggccaggctgcgggagaggagacagcagcgcaagaacagagaagccttccagacattcctggacgagctgcacgaaacaggacagcttcattctatgtcaacttggatggagctctatccagctgtgtccacagatgtgaggtttgccaatatgcttggtcagcccgggagtacaccattagatctgttcaagttttatgtggaggaactgaaggcaagatttcatgatgaaaagaaaattataaaagatattctcaaagacagaggattctgcgttgaggtgaacacagcattcgaggactttgcacacgtgatcagctttgacaagagggccgccgccctggacgcaggaaacattaaactgacctttaacagcctcttggagaaggcagaggctcgggagagggagcgggaaaaggaggaggctaggaggatgcggcggcgcgaagccgcattccgttcgatgctgcggcaagctgttccagccctggaactcgggaccgcctgggaggaggtaagagaaagattcgtgtgcgactcagcctttgaacagatcactctggaaagtgaaagaatccggctgtttcgagaatttctgcaagtgctcgagcagacagagtgccagcacctgcacaccaaaggccgtaagcacggccgaaaaggtaagaaacaccatcacaagaggagccactctcctagcggctcggagagcgaggaagaggaactgcctccaccgtcacttcggccgccaaaacgaaggcgccggaatccgtccgaatctggaagcgagcctagctcaagtttagacagcgtcgagagtggcggcgcggccctgggaggccgcggaagccctagttcccatctgctgggcgccgatcacggactgcggaaagcaaaaaagcctaagaagaagactaaaaagcggaggcacaagtctaattccccagagtccgaaacggatcctgaggaaaaggcaggaaaagagagcgatgagaaggagcaggaacaagataaggacagggagctgcaacaagccgaactacccaaccgcagtccaggctttggaatcaagaaggagaaaaccggctgggacacctccgaatctgagctcagcgagggtgaattggaaagaagacgtcgcacacttctccagcagctggacgatcatcagtag

SEQ ID NO: 12931 - DNA, 21 bp, Artificial Sequence
  Description of Artificial Sequence: Synthetic coding sequence
atgatgcctccacctttctag

SEQ ID NO: 12932 - DNA, 1791 bp, Artificial Sequence
  Description of Artificial Sequence: Synthetic coding sequence
atggaggcagagccccccctgtaccccatggccggcgctgcggggccgcaaggagacgaggatctcttaggggtgcccgatggccctgaggcccccttggatgaacttgtgggagcctacccaaattacaacgaggaagaagaggaaaggaggtattaccggaggaaacggttgggagttctgaagaacgtgttagcagcgtccgcgggtgggatgctaacatatggggtctacctcgggctgttgcagatgcaactcatactccactacgacgagacttacagggaagtcaagtatgggaatatggggcttcctgacattgattccaaaatgttaatgggcatcaacgtgacaccaatagctgctctcctctatacccctgttctgattaggttctttggaactaagtggatgatgttcctcgcggtgggtatttacgctctctttgtatcaaccaattactgggaacgttactatacccttgtcccttctgctgtggctctgggtatggcaattgtccccctatgggcgtcaatggggaattatatcactcgtatggctcagaagtatcacgagtattcccattacaaggagcaagacggacagggcatgaaacagcgcccaccaagagggtctcacgctccctatctgctggtgtttcaggccatattttattcattctttcacctttcatttgcttgcgctcagttgcccatgatctactttttgaaccattatctttacgatctgaatcacactttgtacaatgtgcaatcctgcgggacaaacagtcacggaattctgagtggattcaacaaaacagtgttgcggactctgccacgctctggcaacctgatagtagtcgagagtgtcctaatggccgtatttctggcaatgctgctggtactgggactgtgtggagctgcttaccggcctacagaggagattgacctgcgctcagtagggtggggaaatatcttccagctgccctttaagcatgtcagggactataggctgcgacacctggttcccttctttatctattccggattcgaggtccttttcgcttgtacaggaatcgcgctggggtatggggtgtgtagcgtgggcttggagcgcttagcatatctgttggtggcttactccctaggtgctagtgccgcatcacttttaggactactggggctttggctccctcgccccgtccccctggtggccggggcaggcgtgcatctgctccttacctttattttgttcttctgggcacccgttccgagagtcctccagcattcttggattctctatgtggctgctgcgctctggggagttgggagcgcacttaacaagacaggcctatccacgttactgggaatcctatatgaagataaagaacggcaggatttcatcttcacgatataccactggtggcaagccgtggcaatcttcactgtgtacctcggctcaagtctgcacatgaaagctaaactggcagtgctgttagtgacattggtggcggctgcggtgagctatctaaggatggagcagaaactcagaagaggggtggctccacggcagccccggatcccgaggccacagcataaggtgcggggataccgctatctggaagaagataactccgacgaatctgatgccgagggggaacatggggacggcgccgaggaggaagctccccccgctgggcccaggccaggacccgaaccagctgggctgggcaggagaccatgcccttatgagcaggcccagggaggggatgggccagaggagcaatag

SEQ ID NO: 12933 - DNA, 1446 bp, Artificial Sequence
  Description of Artificial Sequence: Synthetic coding sequence
atggcgtacaatgatactgaccggaaccaaacagagaagctcctgaagcgtgtgcgggagctggagcaggaagtccagaggctgaaaaaggaacaggccaagaataaggaggactctaacattagggaaaacagtgcaggggcggggaagacaaagagggccttcgacttctctgcacatggacgacggcacgtcgctcttagaattgcctacatgggatggggttaccagggttttgcatctcaggaaaacaccaacaataccatagaggagaagttgttcgaagcactaaccaagactagactggtcgagtcacgacagacaagtaattatcatcgttgtggacggacagacaagggggtcagcgccttcggtcaggtgatcagcctcgacttacgctcacaattccccagggggcgcgattccgaagactttaacgtcaaggaggaggctaacgccgctgcagaagaaattagatacactcatatcctgaatcgggtccttcctcccgacatacgaatcctcgcttgggcccctgtggaacccagcttttcagctagatttagttgtttggaacggacgtatcgttacttttttccacgggctgacctggatattgtcacaatggactacgctgctcaaaaatatgttggcacgcacgatttccgcaacctgtgcaaaatggacgtggcgaacggtgtaattaacttccaaagaaccatcctgagtgcacaggtccagctcgtaggacagtctcccggtgaggggaggtggcaggagccctttcaactatgtcagttcgaggtgacgggccaggcctttttgtaccaccaggtacgctgcatgatggccatcttatttttaatcggccagggtatggaaaaaccggaaatcatagacgagctgctgaatattgaaaaaaacccgcagaaaccacaatattcaatggccgtggaattccccctggtactctacgattgcaaattcgaaaacgttaaatggatatacgatcaagaagctcaggaatttaatataacgcatctccaacagctgtgggctaatcacgctgtaaaaacccatatgctgtactccatgctccagggactcgatacagtcccagttccctgcggcatcgggcctaaaatggatggtatgacagagtgggggaatgtcaaaccttctgtcattaagcaaactagcgccttcgttgaaggcgtcaagatgaggacttacaagccattgatggaccggcccaagtgccaggggcttgaatcgcggatccagcattttgtccgcagggggcgaatagaacatcctcatctctttcacgaggaagagaccaaagccaaacgcgattgtaatgacacattggaggaagaaaatactaatttagaaacccccacaaagagagtgtgcgtcgatacagaaattaaaagcattatctag

SEQ ID NO: 12934 - DNA, 939 bp, Artificial Sequence
  Description of Artificial Sequence: Synthetic coding sequence
atggctgatggggattcaggttcggaacggggcggaggtggcggcccatgcggtttccagccagctagccgaggcggcggcgagcaggaaactcaggaactggcgtcaaagagactggacatccagaacaagagattctatttagacgtgaagcaaaatgcgaaaggccggtttctcaaaatcgcagaagtgggcgctggaggtagtaagtcccggctcaccctcagcatggccgttgccgccgagttccgtgacagtctaggcgacttcattgagcactacgcccagctgggccccagcagccccgagcagctagctgccggtgccgaagaaggtggcggaccgagacgagcactaaagagcgaattcctggtccgtgagaatcgcaagtactatctcgacttaaaagaaaatcagcgaggccgcttcctgcggatccgacagactgtcaaccgagggggaggcggattcggtgctggtccgggacccgggggcctgcagagcgggcagaccattgcactgccagcccaaggacttattgagttcagagacgcgttggccaaactaatcgacgattatggcggcgaggatgatgagctggccggaggcccgggcggaggagcaggaggccccggcgggggactctatggtgagctgccggagggcacttccattaccgtagactctaagcggtttttcttcgatgtgggttgtaacaagtatggcgtctttttgcgggtatccgaggtcaaaccatcctatagaaacgctatcactgtgccatttaaggcctggggcaagttcgggggcgctttttgcaggtacgcagacgaaatgaaggagattcaagaaagacagcgggacaagctgtatgaacgtcgcggcggggggagcgggggcggagaggaaagcgaaggggaggaggtagatgaagattag

SEQ ID NO: 12935 - DNA, 969 bp, Artificial Sequence
  Description of Artificial Sequence: Synthetic coding sequence
atggaacgcgcacgtcgacgcgggggtggagggggcagaggcaggggcggaaagaatgtgggtggctccggcctaagcaagtcccgtctgtatccgcaggcacaacacagtcactaccctcactatgcagcctcggctacccccaatcaggccgggggcgcagccgagattcaggaactggcttcaaagagagtagatatccagaaaaagcgtttctatttagacgtaaagcagtctagccggggcaggttcttgaaaatcgctgaagtatggattggcagagggcggcaagataacatacggaaatccaaactgacactctctctatctgtggctgctgaattaaaggactgcctgggcgactttattgagcattacgcacatcttggcttgaagggacaccggcaggagcatggtcactccaaagagcaggggtcaagacgtcgacagaagcactcggctccaagtccaccggtcagcgtgggcagcgaagagcaccctcattccgtattgaagaccgactacattgaaagggacaaccggaagtactacctggatctgaaagaaaatcagagaggtcggtttcttcgtatcagacaaacaatgatgaggggcacaggcatgataggctattttggccactccttgggacaagagcaaacgatcgtgctgccggcccaggggatgatagaattccgagacgcactggttcaactgatagaagactacggcgagggcgacatcgaagaaaggcgcggcggtgacgatgacccactagaacttcctgaaggcacctctttcagagtggataacaaaagattctactttgatgtggggagcaacaaatacggcattttcctgaagctgactaattatccaaaatcgagggagaatatcaacctattccattgctgccagattaagcataaagagcagcctcacgataccacaaagacagtcgaagaatag

SEQ ID NO: 12936 - DNA, 1044 bp, Artificial Sequence
  Description of Artificial Sequence: Synthetic coding sequence
atggagagggcacgcaggcggggcggcggcggtggccggggacgggggggtaagaacgtgggagggagcggactgtctaaaagtcggttgtacccacaggcccaacactcccactacccacactacgctgcctcagccacgccaaaccaggctgggggtgctgcagagatccaggaattagcttctaagcgagtagatatacagaaaaagcgattttatctggacgttaagcagtcttctcggggtcggttcctgaagatcgcggaagtctggatcggtcgtgggaggcaggataatatccggaaatccaagctgacgctctccttgtcagtggcagccgagctcaaggactgtttgggagactttatcgagcattatgctcatctaggactcaaaggccatagacaggaacatgggcattccaaagagcagggttcccgaagaaggcagaaacattctgccccgtccccacctgtgtctgttgggagcgaagagcatccccactcagtgctgaagacagactacatagagcgcgataatcgcaagtattacctggacctgaaggaaaatcaacggggcagattcctgcgcatccgtcagaccatgatgcggggtacaggaatgatcggatatttcggtcatagcttggggcaggaacagaccattgtgttaccggctcaagggatgatagagttccgggacgcactcgtccagctcatagaagactacggggagggggatatcgaagagaggcgagggggcgatgacgaccctctggaactgcccgagggaacatccttccgcgttgataataagagattttacttcgacgtgggcagcaacaagtatggcatctttctgaaagtatccgaggtgagacccccctaccggaatacaatcacggtgccattcaaagcatggacgcgcttcggggagaacttcattaagtacgaagaggagatgaggaagatttgtaacagtcataaggaaaagagaatggacggaaggaaagcttctggcgaggaacaagaatgtttggactag

SEQ ID NO: 12937 - DNA, 429 bp, Artificial Sequence
  Description of Artificial Sequence: Synthetic coding sequence
atggctcctgtgaaaatctctcacgtggtgtctttttcctcccaggatcctaagtatcctgtggaaaacttgttgaatccagattcacccagaagaccttggttaggttgcccccaggacaagtcaggacagctgaaagtggagttgcaactggagcgggccgtgcccacgggttacatcgacgttggcaactgtggatgtgccttcctgcagatcgatgtagggcacagctcatggccactggaccgaccctttatcacacttttgcccgcaaccaccctgatgtctctgactgatagtaagcagggcaaaaatcggagcggcgttcgcatgtttaaggatggtaaagaaggaaagtcccgaaaagacggcggcggcttgtatgagaagcagcggtgtagcaccaaagaggactgtgagtgttactag

SEQ ID NO: 12938 - DNA, 1506 bp, Artificial Sequence
  Description of Artificial Sequence: Synthetic coding sequence
atgaatcgatcgaggcaggttacatgcgttgcttgggtgcgttgcggtgtggcaaaggagactcctgataaggtggagttatctaaggaagaggtaaagaggctgatcgcagaagcaaaggagaagcttcaagaagagggagggggtagcgacgaagaggagacaggatccccttcagaggacggaatgcaatccgcacgaacacaggctcggccgcgggaaccactggaggacggcgatcccgaggacgacagaaccctggatgacgacgagctcgctgaatatgacttagacaagtatgacgaagaaggagacccagacgccgaaactttgggggagagcctgctgggtttgacagtgtacggcagcaatgatcaggacccatacgtaacactgaaagacaccgagcaatacgagagggaagactttctgatcaaaccgagcgataaccttattgtctgtggcagagcggagcaggatcagtgcaacttggaagtgcacgtgtacaatcaggaggaggactccttctatgtccaccacgacattctgttatcggcctacccactctccgtggagtggctaaattttgacccgtccccagacgattcaactgggaattatatcgccgtgggcaacatgacccccgtcatcgaggtgtgggatctggacattgtggatagtttagaacccgtctttacgctagggtccaagctcagcaagaaaaagaagaagaagggcaagaaatcgtcgtcagcggagggccatacagatgctgttctggacctttcttggaataagctcatccgtaacgtgctggcttctgcaagcgccgataataccgttatcctctgggatatgagcctcgggaaaccagcagcatccttggccgttcataccgataaagtccaaacactgcagttccatccctttgaggcccagacactaatctcaggatcctacgacaagagcgtggctttgtacgattgcaggtctcccgacgagtcccataggatgtggagattctctggacagatagagagagtaacctggaaccacttttcaccttgtcattttctggcctctaccgacgacgggttcgtctataacctggacgcgaggagtgacaaaccaatctttacgttgaatgcccacaatgatgaaatctccggcctcgacctctcctcccagatcaaaggctgtctggtcaccgcatctgccgataagtatgttaagatttgggacattttgggtgaccggcctagcctggttcacagcagagacatgaagatgggggtcctgttttgcagctcctgttgtccagatctacctttcatctatgcctttggaggtcagaaagaaggccttcgcgtctgggatatcagcactgtctcttcagttaacgaagctttcggcagacgggagcgccttgtactcgggtcagctcgaaacagtagcatttcaggtccatttggttcacggtcaagtgacaccccaatggagagctag

SEQ ID NO: 12939 - DNA, 762 bp, Artificial Sequence
  Description of Artificial Sequence: Synthetic coding sequence
atgaacaggtcaagacaggtcacttgtgtggcctgggttcgttgcggagtcgctaaggaaacacccgacaaagtggaactcagtaaagaagaagtgaaacgcctgatcgccgaagctaaggaaaaactacaggaagaaggcggaggttccgacgaggaggagacaggctcccccagcgaagacggtatgcagagcgccaggacccaggcgcggccacgagagccactcgaggatggcgaccctgaagacgacagaactttggacgacgatgaactggctgagtacgacttagacaagtatgatgaagagggcgaccccgatgcggagacgctgggcgagtccctcctgggcctgacagtctacggtagtaatgaccaggacccttacgttacactcaaggacacagagcagtacgagagagaagactttctgataaagccatccgacaacctgatcgtatgtggacgggctgaacaggatcagtgcaatctagaggttcatgtgtacaaccaggaggaagactccttttatgtccatcatgatattctgcttagtgcctacccactcagcgtggagtggctcaactttgatccctcccccgatgattcaacaggcaactacattgcagttggcaacatgacccccgttattgaagtttgggatctggatatcgtcgattcactggaacccgtgtttactcttggatcaaagctgagtaagaaaaagaagaagaagggcaagaaggtgaagaagaagcggtag

SEQ ID NO: 12940 - DNA, 750 bp, Artificial Sequence
  Description of Artificial Sequence: Synthetic coding sequence
atgaatcgatctaggcaggtgacatgtgttgcatgggtccggtgcggagttgcgaaggagaccccagacaaggttgaactgtccaaggaggaagtgaagcgtctcattgctgaagcgaaggaaaaactccaagaagaagggggcggaagcgatgaagaggaaaccggctccccctccgaggatggtatgcagtctgccaggactcaggcaaggccccgcgagcccctggaggatggagacccagaagatgaccgaacattggacgacgacgaactcgctgagtacgacttggataagtatgacgaagaaggcgatccagatgccgaaacactcggagagagcctactggggctcactgtttatggctctaacgaccaagacccctacgttacccttaaagataccgagcagtatgagcgagaggactttctaatcaagccctcagacaatttgatcgtttgcggaagggcagagcaggatcagtgcaatctagaagtgcacgtgtataaccaggaagaggacagcttttatgtgcatcacgacatcttactctcggcttatccactgtctgtggagtggctaaactttgatccatcacctgacgatagcacagggaactacatagctgtgggcaacatgacccctgtgatcgaggtctgggacctggacattgttgactctcttgaacctgtgttcacactcggaagtaagctgtcaaagaagaagaagaagaagggtaagaaaaagtag

SEQ ID NO: 12941 - DNA, 297 bp, Artificial Sequence
  Description of Artificial Sequence: Synthetic coding sequence
atgcagtctgcacggacccaggcaaggccgcgggaaccgttggaagacggagatccagaagacgataggaccctggatgacgatgaactcgcggagtacgatctggataaatatgatgaagaaggcgatcccgatgcggaaacgctaggcgaatcattgctgggacttaccgtctatgggagcaacgatcaggacccatatgtgactttaaaagatacagagcaatacgaacgcgaggacttcctcatcaagccttctgataacctaattgtatgtggcagggctgagcaggactag

SEQ ID NO: 12942 - DNA, 1260 bp, Artificial Sequence
  Description of Artificial Sequence: Synthetic coding sequence
atgccagccgagaatagtcccgccccggcttataaggtcagttcccatgggggagatagcggacttgacggactggggggtcctggagtacagctgggaagccctgacaagaagaagcgcaaggccaatacgcagggaccaagctttcccccactctccgagtatgctcccccacccaaccccaattccgaccacctcgtcgcagctaatccttttgatgataactacaacactatttcatataaacccctgccctcgagtaacccttatctgggcccaggttatcctggattcgggggctattctactttccgaatgccgccccacgtaccccccagaatgtcgagcccttactgcggcccatactcgttacggaaccagccccaccccttccctcagaacccactgggtatgggttttaacaggccgcacgcttttaatttcgggccacatgataactcttcttttggaaacccatcctataataacgccctgtctcagaatgtgaatatgccgaaccagcatttccggcagaacccagccgaaaacttctctcaaattccacctcagaacgcctcacaggtaagcaatcccgatctggcctcaaactttgtgccagggaataactcaaactttacctctccgctggagtccaaccactcttttattccacctccgaatacctttgggcaggcaaaagcacctcctccgaagcaagatttcacacagggggcaactaagaatactaaccagaacagcagcgcacatcccccccacttgaatatggacgacaccgtgaatcaatcaaacattgagctcaaaaatgtcaaccgaaacaacgctgtgaaccaggaaaacagcagaagctcaagtactgaggcaaccaacaacaatccagccaacggcacccagaataagccccgccaaccacgtggcgcagccgacgcttgtaccaccgagaaatctaataagtcaagtcttcaccctaaccgacacggccattcaagcagtgacccggtgtatccgtgcggcatttgtactaatgaggtgaacgacgaccaggacgccattctttgcgaagccagctgtcagaagtggttccacaggatctgtacaggcatgaccgagactgcctacgggctccttaccgctgaggcctctgcagtatggggttgcgacacttgcatggccgacaaggatgtgcagttgatgcgcacccgggaaactttcggcccaagcgcagtcggaagcgacgcctag

SEQ ID NO: 12943 - DNA, 1260 bp, Artificial Sequence
  Description of Artificial Sequence: Synthetic coding sequence
atgtctgcggagcaagagaaagacccaattagcctcaagagagttcgcgggggagattcaggcctggacggcctgggcggcccaggggtgcaactgggatctccagacaagaagaaacgcaaggctaacacccagggtccaagttttccacccctaagcgaatatgctcctcctcccaatccaaattctgaccacttggtcgcagctaatccgttcgatgataactacaatacaattagttataaaccacttccatcttcaaacccatacctgggacccgggtaccctggcttcggaggatactctacgttcaggatgcccccacacgtgcctccccgcatgtcctcaccgtattgtggcccttattcgttgcggaaccagccccaccctttcccccagaatccactggggatgggctttaacaggcctcatgcatttaatttcggccctcatgataactcctcctttggtaacccttcatataacaatgcgctgagccagaatgttaacatgcccaaccagcactttagacagaacccggcggaaaacttctcacagatccccccacagaacgcgtcccaggtttcaaacccagacctggcttctaacttcgtcccagggaataacagcaacttcaccagccctctggagagcaatcattcttttattcccccaccaaacacattcggccaggccaaggccccaccaccaaagcaggactttacacaaggtgccacaaagaacacaaatcagaacagtagcgctcacccccctcacctcaacatggatgatacggttaaccagtccaacatcgagcttaaaaacgttaacaggaacaacgctgttaaccaagagaacagtcgtagctcttcaactgaggcaaccaataacaacccagccaacggaacacaaaataaacctaggcagcctcgtggcgccgccgatgcctgtactaccgagaagtctaacaagtccagcctacacccgaataggcatggacatagctctagcgaccctgtgtatccctgcgggatctgtacgaatgaggtgaatgacgatcaggacgccatcctgtgcgaagcctcctgccaaaagtggttccacagaatatgcaccggcatgacagaaaccgcttacgggctgttgactgctgaggcctctgcggtctggggctgtgacacctgcatggcagataaggatgtgcagctgatgaggacccgcgaaacctttggccccagcgctgtgggcagtgatgcatag

SEQ ID NO: 12944 - DNA, 2931 bp, Artificial Sequence
  Description of Artificial Sequence: Synthetic coding sequence
atgtccaactccaatactacccaggaaacactcgagatcatgaaggagtcagagaagaaactggtcgaggaatctgttaacaagaacaaattcatctctaagacacctagcaaggaggaaatagagaaggagtgtgaggacacaagtctgcggcaggaaacacagaggaggacttccaatcatggccatgcacgaaaacgggccaagagcaacagcaaactgaagctggttagatccctggccgtgtgcgaggagtccagcacacccttcgcagatggtccgttggagacccaggatattattcagctacacatcagttgtccgtcagacaaagaggaagagaaaagtacaaaggacgtttctgagaaggaggataaggacaaaaacaaagagaaaatacccaggaagatgttatccagagactcgagtcaggaatatacggattctacgggcatcgacttacatgaatttctggtgaacactctcaagaaaaatccgcgggaccgtatgatgctgctcaaacttgaacaggagatactggagtttataaatgataacaacaatcagtttaagaagtttccccaaatgaccagctatcacagaatgttgctgcatcgcgttgctgcatatttcggaatggaccataacgtagaccagaccggcaaggccgtaattataaataagacatcgaatacgaggattcccgagcagcggttctccgagcacatcaaagatgagaaaaacaccgagttccaacaaaggtttatcctcaagcgggatgatgcttcgatggacagagatgataaccagaccgggcaaaatggctacttaaatgatatccggctcagtaaggaagcttttagctcttcaagtcacaagaggcggcagatattcagaggcaatagggagggcctgagcagaacctcttccagccgtcagtcctctactgactcggaactcaagtccctcgagcccaggccttggtcctccacagacagtgatgggagtgtgcgttctatgagaccacctgtaacaaaggccagctctttctccgggatttcaattctgactcggggcgatagcattgggagcagtaaaggagggagcgccggaagaatttctagacccggcatggccctgggcgccccagaggtgtgcaaccaggtgacctccagtcagtccgtgcgcggactgcttccatgtacggctcagcagcagcagcagcagcagcagcagcaattgcctgctttgcctccaacacctcaacagcaaccgccactcaacaaccacatgatcagtcaggcagacgacctcagcaatccctttggacagatgtccctctctcgccagggctccaccgaagccgccgacccatccgctgcactctttcagacacctctgattagccagcacccacagcagacaagctttattatggcgtcaaccggacagcctttgcccacttccaactactcgacaagcagtcacgccccacccacacaacaggtgcttccgcctcaagggtatatgcagccccctcaacagatacaggtttcctattatccacctggccaataccccaacagtaatcagcaatatagacctctgagccatcccgtcgcctactccccacagaggggccaacagctgccacagcctagccagcagccaggccttcagcccatgatgcctaatcagcagcaggcagcttatcagggcatgattggcgtgcagcaaccacaaaatcagggtttattgagcagtcagagatcttccatgggtggccagatgcagggcttagtggtgcagtacacaccactgccatcataccaggtcccggtcggtagtgacagccagaatgtggtgcagccgccctttcaacagccaatgctggtcccagtgagtcagtctgtgcaaggagggctgccagccgccggagtgcccgtatattatagcatgatccctcctgctcagcagaacggaacatcaccgtctgtgggtttcctccaacctccaggttcagagcagtatcagatgccacaatctccaagcccttgtagtcctccacagatgcctcagcagtactctggcgtcagtccttcaggtccaggcgttgtcgtgatgcagttaaacgtgccgaacggcccgcagcctcctcagaaccctagtatggtgcagtggtcccattgcaagtattactctatggatcaacggggccagaagccaggcgatctatactctcctgatagcagcccacaagcaaatacacagatgtcatccagtcccgtcacctcccctacccagagcccagctccaagtcccgtgaccagcctgtctagcgtgtgtaccggcttgagccccttgcctgttctgactcagttcccgagacccgggggaccagcccagggtgatggacgctactccctcttggggcagcctctccagtacaacttaagtatttgcccacctttactccacggccaatcaacatataccgttcatcaagggcagtctggattgaagcacggcaatcgggggaagcgacaggcactgaagtctgcttccacggacctcggcaccgccgatgttgtgttgggtcgggtgctcgaggtgacggatctgcccgaaggcatcacacgaactgaagcagacaagctgtttacccaactggctatgagcggcgctaaaatacaatggctaaaggatgctcagggactaccaggtggcggcggcggggataactctggtacagcagagaatgggcggcacagcgatctagctgcactttacaccatagtggcggttttcccctctcctttggccgcacaaaacgcttcactacgccttaataattctgtttccaggtttaagctgagaatggccaaaaagaactatgacctgcgtatactggagagggcttctagtcagtag

SEQ ID NO: 12945 - DNA, 2931 bp, Artificial Sequence
  Description of Artificial Sequence: Synthetic coding sequence
atgtctaactcaaatactactcaagagacgcttgagataatgaaagaaagtgaaaagaagttggtggaggagagcgtgaataaaaataaatttatcagcaaaaccccaagcaaagaggagatcgagaaggagtgtgaggacacctccctgagacaggaaacccagcgccggactagtaaccacggccatgcacggaagcgagctaagtctaactctaaactgaaattggtgagaagcctggcggtgtgtgaagagtcctctacccctttcgccgacggcccacttgagacccaagatatcatccaattgcacatttcttgtcccagtgacaaagaggaggagaagagcaccaaagatgtgtcggaaaaagaagataaagacaagaacaaggagaaaattccccgcaagatgctcagtcgcgactcttcccaagagtataccgatagtacggggatagacttacatgaatttctagtgaataccttaaagaaaaatcctcgggatcgaatgatgttactaaaactcgagcaagagatactggaattcatcaacgacaacaacaaccagtttaaaaagttccctcagatgacatcttatcacaggatgcttctgcaccgcgtagcagcttactttggaatggatcataacgtggaccagaccggaaaagctgtgataatcaataagacctctaacacgcgaatcccagaacagaggttttctgagcacattaaggatgagaaaaatactgagttccagcagaggtttatcttgaaacgagacgatgcctcaatggacagagacgacaaccagaccggtcagaacggctacctgaacgatataagactgtccaaagaagcattttcctcctcctcccacaagagacgccagatattccgcggcaatcgagaagggttgtcacgcacctcttcttcccgccagagctctacagacagtgaactcaagagcctcgagcctagaccgtggtcctccaccgatagcgatggcagcgtgcgaagtatgcgacctcctgtgacaaaagcttcatcttttagcggcatcagtattctgacacgcggtgatagtattggatcctcaaaaggggggagcgcaggacgaatatcccggccgggcatggcccttggtgctcccgaagtttgcaatcaagtcacttcttcacagtcagttcgggggctgttgccttgcacagcccagcagcagcagcagcagcaacagcaacagcttcccgccctaccccccaccccacagcaacagcctcccctgaataatcacatgatctctcaagccgacgatctgtctaatccatttggacagatgagcttgtcacgacaggggtccacggaggctgccgaccctagtgctgcactcttccagacacccttgatatcccagcatccacagcagacaagctttattatggcctcaaccgggcaacctttacccacatcaaactatagcacctccagtcatgccccacctacccaacaagtgctacctccccagggctacatgcagcccccccagcagattcaggtttcttactatccccctggccagtaccccaattcaaatcagcaatatcgccccctctcgcaccctgtcgcctattcaccccagcgaggtcagcagctgccacaaccgtctcaacagcctggccttcaacccatgatgccgaaccaacaacaggcagcttatcagggtatgatcggagtccagcaaccccaaaatcaagggctgcttagctctcagaggtcttccatgggggggcaaatgcaaggattggtggtacaatatactcccttaccctcctatcaggtccccgttggctcagactcacagaacgtggtgcagcctcccttccaacagcccatgttggtcccagtttcccagagtgttcagggaggcctcccagcggctggagtccccgtgtattactcgatgattccccctgcccagcagaatggcacatcacccagtgtgggctttctgcagccccctgggtcggaacagtaccaaatgcctcagtctccgtctccctgtagccctccccaaatgccacagcaatactctggggtctctccgtctggccccggagtggtggtgatgcagctgaatgtaccaaacggccctcagccacctcagaacccatctatggtacaatggtctcactgtaaatactactctatggatcagagggggcagaagcctggtgatttgtactcacccgatagcagccctcaggctaatacccagatgtcctcttctcctgtcacttcccccacccagtcccctgccccttcacctgtgactagcctctcctccgtgtgcacaggcttgtccccgctcccagtgctcactcaattcccccgcccagggggaccggcccaaggcgacggcaggtactcactcctcggccagccactgcaatataatctaagtatttgtcctcccctcctgcacgggcagtcaacatataccgttcaccagggccagagtgggcttaaacacgggaaccgcggaaagcggcaggctctcaaatctgcttctaccgatctgggaacagccgacgtcgtgttaggtcgcgtgctagaagtgacagatctgcccgaaggcattaccaggaccgaggctgataagctttttactcagctcgccatgtccggcgcaaagatccaatggcttaaggatgcccaagggttacctggaggcggcggtggggacaattccggtaccgccgagaatggaaggcacagcgacctcgctgctctgtataccatcgtggccgtctttccttcccccctcgccgcacagaacgcaagcctgagactgaacaactccgtctccagattcaaactgcgtatggctaaaaagaactacgacctacgtatattagagagagcctcgtcccaatag

SEQ ID NO: 12946 - DNA, 2112 bp, Artificial Sequence
  Description of Artificial Sequence: Synthetic coding sequence
atgcgtcgcattcagaatttcaatcgcggcagcttcagccgcgagatgatgcctgtatggactgagatgatcactcgggggaacagagaggggttgtcacgcacttcaagcagcagacagtcatctacagacagtgagcttaagtcacttgaaccccgaccatggtcaagcactgactcagatggtagcgtgagatccatgcggccacctgtgacaaaagccagttccttttccgggattagcatactaacaagaggtgattccatcgggtccagtaaggggggcagtgccggccgtattagtagaccaggtatggctttaggcgctcctgaggtctgtaaccaggtgacaagtagccagagtgtccggggtttactgccctgcacagcccagcagcagcaacaacaacagcagcagcagttgccagcccttccccccacacctcagcagcagcctccgcttaacaaccatatgatttcccaagctgatgatttatctaaccctttcggacagatgtcattgtcgagacaaggtagcaccgaagccgccgatccttcggctgcactgtttcagactccgctcatcagccagcaccctcaacagaccagctttatcatggcatccacaggtcaacctctgcctaccagtaattactctacaagcagccatgccccgcccacccagcaggtcctgcccccacaaggctacatgcagccccctcagcagatccaggtctcttactaccccccagggcagtacccaaattccaaccagcaatatcggcccttaagccacccggttgcttactccccgcagcgtggacagcaattacctcagccttcgcagcaacccggccttcagccaatgatgccaaaccaacagcaggccgcctaccagggaatgattggcgtgcagcagccacagaaccagggactgctatccagtcagcgaagtagtatgggcggacagatgcagggtcttgtcgtgcagtacacaccccttccttcataccaggtgcccgttggatccgactcccagaacgtcgtgcagcctccttttcagcaaccaatgctcgtgccagtctctcaatcagtccagggtggtctgcctgccgccggagtgccagtgtattattctatgatcccacccgcacagcagaatggcacatcccctagtgtcggcttcctccagccacctggaagcgagcaatatcagatgccccagagtccaagcccttgtagtcccccacagatgcctcagcagtatagcggggtaagccctagtgggcctggcgtggtggttatgcaattaaatgtgcccaacgggccgcagccccctcaaaatcccagtatggtccaatggagccactgtaagtattactcaatggaccagagaggacagaaacccggcgacctgtatagtcccgatagcagcccacaggcaaatactcaaatgagttcctcccccgtaacatcccctacccagagcccagcgcctagccctgtgacaagccttagtagcgtgtgtacaggcttaagcccgctgcccgtgcttacccagttcccacggccggggggacccgcccagggggatggtcgctactcactgctgggccagccacttcaatacaacttatcaatttgtccacctcttcttcatggacaaagcacttacactgtccaccagggacagagtggtctgaaacatggtaacagagggaagcgccaagcactcaagagtgctagcacggacctgggcactgcggacgtcgttttgggtcgggtactcgaagtaacggacttaccggaaggaattactcggactgaggctgacaagctttttacacaactggcaatgtccggggcgaagatccagtggctgaaagatgcgcaggggctgcccggtggcgggggaggcgacaacagcggcaccgccgagaatgggaggcactcagatttagctgccctgtatacaatcgtggccgtgttcccttcacctctcgctgcccagaacgcgtcattgcgacttaataacagcgtctcacgctttaagctgagaatggcgaaaaaaaattatgacctgcggattctcgagagggcttcctctcagtag

SEQ ID NO: 12947 - DNA, 1791 bp, Artificial Sequence
  Description of Artificial Sequence: Synthetic coding sequence
atgaggcgcatccagaattttaaccgcggatcatttagcagggaaatgatgcccgtttggaccgagatgataacgcgcgggaatagggagggtctgtcccgcactagcagctctcgacagagctccaccgattccgaattgaaaagtctggagccacgtccttggtcatccacggactccgacgggtcagtccggtccatgcgtccccctgttacaaaagcatcctccttctcaggcatttcaattttgacaagaggggacagcatcggatcaagtaaggggggttctgcgggacgaattagcaggccaggtatggccctcggtgcccctgaggtctgcaatcaggtgacgagctcgcaatcggtgaggggattactgccctgtaccgcccagcaacaacagcaacagcagcaacagcagctgcctgccttgcctcccactccacaacaacaacctcctctgaataaccatatgatctcccaggcagacgacctgagtaatccattcgggcagatgagtctgagccggcagggaagcaccgaagcagctgacccaagcgccgccctgtttcagacccctctgatctcacagcatccgcagcagaccagctttatcatggcaagtacaggacagccactacccacatcaaactattctacctcatctcacgccccacccacacagcaggtgctcccaccgcagggctacatgcagcccccacaacagattcaagtcagctactatcctcctggccaatatccaaacagcaaccagcaataccgcccgctgagccacccagtcgcctattcgccccagagaggccagcaactgcctcagccctcccaacaacccggccttcaacctatgatgcccaaccagcaacaggcagcttatcaaggtatgattggggtacagcaaccgcagaatcagggcctcctgagcagccagaggtctagcatgggcgggcagatgcagggcctagtcgtccagtatacacctctgccttcctatcaagtcccagttggctccgactcccagaacgttgtacagccgcccttccaacaaccaatgctcgtgcctgtttcccagtccgttcaagggggcctacccgcagccggggtcccggtgtattactctatgatccctcccgctcagcagaacggcacctctccctccgtgggattcttacagcccccaggatccgaacagtatcagatgccacagagtccaagcccctgttctccacctcagatgccccagcagtattccggtgtttcccccagcggccccggagttgtcgttatgcagttaaatgtcccaaacgggcctcaacctccgcaaaacccctcaatggtccaatggtcccactgcaagtattactccatggaccagaggggacagaaacctggcgacctctattcccctgactcctcccctcaagccaatacccaaatgagttcgagtccagtcacttcgccaactcagtccccagcaccgagcccggtcacaagcctcagctctgtatgcaccggactctccccgcttccagttctgacacagtttcccaggccgggagggccagcccagggcgatggccgctattccctcctgggccaaccgctgcagtacaacctgtcaatctgccctccgctgctccatgggcagtctacatacacggtccatcaaggacaatctggactgaagcacggtaatcggggcaaacgccaggccctcaaatccgcaagtacagacctcggcactgctgacgtggccctgagtttccaaccatag

SEQ ID NO: 12948 - DNA, 2016 bp, Artificial Sequence
  Description of Artificial Sequence: Synthetic coding sequence
atgcgcccccccgttactaaggcttcgagtttctcaggtatttcgattttaacgaggggagattcaatcgggagctcaaaggggggatccgccggaagaatctcacggcccggaatggcgctgggagctcccgaggtgtgcaaccaggtgacctcatcacagtccgtgcgagggctcttaccatgcactgcccagcaacaacagcagcagcaacaacagcaactgccagccctaccccccactccccagcagcagcctccgcttaataatcacatgataagccaacctgtgcctgcgctacaacccagcccccaacccgttcagtttagtcctagttcctgtccacaagtgctgttgcccgtcagccctccacagcagtacaacatggccgacgaccttagcaacccatttgggcaaatgagcctgagcaggcagggatcaacagaagcggccgacccatctgcagctttattccagactccactgatctcacagcatccacagcagacctcctttatcatggcgtctacaggccaacccctgccaacgagcaattactcaactagtagccatgccccgcccacgcagcaagtactgcccccccaaggctacatgcaaccaccccagcagatccaggtcagctactatccccctggacagtatcctaattcaaatcagcagtatcgcccccttagtcaccccgtcgcttactctcctcaaagaggccagcagttgccacaacccagccagcaaccagggctgcagccaatgatgcccaatcagcaacaggcggcatatcaagggatgatcggcgttcagcaaccacagaaccagggcctgcttagctcgcagagaagcagcatggggggacagatgcaggggctggttgtccagtatacaccactgcccagctatcaagtgcccgtgggctcagacagccagaatgtggtccagcctcctttccagcagccaatgcttgtccctgtcagtcagtccgtgcaggggggtttaccagccgctggcgtgcctgtgtactactccatgattcctcccgctcagcagaatgggacctcccctagcgtagggttcttacaacccccgggttccgagcagtatcagatgccccagagtcccagcccatgcagtccaccccaaatgcctcagcagtactcaggggtgtctccaagcgggcccggagtcgtggtgatgcagctcaacgttccgaatgggccacagcctccacagaacccttcaatggttcaatggtcccactgtaagtactactcgatggatcagcgcggccagaaacctggggacctgtattcccccgacagcagtccacaagccaatacgcagatgagttcatctcctgtgacgagccctacccagtcacctgcgccaagtcctgtaacctccctgtcttcggtgtgtacgggcctgtctcccttacccgttcttactcagttcccaagacctggaggccccgctcaaggggacggaaggtatagccttttgggccaaccactgcagtacaatttatcaatttgcccacccttactgcatggccagagtacctatactgttcaccagggtcagtccggattgaaacacggcaaccgcggcaagaggcaagcattaaaaagcgcctctaccgacctgggaacagctgacgttgtcctgggccgcgtacttgaagtgactgacctgccagaggggattacccggacagaagctgataaattattcacccagctggcgatgagtggagctaagattcagtggttaaaggacgcccagggactgccaggagggggtggcggcgacaatagcggcactgccgagaacggccggcatagcgacctggcagccctctacacaatagtcgccgtgttcccatcacccctggcagcccaaaatgcaagcctgcgtctgaacaacagcgtgtccagattcaagctgaggatggcaaaaaagaattacgacttaaggattttagagcgagcctccagtcagtag

SEQ ID NO: 12949 - DNA, 90 bp, Artificial Sequence
  Description of Artificial Sequence: Synthetic coding sequence
atgagcaatagcaacaccacacaggaaacattagagatcatgaaggagtctgagaagaaactcgtggaggaatccgtaaacaaaaactag

SEQ ID NO: 12950 - DNA, 198 bp, Artificial Sequence
  Description of Artificial Sequence: Synthetic coding sequence
atgttttacacacacgtgctgatgtcgaagcgtggccctctggcgaaaatttggttagctgcacactgggaaaaaaaactcaccaaggctcatgtttttgagtgcaaccttgaaatcacgatagaaaaaattctctcaccgaaggtcaagattgcgctccgaacctctggccacttgctcctcggtgtcgtgcggtag

SEQ ID NO: 12951 - DNA, 1566 bp, Artificial Sequence
  Description of Artificial Sequence: Synthetic coding sequence
atgttctacactcatgtacttatgtcaaagcggggcccgctcgccaagatttggctggccgcccactgggagaaaaagctgactaaggcccatgtttttgagtgcaatctggaaatcactattgaaaagatcttgtcaccaaaggttaagatcgccctgagaaccagcggccatctgttactgggtgtagtgcggatctacaatagaaaagctaagtacctgctggctgactgtagtgaagcttttctgaagatgaaaatgactttctgtcccggtctggtagacctcccaaaggaaaacttcgaagcaagttacaatgctatcaccttacctgaggaatttcacgattttgacacacagaatatgaatgccatcgacgtgagcgagcacttcacgcagaatcaaagcagacccgaggagatcacgctaagggaaaatttcgataacgaccttatctttcaagctgagtcttttggcgaggaaagcgagatcctgcggcgccactctttttttgatgacaacatactcctcaatagcagcgggcctctcattgaacactccagcggctccctaactggcgaacgaagtctattttatgacagcggcgacggctttggcgacgagggggccgccggagagatgattgataaccttctgcaagatgaccaaaatattctactagaggacatgcacctgaatcgggagatcagcctgccctctgaaccacccaatagcctggccgtggaacccgataattctgagtgcatctgtgtgccggagaatgagaagatgaatgaaacaatcctcctgtctacagaggaagaaggctttacgttggatcccattgacatctcagacatcgcagagaagaggaaaggcaagaaacggagactgctaatcgaccctatcaaggaactaagctcaaaggtgatccataagcagttgacctcctttgctgatacgctaatggtactggagctagcacctccgacccagagactcatgatgtggaagaaacggggaggagttcacaccctgctgtcaaccgccgcccaggatctgattcatgccgagctgaaaatgctcttcactaagtgcttcctttcctccggattcaaactgggtaggaagatgatccagaaagagtcagtgagggaggaggtcggcaatcaaaatattgtggagacatctatgatgcaagagccgaactatcagcaggagctctccaagccccagacctggaaggatgtcatcgggggcagccagcatagttcacacgaggatactaataagaatattaattcagaggagtccttatccaatgaggagaatatcgaaacagagcggtggaatggccgaattctgcagatgctgaatcgcctcagggtggctgaccaaggccaggcggcagcggcggccaccgctgaggccctgcgacaggcgggacccgagtggtgcgaaccggctggtttgaggcgagcctccgggctgtctcctagagacacggctcacccgactccctatagcgacccacaaccccatggccatgtcccggcccgaaaatag

SEQ ID NO: 12952 - DNA, 1566 bp, Artificial Sequence
  Description of Artificial Sequence: Synthetic coding sequence
atgttttatacgcatgtcctcatgagcaaacgcggccctctggcaaagatctggctcgccgcccactgggagaagaagcttacgaaagcccatgtgtttgagtgcaaccttgaaatcaccatagagaaaatactcagccccaaagtgaaaatcgctctgcgcacaagcggccatctccttcttggggtcgtgaggatctataatcgcaaagccaaataccttctggctgattgctctgaggcattcctcaagatgaaaatgactttttgcccggggttagtggacctccccaaagaaaactttgaagccagttacaacgcaatcactctccccgaagaattccacgactttgatacccaaaacatgaatgccattgatgtgtcagagcactttacccaaaatcaaagccgacctgaggagatcactttgcgagagaactttgacaatgacttgattttccaggccgaaagctttggtgaagagtcagaaatactgaggcgacattcattctttgatgataacattttgcttaattcctcaggaccactcatagagcatagctctggctctctgactggagagcggtcacttttctacgactccggagacggttttggtgatgagggggccgctggtgaaatgattgacaatcttctccaggacgatcagaatatcctcctggaagatatgcatctcaatagggagatttctctcccctccgagccaccaaatagcctggcagtcgagcccgacaattccgaatgcatttgtgttccagagaatgaaaagatgaatgagacaatacttctatccaccgaagaagagggtttcaccctggaccccatcgacattagtgatattgccgagaagcggaaagggaagaaacggcggctgcttattgatccaattaaggaactctcttcaaaggtcatacacaagcagcttaccagttttgcagacactttgatggtgctggaacttgcgcctcctacgcaacggctcatgatgtggaaaaagcggggtggggtgcatacgctgctcagcacagccgctcaagacttgatccatgccgagctaaaaatgctctttaccaaatgcttcctcagcagcggctttaaactaggcagaaagatgatacagaaagagtccgtcagggaagaggtcgggaaccagaatattgtcgagacgtctatgatgcaggagcccaattatcaacaagagctgtccaaacctcagacgtggaaggacgtgatcgggggaagtcagcatagctcccatgaggacactaacaaaaacataaacagtgaggagtccctatccaatgaggaaaacattgaaaccgagagatggaacggaaggatattgcaaatgctgaaccgactaagggtcgcagatcaggggcaagcagccgccgctgcgacagctgaagcactccgccaagcggggcctgaatggtgcgaacctgcgggactgagacgcgcctcaggccttagccccagggatacagcccatcctaccccttattctgacccacagccacatgggcatgtgccagcccgcaagtag

SEQ ID NO: 12953 - DNA, 1671 bp, Artificial Sequence
  Description of Artificial Sequence: Synthetic coding sequence
atgttttacacccacgtgctgatgagcaagcgcggcccactcgccaagatctggttggccgctcactgggagaagaaactcacaaaggcccacgtgttcgaatgtaacctggaaattactatagagaagatcctttcacctaaggttaagattgctctgcgcacaagcggacatctcctcctgggggtcgtgaggatctacaatcgtaaggccaaatacctgttggccgactgcagtgaggctttcctcaagatgaaaatgacattctgcccgggtttagttgatctgccaaaagaaaactttgaggctagctataacgcgatcactctgcccgaggagttccatgactttgatacccaaaatatgaatgccattgatgttagcgaacattttacacagaatcagtcaagaccggaagaaattactttgcgcgaaaacttcgataacgatttgatcttccaagccgaatccttcggcgaggaatccgagatccttagacggcactccttttttgatgataacatattgctaaactcgtccgggccattaattgagcactcatccggatctctgaccggagagcgctcactgttttacgattctggggacggttttggggacgagggcgctgccggggaaatgatagataatctgctgcaggatgaccaaaacatcctcctggaggatatgcaccttaaccgagagatttctctgccctctgaaccccctaacagcttagccgtggaacctgacaatagtgaatgtatctgtgtgccggaaaatgaaaaaatgaacgagactattcttctgtctaccgaggaggaggggtttactctcgacccaatcgatatcagcgatatcgcggagaagagaaagggcaaaaaacgacggttgctcatagatccaattaaggaactgagctccaaggtgatccacaagcaacttacttccttcgccgacacactcatggtgttagagctagccccgcctacgcagagactgatgatgtggaagaagcgaggaggcgtgcatactctgctgagtactgcagcgcaagacctgattcacgccgaacttaagatgttatttacaaagtgtttcctgtcttcgggattcaaactgggaaggaagatgatccagaaagagagcgttagagaggaagtggggaaccagaacatagtggagacaagcatgatgcaagaaccaaactatcagcaggagctgtccaagcctcagacctggaaggacgtgattggtggaagtcagcacagtagtcacgaggatactaataagaatattaattccgagcaagacatcgttgaaatggtgtctctggcggcagaggagtctagcttgatgaacgatctcttcgcacaggaaattgagtattcaccggtcgaattggaaagtcttagtaatgaagaaaatattgagaccgagcggtggaatgggcgaatcctgcagatgctgaatcggctccgggaaagcaacaagatgggaatgcagtctttttctctgatgaaattgtgtaggaactccgatcggaagcaggcagcagctaaattctactcatttcttgtgctgaaaaagcagctcgctatcgagctctcccagtctgcaccttatgccgacattattgccaccatgggtcctatgttctacaacatttag

SEQ ID NO: 12954 - DNA, 3486 bp, Artificial Sequence
  Description of Artificial Sequence: Synthetic coding sequence
atgggcttaggaaagacactgcaggtgattagtttcatagacgtgctgttccggcacactcccgctaaaacggtactcgcaatcgtccccgtcaataccttgcagaactggcttgccgaattcaatatgtggttaccccccccggaggcccttccagcagataacaagccggaagaggtccagccgaggttcttcaaggtgcacatcctgaacgatgagcataaaactatggcctcaagggccaaagtcatggctgattgggtcagtgaaggcggtgtgctgcttatgggctatgaaatgtatcgccttcttacactcaaaaaatccttcgccaccggaagacctaaaaaaaccaaaaagcgcagccaccccgttatcatagacctcgatgaagaggaccgccagcaagagttccggagggaatttgaaaaagcactgtgccggccaggcccagacgtcgtgatctgtgacgaaggccatcgaattaagaattgtcaagccagcacaagccaggccttgaagaatattcgatctcgcagaagagtcgtgttgactggataccccttgcagaataaccttatcgaatactggtgtatggttgacttcgtgagacctgattttttagggacccgtcaggagttcagcaatatgtttgaaagacccatactgaacggccagtgcatcgactctactcctcaagacgtacgactgatgaggtacagaagtcatgttctgcactctctcctggaagggttcgtgcagcgcagaggccacactgtgctcaagattcatctcccagcaaaggaagagaacgtgatacttgttagattgtcaaaaatccagagagatctgtatacccaatttatggaccggtttcgtgattgcgggtccagcggatggctggggctgaaccccttgaaggccttttgtgtgtgctgtaagatttggaaccaccccgacgttctgtacgaggcactgcagaaggagtctctcgccaatgagcaggaccttgacgtcgaggagctcggctctgccgggaccagcgcccgttgcccccctcaggggacaaagggcaaaggggaagacagcaccctcgcttccagcatgggcgaggcaaccaatagcaagttcctgcagggagtggggtttaatcccttccaggagcgggggaataacatcgtcacctatgagtgggccaaagacttgcttacgaattatcaaaccggtgtgttggagaactcacccaagatggtcctcctgtttcacctgatagaggagtccgtcaaactgggggacaagatcttagtgtttagccaatccctttctaccctggccctgattgaagagttcctgggaaagcgcgaggtgccttgtccaccgggaaccgaaggccagggggcccagaaatgggtgagaaatattagctactttaggctcgacggttcgacaccagctttcgaacgggaacggctgattaatcagttcaatgatccctcgaacctaaccacatggctgttcctcctttccacacgggcaggctgtctgggggtgaaccttatcggggcaaaccgcgttgtcgttttcgacgcttcatggaacccgtgtcacgatgcccaagcggtttgtagggtgtacaggtacggccagaagaaaccctgctacatctaccgcttagttgccgattacaccctggagaagaaaatctatgatcggcagatatcaaagcaggggatgagcgatagagtggtcgatgatctcaaccccatgctgaatttcaccagaaaagaagttgagaaccttttgcactttgtggaaaaagagccagccccccaggtcagtcttaatgtaaaagggatcaaggaaagtgtgctccagctggcctgtctaaagtacccacatctgattacaaaagaacccttcgaacacgaaagtctgctgctaaatcgaaaagatcacaagctgaccaaagctgagaagaaagcggctaagaagagctacgaagaagataagcggacctctgtgccttataccaggccgtcttatgcccagtactatcccgcatccgatcagagcctgaccagtattcccgcattcagccagagaaattggcagccaaccctgaagggggacgaaaagccagtcgctagcgtgcggccagtccagagcacccccatcccaatgatgccaagacatgtgcccctggggggctctgtcagcagcgcctcgtcgaccaacccaagtatgaatttccccattaactacctgcagcgtgctggggtactggtacagaaggtcgtcactaccaccgacatagtcatacctggcctcaactctagcacagatgtgcaggcgagaatcaacgctggcgagagcattcacattataaggggtacaaagggaacctatatccggacatccgacggacgcatctttgcagtgcgggctactgggaaaccaaaagtgcccgaggacggacgaatggccgcctccggatcccaaggccctagctgcgagtcgacaagtaatggtcggcatagcgcgagtagccccaaggctcctgaccctgaaggcctcgcacgtcccgtcagccctgatagccctgagatcatatctgagttgcagcaatacgcggacgttgccgccgccagagaaagtagacagagcagtcctagtactaatgccgccctgccgggcccccccgcccagctcatggactcatcagcagtgcctggtaccgctctggggacggaaccccgccttgggggccattgcctgaactcttctttgctggtgactggacagccatgtggagacaggcatccagtccttgatctcagaggtcataagaggaaattagcgacccctcctgccgcccaggagtcaagcaggcggcgtagccgaaaaggccatctgcccgcacctgtccagccttacgaacatggctaccccgtaagcggaggcttcgccatgccccctgtgtctctaaatcacaacctgacaaccccctttacctcacaggcaggagaaaacagtctattcatggggtctactcccagctactaccagcttagtaatcttcttgccgacgctagactcgtgttccctgtgacaacagaccctctggtgccggcaggaccagtgagcagcagttcaaccgcaacttccgtcaccgccagtaacccttccttcatgctcaacccctccgtaccaggaatcctgccaagctatagtctgcctttctcacaaccactgctctcagagccaaggatgttcgcccccttcccctctcctgttttgccctcaaacctctctcggggaatgagcatttaccccggatacatgtctccacacgccggataccccgccggcggtctccttcggtcgcaagtgccgcccttcgactcccatgaggtggccgaagtaggcttctcttcaaacgatgatgaagataaagacgacgatgtaatagaggtgacaggaaagtag

SEQ ID NO: 12955 - DNA, 4404 bp, Artificial Sequence
  Description of Artificial Sequence: Synthetic coding sequence
atgtctgacgaaagcgcatctgggagtgatcctgacctggatcctgacgtggaactggaggatgctgaggaggaggaagaggaggaggaggttgcagtcgaagaatgtgaccgtgatgacgaggaggacctcctggatgaccccagcctggaaggcatgtgcgggaccgagcacgctcagctcggcgaggacgggcagcagcctccccgctgtacctcaacgactagtagccaatcagagccgtctgaacagcttcggcgacaccagggcaagaacctcgcctctgaagacccaaagaagaagcgagcccagaaaccttcacatatgcggagaaacatccggaaactgctgcgcgaggaccagctggagccagtgacgaaagcagcacagcaggaagaactcgagcgtaggaaacggcttgagcaacagagaaaggactacgctgccccaatccccacagtgccactagagttcttacctgaggagatagcgttacgcgccagtgatggtccccagctgcctcccagagtcctcgctcaggaggtgatctgtctggatagttcatctgggagcgaggacgaaaaaagctcacgggatgaagtaattgagcttagcagtggtgaagaggacacacttcacattgttgacagctctgaaagcgtcagcgaagacgacgaggaagaggaaaagggagggacgcacgtgaatgacgtactcaatcaaagggatgccttgggtcgagttctggtgaatctgaatcaccctcccgaggaagagaatgtcttcctggcccctcagctggctcgggcagtcaagccacatcagattggcggcattaggtttctctatgataacctggtcgagtccctggaaagattcaaaactagctcaggcttcgggtgcattctagcccatagtatgggactcggcaagactttgcaagtgatttcgtttatagacgtcctctttagacatacccccgcaaagacagtgctcgccatagtgccggttaatactctgcaaaactggctggccgaattcaatatgtggcttccccctcctgaggcactgcctgcggataacaagccggaagaggttcaaccccggtttttcaaagttcacattcttaacgatgagcataagacgatggcttctagagcgaaggtgatggccgattgggtgagcgaaggcggtgtcctcctgatgggttacgagatgtacaggctcttaacactgaagaagtccttcgcaacaggccggcccaaaaagactaaaaagcgcagtcacccagttattattgatttggatgaagaggatcgccagcaggaatttagacgagaattcgagaaggcactgtgtcgccctggacctgatgtggtgatctgtgatgaagggcatagaatcaaaaattgccaagccagcacctctcaggcactgaaaaatatccgctcacggcgacgggtggtgctgaccggctaccctctgcaaaataacctgattgagtactggtgcatggtcgactttgtacgcccagactttctaggaacacggcaggaatttagcaacatgtttgagaggccaattcttaatggccagtgcatcgattcgacgccccaggacgtccgcctcatgcggtatcgcagccacgtgctgcattccctgttagaggggttcgtgcagcgccgcggacacaccgtgcttaagatccacctccccgccaaggaggagaatgtgatccttgtgagactgagtaagatccagagagatttatatactcagtttatggatcgatttcgggattgcggatcttccggctggttaggactgaatcccctcaaagccttctgtgtgtgttgcaaaatttggaaccatcccgatgtcttgtacgaggcgctccagaaggaaagcctcgccaacgaacaggacctagatgttgaggaattaggcagtgccggaaccagtgctcgttgtccaccccagggcaccaaagggaaaggcgaagacagcactcttgcatcctccatgggcgaggccactaatagtaaattcctgcaaggcgtgggcttcaatccattccaggagcgcggaaataacattgtgacatacgagtgggcaaaggatctgctgacaaactatcaaacaggggtgctggaaaacagcccaaaaatggttttgctgttccaccttattgaagagagcgtgaagctcggagataagatcttggtgttctcccaatccctcagcactctggcactcattgaagaatttctggggaagcgggaagtcccatgtcccccagggacagaggggcagggtgcgcagaagtgggttcggaacattagttactttcggctcgacggcagcacgccagccttcgaaagagagcggctcattaaccagtttaatgacccctccaatcttacaacctggctgttcctcctgtccacccgagcaggttgcttgggcgtcaacttaatcggcgccaacagagtcgttgtattcgatgcatcctggaatccctgccatgatgctcaggccgtgtgtcgcgtttacaggtacggacagaaaaaaccatgttacatctatcggctggtggctgactacacattggaaaaaaagatatacgacaggcagatttccaaacaagggatgtccgatagagtggtcgacgatttgaaccctatgctgaattttacacgcaaagaagttgagaacttgttgcattttgtggaaaaagagccagctccccaggtatcattgaatgtaaagggaatcaaagagagtgtgttgcagcttgcctgcctgaagtaccctcacctcattacaaaagaaccatttgaacatgagtcactgctcttaaacaggaaggatcacaagcttaccaaagcagagaagaaggccgcaaaaaaaagctacgaggaggataaacggaccagtgttccttacaccagaccttcctatgctcagtactaccctgcctcggatcagagtcttacctcaatccccgcctttagtcagcgtaactggcagcctacacttaaaggtgatgagaagccagtcgcgtccgtgagaccagtccagagcacgcctatcccaatgatgccacgccacgttccactgggaggaagtgtcagttccgccagttccaccaatccgagcatgaatttcccgatcaactacctgcaacgcgcgggggtgctggtgcagaaggtggttaccacaacagacattgtgattcctgggctgaattcctccaccgacgtgcaggcacggatcaacgccggagaaagtatccatattatccgaggaacgaagggcacctatatacggacgtctgacgggagaatcttcgcggtgcgcgccactggcaagccgaaggtccctgaagatgggaggatggccgcctcggggtcccaaggcccaagctgcgaaagcacatccaacgggcggcacagcgcaagctctcctaaagcgcccgatcccgaaggcctggccaggccagtgtcacctgatagccctgagattatatcagagctccagcagtatgccgatgttgccgccgcccgtgagtcacgacagtccagcccgagcacgaatgccgcattgcctgggccacctgctcaactcatggactcttctgccgtacccggaacagccctagggacagagcccaggttaggggggcattgcctgaacagtagtctgctggtcaccggccagccttgtggagacaggcaccctgtactagatctgcgggggcataagaggaagttggcgacccctcctgccgcacaggagagttctcggcggcggtctcggaaaggccacctgcctgctcctgtccagccctatgagcacggttacccagtctctggtggcttcgcgatgccacctgtctccctgaaccacaatctcacaaccccgtttacgtcgcaggctggtgaaaactcgttgtttatggggagtacaccttcttattatcagctgtctaacctgttagctgatgcccgtctggtgtttcccgtaactaccgatcctctggtaccagccgggcccgtgtcatcctcctcaacggcgacctctgtcacagccagcaacccttcttttatgctcaacccctctgttccgggtatactgccgagctactcacttccattttcacagcctctccttagtgagccaagaatgtttgcaccatttccgtcaccagtcttgccgagcaatctctcccggggcatgtcgatttatccagggtacatgtcccctcatgctggttaccctgctggcggacttcttaggtcacaggtgccaccatttgattcccacgaagtcgccgaggtgggcttctcctcaaacgacgacgaggataaggatgatgatgtaattgaagtaactgggaagtag

SEQ ID NO: 12956 - DNA, 675 bp, Artificial Sequence
  Description of Artificial Sequence: Synthetic coding sequence
atgcctcccaggaaaaaaaggcgacagcctagccagaaggctcctttactttttcaccagcaacccctcgaaggccccaaacatagctgcgctagtacccaattaccaatcacacacactagacaggtctcccctgactttgacactgctgccggaagcctgttccccgcataccaaaaacatcagaatagggcacgacacagctcaaggaaaccgacaacctccaagtttcctcatcttaccttcgaaagcccacagtcttcctcctccgaaactctgggtattcccctcataagagaatgtcctagtgagtctgagaaagacgtgtcgcggaggccactagtccccgtcctttctccacagagttgcgggaatatgtccgtgcaggccctccaatcgcttccttacgtgtttatcccaccggacatccagacaccagagtccagcagtgttaaggaggagctaataccacaggatcaaaaagaaaactcactgctcagctgtaccctccacactggaacccccaattctccagagccaggccccgtccttgtcaaggacacacccgaggataaatacggaatcaaggttacctggcgacggagacagcacctgctggcctatctacgagaacgaggaaagctgtcccgaagtcagttcctcgtgaagtcatag

SEQ ID NO: 12957 - DNA, 1335 bp, Artificial Sequence
  Description of Artificial Sequence: Synthetic coding sequence
atgggctctagcagattgagggtgttcgatccccacctcgagagaaaggacagcgcagccgcacttagcgatcgggaactcccgctgcccactttcgacgtgccctacttcaagtacattgatgaggaagacgaggatgacgaatggtctagccgttcccagtcttccacagaagacgattcagtcgactcacttttatccgaccgatatgtagtagtgagtgggaccccagaaaaaatcctggagcacctgttgaatgacctgcatctggaggaggtgcaggataaggaaacagagactctgctcgacgacttcctcttaacttatactgtcttcatgacaacagatgatctgtgccaggcacttctgaggatatactccgcaaagaaatatcagggtaaggaagagaactccgatgtcccacgtcgcaaaaggaaggttctgcatctcgtatcgcagtggatcgctctgtacaaagattggttacctgaagatgaacactccaagatgtttttgaagaccatttatcgtaatgtcctggatgatgtatacgaataccctatcctagaaaaagagctgaaggaatttcagaaaatcctcggaatgcacaggagacataccgtggacgagtactcccctcaaaaaaagaacaaagccctttttcatcagttcagcctgaaagaaaattggctgcaacacagggggacagtgacagagacggaggagatattctgccatgtgtatattacggaacattcatatgtgtctgtcaaagctaaagtgagctccatcgcccaggagattctactgtgctcccagctggggaagcgagtccagctcgtaaaaaagttcatcaagattgcggcacattgtaaggcacagagaaacttgaattccttctttgctatcgtcatggggctcaacactgccagtgttagtaggcttagccagacatgggaaaagatccctggcaagtttaagaaactcttcagtgagctggaatcactaactgacccatcactgaaccacaaggcctatcgtgatgcgtttaaaaaaatgaagcccccaaagattccatttatgcccctgttgttgaaagacgtgacctttatccatgagggcaataagacctttctggataacctggtgaattttgagaagctgcacatgatagccgatactgtgaggaccctgcgtcattgccgcacgaaccagtttggagacctgtcaccaaaagaacaccaggaactgaagagttacgtcaaccacttgtacgtgattgatagtcagcaggctttgttcgaactgtctcatcggattgaaccacgggtgtag

SEQ ID NO: 12958 - DNA, 2193 bp, Artificial Sequence
  Description of Artificial Sequence: Synthetic coding sequence
atggccataggggtgtggcagctgctgctagatatgggcataatgctgagcgttgaccaacacttatatttccaggatacttacgtcttttatcaattttcttccgatgagtgctcatatctatattgcgaatttgagagagaggaggagtggcagaacggggtaaagttgttacttcagctggtgccacttatcccagctagaggaggcatctgcgaactgagccaccagaagattgaggactccgaggagagttcagatgagatcttggttagactcaccagcgccgtacagcgggaactggctgctgtcatcgcccttaaggcacgtaagtctgctatagaacaagatgaagaaaataacgacaagcacgtcgccgtgaccgaggctgaatcagtccccgactcacaggctggggtcatgtgtaagctccaggaacgcgatgagatcggcagaatagagctggtgcaaaagctggccaaagaaaactaccagtttctgcagacagacaagaaggagcaggagaagtcagaacaccaggacgatgaggtcactaccgtccaggtgaaggagcaggatcaatctgtgctggtattaaagaaagtccaatgctgtggccccgcccctacggccggcagcgcagagagccattggagatacgtggtggtcagcggaactccggagaagattctggaacacctgttgaacgacctccacctcgaggaagtgcaggataaagagacagaaacactcctggatgattttctgctcacctacactgtgtttatgactaccgacgacctatgtcaggccttgcttaggcactactcagcaaagaagtatcagggcaaagaggaaaatagcgacgtcccaaggcggaagaggaaagtgctccatctggtcagtcagtggatcgccctgtacaaggactggctgcccgaggatgagcactcaaagatgtttctgaagaccatctacaggaacgtgctggacgatgtgtatgaatacccaatcttagagaaggaactgaaggagtttcagaagatacttggaatgcacaggcgccatacagtggacgagtattccccccagaagaaaaacaaggccttattccaccagttttccctcaaggagaattggttacagcatcggggcactgtaaccgagacggaggaaattttctgccatgtctacatcaccgaacattcttatgtgtccgtgaaagcaaaggtctctagcatagcccaggaaatcctgaaagtagtcgccgagaaaatccaatacgctgaagaagacctcgctttggtcgctattactttcagtggagaaaagcacgagttgcagccgaatgacctcgtaatcagcaagtccttggaggcgagcggcaggatttacgtgtatcggaaggatctggcagataccctcaatccatttgcagagaacgaagaaagtcagcagcgtagtatgcgcatcctgggcatgaatacctgggatctggcccttgagttgatgaacttcgattggtcactgtttaattccatccatgaacaggaactaatctattttacctttagccgccaggggtccggcgagcacaccgccaacctctctctactactgcagcgttgcaatgaagtgcaactgtgggtggctacggagattctcttatgcagtcagctcgggaagagagtgcaactcgttaaaaagttcatcaagattgctgctcactgtaaggcccagcggaaccttaattccttctttgccatcgttatgggactgaacaccgcctcagtgtctcgcttgtcacaaacttgggaaaagatccctggaaaatttaagaagctcttttccgagctagaatcccttacggatccctcactgaaccacaaagcctaccgagatgcgtttaaaaaaatgaaaccaccgaaaattcctttcatgcccctgctgttgaaggacgtgacattcatacatgagggcaataagacattcctggataatctcgtaaatttcgaaaaactgcatatgattgccgacacggtgcggactctgaggcattgccgcaccaaccagttcggtgacctgtcccccaaggagcatcaggaactgaagtcctacgtgaatcatttatacgtgattgacagccaacaggccttatttgagctttcacatcgaattgagccgcgggtttag

SEQ ID NO: 12959 - DNA, 1743 bp, Artificial Sequence
  Description of Artificial Sequence: Synthetic coding sequence
atgggatcttctagactacgtgttttcgacccacatttggagcggaaggacagcgctgcagcactgagtgatcgggagctgcccctgcctacctttgatgttccctattttaaatatatcgatgaggaagacgaggacgatgagtggagtagtaggtcacagtcttcaaccgaagacgattccgtggactctctcctgagcgaccgctatgtggtggtctctggcacccccgaaaaaatcctagagcacctccttaatgatctacatctggaagaagtgcaggacaaagagactgagacactgctcgacgatttcctcctgacctatacagtgtttatgacgaccgatgacctgtgtcaggctctgttgagacactatagcgctaagaagtaccaggggaaagaagagaatagcgatgtgcccagacgaaaacgcaaagtgctgcaccttgtgtcccagtggatcgccttgtataaggattggctccccgaagatgaacactccaaaatgtttttgaagaccatctaccggaatgtgttagacgacgtgtacgagtatccgatactggagaaggaactcaaggagtttcagaaaatattgggtatgcacagacgacatacagttgatgaatacagcccacaaaagaaaaacaaagctctgtttcaccagttttcactaaaagagaattggctccagcaccggggaactgtgaccgagacagaggaaatcttttgccacgtttacatcaccgagcattcatatgtctctgtaaaagccaaggtgagcagtattgcacaggagatactgaaagttgttgccgagaagatccagtacgcagaagaagacttggctctggtcgctatcacattcagcggagagaaacacgaactgcagcctaatgacctagttatctccaagtctctcgaagcatctggccgcatctatgtctatagaaaagaccttgcggataccttaaacccattcgccgagaatgaggagagtcagcagcgatcaatgcgtatcttagggatgaatacttgggatttggcgctcgagctgatgaatttcgattggtccctgttcaattctatccacgagcaggagctcatttacttcacgttttcacgtcagggctccggcgaacacacagctaatctgagcttgctactccaaaggtgtaatgaggttcagctttgggttgccactgagatcctgctctgttctcaactcggaaaaagagttcagctggttaaaaaattcataaagattgcggcacattgcaaggctcagcgcaacttaaattcgttcttcgccatcgtgatgggtctcaatacagctagcgtgtcacggttgtcgcagacttgggaaaagattccggggaaatttaagaaactattttctgagctggagtcactgaccgacccctctctgaatcacaaagcttacagagatgctttcaaaaaaatgaagccaccaaagatccccttcatgcctcttctgcttaaggacgtgacgtttatccacgagggcaacaaaacctttttggacaacctggtgaacttcgagaagctacacatgatcgctgacacagtacgcactcttcgccactgtcggacgaatcaatttggagacctctcccccaaggagcaccaggaactcaagtcctatgttaatcacctgtatgtgatcgattctcagcaggctctgttcgagctgagccaccgaatcgaacctagagtttag

SEQ ID NO: 12960 - DNA, 1749 bp, Artificial Sequence
  Description of Artificial Sequence: Synthetic coding sequence
atggggagctcacggctcagggtattcgacccccatctcgaaagaaaggactctgcagctgctttgagcgatcgtgagctccccctccccactttcgatgtgccttactttaaatacattgatgaggaagacgaggacgacgagtggtcttcaagatctcagtccagtacagaagacgactccgtcgatagtttgctgagtgaccgatacgtggtagtgtcaggcactccagagaagattctggagcatctgctcaacgacctccatctggaggaagtgcaagacaaggaaaccgagactctgttagatgatttcctactgacttatactgtgttcatgaccacagatgacctgtgccaggctctcttgagaatttacagtgcgaagaaatatcaggggaaagaagagaatagtgacgttccccggcgcaaaagaaaggtgctgcatctggttagccagtggatcgccctctacaaggactggcttccagaggatgagcacagtaagatgttcttgaagactatataccgcaatgtgctggatgacgtgtatgagtaccctatcctggagaaggagctcaaagagttccagaagatcctgggaatgcaccggaggcatacagttgacgaatactcaccacaaaagaagaataaggccctgttccaccagttttcgctgaaggaaaactggctgcagcatcggggtactgtgaccgagacagaagagatcttctgccatgtctacatcaccgagcactcctacgtgtcagtgaaggcaaaggtgtcctccatcgcccaggaaatcctgaaggtcgtcgctgaaaagatacagtacgctgaagaagatctggctctcgtggcaatcacattttcgggcgacaaggaaaagcacgagttacagcccaacgacctcgtaattagtaaatcactcgaggcttcgggacgcatttacgtctacagaaaagacctggcagacacactcaacccttttgctgagaacgaagaaagccagcaaaggagcatgaggattcttggcatgaatacatgggaccttgccctggaactgatgaatttcgactggtcactattcaatagcatccacgagcaggagctgatatatttcaccttctcaaggcaaggcagcggggaacatacagccaatctgtccctcctgctccagaggtgcaatgaagttcaactctgggtggcaactgagatcctactgtgctcccagctgggcaaacgcgtgcagctcgtgaagaagttcataaagatagctgcacactgcaaggctcagagaaatcttaattcatttttcgcgattgtgatgggactgaacaccgcctcagtctcccgcttatctcagacgtgggagaagatacctgggaaatttaaaaagttgtttagtgagcttgagtcactgactgatccttctcttaaccataaagcctaccgcgatgctttcaagaaaatgaagccaccaaagatcccctttatgcctctgctactcaaggacgttactttcatccacgagggaaataagaccttcctggataatctcgttaactttgagaagctgcacatgattgctgacacggtgcgcacgctgcgacactgtagaaccaatcagttcggtgacttaagccccaaagagcaccaggaacttaaatcctatgtgaatcatctgtacgtgatcgatagccagcaagccctcttcgaattatcacatcgaattgagcccagagtgtag

SEQ ID NO: 12961 - DNA, 1122 bp, Artificial Sequence
  Description of Artificial Sequence: Synthetic coding sequence
atgctcctcggcttggcagcgatggagttgaaggtttgggtggacggcatccagcgggtggtctgcggcgtttccgagcagaccacgtgtcaggaagttgtgatcgccctggcccaggccatcggacagactggacgatttgtgctggtccagagactgagggaaaaagaacgccagttattgccccaggaatgtcctgtaggcgcacaagctacgtgtggacagttcgcgtcagatgtgcagttcgtattgaggagaaccggacctagcctggctgggaggccgtccagtgactcttgcccccccccagaaagatgtctcattagggcctcactgcccgtgaagcccagagcggcactcgggtgcgagccacggaagactctaactccagagccagctccttcattgtctcgccccgggcccgctgcgcccgtgactcccactcccgggtgttgtactgacctccgtggcctcgaactccgggttcaacgaaatgccgaggagctcggtcacgaggcattctgggaacaagagctgcgccgcgagcaagcgcgagagcgggaggggcaggctcgtctgcaggccctgtccgctgctaccgccgagcatgcagcccgtctccaggccctcgatgcacaagcacgtgctttagaagccgaactgcagcttgcagcggaggcgcctggccccccttctcccatggccagtgccacagagcgcctgcaccaggacctggccgtgcaagagagacaaagtgcagaggtccagggaagcctcgcgctggtctcccgcgctttggaggctgctgaacgggctctgcaggctcaggcgcaagagttggaggaactgaatcgggagttgcggcagtgtaacctgcaacaattcattcagcagacgggggccgccctacccccaccgcccaggcccgatcggggcccccctggcactcaggggccgctgccaccagctagggaggagtctctactcggcgccccgagtgaatcccacgctggagcacagcccaggccaagggggggtccacacgatgctgagctgctcgaggttgctgctgctccagcaccggagtggtgtcccttagccgctcaacctcaggctctctag

SEQ ID NO: 12962 - DNA, 1014 bp, Artificial Sequence
  Description of Artificial Sequence: Synthetic coding sequence
atgctcctcggtttggctgcaatggagctcaaagtgtgggtggacgggattcagcgtgtggtctgcggagtgagtgagcagaccacatgtcaggaggttgtgatcgccttggcgcaagccataggtcagaccggacgctttgtgctggtgcagaggttgagggaaaaagaacgtcaactacttccccaggagtgccctgttggggcccaagctacttgcgggcagttcgcttctgatgtacagtttgttctccggaggaccggaccatctttagccgggaggccaagttctgatagctgccctccaccagaaagatgcctgattcgcgcaagtttacccgtgaaaccacgcgccgctctggggtgcgaacctcggaaaactttgaccccggagccagcaccaagcctttctagaccaggccccgctgctcccgtgactcccacaccagggtgctgcacagatctgagaggcctggagctcagagtccagcgcaacgccgaggaacttggccacgaggcgttctgggaacaagagctgagaagggaacaggcccgcgagcgtgaggggcaagcccggctccaggcactttcagccgctactgccgagcatgcagcaagattgcaggccctggatgcccaggcccgggccttggaggcagagttgcagttggcagcggaagctccaggcccaccaagcccaatggcctccgcgaccgagcgcctccaccaagacttggctgtacaggaaaggcagtctgcagaagtccagggaagccttgccctggtgagtagggccctggaggcagctgagagagcacttcaggcccaggcccaggagctcgaggaactgaatagggagctgagacagtgcaatttgcagcaattcatccagcaaaccggagcggctttgcctccaccaccacggcccgaccgggggcctccgggaactcaggtgggtgtggtacttgggggcggatgggaagtgcggacatggccttctcccactccatcttag

SEQ ID NO: 12963 - DNA, 1122 bp, Artificial Sequence
  Description of Artificial Sequence: Synthetic coding sequence
atgctgttgggcctggctgccatggaactgaaagtctgggtcgacggcattcagcgcgtggtgtgcggcgttagcgagcagactacatgtcaagaggtcgtgattgcgctagctcaggctattggccagaccggcagattcgtactggtgcagcggctccgtgagaaggaacggcaactcctcccacaggagtgtccggtcggagcccaggcaacctgcggccagttcgcctcggatgtccagtttgtgctcagacgcactggacctagtctggcagggagaccctcatccgatagctgtccccctcccgagcggtgcctcatcagagcgtctctacctgtgaagcctcgtgctgccttggggtgtgaaccaagaaaaacactaacgccagagcctgcccctagcttaagtcgcccagggcccgctgctcccgtcaccccgacacctggatgttgcactgacttgcgcggcctcgagcttcgagtgcagagaaacgctgaggaactcggccacgaggccttctgggaacaggaactcagaagggagcaggccagggagcgtgagggccaggccagactgcaagccctgagcgcagccactgcagagcacgccgcaaggctgcaggcactggatgcccaggcaagagcactcgaagctgagttgcagctcgctgcggaagccccaggacctccttcaccgatggcatctgccacagaacgcctgcatcaggatctggcagtgcaggaacggcagagcgccgaggtgcagggaagcctcgcactggtttctagagctctggaggctgctgaacgggctctgcaggcacaggcacaggagctggaggaacttaacagagagcttcgccagtgtaatctgcagcaattcatccagcagaccggggccgctctcccacctccaccaaggcccgaccgcggccctcccggcactcagggacctcttcctcctgcacgagaagagtccttactgggtgcccccagtgaatcacacgccggtgcccaaccaaggccccgcggggggccacacgatgcagagcttttggaagtggctgcagcccctgctcctgagtggtgtcctttagccgctcagcctcaggccttatag

SEQ ID NO: 12964 - DNA, 1014 bp, Artificial Sequence
  Description of Artificial Sequence: Synthetic coding sequence
atgcttctgggcctagccgcgatggagttaaaggtctgggtggacggcattcagagggtggtctgcggcgtcagcgagcagaccacgtgccaggaagtggtcattgcgcttgcgcaagccatcggtcagacaggtagatttgtgctggtccagcggcttagggagaaagagcgccagttgctgcctcaggagtgccctgtaggggcgcaagccacgtgtggtcagtttgcaagcgatgtacaatttgtcctgaggagaaccgggccgagcttggccggacggccatccagtgattcttgccctcctccagagcggtgcctgattcgggcatcgctccccgtgaagccccgcgcagccctggggtgcgagccccgcaagaccttgactccagagcctgcccctagcttgagccgaccagggcccgccgcacccgtaactcccacccctgggtgctgtacagacctgcggggactggagctaagggtccagaggaatgcagaagaactggggcacgaggcattctgggagcaggagctgaggagagagcaggcgcgcgaacgcgagggtcaggcaaggttgcaggcactttccgcggccacagccgaacacgctgcgcgtctgcaagcactcgatgctcaggcccgggcactcgaggccgaactgcagctggccgccgaggctccagggccccctagtcctatggcttccgctactgagcgtttgcatcaagatctggccgtgcaggaacgacagtcggcggaagttcagggcagtcttgcactcgtgtctcgtgctttggaggccgctgagcgagccctgcaggcgcaagctcaggagctggaagagctcaacagggagttacgtcagtgcaacttacagcagttcatacagcaaacaggagctgctctgcccccaccccctcgaccagatagagggcctcctgggacccaggtgggggtggtgttggggggtggatgggaggtccgcacatggccttctccaacaccatcctag

SEQ ID NO: 12965 - DNA, 963 bp, Artificial Sequence
  Description of Artificial Sequence: Synthetic coding sequence
atgctgctcgggctggcagcgatggaattgaaagtctgggtcgatggcattcagcgggtggtgtgcggcgtgagtgaacagacaacatgccaggaggttgtgatagcccttgcccaggccattggccagaccggtcgctttgtattagtgcagagattacgcgagaaggaacgacagctcctgccccaggaatgcccagtgggcgcccaggcgacatgtgggcagttcgcatctgatgtgcaattcgttttgcgccggacaggccccagccttgcgggaagaccatcctcagattcctgcccaccacccgagcggtgtctaatccgggctagtttgccagtgaagccacgtgccgccctggggtgcgagcctcgcaaaactctgacccctgagcccgcaccctctctctcacgaccaggccccgctgcccccgttacccccacacccgggtgttgtacagacctccgtggcctggaactccgagttcagcgcaacgccgaggagctgggtcacgaggccttctgggagcaagagctccggcgcgagcaggcccgcgagcgtgagggccaggctcggctgcaagccctgtcagctgctacggctgagcacgcagctagactacaagcccttgatgcccaggcgagggctcttgaagcagaactacagttggctgcagaagcccccggacccccttcacctatggcctctgctaccgagcgtcttcaccaagatctggctgtgcaggagcgccagtccgctgaagttcaggggagcttagccctggtctcccgggccctggaggcagctgaaagggccctccaggcccaggcccaagaactggaggaattgaaccgagaacttagacaatgtaatttacagcaattcatccagcagacgggcgctgcacttccaccccccccacggcccgaccgtggtccacccggaacccagtggcccccttag

SEQ ID NO: 12966 - DNA, 255 bp, Artificial Sequence
  Description of Artificial Sequence: Synthetic coding sequence
atgctactcggcctggccgcaatggagttgaaggtgtgggtcgacggaattcagcgtgtagtatgcggcgttagcgagcagactacttgccaggaagtagtgatcgccctggcccaggccatcgggcagaccgggcgcttcgtgctggtccagcggttgcgcgaaaaggaaaggcaactgttgccacaggaatgccctgtaggggcacaagccacctgtgggcaatttgcatcggacgtgcaatttgtgctgtag

SEQ ID NO: 12967 - DNA, 2145 bp, Artificial Sequence
  Description of Artificial Sequence: Synthetic coding sequence
atgaatacgcttcagggaccggtctcttttaaggatgtggccgttgacttcacacaggaggaatggcagcagttagatcccgatgagaagattacctaccgcgacgtgatgctcgaaaattacagccatctggtgtcagttggctatgataccacaaagccaaacgttattatcaaactggagcagggtgaagagccttggataatggggggggagtttccctgtcaacattccccggaagcctggcgtgtggatgatcttatcgaacggatccaggagaacgaagataagcacagtcgacaggccgcatgcatcaacagtaagactctaaccgaggaaaaagagaatactttcagccagatttacatggaaacctccttggtgcctagctctataattgcacataactgcgtctcctgtggcaaaaacttggaatccatcagccagctgatctccagtgacgggtcatatgcccggacaaagcctgacgaatgtaatgaatgtggtaagacctaccatggcgaaaagatgtgtgagttcaaccagaacggcgatacatattctcacaatgaggaaaacatcctgcaaaaaatatctatactcgagaagccgttcgagtacaacgagtgcatggaggcgctggacaatgaagctgtctttatcgcccataagagggcgtacattggcgagaagccatacgagtggaacgacagcggtcccgactttattcagatgtccaacttcaacgcttatcagaggtctcagatggagatgaaaccctttgaatgcagcgagtgtggaaaatctttctgcaaaaagtcaaagtttattatccaccagagggctcacaccggcgagaaaccttacgagtgtaatgtatgcgggaaatctttcagtcaaaaaggcacactcaccgtgcatagaaggtcgcacctcgaagagaagccctataaatgtaatgagtgcggcaagacgttttgtcagaagttacatctcacccagcatctgcgcactcattctggcgagaagccttacgagtgcagtgagtgcggaaaaaccttttgtcaaaagacacatctgaccttgcatcagagaaaccattcaggggagcgcccctatccctgcaatgaatgcggtaagtcctttagtaggaaaagtgcactgagtgaccatcagcgtacccacacaggagagaagctttataagtgcaatgaatgtggaaaatcatactatcggaagagcacactgataacccatcagaggacacacacgggggaaaagccctaccaatgtagcgagtgtggcaagttcttctcacgggtgtcataccttaccatacactatcgctctcatctcgaagagaagccttatgagtgcaatgagtgcgggaagaccttcaatctgaattcggcttttataaggcaccggaaagttcacacggaggagaaaagtcacgaatgtagcgaatgtggtaagttttctcagctgtatctgaccgatcaccatacggcccacctggaggagaagccatacgaatgcaacgagtgtgggaagaccttcctagtcaatagcgcctttgatgggcatcaaccactgcctaaaggtgaaaaatcctacgagtgcaacgtgtgtgggaagttgttcaacgagctctcatattacacggagcattatcgtagccacagtgaggaaaagccctatggctgctctgaatgtggtaaaacattctctcataactctagtctgtttcgccatcagcgagttcatactggcgagaaaccctatgagtgctacgagtgcggaaagtttttttcccagaagagctacctgactattcatcatagaatacacagtggggagaagccgtacgagtgttctaagtgcggaaaggtgtttagtaggatgagcaacctgacggtgcactatcgttcccattctggggagaagccgtacgaatgcaacgagtgtggcaaggtcttttctcaaaagagctacctgacagtgcattaccgaacacactccggcgagaagccctacgagtgcaatgagtgtggcaagaaattccatcacaggtcagccttcaacagccatcagaggatacaccggaggggcaatatgaacgtgctcgacgtagaaaacctatag

SEQ ID NO: 12968 - DNA, 2145 bp, Artificial Sequence
  Description of Artificial Sequence: Synthetic coding sequence
atgaataccttgcagggaccggtgtccttcaaagatgttgctgtggacttcactcaggaagaatggcagcagctggaccctgatgagaagattacctatcgggacgtgatgctggaaaactacagccacctcgtctctgtgggttacgacactactaagcccaatgtcataataaaactagaacagggggaggagccttggataatggggggggagtttccttgtcagcacagtccagaagcttggagggtagacgatctgatagagaggatccaggaaaacgaagacaagcacagccgccaggcggcgtgtattaactccaaaacccttacggaagagaaagagaataccttctcccagatttatatggagacaagcctggtgccttcatctatcatagctcacaattgtgtatcctgcgggaaaaaccttgaatcgataagccaactcatttcttctgatggctcctacgctcggaccaaaccagatgagtgcaacgagtgcgggaagacttatcacggcgagaagatgtgtgagtttaaccaaaatggggacacctatagtcacaatgaagagaacatcctccaaaagatatccattctcgagaagccattcgagtataatgaatgtatggaagcactcgataacgaagcggtgttcatcgcgcataaaagggcatacatcggtgaaaaaccgtatgaatggaacgacagtggtccggactttatccagatgtctaacttcaacgcttaccaacgtagccagatggaaatgaaaccctttgagtgcagcgagtgcgggaaatccttttgtaaaaaatcaaagtttataattcatcagcgcgcccacaccggcgagaagccgtacgaatgcaatgtatgtggtaagagcttttctcagaaaggtacactgactgtgcatagaaggtcccacctcgaggagaagccctacaaatgcaacgaatgcggcaagacattctgtcagaaactccatctgactcaacatttgaggacgcactctggcgaaaagccctatgaatgcagcgagtgcggaaaaacattctgtcagaagacacacctgaccttgcaccagcgcaatcactctggcgagcgaccctacccgtgcaatgagtgtggtaagtccttttccaggaagtctgccttgagtgatcaccaaagaacccacactggtgaaaagctgtacaaatgcaacgagtgcgggaaatcatactacagaaaaagcactctgataacacaccagcgcacccataccggtgagaaaccataccagtgtagtgagtgtgggaaattcttttcacgtgtttcttacctcaccatacactatcgtagccaccttgaggaaaaaccctatgaatgcaatgaatgtggaaaaacgttcaatctcaattcagctttcatccgacatcgaaaggtccacactgaagagaaatcccacgagtgttccgagtgtgggaaattcagtcagttatatctaacagatcatcataccgcccacttggaggagaagccgtacgagtgtaatgagtgcggcaaaactttcctggtcaattctgcctttgacgggcatcagcctctgcctaagggtgagaaaagctatgagtgcaatgtgtgcgggaaactatttaacgagctctcttactatacagagcattacagaagccatagcgaggaaaagccttatggatgtagcgagtgcggcaagacatttagtcataacagcagtctattccggcatcagagggtccacacaggggagaagccgtacgagtgttacgagtgtggcaagttcttttctcagaagtcctacctgaccattcaccaccgtattcactccggagagaagccctatgagtgttcaaaatgtggtaaagtgttttctcgtatgagtaatctcaccgtgcactaccgctcacactccggagaaaagccttacgagtgtaacgaatgtggcaaagtgttttctcagaaaagctacttgacagttcactatagaacccactcaggagagaagccttacgagtgcaacgaatgcggcaagaagttccaccatcgaagcgcatttaattctcatcagagaattcaccgaagaggtaatatgaatgtcctagatgttgaaaatctgtag

SEQ ID NO: 12969 - DNA, 732 bp, Artificial Sequence
  Description of Artificial Sequence: Synthetic coding sequence
atgaacacactgcaagggcccgtctcctttaaagatgtggccgttgatttcacccaggaggagtggcagcagctggacccagatgaaaagatcacttaccgtgatgttatgctggaaaattactctcacctggtttccgtcggatacgacacgacaaaacctaacgttatcattaagctggagcagggcgaagaaccctggatcatgggcggcgagttcccgtgtcagcactcccccgaggcatggagggtggatgacctgatcgagcgaatccaggaaaacgaggacaagcacagcagtcggcctgcccgacgaccttgtggtcctagatgctgctgctgctgttgttgctctagacctcctaggtctcctcctcctaaaccgctgcctaccagaatgctcacgccacgaaaagccttccgtacctgcagtaaagaatccggcttagcagaaactgagagttgtgggcagacacatacctggccccgcgcgctggccgtgctaatgggactttggtggccgcgcgatcagaaggcgggagaagaggatctgcgctttcgcgaaaggcgccctgggctgcaagccaccgccaccggctccggagagcacggcgcatttccggtgcatagccagggagtctgggcttcaacacactggcaaggaaccgcagtttgtcctctgcagacaccacctcctgatgcattcataagaaataataaagtcctgagctag

SEQ ID NO: 12970 - DNA, 342 bp, Artificial Sequence
  Description of Artificial Sequence: Synthetic coding sequence
atgaacaccctccaggggccagtatccttcaaggacgtcgccgttgattttactcaggaagagtggcagcaactggacccagacgaaaagattacctaccgtgatgtgatgttggagaactattcacatctagtttctgtgggctatgatacaactaagcccaacgttataatcaagctcgagcagggtgaggaaccatggatcatggggggagaattcccgtgtcagcacagtcctgcagcattgcctgccggtcatgtggctccagccgtggcggccgcggccgccgctccaggtaggccaggcccacatagacagtcacggtcgccaccaggatgttag

SEQ ID NO: 12971 - DNA, 1554 bp, Artificial Sequence
  Description of Artificial Sequence: Synthetic coding sequence
atggaccctgctggtgctgctgatccaagtgtacccccgaatcccttgacccacctgtctctgcaagatagatctgagatgcagctccaaagtgaggccgaccgtcggtcgctgcccggcacttggacgcggtcctctcctgagcacacaacaatcctcaggggcggcgttcgacgttgtttgcagcagcagtgtgagcagaccgtgcgcatcctacatgctaaggtagcacaaaaatcgtacgggaatgaaaaacgcttcttttgccctccaccttgcgtgtacctgtcaggtccgggatggagagtgaagcctggacaggaccaggcgcatcaggccggggagaccggacccacagtctgtggttatatgggattggactctgcaagtggctcagccacagagacgcagaagttaaacttcgagcagcagcccgattctagggagtttgggtgcgctaaaaccctgtatatttccgatgcagataagcggaaacacttcaggttggttctgagactggtcctcagaggcgggagagaattaggaacttttcactcccgacttattaaggttatttctaaaccttcacagaagaagcaatccctgaagaatacagatctctgcatatcgtccgggtcaaaggtcagtcttttcaacagattacgatcacagactgtatcgaccagatatctgtccgtagaagacggggcctttgtggcaagcgcacggcagtgggctgcgtttactctgcacctggctgacggccactcggcgcagggagattttccacctagagagggctacgtgagatatggtagtctggtacagctggtgtgtactgttacaggcattaccctacccccaatgatcataaggaaggtggctaagcagtgcgctctcctggatgtggatgagccaatctcacagctccacaagtgcgcatttcagttcccagggtctcctcctggcggaggtggtacctatctatgtctggctacggaaaaggtggtgcagtttcaggccagtccctgccctaaggaagcaaatcgggcactcctgaacgacagctcatgttggactatcattggaaccgaatctgtggagttttcgttctccacatctcttgcctgtaccctggagccagtgaccccggtgcctttgattagcactttagaactgtccggaggaggcgatgtcgcgacgctcgaactgcacggtgagaacttccatgccgggctgaaggtctggtttggggatgtggaagccgagacaatgtatcggagccctcgatccctggtctgtgtagtccctgatgtggctgctttctgtagcgattggagatggctgagagcgcctatcacaatacccatgagcctcgtccgtgcagacggcctgttctatcccagtgctttttctttcacttatacaccggagtactccgtccggcctggacacccaggcgtcccagagcctgctactgacgctgacgcccttctggagagcatccaccaggagtttacccgcactaattttcacctgttcatccaaacctag

SEQ ID NO: 12972 - DNA, 1416 bp, Artificial Sequence
  Description of Artificial Sequence: Synthetic coding sequence
atggaccccgcaggggccgctgatcctagcgtccctccgaatcctcttacacatctgagcctgcaggatcggagcgagatgcagcttcagagcgaagccgaccgtcggagcctccccgggacctggacccgatcatctccagagcatacaactattctgaggggtggcgtgcggcgctgcttgcagcagcagtgcgaacagaccgtgagaatcctacacgcgaaggtcgcccaaaaaagctacggcaatgagaaacggttcttctgtccgcccccctgtgtgtacttgtctggtccaggatggagagttaaacccggccaggatcaggcccatcaggcaggagagaccggaccaacggtatgcggttacatgggactcgattccgcaagtggcagtgccaccgaaacccagaaactcaactttgagcagcagcccgactcaagagaatttggatgtgccaagaccttgtatatttcagacgccgataagcggaagcactttaggctcgtcttaagactggtcctgaggggagggagggaactgggcaccttccatagccggcttattaaggtgatatccaaaccctcccagaagaaacaatccctcaagaataccgatctatgtatcagtagtggatccaaagtaagcctattcaaccggctccggtctcagacggtctcaaccaggtatcttagcgtggaagatggagcatttgtggcaagcgcccgccagtgggccgcttttacactgcatcttgccgacggccacagcgcccagggggacttccccccacgtgaggggtatgtgcgttatggatccctggtccagttggtgtgcactgtcactggaattactttgccccctatgatcattaggaaggtggccaagcagtgcgccttgctagacgtagacgaaccgatctctcaactccataaatgtgccttccaatttccgggaagtccacctgggggcggcggcacttatctgtgcctcgcaaccgagaaagtcgtgcaattccaggcatccccgtgccctaaagaggccaacagagctctgctaaacgatagtagctgctggaccataatcggcacagagtccgttgagttcagtttttcaactagtcttgcctgcacgcttgagccggtcactcccgtgcccctgatttcaactctcgaactgtcgggtggcggggatgtggcaacactggaactgcacggcgagaattttcacgctggattgaaggtatggttcggcgacgtagaggccgagaccatgtaccgatatggcgtcgaaccagcagtccccggtgtccggggggcagggaggggtggactgcttcagcggctcgcactggccgccaggagtcaccataatcctcacgaacccggcgcgcgccgaagggcactcctgccttag

SEQ ID NO: 12973 - DNA, 1551 bp, Artificial Sequence
  Description of Artificial Sequence: Synthetic coding sequence
atggacccagctggagccgcagacccttccgtgccgcccaacccattgacacacctaagcctccaggacaggagcgagatgcagttgcagtctgaagctgacaggaggagcctccccggaacctggacacggtcaagcccagagcacacaactattctgcgaggaggagtaaggagatgtcttcagcaacagtgcgaacaaacagtgaggattctgcacgctaaggtggcccagaaatcctatggaaacgagaaaaggtttttctgtccccccccttgtgtgtacctcagtggccccggctggagggtgaagcccggacaggatcaggcacaccaagctggagaaacaggccccacagtttgtgggtatatggggctcgatagcgcaagtgggagtgcgactgagacccaaaaacttaactttgagcagcagcccgactcccgagagtttggctgcgctaaaaccctgtatatctcagatgccgataaaaggaagcacttccggctggtgttgcggttagtgttgagaggaggccgcgagttaggcaccttccactcccgtctcatcaaagttatctcaaagccgagccagaagaaacagtcactcaaaaacacagatctttgcataagttcaggctccaaagtgtcactctttaatcggctgagaagccagactgtcagcacccgatacttgtctgtggaggacggtgctttcgtggccagcgccagacagtgggcagcattcactctgcatctggctgatgggcacagcgctcaaggggattttcccccccgagagggctacgtgcgatatggcagccttgttcagctggtctgtacagtcacgggtataaccctgcctccaatgattatccgtaaagtcgctaaacagtgcgcactcttggatgtggatgaaccaatttcacagctccacaaatgcgcattccagttccctggatcgccacctggaggagggggcacctatctgtgcctcgccaccgagaaagtggtgcagttccaggcatcaccgtgcccaaaagaggccaacagagctctactgaacgactcttcatgttggaccattatcggtacagagagtgtagaattttccttcagtacctccttagcctgtaccctagagcctgtgacccccgttcctctgataagcactctggagctgagtgggggcggagacgtggctacattggaattacacggggagaacttccacgccgggctgaaggtgtggtttggggacgttgaggctgaaactatgtactcccctcgcagcttagtttgcgtagttcccgatgtggcagctttttgctctgactggaggtggctgcgggctcccatcacaattcctatgagtctggtgagggcggacggattattttatccctctgcatttagctttacatacacgccggagtattctgtccgtcccgggcatccgggagtgcctgagccagccacagacgcagatgccttactcgaatcaatccaccaggagtttacacgcactaatttccacctcttcatccagacttag

SEQ ID NO: 12974 - DNA, 2124 bp, Artificial Sequence
  Description of Artificial Sequence: Synthetic coding sequence
atgcaaacttccgagacaggtagtgatacgggaagtacggtcacccttcagaccagcgtggcaagccaggcagccgtccctacgcaagtggtgcaacaggtgcctgtgcagcaacaagtacagcaggtgcagaccgtacagcaagtccagcacgtgtatcccgctcaagttcagtatgtggagggcagtgacacagtgtataccaacggggccatccgaaccacaacctatccatacactgaaacacagatgtacagccagaatactggtgggaattactttgatacacagggatccagtgcacaggtgacaacagtggtgtcatcccactcaatggtgggcacaggtgggatccagatgggcgtgactggcgggcagctcatttccagctctggcggaacttacctgattggtaattccatggaaaattccggtcattcagtgacccacaccacacgcgcgagtccagctactatagagatggccatcgaaaccctacagaaatcagacggcctgagtacacacagatcttcccttctcaattcccacctgcaatggttgctggacaactacgagacagcagagggggtgagcttgccaagaagtaccctgtataaccactacctgcgccattgtcaggagcacaagctagaccccgtaaacgctgctagcttcggcaagctgatcagatccatatttatggggttgcgaacaagaaggctcggaaccagaggcaattctaaatatcattactacggaatccgcgttaagcccgactcccctctcaatagactacaggaggacatgcagtatatggcaatgcgccagcagcctatgcagcagaaacagcggtacaagcccatgcagaaagtggatggggtcgccgatggttttactggaagtggccagcagaccgggacctctgtcgagcagactgtgatagcccagtcacagcaccaccaacagtttctcgacgcttcacgggccctcccagaatttggagaggtcgaaatttccagtcttcctgacggcactaccttcgaggatatcaagagcttgcagagtctgtaccgagaacattgcgaagctatcttggatgtggtggtaaatctccagttttcacttatcgaaaagctgtggcagaccttttggcggtactcaccttccactccgacggatggcaccactattaccgagagttcgaatctttctgagatcgaatctagactgccaaaggctaaattaattacactgtgtaagcacgaatccatcctgaagtggatgtgtaactgtgatcacggcatgtaccaagctctggttgaaattctcatccccgacgttctaaggcctatcccgagtgccctgacccaagctataaggaacttcgccaaatcgctggagggttggctctccaatgcgatgaacaatatccctcagaggatgatccagacaaaggtggctgcagtaagtgcctttgcgcagacgctgcggagatatacaagccttaatcacctggcacaggctgcccgcgccgttttgcagaacacttcccagattaatcaaatgctgagcgacttgaaccgcgtagactttgctaacgtgcaagaacaggcctcttgggtctgccagtgcgatgacaacatggttcagcgcctggagaccgatttcaaaatgaccctgcagcagcagagtaccttggagcagtgggctgcttggctcgacaacgtaatgatgcaggctctcaaaccctacgagggtcggccaagcttccctaaagcagccaggcagttcctgctgaagtggagcttttacagctccatggttatccgagatctgaccctgagaagcgccgcctccttcggctccttccaccttattcgcctcctgtacgacgagtacatgttctacctcgtagagcacagagtggcgcaggccaccggcgagactcctattgccgttatgggagaggtgagggaggcagagcgagctgtgacccactgggtgatcaagaacaagcccgagcttcacttcagcctgaacaccctgctgattaaaaccatggtgcctaatcaggtttcattgagagcccgaagagactgcggggtcattgctcgagtgccctag

SEQ ID NO: 12975 - DNA, 2124 bp, Artificial Sequence
  Description of Artificial Sequence: Synthetic coding sequence
atgcagacatctgagactggctctgatacaggctccactgttactctgcaaacatcggtcgcaagtcaagcggccgtgccaactcaggtggtccagcaggtccccgtacagcagcaagttcagcaggttcagacagtgcagcaggtgcagcatgtttatcccgctcaggtgcaatatgtggaggggtcagacactgtgtatacgaacggcgccattcgcacaaccacctacccgtacacggagacccagatgtatagccaaaacacgggcgggaattacttcgacacccagggttcttccgcacaagtgaccaccgtcgtgagcagccactctatggtgggaactggcggcatccagatgggcgtaaccgggggtcagcttatctcctccagtggtgggacctatctgatcgggaacagtatggagaactctggacatagcgtgacccacacgacaagagcaagccccgcaacaatcgagatggccattgagaccctgcagaaatcagacgggctgtctactcacagatcttcactgctaaatagccacctacagtggctgcttgacaactacgaaaccgctgagggggtatctcttccaaggagtacgttgtataatcactacttgcggcactgccaagagcataaactagaccctgtgaatgcagcttcatttggaaagttgatccggtccatcttcatgggcctgcgaactcggcgcctcgggacccgcgggaactcaaagtaccactactatggcattcgggtgaagcctgatagccccctcaacagactccaggaggatatgcagtatatggcaatgcgacagcagcccatgcagcagaaacagaggtacaaaccgatgcaaaaggtggatggtgtcgctgatggatttactggaagcgggcagcagacgggcacctctgtagaacagaccgtcatcgcccagagccagcatcatcagcaattccttgacgcaagcagggccttgccggagttcggggaggtggagatctcaagcttgccagacggcaccacttttgaggacattaaaagcctccaatcgctctacagagaacactgtgaagcaatcttggacgtggtcgtgaacctgcagttcagcctaatcgagaagctgtggcagacattttggcgttacagtccttcaactcccaccgatggcacaacaatcacagaaagctcaaacctgtcagagatcgaatccaggctgcccaaggcaaagctgatcaccctttgcaagcatgagtctatacttaagtggatgtgcaactgtgatcacggaatgtaccaggctctcgtggaaatcttgattccggatgttctccggcccatcccttcggcattgacccaagccataaggaattttgcaaaatcactcgagggctggctttcaaacgccatgaacaatattcctcagagaatgatccagacaaaagtggcagcagtgtcagcttttgcacagactttacgacggtatacaagcctgaatcacctcgcccaggcagcaagggcagtcctacagaacacatcccaaattaaccaaatgctctccgacttgaatagggtggactttgctaatgtgcaggagcaagcttcttgggtgtgtcagtgtgatgacaatatggtgcagcgcctggagactgattttaagatgacattacagcagcagtcaacgttagaacagtgggctgcttggctggacaatgtaatgatgcaagccctaaaaccttatgaaggtagaccatctttccctaaagctgcaaggcaattccttctgaagtggtccttttactcctccatggtcattagagatctgacactgcgtagcgctgctagttttggctcattccacttaattcgcctgttatacgatgaatatatgttttacctggtcgagcaccgcgtcgcgcaggctacgggggagacccccatcgccgtgatgggcgaggtcagagaagccgagagagctgtcacacattgggttataaaaaataaaccagagttgcactttagcctcaatacactactgattaagaccatggtccctaatcaggtgagcctcagggcccgaagggactgcggcgttatcgctagagttccgtag

SEQ ID NO: 12976 - DNA, 258 bp, Artificial Sequence
  Description of Artificial Sequence: Synthetic coding sequence
atgcagacaagcgaaaccggaagtgatacaggttctactgttactctccagaccagcgtcgccagtcaagctgctgtgcctacccaggttgtacagcaggtgcctgtgcagcagcaagtgcaacaggtgcagaccgtgcagcaggtgcagcacgtctacccagcacaagtccaatacgtggagggaagcgatacggtttacaccaacggggccatgagtcgggcgccatggtcaatgattctagagtcctcaccttag

SEQ ID NO: 12977 - DNA, 588 bp, Artificial Sequence
  Description of Artificial Sequence: Synthetic coding sequence
atgcagacctctgagacaggaagcgacaccggttccaccgtgacgctccaaaccagcgttgccagtcaagcagctgtgccgactcaagtggtgcaacaggtccctgtccagcagcaggtccagcaggttcagacagtgcagcaggtgcagcacgtgtatccagctcaagtgcagtatgtggagggatccgacacagtgtacacaaacggggctatcagaaccactacgtatccctacacagagactcagatgtactcacagaatactggaggaaactatttcgacacccagggaagctccgcacaggtaactacagttgtctcctctcatagcatggtaggcacaggcggtatccagatgggcgtcaccgggggacagctcatcagtagttccgggggaacatacctgatcgggaactcaatggagaactccgggcattctgtgacacatacgacaagggcctcgcccgcaactgctaacagtgttccagaaatgaagcttctgcgtcagatcacaatgaatcgactgttccccaccctgaatcacaaactcactgaaggtagcggccctcatttccaaagcatctag

SEQ ID NO: 12978 - DNA, 417 bp, Artificial Sequence
  Description of Artificial Sequence: Synthetic coding sequence
atgctttcagacctaaatcgagtcgattttgcaaacgtgcaggaacaggctagctgggtatgtcagtgtgatgataatatggtgcagcgcctcgagaccgattttaaaatgaccctgcagcagcagagcactctggaacagtgggccgcgtggctggataatgtgatgatgcaggctctgaagccatatgaaggaaggccaagcttccccaaggcagcacgccagttcctactcaaatggagcttctactcctccatggtgattcgggatttgacgcttcgatcagccgcaagcttcgggtctttccaccttattcgcttactctatgacgagtacatgttttatttggtcgagcacagggtcgctcaggcaacaggcgaaactccaattgctgtcatgggtgaagtgcccatgtag

SEQ ID NO: 12979 - DNA, 651 bp, Artificial Sequence
  Description of Artificial Sequence: Synthetic coding sequence
atgcagacatccgagacaggatctgatacgggcagcactgtgacattacagacatccgttgcctcccaagcagccgtgcccacccaagtggtccagcaagtcccggtccaacagcaagtccagcaggtgcagaccgtgcaacaggttcagcacgtctaccccgctcaggtgcagtacgtggaaggcagcgacacagtatacactaatggcgctattcgtaccactacatatccctacaccgagacacaaatgtatagtcaaaacacaggcggtaactatttcgatacccaggggtcatcagctcaggtgacgaccgtcgtctcctcgcactctatggtaggcacagggggcattcagatgggagtgaccggcggacagctgatttcctcaagcggcggcacctatctgatcggcaattctatggaaaactccgggcactcagtcacgcataccacgagagctagtcccgctactttgcaatggcttctggataattatgagacagccgagggcgtctctctccccagatctaccctctacaatcactatctgagacactgtcaagaacacaaactcgatcccgttaacgctgcatccttcgggaagctgatacgctctattttcatgggcctgcgaacacggaggctctag

SEQ ID NO: 12980 - DNA, 2250 bp, Artificial Sequence
  Description of Artificial Sequence: Synthetic coding sequence
atgcaaacgtcggaaacagggtcagatacgggctcaactgtgactctgcaaacttccgtagcaagtcaagctgctgtgccaacccaggttgtacagcaagttcccgtgcagcagcaagtgcagcaggttcaaacagtgcaacaggtgcagcacgtgtaccctgcacaggtacagtatgtggaagggtcggacaccgtatataccaatggcgccattagaacaacaacatacccctacaccgagacacagatgtattcccagaacactgggggcaactactttgacactcagggcagttctgcccaagtcacaactgtggtgagttcccacagcatggtgggcacagggggcatccagatgggtgtgacgggcgggcaattaatctcatctagtggcggaacatatctgatcggtaactccatggaaaactcaggccactccgtaacacatactacacgtgctagtccagcaactatcgagatggccatcgaaacccttcaaaagtccgatgggctgtccactcatcggtcctcccttttgaactctcacctccaatggctgttggacaactatgaaaccgcagagggcgtgtccctgccccgcagcaccctgtacaaccactacttgcgccactgccaggagcataagttagatcccgttaacgcagcatcttttggcaaactgatacggagcatcttcatggggctgaggacaaggcggttgggcactcgaggtaattcaaaatatcattattatggcatcagggttaaaccagattcgcccctgaaccgactccaggaggacatgcagtacatggccatgagacaacagccgatgcagcagaaacaacggtacaagccaatgcagaaagtggatggagtggcagacggctttaccggctcaggacagcaaaccggcactagtgtggagcaaactgtcattgcccagtcccaacaccatcagcaatttctggatgccagcagagccttgccagagttcggcgaagtcgagattagttcactgcccgatgggactacttttgaagacatcaaaagcctccaatcactgtaccgtgaacactgcgaggctatcctcgacgtcgtggttaacctgcaattttctctcattgaaaagttgtggcagactttctggcgatatagtcctagcactccgacagacgggaccacaatcaccgagagtagcaatctgtcagagattgagtctaggctgccaaaggccaaactgataactctctgtaagcacgaaagtatcttgaaatggatgtgtaactgcgaccatggcatgtaccaggctttggtcgagatcttgataccagatgtcctgcgcccaatcccatccgctcttacccaggccattagaaacttcgcgaaaagcttagaggggtggctgagcaacgctatgaataacatcccacaaaggatgattcagacaaaggtggcagctgtttctgccttcgcccagacgttgcgccggtacacctctttgaatcatcttgcccaggcagctagagctgtgctgcagaatacttctcagatcaaccaaatgctgtccgacttgaatagggtggactttgcaaatgtacaagaacaagccagctgggtgtgccagtgtgatgataacatggtgcagaggctcgaaactgacttcaaaatgacactgcagcaacagagcacactcgaacaatgggctgcctggctggacaatgtcatgatgcaggccttgaaaccctacgaggggcgtccttcttttcccaaggcggctcgtcaattcctgctcaagtggtctttctactcgagtatggtcattcgcgacctgacactcagaagcgcagccagctttgggtcgttccacctgattcgactcctttacgatgagtacatgttttatttggtggagcacagggttgcacaggcaacaggagaaaccccaatagcagtgatgggcgaatttggtgacttgaatgccgtgagcccaggcaatctcgataaagatgagggttcagaagtggaatctgagatggacgaagagctggatgattcaagcgaacctcaggcaaaaagagagaaaacagagttgagccaagccttcccagtgggctgcatgcagcccgtgcttgagaccggcgtccaaccatctttgctcaatccaatccactcagaacatatagtcacatccacccagactatccgccaatgtagcgccaccggaaatacctataccgccgtgtag

SEQ ID NO: 12981 - DNA, 471 bp, Artificial Sequence
  Description of Artificial Sequence: Synthetic coding sequence
gtccagcaggttcagactgtgcagcaagtgcaacacgtgtatcctgctcaagttcagtatgttgagggctccgatactgtttacactaacggtgccattagaactaccacttacccatatactgaaacacagatgtattctcagaatacaggcggcaattactttgacactcagggaagctctgcacaggtcactacagtggtttcttcccactctatggtgggcacaggaggtattcaaatgggggtcactgggggccagctgatctcttcaagtggcgggacctaccttattgggaactctatggagaactccggacatagcgttacacatacaactcgcgcgagccctgctacagcaaactctgttccagaaatgaaactcttacggcaaataactatgaaccgactctttcccacccttaatcataaactgaccgagggtagtgggcctcacttccagagtatctag

SEQ ID NO: 12982 - DNA, 408 bp, Artificial Sequence
  Description of Artificial Sequence: Synthetic coding sequence
gttcaacaagtgcagactgtgcagcaggtccaacacgtgtaccccgctcaagtgcaatacgtggaagggagtgacaccgtctatacaaatggagcaattcggaccactacctatccatacaccgaaactcagatgtatagccagaataccggcggtaactacttcgacactcagggcagctctgcacaggttaccaccgtggttagctcccacagcatggtcgggacagggggaatccaaatgggcgtgacgggtggacagctgatcagctctagcggggggacctatctgattggcaattctatggagaactcgggccactcagtgacgcacactacacgcgcctcgcccgctacccttttcctgttttcttgtgtaccattcagcctgggacaactctctccttag

SEQ ID NO: 12983 - DNA, 417 bp, Artificial Sequence
  Description of Artificial Sequence: Synthetic coding sequence
atgcaaactagtgaaactggaagcgacaccggctcaaccgtcacattgcagacttccgtggctagccaggctgccgtgccgacgcaggtcgttcagcaagtgcctgtgcaacagcaggtgcaacaagtgcagacggttcagcaggtgcagcacgtctaccctgctcaggttcagtatgtggagggcagcgacaccgtgtacactaatggtgcgatcagaacgacaacctatccttatactgaaacacaaatgtacagtcaaaataccggaggtaattatttcgacacacagggaagcagcgcccaggtgaccactgtcgtgtcctctcactctatggtagggacaggaggtattcagatgggagtcaccggaggccagcttatctcatcctccggtggaacgtaccttatcggctag

SEQ ID NO: 12984 - DNA, 375 bp, Artificial Sequence
  Description of Artificial Sequence: Synthetic coding sequence
gagcaagcctcctgggtgtgccagtgtgatgacaacatggtccagaggctggagactgattttaagatgacactgcagcagcagtcaacccttgagcaatgggcggcctggctggataatgtgatgatgcaggccctgaagccatatgaaggaagacctagtttcccgaaagccgccagacagtttttgctaaagtggtccttttatagttcaatggtaatcagggacctgacactgcgctccgcagcctcattcgggtccttccatctgatacggttgttgtatgacgagtacatgttttatctggtggagcaccgtgtcgcgcaggccactggggaaacaccaatcgcagtcatgggtgaagtacctatgtag

SEQ ID NO: 12985 - DNA, 555 bp, Artificial Sequence
  Description of Artificial Sequence: Synthetic coding sequence
atgcaaacctccgagaccggctcggatactggatcaacagtcaccctccaaacaagtgtggctagccaggccgccgtgcctacccaggtggtccagcaggtccccgttcaacagcaggttcagcaagtacagaccgtccagcaggtgcagcacgtatacccagcacaggtccaatacgtggagggctccgatacggtgtatactaacggagctattcggactactacttacccgtacaccgaaacccagatgtacagccagaatacgggaggtaattactttgatactcagggttccagcgcacaagtgaccacggtggtgagctcgcattcaatggtcggtaccgggggcatacagatgggggttacaggtggtcagcttattagctcaagtggcggtacctacttgatcggaaatagtatggagaattccggccatagtgtgacccacaccaccagagcatcgccggctacaatcgaaatggctatcgagactctccagaaatccgacgggttgtccacacacagaagctcactgctcaatagccacgtctag

SEQ ID NO: 12986 - DNA, 651 bp, Artificial Sequence
  Description of Artificial Sequence: Synthetic coding sequence
atgcagacctcagagaccgggagtgacaccggctccaccgttacactgcagacttcggtcgccagccaggccgccgtcccgactcaagtcgtccagcaggtgccagtccagcagcaggtccaacaagtgcagactgttcaacaggttcagcatgtctacccggctcaggtacaatacgtggaaggttcggacacagtgtacacaaatggagcaatacgcacgaccacatacccgtacaccgagactcagatgtatagccagaacacgggagggaactatttcgacactcagggcagtagcgctcaggtgaccacggttgtatcaagtcattcaatggtgggcaccggtggaattcaaatgggagtgactggagggcagctgatctcttcaagcggtggaacgtatcttataggcaacagcatggagaattcaggtcattccgtcacacacacaacacgcgccagtcccgcaacgctgcagtggcttctcgacaattacgagacagcagagggggtgagcctgccacgtagtaccctttacaaccactatctgagacactgccaggagcacaaattagaccctgttaatgctgcctctttcggcaagttgatcagatcaatttttatggggctgcgcacccgtcgactttag

SEQ ID NO: 12987 - DNA, 525 bp, Artificial Sequence
  Description of Artificial Sequence: Synthetic coding sequence
atgtgcaactgtgatcatggcatgtatcaggccctcgtggagatactcattcctgacgtcctgcgcccgattccatctgccttaacccaagccatacgcaacttcgccaagtccctggaggggtggttatcaaacgccatgaacaacattccacagcgcatgatacagaccaaagtggccgcagtttctgcctttgctcaaacactcaggagatacacgagtcttaaccacttggcacaagccgcccgcgctgtattacaaaacacatcacaaatcaaccaaatgctgtccgacctcaatagggtggatttcgccaacgtgcaagagcaggcctcatgggtgtgccagtgcgacgataatatggtgcagcgattggaaaccgattttaaaatgacactgcagcaacaatcgacactggaacagtgggccgcctggctggacaacgttatgatgcaagccttaaaaccatatgaaggaagaccctctttccctaaggcagcaagacaattcttgctgaaatggtag

SEQ ID NO: 12988 - DNA, 330 bp, Artificial Sequence
  Description of Artificial Sequence: Synthetic coding sequence
atggctgtggtgggcgtaagcagcgtcagtcgacttcttggtcgcagccgacctcagctcggtcggcctatgagctccggggcccacggggaggagggctctgcaagaatgtggaagacgctcaccttcttcgtggctttaccaggagtggctgttagcatgctcaatgtgtacctcaagtcacatcacggggaacacgaaaggcctgagtttatcgcctaccctcatctgaggatccggaccaagccattcccctggggcgacgggaatcacacgctgttccacaacccccacgtcaatccacttcccacaggttacgaggatgagtag

SEQ ID NO: 12989 - DNA, 2235 bp, Artificial Sequence
  Description of Artificial Sequence: Synthetic coding sequence
atgattaaacgccgtgcacacccgggcgccggcggggaccgcaccaggccacgccgccggcgctccacagagtcttggatcgagcggtgcctgaacgaaagtgagaataagaggtattccagccatacctcgctagggaacgtgtcaaatgatgagaatgaggaaaaggagaacaatcgggccagcaaaccacatagcacccctgcaactctccagtggctggaggagaactacgagattgccgagggcgtgtgtattcctcgttcggctctctacatgcactacctggacttttgcgaaaagaatgacactcagcctgtgaacgcggcttcgttcggaaagattataagacagcagtttccccagttgacaacaagaaggctgggcacacgtggtcagtctaagtaccattattatggcatcgccgtcaaagaaagttctcaatattacgacgtcatgtactctaagaaaggcgccgcatgggtgagcgagaccgggaagaaagaggtgtctaaacagacagtggcttacagccccaggagtaaattgggcactctcctgcctgagttcccaaacgtgaaagacttaaacttgcctgctagcctgcccgaggagaaggttagcaccttcattatgatgtatcgaacccattgtcaaagaattctggataccgtgataagagcaaacttcgacgaagtgcagtcttttctgctgcatttttggcaaggaatgcccccgcatatgctgccagtgctagggtcgagcaccgtggtgaacattgtaggggtctgcgattctatattgtataaggccataagtggcgttcttatgcctacagtgctacaggcactacccgacagcctgactcaggttatccgcaaatttgccaaacagctcgacgagtggcttaaggtggctctgcacgatctcccggaaaatttgagaaacattaagttcgaattatcccgcaggttcagccagatattaaggcgccaaacttcacttaatcatctgtgtcaggcttcccgcactgttatccactccgctgatatcaccttccaaatgctagaagactggcgcaatgtagacctgaattcaattaccaagcagacactctacacaatggaggacagcagagacgaacacagaaaattgattacacagctgtatcaagagtttgaccatttacttgaagagcagtcccccattgaaagctatatcgaatggctggacaccatggtcgatagatgtgtcgtcaaggtggccgctaaaagacaggggagcctgaagaaggtggcacaacagtttctcttaatgtggtcatgttttggcacaagagtaatccgggacatgacgctccacagcgccccgtccttcggaagttttcacctgatccaccttatgttcgatgactacgtgctgtatttgttggaatcactgcattgtcaggaacgagctaatgaactcatgagggcaatgaagggggaaggttccacagccgaggtgcgagaggagatcatcctaaccgaggcagcagcccctaccccctctcccgtgcctagtttttcacccgctaaatctgccacatcggttgaggtgccaccacctagttcaccggttagtaatccgagtcccgaatatactggtcttagtacaaccggcgcaatgcagtcttatacatggtcgctgacatacaccgttaccacagcggctgggtcacctgctgagaattctcaacagctgccatgtatgagaaacacccacgttccgagctcttctgtaacccaccgtattcctgtatacccccatcgggaagagcacggatatacagggtcctacaactatggttcatatggcaatcagcatcctcatccgatgcaatcccagtacccagcactgccacatgacacagcgatctctggacccctccattacgctccctaccatcgctcaagcgcacagtacccattcaactcccctacttccaggatggaaccttgtctcatgtccagcacgcctcgtctccatccgaccccagtaacgccacgctggcctgaggtcccatcagccaacacctgttatactagcccatcagttcactctgccaggtacggaaactcctcggatatgtacacgccacttactacccgacgcaattccgagtacgagcacatgcagcatttcccaggcttcgcctacatcaacggagaggcttccacgggatgggccaaatag

SEQ ID NO: 12990 - DNA, 2208 bp, Artificial Sequence
  Description of Artificial Sequence: Synthetic coding sequence
atgcattgtggcctcttggaggagcctgatatggatagcacagagagttggatcgagaggtgcctcaacgagtccgagaacaagaggtactcaagccacacatctctcgggaacgtgtctaatgatgagaacgaagagaaagaaaataacagggcctccaagccacactctaccccagccactctgcaatggctggaggaaaattatgagatcgccgagggggtctgcatcccaaggtccgctctttatatgcactacctcgacttctgcgaaaagaatgatacccagcctgttaatgccgccagctttggcaaaattataagacagcagtttcctcagttgacgacacgcagactggggactaggggacagtccaagtaccattattatggaatagctgttaaggagagctctcagtactacgatgtgatgtattcaaagaaaggcgcagcatgggtttccgagaccggaaaaaaagaagtgagcaagcagactgtggcttattctccgcgcagcaagctgggcacccttttaccagagttcccaaacgttaaggacctgaacttgcctgcttctttgcccgaagagaaagtctctacgttcatcatgatgtaccgaacccattgtcagagaatcctggatacagtgattcgtgccaatttcgacgaagtccagtcattcttactgcatttctggcagggcatgccccctcacatgctaccagtactcggttcaagtacggtggtgaacattgttggcgtgtgcgactccattctgtacaaagccatttctggtgtgctcatgcctaccgtgcttcaggctctccctgacagtcttacgcaggtaatccggaaattcgcgaaacagctcgacgagtggttgaaggtcgccctgcatgacttacccgaaaaccttagaaacattaagttcgaactgagcaggcgcttttcacagattctccggcgccaaacctcgctcaatcacctgtgtcaggcaagcagaactgtgatccactcagccgacataacctttcagatgcttgaggattggagaaatgtggacttaaatagtataactaagcagaccctttacaccatggaggattcccgcgacgaacaccgcaagcttattacccagttataccaagagtttgaccatctgcttgaagaacagtctccaattgaatcatatatcgaatggttggacaccatggttgacaggtgcgtcgtgaaagttgcagccaaacgccagggtagcttgaagaaggtggcccaacaatttcttttgatgtggtcctgcttcgggacccgagtgattcgggatatgacattacattccgctccttccttcggtagttttcatctgattcatctcatgttcgatgattatgtgctctacctgctggagtctcttcattgtcaggaaagggccaacgagctcatgcgggccatgaaaggagaagggagtacagccgaggttagagaggaaatcattttgactgaagccgctgctcctactccaagtcctgttccttcattctcccccgccaagagcgcgacatctgtagaggttcccccgccctcttccccagttagtaacccaagcccggagtataccggtctatccaccacgggcgctatgcagtcatatacatggtctctgacttacactgtaaccactgccgcaggtagtccagcagagaactcccagcagcttccttgcatgcgcaatacccacgtgcccagcagtagcgtgacacaccgcatccctgtgtaccctcaccgagaagagcatggatacacaggttcctacaactacggaagttacgggaatcagcacccccatcccatgcagagtcagtacccggccctgccacacgacaccgctatcagtggaccactacactatgcaccttaccaccgctcatcagctcagtacccattcaattcgccgactagtagaatggagccatgcctgatgagttccacaccacggctgcatcctacccctgtgaccccccggtggcccgaggtgccaagcgccaacacttgctacacctcaccgtctgtccactcagctaggtatggcaattccagtgatatgtatactccactgactaccagaagaaattcagagtatgaacacatgcaacatttcccggggtttgcgtatattaatggggaagcatccactgggtgggccaaatag

SEQ ID NO: 12991 - DNA, 1761 bp, Artificial Sequence
  Description of Artificial Sequence: Synthetic coding sequence
atggcggagggagtaccagcctcccctagctcaggcgaaggatccagaggtccccacagcggtgtgatccagtggctggttgacaatttctgtatttgcgaggagtgcagcgtgcctcgatgcctaatgtatgaaatttatgtcgaaacatgcggacagaacactgagaaccaggttaaccccgccacgttcggcaagctggtgagacttgtattccctgatctggggactcggcgtttagggacacgcggctcagcaagatatcattacgatggtatttgcatcaagaagtctagctttttctacgcgcagtactgctacctgattggggagaaaaggtatcactctggagacgccattgccttcgagaagagtactaactacaactctataatccaacaagaagccacatgtgaagaccattctccaatgaagacagatccagtgggaagccctctgtctgaattccgacgctgcccattcctggagcaagagcaagccaagaagtactcctgtaacatgatggcgtttctagccgacgagtactgtaattactgcagggacattttacgcaatgtcgaggacctgctcaccagcttttggaagagcctgcagcaggataccgtgatgctgatgtcgctccctgacgtgtgccaactgttcaagtgctatgatgttcagctctataagggcatagaggacgtactgctccacgattttctggaagacgtaagtatccagtatttgaaatctgtgcaactgtttagcaaaaaattcaagctttggctgctgaacgccttagaaggtgttccagcccttctccagataagtaagttgaaggaagtgactctcttcgtaaagcggctgcggagaaagacatacttatccaacatggcgaagacaatgcgcatggtgcttaaaagcaaaaggcgagttagcgtactgaagagtgacttgcaggcgatcatcaaccaggggactctggccacgtcaaaaaaagcactagctagtgaccgttcaggagccgatgagctggagaacaacccagagatgaaatgtctccgtaatttgatcagccttctggggactagcaccgatctgagagtctttctcagctgtctcagctcacacctccaagcctttgtttttcaaacctctcgcagcaaagaggagtttactaagcttgccgcgagctttcaactgcgttggaatctactgctgaccgcagtgagcaaggctatgaccctgtgtcatcgggactcctttggatcctggcacctcttccaccttctcttacttgagtacatgatacacatcctccagtcttgcctggaggaagaagaagaggaagaagatatggggacagttaaggaaatgttgcccgatgacccaacgctgggtcaaccggaccaagccctgtttcacagcctaaattcaagcctctcacaggcatgtgcctcgccatctatggaaccccttggcgttatgcctacgcacatgggtcagggtaggtaccccgtgggggtcagtaatatggttcttcggatcctgggcttccttgtcgatacggctatgggcaacaagctcatacaggttctcctagaggacgagaccaccgagtctgctgtcaaactgtcgctacccatgggacaggaagccttaattacactcaaagatggtcagcaattcgtgattcagatatcagacgtgccacaaagctcggaagatatctatttccgagagaataatgccaacgtatag

SEQ ID NO: 12992 - DNA, 1422 bp, Artificial Sequence
  Description of Artificial Sequence: Synthetic coding sequence
atgtacgagatctacgtcgaaacctgtgggcagaacaccgagaatcaggtcaatcctgctacatttggaaagtgcgaggatcattccccaatgaaaactgatcctgtgggatcccccctcagcgaatttcgccggtgcccattcttggaacaagaacaggccaagaaatacagttgcaatatgatggcgtttctggcagacgaatactgcaactattgtcgggatatcctgcgcaatgtcgaggatctcttgaccagcttttggaaatccctgcaacaggacacggttatgctgatgtctctgcccgatgtctgtcaactcttcaagtgctatgatgtgcagctgtataaaggtatcgaggacgtactgttgcatgattttctggaggacgtgtccattcaatacctcaaatctgtacagttgtttagcaagaagttcaagttatggcttctgaatgccttagagggtgtccctgcattattgcagatatcaaaactaaaggaagttacgctatttgttaagaggctgcggcggaagacgtacctgtcaaatatggcaaagacgatgcggatggtgttaaaatccaagaggcgggtcagcgtgctcaaatctgacctacaagctattatcaaccagggcacactcgccacgtcgaaaaaagcacttgctagtgatcgcagtggggctgacgagcttgagaacaatccggagatgaagtgtttgaggaacctgatctctctgctcgggacaagtaccgatctgcgggtttttctttcctgcctctccagccacctccaggcatttgtcttccaaacaagtcggtcaaaggaggaatttaccaagctggctgcctccttccaactacgctggaaccttctgcttacagcagtctcaaaggccatgaccctgtgccaccgcgatagctttggcagctggcaccttttccatctcctgttattagagtatatgatccacattttgcaatcttgcctcgaggaggaagaggaagaggaggacatgggcaccgtgaaagaaatgctcccggatgatcccaccctgggccagcctgaccaggcactgttccatagtttgaactcatccctctcccaggcctgcgctagcccctcgatggagccactaggcgtgatgcctacccacatggggcaagggcggtacccagttggggtttcaaacatggtgctccgcatattaggatttttggtggacacagctatgggtaataaattgatacaggtgttacttgaagacgagacaacagagtcagccgtcaagttatctctgcctatgggccaggaagccctcatcacactgaaggacgggcagcagttcgttatacaaatctcagatgtcccccagagttcagaggacatctactttcgtgagaacaacgctaacgtatag

SEQ ID NO: 12993 - DNA, 138 bp, Artificial Sequence
  Description of Artificial Sequence: Synthetic coding sequence
atgtatgagatctatgtagagacatgcggccagaataccgagaaccaggtaaaccccgctacctttggaaaaatggcattcctcgcagacgaatactgcaattactgcagagacattctcaggaacgtacgtaactag

SEQ ID NO: 12994 - DNA, 1704 bp, Artificial Sequence
  Description of Artificial Sequence: Synthetic coding sequence
atgttggagagaagatgtagagggccactggctatgggacttgcccaaccgaggctgctgagcggcccctcacaggaatcaccacagacccttggaaaggagtcccgcggactaagacagcagggaacctccgtagcacagtcaggagcccaggctccaggtagggctcatcgatgtgcccactgtcggcgacactttccaggttgggtagccctttggcttcataccaggcggtgccaggctaggctgcctctgccatgccccgaatgcggccgccgctttcggcatgcgccattccttgcactgcaccggcaggtccacgcagccgccactcccgatcttggtttcgcatgccacctgtgcggacagtcctttcgcgggtgggtagcattggtgctgcatctgagagcacattctgccgctaagagacccattgcatgtcctaaatgtgagcgccgcttctggaggcggaaacaacttagggctcacttgagaagatgccaccccccagctcccgaggcccggcctttcatctgcggcaactgcgggaggagcttcgcacagtgggaccagctggtggcccataaaagagtccatgttgccgaggccctggaggaagcggccgcaaaagctctgggtcccagacctcgggggcgtcccgctgtgaccgctccgcggcccggcggcgacgcggttgacaggccctttcagtgcgcatgttgcggtaagcggttccgacacaagcctaatctcatcgcacatagacgcgtgcatacaggagagcggccgcaccagtgcccagaatgcggtaagaggttcaccaataagccctacctgacctcacatcgacgtattcatacaggcgagaagccgtacccatgtaaggagtgtggcaggcgctttaggcacaagcccaacctgctgtcacactccaagatacacaagcgctctgaaggctctgcacaggctgcccccggaccaggaagccctcaactgcctgcggggccacaagagtctgccgcggaacccacgcctgcagtgccgctcaagcccgctcaggagccccccccaggggctcctcctgagcatcctcaggatcctatcgaagctccacctagtctttattcttgcgatgattgcggacgttcgtttcggctggaacgatttttgcgggcacatcagagacaacacaccggcgaacgcccctttacgtgcgcggaatgcgggaagaacttcggcaaaaagacgcacctcgtggcacacagcagggtgcatagtggagagagaccctttgcctgcgaggagtgcggccggaggttcagccagggaagtcacctggccgctcatagacgagatcacgcccccgacaggccattcgtgtgccctgactgtgggaaagctttccggcacaagccctatttggctgcgcacagaaggatccacactggcgagaagccctacgtatgccctgactgcggcaaagccttttctcagaagagtaatttggtgtcgcaccgccgcattcacacgggggagcgtccctatgcttgtcctgattgtgataggtctttcagccagaagagcaatttgatcacgcatcgcaaaagccacattagggatggggcgttttgttgtgccatttgcggccagacgtttgacgatgaggaacgactgctggctcatcagaagaagcacgatgtttag

SEQ ID NO: 12995 - DNA, 1704 bp, Artificial Sequence
  Description of Artificial Sequence: Synthetic coding sequence
atgctggagaggcgctgccgaggtccactcgccatgggcctggcccagccacgcctgctgtccggtccatcccaggaatcaccgcagacattggggaaagaaagccgcggtcttaggcagcaaggcacaagtgtggcccagtcaggtgcccaggcgcctgggcgggcccaccgttgcgcgcactgccggaggcactttcctgggtgggtggctttgtggctccatactcgccggtgtcaggccagactgccgcttccttgtccagagtgtggcagaagattcaggcacgcgccgttcctcgcgctacatcggcaggttcacgccgcagctacccctgatcttggatttgcctgtcatttgtgtggtcaatcattccgcgggtgggttgctcttgtcctgcacctgagggcccattcagccgctaagcggccgatcgcatgtcctaagtgtgagaggcgtttctggcgccgaaagcagctgcgggcccacctacgcaggtgccatcctcctgcacctgaggcaaggccatttatttgcggcaattgcgggaggtcattcgcacagtgggaccagcttgtcgcacataaaagagtgcatgtggccgaagccttagaagaggccgctgctaaggcattaggtccacgacctcgtggccgtcctgccgtcactgctcccagaccaggcggagacgcagtagaccggcctttccagtgcgcctgttgcggcaagcggtttcgacataaaccaaatctgatcgcccaccgtagagtgcacaccggagaacgaccccaccaatgccccgagtgtggtaagcgctttaccaacaagccttatctgacaagccatcggagaatacacacaggagagaagccttacccatgcaaagaatgtggaaggagattcaggcacaagcccaacctgctctcccattctaagattcacaagcgttctgaggggtccgcccaagcagcacccggtcctgggagccctcagctccccgcagggccacaggaaagtgctgccgaacccactcctgccgtcccactgaagcctgcccaggagcctccccccggcgcaccccccgaacacccacaggatcccatcgaggcacctccttcactgtattcctgtgacgattgtgggcgatcattcaggttggagcggtttttacgggcccaccagcggcagcatactggcgagagaccttttacctgcgccgagtgtggtaagaacttcggcaaaaaaacccacctggtggcacatagccgggtacacagcggcgagagacctttcgcctgcgaagaatgcggaaggagattctcacaggggtctcacctggccgcccataggcgcgatcacgccccggaccggccgttcgtgtgcccggactgcgggaaagccttccggcacaagccatatttagcagcccaccgtaggatccacacaggcgagaagccatatgtgtgcccagactgtgggaaggcattttcccagaagtccaaccttgtgagtcatagacggatacataccggggagcgaccatatgcttgcccggactgcgataggagctttagccagaagtcgaatctgatcactcaccgcaaatcccatattcgcgatggcgccttttgttgcgcgatttgtgggcagaccttcgatgacgaagagaggctcctggctcaccagaaaaagcacgacgtctag

SEQ ID NO: 12996 - DNA, 1704 bp, Artificial Sequence
  Description of Artificial Sequence: Synthetic coding sequence
atgctcgagaggagatgtcgcgggccactggcaatgggcctggcccagccaagacttttgtccggcccgtcacaggagtcccctcagaccctggggaaggaaagtcggggtctgaggcagcaggggacgagtgtggctcagtctggggcacaggcccccggccgagctcaccgctgtgcacattgtaggcgccactttccgggttgggtcgctctgtggcttcataccagacgttgccaagcgaggctgcccctgccttgtccagaatgtggtcgaagattccgccatgctccatttcttgccctccaccgtcaggtgcacgccgcagccactcctgacctggggttcgcgtgtcacctatgtggacagtcctttcggggatgggttgctctcgtgttgcaccttagggctcattccgctgcgaaacggcccatcgcctgtccgaaatgtgagaggcgcttttggcgaaggaaacagctacgcgcccatcttcggcgttgtcatccacccgcacctgaggcccgacctttcatttgcggcaactgtgggagaagctttgcccaatgggaccagcttgtagcacataagcgagtccatgttgccgaggcgctggaggaggccgctgcaaaagccttggggccacgaccaagagggcgtcctgcagtcaccgcaccaaggcccggcggagatgctgtggaccgaccttttcagtgtgcctgctgcggcaagcgatttcgccacaagccaaaccttatagcgcatcgtcgggtgcacacaggcgagcggccccatcaatgtcctgaatgcgggaagcgcttcacgaacaaaccttacttgacgtctcatcggcggattcacacaggggaaaagccttacccatgcaaagagtgcggcagacgatttcgtcacaagcctaacctcttaagtcactctaagatccacaagcgctcggagggctccgcacaggctgcccccggtcctggatcaccacagctgccagctgggccccaggagtctgctgccgagccaaccccggccgtcccgcttaagcctgcacaggagcccccaccaggagcaccgcccgaacatccgcaggatcctatcgaggcacctccatcactttactcatgtgacgactgtggacgctcctttagattagaacgtttcctcagagcccatcagcgccagcacaccggagagcgcccctttacgtgtgccgagtgcgggaagaattttggaaagaagactcatctcgtggcacactcaagagtccatagcggtgaacgccccttcgcctgcgaggagtgtgggaggcgtttctctcagggctcccacctggccgcgcataggagagatcatgcacctgatcggcctttcgtttgtcctgattgcggaaaggcttttcgccacaagccctacctggcagcacacaggcggatccataccggcgagaagccctacgtgtgccccgattgtggtaaggctttctcgcaaaaatccaatttggtgagccatcgacgcattcacacgggcgagcgcccctacgcttgccctgactgtgataggtcttttagtcagaagtctaacctgattacccaccgcaagtcccacattcgcgacggcgcattctgctgcgcaatttgcggccaaaccttcgatgatgaggaacgactattagcccaccagaagaagcatgatgtttag

SEQ ID NO: 12997 - DNA, 615 bp, Artificial Sequence
  Description of Artificial Sequence: Synthetic coding sequence
atgggcatcggcgtgtccctgctcctgcaattttctttaactccgggcgggtaccggtccgtcggtcggagtaggagatgtagccgcgggagtataccacgcaacatacccaaaaggtcatggaagaaacctcacccccagctgtgctctttacaggcggaggaggaaccgatgctggaacgaaggtgtcgcgggccgctcgctatgggtctggctcagcccaggctcctctctggcccaagtcaggaatcgccccaaacgctgggaaaagaatcgcggggactgcggcagcagggcacctcggtggcacagagcggcgcacaggctcctggccgagcccatcggtgtgcccactgcagacgccatttcccaggctgggtggctctgtggctgcataccaggaggtgccaggctcgactgcccctgccctgtcctgagtgcggacggagatttaggcacgccccttttcttgctttgcatcgacaagtccacgccgctgcaactcccgacctggggttcgcatgccatctgtgcggccaatcattcaggggctgggtcgcactagtgttgcacttgcgcgcccactcagccgcaaaaaggccgatcgcttgctag

SEQ ID NO: 12998 - DNA, 1875 bp, Artificial Sequence
  Description of Artificial Sequence: Synthetic coding sequence
atgggcattggggtttctctgctccttcagttttctctgacaccaggcggatatcgatctgtaggaagatccagacgctgctcccgcggctccatccctcggaacatccctaagagaagctggaaaaaacctcacccccagctgtgtagtttgcaggccgaggaagagcctatgcttgagaggagatgtcggggcccattggccatgggcctggcgcaaccaaggctgttatcaggcccaagtcaggaaagtcctcaaacccttggaaaggaatcgcgcggcctgcggcagcagggcacgtctgtcgcccaatccggggcccaagccccaggtcgcgcccaccggtgtgctcactgcagacgccattttccaggctgggtagccctttggctgcatacacgccggtgtcaggcccggttacctctcccttgccccgaatgtggccgcagattcaggcacgcaccctttctggccctgcatcgtcaagtgcacgccgcagccaccccagatctcgggtttgcatgtcacctatgcggccagagctttaggggatgggtggccctcgtgctgcatcttagagcccatagcgcagccaaaaggccaatagcatgtccgaagtgcgagcggaggttctggcgtcgaaaacaactgagggcgcacttgcgacggtgccacccacccgcgcccgaagcaaggcccttcatttgcggcaattgcggccgtagcttcgcccaatgggatcaactagtggcacataaaagggtgcacgtcgccgaggctcttgaggaggcggctgcaaaggccctaggccctcgacccagggggcggccggccgtcaccgcccctcgccccggtggagatgcggtggaccgcccgttccagtgcgcatgttgtggaaagcgcttccggcacaagccgaacctgatcgctcaccgtagagttcacacaggagagaggccccatcagtgtccagaatgtggaaagcgctttaccaataagccatatctgacttctcaccggaggatccatacaggcgaaaaaccttacccctgcaaggagtgtggtagaagatttcgccataagcccaacctgttaagccattccaagatccataagagatcagaagggagcgcacaagcagcaccaggtccaggctctcctcagttgccggcaggcccccaagaaagtgccgccgaacctacacccgcggtaccccttaagcccgcccaagagccccctcctggtgccccacctgagcatccacaggaccctatcgaggcaccaccttctctttactcttgtgacgattgcggccggtcctttcgactggagagatttctgcgcgcacaccagcgacagcatacgggtgagcgcccttttacttgtgccgagtgcggaaagaactttggaaagaagacccacttggtggcccacagccgagtgcactctggggagcgcccatttgcttgtgaagagtgtgggaggcgcttttcccagggctctcacctagcggcccacagacgggatcatgctcctgatcggcctttcgtatgcccagattgtggcaaggcctttagacataagccttatctggccgcccacagacgaatccatacaggggagaagccctacgtgtgccccgactgtggcaaagctttcagccaaaagagcaacttagtgtcccatcggcgaatacacacaggcgaaagaccctatgcctgcccggactgtgatagaagcttttcacagaagtctaacctgatcacccatagaaaatctcacattcgtgacggtgcgttctgctgtgctatttgcggacagactttcgacgatgaggagagactactggcacaccagaagaaacacgatgtctag

SEQ ID NO: 12999 - DNA, 441 bp, Artificial Sequence
  Description of Artificial Sequence: Synthetic coding sequence
atgctggagaggcgttgccgcggccccttggcgatggggctggctcagccacgcctgctgtctgggccatcccaggagtccccacagacactgggcaaggagtctaggggactgagacagcagggcacctcagttgcccagtcaggcgcccaggctcccggacgcgcgcatcgatgcgcacattgtcggagacatttccctgggtgggtggccctctggctgcatactaggaggtgtcaggcccgcctcccactgccctgtcctgagtgtggacggagattccgacacgccccatttctggcattgcatcgccaggtccacgcagccgccacccctgacctcggatttgcatgtcacctgtgtggacaatcattccgtggatgggtggccttagtgcttcatctgcgcgcccatagtgccgcaaaacggcctattgcgtag

SEQ ID NO: 13000 - DNA, 1704 bp, Artificial Sequence
  Description of Artificial Sequence: Synthetic coding sequence
atgctggagcgccggtgtaggggacctctggcgatggggctcgcccagccacgactcctgtctgggccaagccaggagagcccacagacattgggcaaagagtctcggggtctgcgccagcaaggaacgagcgtcgcccagagcggggcacaagcccccggaagagcccacagatgcgcacactgcagaaggcactttcctggctgggtggctttgtggttgcatacccggcgctgccaggcgcgtcttcccctcccttgcccggagtgcggccgtcgcttcaggcacgcacctttcttagccctgcatcgacaagtgcatgccgcagccacccctgatctaggtttcgcctgtcacctgtgcggccaaagcttccggggctgggttgccctagttcttcacctcagggctcactcagccgccaaaagacccatagcttgcccgaagtgcgagcgaaggttttggcgaaggaagcagcttagggcccacctgcgacggtgtcaccctcccgccccagaggcgagaccttttatctgtggaaattgtgggcgctccttcgcccaatgggaccagctcgttgcccacaagagggtccacgtcgcagaagctttggaagaagccgcagccaaggctctgggaccaagaccacgagggcgtcccgccgttactgcgcctcggcccggtggcgatgccgtcgacagaccttttcagtgcgcatgttgcggcaagaggtttcgccacaaaccaaacctgattgctcatcggagggtgcacacgggagagaggccccatcagtgcccagagtgcggaaaacgttttaccaacaagccatatctgacgagtcatcggcgcatccacaccggcgaaaagccatacccttgtaaagaatgcggccgaagatttcgacataagccaaatcttctgtcccattcaaagatccacaaacggtcagagggttctgctcaggccgcgcccggcccggggtccccacagttgccagcagggccacaggagagcgctgcggagcccacgccagcagtgccactgaagccggcacaagaaccccctcccggcgcacctcccgagcatccacaggatcctatagaggcccctccatcactctactcatgtgatgattgtggccgctctttcagactggaaagatttctccgggctcaccaaaggcagcatactggggaaagaccttttacttgcgccgagtgcggcaagaattttggtaagaagactcatctcgttgctcattctagggtgcactcgggagaacggccatttgcttgtgaagaatgtggccgcagattttcccagggaagtcacttggctgcacataggagggatcatgctcctgacagaccgttcgtttgtcccgattgtggaaaagccttccggcacaaaccttatttagctgcacaccgcaggatccataccggtgaaaaaccatacgtgtgcccagattgtggcaaagccttcagccagaagagcaatcttgtgagtcacagaaggattcatacaggagaacgcccatacgcctgccccgattgcgatcgaagctttagccagaagtcaaacctgatcacccatagaaagagtcacatcagggatggcgctttctgctgtgctatctgtgggcaaacctttgacgatgaggaaagactcttagcccaccagaaaaagcacgacgtgtag

SEQ ID NO: 13001 - DNA, 1449 bp, Artificial Sequence
  Description of Artificial Sequence: Synthetic coding sequence
atggtggagaagggacctgaggtgtcagggaagaggcgcgggagaaacaacgctgcagctagcgcctccgccgcagcagcatccgccgccgcatccgcagcctgtgcttctcccgccgccaccgccgcaagtggtgccgctgcgtcgtctgcctctgcagccgcggcgtccgcggcggccgcacccaataatggccagaataaatccctggcggccgcagctcctaatggcaacagtagttctaacagttgggaggagggatctagcgggtccagcagtgacgaggagcacggcggaggtggcatgcgggtcggcccccaataccaggccgtggtgcccgactttgaccccgccaaactcgctcgccgttcgcaggagcgcgacaatctcggtatgttggtctggagcccaaaccaaaacctgagcgaagctaagctggacgagtatatcgctatcgccaaagaaaagcatgggtacaatatggagcaggctctgggtatgctgttttggcataaacataacattgagaagagcctggccgatttgcccaattttacccccttccccgacgaatggaccgtggaggacaaagtcttattcgagcaggcgttttccttccacggcaaaaccttccatagaatacagcagatgctgcctgataagagcattgcgtcactggttaagttttattactcctggaagaaaacaagaactaagaccagcgtgatggacagacatgcaaggaagcagaaaagagaaagggaggaaagtgaggacgaactggaagaagccaacggaaacaatcctattgatattgaagtcgatcaaaataaggagtcgaaaaaggaggtcccacctaccgagactgttccccaagtgaaaaaggagaaacactccacgcaagcaaagaaccgggcaaaaagaaaacctcctaagggcatgtttctgtctcaggaagatgtggaagcggttagcgccaacgcaacggcagcgacaactgttctgaggcaactggacatggagctggtcagcgtgaagcgccagattcagaacattaagcagacgaatagtgccttaaaggagaaactcgatgggggtatcgaaccttataggctcccggaagtcattcagaagtgcaatgctcggtggacaacggaggagcagctgttggctgtgcaggcaattcgaaagtacggaagggacttccaggccataagcgatgttatcgggaacaagtcggtggtgcaggtgaagaactttttcgtgaattaccggcggagatttaacatagatgaagttctccaagagtgggaggcggagcacggcaaggaagaaacaaatgggccaagcaaccagaaacccgtcaagtcgcctgataattcgataaagatgccagaggaagaggatgaggcaccagtcctcgacgtccgatacgcaagcgcgtcgtag

SEQ ID NO: 13002 - DNA, 1449 bp, Artificial Sequence
  Description of Artificial Sequence: Synthetic coding sequence
atggtggagaaaggccccgaggtcagcgggaagcgacgcggccggaataatgccgcggcatcagccagcgcagcagcagcctcagcagccgcatcggcggcctgtgccagcccagcagctactgcagcatccggggcagccgcctcctcagcttcagctgcggcagcttccgccgccgccgcaccaaataacggccagaacaagagtctagccgcagccgcaccaaatggtaatagctcgtcaaacagttgggaagaaggaagctcaggtagctcctcggatgaggagcatggcggcggcggcatgagagttgggccccagtaccaggcagtagttcctgacttcgacccagcgaaactggccaggagatcccaagaacgtgataatctagggatgctcgtgtggtccccaaatcagaatttatccgaagccaaactcgatgaatatattgccatagcaaaggaaaagcacggatataatatggaacaggcccttggaatgctgttctggcacaagcacaacattgagaaaagtctggccgacctccctaacttcaccccatttcctgacgagtggacggtagaggacaaagtgttgtttgaacaggccttcagcttccatgggaaaacattccacagaatccagcagatgctcccggataaatcgatcgcctccctggtgaagttctattattcatggaagaaaacacgtacaaagacctcagtgatggacaggcacgcccgaaaacaaaagcgcgaacgggaggaaagtgaggacgagttggaggaagcaaatggcaacaaccccatcgacatagaggtggaccagaacaaagagtcaaagaaggaagttcctcctaccgaaacagttcctcaagttaaaaaagagaaacattccacccaggccaaaaatagagctaagagaaaaccaccaaaaggaatgtttctctcgcaggaggatgtggaggccgtgagcgcaaatgctaccgccgccaccacggtactgcggcagctggacatggagcttgtctcagtcaaaagacagatccaaaatattaagcaaaccaatagtgcccttaaggagaagctggatggcggaatcgaaccctatcgcctccctgaggtcatccaaaaatgtaacgcgcggtggacaaccgaggagcagctcctagcagtgcaggctatacgcaagtacgggcgggacttccaggccatcagcgacgtcatcggaaataaatccgttgtacaggttaagaacttctttgtcaactacagacggagattcaatattgatgaggtcttacaggaatgggaggcagaacacggcaaggaagaaaccaacggtccatccaatcagaaacccgtcaagtcccctgacaactctattaagatgcctgaggaagaggatgaggctcctgtcctggatgtgcgttacgcttctgctagttag

SEQ ID NO: 13003 - DNA, 1572 bp, Artificial Sequence
  Description of Artificial Sequence: Synthetic coding sequence
atgccaagtgtgatggaaaagccttcggccggcagcggcatcctctcacgtagccgggctaagacagtcccaaatggaggccagccacatagcgaggatgattccagcgaggaagagcattcgcacgactcgatgattcgcgtgggcactaattaccaggccgtgattcctgaatgcaaacccgaaagccccgcccgatattcaaataaagagctgaagggaatgttggtgtggtctccaaatcactgcgtttccgacgccaagctggacaagtacattgccatggcaaaagagaagcatggttataacatagaacaagcactgggaatgctactgtggcacaagcacgatgtggaaaagtccctggctgatctggccaatttcacacccttcccagacgaatggacagttgaagacaaggttcttttcgagcaagcatttggctttcacggaaaatgtttccagcgcatccagcagatgcttcccgataagctgatacccagcctggtcaagtactactattcgtggaaaaagacaagaagccggacttctgtgatggaccgtcaggctaggcggctcggcgggagaaaggataaagaggactcagatgaacttgaagaaggtcgaggtggggtgtcagagggggagcctgatcctgcggatccaaagagggagccactaccttccagaccgcttaatgcgaggcccggacccggcaagaaggaggtccaagtgtcgcagtacaggcaccatcccctcagaacaagaaggcggcctcccaagggtatgtatctctctcccgaggggttgacggccgtgtctgggagtccagacctggcgaacctgacactgagggggctcgacagccaactgattagcctgaagcgacaggtccagtctatgaagcaaacaaattccagcctaagacaagctctcgaggggggtattgaccccctgcgccccccggaggccaatacaaagtttaacagtcgttggacaaccgatgaacagctactcgcagtacaagctataaggaggtacggaaaggacttcggagcgatagctgaggtcattggcaataagacgctcacccaggtgaaaactttctttgtaagctacaggagacgcttcaacctagaagaagtgttacaggaatgggaggccgagcaggatggggccccaggtgcccccgtgcctatggaggaagcgcggaggggcgcacccctacccgcaccagccctggaggaagacgatgaggtgcagatcacttctgttagcacttcagtgccaagaagtgtgcctccggcgccaccccctccgcccccacccacttccctgtcgcaaccacctcctctgctgaggccacccttgcctacagcccctacgctcctgcggcagcccccacctctccagcagggcaggtttctgcagccgcgtctcgctcccaaccagccacctccaccattgatccggcctgcattagccgcacctcggcattcagcacggccggggccacagcccccacctacactgatcggcaccccgctggagcctccagcacccagtttgtag

SEQ ID NO: 13004 - DNA, 1488 bp, Artificial Sequence
  Description of Artificial Sequence: Synthetic coding sequence
atgcgtgtcggcgccgagtatcaggcccgcattcccgagttcgacccaggagcgactaagtacacggacaaggacaatgggggtatgctcgtgtggtccccttaccactccatccccgacgccaagttggatgagtatatagccatcgcgaaagaaaaacatgggtataatgtggaacaggctttagggatgctgttctggcataagcataacatagagaaatctttagccgacctccccaattttacccctttccccgacgagtggaccgtggaagataaagtattgtttgaacaggcattctccttccatggaaaaagtttccatcggatccaacagatgctccccgataagaccatcgcatctctggtgaagtactactattcttggaaaaagactcgcagccggacaagtctgatggaccgacaggcacgcaaacttgccaatcggcataaccagggcgactctgatgacgatgttgaggaaacacatcccatggatggcaatgactcagattatgatcccaagaaagaggcaaaaaaggaaggcaataccgagcagccagtccaaacaagcaagattgggcttggccgaagagaataccagtccctgcagcacagacaccattcgcagagatctaaatgccgacccccaaagggcatgtacctgacacaggaggacgtggttgccgtatcatgctccccgaatgctgcgaacacaatccttagacaactcgacatggagctaataagtctcaagcgtcaggtgcagaatgcaaagcaggtgaactcggcactgaaacaaaaaatggaaggaggaatcgaagagttcaagccccccgaatccaaccaaaaaataaatgctcgttggacaaccgaagaacagctgctggcagtccagggcgtgcgcaaatatggcaaagacttccaggccattgctgacgtcatcgggaacaagacagtcgggcaggtgaaaaatttcttcgttaattacagaaggaggtttaaccttgaagaggtgttgcaagagtgggaggcagaacagggcacccaggcctccaacggtgatgcgtctacactcggcgaggagaccaaatctgctagtaatgtccctagcgggaaaagtactgacgaagaagaggaggcgcagaccccccaggcccctcgcacacttggaccgtcccctccagctcctagcagtaccccaacccccactgctcctatcgcgacactgaaccaaccacctccactcctgaggccgaccttaccagctgctcctgctctgcaccgccagccccccccactgcagcagcaggcacgcttcattcagccgcgccccactctgaatcagcccccacccccactaatacgccctgccaactcaatgccccctagactgaatcctaggccagtcctatcaacagttggtggccagcagccgccctccttgattggcattcagaccgacagccagagctctctacattag

SEQ ID NO: 13005 - DNA, 1311 bp, Artificial Sequence
  Description of Artificial Sequence: Synthetic coding sequence
atgccaggaatgatggagaaagggccagagttgctcggcaagaacaggtcagcaaatggtagtgctaagtcccctgcggggggtgggggaagtggtgctagctctacaaatggcgggctccactacagcgaacctgagtccggatgctcctcagacgatgagcatgatgtggggatgcgcgtgggggcagagtatcaagccaggatcccagagttcgaccccggcgccaccaaatacacagataaggataatggtggcatgttggtgtggtctccgtatcattcaatccccgatgccaagttggatgaatacatcgctatcgctaaggagaagcacggatataacgtggaacaggccctgggcatgctgttctggcataagcacaatatcgaaaaaagtctggccgaccttccaaatttcaccccattcccagatgaatggactgttgaggacaaggtgctgtttgagcaagcttttagttttcatggtaagtcctttcacagaattcaacagatgctccctgataaaaccatagcatcactggttaaatattattactcatggaagaaaaccaggagtaggaccagcctgatggaccgacaggcacgaaaactcgccaaccgccacaatcaaggggactccgatgatgacgtggaggaaacacaccccatggatgggaacgacagcgattacgatcctaaaaaggaggcaaaaaaagaaggcaataccgagcagcccgtacagacaagcaagattggattaggcaggcgggaatatcaatccctgcaacaccgccatcattctcagagatccaaatgtagaccacctaaaggaatgtacctcacccaggaggacgtagttgccgtgtcctgttcccccaacgccgccaacacaatacttcggcaacttgacatggagcttataagcctgaaacgacaggtccagaatgcaaaacaggttaactcagccttaaaacagaagatggaagggggaatagaagagttcaaaccacctgaatctaatcagaaaatcaacgcaaggtggaccacagaggaacaattgttggctgtccaggggactgatcccacagggagctccgatacagggtcaataacatcatgccccataatccacagtaatactaattcaccttactgccactcggagccagcatcaacaacctcctccagcaataccgcctgttgtcccggctcgagtcccgctgccagttccactcccgccgctggctccgtacatcctgctccagccaatttcaagtctgcctccactactagctacagtccttgttag

SEQ ID NO: 13006 - DNA, 1662 bp, Artificial Sequence
  Description of Artificial Sequence: Synthetic coding sequence
atgccaggtatgatggaaaaagggcctgagctgcttggaaagaacagaagtgcaaatggctccgccaagagtccagccggcggcggaggatccggggctagctctacaaacggtgggcttcactacagtgaaccagagagtggctgtagctcggatgacgaacacgatgttggaatgagggttggagcagagtaccaggcaaggattcccgaatttgaccctggagcgacaaaatatacagataaagacaatggtggcatgctggtgtggagtccctatcattctattccagatgcgaaattggatgagtatatcgcaatcgctaaagagaaacacgggtataatgtcgaacaggccctcggaatgctgttttggcataaacataacatcgagaaatcactcgccgaccttcccaattttacaccctttcctgatgagtggacagtggaggataaggtgctttttgagcaagctttttcgtttcatggcaagagctttcaccgtattcaacagatgctcccggataagactatagcctccctggtgaaatactattatagttggaagaaaaccaggtccagaacatcccttatggaccggcaggctagaaaactggcaaacagacataaccaaggagatagcgacgacgacgttgaggagacccaccctatggacggaaatgacagtgactatgaccctaagaaagaagctaaaaaagagggtaacacggagcagccagtccagactagcaaaatcggtctcggaaggcgcgaatatcaaagcctccagcaccgacaccactctcaacgctctaagtgtagaccaccgaagggtatgtatctgacgcaggaggacgttgtggcggtctcctgcagtcctaacgcagctaatacaattctcaggcagcttgatatggaactaatcagtctaaagaggcaagttcaaaatgcaaagcaggttaattctgcgctgaaacagaagatggagggcggcatcgaggagttcaagcctcctgagtctaaccaaaagatcaatgcccgttggaccacagaagaacaactcctggccgttcaaggcgtgagaaagtacggtaaagatttccaagcaatagccgacgtgattggcaacaaaactgtcggacaggtgaagaactttttcgtcaattacagacggcgcttcaatcttgaggaagttctccaggagtgggaggccgagcagggcacccaggcctccaatggtgatgcctccaccctcggtgaggagactaaaagcgctagtaacgtccctagtggaaaatcaaccgatgaagaagaggaggcacagacaccccaggctcctcggacactgggacccagccccccagccccatctagtaccccaacccctactgctcccatcgccactttgaaccagccaccgcccctcttgagaccaacacttcctgcagctccggcactccatcggcagccaccccccttgcagcagcaggcccgctttattcagccccgaccaacactgaaccagccaccgcctcccctgatccgtcccgctaacagtatgccccctcggctgaatcccagacccgtcttatctactgtggggggacaacaacctccatccctgatcggtatccaaactgacagccagagttcccttcattag

SEQ ID NO: 13007 - DNA, 1350 bp, Artificial Sequence
  Description of Artificial Sequence: Synthetic coding sequence
atgccaggcatgatggagaagggcccggagcttttgggcaaaaacaggagcgccaatggttcggccaagtctccagctggcgggggaggctctggcgctagttccacaaacgggggccttcattacagtgagcctgaatctgggtgcagcagcgacgacgagcatgacgtgggtatgagggtgggcgcagaatatcaggcccggatccccgagttcgacccaggtgcaactaaatacacggacaaggacaacggcggaatgttagtttggtctccttatcacagcatacccgatgcgaaactggatgagtacattgccatcgcaaaagaaaagcatggatacaatgtagagcaggctcttggtatgttattctggcacaaacataacatcgagaaaagtttggctgaccttcccaattttaccccatttccggatgagtggacagtggaggacaaggtgctgtttgaacaggcatttagcttccatggcaaatcattccatcggatacagcagatgctcccggataaaactatcgcgtcactggtgaaatattactacagttggaaaaaaacgcggtccagaacctcattgatggataggcaggcccgcaaactggcaaataggcacaatcagggcgactcagacgacgatgtcgaagagacgcatccaatggacgggaatgattctgattacgaccctaaaaaagaagctaaaaaagagggtaacaccgagcaacctgttcagactagtaagattgggctggggagacgagagtaccagtctctgcagcatcgccaccattcccagagatctaaatgcaggcccccaaaggggatgtacctgactcaagaagatgtggtggcagtgagctgtagccccaacgctgccaacacaatcttaagacagctagatatggagctcataagcttaaaaagacaggtgcagaacgcaaaacaggtaaattcagccctgaagcagaagatggaagggggcatagaagagtttaagccgccagagagtaaccaaaaaattaatgcccgatggaccactgaggaacagctgcttgccgttcagggggtcagaaagtacggcaaggactttcaagccatcgctgatgtgatcggcaacaagacggtggggcaggtgaagaacttcttcgttaattaccggagacgttttaaccttgaagaggtcctgcaagaatgggaggcagagcagggcacacaggcctccaatggggacgcatccactcttggagaagagactaagagcgctagcaacgtcccgagcgggaagtccacagatgaagaagaagaagtgtgcctgtgtatggagttcgaattgatctag

SEQ ID NO: 13008 - DNA, 450 bp, Artificial Sequence
  Description of Artificial Sequence: Synthetic coding sequence
atgcgcgtcggtgccgagtatcaagccagaattcccgagttcgatcctggtgcaaccaaatacaccgataaggataacggggggatgctggtatggtcaccctaccatagcattcctgatgctaaattagatgagtacatcgcgatcgccaaggagaagcacggctacaacgtggagcaggctctgggcatgcttttttggcacaagcacaacatcgagaaaagcctggctgatcttccaaattttacacctttccctgacgaatggaccgtagaagataaggttctatttgaacaagccttttccttccatggaaagtcattccatcgtattcagcagatgctaccagacaagacaatcgcttcattggttaagtactattactcatggaagaagacacggtctcgcaccagcctgatggatcgacaggcgcggaaactggccaactag

SEQ ID NO: 13009 - DNA, 261 bp, Artificial Sequence
  Description of Artificial Sequence: Synthetic coding sequence
atgagggtgggtgccgaatatcaggcaagaatccctgagtttgatccaggagccacaaagtacacagacaaggataatggaggaatgctggtttggagtccgtatcacagtatccccgacgcgaagctggacgaatatatcgccattgcgaaagaaaaacatgggtataatgttgagcaggctctggggatgctattttggcacaagcataacattgagaaatcattggcagacctcccaaattttactcctttcccatag

SEQ ID NO: 13010 - DNA, 555 bp, Artificial Sequence
  Description of Artificial Sequence: Synthetic coding sequence
atgttcctgtcacctggggaggggcctgctacggaaggcggcggcttgggacctggtgaggaagccccgaagaagaagcaccggcgcaaccggacaacctttacaacataccagctccaccaactagagcgggcgtttgaggccagtcactatcccgatgtctactcacgcgaggaactggctgcgaaggtgcacctccccgaagtgagagtccaggtctggtttcaaaaccggcgggcaaagtggcgccgacaagaaagactcgaatctggaagcggcgccgtggctgcacccaggctgcccgaggcccctgctctccctttcgccagaccacccgcaatgtctctccccctggagccctggctgggccccgggcctcccgccgtgccgggactgccacggttacttggtcctggccccggcctccaagctagcttcggtccccacgccttcgctcctacattcgctgacggattcgccttagaggaggcgtctctgcggttgttggcgaaggagcatgcgcaggctctcgatcgtgcctggccacctgcctag

SEQ ID NO: 13011 - DNA, 693 bp, Artificial Sequence
  Description of Artificial Sequence: Synthetic coding sequence
atgcctgcccccgtcgaagggactgattttcctggggctggtaggcaagcgtggggatctcccgctctcagcctgcccgtagctcccccagccgtatctccaccaagtgtgcctttgccttcacatcaggtgggcgcaatgtttttaagtcccggtgagggacctgcaaccgagggaggcggactggggcctggcgaggaggcgcccaaaaagaaacaccgcaggaatcgcacgacctttacgacataccagctgcaccagcttgaacgggcctttgaagcatctcattacccagacgtgtatagtagagaggagcttgctgccaaggttcacctccccgaggtgagggtgcaagtttggttccaaaacagacgggccaagtggcggcgccaggaacgcctggaatcaggaagcggcgctgtcgcggctcccagattgccagaagcaccggccttgccgttcgccaggcctcctgccatgagtctgccactggaaccatggttgggcccaggacccccagctgtacccggattgccaaggctcctcggacccggaccgggcttgcaggcctcgttcggacctcacgcttttgcccctacgttcgcggatggtttcgcactggaggaggccagtctgcgtttgctagccaaagagcacgcccaggcactggacagagcatggccgcctgcttag

SEQ ID NO: 13012 - DNA, 615 bp, Artificial Sequence
  Description of Artificial Sequence: Synthetic coding sequence
tgagctggcgcaggggtgccttggaaatcaaccgagggcctcccctgggccgttggcgccatgttcctgagtccaggggaggggccagccacagaagggggcggactcggacctggggaagaggcaccaaagaagaaacaccgtcggaaccgtaccacgtttactacataccagctgcatcagctggaacgggccttcgaggcttcccattatcctgatgtttattctcgagaagaactggctgcaaaggtgcacctgcctgaggtacgcgtgcaggtgtggttccaaaatcgccgagctaagtggcgccgccaagagcgcctggagtcaggtagtggggcagtggctgcccccaggttacccgaggcacctgctcttcccttcgcccgcccacccgccatgtctctgcccctggagccgtggctcggcccgggcccccctgctgtgcccggcctcccgcggctgctgggacccgggccgggattgcaggcctcctttggaccccatgcctttgcacccacctttgccgacggatttgctctggaggaagcgtctctgcgactgctggccaaggaacatgctcaggcattagaccgcgcctggcctcctgcttag

SEQ ID NO: 13013 - DNA, 1278 bp, Artificial Sequence
  Description of Artificial Sequence: Synthetic coding sequence
atggctgacaaggaggcagcattcgacgacgccgttgaggagagagtaattaatgaggagtataagatctggaagaagaatacgccattcctgtatgacctggtgatgacacatgctctcgaatggccttctctgaccgctcagtggctacctgatgtgacaaggcccgagggaaaagattttagcatccacagattagtgctggggacccatacctcagatgaacagaaccacctggtgatagcatctgtgcaactgccaaatgacgatgcgcagttcgacgccagccactatgactctgaaaagggggagttcggaggctttggcagcgtgtccggcaagatcgagatcgagatcaagataaaccatgaaggtgaagtgaacagggccagatacatgccacagaacccctgcattatcgctacaaaaacaccgagcagcgacgtgctcgtcttcgattacaccaagcatccctccaaaccagatccgtctggcgagtgtaatcctgacctgcgactgcgcggccatcagaaggaagggtacggcttgagttggaatcccaatctgtcaggtcacctgctctctgcttctgatgatcatactatttgcctgtgggacatctcagccgtccccaaggaggggaaagtagtcgatgccaaaacaattttcaccgggcacacagctgtggtcgaggacgtttcctggcatttgctgcatgaatcactcttcggatccgtagccgatgaccaaaaactaatgatctgggatacgcgctcaaacaatacatctaaacccagtcacagtgtggatgcacacaccgccgaagtgaactgtctttcttttaatccgtattctgaattcattctggcaacgggtagcgcagataaaactgtggccctctgggacttgaggaatctgaagctgaagctgcattcatttgaaagccataaagatgaaatattccaggtgcaatggtcgcctcataatgaaaccatactggccagttctggcaccgacagacgcttgaacgtgtgggatctctccaaaatcggcgaggagcagtcccctgaggatgctgaagatggcccccctgaactgctcttcattcacggtggccacaccgcaaaaatctctgactttagttggaaccccaacgagccatgggtgatttgtagcgtctctgaggataacatcatgcaggtgtggcagatggcggagaatatatacaatgatgaagatccggagggcagtgttgatcccgaaggccaaggctcctag

SEQ ID NO: 13014 - DNA, 1275 bp, Artificial Sequence
  Description of Artificial Sequence: Synthetic coding sequence
atggccgacaaggaagcatttgatgacgccgtggaagaacgggtaatcaacgaggaatataaaatatggaaaaagaacaccccatttctgtacgatctggtgatgacccatgccctcgaatggccatccttaaccgcccaatggcttcccgacgtaacccgcccagagggtaaagatttttccatccataggctcgtgctaggtacacacacctccgacgaacagaaccacctggtcattgcatcagtgcagttgcctaatgacgacgcccagttcgacgccagccattatgatagcgagaagggtgagttcggggggttcggatccgtctctggcaaaatcgagatcgaaattaagatcaatcacgaaggtgaggtgaaccgtgcaaggtatatgcctcagaatccctgcatcattgccacaaaaactccctccagcgacgtgttggttttcgattacacgaagcatcccagcaagccagaccccagcggcgagtgcaaccccgacctgaggttgcgcggtcaccagaaggagggatacggcttatcttggaatccaaatctttccgggcacctgcttagcgcttcagatgatcatactatttgtctctgggacatctccgccgtgccaaaggagggtaaggttgtcgacgctaagacaatttttactgggcacactgccgtggtggaggacgttagctggcatcttctacacgaatcgctctttggaagtgtcgccgacgaccagaagctgatgatttgggacacccgctccaataatacttccaaaccctcccactctgtggatgctcacactgccgaggtcaattgcctgtccttcaatccttactccgagtttatcctggccaccggtagtgcagacaaaactgtcgctctctgggacctgcggaacctcaagctgaagcttcactcctttgagtcacataaagatgagattttccaagttcagtggtccccacataatgagaccattctcgctagcagcggaaccgatcgccgcttgaacgtgtgggacctttccaagattggagaggagcaatccccagaggacgccgaagacgggcctcccgagctcctgttcatccatggcgggcacacggcaaagatcagcgatttctcctggaatcctaacgagccttgggtgatctgcagcgtgagcgaagacaatatcatgcaggtgtggcagatggccgagaacatctacaatgatgaggatccagaagggtccgtcgatcctgaaggccaaggatcatag

SEQ ID NO: 13015 - DNA, 264 bp, Artificial Sequence
  Description of Artificial Sequence: Synthetic coding sequence
atgacccacgcactcgagtggccttctctcacagcccagtggctgcccgacgtgacaaggcctgagggaaaagatttcagcattcatcgactggttcttggaactcacaccagcgacgagcagaaccaccttgtaatcgcttccgtgcagcttcccaacgatgacgcccagttcgacgcatcccattatgatagtgagaagggcgagttcgggggatttgggtctgtctctgggaagattgaaattgaaatcaaaattaattag

SEQ ID NO: 13016 - DNA, 1173 bp, Artificial Sequence
  Description of Artificial Sequence: Synthetic coding sequence
atgacccacgcacttgagtggccctcgctgacagcccagtggctgcccgatgtgacacggcctgaggggaaagacttttcaattcataggctggtactgggaacacacacttccgatgagcagaaccacctggttatcgcaagtgtccagctgccgaatgacgatgcgcagttcgatgctagtcattacgattctgaaaagggggaattcgggggcttcggcagcgtctcaggcaagatcgaaatcgaaattaagatcaatcacgagggagaggtgaacagggcacggtacatgccccagaacccttgcattatcgcaaccaagaccccatcttcagatgtgcttgtctttgactacactaagcatccgtctaagccggacccaagcggggaatgtaaccccgacctgcggttacgggggcatcaaaaggaggggtatggtctgtcttggaaccctaatctgtcgggacacttgttgtcagctagcgatgaccacaccatatgcctgtgggacatctcagccgttcccaaagagggaaaggtggtggacgcaaaaacgatattcacaggccataccgctgtcgttgaggacgtgagttggcaccttctgcacgagagcctcttcggatccgtggcagacgatcagaagcttatgatttgggacaccaggtccaacaacaccagcaagccctctcattcggtggacgctcatacagctgaagttaattgcctttccttcaacccgtattccgagtttattctcgccacagggtctgcagacaaaaccgtggctctgtgggatctccgaaatcttaagcttaagcttcacagcttcgaaagccataaagacgaaatctttcaggtacagtggtctccacacaacgagacgatcctggccagctccggtacagacaggagacttaacgtctgggatctttccaagatcggcgaagagcagagcccagaggacgccgaggatggtccaccagagcttctttttatacacggagggcatacagctaaaatcagcgactttagctggaaccctaacgagccgtgggtgatctgttctgtgtccgaggacaatatcatgcaggtgtggcagatggccgaaaacatttataacgatgaggatccagaaggaagtgtggaccctgaaggtcaggggagctag

SEQ ID NO: 13017 - DNA, 543 bp, Artificial Sequence
  Description of Artificial Sequence: Synthetic coding sequence
gttgcagacgaccagaagctaatgatctgggacactaggtccaataatacgtctaaacccagccactcggtggacgctcataccgccgaagttaactgtttgtcattcaatccgtattctgagttcatacttgccactgggagcgctgacaagactgtcgctctttgggacctacgtaatctgaaactgaagctacactcattcgagagtcataaggacgaaattttccaagtgcagtggtccccccataacgaaacaatccttgccagtagcggcacagataggagactgaacgtttgggacctgtctaaaataggggaagagcaatcaccagaggatgccgaggacggtccacctgaattgctgttcattcatggtggccacacggccaaaattagtgatttcagttggaatccaaatgaaccctgggtgatctgctcagtttctgaggacaatatcatgcaagtttggcagatggcggaaaacatctataatgacgaggatccagagggtagcgttgatcccgaaggtcagggttcttag

SEQ ID NO: 13018 - DNA, 207 bp, Artificial Sequence
  Description of Artificial Sequence: Synthetic coding sequence
atgactcatgccctcgagtggccatccttgacggctcagtggctccccgatgtcaccaggcctgagggcaaagattttagcatacataggctggtactcgggactcacactagtgatgagcaaaaccacttggtgatagcttctgtgcagcttcctaacgatgacgctcagttcgatgcttcgcactacgactcagaaaagggctag

SEQ ID NO: 13019 - DNA, 522 bp, Artificial Sequence
  Description of Artificial Sequence: Synthetic coding sequence
atgatctgggatacccgaagcaataatacctctaaaccttcgcacagcgtggacgcgcacactgctgaagtgaattgtctctcatttaatccttattctgagttcatcctggcgactggtagcgcagacaagacagtggctctctgggacctgcggaacctgaagctgaaattacatagcttcgagagtcacaaagatgagatatttcaggtccagtggtcaccacataacgaaacaatcctggcctcatccgggacagaccggaggctgaacgtctgggatctgtcgaaaatcggggaggaacagagccccgaggacgcggaagacggcccacccgaattgctgtttattcatggcggccatactgccaagatctcggacttctcctggaaccccaacgagccctgggttatctgttccgtgtctgaagacaacatcatgcaggtttggcaaatggcagagaacatttataatgatgaagacccagagggcagcgtggatcccgaaggacagggtagctag

SEQ ID NO: 13020 - DNA, 588 bp, Artificial Sequence
  Description of Artificial Sequence: Synthetic coding sequence
atggcagcagaggacgtggtggcaacgggcgccgatcctagcgatctggagtcaggaggcctgctgcacgaaatattcactagccccctgaacctgctgttacttggactctgtatcttcctcctctacaaaattgtccgcggcgatcagcctgcagccagcggggattccgacgatgatgaaccgccaccactcccccgcctcaagcgtcgggacttcacacccgcagagttgcggaggtttgacggggttcaggaccctagaatcctcatggcaattaatggcaaggttttcgatgtgacaaaggggcgcaaattttacgggcccgaaggcccctacggagtgtttgccgggcgggatgcttcgagaggtttagctactttttgcttggacaaagaggctctgaaagatgagtatgacgatttaagcgatcttaccgccgctcagcaagaaaccctatctgactgggagtctcagtttactttcaaataccaccatgtggggaagttactgaaagagggtgaggagccaacagtatactcagacgaagaagaacccaaggacgagtctgcaagaaagaacgactag

SEQ ID NO: 13021 - DNA, 867 bp, Artificial Sequence
  Description of Artificial Sequence: Synthetic coding sequence
atggagccgccagatcagtgcagccagtacatgacctcgttgttaagtccagccgtggatgacgagaaggagctgcaggacatgaatgcaatggtcctgagcctcacagaagaggttaaggaagaggaggaggatgcgcagcccgaacccgagcagggaaccgcagcgggagaaaagttgaaatctgccggcgctcagggcggtgaggagaaggatggaggaggcgaggaaaaggacggcggcggcgccggggtccccgggcatttatgggaaggagatctagaggggacctccggctccgatggaaatgtggaagacagcgatcaaagcgagaaggaaccgggccagcagtactccaggcctcagggcgccgtgggcggactggagcctggaaacgctcagcaaccgaatgtacacgcctttacacctctccaactccaggagctggaacggatctttcagagagagcagttcccttctgaattcctcagacggcggctcgcccgaagtatgaacgttacagaattggccgttcaaatatggttcgagaatcggcgagcaaagtggaggaggcatcagcgcgcactgatggctcgaaatatgctcccgttcatggctgtgggacaaccagtgatggtaactgcggcagaagcaatcacagccccgttgtttatcagcggcatgcgcgatgactacttctgggaccacagtcacagcagcagtctgtgtttccccatgccccctttccctcccccttctctgccccttcctctcatgttgctgccccccatgcctcccgcaggccaagccgagtttggtcccttccctttcgttatcgtacctagcttcacatttccaaatgtgtag

SEQ ID NO: 13022 - DNA, 867 bp, Artificial Sequence
  Description of Artificial Sequence: Synthetic coding sequence
atggaaccccccgaccagtgttcgcaatatatgacctcactcctgagtccggccgttgatgatgaaaaggagcttcaggacatgaacgccatggtactcagtctgactgaagaagttaaggaggaggaagaggacgcacagcccgaacccgagcagggcaccgctgcgggagagaagctgaaaagcgccggagcccagggcggggaggaaaaggatggagggggcgaagagaaagatggaggtggcgccggtgtccccggacacctgtgggaaggaaacctggaggggacaagtgggtccgatggcaatgttgaggactcagaccaatcagaaaaggagccaggccagcaatacagcaggccacagggcgctgtcggtggtctggaaccaggtaatgcgcagcagcctaacgtgcatgctttcacacctctgcaactccaagagctcgagtgcatttttcagcgagaacagtttccttccgagttccttaggcggcgcctggctcggagcatgaacgtgactgaactcgccgtacaaatttggtttgagaatcggcgggctaaatggcgacgccatcagcgcgccctgatggcgcggaatatgttgcctttcatggcagttggacagcctgttatggtgaccgccgccgaggccatcactgcacccctctttattagcggcatgcgagatgactatttttgggaccacagtcatagctctagcctgtgttttcccatgcccccctttcctccaccttccctcccactaccactgatgttgcttcctcctatgccccctgcaggtcaggcagagtttgggccctttcctttcgtgatcgtccccagttttaccttcccaaacgtttag

SEQ ID NO: 13023 - DNA, 375 bp, Artificial Sequence
  Description of Artificial Sequence: Synthetic coding sequence
atgcccgcacccgctgccacttacgaacgagtggtgtacaagaacccttccgaataccattacatgaaggtgtgcctggagtttcaagattgtggggttggcctgaacgccgctcagttcaagcagctgcttatctcagccgttaaagacctcttcggcgaggtggatgccgccctgccactagacatcttaacatacgaagagaaaacattgtcggccatacttcggatttgtagctctggccttgtaaaattgtggtctagcctcactctgttgggctcctataagggcaaaaagtgtgctttccgggtgattcaggtatcccccttccttttagccctgagtgggaatagtcgcgaactggtgcttgactag

SEQ ID NO: 13024 - DNA, 375 bp, Artificial Sequence
  Description of Artificial Sequence: Synthetic coding sequence
atgcccgcaccagctgccacatatgagcgggtggtgtacaagaacccctccgaataccactacatgaaagtctgtctggagtttcaggattgcggtgttgggctgaatgccgcacagtttaagcagttgttgatctcggcagtgaaggatctgttcggcgaggttgacgccgcactacctcttgacatcctgacatacgaagaaaagacgctcagcgccatcctccggatttgcagctcgggattggtcaaattgtggtcctccctcactttactgggttcatacaagggcaagaagtgtgctttccgcgtgatccaagtgtctccttttttgttggctctgagtggaaacagccgggagctcgtgttggactag

SEQ ID NO: 13025 - DNA, 375 bp, Artificial Sequence
  Description of Artificial Sequence: Synthetic coding sequence
atgcccgctccggctgcaacctatgagcgtgtagtatataaaaatcccagtgagtatcattatatgaaggtatgcctcgagttccaggattgtggtgtggggcttaatgcagcccaatttaagcagctccttatctcagcggtgaaggatctattcggcgaggtggatgcggcactgcctctggatatcttgacttatgaggagaagactttgtctgcaattctcaggatctgtagcagcggtctggtgaagctgtggtcatctctgacactgctgggctcctataagggaaagaagtgcgcttttcgagtcatacaagtgtcgccgttcttgttggcacttagcggcaattccagagaactggtgctggactag

SEQ ID NO: 13026 - DNA, 600 bp, Artificial Sequence
  Description of Artificial Sequence: Synthetic coding sequence
atggagaattttcgaaaggtgcggtccgaggaagctcccgccggatgtggcgccgaagggggcggtccaggcagtggaccgtttgccgatctcgcaccaggggccgtccatatgagagtgaaggagggatctaaaatcaggaacctcatggcatttgctacagcctctatggcacagcctgccactcgagcaattgtattcagtgggtgtggccgcgctactactaaaaccgtcacttgcgctgagatcctgaagcgtcgtctcgcaggattgcaccaggtgaccaggctgaggtaccgttccgtcagggaagtctggcagagcctacctcctgggccaacgcagggccagactcccggggaacccgccgccagtttgtcagtgctgaaaaacgtgcccggcctcgcgatactgctgtctaaagacgctctggatccccgacagcctggctaccagccccctaaccctcaccccggaccgtcaagccctcccgctgcgcccgccagcaaaagatcacttggggaacctgcggcaggcgaggggagtgctaagaggtcccagcccgaaccaggagtggccgatgaagatcagaccgcttag

SEQ ID NO: 13027 - DNA, 600 bp, Artificial Sequence
  Description of Artificial Sequence: Synthetic coding sequence
atggagaactttcggaaggtgaggtccgaggaagcacctgcaggatgcggcgctgaaggaggaggtcctgggtccggtccattcgctgacttagctccgggcgccgttcatatgagggttaaggaggggtccaagataagaaacctgatggcttttgctaccgcgagcatggcccagcctgctacgagagccatagttttctcggggtgcggacgggcgactaccaaaaccgtgacttgcgcagagattctcaagcggcggctggcaggcttacatcaggttacccgactgcgttaccggtcggtgagagaagtctggcaatctttacctcctgggccgacccaggggcaaacgccgggcgagcccgccgcttcactatctgtgctcaagaacgtgccaggtctggccatcctgctttccaaggacgccctggacccaagacagccaggctatcagccgccaaatccacatcccggtcccagctcccctcctgcagcccctgcgtctaaacgaagtctcggcgaaccagctgctggtgaggggtctgcaaaacgatcacagccggaaccgggcgtggctgatgaggaccagactgcttag

SEQ ID NO: 13028 - DNA, 1386 bp, Artificial Sequence
  Description of Artificial Sequence: Synthetic coding sequence
atggttagtcgggtccagttaccccctgaaattcagctcgcccagaggctggctggtaacgagcaggtcacccgggacagagcagtgcgtaagctcagaaagtacattgttgcaaggacacagcgcgctgccggtggctttactcacgacgagctgttgaaggtgtggaaaggccttttctactgtatgtggatgcaggacaagccattactgcaagaagagcttggacgaactatatcccagctggtgcatgcatttcagactactgaggcccagcatctcttcctgcaggcattctggcagacgatgaatcgggagtggacaggcatcgatcggctaaggttagataaattttacatgctaatgagaatggtcctcaacgagagcctgaaggtcctgaaaatgcagggatgggaagaaagacaaatcgaggagctgctggaactgctgatgactgagattcttcaccccagttcacaggctcctaatggcgttaagtctcatttcattgaaatcttcctggaagagctgactaaagtcggtgccgaagaactgacagctgaccaaaatctcaagttcattgatcccttctgtcggatagcagcaaggaccaaggatagtctggtcctgaataatattaccagagggatatttgaaacaatcgtggaacaggcccctctggcaatcgaggacctgcttaacgagctcgatactcaggatgaggaagttgcttctgacagcgacgagagctcagagggcggggaacgaggggacgccctgagccagaagcgatcagaaaagcctccagccggtagcatatgccgcgctgagccagaggccggtgaggaacaggcaggcgatgacagggattccggaggaccggttctgcagtttgactacgaggctgtggccaatcggctgttcgagatggccagtagacagtcaacaccgtcacaaaacagaaagcggctgtacaaggtgattaggaagctgttgccttggttctctggcatcttccccgaggacgaaatccccgagaaagcatgccgcaggctgctcgagggcaggaggcagaaaaaaacaaagaagcagaagcgacttctgcgcctgcaacaggagagaggtaagggcgagaaagagcccccatcaccgggaatggagcggaagagaagcagacgccgcggcgtgggggccgacccagaagcgagggccgaagctggggagcagcccggtactgctgagcgagcacttctgagagaccagcctcggggcagagggcaaaggggcgccagacaacgcaggaggactccccggcctcttacgtccgcccgcgccaaagccgctaacgttcaagaaccggaaaaaaaaaaaaagcggcgggaatag

SEQ ID NO: 13029 - DNA, 1386 bp, Artificial Sequence
  Description of Artificial Sequence: Synthetic coding sequence
atggtctctcgcgttcagctccctccagagattcagctcgctcagcggctagccggcaacgaacaggtgactagagacagagccgtgcggaagcttcgtaagtacatagtggctcggacacagcgcgccgccggcggcttcacccatgatgagttgctcaaagtgtggaaaggccttttctattgtatgtggatgcaggacaagccgttgctccaagaggaactgggacgcactattagccagcttgtgcacgcatttcagactaccgaggcccagcacttgtttcttcaggctttctggcagacaatgaatcgcgagtggactgggattgaccgtctgagactggataagttttacatgctgatgcgaatggtgctcaacgagtccctgaaagtgctcaaaatgcaggggtgggaagagcggcagatcgaggaacttttagagttgttaatgaccgaaatcctccacccctccagccaagctcccaacggcgttaaaagtcacttcatagagattttcctagaagagctcacgaaggtcggtgcagaggaactcacagccgaccagaatctgaaatttatcgatcccttctgtagaatcgcagccagaactaaagatagcctggtgctcaacaatatcacccgcgggatcttcgaaaccatcgtcgagcaggcccctctggctatagaagatctgcttaacgagctggacacccaggacgaagaggtggcatctgactctgacgagtccagtgaaggcggcgaacggggcgacgccctgagccaaaaaaggagcgaaaagccaccggccgggtccatctgtagggcagaacccgaggctggcgaggagcaggctggggacgaccgtgactccggcggcccagtgctgcagttcgactatgaggctgtggccaatcgactgttcgagatggcatcccggcagtctaccccaagtcagaacagaaaacggctgtacaaggtaattagaaagctccaagatctcgccggaggcatcttcccagaggatgaaatacctgaaaaggcctgtaggcgcttattagaggggagaaggcagaagaagaccaagaagcagaagcggctcctcagactccagcaggagaggggaaaaggggaaaaagaaccccctagccccgggatggagcggaaacgtagcaggagaagaggagtgggagccgatcctgaggctcgtgctgaagcaggggagcagcctggcaccgctgaacgagccctcctacgcgaccaacccagagggagaggccaacggggggccaggcagaggagaaggacaccacggcccctcacctctgctagagctaaggcagctaacgtccaagagcccgaaaagaagaaaaagagacgggaatag

SEQ ID NO: 13030 - DNA, 1371 bp, Artificial Sequence
  Description of Artificial Sequence: Synthetic coding sequence
atgtttgaagagcctgagtgggctgaggccgcccctgtggcggccggcctgggacctgttatctcgagaccacccccagctgcgtcctcccaaaacaaagggtctaaacgcagacagctgctggctacactgagagctctggaagcggccagtcttagtcagcacccaccctctctgtgtataagtgattctgaggaggaagaggaggagaggaagaaaaagtgtcctaagaaagcatctttcgcatcggcttctgcggaagttggcaagaaagggaagaaaaagtgccagaagcagggccccccatgttctgacagtgaagaagaggtagagagaaaaaaaaagtgccacaaacaggccctcgtaggctcagacagcgctgaggatgagaagcggaaacgcaaatgccaaaagcatgcacccatcaactcagcccaacatctcgacaatgtggatcagacagggcccaaagcatggaagggatctaccaccaacgatccacctaagcagagccctggtagcacatcaccgaaacccccgcataccctctcaaggaagcagtggagaaacaggcaaaagaataagcgccgctgtaagaacaagtttcagcccccccaggtccccgaccaggctccagctgaggcgcctaccgagaagacggaggtctcacctgtacctcggacagactcccatgaagcacgtgcaggggctctaagagcacggatggcccaacgcctggacggcgccaggttccggtacttaaacgagcaactgtattcaggtccctcatctgccgcccagcgcctgttccaggaggatcctgaggccttcttgctgtatcacagaggctttcagtcccaggtaaagaagtggccactgcagccagttgataggatcgctcgcgacttgagacagcgaccggcttcactcgtggtggctgactttgggtgtggcgattgcagactagcctcttccattagaaatccagtgcactgtttcgacttagcctctctggaccctagggtaaccgtctgtgacatggcacaggtcccccttgaggacgagagcgtcgatgtcgcggtgttttgtttatccctgatggggactaatattagggattttctcgaggaggcaaaccgagtccttaaacctggcggccttctgaaggtggcagaagtcagcagtaggtttgaagatgtaaggacattcttaagagcagttacgaagctggggtttaaaatagttagcaaagacttgacgaattctcactttttcctgttcgattttcagaaaacgggccctccacttgttgggccaaaagctcagctgagcggcctgcaactgcagccatgcttgtacaagaggaggtag

SEQ ID NO: 13031 - DNA, 1017 bp, Artificial Sequence
  Description of Artificial Sequence: Synthetic coding sequence
atggaactgtgggggaggatgctgtgggcattgctgagtggccctgggaggagagggtctacaagagggtgggctttctcttcatggcaacctcagcccccactggcgggcctgtcttccgccattgagttggtgagccactggaccggagtcttcgaaaaaaggggtattccggaggccagggaatctagcgagtacatagtagcacacgtgttgggtgcgaagacattccagtctttgcgccccgcgctgtggacccaacccctgacgagccagcaactccagtgtatacgggaattgtcctccagacgactgcagagaatgccagttcagtatatcctcggtgaatgggactttcagggattgtctctgagaatggtaccccccgtgtttattccccgccccgagaccgaagagctggtggagtgggtcctcgaggaggtcgcccagcgctcccatgccgtcggtagtcccggctccccactcattcttgaggtagggtgcggaagtggagctatctctctgagtctcctgagccaacttccacagtcccgagtgattgctgtggacaagcgtgaggccgcgattagcctgactcacgagaatgcacagcgcctgcggctccaagacagaatttggattatccatctggacatgacctcagagcggtcctggactcatctgccgtggggccctatggacttgatcgtatctaaccccccttatgtctttcaccaggatatggagcagctcgctcctgagattcgaagctacgaagacccggccgccctggacggcggagaggagggtatggacatcatcacccatattctggccctggcacctagattactgaaagacagtggaagtattttcttagaagtggatcccaggcacccagagctggtgagttcctggttgcagagcagacccgatttatacttgaatctggtggctgtgcgcagggatttttgcgggcgcccccgctttctacacatccgccgatccgggccgtag

SEQ ID NO: 13032 - DNA, 1050 bp, Artificial Sequence
  Description of Artificial Sequence: Synthetic coding sequence
atggccaaagccggggataagtcctcctcttctgggaaaaaatcactgaagcgaaaagccgccgctgaagagttacaggaggcagccggggccggtgatggcgccacggagaatggagtccagccacctaaagctgccgcattcccccccggtttctccatcagcgagataaagaacaaacagcgccgacacctgatgttcacgcggtggaagcagcagcagcgaaaagagaaactcgccgcaaagaaaaaactcaagaaagagagggaagcactgggtgacaaagctccaccgaagccagtgcccaagacaattgacaatcaacgcgtctacgatgaaactaccgtcgatccaaacgacgaagaggtggcatacgacgaggctacggacgaatttgctagttattttaataaacagacaagtccaaaaatattaatcaccacttccgataggccacatggtcgaactgtgagattatgcgaacagctgtcgacagtcattccaaactcacatgtgtactatcgccggggcctggccttgaaaaaaatcatcccccagtgtattgcaagagactttactgatttgatcgttatcaacgaagatcggaaaacacctaacggtctgatcctaagtcatctgcccaatgggcccacggcccactttaaaatgtcatctgtgagactgagaaaggagataaagcgaagaggcaaagatccgactgaacacattcccgaaatcatcctcaataattttacaaccaggctcggacacagcataggacgcatgtttgcctctctgtttccccacaatcctcagttcattggccgccaggtggccacttttcacaatcagagggattacatcttttttagattccaccggtatattttcaggtctgaaaaaaaagtcggaatccaagagctcggccctaggtttacgctgaaactgcgaagcctgcagaagggcactttcgacagcaaatatggcgaatacgagtgggtacataagcctcgcgagatggatacttctagaaggaagttccatttgtag

SEQ ID NO: 13033 - DNA, 390 bp, Artificial Sequence
  Description of Artificial Sequence: Synthetic coding sequence
atggcaaaagctggagataaaagctccagttccggcaagaagagccttaagcggaaggccgccgcagaggagcttcaggaagccgcaggcgccggcgatggcgcgaccgagaatggtgttcagcctccaaaggccgccgcattccctccgggcttctccatctcagagatcaagaataagcagagaaggcacctcatgtttaccagatggaagcaacagcagagaaaagagaaactggcagcaaaaaagaaactgaagaaagagcgtgaagctctcggggacaaagctccccctaagccagtgcctaagacaatcgataaccaaagggtatatgacgagaccactgtagacccaaacgatgaggaagtgatgttagaggtgctcaactag

SEQ ID NO: 13034 - DNA, 627 bp, Artificial Sequence
  Description of Artificial Sequence: Synthetic coding sequence
atgtgctttgtgttgaaagctatcaatttcgtgctccaatacgcactcaagaagccatacggagtgttgtataagaaaaagaatatcacccggcccttcgaggatcagacatctcttgaatttttttcaaagaaatccgattgttctctcttcatgttcggctcccataacaagaagagaccgaataatttagttatagggaggatgtacgactatcacgtactggacatgatcgaactgggcattgagaatttcgtgtccttgaaggatattaaaaattccaagtgtccagaggggacgaagcctatgctgattttcgcaggggatgacttcgacgtcacagaggactaccgccggctgaagagtctcctcatcgatttctttcggggcccaaccgtgtcaaatatacggttggccgggctggaatatgtgctgcactttacggccctaaacggaaagatttacttcagatcatacaaattactgttaaaaaagtctggatgcagaacgcccagaatcgagttggaggagatgggacccagccttgacttggtcttgagacgaacccacttggcaagcgacgatttgtataagctctcaatgaagatgcctaaagccctcaagtag

SEQ ID NO: 13035 - DNA, 645 bp, Artificial Sequence
  Description of Artificial Sequence: Synthetic coding sequence
atgttgatcaaaggaggaaacgcgaatgccactgtgacgaaggtgttgaaagatgtgtatgcgttgaagaagccttacggcgtcttatataagaaaaaaaatatcacccgtccgttcgaggaccagacctctctggagttcttttctaagaagtccgactgctctctgttcatgttcggtagccataacaaaaagcgccctaacaatctggtgattgggcgaatgtacgattatcatgttctggacatgatcgaattgggcattgaaaactttgtctccctgaaggatattaaaaattccaaatgtcctgaagggaccaaaccgatgctgattttcgctggagacgatttcgatgttactgaggactaccgccggctcaaatctctccttattgacttttttcggggccccacagtcagtaatattaggttggccggtcttgagtatgtcctgcattttacagccctcaacggtaagatttacttccgaagctataaattgctgctcaaaaagagtggctgccggaccccgcggattgaactggaagagatggggccctctctggacctcgtgttgaggcgaactcatctggcctccgatgacttatacaaactgagtatgaaaatgcccaaagccctgaagtag

SEQ ID NO: 13036 - DNA, 921 bp, Artificial Sequence
  Description of Artificial Sequence: Synthetic coding sequence
atggacacattggacagagtggtaaaacctaaaaccaaaagagctaagcggttcctcgagaaaagggaaccaaaactgaacgaaaatataaaaaatgccatgctgatcaaaggaggtaatgccaatgccactgtgaccaaggtgttgaaagatgtttacgctctcaaaaagccctatggggtgctttacaaaaaaaagaatattacacgtcccttcgaagatcaaacctctctcgaatttttctctaaaaaatccgactgcagcctgtttatgttcgggagccataacaagaaacggccaaataacttagtaatcggccggatgtatgactaccatgtcctcgacatgatcgaactggggatagagaattttgtgtccctgaaggatataaaaaatagcaaatgtccagaaggtaccaagcccatgctgatttttgccggcgatgatttcgatgtcacagaagactacagacggttaaaatcattgctgatcgacttttttcgcgggccaaccgtctcgaatattaggctcgccggtctggaatatgttctgcacttcaccgctctgaacggtaagatttacttccgcagctataagctacttctgaagaagtcgggttgccgaaccccccggatcgagctggaggaaatgggacctagtttagacctggtgctgcgccgcacacatttagcaagcgatgacctgtacaaactcagcatgaagatgccaaaagcactgaaacccaaaaaaaagaagaatatcagccacgacacctttggaactacctatggtagaatacatatgcagaaacaggacttatctaagttgcagactcgcaagatgaaagggcttaaaaagagacctgccgagagaatcaccgaggaccatgagaaaaagtcaaagcgaattaaaaaaaactag

SEQ ID NO: 13037 - DNA, 546 bp, Artificial Sequence
  Description of Artificial Sequence: Synthetic coding sequence
atgtccggcatcgggaacaaacgcgcagcgggggagccgggaactagcatgcctcccgagaagaaggcagcagtggaagactcaggtaccacagtggaaaccatcaagcttggaggcgtgtcttctaccgaggagctggacattaggactctccagaccaaaaaccgcaaactcgcagagatgttagatcagagacaagcaatagaagatgaactcagagagcacatcgagaaattggaaaggagacaggcgactgacgacgcatccctgctgattgtgaaccgttactggagtcagttcgacgaaaatatcagaattattcttaagcggtatgacttagaacaggggctgggcgaccttctgacggagcgtaaagcactggtcgtgccagagccagaacctgacagcgactctaatcaagagcgaaaggatgacagggagcgcggcgaggggcaagagcccgctttcagttttttggccacactagccagttcttccagtgaggaaatggagtctcagctgcaggagcgggttgagagctcctag

SEQ ID NO: 13038 - DNA, 2928 bp, Artificial Sequence
  Description of Artificial Sequence: Synthetic coding sequence
atgagtgggatagggaacaaacgcgctgctggagaaccaggtaccagtatgccaccagagaagaaagcagcggtggaggattccggaacgacagtggaaaccatcaaactgggaggcgtaagcagcacagaagagctcgatatcaggacactgcagactaagaaccggaaattagctgagatgctcgaccaacggcaggcaatcgaggatgagttgagggaacatatcgagaagctggagcgccgacaggccactgatgatgccagcctccttatcgttaaccggtactggtcccagttcgacgaaaatatcagaatcatcctgaaaagatacgacctagagcaggggctgggagatctgctgacagaacggaaggccctggtagttcccgaacctgagccagattcagattccaaccaggaaaggaaagacgatagggaaagaggggaaggacaagagcccgccttttcattcctcgccacccttgccagcagctcctcagaagagatggagtctcagctgcaggagagagtcgaatccagcaggagggccgtcagccagatcgtcacagtctacgacaagctacaagagaaagttgagttactgtcccggaagctcaactccggtgataacctaattgtggaagaagccgtgcaagaactgaattccttccttgcccaggaaaatatgagactccaagaactcacagacctgctgcaagaaaagcatcggacgatgtcacaagaattttcaaagctgcagagtaaagtcgagaccgccgagtcacgggtgagtgtactggagtcgatgattgacgatctgcaatgggacatcgataagatccgtaaacgcgaacagcgccttaacaggcacctcgcagaggtgctggagagggtgaattcgaaaggatacaaagtgtatggtgccgggagttccctctatggtggaaccataacaatcaatgctcgaaagtttgaagaaatgaatgcagagctggaggagaataaagaattggcccagaacagactgtgtgagctagaaaaactgcgacaggactttgaggaagtaactactcagaacgagaaattaaaggtcgaacttagatctgccgtggagcaggtggtcaaagaaacacccgagtatcgttgtatgcagagccaattctctgtcttgtataacgagtccctccagttaaaggctcacctagacgaagcgcggaccttgctccacgggaccagagggacgcatcagcaccaggttgagctgattgagcgggacgaagtcagcctgcacaaaaagcttcgaactgaagtcatccagctagaggacacacttgcccaggtgcggaaggaatacgagatgctcagaatcgaattcgagcagactctggcagccaatgagcaagcgggccctattaaccgggaaatgcgacacctgatttcttccctgcagaatcataatcatcagctcaaaggggaagtgctgagatataagaggaagttgagagaagcacagtccgacctgaacaagacccggctgcgttcgggcagtgccctgctgcaaagccagagctcaacagaggacccaaaggacgaacccgctgagctgaaaccagactctgaagacctgagctcacagtctagcgcaagcaaggcatctcaagaagacgccaacgaaattaagagcaagagggacgaagaggagcgggaaagggagagacgcgaaaaggaaagagaacgcgagcgggagagggagaaggaaaaggagcgtgagcgtgagaagcagaagctgaaggagagtgagaaagagagggactccgccaaggataaggagaaagggaagcatgacgacggtagaaaaaaggaggcagagatcattaaacagctgaagatcgagctgaagaaggcacaagaatcccaaaaggaaatgaagctactgctggatatgtatcggtcagctcctaaggaacagcgcgacaaagtacagctgatggctgctgagaaaaaatccaaagcagagctagaggacttacggcaacgtctcaaagatttagaggacaaggagaagaaggaaaataaaaagatggcagatgaggatgccttacggaagatccgcgcagtcgaggagcagatagagtatttacagaagaagttagcaatggctaagcaagaggaggaagccctgctaagcgaaatggacgttactggccaggccttcgaagatatgcaggaacaaaatattcggctgatgcaacagctccgggagaaggacgatgctaatttcaagttgatgagtgagcgcattaagagcaatcagattcacaagctgctcaaggaggaaaaggaagaattggctgatcaggtcttgacactgaaaacacaagtggacgcgcagctccaggtagtccggaagttagaagagaaggagcacctgttgcagagcaatatcggaactggggagaaggagctaggacttaggacacaggccctcgagatgaataaacgaaaagccatggaagctgcacagttggctgatgatctgaaagcccagctggagttggcgcaaaaaaagctccacgacttccaggatgagattgtggaaaatagtgttacaaaggagaaggacatgttcaactttaaacgggcccaagaggacatctctaggctgcggcgtaaactcgaaacgacaaagaagcccgataatgtgccaaaatgtgacgagattctgatggaagaaatcaaagattacaaggccaggctcacctgcccttgctgtaatatgcggaagaaagacgccgttctaacaaagtgctttcatgtgttttgcttcgagtgtgtgaaaacacgctacgatacgagacagcggaagtgccctaaatgcaacgccgcattcggtgctaacgactttcatcgaatttatatcggttag

SEQ ID NO: 13039 - DNA, 438 bp, Artificial Sequence
  Description of Artificial Sequence: Synthetic coding sequence
atgtcggggattggcaacaaaagagccgccggggagcccggaacatcaatgccaccggagaagaaggccgccgtggaagactccggaaccaccgtagaaaccatcaaactgggcggggtgagctcaacagaagagctggatatccgtacattacagaccaagaaccggaagctggccgagatgctagatcagcgccaggcaattgaagacgagttgcgcgagcacatcgagaagctcgagagacgccaggccaccgatgatgccagcctgctgatcgtgaatcggtattggagccagttcgacgagaacattagaattatcctgaaacgctatgacctcgagcagggcttgggtgatcttctgacggagagaaaagcccttgttgtcccagagccagaaccggatagcgactctaaccaggaaagaaaagacgactag

SEQ ID NO: 13040 - DNA, 300 bp, Artificial Sequence
  Description of Artificial Sequence: Synthetic coding sequence
atgagcggaatcggaaataagagggctgccggcgaacccggcacgtctatgccccctgaaaaaaaagcggcagtggaagattcaggtacaacggtggagaccatcaagctcggtggtgtgagctccactgaagagctggacatcagaacactgcagactaagaaccgaaagttagccgagatgctagatcagaggcaggctatcgaggatgagctgcgagagcacatagagaaactggaaaggcgacaggcaactgacgatgccagcctcctcatcgtcaaccggtattggtctcagtag

SEQ ID NO: 13041 - DNA, 1878 bp, Artificial Sequence
  Description of Artificial Sequence: Synthetic coding sequence
atgaacgtcacctctatagcgctgagagcagaaacatggttgctagcagcctggcacgttaaggttccgcctatgtggctggaagcctgtatcaactggatccaggaagagaacaacaacgtgaatctgagccaggctcagatgaacaaacaggtctttgagcagtggctgctgaccgacttacgcgacctcgaacaccccctcctccccgatgggatcctggagatccccaaaggcgaactgaatgggttctatgccttgcagataaacagcctagtggacgtcagccaaccggcttattctcagatccaaaagctgagaggcaaaaacactactaatgatctcgtaacggctgaggcccaggtcaccccaaaaccctgggaggctaagccttcccggatgctaatgctgcagctgacagacgggatagtccagatccaggggatggaatatcaaccaatacctatcttgcattcagatctgcctccagggacaaagattctgatatacggaaatattagcttcaggctcggagtcctccttcttaaacccgaaaatgtaaaggtactgggaggagaggtggacgctctactcgaagagtatgctcaggagaaggttctggcgaggctcatcggcgaaccagacctggtggtgagtgttatccccaacaacagtaacgagaacatccctcgcgtgactgacgtcctcgacccagcacttgggccctctgatgaagagttgctggctagcctagatgagaatgatgagttgactgccaataatgataccagtagtgagcggtgttttaccacaggctctagcagcaacactatccctacaaggcagagtagcttcgagcctgaattcgtgatcagtccaaggcctaaggaggagccttccaacttgagcatccacgtgatggatggggagcttgacgatttttcactggaggaggcgcttctgcttgaggaaactgtccaaaaggaacagatggaaacgaaagagcttcaaccactgacgttcaaccgaaacgccgaccgctctattgagcggttcagccataacccgaacaccactaacaattttagcctcacctgtaagaatggaaacaacaactggtccgagaagaacgtttctgaacagatgacaaacgaagacaaaagtttcggatgcccttcggtccgggaccagaatagaagcatattcagcgtccactgcaacgtgcctctcgcgcacgactttaccaataaagagaaaaacttggaaaccgataacaaaatcaagcagacctctagtagcgacagccactctcttaataataagatcctcaatcgtgaggttgtgaattatgtgcagaaacgaaatagccagattagcaacgagaacgactgtaatctccaatcatgcagccttcggtccagcgagaatagtattaatcttagcattgccatggatctttatagccccccgttcgtctacctcagtgtgctgatggccagcaagcctaaggaggtcactacggtaaaagtgaaagcctttatcgttacgctgaccggtaatctgagtagtagcggaggtatctggtctatcactgccaaggtcagcgatgggacagcatatctggatgtggattttgtggatgagatcttaacgagcctgattggtttttctgttccagagatgaagcaatccaagaaggaccccctgcagtaccagaaattcttggagggtctgcagaagtgtcagagggacttgatagatctatgttgcctaatgaccatctccttcaacccatcactgagcaaggcgatggtgctggcactacaagacgtcaatatggaacacttagaaaacctgaaaaagcgcctcaacaagtag

SEQ ID NO: 13042 - DNA, 2196 bp, Artificial Sequence
  Description of Artificial Sequence: Synthetic coding sequence
atgccaagcatacctccaatccctgttccgcctcctgtgcctactctcccacccgtaccccctgtcccgcccatccccccagtgccatctgtccctccaatgacaccgctacctcccatgagcggtatgccccccctgaatcccccgccagtagccccgctccccgcagggatgaacggaagcggagcaccaatgaatctgaacaataatctcaatcccatgtttctgggacctctgaacccagttaacccaattcagatgaattcccagagttctgtgaagcccctgcctatcaaccctgacgatctgtatgtgtccgttcacgggatgccctttagtgcgatggaaaacgacgtcagagatttttttcatggattgagggttgacgcagtgcacctgctgaaggaccacgtgggcagaaacaacggcaacggtttggtcaaattcctttcacctcaggatacatttgaggccttgaagcggaaccgtatgcttatgatccagcgctatgttgaggttagcccggcaaccgaacgccagtgggtggcggcaggtggtcacataacgttcaaacagaatatggggccgtccggacaaacccaccctccgccacagacgctgcctaggagtaaaagtcctagtggacagaagaggtccaggagccgcagcccacatgaagctgggttctgtgtgtacttgaaaggactgccctttgaggcggagaacaagcatgtgatcgatttctttaagaaacttgatatcgttgaagattcaatctacatagcctacggacccaatgggaaagccaccggagagggttttgtggaattccgcaacgaggcggactacaaagctgctttgtgccgccataagcagtacatgggcaatcggttcattcaagtccacccgatcactaagaagggcatgctcgaaaagatcgatatgatcagaaagcgcctacaaaacttttcctatgatcaaagagaaatgatcttaaatccagaaggagatgtgaactcagctaaagtctgtgcacatatcactaacatcccgttttcaattacaaagatggacgtactgcagttcctagaggggattcctgttgacgagaatgctgtgcacgtgctggtggacaacaatggtcagggacttgggcaggccctggtacagttcaagaatgaggacgatgcaagaaaatccgagaggcttcacagaaagaaattaaatgggcgggaggcctttgtacacgtggtgaccctggaggatatgcgtgaaatcgaaaagaatcctcctgcacagggcaagaaagggctgaagatgccagtgcctggaaacccagccgtgccaggcatgccaaatgccggactgcctggcgtcggactaccatcagccggcctgcctggtgccggcctaccctccactggtctgcccgggtctgctatcacctctgcaggtctgcccggcgctggcatgcccagtgctggcattccctcagcgggtggagaggagcatgcctttttgactgtcggctcaaaagaggcaaacaatggccctcccttcaactttccagggaatttcggcggttccaatgcatttggacccccgattccgcctccagggttaggaggaggcgctttcggcgatgcacggcctggcatgccttctgtcggcaattctggactcccggggctgggccttgacgtgccaggcttcggagggggccctaataacctgagcggccccagtggatttggcggaggacctcagaatttcgggaatggccctgggagtctagggggcccccctggctttggaagcggcccccccggactgggcagtgcacccggtcatttaggcgggcctccagcttttggccccggacctgggcctggccctggtcctgggccaattcacattggtggtcctccggggtttgcttcttcctctggcaaacccgggcctaccgtgattaaagtccagaatatgcccttcactgtgtctattgacgaaatactggactttttttacggctatcaagtgattcctgggagcgtgtgtctgaagtataacgagaaaggcatgccaactggcgaggccatggtggcgttcgagagccgcgatgaggccaccgccgccgtgatcgatcttaatgatcggccaatcggatcccgcaaggtgaaactcgttctcgggtag

SEQ ID NO: 13043 - DNA, 2799 bp, Artificial Sequence
  Description of Artificial Sequence: Synthetic coding sequence
atggccgtcgtgatccgcctgcagggcctgccaatcgtcgccggcaccatggatatcaggcactttttcagcgggcttaccattcccgatgggggggtgcacatcgtcggaggagagctgggagaagcctttatcgtgttcgccacagatgaagacgccagacttggcatgatgcgtaccgggggaacgattaagggaagcaaggtgacactgctgttgagcagcaaaacagaaatgcagaatatgattgaactgtctcggagacggttcgaaaccgcgaatttagacatacccccagccaacgccagtagaagcggccctccaccctctagtggcatgtcttctagggtgaacctgcctacaactgtgtccaattttaacaatccctccccttccgtggtgactgccacaacgtccgtgcatgaatctaacaagaatattcaaaccttctcaaccgcatccgtggggacggctcctccaaatatgggcgcatcgtttggcagcccaactttttcttcaaccgtgccaagcactgcaagccctatgaacaccgtgccccccccacctataccccccatcccagccatgccgtctttacccccgatgccgagtattccccctattcccgtaccacctccggtacccaccttgcccccagtacctccagtgccacctatccctccggtcccctctgttcccccgatgacgcccctcccccccatgagcggtatgcctccattgaatcctccaccggtcgctccccttcctgcagggatgaatggctccggcgctcctatgaatcttaacaataacctgaacccaatgttcctcggtcccctgaacccagtgaatccaattcagatgaattctcaatccagtgtgaagcctctgccaatcaaccctgacgatttgtatgtttctgtgcacgggatgcccttcagcgctatggagaacgatgtgagggacttctttcacgggctgcgggtggacgcagtgcaccttctgaaggatcacgttggtcgaaataacgggaatgggcttgttaaattcctatctccacaggacacgttcgaagctctcaaaagaaaccgcatgcttatgatacagcggtacgtagaggtgagcccggctaccgagcgccagtgggtggctgccgggggtcatatcactttcaagcagaacatgggaccgagcggacagacacatcctcccccccagacgctgccacggtctaaatctccctcagggcaaaagaggtcaagaagcagatccccacacgaggccggtttctgtgtgtacctgaaggggcttccattcgaggcagagaataagcacgtgatcgatttcttcaagaaactggatatcgtcgaggattccatttacattgcatatgggcctaatggtaaagcgactggggaaggattcgtggagttccgtaatgaagcagattacaaagccgcgttgtgtcggcataaacagtatatggggaacaggtttatacaagtgcatcccataaccaaaaaagggatgttggagaaaattgacatgatccgcaagcgcctgcagaatttttcttatgaccaacgcgaaatgatccttaatccagagggggatgtgaatagcgccaaggtctgcgcacacatcacaaacattccctttagcatcacaaagatggatgtgctccaattcctcgaaggaattcctgtggatgaaaacgcggtccatgtcctggtggataataacggccaggggctgggacaggcgctggtgcagttcaagaatgaggacgacgctcgtaagagcgagcgacttcatcgtaaaaagctcaatggtagggaagccttcgtgcacgtggttactctggaggacatgagagagatcgagaagaacccacccgcccaggggaaaaaaggactgaaaatgcctgttccgggtaatccggctgttcctgggatgcctaacgccggtctccctggagtcggcctgcccagcgcaggactacccggagctggactgccaagcaccggtctgcctggttccgccatcaccagcgcgggacttcccggggccggtatgcccagcgccggcattccgagcgcagggggagaggaacatgcattcctcacagtcggttccaaggaagcaaacaatggcccacctttcaattttcccggcaacttcgggggttctaacgctttcggcccgcctatccccccccctggccttgggggcggagcgtttggcgacgccaggccaggaatgcctagcgtcggcaacagtgggctgcctggtctggggctcgatgtgccaggattcggtgggggcccaaataacctgtccggacccagtggattcggcggcggcccccaaaatttcggcaacggcccaggttcactaggaggcccacctggcttcggatcgggcccacccggtttgggctcagcccctggccatctgggtgggccaccagccttcggccccggaccaggacccggccccggcccagggcctattcacatcggaggaccacctggattcgcttcttctagcggtaaaccggggcctacagttattaaggtgcagaatatgcctttcacagtgtcgatcgacgaaatactggattttttttatggataccaggtaatccctgggtctgtttgtctgaagtacaacgagaagggaatgcccacaggggaggccatggtggctttcgagagcagagatgaggcgacagcagctgtgatagacttgaatgacagaccgatcggctcacgtaaagtgaagctcgttctcggttag

SEQ ID NO: 13044 - DNA, 2799 bp, Artificial Sequence
  Description of Artificial Sequence: Synthetic coding sequence
atggccgtggtgattagactccaagggctgcctatcgtggccggcaccatggacatcagacacttcttcagcgggttgacgatccccgacggtggggtgcacatcgtgggcggggagctcggggaggcatttatcgtcttcgcaaccgacgaagacgcccggttaggaatgatgcgaaccggcggaacaattaaaggctcgaaagttaccctgctgcttagttctaagactgaaatgcagaacatgattgagttgagtcgtcggaggttcgaaacggccaacttagatattccccccgccaacgccagccgctcgggtccacccccgtctagcggcatgtcatctcgcgtcaacttgcccaccacagtcagtaatttcaataacccgagcccctctgttgtgacggccactacaagtgtccacgagtctaataagaacatccagacgttttccacagcttcggtgggtacagcccctcctaatatgggagcctcttttggcagtcccaccttctcgagcaccgtgccttcaaccgcatcaccaatgaatactgtgccaccaccccctatccccccaattcccgctatgccttcactccccccaatgccctcgatcccacccattccagtccctcctcctgtccccaccctgccaccggtgccacccgtgcctccaatccctccagtgccatccgttccacctatgacaccattaccgcctatgagtggaatgcccccactaaatcctccccccgtcgccccactacccgcgggcatgaacggctctggggccccaatgaatctgaacaacaatctgaaccccatgtttctcggtccccttaatccagtaaacccgatccagatgaacagtcagtcctctgtgaagcccctgccgatcaaccccgacgatctgtatgtgagtgtgcatgggatgccattttccgcaatggaaaacgatgtaagagactttttccacgggctacgcgttgacgccgttcacctccttaaggatcatgttgggaggaataatggcaatggattggtgaagtttctgtcccctcaggatactttcgaggcactaaaacggaatcgcatgctgatgattcaacgttacgtggaagtatccccagccaccgagcggcagtgggtggcggcggggggacacattacgtttaagcagaacatggggcctagtggccagacccacccacctccccagacactgccacgctcaaagagcccctcgggacagaagagaagccgatcccggtcaccacatgaggctggcttctgcgtgtacctgaaagggcttccttttgaagcagagaacaagcatgtcatcgatttctttaagaaattggacatcgtggaggatagcatttacattgcttacggaccaaacgggaaagccacaggggaaggctttgttgagtttaggaatgaggctgattacaaggctgctctctgtcgacataagcagtacatgggcaataggtttatccaggtgcaccccatcacgaaaaaggggatgctcgagaagattgacatgattcggaagaggcttcagaattttagctacgaccaacgcgagatgattcttaaccccgaaggagacgtcaactctgccaaggtttgtgctcatataactaatattccattcagtatcaccaaaatggacgttctgcagttcttagaaggcatacctgttgacgaaaacgccgtgcatgtgctggtcgacaacaacgggcaggggctaggacaggccctggtgcagtttaagaatgaggacgacgcacgcaaatccgaacgcctgcaccggaagaaactcaacggtcgcgaagcattcgtgcacgtggtgacgctggaggacatgcgggaaatcgagaaaaatccacctgctcaaggcaaaaagggcctgaagatgcccgtgcctggcaaccctgctgtgccgggaatgcccaatgccgggctgcctggggtgggactgcccagcgccggacttccaggggcaggactcccctcgacaggcctgcccggatctgcgataactagcgccggactaccaggcgctgggatgccatctgctggcatcccgtcagctgggggtgaggagcacgcatttctgactgtgggctctaaggaagcgaacaacggaccacccttcaacttcccaggtaactttggtgggtctaacgcgtttggcccacctattccaccccccggcctcggtggaggtgctttcggagacgctcgaccaggcatgccttctgtcggaaactcaggccttccaggcctgggccttgacgttcctgggtttggaggcgggcctaataacctgagtggacccagtgggttcggtgggggtccccagaattttgggaacggccccgggtctctgggaggacctcccggatttggatctggcccaccaggcctagggagcgctcctggtcatctgggtggccctcccgcctttgggcctggcccgggacccggcccagggccagggcctattcatataggtggtcccccagggtttgcttccagttcagggaaaccaggtcctacagtcattaaagttcagaacatgcctttcacagtctccatcgacgagatactggacttcttttacggctaccaggtgattccggggagcgtgtgcctgaagtacaatgagaagggcatgccaactggcgaggcaatggtcgcttttgagtcaagggacgaggctacggccgccgtgatcgacctcaatgaccgccctatcgggtctcgaaaagttaagctagtcctgggctag

SEQ ID NO: 13045 - DNA, 2799 bp, Artificial Sequence
  Description of Artificial Sequence: Synthetic coding sequence
atggcagtagttattagactacagggccttcctatagtcgcagggactatggacatccgccatttctttagcggtcttacaatcccggacgggggtgtccatatcgtgggcggagaactgggggaggctttcattgttttcgctacggatgaggacgccagactaggtatgatgaggaccggaggcaccatcaagggatctaaggtaacgctgcttcttagcagcaagacggaaatgcaaaacatgatcgagcttagtcgaaggagattcgagacagctaatttagatattccgccagcgaacgcaagccggtccgggcccccaccttcaagcggcatgagtagtcgcgtcaacttgcccaccacggtctccaattttaataatcccagcccttccgtcgtgacagcgacaacctccgtgcacgaaagtaacaaaaatatccagacgtttagcacagctagcgtgggcaccgcccctcctaatatgggagcgtctttcggatctcctactttttcgtctacagtgccatcaacggccagtcctatgaatacagtgccacccccaccgatacctcccattcccgccatgccctctctgccccccatgccttctatccctcctataccagtcccccctcctgttcccacgcttccccctgtgcctcccgtgccgcccatacctcccgtcccttccgttccacccatgactccactgcctcccatgagcggcatgcctcctctcaatccacctcccgtggccccactgccggccggcatgaatggctccggggcccctatgaatttaaataataacctgaacccgatgtttctgggccccctgaaccccgtgaacccaatccaaatgaactcccagtcctctgtgaagccattgccgatcaatcccgatgacttatacgtttctgtccacgggatgccattctccgctatggaaaatgacgtcagggacttctttcacgggttgagggtcgatgccgtacaccttctgaaggatcacgtcggccggaataacggtaatggacttgtaaaatttctctcccctcaggacaccttcgaggctctgaagcgaaaccgcatgctgatgatccaaagatacgtcgaggtttcgccagccaccgagaggcagtgggtggctgcagggggccacatcacgttcaaacagaatatgggcccatcaggtcagactcatccacctccgcagacccttcccaggtccaaaagcccgagcggccaaaaaagaagccgttcccgcagcccccacgaagccggtttttgtgtgtatttaaaaggtttacccttcgaagccgaaaataagcacgtgatcgatttctttaagaaactcgatattgtggaggattccatttacatcgcttacggccctaacgggaaggccacaggtgaaggattcgtggagtttcgtaacgaggctgattacaaggcagccttgtgccggcacaaacagtacatgggcaaccgctttattcaggtgcaccctatcacaaagaaagggatgttagagaaaatagatatgatacgtaaaaggcttcagaacttcagttacgaccaaagggaaatgatcttgaaccctgagggcgacgtgaattccgctaaggtttgcgcacatataactaatatacccttcagcatcaccaaaatggacgtacttcagttcctggaggggatccccgtggacgagaacgctgtccacgtcttggtggataacaacggtcagggactgggccaggctctggttcagtttaagaatgaagatgatgcgagaaaaagtgaaagactacacagaaaaaagctcaatgggagggaagcttttgtccatgttgttactttggaggacatgagggagatcgaaaagaacccgcccgcacaaggcaagaagggcctgaaaatgcctgttccggggaacccagccgtaccaggaatgcctaacgcagggctgcccggcgtgggcctgccttctgcaggccttcctggcgcagggctcccttccaccggcctgcctggaagcgctatcacatctgccggactccccggtgctgggatgccatccgcggggatccctagcgccggtggggaagaacatgctttcctgaccgtggggtccaaggaagccaataatggccccccatttaactttcctgggaactttgggggatctaatgctttcggcccgcccatccccccccctgggctgggtggcggcgcatttggcgatgccaggccggggatgccatcagtgggcaactctggacttccggggctaggcctcgacgtccccggattcgggggagggcccaacaatttgagtggtcctagcgggttcggtggagggccgcagaatttcggcaacggacctggaagccttggcggacccccgggcttcggtagtgggccaccaggtttgggatccgctccaggtcacctgggtggccctccagcatttgggccagggccaggtcccgggccagggccaggcccaatccacattgggggcccacctgggtttgcctcctcaagcgggaaaccaggaccaacagtaatcaaggtacagaatatgccttttacagtatcaatcgacgaaatcttggactttttctacggctaccaggtgatccccgggagcgtttgtctgaaatacaatgaaaagggcatgccgaccggagaagctatggtagccttcgaaagtcgggacgaggccactgccgcagtgatagacctcaatgacaggcctattggatctcggaaagtgaagttggtcttagggtag

SEQ ID NO: 13046 - DNA, 876 bp, Artificial Sequence
  Description of Artificial Sequence: Synthetic coding sequence
atggccgtcgtcattcgtttgcaaggcctccctatcgtcgccgggacgatggacattagacacttcttctcaggtcttaccatccccgacggaggagtgcatatcgtggggggggaactcggggaagcatttatcgtttttgccacagatgaagatgccaggctgggcatgatgagaacgggggggacgataaaaggctctaaggtcacactgttactgtcctctaagacagagatgcagaatatgattgagctctcacggcggcgcttcgaaacagcaaacctcgacatcccgcctgctaacgcttcaagatctggtcctccccctagttccggtatgtcatcccgagtcaatttacctacaacagtttcaaacttcaataatccttcgccaagtgtggtgacagcgaccacatcagtgcacgagtctaataaaaatatacagaccttctccacggcatccgtggggacagccccccctaatatgggagcgtcttttggaagccccaccttcagcagtactgtgcctagtacggcctctcctatgaacaccgtgcctccccctcctattcctcctatccccgcaatgccgagcctccctcccatgcccagtattcccccaattcctgtgcctccccctgtgcctacgttacctccagtgcccccagtcccgcctattccgcctgtccccagtgtcccacctatgactcccctccctcccatgtcgggcatgcccccattgaatccccctcctgtggctcctttgcccgctggtatgaatggctcaggcgcaccaatgaatctcaacaacaacctgaacccaatgttcctcggcccacttaatccagtaaatccgatccagatgaactctcaatag

SEQ ID NO: 13047 - DNA, 432 bp, Artificial Sequence
  Description of Artificial Sequence: Synthetic coding sequence
atggcggttgtgatcagactccagggtctgcctattgtggctggcacaatggacatccggcacttcttttctggccttaccattcctgatggcggtgtgcacattgtgggcggtgagctgggcgaggcttttatcgtctttgcaaccgatgaagatgctcggctcggaatgatgcgcacaggcggtaccattaagggatcgaaagtgaccctactacttagctcgaaaacagaaatgcagaacatgatcgagctcagccggcggcggttcgagaccgcaaatctcgatatcccccctgccaatgcttccagatccggcccccctccctcatcaggaatgtcatcccgagtgaatctgcccactacggttagcaacttcaacaatccttctccaagtgtcgtcacggcgactacaagcgtgcatgagagttag

SEQ ID NO: 13048 - DNA, 405 bp, Artificial Sequence
  Description of Artificial Sequence: Synthetic coding sequence
atggcggtggtcatccgcttgcaaggtctgcccattgtcgctggtactatggatattaggcacttcttcagtgggctcaccatacctgatggcggcgtacatattgtcggtggagaattaggcgaagccttcatagtcttcgccaccgatgaggatgcccgactagggatgatgcgcacgggaggaactatcaagggctccaaggtgacgctcttgctttccagcaagaccgagatgcagaacatgattgaactgtctcggcggcgatttgaaaccgccaacctggatattcctccggcaaacgccagccgatcagggcctccaccatcaagcggcatgagctcccgcgtgaatctgcctactactgtgtccaactttaacaacccgtctccgtccgtggtgtag

SEQ ID NO: 13049 - DNA, 1251 bp, Artificial Sequence
  Description of Artificial Sequence: Synthetic coding sequence
atgtctaacaagggcaaaaagctgaagcggatcattttggctatccctccagcggcacctgccacagttgcaatgagaccggtggaggctgcccccagcgggagacaggctcgtagaaggggtgtgggtgctattatcaaagcagggatcgaatctgcagttgtcgttgaaattggaatcggaatcgatggcgagatcgttggcgctgaagtccaggtaggctccgtcgttcggtcacggagctgggaccgaagacatgggtcagaatccagaagcagggatcatcgcagagaggacagagttcactatcgatcccctccactggcaactgggtatcgctacggccatagcaagagcccacattttagagaaaaatccccagtccgcgagcctgtggataatctgtctcctgaagagcgggatgctagaacagtgttctgcatgcagctggccgcccgtatccgcccaagagacttggaagatttcttctcggctgtcgggaaagtgagggacgttagaatcatttcagacaggaactcacgcaggagcaagggaattgcctacgtggagttctgtgagattcagtctgttcccctagcgattggacttactgggcaacgcctactgggagttcccatcatcgtccaagcgtctcaggccgagaagaacagactggcagctatggccaataatctgcagaaaggaaatggtggtcccatgcgcctgtacgtgggctctcttcactttaatatcaccgaagatatgctgagaggcatcttcgaacctttcggcaagattgacaatattgttctgatgaaagactcagataccgggaggagcaagggatacgggtttatcaccttcagcgacagtgagtgtgcgcgacgggctctggaacagctcaacggatttgagctagctgggaggccgatgagggtcggccatgtgactgaaaggctggatggaggcacggacattacctttcctgatggagatcaagaactggatctgggatctgccggaggaagatttcaactgatggccaagctcgcagagggagctggcattcagttgccttccacggcagcagctgccgcagccgcagctgctcaggctgccgctctgcaactgaatggagccgtcccactgggcgccctgaacccagcggcattaactgctctgtccccggctcttaacctggcctctcaatgcttccagcttagctctctgttcacaccacagacaatgtag

SEQ ID NO: 13050 - DNA, 1218 bp, Artificial Sequence
  Description of Artificial Sequence: Synthetic coding sequence
atggcttccgacgacttcgacattgttattgaggctatgctcgaagcaccttacaaaaaggaagaagacgaacaacagcggaaggaagtcaaaaaagattacccctctaacaccacctccagcacatcaaactcaggaaacgaaacgagtggatcatcaaccataggcgagacatcaaaccgctccagagaccgagaccgctatcgccggcgcaattccaggagcagaagtccgggccgacagtgtagacacaggtcaagatcatgggatcgccgccatggctcggaaagccggagtcgggaccataggcgggaggacagggtccattaccgatctccccctctggctactggcgagcctgtcgataacctgtctcccgaggagcgcgacgcccggactgtgttctgcatgcagctagcagctcgtatccgacctcgagacttagaggacttctttagcgctgtcggtaaagtgagagacgttaggattatctccgatagaaatagcagaagaagtaagggaattgcctatgtcgagttctgcgagattcagagcgtcccattagccatcgggctgaccgggcaacgtctgttgggtgtgcctattattgtccaggctagccaggctgaaaaaaaccggttagcagcaatggcaaataatctgcagaagggcaatggcggccccatgcggttgtatgtgggttctttacacttcaacatcacggaagatatgttgaggggaatctttgagccttttggtaagatcgacaatatagtgttgatgaaagacagtgatactggacgctccaaaggctacggctttatcacctttagcgacagcgagtgtgcacgacgggcgctggaacaactgaacggtttcgagctggccggacgaccaatgcgagtagggcatgtcactgaacgtctcgatggcggcaccgacatcactttccccgacggcgaccaggaacttgatctaggctcggccggcggaagattccagctgatggccaaattagctgagggcgcgggtatccagctccccagcacagcagccgccgccgcagctgctgccgcccaagcggccgcactgcagcttaatggagcagtgccgcttggcgccctcaacccagctgctctgaccgcactgagcccagcactcaacctagctagtcagtgcttccagctgtcctcgttgtttacgccacagaccatgtag

SEQ ID NO: 13051 - DNA, 1320 bp, Artificial Sequence
  Description of Artificial Sequence: Synthetic coding sequence
atggcttctgatgatttcgacatagtcatcgaggctatgctcgaggcgccttataagaaggaggaggatgaacagcaaagaaaggaggtgaaaaaggattatccatccaatactacctcaagtacttctaattccgggaacgagacctccggctctagcacgattggggagacttcaaagaaaaaaaggtcccggagtcataataagtcccgggaccgtaagcggtccagatcaagagaccgagaccggtaccgcaggcggaatagccgctccaggtctcccggacgtcaatgtcggcaccggagtagatcctgggataggcgtcacggttctgaatcacgctctagggaccatagaagggaggatagagtgcactatcggagccctccgctggccactggttatcgatatggacatagtaaatcacctcacttccgcgaaaagagccccgtcagggaaccggtggacaacctcagtcccgaggaacgcgatgcaagaacagtattttgcatgcagttggcagccagaatcaggcccagagacctggaggatttttttagtgccgtcggaaaggtgcgggacgtacgtataatctcagatcggaattctcgacgcagtaaaggaatagcatatgttgaattttgcgaaattcaatccgtgcccctagccatcggactcacagggcagcgtctactcggagtccctatcatagtgcaggcctcccaggcagagaaaaacagactggcagccatggcaaacaatctacagaagggtaacgggggccccatgcgtttatacgtcggttccttgcacttcaacatcaccgaggatatgctacgcgggatcttcgagcctttcggcaagatcgacaacatagtattgatgaaggattctgacacaggacgatcaaagggttacggtttcatcactttctcagatagtgaatgcgcccggagagcactcgagcagctcaatgggtttgagctggccgggcgaccaatgagggtgggacatgtgactgaacgccttgatggagggaccgacatcacctttccagatggcgaccaagagctcgatctgggcagcgctggcgggcgttttcagctgatggccaagttggcggaaggcgccggcatacagctgccaagcacggcagccgccgccgcagccgccgcggcacaggcggcagctcttcagttgaatggagcagtccctctcggggcactgaaccccgcggcccttacagctctctcacctgcactgaacctggcttcacagtgctttcagctcagcagtctgttcaccccacagactatgtag

SEQ ID NO: 13052 - DNA, 1272 bp, Artificial Sequence
  Description of Artificial Sequence: Synthetic coding sequence
atggcaagtgatgatttcgacattgtcatcgaagccatgttggaagctccttacaaaaaagaagaggatgagcagcagaggaaggaggtgaagaaggattacccctcaaacacgactagctcaaccagcaattcagggaacgagacaagtgggtcttcgaccattggcgagacttcaaaccgatccagggacagagaccggtatagacgacgaaactccaggagtcgcagccctggtcgccagtgcaggcacagaagtcgcagctgggatagacggcacgggagtgaaagcaggagccgcgaccaccggagggaagacagagttcactaccggagcccacctttggctaccggttacaggtacggtcactcaaaatctccgcacttcagggagaagtctcccgtgcgcgagcccgtggataacttgtctcctgaagagagggatgctcgaaccgttttctgcatgcagctcgctgcgagaatcagaccacgggacttggaggacttcttttctgcggtggggaaggttagggatgtgaggataatatccgaccgaaacagtcgccgctccaagggaattgcatatgtggagttttgtgaaatccagtcagttcccttggctattgggctgacgggacagcgcctgctgggagtgcccattatcgtgcaggcttcccaggccgaaaagaacaggcttgccgctatggccaacaacctacaaaaaggcaatgggggcccaatgagactgtatgtcggcagcttgcattttaatattaccgaagatatgctgcgcggcattttcgagccatttggaaagatcgacaacattgtcttgatgaaggactccgacacaggtagatcaaaggggtacggtttcataactttcagtgacagcgagtgcgcccgtcgcgccctggagcagctcaacggatttgagttggcgggccgccctatgcgggtcggccacgttacggaacgcctcgatgggggtaccgatatcacatttccagacggagatcaggagctagaccttggcagtgcggggggccgtttccagcttatggcaaaactggcagaaggagcaggtatacagctcccttcaacagctgctgcggcggcggctgcggccgcccaagccgcggccctgcagttaaatggcgctgtaccgctgggggccctgaatccagccgcactcactgctctgagtccagccctgaatctcgcctcccagtgtttccagctctcaagcctgttcaccccacagacaatgtag

SEQ ID NO: 13053 - DNA, 183 bp, Artificial Sequence
  Description of Artificial Sequence: Synthetic coding sequence
atggccagtgacgatttcgatattgttatcgaggcaatgttagaggctccatacaagaaagaggaagacgaacagcagcgcaaggaggtcaagaaggattatccttccaatacaacctccagtaccagtaacagcggcaacgagacaagcggcagctctactatcggggaaaccagcaaatag

SEQ ID NO: 13054 - DNA, 435 bp, Artificial Sequence
  Description of Artificial Sequence: Synthetic coding sequence
atggcctccgacgatttcgacatcgttatagaggctatgctcgaggctccttacaagaaggaggaggacgagcagcagcggaaggaggtaaagaaggactacccgtccaacacaacaagcagtacaagcaattccggtaacgaaaccagcggcagcagtaccattggggaaacttcaaaaaaaaagcgatcgcggagccataacaaatctagagaccggaaacggtcccgcagtcgggatagggaccgttacaggcgtaggaactcaaggagtagatcgccgggaaggcaatgtcgacaccgctcccggagctgggacaggcggcacggctcagagagcaggtccagagaccacagaagggaggaccgcgtccattataggtcgccaccacttgctaccggcgagccggtcgacaatctaagtcctgaagagtag

SEQ ID NO: 13055 - DNA, 228 bp, Artificial Sequence
  Description of Artificial Sequence: Synthetic coding sequence
atggcctctgacgattttgacatcgtgattgaggctatgttggaggcaccctataagaaagaagaggacgagcagcaaaggaaggaggtgaaaaaggattaccccagcaatactacatctagtacgtctaacagcggtaacgaaacaagtggctcttccacaatcggtgagaccagcaagaaaaagcgatctcgatctcataacaagagcagagaccggaagaggtag

SEQ ID NO: 13056 - DNA, 303 bp, Artificial Sequence
  Description of Artificial Sequence: Synthetic coding sequence
atggctagtgacgatttcgatatcgtgatagaagctatgctcgaagcaccctacaaaaaagaggaagatgaacaacagcgcaaggaagtcaagaaggattacccttccaatacaacctcatccacaagtaatagcggtaacgagacctctggatcctccacaataggggaaacaagcaaccgctcccgcgacagggataggtataggcgcaggaattctcgttcccgcagccccgggcggcagtgtcggcatcggtcccggtcctgggatagacgacatggaagcgagagcagatccagatag

SEQ ID NO: 13057 - DNA, 174 bp, Artificial Sequence
  Description of Artificial Sequence: Synthetic coding sequence
atggcctcagacgatttcgacatcgtgattgaggccatgttggaagccccctataaaaaggaggaggacgagcagcagcgtaaagaagtgaagaaggattacccttctaataccactagctctacgtctaatagtggaaacgagactagcggatcgtctacaattggcgaatag

SEQ ID NO: 13058 - DNA, 279 bp, Artificial Sequence
  Description of Artificial Sequence: Synthetic coding sequence
atggcaagtgacgattttgatattgtcatcgaggctatgttggaggccccttacaaaaaggaagaggacgaacaacagcggaaggaagtcaagaaggactaccccagcaacactacatcttcgaccagtaactctgggaatgaaacgtccggtagcagcactattggtgaaacatcgaaaaagaagaggtcccgttcccacaataagtctagagacaggaagaggtctcgaagtcgggatcgcgaccgataccgacgccgcaactctcgttccagatag

SEQ ID NO: 13059 - DNA, 201 bp, Artificial Sequence
  Description of Artificial Sequence: Synthetic coding sequence
atggcctctgatgacttcgatattgtgatcgaggccatgctcgaggctccttataagaaagaagaagatgagcagcagagaaaggaggtgaaaaaggactacccgtccaacacgacttccagcacctcaaacagcggcaacgaaacatccgggtcttctaccatcggcgaaacctctaaccgttctagggatagagattag

SEQ ID NO: 13060 - DNA, 306 bp, Artificial Sequence
  Description of Artificial Sequence: Synthetic coding sequence
atggcctctgacgatttcgacatcgtcattgaggcgatgttggaggccccatacaaaaaagaagaggatgaacaacagcgaaaagaagttaagaaagattaccccagcaacacaacaagctcgacaagcaattccggtaatgaaacgtcgggctcttcaaccatcggagagaccagtaatcgatctcgggaccgggataggtatcggaggcggaatagccgctcccggagtcccgggaggcagtgtcgccacaggtccagatcctgggaccggcgccacgggagcgagagtcggagtcgtgactag

SEQ ID NO: 13061 - DNA, 276 bp, Artificial Sequence
  Description of Artificial Sequence: Synthetic coding sequence
atggcatctgacgactttgatatcgtaattgaagcaatgcttgaggccccatacaagaaagaagaggatgaacagcagcgcaaagaggtgaagaaagactatccgtccaatactaccagctcaactagcaattcgggcaatgagaccagtggaagctctacaattggcgagacctctaatagaagtcgcgaccgggatcgctatagacgacgaaatagtagaagtaggagtcccggtcgccagtgtagacacagaagcagatcttgggacagatag

SEQ ID NO: 13062 - DNA, 636 bp, Artificial Sequence
  Description of Artificial Sequence: Synthetic coding sequence
atggccctggagggcatgagtaagagaaagcgcaaacggtccgtccaggagggcgagaatccggatgacggcgtgcgggggagcccacctgaggactatcgcctggggcaggtggcctcctcactgttccgcggggagcaccactcaagaggcggcacaggtaggctcgcttccttgttttctagcctcgagcctcagattcaacccgtgtacgttcccgtgcccaagcagaccatcaagaaaaccaagcgaaacgaggaggaagagtcgacttctcagatcgagcgaccacttagtcaggaacccgcgaaaaaagtgaaagcaaaaaagaagcatacgaatgccgagaaaaagctcgccgactcctccccgtttcgtcttatgctgaggccctgtctctcaatcagtagtaacacactttattgcatatatcggttcacgatttacttctgggagagtgccctcgctagcgctgacctcgaggaggagattcatcagaaacaaggccagaagcgtaagaacagccagcccggtgtcaaagttgctgacaggaagattctcgacgacactgaagacactgtagtttctcagaggaaaaaaattcagatcaaccaagaagaagagaggctgaagtag

SEQ ID NO: 13063 - DNA, 1293 bp, Artificial Sequence
  Description of Artificial Sequence: Synthetic coding sequence
atggctcttgaaggaatgtcgaaacgcaagcgtaagcgctcggtccaggagggagagaacccagatgacggcgtccgtggtagtccacccgaggattacaggctcggacaggtggcttctagcttgttccgcggtgaacaccattcccgtggtgggactgggcgtctggcctcgctgtttagctcattggaaccgcagatccagccagtgtacgtgccagtgcctaagcagactataaagaagactaagaggaacgaagaggaagaaagcactagccagatcgaacgacccttgtcacaggaacccgccaagaaagtcaaagccaagaaaaaacatactaatgcagagaagaagttggccgatagagaatctgcccttgccagcgcggacctggaagaggaaatccaccagaaacaggggcagaagcgtaagaactcacagcccggagtgaaggtggctgacagaaaaatccttgatgacacagaagacaccgtcgtgtctcagcgcaagaaaatccagatcaatcaggaagaagaacgcctcaagaacgaacgcactgtgttcgtgggaaatctaccagtaacctgcaacaaaaaaaaactcaagagcttttttaaggagtacgggcagatcgagtctgtccgctttcgatcactcatccctgccgagggcactcttagtaaaaagctggccgcaatcaagcgcaagattcaccccgatcagaagaacatcaatgcatatgtcgtgttcaaggaagagtctgcagctacccaagctctcaaacggaatggggcacagatcgccgacggcttccgcataagggtggacctggcctctgaaacctccagtcgtgacaagaggtccgtgttcgtcggaaatctcccctacaaggttgaagaatctgctatagagaaacattttcttgattgcggctctattatggcagtaaggatagtgagagataaaatgacaggaatagggaaggggttcggctatgtgctttttgaaaatacggatagcgttcatctcgctctcaaactaaataacagtgagctcatgggccgtaaattacgagtcatgaggtccgtgaacaaggagaaatttaagcaacagaactctaatccccgactgaagaatgtgtccaaacctaaacagggtctgaactttacttccaagactgctgaaggccaccctaagtcccttttcatcggcgaaaaagccgtactcctgaaaacaaagaagaaaggacagaagaaatcaggccgtcctaagaagcagcgaaagcagaaatag

SEQ ID NO: 13064 - DNA, 636 bp, Artificial Sequence
  Description of Artificial Sequence: Synthetic coding sequence
atggccctggaaggcatgagcaagcgtaaaagaaagagatctgtgcaagagggagaaaatcccgatgatggtgtacgaggctctccgccagaagactaccgactgggacaggtcgcttcaagcttgttcagaggggaacatcattcaaggggagggactggaagactagccagcctcttcagcagtctcgagccgcagattcaaccggtttacgtgcccgttccaaaacaaactataaaaaagacaaagcggaacgaagaggaagaatctacttcacaaatcgagcgtccgctaagccaggagcctgccaaaaaagtgaaggccaagaaaaagcataccaatgcggaaaaaaaattagcagacagctccccatttagattgatgctgcgcccatgccttagcatcagctcaaatactctctattgtatctaccgtttcaccatttacttttgggaatccgccctggcttctgcagatttagaagaggagatccatcagaagcagggccagaaacggaaaaactcacaaccaggagtgaaggtggctgaccgtaaaattttagacgatacagaggatacagtggtgagccagagaaagaagattcagataaaccaggaggaggagagacttaaatag

SEQ ID NO: 13065 - DNA, 1074 bp, Artificial Sequence
  Description of Artificial Sequence: Synthetic coding sequence
atggcatccgttttgaacgtgaaggaatctaaagcgcctgagcgaactgtcgttgtggctggcctccctgtcgacctgtttagtgaccagctactggcggtcttggtgaagagtcacttccaagacatcaaaaacgagggtggcgacgtggaggacgtgatctatccaacacgcactaagggcgttgcttatgtgatctttaaagagaaaaaggtggccgagaatgtgatccgtcagaagaagcattggttggccagaaagacacggcatgcggaattaacagtgtcactacgcgtctcacatttcggtgacaaaatcttttcatcggtcaacgccattctggatctgagtgtatttggcaaggaggttactttagaaaccctggtgaaagacttaaagaaaaagattccctctttgtctttttcccctctcaaacctaacgggcgaatttccgtggaaggatccttcctcgcagtgaagcggctccgggaatcgttactggcccgggcttgtagccttcttgaaaaggacaggaactttacaagcgaagaacgcaagtggaaccgccagaaccctcaaaggaatctacagagaagtaataatagcttggcctcagtgaggaccctggtcccagagaccgcccggtctggagaaatgctcgtgctggataccgacgtctttctctacctcaagcataagtgcggatcatatgagtcaacactgaaaaagttccacatcctcagtcaggagaaggtggatggcgagatcacgaccatctgcttgaagtccatccaagtgggatcgcagcccaacaatgccaagcatgtcaaagaactgatagaagagtggtcgcacgcattatacctaaaattacggaaggagacgtttatactagaaggcaaagagaatcgggagaaaaggatgatcaaacgcgcatgcgaacagctttccagtcgctacctggaagtgctcattaatttatatcggactcatatcgatataatcggaagctctagcgatacttatctgtttaagaagggggtgatgaaactgatcggtcaaaaagtgagttag

SEQ ID NO: 13066 - DNA, 1782 bp, Artificial Sequence
  Description of Artificial Sequence: Synthetic coding sequence
atgacggcagaagatagcacggctgccatgagcagcgatagcgccgcggggtcctctgctaaggtcccagaaggcgttgccggtgccccaaatgaggccgcactgctcgccctaatggaaagaacaggatacagtatggtccaagagaacgggcagcgaaaatatgggggcccacctccaggctgggagggacctcacccccagcgcgggtgcgaggttttcgtaggaaaaatcccgcgggatgtttacgaggacgaattggtgccggttttcgaggctgtgggaagaatttatgagcttcggcttatgatggacttcgacggcaagaatagaggctatgcctttgtaatgtactgtcacaaacacgaggccaaacgagctgttcgcgagttgaataattatgaaatccgccctggccgcctgttaggggtgtgctgtagcgtcgataactgccgcctgtttattggtggcattccaaagatgaagaaaagagaagaaattctagaggagatagctaaagtgacggaaggtgtgctggatgtgattgtttacgcttcagctgccgataagatgaagaaccgcggattcgccttcgtagaatacgagtcacatagggctgctgcaatggcgcggagaaaactgatgcctgggcgcatccagctttggggtcaccaaatcgctgtggactgggcagaaccggaaatagatgttgacgaggacgtgatggagacagtcaaaatcttgtatgtacggaacctgatgatcgagactactgaggacactatcaaaaagtctttcggccaattcaaccccgggtgcgtggaaagggtcaaaaagatacgagactatgcctttgtgcattttacatcaagggaggatgcagtgcatgcaatgaacaatcttaacggcaccgaattggaaggttcctgtttggaggtcaccctagccaagcctgtggacaaagaacagtacagtagatatcagaaggcagccagaggaggcggagcagcagaggcagcacaacagcccagctatgtctacagctgtgatccttataccctcgcctattacgggtatccatataacgcactgattgggcccaatcgagactatttcgtgaaagccggaagcattaggggacgcgggcgaggggctgctggaaaccgggctcccggccctaggggttcttatctcggggggtatagcgcaggtcgcggaatctatagtcggtaccacgaaggaaaaggcaagcaacaagaaaaagggtatgaattggtgcccaacttagagataccgactgtgaatcccgttgccatcaaaccgggaacagtggccatccctgccatcggcgcgcagtattccatgttccctgcagctccggctcctaagatgatcgaagatgggaagattcacactgtcgagcacatgatcagcccaatcgcagtacagcccgacccagcctctgcggccgcagccgccgccgcagcagccgctgcagctgcagcagtgattcccaccgtgagcacacccccaccgtttcaagggaggcctattacaccagtttatacagtggcccccaatgttcagcgcatccctacagctgggatatatggggctagttacgtgcctttcgcagccccagccaccgcaactattgcaaccctgcagaagaacgccgccgccgccgcagctatgtatggtggctatgcagggtatatcccacaggcattccccgccgctgcaatccaggtacctattccagatgtgtatcagacctactag

SEQ ID NO: 13067 - DNA, 1575 bp, Artificial Sequence
  Description of Artificial Sequence: Synthetic coding sequence
atgacagcagaggacagcaccgcagccatgagctccgacagtgcagccgggagtagcgccaaggtgccagagggcgtagccggcgctccgaatgaggctgccctcctggccctaatggagaggactggttacagcatggtgcaggagaacggccagcggaaatatggggggcctcctccggggtgggagggacctcatccccagcggggatgtgaggtctttgtaggcaaaattccccgagacgtatacgaagacgaactggtcccggtgtttgaagctgtgggcagaatctacgagttaaggctgatgatggactttgatggaaagaaccgcggatacgcttttgttatgtattgtcataagcacgaggcgaagcgggcagtgagagaattgaacaattacgagataaggcccggaaggttactgggcgtctgctgcagcgtcgataactgccgcttgttcataggcggtattccgaagatgaagaaacgggaagagattcttgaggagatcgccaaggtcactgagggggtcctcgatgtgatagtttacgcttcggcagcagataaaatgaagaacaggggtttcgcctttgttgaatatgagtctcatagagccgccgcgatggccagaagaaaactgatgcctgggcgcatccagctgtgggggcaccagattgctgtggattgggccgagcctgaaatcgacgtcgacgaggacgtgatggagaccgttaagatattgtacgtgagaaatttaatgattgagaccacagaagatactataaagaagagttttggacagttcaaccctgggtgcgtggagcgagtgaagaaaattcgagactacgctttcgtgcatttcacttcacgggaagatgctgtgcacgccatgaacaatttgaatggaaccgagctggagggctcctgcctagaagtgaccctggcaaagcccgttgacaaagagcagtactcccgttaccagaaagctgcgagagggggcggagcagctgaagccgctcagcagccttcctacgtttactcttgcgatccctacaccctcgcttattatggttatccgtacaatgccctgattggaccaaatcgagactacttcgttaaagtggccattccagccatcggagcccagtactctatgtttcccgccgcaccagctcctaagatgattgaggacggcaagatccacaccgtcgaacacatgatttctcctattgcggtccaaccggaccccgccagtgccgcagccgcggctgctgccgctgcagcagccgccgccgcagtgatcccgaccgtgtcgacaccacccccatttcagggcaggcccattactcctgtatatacggtggccccaaatgtacagcgaatccccacagctgggatatacggtgctagctatgtgcccttcgctgccccagcaaccgctaccatcgccaccctgcaaaaaaatgctgccgctgctgcggcaatgtatggcggttatgccggctatataccgcaggcttttcccgctgccgctatccaggtcccaatccccgatgtgtaccaaacttactag

SEQ ID NO: 13068 - DNA, 1782 bp, Artificial Sequence
  Description of Artificial Sequence: Synthetic coding sequence
atgacagccgaagatagtaccgccgccatgagcagcgatagtgccgccgggagcagcgccaaggtgcctgaaggagtcgccggggctcccaatgaagccgccctgttggctctgatggagcggaccggatattctatggtgcaagaaaacggtcagcgaaagtacgggggacctccaccaggttgggagggcccacacccccaacgcggttgcgaagtcttcgtgggaaaaattccacgggatgtgtatgaagatgaactcgtgcctgtgtttgaggcagtcgggaggatatacgagctgcgcctcatgatggattttgatggcaagaatcggggttatgccttcgtgatgtactgccacaaacatgaggcaaagagagccgtcagggaacttaacaattacgagatcagacctggtcggctcttgggcgtctgctgtagtgttgataactgtaggctctttatcggggggattcccaaaatgaaaaaacgagaagagattcttgaagagattgccaaggtaaccgagggtgtgctagacgtgatcgtctatgcctctgcagcagataaaatgaaaaataggggctttgccttcgttgagtatgaatcccatagagcagccgcaatggctagacgaaaactgatgcctgggcgtatccagttgtggggccatcagatcgccgtggattgggccgagcctgaaatcgacgtggatgaggacgtcatggagacagtgaaaattctgtatgtgagaaaccttatgattgaaacaactgaagacacgattaagaaatcttttggccagttcaaccctggttgtgttgagagagttaaaaagattcgtgactacgcatttgtccacttcacaagtcgcgaggacgcggtgcacgccatgaataatctgaacgggacagaactggagggatcatgtctagaggtgactctggccaagccagtcgacaaggagcaatattctagataccaaaaggcagccagaggcggaggagctgctgaagccgcgcagcaacctagttacgtttactcttgcgacccctacacattggcctattacggttacccatacaacgcactcattgggccaaacagagactacttcgtcaaagcgggctctatcagaggccggggcaggggagcagcaggcaaccgcgcccctggacctaggggaagctatctgggcggatacagcgccgggcgaggtatttatagtcgctaccatgaagggaagggaaagcagcaggaaaagggttacgagctggtgcccaacctggaaatccccacagtgaaccctgtcgctatcaaaccaggcacagttgctatcccagccatcggcgcacaatatagcatgtttccagcggcccctgcaccaaaaatgattgaagatggaaaaattcatactgtggaacacatgatctcaccaatcgctgtgcagccggaccctgcctccgccgccgcagccgccgccgccgccgcagctgcagccgccgccgtgattccaacagtcagcacaccccccccatttcagggacgaccgattaccccagtgtataccgttgccccaaatgtccagagaattccaacagcgggtatttatggggcaagctatgttccctttgcagctccagctacagccaccatcgctacattgcagaagaacgcagctgctgctgcggccatgtatggcggttacgctggttatattccacaggcttttcccgctgccgctatacaggtgccaattcctgacgtctaccagacctactag

SEQ ID NO: 13069 - DNA, 1575 bp, Artificial Sequence
  Description of Artificial Sequence: Synthetic coding sequence
atgacagctgaagatagcaccgccgctatgtccagcgatagcgcagccggttcttctgcaaaagtgcctgagggagtcgccggtgcccccaatgaagcggccctgctggcccttatggagcgcaccggctactctatggtacaggagaatggacaaaggaagtatgggggtcctccccccggttgggaggggccccacccccagcggggctgtgaagtgtttgtagggaaaattccacgtgatgtgtacgaggacgagctcgtacctgtgttcgaggccgttgggagaatatatgagttgcgacttatgatggacttcgatggtaaaaacaggggctacgcgtttgtcatgtactgtcacaaacacgaggccaagcgcgctgtgcgtgagctgaataactatgaaatacggcccggaagattgcttggcgtttgctgttcagtcgataattgccggctgtttattgggggcatcccgaagatgaaaaagcgggaggaaattctggaggaaatcgctaaagtaaccgaaggcgtgttagatgtgattgtatatgcatccgccgcagacaagatgaagaataggggcttcgccttcgtggagtatgagagtcatcgcgccgcggccatggccaggcggaaattgatgccaggtcggatacagctctggggacaccagatcgcagtcgactgggcagagcctgaaatcgatgtggatgaggatgtgatggagacagttaagattctgtacgtgagaaatttgatgatcgagacaacagaagacactataaagaaaagttttggacagtttaatccgggttgtgtagagcgcgtcaagaagattcgggactatgcattcgtccactttacatctagggaagatgcagtgcacgctatgaacaatctgaacggtacagaattagaggggtcctgtttggaagtgactttagctaagcccgtggacaaggagcagtactcccggtaccagaaagctgcgcgaggagggggagcggctgaggctgcacaacagcccagctacgtctactcttgcgacccttatactcttgcatactatggctatccatacaacgctctcataggtccgaatagggactactttgtgaaagttgcaatacccgctatcggggcacagtacagcatgttcccagctgcacccgcccccaagatgatcgaagacggaaaaatccacaccgtggagcacatgatcagccccattgccgtgcaacctgaccccgcctcagccgctgccgccgcagccgcagctgccgcggcggcagctgccgtgatcccgacagtaagtaccccacccccctttcagggccgtccaattacacctgtgtacacagtggctccaaatgtacagcgcattcctacggcaggcatttacggtgcctcctatgtgcctttcgcagctccggcgactgccacaattgcgaccctgcagaagaatgctgctgcggccgcggccatgtatggagggtacgccggttacatccctcaggcatttcccgcagccgctattcaggtgcccatccctgatgtgtaccagacctattag

SEQ ID NO: 13070 - DNA, 180 bp, Artificial Sequence
  Description of Artificial Sequence: Synthetic coding sequence
atgacagccgaggatagcaccgccgcgatgtcaagcgactccgcagccggctcatcagccaaagtgcccgagggggttgccggggccccaaacgaagccgctcttctcgcattgatggagaggaccggttacagtatggttcaggagaatgggcaacgcaagtacggaggtcccccatag

SEQ ID NO: 13071 - DNA, 480 bp, Artificial Sequence
  Description of Artificial Sequence: Synthetic coding sequence
atgaccgccgaggattccacagctgcaatgtcctcagactccgctgccggttcgtccgcgaaggtccctgaaggagtggcaggcgcgccgaatgaagccgcccttctggcccttatggaaagaacgggatattcgatggtccaggaaaacggtcagcggaagtatggcggaccaccacccggatgggagggaccgcatcctcagcgcggatgtgaggtgttcgtgggaaaaattccccgcgatgtttacgaagacgagctggttccggttttcgaggcagtgggtagaatctatgagttaaggctgatgatggattttgacggtaagaatcgtgggtacgccttcgtgatgtattgccataagcacgaggctaagcgcgccgtgcgggagcttaataactacgagattaggcctggtaggttgcttggtgtttgctgcagtgtcgacaactgtagacttttcattggaggaattccctag

SEQ ID NO: 13072 - DNA, 375 bp, Artificial Sequence
  Description of Artificial Sequence: Synthetic coding sequence
atgaccgccgaggattctacagccgccatgagttccgactcagcagctgggtccagtgccaaggtgcccgagggggtggctggtgctccgaatgaggctgccctgctggcactgatggaacggacaggttatagcatggtgcaggagaacggccaacgcaagtacgggggacccccccctggatgggaggggccacacccacaaaggggatgtgaggtttttgtgggaaagatccccagggacgtttatgaggacgaacttgttcctgtattcgaggccgtgggtcggatttatgagttgaggttaatgatggatttcgatggcaaaaaccgcgggtacgccttcgtaatgtactgtcacaaacatgaggcatag

SEQ ID NO: 13073 - DNA, 345 bp, Artificial Sequence
  Description of Artificial Sequence: Synthetic coding sequence
atgaccgcagaggattccacggcagccatgtcctcggatagcgccgccggttcaagcgccaaggttccagagggagtcgctggggcacctaatgaagccgccttgctggcactgatggaacgcacagggtactctatggttcaagagaacggccaacgaaagtacggtggtcctccacctggatgggagggcccacacccccagcgtgggtgtgaggtatttgtaggcaaaatccctagagacgtttacgaagacgagttggtgcccgtgtttgaagccgtgggacgtatttacgagctgcgtctgatgatggatttcgatggcaagaaccgaggatatgcatag

SEQ ID NO: 13074 - DNA, 180 bp, Artificial Sequence
  Description of Artificial Sequence: Synthetic coding sequence
atgacagccgaggattcaacggcggccatgtccagtgactctgccgcggggtctagtgccaaagttccggaaggagtggctggggcacctaatgaggcggcccttttagcgctgatggagaggaccggttactcaatggtccaggagaatggacagagaaaatacggtggtccaccgtag

SEQ ID NO: 13075 - DNA, 582 bp, Artificial Sequence
  Description of Artificial Sequence: Synthetic coding sequence
atgactgccgaagacagcacggccgccatgtcttcagactcagcggctggctcatccgcaaaagtgcccgagggtgtggcaggagcacctaatgaggccgctcttctggccttaatggaaaggactggatactctatggtgcaagaaaacggacagcgcaagtatggaggcccaccacctggatgggagggcccccatcctcagcggggctgtgaggtgttcgtcggcaaaatacctcgtgatgtttatgaagacgaacttgtcccagtgttcgaagcagttggacggatctatgagttgcgccttatgatggattttgacggtaagaacaggggatatgctttcgtcatgtattgccataagcatgaggctaagcgcgcagttagagagctcaacaactatgagattagaccggggcgacttttgggcgtgtgttgctcagtggataattgccgtctattcataggcgggatccccaagatgaagaagagagaagagatcctggaggagattgccaaggtgacagagggcgtgttggatgtgattgtgtacgcctcagccgctgataagatgaagaattag

SEQ ID NO: 13076 - DNA, 414 bp, Artificial Sequence
  Description of Artificial Sequence: Synthetic coding sequence
atgactgccgaagatagcactgcagctatgtcttctgactctgcagctggtagctccgccaaggtgcctgaaggagtggcgggcgcaccaaacgaggctgctcttcttgccttgatggaacgaacagggtactctatggtccaggagaacggacagcgtaagtacggtgggccccctcctggttgggaaggtccccacccccagaggggctgtgaggtgtttgttgggaagattccccgggatgtttacgaggatgaactcgtccccgtttttgaggctgtaggacggatatatgagctgagactcatgatggactttgacggcaaaaatcggggctatgcctttgtaatgtactgtcataaacatgaggcgaagcgggcagtgcgggaactgaacaattacgagatcaggtag

SEQ ID NO: 13077 - DNA, 654 bp, Artificial Sequence
  Description of Artificial Sequence: Synthetic coding sequence
atgacggctgaggacagcacagcggctatgtcatcagattcagccgccgggagcagcgccaaagtccctgagggggtcgcgggtgcccctaacgaagcagcccttttggcactgatggagagaactggatatagcatggtccaggagaatggacagcgaaagtacggcggaccaccaccgggttgggaaggcccgcaccctcaacgtgggtgcgaagttttcgtgggtaagattccaagagacgtttatgaagacgagttggtgcctgtcttcgaggctgtcggtagaatctacgaactccggcttatgatggattttgatgggaaaaatagaggctatgcctttgtaatgtattgccataagcacgaggccaagcgagcagtgagagaactcaacaattatgaaattcgccccggccggctgctgggcgtttgttgcagcgttgataattgccggctcttcatcggcggtataccaaagatgaagaaacgggaggaaatccttgaagaaatagcaaaagtcacggagggggtcctggacgtaattgtttacgcgagtgcggccgataagatgaaaaatcgaggtttcgcttttgtcgaatacgaatctcacagagccgcggcgatggccagaagaaaactgatgcctggatag

SEQ ID NO: 13078 - DNA, 1080 bp, Artificial Sequence
  Description of Artificial Sequence: Synthetic coding sequence
atggtcaaactgttcatcgggaacttgcccagggaagccacggagcaggaaatacggagcttgttcgagcagtatgggaaggtcttggagtgcgacattattaagaattacgggtttgtgcatatcgaagacaagacagcagccgaggatgccatccggaatctgcaccactataagctgcatggtgtcaatattaacgtcgaggcctctaaaaataaatctaaggcaagcacgaaattgcacgtgggaaacataagcccaacctgcactaatcaggagctgcgggccaagttcgaagagtatgggcccgtgatcgaatgtgacatcgtcaaagattacgccttcgtgcatatggagagggcagaagacgccgtggaagccatccgggggttggataatactgagttccagggtaagcgaatgcacgtgcagctttcaacctcccgactgaggactgcccctggcatgggcgatcaatccggctgctacagatgtggtaaggaagggcattggtcaaaagagtgcccagtggatcggaccggtagagtagcagatttcaccgagcagtacaacgaacaatatggagccgtccgtaccccttatacaatgggatatggcgaaagcatgtattacaatgacgcttacggtgccctcgactattacaagcgatatagagtgcgatcttatgaggccgtggccgctgcggcagctgcaagcgcttataattatgccgagcagactatgagtcatctgcctcaagtgcagtccacaactgtgacctcccacttgaactctactagcgtcgatccatatgatcgccaccttctgccaaacagcggcgcagccgcgacttccgcagcaatggctgcagcggctgcaactactagttcttattatggccgtgaccggtctcctctccgccgagccgcggcaatgcttcctacggtgggagagggatacgggtatggcccggagagtgagctgtctcaggcttctgccgcgacccgcaactctttgtacgacatggctcgctacgaacgtgaacagtacgtcgatcgagctcgatactcagcgttctag

SEQ ID NO: 13079 - DNA, 1080 bp, Artificial Sequence
  Description of Artificial Sequence: Synthetic coding sequence
atggtcaaactgtttataggcaacctaccacgggaagctaccgagcaagaaattcggagtctgtttgagcagtatggcaaggtcctggaatgcgatatcatcaaaaattacgggtttgtgcatatcgaggacaagaccgccgccgaggacgcgattaggaatctgcatcactacaaattacatggggttaacattaatgtggaagcttccaaaaacaagtctaaggcaagcacaaaactgcatgtggggaatatttctccgacctgtactaatcaggagctcagagcaaaattcgaggaatatggaccggttatcgagtgcgacattgtcaaagactatgcctttgtgcatatggagagagctgaagacgccgtagaagccattagaggactggacaacactgagtttcaaggcaaaagaatgcacgtgcaactgtcgacatctaggttgagaactgcccctggtatgggagatcaaagtgggtgctaccgctgcggcaaggagggtcactggagcaaagaatgcccagtcgacagaaccggacgagtggccgacttcactgagcaatacaatgaacaatatggggccgtcaggacaccatacacgatgggctatggagagagcatgtactataatgacgcctatggggccctggattactataagcggtacagggtccgctcctacgaggccgtcgcagcagctgccgctgcgagcgcctacaattacgccgagcaaactatgagccacctgccccaggtgcaatccaccaccgttacttcccatctcaactctacatccgtggacccatacgacaggcatctgctgcctaacagcggtgcagcagccacctctgccgctatggccgccgcggcagccactacatcttcttactatggacgggaccggagccctctccgccgtgcagctgccatgttgcccacagtgggagaggggtacggctacggccctgaatccgagttatctcaggcgagtgcggcgacgcgcaattctctgtacgacatggcgcgttacgaaagagagcaatatgtcgatcgggccaggtactccgccttctag

SEQ ID NO: 13080 - DNA, 2448 bp, Artificial Sequence
  Description of Artificial Sequence: Synthetic coding sequence
atggggtctgataaacgggtgagccgaactgaacgtagcggtcggtacggtagtatcatcgatcgggacgatagggacgaacgagagtctcgttctcgccgaagggattctgactacaaaagatcaagcgacgaccgtcgaggagatagatacgatgattaccgggactatgattctccggagagagaacgagaacggcgcaattcagaccgctccgaggacgggtaccattccgacggcgactacggcgagcacgattaccggcatgacattagtgatgaaagggaatcaaagacgattatgctacgcggtctgcccatcaccataacagagtcagacatacgagaaatgatggagagtttcgaaggaccacagcccgccgacgtgaggctgatgaaaaggaaaactggcgtgagcaggggctttgctttcgtggaattctatcacctgcaggatgccacatcctggatggaagctaatcaaaaaaagctggtaatacagggcaaacacatcgcaatgcactactccaatccccgacccaaattcgaggattggttatgtaataagtgctgcttaaacaattttagaaaacgactaaaatgcttccgatgtggagcagacaaattcgatagtgagcaggaggtgcctcccggaacaactgaaagcgtgcaaagcgtggattattattgtgacacaatcattcttcgcaacatagctccgcatacagtcgtcgattccataatgactgcactctcgccttacgcttcactcgctgtgaataatataagactgataaaggataagcagacacagcagaacaggggattcgcctttgtccagttgagcagcgctatggacgcatctcagttactccagattctgcagtctctccatcccccgctgaagattgacggtaagaccatcggagtcgacttcgccaagtccgctagaaaagatctggtgctgagtgatgggaacagagtttccgctttctctgtggctagcaccgccattgcagccgcccagtggtcttctacccagtcccaatccggcgagggaggaagtgtggattactcttacctgcagccaggccaagatggctatgcacagtatgcacagtattctcaagattatcagcagttctaccaacagcaggcaggcggccttgaatcagacgcctcaagcgcctcaggtacagccgtcaccacgacttctgctgctgtcgtgtcccagtctcctcaactgtacaaccagacttcaaatcctccaggatcccctacagaggaagcccaaccaagcacctccacatccacccaggcacccgcagcgtcccccacaggggtggttccaggaaccaagtatgcggtccccgacacctctacctaccagtacgacgagagttctggctattattatgatcccactaccgggctttattacgatcctaattcccaatattattataacagtcttacccagcagtatctgtattgggatggtgagaaggagacctatgttccagccgctgaatctagctctcaccaacagagcggattgccccccgctaaggagggtaaagagaaaaaggaaaagcctaagagcaaaactgcacagcagattgccaaagatatggaacggtgggcaaaatcactaaataaacagaaggaaaacttcaagaatagcttccaacccgtcaattctctccgggaagaagagcgccgagagtctgccgctgcagacgctgggttcgctttgttcgaaaagaagggcgctctcgccgagcggcagcaactaatcccggagctcgttcggaacggtgatgaagaaaaccccctgaaaaggggtctcgtcgccgcctattcgggagacagcgataatgaggaggagttggtcgaacgactggaatctgaagaggaaaaactggccgactggaagaagatggcttgcctgctgtgccgaagacagtttccaaacaaggacgccctggttagacatcaacaactttcagatctccataaacagaacatggatatatacagacggagccgcctctccgagcaggagcttgaggccctggagctgagagagcgcgagatgaagtacagagaccgggctgcagaacggagggagaaatatggtatacccgagccccccgagccaaagcggaagaagcagttcgatgccggcaccgtgaattacgagcagcctaccaaagacgggatcgaccattcaaacattggcaataagatgcttcaggccatgggatggagggagggctcaggattgggtaggaaatgtcagggcattaccgctccaatcgaggcccaggtacgattgaagggagcaggcctgggcgccaagggttctgcgtatggtttgtccggcgccgattcttacaaagacgctgtcagaaaagcaatgtttgcgaggtttacagaaatggagtag

SEQ ID NO: 13081 - DNA, 363 bp, Artificial Sequence
  Description of Artificial Sequence: Synthetic coding sequence
atgggttccgacaagagagtttccagaaccgagaggtcgggccgctatggatctattatcgatcgcgatgatagagacgagagagaatcccgctcccgccggagagacagcgattacaagcgaagctccgatgatagacggggggaccgttacgacgactaccgggactacgacagcccggagagagagagggagcgacgaaactctgatcgttcagaggacggatatcactccgacggagactacggggaacacgattatcgccacgatattagtgacgagcgggaatctaagaccatcatgttgcgcggactgcctattacaatcaccgaatccgacatacgggagatgatggaatcctag

SEQ ID NO: 13082 - DNA, 318 bp, Artificial Sequence
  Description of Artificial Sequence: Synthetic coding sequence
atgggctctgacaaacgagtcagcaggactgaaagatctggccgctatgggtccatcatcgatcgggatgatagagacgaacgcgagtctagatcgcgacggcgggattcagactacaaaaggagctcggacgacagaagaggtgaccggtatgatgattaccgcgattacgactcccctgaaagggagcgagagcgcaggaattccgatcgctcagaggatgggtatcattctgacggcgactacggggagcatgattatcgccatgacattagcgatgaaagagagagtaagacaatcatgctccgggggctctag

SEQ ID NO: 13083 - DNA, 414 bp, Artificial Sequence
  Description of Artificial Sequence: Synthetic coding sequence
atgggctctgataagcgggtcagcagaactgaaagaagtggtcgctatggctccataattgacagggacgatcgggatgaaagagagagtagatctcgcagacgggattccgactataaacggtccagtgatgacaggcgtggagacaggtacgatgactatcgcgactatgattctccagaacgtgaacgggagcgccggaattcggacaggagtgaagacggataccatagcgacggcgattatggtgagcacgactatcggcacgacataagcgacgaaagagagtccaaaaccataatgctacggggattgcccattactatcacagaatccgacattcgagagatgatggaatccttcgagggccctcagcctgcagatgtgcgattgatgaaacggaaaactggctag

SEQ ID NO: 13084 - DNA, 432 bp, Artificial Sequence
  Description of Artificial Sequence: Synthetic coding sequence
atgggatcagataagagagtctcacgcaccgagcgatctgggcggtatggaagtatcatcgatcgagacgatagagatgagcgggagtccaggagcaggaggcgcgactctgactataaacgatcaagcgatgaccgacggggcgatcggtacgatgactaccgcgactatgacagtcccgagagagaacgcgagaggaggaacagtgataggtcagaagatggataccacagcgacggggactatggggaacatgattacaggcatgatatatctgacgagagagaatccaagacaataatgcttcggggtctgcctattacaattacagagagcgacattcgtgaaatgatggagtctttcgaaggaccgcaacccgctgacgtacgattaatgaaacggaaaactggggagagtcttctgtcctcctag

SEQ ID NO: 13085 - DNA, 381 bp, Artificial Sequence
  Description of Artificial Sequence: Synthetic coding sequence
atgggttccgacaagagagtgagtagaaccgagagatctgggcggtatgggtctattattgatcgggatgaccgggatgaaagagaaagtagatcccgtaggagggatagtgactacaagcggtcatctgacgaccgccgcggcgaccgctacgatgattatcgggactatgattctccagaaaacgacaaatatagcagaaatgatggtgtacttagaaggcccagcgcctgcggatgcgaggccgacgaggaggaaaaccgctgcaagccatggttcaggctacgtggtgttctgtcgcttgcgagatgctatcagctggacgggagccagagcgagaaggtgggagactcccggaaggcccactgtaatgcattgtag

SEQ ID NO: 13086 - DNA, 450 bp, Artificial Sequence
  Description of Artificial Sequence: Synthetic coding sequence
ggcacaaaatgcagagtctctcgtaccgagcggtctgggcgatatggctctatcatcgatagggacgatagggacgaacgagaaagtcgatcacggagaagagatagcgattacaaaagaagctctgacgaccggcggggggacaggtacgacgattacagagactatgactcccctgaacgggaacgcgagagacggaattctgaccgaagtgaggacggctaccactccgatggcgactacggagagcacgactacagacatgatatctccgacgaaagggagtctaagaccatcatgctgcgcgggctgcctattacaattacagaaagcgatatccgggaaatgatggaatccttcgaggggccacagcccgccgacgtgcggctcatgaaacgcaagacagagaaggtgggagatagccgaaaagcccactgtaacgcgctgtag

SEQ ID NO: 13087 - DNA, 2445 bp, Artificial Sequence
  Description of Artificial Sequence: Synthetic coding sequence
ggcaccaagtgccgtgtatctaggaccgagcggtcgggtcgttatgggtcaataatagacagagacgatcgggatgagagggagagcagatcaaggcgtcgcgattccgattataaacggtcttccgacgatcgccggggggacaggtacgacgactaccgcgactatgactcgcctgaacgagaacgagagcgcagaaattccgatcgctccgaagacggctaccatagtgacggcgattacggtgaacatgattataggcacgacatctcagacgaaagagagagcaaaacaatcatgctccgaggactgccgatcacgatcactgaaagtgacattagagaaatgatggaatccttcgagggacctcaacctgccgatgtgaggctgatgaaaaggaaaacaggtgtcagcagagggttcgctttcgtggagttctatcatctccaggatgccaccagctggatggaggctaaccagaaaaaactggtgatccaaggcaaacatatcgcaatgcactactcaaatcctcggcccaaattcgaagactggctgtgtaataagtgctgcctaaacaatttccgaaaaaggctgaaatgttttcggtgtggagccgataagtttgactcagagcaagaagtaccgccaggaacgaccgagtccgttcagagcgtcgactattactgtgataccattatacttcggaatatcgccccacacacggtggtggactccatcatgaccgccttgtctccttacgcttccctcgctgtcaataatattcgactgatcaaagacaagcagactcagcagaaccggggctttgcctttgttcagttatcgtccgcgatggacgcttcacagctgcttcagattctgcagtcacttcatcctcccctgaagattgatggaaaaaccattggtgtagacttcgctaagtcagcaaggaaagaccttgtccttagcgacgggaatagggtctctgccttttccgtggcaagcactgccatagccgctgctcagtggtcttccacacagtcccagtcaggagagggaggaagtgttgactatagctacctccagcccggccaggacggctacgctcaatatgcgcagtatagccaggactatcaacagttttaccaacagcaggccggcgggctggaatcagacgcgagtagcgccagcggtaccgcagtcactaccacctccgccgcagttgtttcccagtcgccacagctttataaccagaccagcaacccccccgggtcaccgactgaagaggcccagccttccactagtacgagtacacaagcccccgccgcttctcccaccggcgtggtcccagggacgaagtatgctgttccagacacctctacctaccaatacgacgagtctagcggctattattacgatcccaccaccggactttattacgatcccaactcccaatattactacaatagcctcacacagcagtatctgtactgggacggggagaaagagacttacgttccagcggctgagtcaagcagtcaccaacagtcgggcttgccaccagcaaaggaaggtaaggagaaaaaggaaaaacctaaatctaagaccgcccaacagatcgccaaggacatggaacgctgggccaaatcgttgaacaaacaaaaagaaaacttcaagaattcctttcagccggtgaattcactccgggaggaagagcgccgggagtccgcggctgctgacgctggattcgcattgttcgaaaagaagggggccttggccgagcgccagcagctgatccccgagctagtcaggaacggagacgaagaaaaccccttgaagcgagggctggttgctgcctattccggggactccgacaatgaagaagagcttgtcgaaaggctggaaagcgaagaggagaaattggcggactggaaaaagatggcttgtctgctctgccgtcgccagttccccaataaggatgcacttgtgaggcaccaacaacttagtgatctccataaacagaacatggatatctatcgcagatcgagactgtcagagcaggagttggaagcgctggaactgagggagagggagatgaagtaccgggacagggccgcagagcggcgcgagaaatatggcattccagaaccacccgagcccaaaaggaagaaacagtttgatgcgggaaccgtcaattatgaacagcctacgaaggacggtattgaccatagcaacattggtaacaagatgctgcaggctatgggttggcgggaaggttcaggcctagggcgtaagtgccaaggaattacggcccccatcgaggcacaggtacgtctgaaaggggctggcctgggggcgaagggctcagcatacggtctgtcaggtgctgacagctataaggacgccgtgagaaaagctatgtttgcacgcttcactgagatggagtag

SEQ ID NO: 13088 - DNA, 1518 bp, Artificial Sequence
  Description of Artificial Sequence: Synthetic coding sequence
aatggctttcggagcggcgaacgcgacctggtcttgtccgacggtaatagagtctccgctttctctgtcgcttccactgcgatcgcggcagcccagtggtcttctacgcaatcccaatctggtgaaggaggctccgtcgactatagttatctgcagcccgggcaggacggatacgcacaatacgctcaatattctcaggactaccaacagttctaccagcagcaggcgggcggcttggaatctgatgcgagctccgcgtcaggcactgcggttactaccacctcagcagccgtcgtatcccagtctccgcagctatataatcaaacatctaacccgccagggagtcccacagaagaagcacaaccctcgacgagcactagcacccaagcaccagccgcctctcccacaggggttgtcccaggaacaaaatacgcagtgccagatacttccacttatcagtacgatgaaagttctgggtactactatgaccctaccacaggcctgtactacgatccaaactcccaatactactacaatagtcttacacagcagtatctgtattgggacggtgagaaggaaacatatgttcctgccgctgagtcttcttcacaccagcagtccggtctgccccctgctaaggaggggaaagaaaagaaagaaaaacctaaaagtaagaccgcccagcagattgccaaggacatggaaaggtgggcaaagtccctcaataaacagaaggaaaatttcaaaaatagcttccagcctgtcaactccttgcgggaagaggagcgtcgcgaatccgcagcagcagatgctgggtttgcattgttcgagaagaaaggcgccctggccgagaggcagcaactcatacctgaactagtgcgtaacggggacgaagagaacccattaaagagagggctggtggctgcctacagtggcgacagtgataatgaggaagaattagtggagcggttggaaagcgaggaagagaaactcgctgactggaaaaagatggcctgcctgttatgtcggagacaattccccaataaggatgccctagtccgccatcagcagttgagcgatctacacaagcagaatatggatatttataggcgatcgagacttagcgaacaggagcttgaagctctcgagttaagggaaagggagatgaaatatcgcgaccgcgctgctgaacggcgggagaagtatggcatccctgaacctcccgaacccaagcgcaagaaacagttcgacgccgggaccgtcaactacgaacagcccaccaaggacggcatcgatcacagcaacataggaaataaaatgctgcaggccatggggtggcgcgagggttccggactgggtcgaaaatgtcagggcattactgcaccaatcgaggctcaggttcgcctaaagggagcagggctgggagctaaaggctctgcttacggtctgtctggtgcagacagctacaaggatgctgtgcggaaagccatgtttgcccgattcacagagatggaatag

SEQ ID NO: 13089 - DNA, 3372 bp, Artificial Sequence
  Description of Artificial Sequence: Synthetic coding sequence
atgtggggtgactcaagaccggccaacagaaccgggccctttcggggatcccaggaggaaagatttgcccctggatggaaccgggactacccgcctcctcccctgaaatcgcacgctcaggagcgacactctggcaactttcccggaagggactccctacccttcgacttccaagggcattcgggcccaccttttgccaatgttgaggaacacagtttcagctatggcgcccgtgatgggccccacggtgattaccgggggggggagggtcctggacacgacttcagaggtggggatttttcatcttctgacttccaatcccgggactcaagtcagttggattttagaggccgcgacatccactctggggattttcgggatcgtgaaggcccacccatggactacagggggggagacggcaccagcatggactaccgggggcgcgaagcccctcacatgaattatagagaccgcgacgcccatgccgttgatttccgcggacgcgatgcccctccatctgactttcggggccgcgggacctatgacctggactttcgagggcgtgacggtagtcacgctgactttcgagggcgtgacctgtctgacctggattttcgcgcccgggaacaatcacgatcagactttagaaatagggacgtgagcgatcttgattttcgagataaggacggcacccaggttgatttccgcggtaggggaagcggcactaccgatctcgattttcgagacagggatacaccacattccgacttccgcggcagacatcgttccagaacagatcaggactttcggggtcgggaaatgggtagctgcatggagtttaaagatcgcgagatgccccctgtagaccccaacattctcgattacatccagccatctacacaggaccgggagcactctggtatgaatgtgaatcggagggaagaatccacccatgaccacacgatcgagaggccagcctttgggattcaaaagggcgaattcgagcactccgagacccgcgaaggggagacacaaggtgtcgcgtttgaacatgagagtccagcggacttccagaatagccaatctcccgtgcaggatcaggataagagtcaactgagcggtagggaagagcagtcatcagacgcaggattatttaaagaagagggcggcttagatttcttggggcggcaggacactgattaccgcagtatggagtacagggacgtcgatcataggttaccaggctcccaaatgtttggctatgggcaatccaagtcatttcccgaggggaaaaccgctagagatgcccagcgagaccttcaggatcaagactaccgcaccggcccatcagaggagaaaccttctcggttgatccgactaagcggagtccctgaagatgctaccaaggaagaaattctgaatgcgttcagaaccccagatggcatgccagtcaagaacctgcaacttaaagagtataacacaggctatgactatggatacgtctgtgtggagttctctctgttggaagatgcaatcggctgtatggaggctaatcagggcactttgatgatccaggataaggaggttacacttgagtatgtgtctagtctggacttttggtattgtaaacggtgtaaagccaacatcggggggcatagaagtagttgcagtttctgtaagaaccctcgcgaggtgacggaagccaagcaggagctcatcacctacccccaacctcagaagacctccatccctgcaccactggagaaacagccaaatcagccccttcggcccgctgacaaggagcctgaacccaggaagcgggaagaaggtcaggagagccgattggggcatcagaagcgagaggcggaacggtatctgcctccgtctcgaagggaaggccccaccttccgcagggacagagagcgcgagtcttggagcggcgagacccggcaggacggtgaaagcaagaccatcatgcttaaacggatttacagatcgacgccccctgaagtaattgtggaagttctggagccttatgtgagacttactacagcaaacgtacggatcatcaagaaccggacaggccctatgggccacacctacggtttcatcgacctggactctcatgcggaggctcttcgagttgtcaaaatacttcagaatctcgaccccccattctcaatcgacggcaagatggttgctgtcaacctcgccactggaaaacgaagaaatgactccggcgaccacagcgatcatatgcattactaccagggcaaaaagtacttcagagatagacggggcggcggcagaaacagtgactggtctagcgacaccaaccggcaaggacagcagtccagcagcgactgttacatttatgattctgccaccggctattattacgaccctctcgctggaacgtactacgacccgaatacccagcaggaagtatatgtgccccaggaccccgggctgcccgaggaggaggaaatcaaagagaaaaagcctacatcccagggcaagtcaagctcaaaaaaagaaatgtccaagagagacggcaaagaaaaaaaggacaggggagtcacacgattccaggagaacgctagcgagggcaaggctcctgctgaggacgtttttaaaaagccactcccaccaacagtgaaaaaagaagaatcaccccccccccctaaagtcgtcaatcctcttattggtctgctcggtgagtacggcggcgactctgactatgaagaggaggaggaagaagagcagactcctcctccacagcctaggaccgcgcagcctcaaaaaagggaagaacaaacaaaaaaggagaatgaagaggacaaattgaccgactggaacaaactagcctgtctgctgtgtcgaaggcagttccccaacaaggaggtgcttatcaagcaccaacagctctcggatctgcacaagcaaaatttagaaatccatcgcaaaatcaagcagtctgaacaagagctcgcttacctagagagacgcgaacgggagggaaagtttaaaggtcggggaaacgaccggagggaaaagctacagagcttcgactccccggagagaaagcgcattaagtactcccgcgagacagactccgacaggaagctggtcgataaagaagacatagatacaagcagcaaaggaggatgcgttcagcaggcgacaggctggcgtaagggaaccggactgggctatggacaccctggcctcgcgagctctgaggaagcagaagggcggatgcgtggcccctcagtgggggcaagtggccgcacgtctaaacgccaatctaatgagacatatagagatgctgtcaggcgggtaatgttcgcgcggtataaggagctggactag

SEQ ID NO: 13090 - DNA, 429 bp, Artificial Sequence
  Description of Artificial Sequence: Synthetic coding sequence
atgtggggggacagtagacccgctaataggactggcccatttagggggtcacaggaagagaggtttgcccctggctggaatagagattaccctccaccacctctgaaatcccacgcccaggaacgccactccgggaactttcccggtagggacagcttaccctttgacttccagggccactctggccctcccttcgcaaatgttgaggaacacagcttctcgtatggtgcccgcgacggtcctcacggtgactataggggcggggagggccccggtcatgactttaggggaggagacttctcatcgagcgatttccagtcccgtgattcctcccaattagacttccgtggaagagatatccactcgggcgatttccgagatagggagggtccacccatggattatcgaggtggtgacgggactagctag

SEQ ID NO: 13091 - DNA, 1806 bp, Artificial Sequence
  Description of Artificial Sequence: Synthetic coding sequence
atgattcaggataaagaagtaactctagagtatgtgagcagccttgatttctggtactgtaagcgatgcaaagccaatatcgggggtcacagaagctcttgctctttttgcaaaaaccccagggaggttacggaagcgaaacaggagctgattacctacccacagccacaaaagacgtcaatccccgctcctttagagaaacagcccaatcagcccctgcggccagccgacaaggaaccagaaccgagaaagcgggaggagggtcaggagagcaggctcgggcaccagaagcgagaggcagagcggtatttacctccatcaaggcgggaaggtccaacgtttcgtcgcgacagagaaagggaaagttggtccggtgagaccagacaggacggcgagagtaagactatcatgttgaagaggatttaccgatccactccaccggaagtcattgtggaagtgcttgagccgtacgtccggctgaccacagccaacgtgcgcattattaagaatcggacaggacctatgggacatacatatggatttatcgatttggatagccacgcagaagccctacgcgtggtcaagatactccagaacttggacccacctttttccattgacgggaagatggtggccgtcaacctggctaccggcaaaaggcggaacgacagcggagatcattccgaccatatgcactactatcaagggaagaagtactttcgagacagaaggggtggcggccgcaatagcgactggtcctctgataccaataggcagggtcagcaatctagctctgactgttatatttatgactccgcaaccggatactactacgaccctctcgctggcacctactacgatcctaatacccagcaagaagtgtacgtgcctcaggatcctggtctacccgaagaggaggagatcaaagaaaaaaagccgaccagccaggggaagtcttcatccaagaaagagatgtctaaaagagacggaaaagagaaaaaagatcgaggcgttacgcgatttcaggaaaatgcttcagaaggtaaggctcccgccgaggacgtgttcaaaaagcctctgcctccaaccgtaaaaaaggaagagtccccacccccacctaaggtggttaatccgctgattgggctccttggcgagtatggcggtgactccgactacgaggaggaagaagaagaggagcagacccccccgcctcagcctcgcactgcccagccgcaaaagagggaggaacagaccaagaaggaaaatgaagaagataagttgaccgactggaacaaactcgcctgcctgctttgtcgcagacaattccccaataaggaagtcttgataaaacatcagcaactgtctgatcttcataagcagaatcttgagatccaccggaagattaagcagtccgaacaggagcttgcatatttggaaaggcgagaacgcgaaggaaagttcaaaggtaggggtaatgaccggcgcgagaaactacagagctttgacagcccagagcggaaacgcattaaatattcgcgggagacagacagcgaccgaaagttggtcgacaaggaggacattgatacctcctcgaaaggaggctgcgtgcagcaggctactggctggagaaaagggaccggacttggctatggccaccccggcctggcctcgagcgaggaggccgagggccgcatgcgaggtccgagcgtcggcgcaagtggccggacatccaaacggcaatctaatgagacctaccgcgatgccgtccgcagagtgatgtttgcacgttacaaagagctcgattag

SEQ ID NO: 13092 - DNA, 1563 bp, Artificial Sequence
  Description of Artificial Sequence: Synthetic coding sequence
atgtggggggacagtagaccagccaatcgcaccggtccattccggggtagccaggaagaacgattcgctcccggctggaaccgagattacccaccgccccccctcaagagccacgcacaagagcgccactcaggaaacttccccggtcgggatagcctaccatttgattttcaggggcactccggccctccctttgcaaatgtcgaggaacacagtttcagctatggcgcccgggatggtccgcatggagattaccgcggcggcgagggcccggggcacgatttcagggggggggacttttcaagctctgactttcagtctagggacagtagtcagttggactttcgtggacgcgacatacatagcggggactttcgggatcgcgagggacctcctatggactatcgggggggcgatgggacttcaatggactatcggggccgcgaagcgccgcatatgaattatagggacagagatgcccacgcagtggactttcgagggagggacgcacccccctcagattttcggggtagggggacatatgacctggatttcagaggacgtgacgggtctcacgcagacttcagaggacgcgaccttagcgacctcgactttcgcgcgcgtgaacagtccagaagcgactttcgaaatcgggatgtgagcgatcttgattttcgcgacaaagacggtactcaggtggatttccggggccgcgggagtggtactaccgacctggatttcagagatcgcgacaccccgcattcagatttcagaggacgccacagaagccgcactgaccaggactttcgcgggcgagaaatgggcagttgcatggagttcaaagatagggagatgcctcccgtggacccaaacattctggattatatccagccgtccacccaggaccgtgagcacagcggtatgaacgttaaccggcgcgaggagtcaacccatgatcatacaatcgaacgccccgctttcggcattcagaaaggcgaattcgagcactctgaaactcgagaaggggagacccagggtgtcgcttttgaacacgaatctcccgccgacttccaaaacagtcagagtccagtccaggatcaggataaatcacagttgtccggtcgggaggaacagtcctccgatgcgggactgtttaaggaggaaggcgggttagattttctggggcggcaagacaccgactatcgctcaatggagtaccgcgatgttgaccatcggctccctgggtcacagatgtttggatatggccagtctaaatcttttcccgagggcaaaacggcaagagatgctcagagggacctccaagaccaggactacaggaccggtccctcagaagagaaaccctcaagactgattaggctgtcaggtgtgccagaagatgcaaccaaagaagagattctcaacgcgttcaggacaccagatggcatgcctgttaagaacctgcagcttaaggagtataacacgggaaactctaatgatccaggacagaggagttaccccggagtctgcattaagccgggcttcctcgtgctgcagacaatgtag

SEQ ID NO: 13093 - DNA, 231 bp, Artificial Sequence
  Description of Artificial Sequence: Synthetic coding sequence
atgtggggagactctcgtcccgcaaaccggacaggccctttccgcggctcacaggaagaacggttcgcccctggttggaacagggactatccccctcccccattaaagagccatgcccaagagcgtcactccggtaatttcccaggtagagatagtttgccatttgattttcaaggccattctggtcccccctttgctaacgtcgaggaacacagtttttcctacggatag

SEQ ID NO: 13094 - DNA, 1806 bp, Artificial Sequence
  Description of Artificial Sequence: Synthetic coding sequence
atgattcaggataaggaagtgaccctggagtatgtttccagtctcgatttctggtactgcaaacggtgcaaggccaatattgggggccacaggtcgagttgcagcttctgcaaaaatccccgcgaagtgactgaagcaaagcaggagctgataacttacccacagccacagaagacatccatccccgcgccattggaaaaacagcccaaccagccactccggccggccgataaagagcctgagccccggaaaagagaggaggggcaggagtcccggttaggtcatcagaagcgcgaggcagagcgctatctgcccccatcccgaagggaagggcctactttccgaagggacagagaaagagaatcttggtccggagagacacgtcaggacggggaatcaaaaacaattatgttaaagagaatctatcggtcaacaccacctgaagtgattgtagaagtgctcgaaccctacgtccggttaaccacagccaatgttagaatcatcaaaaatcgcacaggacctatggggcacacttacggatttatcgacctggatagtcatgccgaagccttacgcgtggtgaaaattctgcaaaatctcgatccgcctttctccatcgacggaaagatggtggctgtcaacctggccactggaaagcgcagaaatgactcaggggatcattccgatcatatgcactattatcagggtaaaaagtacttccgcgataggagagggggtggcaggaactccgattggtcatccgatactaaccgacaagggcagcagtcgagctcagactgttacatatatgactccgctactggttattattatgaccccctggctggaacgtactacgaccccaatacccaacaagaggtttatgttccacaggacccaggacttcccgaagaagaggaaatcaaagagaaaaagcctacgtcccagggtaagtcctcaagcaaaaaagagatgtcaaaacgggacggtaaagaaaagaaagaccgcggcgtcactcggttccaggagaacgcctccgaggggaaagccccagcagaagacgtgtttaaaaagcccctccccccaacagtcaagaaggaggagtcgccgcccccaccaaaggttgtgaatccactgataggtttactgggagaatacggcggcgacagtgattacgaggaggaggaagaggaagagcaaactcctcctccccagccccgcaccgcgcagccccagaaacgcgaagaacagacgaaaaaagaaaatgaggaggataaactgaccgactggaataagctcgcatgcctgctctgccgacgacagtttcctaacaaggaggtgttaattaagcatcaacaattatcagacctgcacaagcagaacctggagattcacaggaaaatcaagcagagtgagcaggagcttgcgtatctggagagacgggagagagaggggaaatttaagggccgtggaaacgaccgccgcgagaaacttcagtcattcgactcgccagaacgaaagaggatcaaatactcacgggaaacggactcagatcgaaaactcgttgacaaagaagacattgatacatcgtctaaggggggctgtgtgcagcaggccactggttggcgaaaagggaccggcctgggatacggtcatcctggacttgcttcctcagaagaggctgaaggccgcatgaggggacccagcgtgggggcctcaggccgcaccagcaagagacagagtaacgagacgtaccgagacgctgtacggcgggtgatgtttgcccggtacaaagaactggattag

SEQ ID NO: 13095 - DNA, 2976 bp, Artificial Sequence
  Description of Artificial Sequence: Synthetic coding sequence
atggactaccggggcggggatggcacttcaatggactaccgcgggcgagaggccccccacatgaattaccgggatagggacgcccacgcagtggattttcgcgggagggacgctccacctagcgacttcagaggccgagggacttacgacctcgattttaggggccgagatggctcacacgccgacttccgcggcagggacctgtccgacctggattttagagcacgcgagcaatcacggagcgacttcaggaacagagacgtcagcgacctggatttccgggacaaggacggaacccaggtggatttccgagggagagggtctggcacaaccgacctcgatttccgcgaccgagacacaccccatagcgatttcagaggaaggcatagaagtcggactgatcaagatttcagaggaagggagatgggctcttgcatggagtttaaagaccgcgaaatgccgccggtcgaccctaatatattggactacattcagcccagcacccaagatagagaacattccggcatgaacgtgaaccggagagaggagtcaacacatgatcacaccatcgagcgaccggcctttgggatccaaaaaggagaatttgagcacagtgaaactcgagagggggagacacagggcgtggcttttgagcacgaaagtcccgcggacttccagaactcccaatctcctgtgcaagaccaggataagtcacagttgtccggtcgggaagagcagtcctcagacgctggactttttaaggaggaagggggactggattttctcgggaggcaagataccgattatagatcgatggaatacagagacgttgaccaccggctccctggcagccagatgttcggctatggacaatctaagtcattccctgaaggcaaaacagcgcgggatgcccagagagacctgcaagatcaggattacaggaccggtccatccgaggaaaagcccagcagactcattagactctctggcgttcctgaggacgcaaccaaagaggagatcctgaacgcattccggacacctgatgggatgccggtgaagaatctccagctaaaggagtacaacactggatacgactatggatatgtttgtgtcgaattttctcttttggaagatgctattggatgcatggaagctaaccagggaacgctgatgatccaagataaagaggtaacactcgaatatgtctcctcactcgacttctggtactgtaagcggtgtaaggcaaacattggcggacacaggtcgagctgttctttttgtaagaaccccagggaggtgaccgaagccaagcaagagctcatcacttatccacagccccaaaaaacctctattccggcccctttagaaaaacagcccaaccagccactgcgcccagcagataaggaacctgagcctcgtaaacgcgaggaggggcaagagtcccgactgggacatcaaaaacgggaggctgaacgctacctgcccccctcccggagagagggccccacattccggcgggaccgggagagagagagctggtctggagagacccggcaggacggggagtcaaagactataatgctgaagcgcatctatcggtccacacctccagaggtgatcgtggaggtgctcgaaccatatgtgcgactcaccacagcaaacgtgcgcatcatcaagaatcggaccggacccatgggccacacgtacggctttatagacttggattctcacgcggaggctctccgcgtggtcaagattcttcagaatttagaccccccgttctccatcgacggcaagatggtggccgtgaatttagccacaggaaagcgtcgtaacgactcaggtgaccacagtgatcatatgcactactatcaaggcaagaagtattttcgcgaccggaggggaggaggtcgaaactccgactggtcctcggataccaaccgtcaaggccaacaatctagttccgactgttacatttatgatagcgcgactgggtactattacgatcctctggccggcacttactatgaccctaatacgcagcaggaggtgtatgtccctcaggatccggggcttcctgaggaggaagagattaaggagaagaagccgaccagccaggggaagtcaagctccaagaaggaaatgagtaaacgggatggcaaggaaaagaaggaccggggggtgactagattccaggaaaacgcgagcgaaggcaaggcaccagcagaggacgtcttcaagaaacctttgcctcctacagttaagaaagaagaaagtcctccaccccctaaagtcgtgaatcctctgataggactgttgggtgagtacggcggagactcagattatgaggaagaggaagaggaagagcagaccccaccaccacaaccacgcaccgcgcaacctcagaagcgtgaagaacaaaccaagaaggagaatgaggaggacaagctgactgactggaacaaactcgcgtgcctgctgtgtagacggcagtttccaaacaaagaggtacttatcaaacaccagcaactgtcagatttgcacaagcagaatctggaaattcacagaaagattaagcagtccgagcaagaactcgcttatctcgaacgccgggaaagggaaggcaagttcaaaggaagaggaaacgatcgccgggaaaagctccagagctttgactcacccgaacgaaaacgcatcaaatactctagggagactgatagtgaccggaaactggtggacaaggaagatatcgatacttcttcaaagggaggctgtgtccagcaggccaccgggtggagaaagggcacgggacttgggtacgggcaccctgggctggcttcttctgaagaggcggagggaagaatgcgcgggccatcggtgggagctagcggaagaactagcaagaggcagtccaacgagacctacagagacgctgtgcgacgcgttatgtttgcaaggtacaaagaacttgattag

SEQ ID NO: 13096 - DNA, 1398 bp, Artificial Sequence
  Description of Artificial Sequence: Synthetic coding sequence
atgttaaagagaatttatcgcagcacccctccggaggttatcgtggaggtgctggagccatatgtaaggcttactacagccaacgtgcggataatcaagaatcgcacgggtcccatgggccatacatacgggtttatagacttagactcacacgcggaggcactccgagtagtgaagattttgcaaaacctcgaccctcccttcagtatagacggaaagatggtggccgtgaacctggccacaggcaaacggcggaacgactcaggggatcactctgaccacatgcactattatcaggggaagaaatatttcagggatagacgcggggggggacggaacagcgattggtcctccgacactaataggcagggacagcagtcctcttccgactgctatatatacgactcggctactggctactactacgaccctttagctggcacttattacgacccgaacacccagcaggaagtctatgttccccaagaccctggtcttcctgaagaagaagagatcaaggagaaaaaacccacctctcagggcaagtcctcttctaagaaagagatgagcaagcgtgatggcaaggaaaaaaaagacaggggcgtaactaggtttcaggagaacgccagcgaagggaaagccccagcagaagatgtatttaaaaagccccttcccccgacggtcaagaaggaagagagtccaccaccgcctaaggtggttaaccccctgattgggctgttgggtgagtacgggggtgactcagactatgaggaggaggaggaagaggagcagaccccaccaccccaaccaagaaccgcacagccacagaagcgagaggaacagactaaaaaggagaacgaagaggataaactcacagactggaacaagctggcatgcttgctctgccggcgtcagttccccaacaaagaggtgctgatcaagcaccagcagctgagtgatctccacaagcagaacctggagatccaccgaaaaattaagcagtctgagcaggaacttgcatatctggaacggcgagaacgggagggtaagttcaaggggcgaggcaacgataggcgcgagaaactgcagtcctttgatagccccgagcgtaaacggatcaagtattccagagaaaccgattccgaccggaaactggttgacaaggaagacattgatacatcttccaaaggggggtgtgttcagcaggccacaggctggagaaagggcactggactgggctacggacacccagggctcgcctcctcagaagaggcggagggtcggatgcgcggcccttccgtgggcgcctccgggcggacgagcaagagacagtccaatgaaacgtaccgagacgccgttcggcgggtaatgtttgcccggtataaggaattagactag

SEQ ID NO: 13097 - DNA, 1173 bp, Artificial Sequence
  Description of Artificial Sequence: Synthetic coding sequence
atggtcgaagccgaccgcccagggaagctatttataggaggactcaacaccgagaccaatgagaaagccctcgagaccgtcttcggcaagtacggacggattgtggaagttctcctgattaaagatagagaaactaacaagtctcggggtttcgcgtttgtcaccttcgagtcacctgcagatgccaaagacgctgcccgggacatgaatggcaagtccctcgacggtaaggctattaaggttgagcaggcaacaaaacccagcttcgagagaggccgtcacggtccacctcctcctccgaggtccaggggacccccacgcgggttcggagcggggcgcggcggctccggcggaactcgggggcccccctctcgtggtggccatatggatgacggaggttatagtatgaattttaacatgagcagctcccgcggccccctccctgtgaagcgaggcccccccccccgctccggaggcccgtcccctaagagatccgctcccagcggcctggtccggtcatctagtggtatggggggccgcgcgcctttgtcccggggccgcgattcttatggaggccccccccgaagagagcctctgccaagcaggcgagacgtctacttgtcaccacgggatgatggatattcaaccaaggactcttactcaagcagagattacccctcaagtcgcgacacgcgcgactatgcccccccaccacgggactatacctacagagactacggccactcttcaagcagagatgactacccctcacgtggatatggagatcgagacggctacggaagggatcgcgattacagtgaccatcctagcggaggatcttacagggattcctatgagtcatatgggaactcccgatccgcaccccttacgcgcggcccaccaccgtcctacgggggttcctctcggtacgacgactatagttcaagtagggacggatatggtggttccagagattcgtatagttcgtccagaagtgatctttactcctcctgtgatagagtgggaagacaggaaagaggacttcccccttctgtagaaaggggatatccttctagccgcgatagctacagctcctctagtaggggcgcaccaaggggggcaggccctggagggtcacgctcagatcgtggaggcgggaggtcgaggtactag

SEQ ID NO: 13098 - DNA, 1173 bp, Artificial Sequence
  Description of Artificial Sequence: Synthetic coding sequence
atggtggaagccgaccgccctgggaaattgtttataggtggtttaaacactgaaaccaatgaaaaagccctcgaaactgtttttggtaaatacggacgaattgtggaagtgctgctgatcaaggatcgggagacaaataagagccgtggcttcgccttcgtgacctttgagagcccagctgacgccaaggacgccgcaagagatatgaatggaaaatctctcgatggcaaggcaattaaggtcgagcaggccactaagccttctttcgagcgcggacggcacggccctccccctccacctcggagcaggggtcctccacgcggatttggggcagggaggggcgggagcggggggacgaggggtcctcccagtcggggtggacatatggacgacggcgggtattcgatgaacttcaatatgtcctccagccggggacccctgccagtgaagaggggacctccacccaggagcggagggccctccccaaagagatccgctccatccggactggtgagatcaagctcaggtatgggcggtcgtgccccattatccagagggagagatagttatggaggaccgccccgcagggaacctctgcctagtcggagagacgtgtacctgagtccgcgggacgatggttatagtactaaagattcgtatagctcacgcgattaccctagttccagggacacccgggactatgctccaccgccgagggactacacttacagggactacggtcattccagttcccgggacgactaccccagcaggggctacggcgacagagacgggtacgggcgtgacagggactacagcgaccatccctcaggtggcagttatcgggattcatacgaatcttacgggaatagccgctcggcacccctaactcgaggccccccacccagttatgggggaagctcccgatatgatgactattcaagtagcagggacgggtacggtggctctagagactcttacagttctagtcggagcgacctctacagtagctgcgacagagtgggccgacaggaaagggggcttcccccaagcgtcgaaaggggttaccccagctcccgggattcgtactcatcttcctcaaggggcgcacctagaggcgcaggccctggaggaagcagaagcgatagaggcgggggaaggtcaagatactag

SEQ ID NO: 13099 - DNA, 1491 bp, Artificial Sequence
  Description of Artificial Sequence: Synthetic coding sequence
atggtggaggcagatcacccagggaagttgttcatcggcggacttaatcgggagaccaacgagaagatgctgaaggccgtctttggcaaacatggccctataagtgaggtgctgctgattaaggatcggacatcaaagtcaagaggcttcgccttcatcacttttgaaaatccagccgatgccaagaacgccgccaaagatatgaatggaacatcgctgcacggcaaggccataaaggtagagcaggccaagaagccgagcttccaaagtgggggacggaggcggccacccgccagcagtagaaaccgtagccctagcggtagcctgcggagcgctcgtggatccagcggggggacccggggatggctcccttctcacgagggacatctggatgacggaggatatactccagacttgaaaatgagttacagtcgcggactgatcccagtgaagagggggccctcatcccgctccggagggccaccgcctaagaaatcggcaccatctgccgtggccaggagtaattcctggatgggtagtcaagggccaatgagtcagagacgtgaaaactatggagtccctcctcgccgggcaacaatttctagttggaggaatgatcgaatgagcacccgtcacgatggttacgcaaccaatgacgggaatcatccttcctgtcaagaaaccagagactacgccccacctagcagaggatacgcctaccgtgacaatgggcacagcaacagggatgagcacagttcccgcggatatcgaaatcacagaagttctcgggaaacacgagattacgcccctccctcacgcggtcatgcataccgggactacggacactcaagaagggacgaatcatatagtcgtggctatcgcaatcatagaagctcacgggaaacccgcgagtatgcccccccaagtcgggggcacggttatcgtgactacgggcacagtcgccggcacgagtcctacagcaggggttaccgcaatcacccctcctcacgggagactcgcgactatgccccaccacatagagactacgcgtatagagactatggacatagcagctgggacgagcattcatcgcgcgggtatagctaccacgacgggtacggagaagccttaggcagagatcactcagagcatctgagtgggagctcatatagggacgcgctgcagcgttatggcacaagccacggtgctccaccggcaaggggtccacgaatgtcttacggtggctcgacctgtcacgcctattccaatacgcgggatagatacggtagatcatgggaatcctactcctcctgtggcgactttcactattgcgaccgtgagcatgtctgtagaaaggaccagagaaatccccctagcttgggaagagtgttgcctgatccacgcgaagcctacggctcatcctcatacgtagcttccatcgtagatgggggagagagcagatctgaaaagggtgattcatcccgatactag

SEQ ID NO: 13100 - DNA, 1380 bp, Artificial Sequence
  Description of Artificial Sequence: Synthetic coding sequence
atggtagaggctgaccatcccggaaaactgttcattggcggtcttaacagggaaaccaatgaaaagatgctcaaagcggttttcggaaaacatgggccaatcagcgaagtgctgctcattaaggatagaaccagcaagtcaagaggattcgctttcattacattcgagaaccctgctgacgccaagaatgctgcgaaagacatgaatgggacatcgctgcacgggaaggcgattaaagtggagcaggctaagaagccttccttccagtctggtggtagaagacggccacctgccagctctcgtaaccgctccccctcaggctccttgaggtctgcaaggggctccagcgggggtacccgaggttggctcccatcccacgagggccacctagacgacggggggtacaccccagacttaaagatgtcttactcaagaggcctcattcccgtgaagcgcggtcccagcagccgatctggagggcctcccccgaaaaaaagtgcccctagcgcggtggctaggtcaaacagctggatgggaagccagggacctatgtcgcagcggagagaaaattatggggttcctccccggagagctacgatctcaagttggcggaacgaccgtatgagtaccaggcatgacggatacgccacaaatgacggcaatcaccccagttgccaagagactagagactatgcaccgccatcgcgaggctacgcctacagagataatggacatagcaatagggacgagcatagttcccgtggttatagaaatcaccggagcagcagagagacaagggattatgcgcccccgagtagaggacacgcgtacagggactacggccactcccgccgggatgagagctactcccgcggatacagaaatcaccgttcaagtagagagactagagagtacgcgccgccctctaggggacatggttatcgggattacggacatagtaggcgccatgagtcatattcacgcgggtacagttaccatgacgggtacggcgaggccctgggccgcgaccattccgagcacttgagcggctctagctacagggacgccctccagcgctacgggacctctcacggtgccccccccgccagaggcccacggatgagctacggagggagcacttgccacgcctatagcaacaccagagacaggtatggcaggagttgggagtcttactcttcatgtggcgattttcactattgtgacagagagcatgtctgccgaaaagaccagcgcaatccgccttcgctggggagagtgctgccggatcccagagaagcatacgggagcagctcttatgtggcgtccatcgtagacggaggagagtcccggtctgagaagggggattcttcaagatattag

SEQ ID NO: 13101 - DNA, 1491 bp, Artificial Sequence
  Description of Artificial Sequence: Synthetic coding sequence
atggttgaagcagaccacccaggcaagctgtttatagggggcctgaacagggagacgaacgaaaagatgctcaaagccgtgttcggaaagcatggtccaattagtgaggtgcttctcatcaaagacagaacatccaaatcgagaggtttcgccttcattacctttgaaaatcccgctgacgccaagaacgctgccaaggacatgaacggcacatctctccacggaaaagccataaaagtcgagcaggctaaaaaacctagttttcagtccggcgggagacggcgtccacctgcctcgagtagaaaccggagtccttctggcagcctgcgcagcgcgaggggatcttccggaggcactcggggctggctcccttctcacgagggccacctagacgacgggggatacaccccagacctcaagatgtcctactctagaggcttgattcccgtcaaacgaggcccgtcttcccggtcaggcgggccccctccaaaaaagtcagcccccagcgccgtcgcacggagtaactcgtggatgggtagccaggggccgatgtcccaacgccgcgagaactacggcgtccctcctcggagagctaccatttccagctggcgaaatgatcggatgagcacccgccatgatggctatgctaccaacgacgggaatcaccccagctgccaggaaacccgtgattacgcgccaccatcccgaggctatgcctacagagacaacgggcacagcaaccgagatgagcattcctcacgggggtacagaaaccaccgatctagccgcgagacaagggattacgcaccgccaagtcggggtcatgcataccgagactacggtcacagccggagggacgagagttatagccgcgggtacaggaatcacaggtcctcacgtgagacccgcgagtatgctccgccttcgaggggacatggctaccgtgattacgggcattctcgccgccacgagtcctacagccggggttacagaaatcatccttctagcagagaaacacgcgactatgctccaccacacagagactatgcttaccgggactacgggcactcatcatgggacgaacacagtagccggggatacagttatcacgacggatacggtgaagccctgggccgggaccactctgaacatctgtccggaagcagttaccgcgatgccctacagagatatgggacaagtcacggcgccccccctgcccggggcccacgaatgtcctatggtggctctacctgtcatgcatattctaacacacgagaccgctacggacgctcttgggaatcctactcatcctgcggggactttcattattgcgatcgcgaacatgtgtgtcgcaaggaccagcgtaaccctccctcactggggagggtgcttccggacccccgggaggcctacggcagctcaagctacgtagcgagcattgtggacggaggagaatcccgaagcgagaaaggagattcgtccagatactag

SEQ ID NO: 13102 - DNA, 1491 bp, Artificial Sequence
  Description of Artificial Sequence: Synthetic coding sequence
atggtggaggccgaccaccctggaaagttgtttattggcgggctgaacagggaaactaatgagaagatgctaaaggctgtgtttggtaaacacgggcccatatcggaggtgttgctgatcaaggatcgcacctcgaagagcagaggatttgcattcattacatttgaaaacccagccgacgctaagaatgctgcaaaggacatgaacggaacaagtctccatggcaaagctattaaggtcgaacaggccaagaagccatccttccagagcggcggaagaagacggcccccagcctcctcacgaaatcgatcaccctctggctccctgcgaagcgcccgaggctcatctggggggacacgcggctggctaccaagccacgaaggacaccttgacgatggaggctatacccccgatctcaagatgagctatagcagaggattgattcctgtaaaacggggcccatcctctcgttcgggcggcccgccccctaagaagtcagcaccatccgctgtagcacgaagcaatagttggatgggttctcaggggcctatgtctcagaggagagagaactacggagtgccgccacggcgtgcgacaatcagttcttggcgtaatgaccggatgagcaccaggcacgacggttacgcaaccaatgacggcaatcacccatcctgccaggagacgcgggattacgctcctcctagccgcggatacgcatatcgagataatggccacagcaatcgggacgaacatagtagtcgcgggtacaggaatcaccggtctagccgggagaccagggactatgccccaccatcaaggggccacgcatatcgggactacgggcacagtcgaagagatgagtcatacagccggggatacagaaatcacaggtcttcccgcgagacacgcgaatatgccccccccagcagaggtcatggttacagagactatggccatagccgcagacatgagagctactctagaggatatcgaaaccatccgtcatcccgcgagacccgggattacgcccctcctcaccgggattatgcctacagagactatgggcactccagctgggatgagcatagctcccgaggttactcttatcacgatggatacggggaagcacttgggcgggaccactctgagcatctgagtgggagcagttacagagacgcacttcagcgctatggaacttcccacggggcgccgcctgccagaggtccgcgcatgtcttatggaggttctacctgccatgcctactccaatactcgcgacaggtacggtcgtagctgggagtcctatagctcttgcggagacttccactactgcgacagagagcacgtttgtaggaaagaccaacgaaaccctccgtccctgggacgggtcctgcctgacccccgcgaagcttacggatcctcttcgtatgtcgcctcgatcgtggacggaggggagagccgtagcgagaagggagatagctctcgctattag

SEQ ID NO: 13103 - DNA, 1380 bp, Artificial Sequence
  Description of Artificial Sequence: Synthetic coding sequence
atggtggaggcagatcacccgggaaaattattcattgggggtcttaaccgagagactaatgagaagatgttgaaggctgtgttcggcaaacatggacccatcagtgaagtgctgttaattaaagaccggactagcaagagcagggggttcgctttcattaccttcgagaaccccgcggatgctaagaatgccgccaaggatatgaacggcacatcgctacacggcaaggccattaaagtggaacaggcaaagaagccttcctttcagagtgggggtcgtaggcgcccaccggccagcagccggaacagaagcccatctgggtctctaagaagcgcacgaggctcatccggagggactcgggggtggctgccatcacacgagggccatctcgacgatggaggatatacccccgatctgaagatgagctacagtcgtggactgattcccgtgaaacgtggtccttcctctcgctctggcgggccccctcccaagaagtccgccccttcggcagtggctaggagcaattcctggatggggagccaaggtcccatgtctcagcgaagagagaattacggggttcccccacgaagggcgaccatttcgtcttggagaaacgatagaatgtcgaccagacacgatggatatgctaccaacgacggcaaccacccatcatgtcaggaaacccgcgactatgcccccccaagccgtggatatgcgtaccgtgataatggccattcgaaccgtgacgaacactctagtcgaggatatcggaaccacaggagctcacgtgagacaagggactatgcacccccctccagaggccatgcgtaccgagattatggccatagcagacgagatgagagctacagcaggggttacagaaaccataggtcctcccgggagacacgtgaatatgctccgccctcccgcggccacgggtatcgagactatggacactctcgccggcacgagtcatacagcaggggttatagctaccatgatgggtacggggaggctctggggcgggatcactcagagcacctaagcggctcctcatacagagatgctttacagcgctatggcaccagtcatggggcccccccagcgagaggcccacgcatgtcttacggtggatcaacgtgccacgcctacagcaatacaagggatcgatatgggagaagctgggaatcctattcctcctgcggggatttccattactgcgacagagagcacgtgtgccgcaaggatcaacggaacccaccctcactaggaagggtgctgcctgatccgagagaagcctatggttcttcctcttatgtggcaagcattgtggacggcggggagagccgctctgagaagggggattccagccggtactag

SEQ ID NO: 13104 - DNA, 1221 bp, Artificial Sequence
  Description of Artificial Sequence: Synthetic coding sequence
atggggaaagtgtggaagcaacagatgtaccctcaatacgccacatactattacccgcagtacctgcaggccaagcagtcacttgtaccggctcaccccatggcccctccatccccatccacaacttcctcaaacaacaattcttccagctcttcgaattctgggtgggatcagctgagcaagaccaacctctatattaggggattgccgcctcataccacagaccaggatttggtcaagctgtgccagccatacgggaagatagtaagtacaaaggcaatactagataaaactactaataagtgcaaaggctatggcttcgtggacttcgattccccagcagccgctcagaaagccgtgtcagccctgaaggcttctggcgtgcaagcacagatggccaaacagcaggaacaggatcctacaaacctctacatctcaaacctcccgttatcaatggacgagcaggaactggagaatatgttaaaaccattcgggcaagtcatctccacaaggattcttcgggatagttcagggacatcaagaggcgtcgggtttgccagaatggaaagcacagaaaaatgtgaggccgtgatcgggcacttcaacggcaaatttatcaaaacccctcctggagtgtccgcgcctaccgaacctttgttatgtaaattcgcagacgggggacagaaaaagcggcagaatcctaacaagtacattcccaatgggagaccatggcaccgcgagggagaagtgcggctggctggaatgacgctaacgtacgaccccaccacagccgccatccagaatggcttctacccctcaccctacagtatcgctacaaatcgcatgataacacagacatcgatcactccctatatcgcatctcctgtctccgcataccaagttcagtcacctagctggatgcaacctcagccctatattctgcaacacccaggagcagtgttgaccccctctatggaacacacaatgtcactccaaccggcttctatgatctctccgctggcccagcagatgtctcatctgagcctcgggtctacaggaacctacatgcctgcaacctcagctatgcagggtgcatacctaccacaatatgcccatatgcaaacaaccgccgttccagttgaggaggcctctggtcagcaacaggtggccgttgaaacatctaacgaccattcaccttataccttccagcccaacaagtag

SEQ ID NO: 13105 - DNA, 1260 bp, Artificial Sequence
  Description of Artificial Sequence: Synthetic coding sequence
atgggtaaggtctggaaacagcagatgtatccacagtatgctacttattattatccccagtacctgcaagctaaacagtccctggtccctgcacaccccatggctccccctagtcccagtaccacgtctagcaacaataactcctcctctagcagtaattctggctgggaccagctgtccaagactaacctctacatccgcggcctccctccccacaccacagaccaggacctagtgaagctctgccagccttacggcaaaatcgtatctacaaaagccattctcgataaaactactaacaagtgcaagggctacgggtttgttgattttgattcaccggcagctgcacagaaggctgtaagtgctcttaaagcctccggcgtacaggcacagatggcgaaacagcaggagcaagatccaaccaacctgtacatttccaaccttcctctaagcatggacgaacaggaactggagaacatgctgaagccatttggccaagtgatcagcaccaggatattgcgggactcgagcggcacatcccgaggcgtgggttttgccagaatggaaagtactgagaaatgtgaagccgtgatcgggcactttaacggcaaatttatcaaaacaccaccaggcgtttccgccccaacagagcctttgctctgcaaattcgcagacggcggccagaagaaaaggcagaatcctaataagtacatccctaacggacggccatggcatcgtgaaggtgaagccggaatgaccctaacatatgatcctaccacggcggccatccagaacgggttctacccgtctccctatagtatcgcaacaaatagaatgatcacccagaccagcatcacaccctacatagcctcacctgtgtccgcctaccaggtggccaaagaaacgagggaaaataagtaccgtgggtccgccatcaaggtgcaatccccctcttggatgcagcctcagccatacatcctgcagcaccctggcgccgtcctgaccccatctatggagcacaccatgtcactgcagcccgcttctatgatttcacccctggcccaacagatgagccatctgtctcttggttcaacgggaacctacatgccagccacctcggcgatgcagggagcatatctgcctcagtacgcccacatgcaaacaactgccgtgccagttgaggaagcatctggtcagcagcaagtggcagtggagacgtcgaacgaccatagtccctacaccttccagcctaataagtag

SEQ ID NO: 13106 - DNA, 1113 bp, Artificial Sequence
  Description of Artificial Sequence: Synthetic coding sequence
atggccccgcccagtccttccaccacctcctcaaataacaactcaagtagctccagtaactccggctgggaccaactcagtaagaccaatttgtatatccgcggtttgccgcctcacacaacggaccaagaccttgtgaagttgtgccagccatacggtaagatcgtctcaacaaaagcaatcctggacaagaccacaaataaatgcaagggatatggattcgttgatttcgattccccagccgcggctcagaaggctgtgagtgctctgaaagctagcggtgtacaggcccagatggccaaacagcaggaacaggatcctacaaatctgtatatttccaatctgccgctgtcaatggatgagcaggaacttgagaacatgctgaaaccgtttggccaagtgatctctactcggatcttgagagactcgtctgggacctctcgcggagtgggttttgccagaatggaatccactgaaaaatgcgaagccgtcattggccacttcaacggcaaatttatcaaaaccccacccggcgtcagtgcaccgacggaaccattgctctgtaagtttgctgatggcggacaaaaaaagcgtcagaaccctaacaaatacattccaaacggacgcccttggcacagggaaggcgaagccggtatgaccttgacttacgatcctaccacagctgcaattcagaatgggttttatcccagtccgtatagcatagccactaacaggatgataacccagactagcattaccccttatatcgcatcacctgtcagcgcctatcaagtgcagagccccagttggatgcagcctcagccctatattctccaacacccgggggcggtcctgacacctagcatggaacatacgatgtccctgcagcccgcatccatgatcagccccttggcccagcagatgagccatctttctttgggttccaccggcacatatatgcctgccactagtgcgatgcagggcgcctacttaccgcagtatgcccacatgcagaccaccgcagtccctgtggaagaggcgtcggggcaacagcaggtggccgttgaaacgagtaatgaccacagtccttacacatttcaacccaacaagtag

SEQ ID NO: 13107 - DNA, 1113 bp, Artificial Sequence
  Description of Artificial Sequence: Synthetic coding sequence
atggcccctccttctccaagcacaacatctagtaataacaattcctcgtcttccagcaattcggggtgggaccaactctctaaaaccaatctgtacattcgcggcctgcctccccacacaactgatcaggacctcgtaaagctctgccagccttacggcaagatcgtgtcaactaaagctattctcgataagacgactaacaagtgcaaggggtatgggtttgtggatttcgatagcccagccgccgcgcagaaggccgtgtctgcactcaaagccagcggagtacaggcacaaatggcaaagcagcaggaacaggacccaaccaacctttatatttccaacctaccattgagtatggatgaacaggagctcgaaaacatgctgaaaccttttgggcaggttatatccactcggattcttcgagacagctcaggaacaagccgcggcgttggattcgcccggatggagtccaccgaaaaatgtgaggctgttattggacatttcaatggtaagtttattaagacccccccaggcgtttcagcacccacagaacctctcctctgcaagtttgcagatggcgggcagaaaaaacgccagaatccgaacaagtacatccccaacggccgcccctggcaccgcgaaggagaagccgggatgacattaacatatgatccaactacagcagccattcagaacggattttacccttcaccatacagcatcgcgactaacagaatgatcactcagacctctatcacaccctacatcgcgagtcccgtcagtgcttatcaagtgcagagcccatcttggatgcaacctcagccttatatcctgcaacatcctggggccgttctgactccctctatggaacatacaatgagtctgcaaccggcttcgatgatttccccgttggcacagcagatgtcacacctatccctgggctccacgggcacgtatatgccagctacttcagccatgcagggggcttatctcccacagtacgcacacatgcaaaccaccgctgtgcccgtcgaggaggcaagcggccagcagcaagtcgcggtcgaaacctcgaatgatcactcaccatatacctttcagcctaataagtag

SEQ ID NO: 13108 - DNA, 1113 bp, Artificial Sequence
  Description of Artificial Sequence: Synthetic coding sequence
atggcaccaccctcgccgagcacaacctcttcgaacaacaatagctcctcttccagcaattctgggtgggaccagttgtctaaaactaacctgtacatccgaggccttcccccgcataccactgaccaagatcttgttaagttatgtcagccttatggcaagatcgtgtcaaccaaagctatcctggataaaaccacaaacaagtgcaagggctacggatttgtggattttgatagccccgccgcagcccagaaagcagtgagtgctctgaaggcttctggtgtccaagcccagatggcaaagcaacaggaacaagatccaacaaatctctatatcagcaatttgcctctctcaatggatgaacaggagctggagaatatgctgaaacctttcggacaggtcatttccactcggattctgcgcgattcatccggcaccagcaggggagtgggcttcgctcgcatggagtctaccgaaaagtgcgaggcagtaataggtcatttcaatgggaagtttattaaaactcctccgggagttagcgcccctacagaaccactcctctgcaagtttgccgacggaggccagaagaaaaggcagaaccctaacaaatacattcccaacggcagaccttggcacagagagggcgaagctggtatgacattgacctatgatcctaccactgcggcaatccaaaacgggttctatccctcaccttacagcattgccacgaataggatgatcactcagacttctatcacaccatacatcgcctctccggtttctgcataccaggtgcagtctcctagctggatgcagccccagccatatatccttcagcatccgggggccgtgctgactccatctatggaacatactatgagcttacagccggccagtatgatctcacctctggcacaacagatgagtcatctctccctcgggagtaccggcacatacatgcctgcgacatcagccatgcaaggtgcctacctgcctcagtacgcacacatgcagaccacagcagtgcccgtggaggaggcctccggccaacagcaagtcgccgtggagaccagcaacgatcatagtccttacacctttcaaccaaacaaatag

SEQ ID NO: 13109 - DNA, 387 bp, Artificial Sequence
  Description of Artificial Sequence: Synthetic coding sequence
atggcaccaccttctcctagtactacgtcatcaaacaacaattcctcttcctcttcaaactcaggctgggaccagttgtcaaaaacgaacctctacatacgtggtctaccccctcataccacagatcaggatctggtgaaactgtgtcaaccttacggcaagatcgtgagtaccaaggccattctcgataagacaacgaataaatgcaaggggtacggatttgtcgactttgattcccccgccgccgcccagaaggccgtgtccgctttgaaagccagtggcgttcaagcacagatggccaaacagcaggaacaagatcccaccaacttgtatatcagtaatctccctctaagcatggatgaacaggaactggagaacatgttatag

SEQ ID NO: 13110 - DNA, 1224 bp, Artificial Sequence
  Description of Artificial Sequence: Synthetic coding sequence
atgcttctgtccgtgacctccaggcctggtatcagcacattcggatataataggaacaataaaaaaccctacgtgtccctcgcccagcagatggctccaccctctcccagcaactcaacacctaattcgagttctgggtctaacggtaacgatcagctgtccaaaacgaatctttatattcgcgggctgcagccaggtaccaccgatcaggacctcgtgaaactgtgccagccctatggcaagatcgtgtcgacaaaagccattctcgacaagacaaccaacaaatgcaaggggtacggctttgtcgattttgattccccttccgccgcccagaaggctgtgacagcattgaaagccagtggggtccaggcacagatggcaaagcagcaagagcaagaccccactaacttatacatctcaaacttgcctctctccatggatgaacaggagctggaagggatgctgaaacctttcggacaggtgatcagcacgcgaatactccgcgatacttccggcacttctcgaggagttggttttgcacggatggaaagtactgaaaagtgtgaagcgataatcactcactttaatggaaaatatatcaagacccccccaggggtccccgctccctcggaccctttgttatgcaagttcgcagacggggggcccaaaaaacgacaaaatcagggaaagttcgtgcagaacggccgtgcttggcctcggaatgctgacatgggggtgatggctctgacttacgatccaaccaccgccctgcagaatggcttttatcctgccccgtataacataacccctaacaggatgctcgcccagagcgcactttctccctacctcagcagcccagtgagcagttatcagagggtcactcagacttcacctttacaggtacctaacccatcgtggatgcaccaccactcctatctgatgcagccttcaggcagcgtgctcactccaggaatggatcaccccattagtctccagccagcttcgatgatgggacccttgacccaacagttgggccatctgagcctttcatctactggcacatatatgccgacagctgccgcgatgcaaggtgcctacatttctcagtacacacccgtaccctcttcttccgtgtccgtcgaagaaagcagcggccagcagaatcaggtggccgtcgacgcaccgtccgaacacggggtatatagctttcaattcaacaagtag

SEQ ID NO: 13111 - DNA, 921 bp, Artificial Sequence
  Description of Artificial Sequence: Synthetic coding sequence
atgtcgttgaagctgcaagccagcaacgtgactaacaagaacgatcccaaatctattaatagtcgtgtgtttataggtaacctcaacactgctttagtcaaaaaatcagacgtggagacaatcttcagtaaatatggcagagtggctggctgttcagtacacaaggggtatgctttcgtgcaatatagcaacgaaagacacgccagagcagcagttttaggggagaacgggcgagtgctggccgggcagacgcttgacatcaatatggccggcgaaccaaagcctgaccggcccaaggggcttaagagggcggcatccgctatctacagcggatacattttcgactacgattattatagggacgatttttacgaccggctgttcgattaccgcggtcgcctgtcgccagtgcctgtgccacgcgccgtaccagtcaaaagaccccgtgtgactgtaccgcttgtgaggcgcgtaaagacaaacgttccggtaaagttatttgcacgctctacagctgtgaccacctcctccgctaaaatcaagctcaaaagcagcgaactgcaagcaatcaaaactgaactgactcagatcaagtctaatatcgacgctcttctatccagacttgaacagatcgccgctgagcagaaagccaaccccgacgggaagaagaagggagacgggggtggagcaggaggcggaggcgggggcggtgggtcggggggcggaggttccgggggaggcgggggtggggggtcgtcgcgcccacccgcaccccaagaaaacaccacatctgaggccggactgccacagggcgaagcccgaacccgggatgacggagacgaagaaggtctgctcactcactccgaggaagaacttgagcactcacaagatacggacgccgatgatggtgcgctacagtag

SEQ ID NO: 13112 - DNA, 873 bp, Artificial Sequence
  Description of Artificial Sequence: Synthetic coding sequence
atgagcttgaaactccaagcgtcaaacgtgaccaataagaatgaccccaaatctatcaattcacgcgttttcattgggaatctgaacacagctctggtcaagaaatctgatgtggaaaccatcttctctaaatatgggcgcgtggccggttgctctgtacacaagggctacgcttttgttcagtattcgaacgagcgtcacgcccgtgcggcagtactgggtgagaacggacgagttctagcaggtcaaacactggacatcaatatggcgggagagcctaagcccgatcggcctaaagggttgaagcgggcagctagtgcaatatatcgcctcttcgactaccgtgggcgcctgtccccagtgccagtgccgcgcgccgtgcccgttaagcgaccaagagtgacagtgcctctggttaggagagtcaagaccaatgtcccagtgaagttattcgcccgatcaaccgctgtaactacttctagcgccaaaattaagctcaagtcttctgagttgcaggccattaagacagaattgactcagattaaatcaaatatagacgcattactgtctaggttggagcagatcgcagctgagcagaaagccaatcccgatggcaaaaagaagggcgacgggggcggcgccgggggaggcggaggcggcggcggttctggcggagggggctccggcggcggcggcggcggcggctcctcacgcccccctgcaccccaggaaaataccacatcggaagcaggcctgccacagggagaggcaagaacgcgcgatgacggggatgaggaaggcctcctcacccacagcgaagaagagcttgaacactcccaagataccgatgccgatgacggggcactgcagtag

SEQ ID NO: 13113 - DNA, 270 bp, Artificial Sequence
  Description of Artificial Sequence: Synthetic coding sequence
atgtccctgaagttgcaagcatctaatgtgactaacaagaatgaccccaaaagcattaacagcagggtgttcattggcaacttgaataccgctttggtaaaaaagtctgacgtggagacaatctttagcaagtacggtagggtagcaggctgttctgtgcacaaggggtatgcctttgtccagtacagcaacgaacggcacgcccgggccgccgtgctcggagagaacggaagggtgttagccggacagaccctggatataaatatgtag

SEQ ID NO: 13114 - DNA, 714 bp, Artificial Sequence
  Description of Artificial Sequence: Synthetic coding sequence
atgtctttgaagttgcaagcctcaaacgttacgaataagaatgacccgaaatccatcaacagccgggtctttataggtaacctgaacaccgcactagtgaaaaaaagtgacgtggagaccattttttccaagtacggacgggtcgctggctgctccgtccataagggatacgccttcgtgcagtactctaacgaaagacacgcccgggccgccgttctgggggagaatggtcgtgtcctggccggacagaccttggatattaatatggctggggaaccaaagcctgataggccaaagggcctcaaaagagctgcctcagccatttatcgcctgtttgattacagagggagactgtcccctgtccctgttccaagagccgtgcctgttaagcgacctagagtcaccgtgcccttggtgagacgtgtaaaaactaacgttcctgtaaagttatttgccagatccaccgcagtgaccacttcatccgccaagatcaaattgaagtcctctgagctgcaggccattaagacagagttgacccagattaagagcaacatagatgcattactcagtcggctcgaacagattgccgccgaacaaaaggccaacccagatggcaaaaagaaaggcgacggtggcggcgctgggggtggcggcggcgggggcggatcagggggtggcggaagcggaggtgggggaggtggcgggtctagctag

SEQ ID NO: 13115 - DNA, 546 bp, Artificial Sequence
  Description of Artificial Sequence: Synthetic coding sequence
atgtccctgaaactacaggcctctaatgtaaccaataagaacgatccgaaatcaattaactctcgagtgtttattggaaatctgaatactgcacttgtgaaaaaatcggatgtcgagactatctttagcaaatacggaagagtcgccggttgctctgtgcataagggctatgcctttgtgcagtactcaaacgagaggcatgcgcgggccgctgtcctcggcgaaaatgggagagtgctggcaggtcaaactctggacataaacatggccggagaaccaaaacccgaccggcccaaagggctgaagcgcgctgcatctgctatatactcaggatacatctttgactacgactactacagagacgacttctacgatcggctgttcgactatcgcggaaggctgtctcccgtccctgttcctcgggcagtgcccgtgaaaaggccgcgtgtcacagtgcctctggtgcgccgggttaaaacgaacgttcctgtaaagctgttcgcacgctccacagctgtcactacctcctctgcaaaaattaagtag

SEQ ID NO: 13116 - DNA, 564 bp, Artificial Sequence
  Description of Artificial Sequence: Synthetic coding sequence
atgacctcattaacacctggctgcaggtactctgttagagtttctccgcaaatggcaaacaggatagtggactccgcccgctcaattctgaacaaattcatcccggatatttacatctataccgaccacatgaagggggttaattccggtaagagccccggctttgggttgagcttggtggccgagaccactagcgggacctttctgtctgctgagctggcctctaatccccagggacagggcgccgccgtgttgcccgaagacctgggtaggaactgtgccagactgctgctcgaggagatctatcgtggcgggtgtgtggacagtaccaatcaaagcctagccctcctgctcatgactctggggcagcaagacgtcagtaaggtcctcctgggccccctctctccatatacgatcgagttcctgcggcatctcaaatcgttcttccaaatcatgttcaagatcgaaacaaagccgtgcggtgaagagctcaagggcggcgataaagtcttaatgacatgtgtcggaattggcttcagtaacctctctaaaaccctgaagtag

SEQ ID NO: 13117 - DNA, 564 bp, Artificial Sequence
  Description of Artificial Sequence: Synthetic coding sequence
atgaccagccttactcccgggtgtcgctacagcgtgcgcgtttctccgcagatggccaaccgcatagtggacagtgcgagatcaattctaaataagtttattcccgatatctacatttataccgaccacatgaagggagtgaattcaggaaaatcacctggatttggattatcccttgtggctgagaccacatctggaacattcctgtctgcggaactggcaagcaacccacaaggtcaaggggcagccgttctccccgaggacctggggcgaaattgtgcccgactgctgttggaggagatctatagggggggctgtgtagatagtaccaatcaatctctcgcccttttactcatgaccctgggacagcaggatgtctcgaaagtgttactcggtcccctgagtccatatactattgaatttctgcgccacttgaagagcttcttccagataatgttcaagatagagacgaaaccatgtggagaagagctgaagggaggggataaggtcctaatgacgtgcgttggaattggtttttcaaatctgagtaaaaccctgaaatag

SEQ ID NO: 13118 - DNA, 528 bp, Artificial Sequence
  Description of Artificial Sequence: Synthetic coding sequence
atggccacccaggcccattccttgagttacgccgggtgcaacttcctcagacagcggttagtactgtccacactgtcaggtcgccccgtcaaaattaggaagatccgggctagggatgataaccccggacttagggacttcgaggcatctttcattcggctgctggataaaatcaccaatgggtctcgcatcgagattaatcagacgggcactacactgtactatcagcctggtctgctttatggtggctctgtggaacacgactgctctgtgcttagaggtataggttactatctcgagtccctgctgtgccttgcaccttttatgaagcacccattgaagatcgttcttagaggtgtgacaaacgaccaggttgatccttcagtatccatagaaaataagccttggtgtggcttctgtttcgtctcctgtcacaatccaacatgcgagaagaaagtgccttataaggcacaattctactacaagtgcatattactactgttattcaccttgagatttagggggtag

SEQ ID NO: 13119 - DNA, 1122 bp, Artificial Sequence
  Description of Artificial Sequence: Synthetic coding sequence
atggcaacccaagcccactctctctcctatgccggatgtaacttcctgcgccagagactggtactctctacacttagcggacggcctgtcaagatccgtaagatccgggctcgtgacgataatcctggcttaagggacttcgaggcgagctttatcaggttgctggataaaattaccaacgggtcccggattgaaatcaaccagacaggcactacactgtattatcagccgggactcctatatggtggtagcgtggagcatgattgctctgtactcaggggcatagggtactatctggaatcactgctgtgcctggccccattcatgaaacatccactgaaaattgtcttacgcggcgtgaccaacgaccaggttgaccccagtgtcgacgtgctgaaagcaaccgctctgcctcttctcaagcaatttggcatcgatggcgagtctttcgaactgaaaatcgtgagacgtgggatgccacccggaggtgggggagaagtggtattcagttgtccggtgcgtaaagtgttgaagcctatccaactcactgaccctggaaagattaaacggattcgcggcatggcttacagtgtaagggtgagcccccaaatggcaaaccggattgttgactctgctcggtcgattctcaacaagttcataccagacatatacatctacaccgatcacatgaagggtgtgaatagcggcaaaagcccaggcttcggattgagtctcgtggcagagacgacctccggtacctttctaagtgccgagctggctagtaatcctcagggacagggcgcggcggtgctccccgaggacctgggccggaactgtgcacgcctgcttcttgaggagatctatagaggagggtgtgttgacagcaccaaccagtccttggcgctcctcctgatgactctggggcagcaggatgtttctaaagtgctgctgggccccctttcaccctataccatcgagttccttaggcacctcaagtctttcttccagatcatgttcaaaattgaaacaaaaccatgtggcgaggagctcaaggggggcgacaaggttttaatgacctgcgtaggcatcggattttcgaatttatcgaagaccctgaagtag

SEQ ID NO: 13120 - DNA, 417 bp, Artificial Sequence
  Description of Artificial Sequence: Synthetic coding sequence
atgacatcgcttactccgggctgccgctattcagtacgggtcagcccccagatggctaaccgcatcgtcgattccgcccgcagtattctgaataaatttatcccggacatatatatttacaccgaccatatgaagggcgtaaatagcggaaaaagtccaggctttggcctgagcctcgtcgccgagacaacaagcggcacctttctttctgccgagcttgcctccaatcctcaggggcagggcgccgcagtactgccagaggacttagggcgtaattgcgcccggctacttctggaggaaatttataggggcggctgcgtggatagtacaaaccagagcctcgccctgctgcttatgaccctcggtcagcaggatgtctctaaagtcctcttgggtccgctaagtccctacacatag

SEQ ID NO: 13121 - DNA, 549 bp, Artificial Sequence
  Description of Artificial Sequence: Synthetic coding sequence
atgccccccgggggggggggtgaggttgttttcagctgcccagtgagaaaagttctgaaacccattcagctcactgatccaggaaagattaaaaggatccgcggaatggcctactcagtgcgggtctccccacagatggctaaccgcatcgtggactccgcacgatctatacttaacaaattcatcccagacatctacatctatacagatcatatgaagggggttaactcaggcaaaagcccaggctttggactgtcattagttgcagagacgacgtctggaacgttcttgtctgctgaactggcttcaaatccccaagggcagggggcggccgtactgccggaggacctgggacgaaattgcgcccgcctgctcttggaagaaatttacagggggggttgcgtcgacagtaccaaccaatctttggcactcctcctaatgaccttaggccagcaggatgtgtcaaaagtcctcttaggacccctgtcaccctataccatcgagttcctacgccatcttaaatcctttttccaaatcatgtttaagtag

SEQ ID NO: 13122 - DNA, 564 bp, Artificial Sequence
  Description of Artificial Sequence: Synthetic coding sequence
atgacttcattgaccccaggctgtcggtatagtgtccgcgttagccctcagatggccaatagaatcgtagactcggcaagatcaatcctgaataaatttatccccgacatatatatttacactgatcatatgaagggagtcaactctggcaaatctcctggcttcggcctcagtctggttgcagaaaccacatccgggacatttctgtccgctgaactcgcctccaacccacaagggcaaggggctgcggtgttgcccgaggacttaggcagaaactgtgctcgcctgctgttggaagagatatacagagggggctgcgtcgacagcacaaatcagagcttagcactgctgctgatgacacttgggcaacaggatgtgtctaaagtgctactggggcccctttctccctacactatcgaattcctccgacacttaaagtccttcttccaaataatgtttaaaatagagaccaagccctgcggcgaagaattaaaggggggtgacaaggttctaatgacctgcgtcggcatagggttctctaatctgtccaaaacccttaaatag

SEQ ID NO: 13123 - DNA, 1554 bp, Artificial Sequence
  Description of Artificial Sequence: Synthetic coding sequence
atggcagccccggagcagccattggctatttccagaggctgtacatcctcatcttccttgtctccccctagaggtgatagaacccttctcgtgcgtcatctgccagctgagctgactgctgaagagaaagaggatctgctgaagtactttggagcccagtccgtacgagtgctttccgacaaaggaaggctgaaacatacagccttcgccacctttcccaacgagaaggcagccatcaaggctctgactaggctgcaccaactgaaattgttggggcacaccctggtggtggaatttgcaaaagaacaggaccgagtccactctccgtgcccgacaagtggatcggaaaaaaaaaagcggtcagatgatcccgtcgaagacgataaagagaaaaaagagcttggctacctgacagtggagaatggcatcgcgccaaatcacggactcacattccctctgaattcctgtctaaagtacatgtatccaccacccagttccacaattctggctaatattgtcaacgccctggcgtctgtgcccaaattttacgtgcaggttctgcatctgatgaacaagatgaacttgcccacccccttcggaccgattacagcgcggccgccaatgtacgaagactatatgccactgcacgctccgctgccaccaacctcaccacagccacccgaggagccacctctgcctgatgaggacgaagaactgagctcagaagaatcggaatacgagagcaccgacgacgaggaccggcagagaatgaataagctgatggaactagccaatctgcaaccgaagcgccccaaaaccatcaagcagcgccacgtgagaaagaagcgcaaaatcaaagacatgctaaacacgcccctttgcccttcacactctagtctccacccagtgttgctgccaagcgacgtcttcgaccagcctcaacctgtggggaataaacgcattgagtttcatatatccacagatatgcctgcggccttcaagaaagacttagaaaaggagcagaactgcgaggagaagaaccacgatctaccggccactgaagtggacgctagcaatatcggatttgggaagatttttcccaagccgaacctcgatattaccgaagagattaaagaggactctgatgagatgccctccgagtgtatcagccgaagagagctcgagaaaggccggatcagcagagaggaaatggagacattaagcgtcttcaggagctacgagcccggtgaaccaaattgccggatctatgtaaagaacctggcgaagcatgttcaggaaaaggacctcaaatatatcttcggaaggtacgtggacttcagttcagaaacccagaggatcatgttcgacataagactaatgaaggaggggcgaatgaaaggtcaggcgtttattgggctccctaacgaaaaggctgccgcaaaagcactgaaagaggccaatggttatgtgctgttcggaaagcctatggttgtgcagttcgcacgctctgccagaccgaagcaggatccaaaagagggcaaaaggaagtgctag

SEQ ID NO: 13124 - DNA, 387 bp, Artificial Sequence
  Description of Artificial Sequence: Synthetic coding sequence
tgacgccgcgagctggagaaaggccgaatctcaagggaggaaatggaaaccttgtctgtattccgctcttacgagcctggggagcctaattgtcgtatctatgtgaaaaatctcgctaagcacgtccaggagaaggatctgaagtacatctttggccgatacgtggattttagctccgagacgcagagaatcatgttcgatatccgtcttatgaaagagggcagaatgaagggccaggcgttcataggtctaccaaatgaaaaagctgcggctaaagctctaaaagaggcaaacggctatgtacttttcggaaaaccaatggtggtccaattcgctagatcggccagaccaaaacaggaccccaaggaagggaagagaaagtgctag

SEQ ID NO: 13125 - DNA, 558 bp, Artificial Sequence
  Description of Artificial Sequence: Synthetic coding sequence
atggcggctccagagcagccactggcgatctcacgcggatgcaccagtagcagctctctgtctccacccagaggggatcggaccctcctcgtgaggcacctacccgctgagttgactgctgaggagaaggaggatttgctgaagtatttcggggctcaatccgtccgcgttcttagcgacaaggggcgactgaaacatactgcctttgccacattccctaacgagaaggccgccattaaggctctgacgaggctccatcaacttaaactgctgggccatactctcgtggtggaattcgcaaaggagcaggatagagtccactcgccttgtcccaccagcgggagtgagaaaaaaaagcgcagcgacgatcctgtggaagacgacaaggagaaaaaggagctcggctatttgacagttgagaatgggatcgcgcctaatcatgggctgacttttccattgaactcctgtctgaaatacatgtacccccctccatcttccactatcctagcgaacatagtaaatgccctggccagcgttccaaagttctacgttcaatag

SEQ ID NO: 13126 - DNA, 1554 bp, Artificial Sequence
  Description of Artificial Sequence: Synthetic coding sequence
atggcggctcccgaacaacccctggccatttctagggggtgtacttctagcagctcattgagcccacccagaggagatcgcactctactcgttcgccacctccccgccgagttgaccgcagaagagaaggaggacctgctaaaatacttcggtgcccagagcgttagagtgttgtcggacaaaggccggcttaaacataccgcgtttgctacatttccaaatgaaaaggctgcaattaaagctttgacccggctgcatcagcttaagttgctcggccatacactggtggtcgagttcgctaaagaacaggaccgagtacatagtccatgtccaaccagtgggtcagagaagaagaagagaagcgacgatcccgtcgaggacgacaaagagaagaaagaactcggatatctcacagtagagaacggaatagcgcctaaccatggcttgacctttccgctgaactcatgccttaagtacatgtatcccccaccttccagcaccatactggccaatattgtgaacgccttagcttcggtgccaaaattttatgtccaggtgctgcacctgatgaacaagatgaatttgcctacgccgttcggccccatcaccgcccgacccccaatgtatgaggattacatgcctctccatgccccgctgccgccaaccagcccccaaccgcctgaagagcctcctctgcccgatgaagacgaagaactgtctagtgaggagagcgagtatgaaagtaccgatgatgaagatagacagaggatgaataagttaatggagttggccaacttgcaaccgaagaggccaaaaaccattaagcagcggcacgtgaggaagaagcggaagatcaaagatatgcttaatacccccctttgtcctagtcactcttcacttcacccagtgctcctccccagcgacgtattcgaccagcctcagccagtgggaaataaaagaatagaatttcacatcagcactgatatgcctgctgcttttaaaaaagacctggaaaaggagcagaattgcgaagaaaagaatcatgaccttcccgctaccgaggtcgacgcatctaacatcggattcggaaagattttccctaagcctaatctggatattaccgaggagattaaggaagactcggatgaaatgccttccgagtgcatctcccggcgtgagctggagaagggccggatcagtcgcgaagagatggaaacactcagcgtgtttcgctcatatgagcctggagagcccaactgccgaatctatgtgaagaacctcgcgaaacatgtgcaagaaaaggatctcaagtatatcttcggaaggtatgtggatttttcctctgagacacagcgcatcatgttcgatattcgcctgatgaaggaaggaagaatgaagggccaagcctttatcggccttcctaacgaaaaggccgccgctaaagctcttaaggaagctaacggatacgtgctgtttggcaagcctatggtggtgcagtttgccaggtctgccagacccaaacaggaccctaaagaaggcaagaggaaatgctag

SEQ ID NO: 13127 - DNA, 2409 bp, Artificial Sequence
  Description of Artificial Sequence: Synthetic coding sequence
atgttcatatctggtaggcggacagcggataagtggcgtgcagaggagcgactacagtgtcctgctgggagcgccagggccgccctggcccggtgtgctgacggaggagccgttggacctttcaaatgcgtctttgttggagaaatggctgctcaagtgggcgctgttagggtggtccgcgccgtcgccgctcaagaagagcctgacaaggagggcaaggagaagccacatgcaggcgtgtcccccaggggggtgaaaagacaacgcaggtccagtagcggcggcagtcaggagaagaggggacggccgtcccaggagccacctctggcccccccccaccgacggagacggagtaggcagcatccggggcccttgccacccactaatgccgctcctaccgttcccgggcccgtcgaacccctgcttctccctcctccacctccaccaagcttggcaccagcgggaccagccgtcgccgcccctctccccgcacccagtacttctgctctgtttacctttagccccctcacagtgagcgccgccggccccaagcacaaagggcataaggaacggcataaacatcatcatcatcgtgggccagacggcgacccctcatcttgcggtaccgacctcaaacataaagataagcaggagaatggcgagagaacgggaggggtccctctgattaaagcaccgaaacgggagacccccgacgagaacggcaaaactcagagagctgatgatttcgtacttaagaagattaagaaaaaaaaaaaaaagaaacaccgggaggatatgcgcggtcggcgcttaaaaatgtataacaaggaagtgcagactgtatgcgccgggctgacgcgcatcagtaaggagattctcacccaagggcagattaacagcacctctgggctgaacaaagaatctttcaggtatctgaaagacgaacaactttgccggctgaatttaggaatgcaggaataccgtgtgccccagggcgtccaaaccccttttatgactcatcaggaacacagcattcgacgcaactttctgaaaaccggaacaaagttttcaaacttcattcacgaagagcatcagagcaacgggggagcactggtcctgcacgcctacatggatgagctcagctttctttcacctatggagatggagagattcagcgaagagtttctggccctgactttctcagaaaatgagaaaaacgcagcatattacgctctcgccatcgtccacggcgccgctgcgtatttacccgactttctggactatttcgccttcaattttccaaatacaccggtgaagatggagattctcggcaaaaaagatattgagaccaccactatcagtaacttccacacccaggtgaaccgcacatattgttgtggcacatatagggcgggtccaatgcgccaaatcagcctggtcggcgccgtcgatgaagaagtgggtgactattttcctgagttcttggatatgttggaggaatctcccttcttgaaaatgactctgccatgggggactctatcttcgctgcggctgcagtgtagatctcagtcagacgacggcccgattatgtgggtgcgccctggcgagcagatgatccccactgcagatatgcctaaaagcccattcaaacgaaggagatcgatgaatgaaatcaaaaacctgcagtatttacctcgcacctccgagcctcgcgaggtgttgttcgaagacagaactagagcgcatgccgatcatgtcggccagggatttgactggcagagcacagctgctgtgggggtgttgaaagccgtgcagtttggggagtggagcgaccagcccagaataaccaaggatgtgatctgttttcatgccgaggactttaccgacgtagtgcagagactccagctggaccttcatgagccacccgtatctcaatgcgttcagtgggtggacgaagctaagctgaatcagatgagacgggaagggatcaggtatgcacgcattcagctctgcgataacgatatttacttcatcccaagaaatgtaatccatcagttcaaaaccgtctccgccgtctgcagcctggcatggcatattaggctgaagcagtaccatcccgtggtggaggctacccagaacacggagtcaaacagcaacatggactgcgggctgacgggtaaaagggaactggaagtcgattcacagtgtgtcaggataaagaccgaatctgaggaagcttgcacggaaatacagttgctgaccaccgccagcagcagtttccctcctgcctcagagctgaatctgcagcaggaccagaagacacagcctattccagtgctgaaagttgagagtaggttggatagcgaccagcagcacaatctgcaggagcactcaacaacatccgtgtag

SEQ ID NO: 13128 - DNA, 2541 bp, Artificial Sequence
  Description of Artificial Sequence: Synthetic coding sequence
atggctgagccccctagccccgtccattgcgtggcggccgccgcccctactgcgaccgtcagtgagaaggaaccattcgggaaactacagctcagtagccgagatccacctgggtctctgtcagctaaaaaagtgaggaccgaggaaaagaaggccccaagacgagtgaacggggagggaggctctggcggaaactctcgtcaactgcagccccctgctgctccatctccccagtcttatgggagtcccgcgtcctggtccttcgccccattgtccgcggccccttcaccctcttcatctaggagcagtttttccttttctgcaggaaccgccgtaccctcatcggcctctgccagtctcagccagcctgtgccacggaagctgctggtgcctccaaccctactgcatgcccagccccaccacctcctacttcctgccgccgctgccgcggcatcggcgaacgcaaaaagcagaagaccaaaggaaaaacgagagaaagagcgtcggagacacggattgggaggtgcccgggaggctggaggcgcttcccgagaggaaaacggcgaggttaagccactgccccgggacaagattaaagataagattaaagagagggataaggagaaggaacgagagaagaagaagcacaaggtgatgaacgagatcaaaaaagaaaacggggaagtgaaaatcctgctgaagagcggcaaggagaagcccaaaaccaacattgaggatcttcagatcaagaaggtcaagaagaagaagaagaagaaacacaaagagaatgagaaacggaagcgacctaagatgtacagtaagtctatccaaacgatctgctctggtttgctcacagacgtggaagaccaggctgctaaaggaatcctgaacgataatattaaagactacgtgggcaagaatttggataccaaaaactatgactcgaaaatccccgagaacagcgagttcccgttcgttagcttgaaggagccccgggttcagaacaatcttaagcgtctggatacactcgagtttaaacagcttatccatattgagcatcagcccaacgggggagcaagcgttattcacgcttactcaaacgagctcagtcacctctctcccatggagatggaaaggttcgcggaggagttcgtgggtctggttttctcagagaacgaaaattccgcagccttctatgttatggggatcgtccacggtgctgctacctatcttcctgattttctggattacttctctttcaactttcccaacagccccgtcaaaatggaaattcttggtaagaaagatatcgaaacgactactatgtctaattttcatgcacaggtgaagcgtacgtactcgcacgggacctacagagccggcccaatgcggcagatcagcttggttggtgcagtagatgaggaagtcggagactactttccagagttcctggacatgcttgaagagtcaccattcctcaaatgtactctaccctggggtacactgagctctcttaaactccagtctcgaaaggattctgatgatgggccgataatgtgggttcgtcctggagaacagatgatacccgtggcagacatgccaaaatctccattcaagcggaagaggacgaccaatgagataaaaaacctccaatacctacctaggacatcagagccacgcgagatgctctttgaggatcgcactcgggctcacgctgatcacattggccaaggatttgaacgccaaacaacggccgctgtgggcgtactcaaggcagtacattgtggggaatggcctgatcagccacggattaccaaagatgtgatatgttttcacgctgaggattttttagaagtggtgcagcggatgcagctcgatttacacgagcctccactgtctcagtgcgtgcaatgggtcgacgacgctaaattaaaccagttgagacgggagggtattagatacgcccggatacagctgtatgacaacgacatatatttcatacctcggaatgtcgtccatcagttcaaaaccgtctccgcagtttgctcccttgcatggcatatccggcttaaactgtatcatagtgaggaagatactagccagaataccgctacgcatgagaccggtacaagctccgattctacatcatccgtgttagggccccatactgacaatatgatctgtgcagtctccaaggctagcctggatagcgtcttctcagataagttacatagtaaatacgagctccagcaaatcaagcatgagccgatcgctagtgtcagaatcaaggaggagcccgttaatgtcaatattcccgaaaagaccacagctctgaacaatatggacggcaaaaatgtcaaggccaaactcgaccacgttcagtttgccgagttcaagatagacatggatagcaaatttgaaaacagcaataaggacctcaaagaagaactctgtcccggaaacctgagcctggtcgacacgagacagcattcaagcgcacacagtaatcaggataagaaagacgatgatattctatgttag

SEQ ID NO: 13129 - DNA, 1731 bp, Artificial Sequence
  Description of Artificial Sequence: Synthetic coding sequence
atgtactccaagtctatacaaactatctgttccggcttgctcactgatgtcgaggatcaggcagcaaagggtatattaaacgacaatattaaggattatgtcggtaaaaaccttgatactaaaaactatgatagtaagataccagagaactccgagttcccattcgtgtctttgaaagaacctcgggtgcagaacaatctaaagaggttggatacattggagttcaagcagctgattcatatcgaacaccagccaaacggaggggcgagcgttattcacgcctattcaaatgaactatcccatctctccccgatggaaatggaaaggtttgctgaagagtttgtcggcctggtattcagcgaaaatgaaaactcagccgcattttacgtcatgggaatcgtacatggagccgcaacctatcttcccgattttctggactacttttcattcaacttccctaattctccggttaagatggaaatcctgggaaagaaggatatcgagaccacgacaatgtccaacttccatgcacaggtcaagcgaacctattctcacgggacttaccgggccgggcctatgagacaaatttcactcgttggcgcggtcgacgaagaggtcggcgattattttccggagttcttagatatgctggaggaaagtcctttcctcaaatgcactttgccctggggtacattaagcagcctgaaacttcagtcccggaaggactctgatgatggaccgattatgtgggtccgtcccggagagcagatgatcccagtggctgacatgccaaaatctccctttaagaggaagcgaacaaccaacgaaataaagaacctgcagtaccttccacgcacgagtgaaccccgcgaaatgctttttgaagaccgcacccgcgcccacgctgaccacatcggccaggggtttgagcgacagacaactgccgcggtgggcgtgttaaaggctgtacactgcggggaatggccagatcagcctcgcattaccaaagatgtgatctgcttccacgcggaggattttcttgaagtggttcagagaatgcagctggatctgcacgagccacctctgtctcagtgcgtgcagtgggtggatgatgctaagctaaaccagttacggcgggaaggtatccgatatgcgcgaattcagctctacgataacgacatatacttcatacctcgcaatgtggtgcatcaattcaagaccgtgtcggcagtatgctctctggcatggcacatcaggcttaagctttaccactccgaagaagatacctcccagaatacggcaacccatgagacaggcacctccagtgactccacctcctcagtcctgggaccccacacagataacatgatttgtgccgtctccaaagcatctctcgattcagtgttcagcgataagctgcattccaagtacgagctgcagcagatcaaacacgaacctatcgccagcgtcaggattaaagaggagcccgtaaacgtaaacattcccgagaaaacgaccgcactcaataatatggatggcaagaatgtgaaggctaaactcgatcatgtccagttcgcagagtttaagatcgacatggactccaaattcgagaattccaataaagatttgaaggaagaactgtgtcccggcaacttatcactcgtggatacacggcagcatagtagcgctcattcaaatcaggacaaaaaggatgacgatattctgtgttag

SEQ ID NO: 13130 - DNA, 1815 bp, Artificial Sequence
  Description of Artificial Sequence: Synthetic coding sequence
atgatttccgtgaaaaggaatacttggagagccctctccttagtgatcggagactgtcgcaaaaaggggaattttgagtactgccaagaccggactgaaaaacattctactatgccggattcacctgtcgatgtcaagactcagtccaggctgacgccgccaacaatgcctcccccacctacaacgcaaggtgctcccaggacaagctcattcacccccacaacactaacaaacggaacttcacattcacctactgcgctcaacggcgccccgtctcctcctaacgggttttcgaacggaccttcctcttctagctccagctccctggccaatcagcaactccctcctgcttgtggggcgcgtcaattgtccaagctaaaacgctttcttacgacactgcagcagtttggaaacgacatctcacccgagattggggaaagagtgagaactctggtgctgggcttagtcaactccaccttgactattgaagagtttcactcaaagctgcaggaagcaactaactttcccctacgaccctttgtcatcccattcctgaaagctaaccttcccctgctgcaaagggagctgttacactgtgccaggctggctaagcagaatccggcccagtacctcgcgcaacatgagcagctcctgttggacgccagcaccaccagccccgttgactcctctgagctcctgttggacgtgaatgagaatggaaaaagaagaacgcccgataggacaaaagagaacggattcgaccgggagcctctgcattcagagcacccgtctaaacggccatgtacaattagcccaggtcagaggtactctcccaataatggcctgtcgtaccaacctaatgggctccctcatcctacccctccacctccacagcactacagactggatgatatggccatagcccatcattatcgggacagctacagacatccctcacatagagatctgcgtgacagaaatcgccctatggggttgcatggaacgcgccaggaggagatgatcgaccatagactgacagatcgagaatgggctgaagagtggaagcatctggaccatttgttaaattgcatcatggacatggttgagaagactagaagatctctgacggtactcagaagatgccaggaagctgatagagaggaattgaactattggatacgccgatacagcgacgccgaggacttgaaaaagggaggaggatcttcctccagtcactcaaggcagcagagcccagtgaaccccgaccctgtcgctttagacgcccacagagaattcctgcatcgcccagcctctggctacgtccccgaagaaatttggaagaaggccgaggaagccgttaacgaagtgaagcgccaggccatgaccgagctgcagaaagctgtgtcagaagctgagcgaaaagctcacgacatgatcaccacagaaagagctaagatggagcgaactgtggccgaagccaagagacaggctgccgaggacgcattagccgtgatcaaccaacaggaggactccagcgagtcttgctggaattgtggacggaaagcttcagaaacatgctctggctgtaacaccgctcggtattgcggctctttctgtcagcacaaggactgggagaagcaccatcatatatgcggtcaaactctgcaggcacaacagcagggcgacacccccgccgtatcttctagcgttacaccgaactcaggtgccgggagtccaatggatacaccccccgcagctaccccacggagcaccacgccaggcacgcccagtacgatagaaactaccccaaggtag

SEQ ID NO: 13131 - DNA, 1704 bp, Artificial Sequence
  Description of Artificial Sequence: Synthetic coding sequence
atgcctgacagccccgttgacgtgaagacccagtctcggctcacccctccaaccatgccgccaccacctaccactcagggagccccacgaacatctagtttcacacccacgacactgaccaacggcacttcccactctccgacagcactgaatggtgccccatcacctccaaacgggttctctaacggaccttcttcatcttcctctagttccctggctaaccaacaactcccccccgcctgcggtgcgagacagctttcaaaacttaagcggttcttaactacactgcagcagtttggcaacgacatttcacccgagattggagagcgagtgaggactctggtgctaggactcgtgaattctacactgaccattgaggagttccacagcaaactgcaggaagccaccaatttccccctccggcccttcgtcatcccttttttaaaagccaacttacccctactgcagcgggaactcctccattgcgcccggctagctaaacagaatcctgcccaataccttgcacaacacgagcaattactgctggatgcctccactacaagccccgtagattcctctgaactcttgctcgatgtaaacgagaatggcaagcgccggacccccgacagaaccaaggaaaacggctttgacagggaaccactgcactctgaacaccccagtaaacgcccatgcaccatctctcccggccagcgctacagtcctaataacggactctcctatcagcccaacgggcttcctcaccccacccccccgccaccccagcactatcgtcttgatgatatggctatagctcatcattatcgagatagctataggcacccgtcccatcgggacctgagggataggaaccgtcctatgggacttcatggaacgcgacaggaagaaatgatcgaccaccggttgacagatcgggagtgggccgaggaatggaaacacctggaccatctcctgaattgcatcatggacatggtagaaaaaacgagacggtccttgactgttctgagacggtgtcaggaagcagatcgggaagagttgaactactggatccgacgctacagcgacgctgaggatctgaagaagggcggcggctcctcttcctcacactcacgccagcagtctcccgtaaatcctgacccagttgcccttgacgcccatcgcgaattcctgcaccgaccagcctccgggtatgtccccgaagagatttggaaaaaagccgaagaggccgtaaatgaagttaaacggcaagccatgacggaacttcagaaggcggtttccgaggctgagcgaaaggcccatgatatgattaccactgagcgcgcaaaaatggaacgaaccgttgccgaagccaagcgccaggctgcagaggatgctctagcagttatcaaccagcaggaagacagtagcgagtcatgttggaactgtggcagaaaggccagcgagacgtgctccggttgtaatacagcccggtactgcggctccttctgtcagcacaaggattgggagaaacaccaccacatctgcggacaaaccctccaggcacagcaacagggggacactcccgctgtgtcgtccagcgtgacacccaattctggcgccggctctccaatggatactcctccagctgccacaccgcgaagcaccactcctggcaccccatctactatagaaactaccccccgatag

SEQ ID NO: 13132 - DNA, 1734 bp, Artificial Sequence
  Description of Artificial Sequence: Synthetic coding sequence
atgccagataggactgagaaacatagtacgatgcccgatagcccagttgatgtgaagactcagagcagattgacaccaccgactatgcccccccccccaacaacccagggcgccccccggacctcgtctttcactcccacgactctgacaaatggaacgagccactcccccaccgccctgaacggggcaccgagcccccccaatggattctctaatggacccagctcgtccagttcgagctctttggccaatcaacagctccccccagcatgcggggctcggcagctctctaagctgaagagattcctgacgactctgcagcagttcggaaacgatatctcacccgaaattggagaacgcgtgcgtaccctggtgctcggcctggtcaattcgaccctcactattgaggaattccacagtaaactgcaggaagccacaaactttcctttgcgaccatttgtgatcccttttctgaaagccaacctccctctactgcaacgcgaattgctccattgcgccagattagcaaaacagaatccagctcagtacctggcccagcacgagcagcttctgctagacgcttcaaccacgagtccagtggactcgagcgagttgctcctggatgtgaacgagaatgggaagaggcgcaccccagatcggacaaaggagaacggtttcgatagagagcccctgcactctgaacatcctagcaaaaggccatgcaccattagccccgggcagcgctacagccctaataatggactttcctaccagcctaacggactgccacatcccaccccccctcccccgcagcattacaggttggacgacatggcaatagcgcatcattatagagattcataccgccaccctagccatcgagaccttagagacagaaaccgccccatgggactgcacggcacaagacaggaggagatgattgaccaccgactgacagacagagaatgggccgaagaatggaagcacctggatcatctgttgaactgcattatggacatggtggagaagacacggcgaagtctcacggtgttgcggcgttgccaggaggccgatcgagaggagcttaattactggatccgcagatattcagacgcagaggacctgaagaagggcggtgggtctagctccagtcactcgcggcagcaatctcccgtaaaccctgacccagtcgccctggacgcgcacagggagttcctccacaggcccgcttccgggtacgttcctgaggagatctggaagaaagctgaggaggcagtcaacgaggtgaagaggcaggccatgactgaactgcagaaagccgtgagcgaggctgaaagaaaggcgcacgacatgattactaccgagcgggccaaaatggaaagaacggtggcggaggccaagcggcaggctgcagaagatgctctggcagtaatcaaccaacaagaagatagttctgaatcttgttggaactgtggacggaaagcttccgagacctgctctggttgtaatactgcaaggtattgtgggagcttctgtcagcataaggattgggagaagcaccatcacatctgcgggcagaccctgcaagcacagcaacagggggacacgcctgctgtgtcttcctccgtcacccctaatagtggcgccggatcaccaatggacaccccaccagcagcaactcccaggtcaaccacaccgggaactccttcaacaattgagacgacccccaggtag

SEQ ID NO: 13133 - DNA, 1704 bp, Artificial Sequence
  Description of Artificial Sequence: Synthetic coding sequence
atgccagactcacccgtggatgtgaaaacacagtcacggctgacccctcccacaatgccgcctccacctactactcagggtgccccacgaacgtctagctttactcctactacacttacgaacgggacatctcactcacccacggctctgaacggagcaccatcacctcccaacggcttctcgaatggccccagttcctcttcgtcttcttctctggccaatcaacagctgcctcccgcttgtggcgctcgccagctcagcaagctgaaacggttcctgacaaccctgcagcaattcggtaatgatatatcccctgaaatcggagaacgcgtgcgaacactggtgctggggctggtgaattccacactcacaatagaagagttccactctaagctgcaggaggctaccaatttcccattgcgtcctttcgtgattccgttccttaaggctaacctccctctcctgcagcgagaactgctccactgcgctagactggctaaacagaatcccgctcagtatctggcccagcatgaacagttgctgttagacgcatccacaacaagcccagtggatagttctgaactgctgcttgatgtgaacgaaaatggcaagagacgtactcccgataggacaaaagagaacggctttgacagggaaccgctgcattctgagcacccatctaaacgtccctgcactatttctcctggacaacggtattctcccaacaacggcctttcatatcagcctaacggcctgcctcacccgaccccaccacccccccaacactacaggctcgacgatatggccattgcacaccactatcgggactcttaccgccatccatcccatagagatctacgcgaccggaaccgtccaatgggtttgcacggcactcggcaggaggagatgattgatcaccgccttaccgatagagagtgggccgaggaatggaagcatctcgaccacctccttaactgcattatggatatggtggagaagacacgcaggagtctgacagtgctgcggcggtgtcaggaagcggacagggaagagctgaattactggatcagacggtattcagatgctgaggacctgaagaagggcgggggtagctcatctagtcactcacggcagcagagccctgtgaatccggacccagtggcactggacgcacacagagaatttttgcatagacccgcttccgggtacgtgccagaagagatttggaaaaaggcggaggaagccgtgaacgaggtaaagcgtcaggcaatgaccgaactccagaaggccgtgtcagaagcggagcgcaaagcccatgacatgattacgactgagagggcgaagatggagcgcaccgtggccgaagcaaagcgccaggctgccgaggacgctttagccgttatcaaccagcaagaggactcttctgaatcttgctggaactgtgggcgcaaggctagtgaaacatgctccggctgcaacacggcaaggtattgtgggagcttttgtcagcacaaggactgggagaaacatcatcacatttgtgggcagactctgcaggctcagcagcagggcgatacacccgccgtgtcttcgagcgtgacgccaaacagcggagccggtagccccatggacacaccccctgctgccacaccccgaagtaccacacctggcactccttcaaccatcgaaactacaccccggtag

SEQ ID NO: 13134 - DNA, 1848 bp, Artificial Sequence
  Description of Artificial Sequence: Synthetic coding sequence
atgtgccatcccgataaagcttttacatccgacaagttacagtgtgtgtttaacgaatacaaagcagccgtgtgggttcccccgaggccgaggcccctgagccgggcaccactgcctgaggaccgcacagagaaacatagcactatgcccgatagtccagttgatgtgaaaacacagtcccggctaacaccgcccacaatgccaccccccccaacgacacagggcgcaccccggactagcagctttacccctactacacttacgaacggcacttcacatagtccaacagcactaaatggagcccccagtccaccgaatggattctccaacgggcccagctcatcaagtagttcaagtctggcgaaccagcagctccctccggcctgtggggcaagacaactttcgaagctgaagcggtttctcacaaccttacaacagttcggtaacgatataagtcccgagatcggtgagcgggtccggaccctggtgctgggcctggtaaactccaccttgaccattgaagaatttcatagtaagctgcaggaggccactaattttcccctcaggccttttgtcatacctttcctgaaagccaaccttcccttgttgcaaagggagctgcttcattgtgcacggctagccaagcagaatcctgcacagtatctggctcagcatgaacagttactactggacgcatccacaacatctccagtcgactcttcagaactcctgcttgacgtgaacgaaaatgggaagcggaggacaccagatcggacaaaggagaatggcttcgatagagaacccttgcatagtgaacaccccagcaagcggccctgcactatttctccagggcagcggtatagcccaaataacggcctgtcctaccagccgaacggtctgccgcacccaacaccacccccgcctcagcactacaggctggatgacatggcgatcgcccaccactatcgtgactcttatagacacccatcacatcgggacctccgtgaccggaacaggcctatgggcttacatgggactcgacaagaagagatgattgatcaccgtctgactgaccgggaatgggccgaggagtggaaacatctggaccacttgttgaattgtatcatggatatggtcgagaagacccgtcggtccctgacagtcctgagaagatgccaggaagctgaccgcgaggagctgaattactggattcgacgctactccgacgcagaggatctgaaaaagggtggagggagctccagctcacactcgcgtcagcagtcgcctgtgaaccctgacccggtggccttagacgcccatagggaatttctacaccggcccgcctctggttacgtgccggaggagatttggaaaaaggccgaggaggccgtgaatgaagtgaagcgccaggcaatgaccgaactgcagaaggcggtgtctgaagctgagagaaaggcacatgatatgatcacgaccgaacgggcaaagatggagcgcacagtcgcagaggcaaaacgacaagctgccgaggacgcccttgccgtaatcaaccagcaggaggactctagcgagagttgctggaactgcggacgcaaagcctcagagacttgctctggctgcaacaccgcaaggtactgcggatccttctgccagcacaaggattgggaaaagcatcaccacatatgcggccagaccttacaggcacaacagcaaggcgacacgccagccgtgagctctagtgtgacccccaacagcggggccggttctcctatggacactccccccgccgctactccccgctctacgacccccgggacccctagcaccattgagacgactccccgctag

SEQ ID NO: 13135 - DNA, 363 bp, Artificial Sequence
  Description of Artificial Sequence: Synthetic coding sequence
atgccagattctcctgttgacgtcaagacacagtcacgactgacacctcctaccatgccacctccccctactactcaaggggctccgaggactagctctttcacgcctacgacactgactaatggtacatcacactcacctaccgcgttgaatggggcaccctctcctcccaatggcttctcgaatgggccaagtagtagctcttcttcttctctcgcaaaccagcagctgccccctgcatgcggcgccaggcagctttcaaagcttaagagattcctcaccaccttgcagcaatttggtaacgatatcagtcctgaaataggagaacgagtccgcacacttgtgctggggctggttaactag

SEQ ID NO: 13136 - DNA, 408 bp, Artificial Sequence
  Description of Artificial Sequence: Synthetic coding sequence
atgataagcgtgaaacggaatacttggcgagcgcttagcctggtgattggcgactgccggaagaagggaaacttcgagtactgtcaggataggacggaaaagcactcaaccatgcccgacagtcccgttgatgtgaaaacacagtcgaggctgactcccccaacaatgcctcctccccctacaactcaaggcgcccccagaacttctagttttactcctacaaccctcacaaacggcacctcccattcacccactgctctcaacggagcaccctctcctcctaacgggtttagcaacggcccttcatcaagttcctccagctccctagcaaatcaacagctgccccctgcctgcggggcgcggcaactctccaagctgaaacgcttccttacaactcttcagcaatag

SEQ ID NO: 13137 - DNA, 210 bp, Artificial Sequence
  Description of Artificial Sequence: Synthetic coding sequence
atgcctgaccggaccgaaaagcactcgactatgccagacagccccgttgatgtgaagacccaaagcaggctgaccccccccacaatgccacctcctcctactacacagggtgcgcccaggacctcaagtttcacacctacaacgctgacaaacggcactagccacagccccacagcgctgaatggcgccccatcgccccccaacgggtag

SEQ ID NO: 13138 - DNA, 177 bp, Artificial Sequence
  Description of Artificial Sequence: Synthetic coding sequence
atgatctccgttaagaggaatacatggagagcgctgtcacttgtgattggcgattgtcgtaaaaaggggaacttcgaatactgccagggcgcccgggcccagcatcctgcaagcggtgacgccgccccggcccccctcatggccttactgagcgccgccacccacagccggacatag

SEQ ID NO: 13139 - DNA, 240 bp, Artificial Sequence
  Description of Artificial Sequence: Synthetic coding sequence
atgcccgaccgcacagaaaagcactccaccatgcctgactcccccgtagacgtgaaaactcagagccggctgaccccgccaactatgcctcctcccccgacaactcaaggagccccaagaactagctcctttactcctacgaccctcactaatggtacctcacacagcccaaccgcacttaatggagcacctagccctcctaacggctttagtaacgggcctagctctagcagcagctag

SEQ ID NO: 13140 - DNA, 141 bp, Artificial Sequence
  Description of Artificial Sequence: Synthetic coding sequence
atgccagactctcccgtggacgtcaagacgcaaagcagacttaccccgccgaccatgccaccacccccaactacccagggcgcccctcgaacgagctcttttactcccaccacactgactaacggtaccagccattcctag

SEQ ID NO: 13141 - DNA, 1734 bp, Artificial Sequence
  Description of Artificial Sequence: Synthetic coding sequence
atgcccgaccggaccgaaaagcactctaccatgccagacagccctgtagacgtgaaaactcagtcaagattaacacccccgacaatgccacccccacccacaacgcaaggcgcccctcggacgtcctcctttacccctaccacgctcacaaatggcactagccacagtccaactgcattgaatggtgctccctctcctcctaacgggttcagcaatgggccaagctcctccagcagctcttctctggccaaccagcaactcccacccgcttgtggggctcggcagctcagcaagctgaagaggtttctgaccactctccagcagtttggcaacgacatctctcccgaaatcggggaacgcgtgaggactttagtgctggggttagtcaattctacattaacgattgaggaattccatagcaagctccaggaggcaaccaatttcccattaagaccatttgtgataccttttctgaaagccaatttaccattgctgcagcgggaattgcttcattgcgccaggctggctaagcagaatccggcccagtacctcgcgcagcacgagcagcttctcctcgatgcctccaccacctcacctgtggactcgtctgagttgttgctggacgtcaatgaaaatggaaaacggcgaacaccagatcgcacaaaagaaaacggatttgatcgggagcccctgcatagtgagcatcccagcaagcggccctgcacaatcagccccggccagcggtattcccccaacaacgggctttcttaccagcccaatgggctgccccacccgacccccccccccccacagcactatagattggacgatatggctattgcccaccactaccgcgactcatacaggcaccccagccaccgagatctgagggaccggaatcggccaatggggctgcacgggactagacaagaggagatgattgaccaccggttgacggaccgtgagtgggctgaggagtggaagcacctcgaccacttattgaattgtatcatggatatggtcgaaaagactagaaggtctctcaccgttctccgccgctgccaggaggccgacagggaggagctgaactattggatccgacgatattcagacgctgaagacctgaaaaaggggggcggcagttcgagttcacactcacgccagcaaagccccgtaaaccccgatccagtggctctggatgcccaccgagagtttctgcaccgtcccgcatccggttacgtgcctgaagagatctggaaaaaggccgaggaggcggttaacgaggtcaagcggcaggccatgacagagctgcagaaggccgtgagcgaggctgagaggaaagcacacgatatgatcactacagaacgcgccaagatggagcgtaccgtcgctgaagccaagaggcaggctgccgaggatgcacttgccgtgattaaccagcaggaagatagctctgaatcatgttggaactgtgggaggaaggcctctgagacatgcagcgggtgcaatacagctagatattgtggctcattctgccagcacaaggattgggagaaacaccaccacatttgtgggcagactctgcaagcccagcagcagggcgacactccagccgtttcaagcagcgtgaccccaaattctggagcaggaagtccaatggacactccgccggctgccacaccaagatccactaccccaggcaccccctctacaattgagacaactccgaggtag

SEQ ID NO: 13142 - DNA, 165 bp, Artificial Sequence
  Description of Artificial Sequence: Synthetic coding sequence
atgattagcgtgaagagaaatacatggagagcgctgagcttggtcatcggcgattgtcggaagaaagggaattttgagtattgtcaggacagaactgaaaaacattctaccatgcccgattccccagtggacgttaaaacccaaagtagactgaccccaccctag

SEQ ID NO: 13143 - DNA, 690 bp, Artificial Sequence
  Description of Artificial Sequence: Synthetic coding sequence
atgatcagtgtcaaacggaatacgtggcgcgccctctctctggtcatcggggactgcagaaagaagggtaactttgagtattgccaagatagaacagagaaacacagcacaatgccagactctcctgtggatgtgaagacacagagccgccttactccacccaccatgcccccacctccaacgacgcagggggcaccccgtacttcctcttttactccaacaactttgaccaatggcacctcacattccccgaccgcactaaacggcgcacccagccctcctaacgggtttagcaacggaccttctagctcaagttcatccagcttggccaatcagcaactgccacccgcatgcggcgctagacaactgtcgaaacttaagagattcctaactacattgcagcagttcgggaatgacattagccccgaaattggcgagcgcgtgaggactctcgtcctgggacttgtgaactccacgttgaccatcgaagaattccactcaaagctccaggaggccactaactttcctttgagaccgttcgtgattccttttctcaaggccaatctgcccctgctgcagcgggagctgttacattgtgctcggctcgccaaacagaatccagcccaatatcttgctcagcacgaacagcttctgttagatgcgagtaccactagtcctgtcgacagctag

SEQ ID NO: 13144 - DNA, 81 bp, Artificial Sequence
  Description of Artificial Sequence: Synthetic coding sequence
atgccagaccggaccgagaagcactctaccatgcctgactcacccgtggacgtgaagactcagagtcggctcaccccatag

SEQ ID NO: 13145 - DNA, 510 bp, Artificial Sequence
  Description of Artificial Sequence: Synthetic coding sequence
atgatctctgtgaagcgcaatacctggcgcgcccttagccttgtgataggtgactgtagaaaaaaaggaaattttgaatactgccaggataggacggagaaacactccacaatgcctgactcccctgtggacgtgaagacgcaatcccgcctaaccccacccaccatgccaccccctcctacaacacaaggtgcaccaaggacctcaagtttcacccctacaaccctgaccaatggcacctcccacagccccaccgcactgaacggcgcccctagcccacccaacggcttctcaaacggcccaagctccagctcatccagttccttggcaaatcagcaactgccgccagcttgcggagcccggcaactcagtaaactgaagagatttttaacaacgttgcagcagtttggaaatgatattagccctgagattggcgaacgagtacggacgcttgtgctcggtctcgtgaattcaaccctcacaattgaggaatttcacagcaagctatag

SEQ ID NO: 13146 - DNA, 147 bp, Artificial Sequence
  Description of Artificial Sequence: Synthetic coding sequence
atgatttccgtgaaacggaatacatggcgcgcgctctctttggtcattggcgattgccgcaaaaaaggaaactttgagtactgtcaggaccgcaccgagaagcactcaaccatgcctgactccccggttgatgtgaaaactcagtag

SEQ ID NO: 13147 - DNA, 276 bp, Artificial Sequence
  Description of Artificial Sequence: Synthetic coding sequence
atgcctgattcccccgttgacgttaaaacccaaagtcggcttactccacctactatgccccctccacccacaacgcagggagccccacgaactagtagcttcactccgaccactctcaccaatggtacctcccattctccaactgcgctgaacggggccccaagcccgccaaacggattctcaaacgggcccagtagctcgtccagctcctcccttgcaaaccagcaattacctcccgcatgcggcgcgcgccaacttagtaaactaaagcgctag

SEQ ID NO: 13148 - DNA, 363 bp, Artificial Sequence
  Description of Artificial Sequence: Synthetic coding sequence
atgatttctgttaaacgtaacacatggagggctctcagcttggtgatcggggactgcaggaagaagggaaattttgaatattgtcaggacagaaccgaaaagcacagcacaatgccagactcccccgtagacgtgaagacccagtctcgcttgactccaccaactatgcctccaccaccaactactcaaggggcgcctaggacgtccagcttcacacctaccaccctgaccaatggcacgagccactcccccaccgctttgaatggggcgccttcacctcccaacgggttcagcaacgggcctagctctagtagcagctcttctctcgctaatcagcaactacctccagcatgcggcgcctag

SEQ ID NO: 13149 - DNA, 1704 bp, Artificial Sequence
  Description of Artificial Sequence: Synthetic coding sequence
atgccagattcccccgtcgatgtcaagactcagtcacggttgacaccacctaccatgccgcccccacccaccacacagggcgcccctcgcacctccagctttacgccgactaccctgacaaacggcacatctcatagcccaacagccctgaacggcgcgcctagcccacctaatgggttttctaacggcccctcctctagctcaagtagtagtttggcaaaccagcagctcccaccagcctgcggggcacgccagttgagtaaactgaagcgctttctgacgacgctgcaacagttcggtaacgatatctcgcccgaaattggtgaaagagtacgaactctggtgctcggactggtgaacagcactttaactatagaagagtttcattccaaactccaggaagcaacgaattttccgcttagaccctttgtcatccccttccttaaggccaacctgccactcctgcagcgggagctgttgcactgcgccagactggcgaaacaaaacccagcacagtatctggcccaacacgagcagttgttgcttgatgcaagcactaccagccctgtggatagtagcgaactactcttggacgtcaacgagaacggaaagcgaaggacacccgaccgtaccaaagagaacgggtttgatcgtgaacccctgcattccgaacatccatcaaaacggccatgtacaatttcccctggtcaaaggtacagtccaaacaacggactctcctaccagccaaatggcctcccgcacccaaccccaccacctccccagcactacagactcgacgatatggcaatcgctcaccattaccgcgacagctaccgccacccatcccaccgcgatctcagggatcgcaacagacccatgggactgcatgggacccggcaggaggaaatgatcgaccatcggctgacagacagagaatgggccgaggagtggaaacacctggatcacctactgaattgtattatggatatggtggaaaaaacacgaaggtcactgaccgtactgcgccggtgccaggaggccgacagagaagagcttaattattggatccgacggtatagtgatgctgaggacctcaaaaagggagggggctctagcagctcccactcacgccaacagtcacccgtgaaccctgatcctgttgccctggacgctcaccgcgagtttcttcatagaccagcatctgggtacgtccctgaagagatttggaagaaagccgaggaagctgtgaacgaagttaagaggcaggccatgacagaacttcagaaggctgtcagcgaggccgagcggaaagcccatgatatgataacgacagagcgtgcaaagatggagcgcacggtagcggaagccaagagacaagccgccgaggatgccttggccgtaattaatcagcaggaggattcctctgagtcctgctggaattgcggacgcaaagcctcagaaacatgcagtggatgcaatacagccagatactgtggatcgttctgccagcataaagactgggaaaagcatcaccacatctgtggccagactttgcaggcccagcagcaaggggacaccccagctgtgtccagctcggtgacgccaaattctggcgccggctcaccaatggatacaccccctgctgctacccctcgcagcactacaccaggaactccaagcaccatagagaccacacccagatag

SEQ ID NO: 13150 - DNA, 258 bp, Artificial Sequence
  Description of Artificial Sequence: Synthetic coding sequence
atgatttcagtgaaacggaacacatggcgggccctctcactggtgatcggtgactgccggaaaaagggcaactttgagtactgccaggacaggacagaaaaacattcgactatgcccgattctcccgtggacgtcaaaacccaatccagactcactccaccaaccatgccgccccctcccacaacccagggagctccgcgcactagttcttttaccccaaccaccctgactaacggcacatcacattccccaacctag

SEQ ID NO: 13151 - DNA, 516 bp, Artificial Sequence
  Description of Artificial Sequence: Synthetic coding sequence
atgccggacagtccagtggatgtgaagactcagagccggctgactccacccactatgccacccccgcctactacccagggggcccctcgcacatcttcatttacccctactacactgaccaatgggacttctcatagccctaccgcactgaacggggcccccagccctccaaacggtttttcaaacgggccaagctcctctagctcttctagcctcgctaaccagcaacttccaccagcctgtggggccagacagctgtccaagctgaagagatttctgactacccttcaacaattcggcaacgatatctcccctgaaatcggggaaagagtgcgcaccctggttttagggttggtcaactctaccctcactattgaagagttccactcaaaactgcaggaggccacaaactttcccctgagacctttcgtgatcccctttctaaaagcaaatctacctctcctgcagcgtgagctcctccattgcgcccgcctcgccaaacagaaccccgcatag

SEQ ID NO: 13152 - DNA, 270 bp, Artificial Sequence
  Description of Artificial Sequence: Synthetic coding sequence
atgcctgactcccccgtggacgttaaaactcaatcgcggttgacccctcctacgatgccaccgccacccactacccaaggtgctccccggacttcatcctttactccgacgacactgaccaatggcacctcgcattcccccacagctcttaatggggcccccagtcctcctaacggctttagcaatggcccatcgtctagctcatcttcatccttggcgaatcagcaactcccaccggcttgcggggctaggcagctgagcaaactgtag

SEQ ID NO: 13153 - DNA, 285 bp, Artificial Sequence
  Description of Artificial Sequence: Synthetic coding sequence
atgatatccgtcaaacggaacacttggagggctctatctttggtgatcggcgactgcaggaagaaagggaattttgagtattgtcaggacaggacagagaaacacagtacgatgcccgacagccccgtggacgtcaaaacccagagccggctcaccccacctacgatgcctccgccacccactacccagggcgccccaagaacatcctctttcactccaaccactttgaccaacggcacttcccattcaccaaccgccctcaatggcgctcccagccctccatag

SEQ ID NO: 13154 - DNA, 306 bp, Artificial Sequence
  Description of Artificial Sequence: Synthetic coding sequence
atgccagatcgaaccgagaagcactccacaatgcccgatagtcctgttgatgtgaaaacccagagtagactgacaccaccaaccatgccgccgccgccaacgactcagggcgctcctcggaccagtagctttactcccacaacactaacgaatggcacgtcccacagcccaaccgccctgaacggcgccccatctcccccgaacggtttttccaacggtccgagctcatcttcatccagttccctcgcgaaccagcagttgccccctgcatgcggagcacgacagctgagcaaactgaagcggtag

SEQ ID NO: 13155 - DNA, 471 bp, Artificial Sequence
  Description of Artificial Sequence: Synthetic coding sequence
atgattagcgtgaagagaaatacttggcgcgcactttccctcgttattggcgactgtaggaaaaaagggaacttcgagtactgccaggataggactgaaaagcatagcactatgccggattctcctgtggatgtgaagacacagtcaagacttacgccaccaaccatgcctccacctcccactacccaaggtgccccacgtacaagttcatttacgcccaccactttaacgaacgggacctcccactcacccacagcactcaatggggctccttcgccccccaacggcttcagtaatggaccatcgtcatccagctcctcgagcctggcaaaccagcagttgcccccagcttgcggcgccaggcagctatctaagctgaaaagatttctgactactttgcagcaatttggaaacgatatatccccagaaattggggaacgtgtgaggactttagtccttgggctggtgtag

SEQ ID NO: 13156 - DNA, 363 bp, Artificial Sequence
  Description of Artificial Sequence: Synthetic coding sequence
atgatttctgtcaaacggaatacatggagagctttaagtctggtgatcggagattgtagaaaaaaaggaaactttgaatattgccaggacagaactgagaagcactctaccatgcctgacagcccggtcgatgtgaagacacagagccggttgacccctcccactatgcccccacctcccaccactcagggggccccgcggacctcatctttcacccccactaccctgacaaacggcacttcacattcacctaccgctctaaatggagccccttccccccctaacggatttagtaacggcccttcatcgtcatcgtcaagcagtctcgcaaaccagcaactgcctccagcttgcggagcatag

SEQ ID NO: 13157 - DNA, 1815 bp, Artificial Sequence
  Description of Artificial Sequence: Synthetic coding sequence
atgatctcggtaaaaagaaacacttggagggctctgagccttgtcatcggtgactgtaggaaaaaagggaacttcgaatactgccaggacaggacagagaagcactctaccatgcccgatagcccagtggatgtaaaaacccaatctaggctgacccctcccacaatgcctccaccaccaacaacccagggagcccccagaaccagttcattcacccctacgactctgactaatggaactagccactctcctacagctctgaatggcgcgccctctcctcccaacggattcagcaacggcccatcctcgagctcctccagcagcctcgccaaccagcagttgcctcctgcctgcggcgcaaggcagttgtcaaagctgaagaggtttctgactaccctgcagcagttcggaaacgatatctcccccgaaatcggagagcgcgtgaggacactggtactaggcttggtcaactctacgttgactatcgaggaatttcactcaaagcttcaagaagccaccaacttccccctccggccctttgtgatcccttttttgaaggccaatcttcccctactgcagcgcgaacttcttcactgcgcaaggctcgcaaagcagaatcccgcccagtatctggcacagcacgaacagctcctgttggacgcttcaactacgtctcccgtggatagctctgagttgctactggacgtgaacgagaatggaaaaagaaggacacctgataggacaaaagagaatggttttgatagggaacctctccactcagagcaccctagtaaaagaccctgcacaatttcccccgggcaaaggtactctcctaacaatgggttatcttaccagcccaacggactccctcacccgacaccgccaccaccccagcactaccggttagatgacatggccatcgcacaccactacagagatagctaccggcatccctcccatagagatctgagggatcgaaatcgacctatgggcctgcacggtaccagacaggaggaaatgatcgaccatcgactaacggatcgtgaatgggccgaggaatggaagcacctagatcatttactcaactgtatcatggatatggtggagaaaactcgccgcagcctgactgttttgagaaggtgtcaggaggcagaccgggaagagctcaactactggatacggagatactccgatgccgaagatctgaaaaaaggcgggggctcctcctccagtcatagtcgtcaacagtctcccgtgaaccccgatcccgtcgcactggacgcacaccgggaattcctgcacaggcctgccagtggatacgtacccgaagagatctggaaaaaggccgaagaagcagtgaacgaagtcaaaaggcaggccatgaccgagctgcaaaaagcggtttctgaagcagaaaggaaagcacacgacatgattaccacggaaagggccaaaatggaaaggaccgtcgctgaagccaaaaggcaagctgccgaggacgccctggctgtgattaaccaacaggaggatagctccgaatcatgctggaactgcgggcggaaagcatcagaaacatgttcggggtgtaacaccgctcgctactgtggttcgttttgccaacataaggattgggagaagcaccaccacatctgtggacagacgctgcaggcacagcaacagggtgatacacctgccgtgtcttcatctgtaactcctaactccggtgcgggaagcccaatggacacaccccccgccgctacccccaggtccaccacgcccggtacaccttccacaatcgaaacgactccgcggtag

SEQ ID NO: 13158 - DNA, 3105 bp, Artificial Sequence
  Description of Artificial Sequence: Synthetic coding sequence
atggctgcagcgacaggagctgtcgcagccagcgctgcttctggacaggctgaggggaaaaagatcaccgacctgagagttattgatctgaagtccgaactgaaacgccggaatctcgatatcacaggggtgaagactgtgttgatcagcaggctgaagcaagcaatagaggaagagggaggtgacccagacaacatcgaactcaccgtctccacagatactcctaacaagaaaccaaccaaggggaaaggaaagaaacacgaggccgacgagctcagcggtgatgccagtgtagaagacgatgccttcattaaggactgcgaactggaaaaccaggaagcccatgaacaggacggtaacgatgaacttaaagactccgaggaatttggggaaaacgaagaggagaacgtacactccaaagagctcttgtctgccgaagagaacaaacgggctcacgaacttatagaagcggaggggattgaggatatcgaaaaggaagacatcgaatcgcaggagatcgaagcccaggagggcgaagatgatacctttctcacagcccaagacggggaggaggaggagaacgagaaagacatcgctggatctggcgacgggacccaggaagtgtccaagccactacccagcgagggctctctcgccgaggccgaccatactgctcacgaggaaatggaagctcacaccacagtcaaagaagccgaggatgacaatatctctgttaccatccaggccgaggatgccatcaccctggactttgacggtgatgacttgcttgagaccgggaagaatgttaaaattacggatagcgaagctagcaaaccgaaagatggccaggatgccatcgctcagtcgcccgaaaaagagagcaaggattatgagatgaacgcaaatcacaaagatgggaagaaagaggattgcgtgaagggcgatcctgttgaaaaggaagccagggagtccagcaagaaggctgagtcaggagacaaggaaaaagacactttaaagaagggcccctcatctaccggggcaagcggccaggccaagtcttccagcaaagagtcgaaagactcaaagacgtcaagtaaggatgacaagggttcgaccagctccactagtggctctagcggaagctcgaccaaaaatatctgggtttcaggactttcatctaacacgaaggcagcggacctgaagaatctcttcggaaagtacgggaaggtgctatctgcaaaagtggtaaccaatgcgcgcagcccaggcgcgaaatgttacggtatcgtaaccatgagctcatccaccgaggtctctagatgcattgctcacctccaccgtaccgagctgcatggccagctgatctccgtagagaaagttaaaggcgacccaagtaagaaagaaatgaaaaaggagaacgatgagaaaagtagttcaagatctagcggagacaagaaaaatactagcgaccggagtagtaagacgcaggcaagtgtaaaaaaggaggaaaagcgctcatccgagaaatccgaaaaaaaggagtctaaggataccaagaagatcgaggggaaagatgaaaagaatgacaatggcgcttccggacagacttccgaatcaatcaagaagagcgaagagaagaaaagaatcagctccaaatccccaggacacatggttatcctggatcaaacaaaaggtgaccattgtaggcctagtcgacgcggaagatacgagaagatccacgggaggagtaaagaaaaagaacgggcgagcctcgacaagaagcgtgataaggactacagaaggaaagagatcctacccttcgaaaaaatgaaggaacaacgcctgcgcgagcacctcgtaagatttgagcgcctgcgccgcgccatggaactgcgcagaagacgggagatcgccgaacgcgagcgcagggaacgagaacgcattcgcatcatcagggagcgggaggaaagggaaaggctacagcgggaacgggagcgcttagagatagaacgacaaaaactcgaacgtgagaggatggagcgggagcgtcttgagcgcgagagaatcaggattgaacaagagcggcgaaaggaagccgagcggattgcccgggaaagagaagagctcaggcgacagcagcaacagcttaggtatgagcaggagaagcgaaactctctcaagcggcccagagacgtggatcatagacgcgacgatccctactggagtgagaataaaaagctgtcattggataccgacgccagattcgggcacggctcagactactcacgacaacagaatagattcaatgatttcgaccatcgcgagcgcggtaggttcccagagtcgagtgctgtccagagctcctctttcgagaggagggatagatttgtggggcaaagcgaaggaaaaaaggccagaccgaccgctcgacgtgaggatccctctttcgaacggtacccgaagaatttctctgactcacggcgaaatgaacccccccctccccgaaacgaactcagggaatcagaccgcagagaagttagaggcgaaagggatgagcggaggactgtgattatacacgaccgacctgatataacccaccctagacatcctagagaagctggtccgaatccatcacggccgacttcctggaagtccgaaggatccatgtctacagacaaaagagagactcgcgttgagaggccagaacggagcggccgcgaggtgagtggccacagcgtgaggggggctcctccagggaataggtcctccgcttccggatacggctccagagagggcgaccgtggcgtcataacagacaggggcggcggatctcaacactacccagaagaacgacatgtcgtggagcgccatgggagggatacaagcgggccacggaaagaatggcatgggccacctagtcaggggccgtcctaccacgacacacgaagaatgggggatggccgggctggagctggcatgattacccaacattcctccaatgccagccctattaatcgcatcgtgcagatatcggggaactcaatgcctagaggaagtggctccggttttaagcctttcaagggaggtccacccagacgcttttag

SEQ ID NO: 13159 - DNA, 1812 bp, Artificial Sequence
  Description of Artificial Sequence: Synthetic coding sequence
atgtccagttccacagaagtttctcgttgcattgcacaccttcatagaacagaacttcatgggcagctgatcagcgtggagaaagtgaaaggagatccttccaaaaaagagatgaagaaggagaatgatgagaagagtagcagtagatcttcgggtgacaagaagaatacatcagataggtcctcaaagactcaggcaagcgtgaagaaggaagaaaagcgttccagcgagaaaagtgaaaagaaagagagtaaggatacgaagaaaattgaggggaaagatgaaaagaatgataacggcgctagcggacagacaagtgaaagcatcaaaaagtcggaggaaaaaaaaagaatttcttccaaatcgcccgggcacatggtgatcctcgaccagaccaagggggatcactgtagaccgtctaggaggggacgatacgagaagattcacggacgtagcaaggaaaaggaaagggcgtcattggataaaaaaagagacaaggactacagacgaaaagagatactgcctttcgaaaagatgaaggaacaaagattgcgggagcacctggtccgattcgagaggctccgcagagctatggaactcagacggagacgggaaattgcagagcgcgaacgacgggagagagagaggatccggatcattagggagagagaggagcgagagaggctgcagcgcgaaagggaaaggctggaaatcgagaggcaaaagctggagcgggagaggatggaacgggaaagattggaacgcgagaggattcgcattgagcaggaaagacgaaaagaagcagaaagaattgcccgcgagagagaagagctgcggaggcagcagcaacagctcagatatgagcaggagaagcggaatagcctaaagagacctcgcgacgtcgaccacaggcgggatgatccgtactggtcagagaacaagaagcttagcctggacacagatgccaggttcgggcacgggagcgattactctcggcaacaaaacaggtttaacgattttgatcatagagagagggggagatttccagaatcttctgccgtacagagttccagtttcgaaagaagagacaggttcgtgggccagtctgaggggaaaaaagccaggcctaccgctcggagggaggatccttcttttgaaagatacccaaaaaacttctctgattcacgccgcaacgagccaccgccaccccggaacgagctcagagagtccgaccggcgggaggtgcgtggagagagggatgaacgacggaccgtaatcattcatgatcgccccgatataacccacccccgccatcctcgggaggccggacctaacccgtctcgccctacgtcatggaagtcagaggggtcgatgagcaccgataaaagggagaccagggtggaacgacctgagcgttcagggcgcgaggttagtggccactctgtccgcggggctccacctgggaatcgctccagtgcttcggggtacggatccagagaaggggatcgcggtgtcatcacagatcgaggcggcggctcgcaacactatccagaagagcgacacgttgttgaacggcacggccgggatacatctggtccccgtaaggaatggcatgggccaccttcacaggggcctagctaccacgatactaggaggatgggtgatggcagagccggggctgggatgatcacccagcactctagtaacgcatcccccatcaacaggattgtacagatttctggcaacagcatgcccagggggagcgggtcagggttcaaaccgttcaaaggcgggcctcctagacgtttctag

SEQ ID NO: 13160 - DNA, 303 bp, Artificial Sequence
  Description of Artificial Sequence: Synthetic coding sequence
ggggtgatcaccgaccgaggaggaggcagtcagcattacccggaggagcgacacgtggtggaacgccacgggcgggataccagcggcccgcgtaaagagtggcacggcccaccatcccaaggccctagttaccacgacacccgacgcatgggtgacgggcgggcaggtgctggaatgataacccaacacagctcaaacgcatcgccaataaatagaatcgtgcagataagcggtaactcgatgccacgcgggtccggtagcggcttcaagccgttcaagggtgggccacccagaaggttctag

SEQ ID NO: 13161 - DNA, 552 bp, Artificial Sequence
  Description of Artificial Sequence: Synthetic coding sequence
atgaacggcttctctacagaggaggatagtagagaggggcctcctgcggctcctgccgctgccgcccctgggtatggacagagctgttgcctcattgaagacggggaaaggtgcgttcggcccgccggcaacgccagttttagtaagcgggtgcagaagagcatttctcaaaagaagttgaaattggacattgataagagtgtccgccatctgtacatctgtgacttccataagaatttcatacagagtgtccgcaacaaaagaaagcgcaagaccagcgacgatgggggcgattcgccggaacatgataccgacatccccgaagtagacctgtttcagctccaggtcaatactctgcggcgctataaaagacattacaagcttcagaccaggccaggatttaataaggcgcagttggctgagactgtttctaggcattttagaaacattccggtcaatgagaaggagaccctggcctacttcatctatatggtgaaaagcaacaagtccagactggaccaaaagtcagaaggaggaaagcaactggaatag

SEQ ID NO: 13162 - DNA, 414 bp, Artificial Sequence
  Description of Artificial Sequence: Synthetic coding sequence
atgaatggattttccacagaagaagatagccgagagggtcccccagccgctccagcagccgctgccccgggttatggccagtcatgttgtctcattgaggatggtgaacgttgcgtgcggcctgctgggaacgcttccttcagcaagcgcgtgcaaaagtctatttctcagaagaagctgaagctagacatcgacaagtctctgcaggttaacaccttgcgcaggtataagcggcattacaagctgcagacacgcccggggttcaacaaagcacagcttgccgaaactgtgagccgacacttccgtaacatccccgttaatgagaaggagacgctggcttatttcatttacatggtgaagagcaacaaatcacggttggatcagaaaagcgaaggcgggaaacagcttgagtag

SEQ ID NO: 13163 - DNA, 429 bp, Artificial Sequence
  Description of Artificial Sequence: Synthetic coding sequence
atgaacggcttcagcactgaagaagatagcagagaagggcccccggcagccccagccgctgcagcgccgggctacggccagtcctgttgcctgatcgaagatggagagaggtgcgtgcgtcccgcaggcaacgcctctttttcaaagcgggttcagaaaagcatatcccagaaaaagttgaagttagatattgataaatccgttgatttgttccagctgcaggtaaacaccctgagacggtataaaagacactacaagttgcagaccagacctggttttaataaggctcagctggcagaaactgtaagtcgacacttccggaacatccctgtgaatgagaaagaaaccctcgcttacttcatctatatggtcaagtccaacaaatctcgcctcgaccagaagtccgaaggcggaaaacagcttgagtag

SEQ ID NO: 13164 - DNA, 540 bp, Artificial Sequence
  Description of Artificial Sequence: Synthetic coding sequence
atggcagccaccgagccaatccttgctgccacagggtctccagcagccgtgccacccgagaaactagaaggtgccggttcttcttctgcccccgagagaaactgcgtaggatccagcctgcctgaggcctcgcccccagcccctgagccatcctcgccaaatgccgccgtaccagaagctatccctaccccgcgtgcagcggctagcgccgcgctggaactgccactcggaccagccccagtgagtgtggctccccaggctgaggctgaggctcgttcaacccccggacccgctggcagcagactcggcccagagacatttaggcagcgatttagacaatttagataccaggacgcggctgggccccgcgaagcttttaggcagcttagagaactctccaggcaatggttgcgccccgacatacgcactaaggagcagattgttgagatgttggtgcaggagcagttgctagctattctgccagaagccgcaagagcccgcagaatcaggagacgtacagatgtccggatcacaggatag

SEQ ID NO: 13165 - DNA, 540 bp, Artificial Sequence
  Description of Artificial Sequence: Synthetic coding sequence
atggctgctacggaacccatcctcgccgcaaccggcagccctgctgcggtgccacctgaaaaacttgagggggccggaagctcctccgcacccgagagaaattgcgtaggaagttctctccccgaggccagcccaccagccccagagccatcctcacccaatgccgccgtacctgaagccattcccactcccagagctgctgcttctgccgccctcgagcttcccctgggccctgccccagtcagcgttgctccccaggcagaggccgaggcaaggtcaactcctgggcctgctggctcaagactcggccccgaaacgttccgacagcggtttcgtcaatttaggtatcaggacgccgctggtccccgagaagcttttcgccagctacgcgagttgagcagacagtggcttagaccagacatccgaactaaagaacagattgtagagatgttggtgcaggagcagctgctggccattcttcccgaagctgccagagctaggcgcattagaaggcgcacggacgtgcgaattactggttag

SEQ ID NO: 13166 - DNA, 3978 bp, Artificial Sequence
  Description of Artificial Sequence: Synthetic coding sequence
atggaggcggttagcagggtcttccctgccctggcgggacaggccccagaagaacagggggagataattaaggtgaaagtcaaagaagaagaccacacctgggatcaagagagtgcactgagacgaaatctttcttacacccgcgagctttcccgccagagatttcgtcagttctgctatcaggagacccccgggccaagagaagctctgtctcagctcagggagctatgccggcaatggctgaatccagagatccacaccaaggaacagattctggagctgctggtgctcgagcagtttttgactatcctgccagaggagctccaatcctgggtaagggaacataatcctgaatcaggggaagaggtcgttacactgctggaggaccttgagcgggaactggatgaaccacgccagcaggtctcccaagggacgtacgggcaggaagtctccatggaggaaatgatcccactggactccgccaaggagagcctagggacacagttgcagagcatggaggacaggatggaatgtgaaagccctgaaccccatccgctccaggataatgggtcgtttttatggttttcaatgatgtcccaaagcatgggtggagacaacttatcatctctggacacaaacgaggccgagattgagccagagaacatgagagagaaatttttccgtagcttggctcggctcttagagaacaaatcgaataatactaaaatcttctctaaagctaagtattgccaacttatcaaagaagtgaaggaggcgaaagcaaaagcaaagaaggaatctgtggactacagacgcttggcccggtttgatgtgatcctggtacaaggcaacgagaagctgatagaggcagtcaacggggaaactgacaagatacgatattatctgcacagcgaggacctgttcgacatccttcacaacactcacctctctatcggccatggcggcaggaccagaatggaaaaggaactgcaagcaaagtacaagaatatcactaaggaagtgattatgttgtatctgacactgtgcaagccttgccagcagaagaactctaagttgaaaaaggtcttaacttccaagtccattaaagaggtctcctctagatgtcaggtggatttgatagacatgcaactgaatcctgacggcgaatacagattcatcctccactaccaggacctgtgtacgaagttaacttttctccggtccctgaagagcaagcgcccaacagaagttgcacacgctctcctcgacattttcactataattggggcgcctagcgtgctacaatctgacaacggtagagaattttccagccaagtcgtaagtgaactgtctaatatttggccagagttgaagatagttcatggaaagagtcaaacctgccagagccagagctcggccgagcagacagaggatatacggaaacgcattttcagctggatgcagacaaataactcatcccactggaccgagttcctttggttcatacagatgtctcaaaatcaaccctatcaccgttcaatgcagcagaccccctgtgaatccgctttcagcagtgaagcaaaacttggcctgagccattctcaattgactgaagagctggtggcctctttgcatactgagaatgagctggaccaggccgacaaggagctggaaaataccctgcgtgctcaatacgaggagaacatcgaaacaggaaccgacagtagcgatatcgaggagaaccttagcgtgacccccaaagtcgccgagaaatctcctcctgaatctaggctgcgctttctgagctgcgtggtctgtgaaaaggaatgcactggcgtgaactcttgtatcagctgcgatgggaatattcacgccatctgcggggtgccatctcagcatgggactgagggatgcggcaggcagattacgtgttccctttgttacgagacatctaccatgaagaggaaacacgacgaaatccagcgcagcctgcccgtgaaaccttctaagatgctgaaaccgtcaggcacaccctttagtcctgataaggtcggcgactggatggcgaaacaggcatctctggacttttttgtgaagaagcggcacgccttttcggagcattcttccagtaacaagaggaatgtcaacaaccgcagttaccccgaggaagggaaaacaaagcgagtgcatgccagcttcacacggaagtacgacccttcatatatcgagttcggattcgtcgccgtgatagatggggaggtgctgaagccccagtgtattatttgcggagatgtcctggcaaatgaggccatgaaaccatccaagcttaagagacatctttattcaaaacataaggagatctcaagtcagcctaaggaatttttcgaaagaaagagtagcgaactaaaatcccagcctaaacaggttttcaacgtgtcccacattaacatttccgcgcttcgcgcctcttacaaagtcgcactcccggtggctaagagcaagaccccctacaccatcgccgaaactctggtcaaggactgtataaaggaggtgtgtctggaaatgctgggagagtcagctgccaaaaaagtggcccaggtgccactgagcaatgataccattgctaggagaatccaggagcttgccaatgatatggaagaccagcttatcgaacagattaagcttgctaaatacttctccttgcagctggatgagtgtagagatatcgcgaatatgattatcttactggtatatgtgcgattcgaacacgatgacgacatcaaggaggagttttttttttctgcttcattgcctaccaatactacgagctcggagctctacgaagctgtcaagaactacatcgtaaataagtgcgggctggagtttaaattctgcgtgggcgtgtgtagcgacggtgccgccagcatgaccggaaagcatagcgaggtggttacccagatcaaagagcttgcacctgaatgtaaaacaacacattgttttatccatcgcgaatcattggcaatgaaaaaaatttctgcggagctcaatagcgtcctcaatgacatagtgaaaattgtcaactacataaaatccaacagcttgaactctcgcctgttctcacttctttgtgataacatggaggccgatcacaagcagctgctcttgcatgccgaaataagatggctttcccggggcaaggtgctctctcggatgtttgagatccggaacgagctgcttgtgttcctgcagggaaaaaagccgatgtggtctcagttattcaaggatgtgaactggacagcacgtctagcatatcttagtgatatattctcaatcttcaatgacctcaatgcatctatgcaggggaagaacgcgacctacttcagcatggccgataaagtagaaggtcagaaacagaagctggaggcctggaaaaatagaatctcaactgactgctatgacatgttccataatttgactaccataataaacgaggtgggcaatgacctcgatatcgcgcatttacggaaagtgatcagcgagcatctgacaaacctgctggaatgcttcgagttctactttccatccaaggaggacccccggattggaaatctgtggatccaaaatccattcctatcgtccaaagacaacctcaatctgactgtcacacttcaagataagttgctgaaactggcaaccgacgaaggcttgaagatatcttttgagaacacagctagcctgccctccttctggataaaggctaagaacgactatcctgaactggccgagattgccctgaagctgctgctgctgttccctagcacttacttatgtgagaccggtttttcaacactgtctgtcatcaagacaaaacaccgcaacagtttgaatatacactatcccttgagggtggccctctcctccattcaacctcggttggacaaactgacttctaaaaaacaagcacacctgagccattag

SEQ ID NO: 13167 - DNA, 2706 bp, Artificial Sequence
  Description of Artificial Sequence: Synthetic coding sequence
atggaagcaaatcagtgcccactggtcgttgagccaagctatccagacctggtgattaatgtaggagaagtgacattgggcgaggaaaataggaagaagctacagaagatacaaagagatcaggagaaggagagagtgatgagggcagcttgtgctttattgaatagcggcggcggcgtcatcagaatggccaaaaaggtggagcacccagttgagatgggcctggatctagaacagtccttgcgggagctgattcaaagcagtgatttgcaggcctttttcgagaccaaacagcaaggaagatgcttctacattttcgtcaagtcctggtcatctgggccttttcctgaagaccggtctgtaaagccacggctgtgtagtctgtccagttcactatataggagatctgagacttccgtgaggagcatggactcccgggaggccttttgttttctgaaaactaagagaaagcccaagatcttagaggaaggtccgttccataagattcacaagggggtgtatcaggagctgcccaactccgacccagcagacccaaactccgaccctgccgatctcattttccagaaagattatctggagtacggtgagattctgccgttcccagaatctcagctggtggagtttaagcaattcagcacgaagcattttcaggaatacgtgaagaggactattcccgagtatgtgccagccttcgctaacaccggcggtggatatctgttcatcggggttgatgacaaatcaagggaagttctgggctgtgccaaggagaatgtggatccggattcactgagaagaaagattgagcaggccatttacaagctcccatgcgtgcacttctgtcagccccaacgacccataactttcaccttaaaaatcgttaacgtcttaaagagaggcgagctgtacggttatgcttgcatgattagagttaatcccttctgctgcgctgtcttctccgaggcccccaatagctggattgtagaggacaagtatgtgtgttcgctcaccacagagaaatgggtgggtatgatgacagacaccgatccagacctactgcaactctccgaggatttcgaatgccaattatcactgagctctggtcctccattgagcagacctgtgtattccaaaaagggcctcgaacacaagaaggaactgcagcagctcctgttttccgtcccacctggatatctacgctacacgccagaatctctatggcgagacttaatttcagaacaccgggggctcgaggagctgatcaataagcagatgcagcctttcttcagaggaatcctcatcttctcacgatcatgggccgtggacctgaacctacaggagaagcccggagtgatctgtgatgctctgctcattgcacagaactcaaccccgatcctttacaccattctcagggagcaagacgctgaggggcaagattattgcacacggacggccttcactctgaaacagaagctggttaacatgggaggctacactggaaaagtttgtgtgcgcgcgaaggtgctgtgccttagccccgagtcgtcagccgaggcgctggaggccgctgtgtcgccaatggactatccagccagctattcactggcaggaacacagcacatggaagctctcctccagagtcttgtgattgtgctgctaggctttcgatcactgttaagcgatcagctaggctgtgaggtgttgaacctactaacagcccagcagtatgagattttttcacgctctctccggaagaaccgagagctgtttgtccacggcctcccagggtctgggaaaacaatcatggccatgaagattatggagaaaattagaaacgtattccattgcgaggctcacaggattctgtatgtatgtgaaaatcagcccttacgtaacttcatcagcgaccggaacatttgccgtgccgaaactcgcaagaccttcttgcgcgagaactttgagcacatacagcacatcgtaattgacgaggcccagaatttcagaaccgaggacggagattggtacggcaaagccaagagcattactcgaagagctaagggcggcccgggaatcttatggatctttctggattacttccagacctcacatctggactgcagcggccttcccccgctctcagaccagtaccctcgcgaagaactgaccaggatcgtgcgaaacgccgaccccatagccaagtacctacagaaagagatgcaggtgattagatccaatccctcctttaacattcccaccgggtgtctcgaagtgtttcccgaggctgagtggtcacagggcgtgcaggggacactgaggatcaagaagtacttgacagtagagcagatcatgacgtgcgtcgccgatacatgtaggcgctttttcgaccgggggtatagccctaaagatgttgccgtgctggtcagcactgctaaggaggttgagcattataaatatgagctcttgaaggcgatgagaaaaaaacgtgtggtccagttgtccgatgcttgtgatatgctgggcgatcatattgttcttgatagtgtccgccggttctcgggcctggagagaagcattgtcttcgggattcaccctcgcactgcagacccagccatactgccgaatgtgctgatttgtctggcctcgcgcgctaagcagcacctgtatatcttcccatggggtggtcactag

SEQ ID NO: 13168 - DNA, 2706 bp, Artificial Sequence
  Description of Artificial Sequence: Synthetic coding sequence
atggaagctaatcaatgccctctcgtcgttgaaccgagctatcccgacctggtaatcaacgtgggcgaagtgactcttggcgaggagaatcgaaagaagctgcaaaagatccaacgtgatcaggagaaggagcgggtcatgagagcagcctgcgcgctacttaacagtggaggaggggtcatccggatggccaaaaaggtggagcaccctgtcgaaatgggactggacttagagcagtccttacgggagctgattcagagctcggatcttcaggccttttttgagactaaacagcagggacggtgtttctatatttttgtgaaatcctggtcaagcgggccattcccagaagaccgcagtgtgaagcccagactttgcagcctcagctcaagcttgtatcggcggagcgagaccagtgttcggagcatggatagccgtgaggccttctgctttctgaaaaccaaaagaaagcccaagatcctggaagagggccccttccataaaatccataagggcgtataccaggaactgcctaattccgatccggcagacccaaattcagaccccgcagacctcatctttcaaaaggattacctcgagtacggggaaattctgccttttccagaatctcaactagtggagtttaaacagttttccactaaacattttcaggaatacgttaagagaacaattcccgaatatgtgcctgccttcgccaacaccggcggcggatatttgttcattggggtcgatgataaatccagggaggtgttaggctgtgctaaggagaatgtcgatcctgactcactaaggagaaagatcgaacaggcaatatacaagctcccttgcgtgcatttctgccagccccagagaccaatcacattcactttaaagatcgtgaatgttttgaagcgaggagagctgtatggctacgcttgcatgatccgcgtgaacccattttgttgtgccgtgttcagcgaagctccgaattcgtggatagtggaagataagtacgtctgcagtttgactacagaaaaatgggtgggcatgatgactgacaccgacccagatctcctccagctgtctgaggactttgagtgtcagctctctttgagcagtggcccacctctttctcggcctgtgtatagcaagaaaggcctggaacataaaaaggaattacagcagctgctctttagcgtgcctccaggatacctgagatatacccctgagtccctgtggcgtgacctaatttctgaacaccgaggactagaggaactgatcaataagcagatgcagccattttttcgaggaatactgattttctcacgcagctgggccgtcgacctgaacctccaagaaaaacctggggtgatctgtgacgccttattgattgctcagaattcaacccccattttgtacactattctccgagaacaagacgcagaggggcaggactactgcacacgtaccgcgttcaccttgaagcaaaaacttgttaatatgggtgggtacactggtaaggtctgcgttcgagcaaaagtgctttgtctcagcccagaaagctccgctgaagcgttggaagcagctgtgtcccccatggactaccctgcgtcctactcgctcgctgggactcagcacatggaagccctactacagagcctggttatcgtgttgctcgggtttagaagcctgctctcagaccagctaggctgtgaagtacttaacttactgacagcgcaacagtacgaaatattctcaaggagcctccgcaaaaacagggagctctttgtccacgggctgccaggatctggaaaaacaatcatggctatgaaaattatggaaaaaatcagaaacgtctttcattgcgaggcgcacaggatcctgtacgtttgtgaaaaccaacccctacgaaattttatcagcgataggaacatatgtagagctgagactagaaagacctttctccgggagaatttcgagcatattcagcacattgtgatcgatgaagctcaaaactttcgaacagaggatggagactggtacggaaaagcgaagagcatcaccaggagggccaaaggagggcctggaattctgtggatatttttggattattttcaaacttcacatctggactgctcgggactccccccactgtcagaccagtacccgagggaagaactgacgcgcatcgtgaggaatgccgatcccatagcgaagtacctgcaaaaagagatgcaggtcatcagatcaaatccctcattcaatatacccaccggctgtctggaggtatttcctgaggcggaatggagtcagggcgtgcagggtaccctgcgaatcaaaaagtatctcacagtcgagcagataatgacatgcgtcgctgatacctgtcgccgctttttcgatagaggatattccccaaaggacgtggcggtgctagtttctactgccaaggaggttgagcactacaagtacgaattgctcaaagctatgcgcaagaagagggtggtccaattaagcgacgcttgtgacatgctgggggatcatattgtgttagacagcgtgcggcgcttctctggcctggagcggagcattgtgttcggaattcacccccgaactgctgaccctgccattctccctaatgttctcatctgcctggcctcccgtgccaaacagcatctttacatatttccatggggcgggcactag

SEQ ID NO: 13169 - DNA, 273 bp, Artificial Sequence
  Description of Artificial Sequence: Synthetic coding sequence
atggaggccaatcagtgcccgcttgtggttgagccttcttatcccgatttggtgatcaacgtgggcgaagtaacccttggcgaagagaatcggaagaagttgcaaaagatacagagggaccaggagaaggagcgcgtgatgcgggccgcctgcgccctgctcaacagtggggggggtgtcatacgtatggccaagaaggtcgagcaccctgtggagatgggactcgatctggaacagagcctgagggaactgattcagagttccgacctgtag

SEQ ID NO: 13170 - DNA, 273 bp, Artificial Sequence
  Description of Artificial Sequence: Synthetic coding sequence
atggaggctaatcaatgccccctggtggtagagccttcttaccctgacttggtgatcaacgtcggagaggtgacactgggcgaggagaatcggaagaagctccagaaaattcaacgggaccaggagaaggaaagagtgatgcgggccgcctgtgctcttctgaatagcggcggtggcgttattcgaatggccaagaaagtcgagcatcctgtcgaaatggggctggatttggagcaaagcctgcgggagctcattcaaagctccgacctatag

SEQ ID NO: 13171 - DNA, 273 bp, Artificial Sequence
  Description of Artificial Sequence: Synthetic coding sequence
atggaagcaaaccagtgccccctggtagtggaaccatcttatcccgaccttgtcattaatgtaggggaagtcaccttaggggaagaaaatagaaagaagttgcaaaagatacaaagagatcaggagaaagagagggtgatgagagcggcatgcgcactgctaaattctggtggaggagtcattagaatggctaagaaggttgagcatcctgttgaaatgggcctggacctcgagcaatccctgcgggagttgatccagagctccgatttgtag

SEQ ID NO: 13172 - DNA, 606 bp, Artificial Sequence
  Description of Artificial Sequence: Synthetic coding sequence
atgtcattcgcgacactccggccggcacccccagggcgttacctgtaccccgaagtttcccctctgtctgaagacgaggaccgtggctccgattccagcgggtctgatgaaaagccgtgccgagtacatgccgcgagatgcggacttcagggtgcccgtcgcagggctggtggacgtagggcaggaggcgggggaccgggcggaagaccgggaagagaacccaggcagcgacacaccgcaaatgcccgagagcgagaccgaacaaatagcgtaaatactgcatttacggctttaaggaccctgattcccacagaaccagcagatagaaaactgtcaaagatagagaccttgcgcctggcatcttcctacatttcacatcttggaaatgtgttactggccggtgaagcctgcggcgatgggcagccctgccatagcgggccagcgtttttccacgctgctagagctggcagcccgccgcctccgccacccccaccccctgcccgcgacggagaaaatacgcaaccaaaacagatttgtacattctgtttgtctaatcagcgcaagttatcgaaggacagggacagaaagacagccatccgctcttag

SEQ ID NO: 13173 - DNA, 2472 bp, Artificial Sequence
  Description of Artificial Sequence: Synthetic coding sequence
atgaatggcgaacaacagttggacgctgatgctggttctggtatggaggaggtagagttaagctgggaagattatcttgaagagacaggctccactgctgttccctacggatccttcaagcacgtggatacccgcctgcagaacggctttgcgcccggcatgaagctggaagtcgcagtgaggactgaccctgaaacctactgggtggcaactgtaattaccacttgcgaacagctcctccttctgcggtacgacgggtacggagaggacaggcgtgcagatttttggtgcgacattcgaaaggccgatctgtatcccatcggatggtgcgagcaaaacaagaaaaccttggaggccccagaggggattcgggataaagtgtcggattgggatgaattcctccgccaaacactgattggcgcatgcagcccccccgtcccgctgctggaaggcctgaggaacggccgtaatccactcgacttgatcgctccagggtctagactggagtgtcaagcttttcaagattctctgtcaacctggattgtgacagtggtggagaacattggcgggcgcctcaagcttcgctacgaagggttagaatcgagcgacaattacgagcattggttatactaccttgacccttttctccaccacgtggggtgggccgctcagcagggctacgagttgcagccacccagcgcaattagacacttgaagaacgaggccgaatggcaagaaatcctcgccaaagttaaggaggaagaggaggagcctcttccttcatacttgtttaaggataaacaggtcatcgggattcacaccttctccgttaatatgaaactcgaggccgtggatccctggtctccttttggcatttccccagctaccgtcgttaaggtatttgacgagaaatacttcctggttgaaatggatgacttgagacccgaaaaccatgctcgcaggagtttcgtgtgtcacgccgactcccctggaatcttcccagttcagtggtccttgaagaatgggctacacatctctcccccacccggatacccaagccaggattttgactgggccgactatttgaaacagtgtggcgcagaagccgcaccccagcggtgcttccctccactgatcagtgagcacgagtttaaggaaaacatgaagctcgaagccgtaaacccaattcttccagaagaagtgtgtgtggctacgatcacggctgttcggggcagttacctctggctgcagctcgagggatccaagaagcctatccccgagtgcatcgtctctgttgagtctatggacatcttccctctgggttggtgtgagacgaatggccaccccctgagcacaccacgacgtgcccgcgtgtataaacaacgaaaaatcgcggtggtgcaaccggaaaaacaggtacctagctctcggaccgtgcacgaaggcctaagaaatcaggaattgaacagtacggaatccgtgatgattaatgggaaatattgttgtccgaaaatttacttcaatcatcgttgcttctccggtccatatctgaacaaaggtagaatcgcagagctgccgcagtgtgtgggacccgggaattgcgtgctggtactgcgagaagtgctgacattactgatcaatgccgcctacaagcccagcagggtactccgggaactccagctggacaaggattcagtgtggcacggttgcggtgaggtcctcaaagccaagtacaaagggaagtcctaccgggctacagtagaaattgtgaagacggcagacagggtcaccgaattctgccgccagacatgcatcaagctcgagtgctgtccaaatctcttcggcccgagaatggtgcttgacaaatgttctgaaaactgcagtgtgctgaccaagacaaaatacactcattactacggaaagaagaaaaacaagcggatcggccgacctccgggaggccatagcaatctggcctgcgctctgaagaaagcctcaaagcggcggaaacgacgaaaaaacgtatttgtccataaaaagaagagatccagcgcctccgtggataacactccagctggatccccacagggatctggtggagaagatgaggacgacccggatgagggggacgatgactcactgtctgaaggtagcaccagcgagcaacaggacgaactacaagaagagtccgaaatgtcagagaagaagtcatgctcctcatctcccacgcagagcgagatttctaccagccttcccccggataggcaacgcagaaagcgcgaactgcggacatttagcttctcagatgacgaaaacaagcctccatccccgaaggaaattgatggacaggccttactcctgctgaccctgcccacagtgcaagaatgtatggacctgaaactggggcccgcaatcaaactgtgccaccatatcgaacggataaagttcgcgttctacgaacaattcgctaattag

SEQ ID NO: 13174 - DNA, 2601 bp, Artificial Sequence
  Description of Artificial Sequence: Synthetic coding sequence
atgaacggggagcagcagcttgacgcagatgctggatccggcatggaagaggtcgaactgtcttgggaagactacctggaggagaccggatctaccgctgtgccctacggatcgttcaagcacgtggataccaggctacagaacggctttgctccaggaatgaagctggaggtggccgtgcgcacggatcccgaaacttattgggtagctacagttatcaccacttgtgagcagttgctcctcctccgctatgacggttacggcgaagatcggagagctgatttctggtgcgacatcagaaaagccgacctatatccgatcggctggtgcgaacagaacaagaagacactggaagcacctgagggcatccgagacaaggtgagtgactgggatgagttccttagacagaccttaataggagcttgcagcccgcctgtcccactgctcgagggactaagaaatgggcggaaccccctggacctgatcgcccccggaagtaggctcgagtgccaagcgtttcaggactcactgtccacctggatcgtcactgttgtagaaaacatcggtggtcggttgaaactgagatacgagggcctggagtcgagtgacaattacgaacactggctctactatctcgatccatttctgcaccatgtcggctgggcagcccagcagggctatgaactgcagccacccagcgctatcagacacctcaagaatgaggctgaatggcaggagattcttgcaaaggtcaaagaagaggaagaggagcccttgccttcttacctgttcaaagataaacaggtcatcgggatccatacgttttccgtgaacatgaaactcgaagccgtggacccttggtcccccttcgggatctcacccgcaaccgttgtgaaagttttcgacgagaaatactttcttgttgaaatggatgacctgcgtccagaaaaccacgcacggcgaagtttcgtgtgtcatgcggactcccccggcatttttccagtgcagtggagcctgaagaacggcctccatattagcccacctccgggctatccatctcaggatttcgattgggccgactatctgaaacagtgtggagctgaggccgcccctcaacgttgttttccacccctcatttccgaacacgagttcaaggagaatatgaagctcgaagctgtcaaccctattctgcctgaagaggtctgcgtcgccactattaccgctgttcggggctcctatctttggctgcagttggaaggttccaagaagcctattcccgaatgcattgtttctgttgagtcaatggatatattcccgctgggatggtgtgagacgaatggacacccgttgagcacccccagacgggccagggtctacaagcagaggaaaattgccgttgtgcagccggagaaacaggtgccttcgtcgcgcacagtccacgagggcctccggaaccaggagttgaattcaaccgaatctgtgatgattaatggtaaatactgctgcccaaagatctatttcaatcatcggtgtttctctgggccctatctgaataaagggagaattgcagagctcccccagtgcgtcggaccaggcaactgtgtgttggttttaagagaagtcctgaccctcttaattaatgcggcttataagccttctagagtgctaagagagctccagctagacaaagacagtgtctggcacggctgtggcgaagtgctgaaggcgaaatacaaaggcaagagctacagagccaccgtcgagattgttaagaccgcagatcgtgttacagaattttgcaggcagacctgcataaagctggagtgttgccctaatctctttggccctagaatggttctggacaaatgctctgagaactgctccgtgcttacgaagaccaaatacacccactattacgggaagaagaagaacaagaggatcggccggccccccggggggcactcgaacttggcctgcgcactcaaaaaggcttccaagcggaggaagcggcggaaaaacgtgttcgttcacaagaagaaacggagtagcgcaagcgtggacaacacccccgctggatcacctcagggctcgggcggcgaggatgaggatgatcccgacgagggtgacgatgattccctgtctgagggctccaccagcgagcagcaagacgaactgcaggaggagagcgaaatgagcgagaagaaatcttgctcatcaagcccaacccaatctgagattagcacaagcctgcctcctgatagacaacgccggaagcgggaactaaggacattttcttttagtgatgacgaaaataaacctccaagccccaaggagatccgtatagaggtcgcagagcgactgcacctcgattcgaaccctttaaagtggtcagtggcagatgtcgtgaggttcataagatccactgactgtgctccccttgcaaggatctttctcgaccaggaaatcgatggacaagctttattgttactgaccctgcccactgttcaggagtgcatggatctgaagctcgggccagcaataaaactgtgtcaccacattgagcgcattaaattcgctttttacgaacagttcgccaactag

SEQ ID NO: 13175 - DNA, 2601 bp, Artificial Sequence
  Description of Artificial Sequence: Synthetic coding sequence
atgaacggggaacagcagcttgacgccgatgccggatcagggatggaggaggtggagctcagttgggaggactacctggaggaaaccggttccacagccgtgccgtacggcagtttcaaacatgtggacaccaggttgcagaatggattcgccccaggaatgaagctcgaagttgccgtccgcacggacccagaaacctactgggtcgccaccgttatcaccacttgtgagcagctattgttgctgcgctatgacgggtatggggaggatagaagggcagatttctggtgcgatataagaaaggccgatttgtaccctattggctggtgtgagcagaataagaaaacactggaggccccagaaggcatcagggataaggtctcagattgggacgagtttctgagacaaacattgatcggtgcatgctccccccctgtgccactgctggagggactcagaaacgggaggaacccactggacctgatcgctcccgggtctcgcctcgaatgtcaggcctttcaggattctctgagcacttggattgtgacagtggttgaaaatatcggagggagactcaaacttcggtatgagggtctcgagagtagcgacaattacgaacactggctgtactatctcgacccttttctgcatcatgtgggatgggcagcccaacagggatatgagcttcaacccccgtccgcaattagacacctgaaaaatgaggccgagtggcaggagattttggcgaaggtgaaggaagaggaggaggaacctctgccttcataccttttcaaggataaacaggtgattggcattcacactttttccgtgaacatgaagctagaggcagttgacccatggagtccctttggcatttccccagctaccgtggtgaaggttttcgatgaaaagtactttctcgtggaaatggatgacttacgtcctgaaaaccatgcccgccggtccttcgtctgccatgcagacagccccggaatatttcctgtccagtggtcactgaagaacggtctccacatcagtccgcctcctggttacccaagccaggatttcgattgggctgattatttaaaacagtgcggggcggaggcagcaccgcaacgatgcttcccacctctcatatctgagcatgaattcaaggagaacatgaagcttgaagcggtgaaccccattttgccagaggaagtctgtgtggcaacgatcacggctgttcgcggaagctatctgtggctacagctggaggggtcaaaaaagcccattcccgagtgcatcgtctccgtcgagtcaatggatattttccccctggggtggtgcgagactaacgggcaccccctctctactcctaggcgggccagagtgtacaaacagcgcaaaatcgctgtggtccagcccgagaagcaagtaccttcttcccgaacggtccacgaggggttacgcaaccaggagctcaattcaaccgagtcagtcatgattaatggtaaatactgctgtcctaagatctacttcaatcaccgatgctttagcggcccctatcttaataaggggaggatcgccgagctccctcaatgtgtgggacctggcaactgtgtgcttgtactgcgcgaggtgcttactttattgattaatgcagcctataagccaagtagagtgttgcgagaactgcagcttgacaaggactctgtgtggcacggctgtggcgaggtgttaaaagccaagtacaaagggaaaagctaccgggctaccgtggagatcgtgaaaaccgctgaccgcgtgaccgagttctgcagacagacctgcataaagctagagtgctgcccgaacctgttcggacccaggatggtgctcgacaagtgtagtgagaactgctctgtcttgacaaaaaccaagtacacacactactacggtaagaagaagaacaagcgaattgggagacctcccggaggtcacagcaatttggcttgcgctcttaaaaaggcctcaaaacggcgcaagaggcgcaagaatgtgtttgttcataaaaaaaaaagaagctcggcctccgtcgataacacaccggccggctccccacagggaagcggcggagaggacgaagacgaccctgacgagggtgacgacgacagcctgtccgaaggaagtacaagcgagcagcaagacgagctgcaggaggagagtgagatgtccgaaaagaagtcctgctcttcttcaccaacacagtccgaaattagcacctcccttcccccagatagacagagacggaagcgcgagctccggacgttcagcttttccgacgatgaaaacaaacctccttcccctaaggagatccggattgaagtagcggagaggttacacctggactcaaaccctctgaagtggagcgtggcagacgtggtaaggtttattcgttccactgactgcgccccgcttgcccgcatttttttggaccaagaaattgatgggcaggcccttttgttgctgactctaccgactgtgcaggaatgtatggatcttaaattggggccagccatcaagctgtgtcatcatatcgagaggatcaaatttgcgttctatgagcagttcgccaattag

SEQ ID NO: 13176 - DNA, 2601 bp, Artificial Sequence
  Description of Artificial Sequence: Synthetic coding sequence
atgaatggggagcagcagctagacgctgatgccggatcaggcatggaagaggtggaactgtcctgggaagattaccttgaagaaaccggttcaacagctgtaccctacggtagcttcaagcacgtcgataccaggctgcagaacggctttgcccctggcatgaagctggaggtggcagtgcgcacggatcctgaaacgtactgggtggcaactgtgattacgacctgtgagcagctcctcctccttcgttacgacggctacggcgaagatcgtcgcgccgacttctggtgtgacatccggaaggcagatctgtaccctatcggttggtgcgagcaaaacaagaagacactggaagcaccagagggaattcgtgataaagtttccgactgggacgaattcctacgccagactctcattggcgcttgtagcccccccgtgccactcctggaggggctgcggaacggaagaaaccctctggatctcatcgcacctggcagccgcctggagtgccaggcctttcaggactctcttagcacatggatcgtaacggtggtcgagaacattgggggtcggctcaaactgcgatatgagggactagagagtagtgataactacgaacattggctgtactaccttgaccccttccttcaccatgtgggatgggccgcccaacagggctacgaactgcaacctccttctgccataaggcacctgaaaaatgaggctgagtggcaggaaatcctggcaaaagttaaggaagaggaggaggaacctctcccaagctacctcttcaaagataaacaagtaattgggatccataccttttcagtgaatatgaagttggaggccgtggacccctggtctcccttcggtatctccccggcgacagtcgtgaaggtgttcgatgagaagtattttctggtcgagatggatgacctccggccagaaaaccacgctaggcgctctttcgtgtgccatgccgacagtccagggatttttccagtgcagtggagtctgaagaatgggttgcatatatcaccaccgccagggtatccctctcaggattttgactgggctgactacttgaaacagtgcggcgcggaggcagccccacagcgctgtttcccccccctaatttctgagcatgagttcaaagaaaacatgaagctggaggccgtcaacccaatcctcccggaggaggtgtgtgtggccactatcaccgctgtgcggggttcgtacctttggttacagctcgagggttctaagaaacccatcccagaatgcattgtcagtgtagaatctatggatatattcccactgggctggtgtgagaccaacggtcatcctctgtcgaccccaaggagggccagagtatacaaacaacggaagatagctgtagttcagcctgagaaacaggtccccagttctcgcacagttcatgaggggctgcggaaccaagagttaaattccacagaatcagtcatgatcaacggaaagtactgttgtcccaaaatctactttaatcaccgctgctttagcgggccctacctgaataagggtcgaatagcagaactcccacagtgcgtggggccaggaaactgtgtgctggtcttgcgcgaagtcttgacattgctcatcaatgccgcgtataaacccagtagagtactgagagagcttcagctagacaaggatagcgtgtggcacggatgcggcgaggtacttaaggctaagtacaaaggaaaaagctatcgtgccacagttgagatcgtgaaaacagctgaccgcgttactgagttctgccgccagacctgtattaagttggagtgctgcccaaacctgtttggtcctaggatggttttggataagtgtagcgagaactgcagcgtgcttacaaaaacaaaatacacccactactatggaaagaaaaaaaacaaaagaatcggcagaccccccggggggcactccaatctggcctgcgctctgaaaaaggccagtaagagaagaaaaaggcgtaagaacgttttcgtgcataaaaagaagcggagtagcgctagcgtggataatacccccgcaggcagcccccagggcagcggaggagaggatgaagatgaccctgatgagggcgatgatgatagcttaagtgaggggagcacctcagagcagcaagatgaattgcaggaagagtcagagatgagtgaaaagaaaagctgttcttccagccctacacagagtgagattagcacatctctccctcctgaccgccaaagacgaaaaagagagctgcgcaccttcagctttagcgatgacgagaacaaacctccatcccccaaggagatcagaattgaggttgccgagaggcttcaccttgacagcaatcctttgaagtggtcagtggctgatgtagtcaggtttatccgcagcacagattgtgctccattggctaggatcttcctcgatcaggaaatcgacggacaggctctattgcttctcacattacccactgttcaagaatgtatggacctcaagctgggccctgctataaagctgtgccaccatatcgagaggataaagttcgccttctatgaacagttcgctaattag

SEQ ID NO: 13177 - DNA, 366 bp, Artificial Sequence
  Description of Artificial Sequence: Synthetic coding sequence
atgaacggagaacagcagctcgacgccgacgccggatcaggtatggaagaagtggagctctcctgggaggattatctcgaagaaacggggtcaacagctgttccatatggctcattcaaacacgttgacacccgcctccagaacgggttcgcccctggcatgaagctggaagtcgccgtgaggacagaccccgagacttactgggtggctacagtgatcaccacctgcgagcaactcttgctactgcgttatgatggctacggcgaagatagacgcgctgacttttggtgtgacatacgaaaggccgatctgtaccctataggttggtgtgagcagaacaagaagactctggaggcacccgagtag

SEQ ID NO: 13178 - DNA, 285 bp, Artificial Sequence
  Description of Artificial Sequence: Synthetic coding sequence
atgaacggggaacagcagctcgatgcagacgccgggtccggtatggaggaggtggaactgagctgggaggattacctggaagagacagggagtactgctgttccctacgggtcgtttaaacacgtcgatacaagactccagaacggttttgcgcctggaatgaagctggaggtagcagtcaggaccgacccagaaacctactgggttgccactgtgatcacgacctgtgaacagctgctcctgctgcggtatgacggatatggagaggaccgccgcgccgactag

SEQ ID NO: 13179 - DNA, 153 bp, Artificial Sequence
  Description of Artificial Sequence: Synthetic coding sequence
atgaacggggaacagcagctggatgctgacgcaggttctggtatggaagaggtggaactgagttgggaagactacttggaagagaccgggagtaccgctgtgccatacggctcgtttaagcacgtggacacccgcctacaaaatggcttctag

SEQ ID NO: 13180 - DNA, 2685 bp, Artificial Sequence
  Description of Artificial Sequence: Synthetic coding sequence
atggaatccaccttaagtgcctccaacatgcaggacccaagctccagtccactcgaaaaatgcctaggatccgccaacggaaatggagacctcgacagtgaggagggcagctctctggaggaaacaggcttcaattggggcgagtacctggaagagaccggagccagcgctgccccacatacctcattcaaacacgtcgagatctctatacagagcaacttccaacctggtatgaaacttgaagttgccaataaaaataacccggatacctattgggtggccactatcattacaacatgcggccagctgctgttactgcggtactgcggatacggggaggaccggagggccgatttctggtgtgatgtggttatcgccgatctgcatcccgtcggctggtgcacccagaataacaaggttctcatgccacctgacgccattaaggagaagtatactgactggaccgaattcttgatcagggatttgactggctcgcgtacggccccagctaatcttctggagggacccttgagaggaaaaggccctattgatctgatcactgtgggcagcctgattgaactccaggacagccagaatcctttccaatactggatcgtttccgtgattgagaatgtcgggggtcgcctgagactgagatacgttggcctggaagacactgagagttacgatcagtggttgttctatcttgactatcgcctgcgccctgtgggatggtgccaggaaaacaaatatcgtatggatcctccttctgagatctaccctctgaagatggccagtgagtggaagtgcaccttagagaagtcactgattgacgccgctaaattccctctgcctatggaagtgtttaaggaccatgccgacctgcgcagccatttctttaccgttggaatgaagcttgagacagtcaatatgtgtgaaccattttatatcagccctgcctccgttaccaaagtgtttaataaccacttttttcaggtgaccatcgacgacttgagaccagagccttctaagctctcaatgctctgccacgccgatagcttgggtatcctgccagtgcagtggtgtctcaagaacggcgtatcactgactccgcctaagggatacagtgggcaggacttcgactgggcagattatcacaagcagcacggcgcccaagaagccccgcccttttgttttcggaacacttctttttctcggggtttcaccaagaacatgaaactcgaggccgtgaacccaagaaatcctggcgagctctgtgtcgcatcagtggtctccgtgaaaggcagacttatgtggttacacctggaagggctgcagacccccgtgcccgaggtcatagttgacgttgagtcaatggatatctttccagtgggatggtgcgaggccaactcttacccgctcacggccccacacaaaacggtgagtcagaagaaacgcaagatcgccgtggtgcaacctgaaaaacagttgccacccacagtccccgtgaaaaagatcccgcatgacttgtgtcttttcccacatctcgacactactggtaccgtgaatggaaagtattgctgtcctcagctgttcattaatcatcgatgcttctctggtccctaccttaataagggtagaatcgcggaattgccacagagtgtgggccctggaaagtgtgtcttggtccttaaagaagtgctgtcaatgatcataaacgcggcttacaagcctggaagagtactcagggagctgcaactggtcgaggaccctcactggaatttccaagaggaaacgctgaaagccaagtacaggggcaagacctaccgggccgtggtcaagatcgtgcgcacttcagaccaagttgccaatttttgccgacgcgtctgcgccaagttggagtgttgccccaacctgttctcacctgtgctgatcagtgaaaactgccctgaaaattgttctatccataccaagactaagtacacgtactactacgggaagcgaaagaaaataagtaaacccccaatcggagagtcaaacccagactccgggcaccccaaacctgcacggaggcgtaagcgccgtaaatccatttttgtgcaaaagaaaagaagatcctcagccgtcgattttaccgcaggctctggagaggagagtgaggaggaggacgctgatgccatggacgatgacacagccagcgaagagaccggttcagaactccgggacgatcaaacagatactagctccgcagaggtgcctagcgctcgacctaggagagcagtgacgctgcgcagtgggtctgagccggtcaggcgccctcctcccgaaagaacacgcagagggcggggtgcgcctgccgcctctagtgccgaagagggcgagaagtgtcctcctacaaagcccgagggtacagaagatactaaacaggaggaggaggagagactagtcttggaatccaaccccctggaatggaccgtgactgacgtagtcaggttcatcaagctgaccgattgtgcccccctggccaaaatcttccaagagcaggacattgacgggcaggcactgctccttctgactctgcccactgtccaggagtgtatggagctgaagttgggacctgctatcaagctttgtcatcagatagagcgcgtcaaggtagccttctatgcgcagtacgctaactag

SEQ ID NO: 13181 - DNA, 483 bp, Artificial Sequence
  Description of Artificial Sequence: Synthetic coding sequence
atggagagtactctgtcagcaagcaatatgcaggacccctcttcgagccccttagagaaatgcctggggtccgcgaacggaaacggggatctcgactcggaggaagggtcctcactggaggagactggattcaattggggggaatacctcgaagagactggtgccagcgctgcccctcacactagctttaaacacgtggaaatttccatccagtccaatttccagccaggtatgaagttggaggtggctaataaaaataaccccgatacgtactgggtcgccactattatcaccacctgcggccagttattgctgctcaggtactgcggatacggggaggaccgacgggccgacttctggtgcgatgtggttatcgctgatctgcaccctgtcggttggtgtacccagaacaataaggtgctcatgcccccggacgtcgagagtgatgttaagccttctgcctctgttcagcacatttcctag

SEQ ID NO: 13182 - DNA, 561 bp, Artificial Sequence
  Description of Artificial Sequence: Synthetic coding sequence
atggaatccaccctcagcgcatccaacatgcaggacccaagtagcagccccctggagaagtgcctgggcagcgccaatgggaacggggatctagatagcgaggaagggtcttccttggaagaaactgggttcaactggggagaatatttggaggaaactggcgccagtgcagcccctcacaccagcttcaagcacgttgaaatatcgattcagtctaatttccaacccggcatgaaattggaggtggccaacaagaacaatcccgacacttattgggtggcaactataattactacatgtggccaacttctgctgcttaggtattgtggctatggggaggaccggcgggctgacttttggtgtgatgtcgtcattgccgacctgcatcccgtggggtggtgcacacagaacaacaaagtccttatgcccccggacgcaattaaagaaaagtacaccgattggaccgagtttctcatcagagatcttacaggtagtcgaactgcccccgctaacctgcttgaaggggtgtgcattgtagtgatacacctcatgtatttgtag

SEQ ID NO: 13183 - DNA, 483 bp, Artificial Sequence
  Description of Artificial Sequence: Synthetic coding sequence
atggaatccaccctctccgccagcaatatgcaagacccctcttccagcccactcgaaaaatgtctgggtagcgctaatggtaacggagatctggacagcgaagagggaagttccttggaggagactggtttcaactggggcgaatatttggaagaaactggggcaagtgccgccccacacacatcttttaagcacgtggagatctcaattcagtctaacttccagcccggaatgaaattagaggtagctaataagaataatcccgatacatattgggtggccactataatcactacatgcggtcagctgctgctattgcggtactgtggctatggagaggaccgcagagccgacttttggtgcgacgtagtgattgccgatctccaccctgttggctggtgtacccagaacaataaggtgttgatgcctccggatgtcgaatccgacgtcaaaccgagcgcctccgttcagcacataagttag

SEQ ID NO: 13184 - DNA, 2685 bp, Artificial Sequence
  Description of Artificial Sequence: Synthetic coding sequence
atggagtctactctgtccgcatccaacatgcaagacccctcttccagcccacttgagaagtgcctcggatccgccaacggaaatggcgatttggattccgaagaagggtcaagcctggaagagacaggattcaattggggcgaatatctggaggagaccggcgccagtgcagccccacacacttcctttaagcacgtcgaaatttctatccagtcaaactttcagccaggcatgaagttagaggtggccaacaagaataacccggatacctattgggtggctaccatcatcactacatgtggacagctgcttttgctgaggtactgtggctatggtgaggatcggcgtgctgacttctggtgcgacgtggtgatagcagacctacatcctgtcggatggtgcacgcaaaataacaaagtgttgatgcctccggacgcgatcaaggagaagtacaccgactggacagagtttctgataagggacctgaccgggagccgtaccgcccctgctaatctgttggaaggacctctgcggggaaaaggtcctattgacctaataaccgtgggttccctgattgagttacaggactcgcagaacccctttcagtactggattgtctccgtgatagaaaacgtggggggcaggctccgcctgcgctacgtggggctggaagataccgagtcctatgaccagtggcttttctatctggactaccgattaagacccgtggggtggtgccaggaaaataaatacagaatggaccctcccagcgagatttatccactcaaaatggcatctgaatggaaatgtacattggagaaatctctgattgatgccgctaaattccctctgcctatggaagtgttcaaagatcatgccgatcttaggagtcacttttttactgttggaatgaagcttgagacagtaaatatgtgtgagcccttttacatcagtccagctagcgtcacaaaggtcttcaataatcattttttccaggttacaattgatgatttgagacccgaaccatcgaaactatccatgttgtgtcacgcagactccctggggattctgcccgtacagtggtgcctgaaaaacggtgtgagcctcacaccccccaaagggtacagcggccaggactttgactgggccgactatcataaacagcacggcgcccaggaggccccgccattctgttttaggaatacctccttcagcaggggttttactaaaaatatgaaattagaagccgtgaaccctcggaatcccggtgaattgtgtgtcgcatccgtggtgagtgtgaagggtaggctgatgtggctgcacctggagggtctgcagacaccggtgcctgaagtgatcgtggatgtggagtccatggacatcttccctgtgggctggtgtgaggccaattcatatcctctgactgcacctcacaagaccgtctcacaaaaaaaaaggaagatcgcagtggtgcagcctgagaaacagctgcccccgaccgttccggtgaagaagatcccccacgatttatgtctttttccgcatcttgacaccacaggaactgtaaatgggaagtattgttgtcctcagttgtttattaaccatcgctgcttcagtggaccttacctgaataaaggccgtatcgccgaattgccccagtccgtggggcccgggaaatgcgtgttggtactcaaagaggttctatctatgatcataaatgccgcatacaagccagggagagtcttgagagaactgcagctcgtggaggacccgcattggaatttccaggaagaaacgctgaaggcaaagtacaggggcaagacctaccgggcagtggtgaagattgtccggaccagtgaccaggtggccaacttttgcagacgggtctgcgccaagctggagtgttgccctaatttattctctcctgtgttaatctcagaaaattgccctgagaattgttccattcacaccaagacaaagtatacgtattactacggcaaacgaaaaaaaatctccaagccccctattggcgaatcgaacccagacagcggtcatcctaaacccgccaggagaagaaagcgcagaaagagcatcttcgtccagaagaagaggagatctagtgccgtggactttactgccggttccggtgaggagagtgaagaggaagacgcagacgctatggatgatgacactgcctctgaagagaccggaagtgaactgcgtgacgaccagaccgatacttcaagtgctgaagtgcctagcgcaaggcccagaagggccgtgacgctgcgctccggaagcgagcccgtccgaaggccgccacctgaacgaacgcgcaggggccggggggcccctgccgctagtagcgctgaagagggggaaaagtgtcctcccaccaagccagagggtacagaggatactaagcaggaggaagaagaaaggctggtgctcgagagcaaccctctggaatggacagttacagatgtcgtgagatttattaagctgaccgactgcgctccactagcaaaaattttccaggagcaagacattgacgggcaggctctactgctactaacccttcctactgtgcaggagtgcatggaactcaaactaggaccagccattaaactgtgccaccagatcgagcgagtcaaggtggcattctatgcacaatacgctaattag

SEQ ID NO: 13185 - DNA, 924 bp, Artificial Sequence
  Description of Artificial Sequence: Synthetic coding sequence
atgcctcgatccttcctagtgaagaagatcaagggagatggctttcaatgcagtggcgtacccgctcctacttaccacccactggaaactgcctacgtattacctggcgccaggggaccacccggagacaatgggtacgcaccccacagactgcctccctcttcctatgatgctgaccagaaaccaggccttgaattggcccctgccgaacccgcttacccaccggccgccccagaggaatattccgaccccgaaagtcctcaatcatccctttccgcccgatacttcagaggagaggcagcagttaccgactcctatagcatggatgctttcttcataagtgacgggcgttccaggcgccggagggggggaggcggtggagatgccggcgggtccggggacgcggggggagcaggaggtcgggccggccgcgcaggggcacaggccggggggggacataggcatgcctgcgctgagtgcgggaaaacctacgcgacttcaagcaatctgagtcgtcataagcagacccataggtcgctggattcccaactggcccgcaagtgccccacatgtgggaaagcctacgtgagcatgccggccttggcaatgcatctgttgacccacaatctacgtcataaatgcggggtttgtggcaaggccttttctagaccttggctcctgcaaggccatatgcggtcccacaccggcgaaaaacccttcgggtgcgctcactgtgggaaagccttcgccgatcggtccaacttgcgtgcccacatgcagacccactctgcatttaaacattatcgttgtcgacaatgtgataaatccttcgcgctgaagagttacctccacaagcactgtgaggctgcctgtgctaaagccgctgaacccccaccaccgacccccgccggaccagccagctag

SEQ ID NO: 13186 - DNA, 2064 bp, Artificial Sequence
  Description of Artificial Sequence: Synthetic coding sequence
atgagcaacagaaataataacaagctgccatccaatctgccgcaactacaaaatctcataaagcgggatcccccggcgtatatcgaggagttcctccagcagtataaccactacaagagcaacgtcgaaatattcaagttacagccaaacaaaccaagtaaggagctggcagaattagtcatgttcatggcccagatctctcattgctatccagagtacctgtctaatttccctcaggaggtgaaagacctgctttcttgtaatcacacggtactggacccagacctgcgcatgacgttctgcaaagccttgattctgctgcgcaacaagaacttgattaatcctagttctctattagagctcttttttgaattgttcagatgccacgataagcttttgaggaagacactgtacactcatatagtgaccgatataaaaaacatcaacgcaaaacataaaaacaacaaggtaaacgtggtgctgcagaacttcatgtatactatgcttcgggatagtaacgctaccgctgccaaaatgagtctagacgtgatgatagaactctacagaagaaatatctggaatgacgccaaaaccgtcaatgtgattaccaccgcatgtttctctaaggtaaccaagattttagtggctgccctaaccttttttctaggtaaagacgaggatgaaaaacaggatagtgacagtgagtcagaagacgacggacccactgccagagacctactggtacaatacgcaaccgggaagaagtctagcaagaataaaaaaaaactcgagaaggctatgaaagttttaaaaaagcaaaagaagaaaaagaagcctgaggtttttaatttctctgcaattcacttgatccatgacccccaggactttgccgagaaactcctcaagcagctcgagtgttgtaaagagaggttcgaggtgaagatgatgctgatgaacctgatctcccgcctcgttgggatccacgaactgttccttttcaacttctaccccttccttcaacgttttctccagccgcaccagagggaagttactaaaatccttcttttcgcagcccaagcctctcaccatctcgttccaccagaaattatccagtccctgttgatgacagtggcgaacaattttgttacagacaagaattccggcgaagtgatgacagtgggcattaacgcaatcaaggaaattactgcccgctgtccactggccatgacagaagaactgcttcaggacctcgctcagtataaaactcacaaggacaagaacgtgatgatgagtgctaggacccttatacacctgttccgcaccttaaatccgcaaatgctccaaaagaaattccggggcaagcccacagaggcgtccatagaagcccgcgtacaggaatacggagaactagatgcaaaggattacattcccggagcggaagtgcttgaagttgagaaggaagagaatgctgaaaacgatgaggacggttgggagtcaacctctttgtccgaagaggaagacgcagacggcgagtggattgacgttcagcattcctccgatgaggaacagcaagaaataagcaagaagcttaattccatgcccatggaggaacgcaaagcaaaagccgctgctatttcaacatcccgagtcctcacacaggaggacttccagaaaattcggatggcacagatgcggaaagaactggatgccgctcctggcaagagccagaaaaggaaatacatcgaaatcgactccgacgaggagccaagaggtgaactgctgtcgcttcgagacatcgaaaggctgcataagaagcccaagtcagacaaagaaacacgcctcgcaaccgcgatggccggtaagaccgataggaaggaattcgtgcgcaaaaagaccaagactaaccccttttccagctctaccaataaggaaaaaaagaaacagaagaacttcatgatgatgcgttacagccagaatgtgaggagtaaaaataagcgatcttttcgagaaaagcagctggccttgagggacgccctcctgaaaaagcgaaaaagaatgaagtag

SEQ ID NO: 13187 - DNA, 786 bp, Artificial Sequence
  Description of Artificial Sequence: Synthetic coding sequence
atgtcccggtacacccggccgccaaataccagtttgttcatacgtaacgtggctgacgctactcggcccgaggacctgcggcgcgagtttgggcggtacgggccaatagtggacgtgtacattcctctcgatttttacactcgcaggccacgtggatttgcctatgtgcaatttgaggacgttagagatgcagaagatgccctgtataacctgaaccggaagtgggtgtgtggcaggcagattgagattcagtttgcacaaggcgatagaaaaacccccggccagatgaagtccaaggaacggcatccttgcagcccctctgaccaccgaaggtcccgctctccgagccagaggcgcactagaagccgttcctcctcatggggacgcaacagacgaaggagcgacagcctcaaagagagccgtcataggcggttctcttacagccaatctaaaagccgcagcaaatctcttccgaggcgtagcacatccgctagacagagtaggacccctaggcggaactttggatctaggggccggagccggtcaaaatctctgcagaaaagaagcaaatccataggcaaaagccagtcctcgagccctcagaaacagacctcctccggaactaaatcgaggagccacggccgccatagtgatagtatcgctcgttccccttgtaaaagcccaaaaggctacacaaactccgagaccaaagtgcagacggccaaacacagccattttcgttcgcattcccgaagccgtagctaccggcacaaaaactcatggtag

SEQ ID NO: 13188 - DNA, 1245 bp, Artificial Sequence
  Description of Artificial Sequence: Synthetic coding sequence
atgattcctctagaaaaacctggaagcggggggagctcgcctggcgctactagcggatcaggccgagctgggcggggactctccgggccgtgcaggcctcctcctccccctcaggcaagggggcttcttacggaaatccgcgcagtggtgaggactgaaccttttcaagacgggtattccctctgccccggccgcgaactaggtagaggcaaattcgctgtggtgaggaaatgcattaaaaaggatagcgggaaggagtttgccgccaaattcatgcgaaaacggagaaagggacaggattgcagaatggagatcattcatgagatagccgttctggagctcgcccaagataacccctgggtcattaacctgcacgaggtgtatgaaactgccagcgagatgatcctggttcttgaatacgccgctggcggcgaaatcttcgaccagtgcgtggccgatcgggaagaggcatttaaagagaaagatgtacagcggctgatgcgccagattctggaaggcgtccatttcttgcacactcgggatgtggtacacttggacctcaagcctcaaaacatcctgttaacctccgagagtcccctcggcgacatcaaaattgtggatttcgggcttagccgaatcctcaaaaacagcgaagaactgagagagatcatggggacaccagagtacgtggcaccagagattctgtcctacgaccccattagtatggctacagacatgtggtctatcggggtgttaacctacgtcatgcttacaggaatttccccgtttctgggcaatgataaacaggagactttcttaaacatttcgcaaatgaatttaagctactcagaggaagaattcgatgtgttatccgagagcgccgtggattttattcgtaccctgttggtgaagaaacctgaggaccgcgcaactgcagaagagtgcctgaaacacccatggctgacccaaagcagcatccaggagccttctttccggatggaaaaggcactggaggaggccaacgctctgcaggagggccacagtgtcccggaaataaactcggatacggacaaaagtgaaactaaggaatcgatcgtgactgaagaactcatcgttgtgactagctacaccctgggccaatgtcgacagtctgaaaaggagaagatggagcaaaaggctattagcaaaagatttaagtttgaagaaccgcttctgcaggagatcccaggcgagtttatctactag

SEQ ID NO: 13189 - DNA, 1062 bp, Artificial Sequence
  Description of Artificial Sequence: Synthetic coding sequence
atgagcctgcatacccagtacctggagtctttcctcaggtcccagttctacatgctccgaatggatggcccattgccgttgccttatcgacattacattgctattatgaaactggtgaaaaccggagagaacaactggagcttaccggagttagtgcacgccgtggtgctccttgcgcactaccacgcgcttgcaagctttgtatttgggtcaggcatcaatcccgagagagacccagagatcagtaacgggtttaggctgatctccgtcaataatttctgcgtatgcgacctggcaaacgacaataatatcgaaaatgcatcattgtccgggagtaactttgggatcgtggatagcttaagcgaactggaagccctgatggagaggatgaagaggttgcaggaggagcgagaggacgaggaggcctcacaagaggagatgagcacccgcttcgaaaaagaaaaaaaagaatcactctttgtcgtaagtggggacacgttccacagttttccgcactcggactttgaagacgatatgatcatcaccagtgacgtctctcgttatatcgaggatcctggttttggctatgaagactttgccaggcgaggagaggaacacttgcctacattccgcgcgcaggattacacctgggagaatcacgggttttctttggtcaaccgcctgtattccgacatcggacacctgctggatgaaaagtttcggatggtgtataacttgacttataataccatggccacgcacgaggacgtcgatactacaatgctgaggcgtgctctgttcaattatgtgcactgcatgtttggcattcgttacgatgactacgactacggcgaggtaaaccagctattagaacgcagcctgaaggtgtacattaagactgtaacgtgttatcctgagagaactacaaagcgcatgtacgactcatattggaggcaattcaaacattctgagaaggtccatgtgaacctgcttcttatggaggcccgtatgcaggctgagctcttgtatgcgcttcgagccataacacgacacctcacatag

SEQ ID NO: 13190 - DNA, 954 bp, Artificial Sequence
  Description of Artificial Sequence: Synthetic coding sequence
atgaacagaggcggtggatctcccagcgcggcagccaactacctcctctgtactaattgtaggaaggtgctccgtaaggataagcggatccgagtgagtcagccattgacacgagggcccagcgcatttattcctgagaaagaggtggttcaggctaacactgtggacgaacggaccaattttttagtggaggagtactcaacttccgggcgactggacaatatcacccaggtgatgtctttacacacacaatacctggaatccttcttgagatctcagttttacatgttacgcatggatggtcctctgccactgccctataggcattacatcgcgatcatggcagcagctcggcaccagtgtagttacctgatcaacatgcacgtggatgagtttttaaagaccgggggcatagccgaatggctgaatggcctggagtacgtgcctcagaggctgaaaaacctcaatgagataaacaagctgcttgctcaccgtccttggttgatcacaaaagaacacatccagaagctggtgaagactggagaaaacaattggtctctccctgagttagtgcatgcagtcgtccttctggcccactaccacgcgctggcatcatttgtgttcggaagtggtattaacccagagcgtgatccagagatttccaacggctttaggttgatttctgtcaataatttttgcgtgtgtgacctcgctaatgacaacaatattgaaaacgccagtctgagtggttcaaatttcggcatcgtggactctctatccgagctggaggccctaatggagcggatgaagaggttgcaggaggaaagagaagacgaagaggcctcccaagaagagatgtcaactcgctttgaaaaggagaagaaggagtcgctgtttgtcgtttccggggacacttttcattcatttccacatagcggactactgaaatactag

SEQ ID NO: 13191 - DNA, 966 bp, Artificial Sequence
  Description of Artificial Sequence: Synthetic coding sequence
atgaatcggggcggaggctccccaagcgcggccgctaattatctgctatgcacgaactgcagaaaggtgctaaggaaagacaagcgaataagagtcagtcagccacttacacggggacccagtgcctttatccctgagaaggaggttgtccaggccaatactgtcgacgaaaggactaattttcttgttgaggaatatagtaccagcggacgtctcgacaatatcacacaagtgatgtccctacacacacaatatctggagtcattcctacgtagccagttctatatgctccgcatggacggcccgctacctctcccctaccgtcactacatcgcgatcatggccgcggctagacaccagtgttcttacctgatcaacatgcatgttgacgagtttctcaagactggaggtatagccgaatggcttaatgggttagaatacgtcccacagcggctcaagaatctgaacgagattaataagttacttgcacatagaccttggctaattacgaaggagcacatccagaaactggtgaagactggagaaaataactggagtcttccggaattggtccacgcagtggttctgctcgctcactatcatgcccttgcttcttttgtgttcgggtcaggtatcaatcccgaacgcgatccagaaatctctaatgggttccgtctgatcagcgtgaacaacttctgcgtgtgtgatctggctaatgacaacaatatcgagaatgccagtcttagtggaagcaacttcggaatagtggacagcttgtctgaactcgaagccctaatggagaggatgaaacgtctgcaggaagaacgggaggacgaagaggccagtcaggaggagatgtctacacggttcgagaaggaaaaaaaggaatccctgtttgtagtctccggagatacctttcactcatttccacacagcggagcgtttcttcatttcttcgcgttctag

SEQ ID NO: 13192 - DNA, 1479 bp, Artificial Sequence
  Description of Artificial Sequence: Synthetic coding sequence
atgaaccgtgggggcggctcacccagcgcagccgctaattacctgctgtgcacaaactgccggaaagttcttagaaaggacaagcgcattagggtgagccaacctctgacccgcgggcccagcgccttcattccagaaaaggaagtggttcaggcgaatacagtcgacgaacgtaccaactttctcgtggaagagtactctacgtcaggacggctcgacaacattactcaggtgatgtctctacatacacagtacctggaaagctttctgcgatcccaattctacatgttaagaatggacggaccgcttcctctgccttaccggcattacattgctatcatggccgcggcaaggcatcaatgtagttatctgatcaatatgcatgttgatgagtttctcaagaccggcggaatagccgaatggctcaacgggctggaatatgtacctcagcggctgaagaacttgaatgagatcaataagctgctggcacatagaccctggctgattacgaaggagcacatacagaagctggtaaaaactggcgagaacaactggtcactgcctgagctcgttcatgcagtggttctcctggctcactatcacgcgcttgcctcattcgtgttcggttctggcataaacccagaaagagatcccgaaatatccaatggattccggctgataagtgtcaataatttttgtgtttgcgatctggctaatgacaataacattgagaatgcttcactgtccgggagtaacttcgggattgtggatagtctgagtgagcttgaggcactgatggagaggatgaaaagactccaggaggagcgggaggacgaagaggcaagtcaagaagagatgagtacaagattcgagaaagagaagaaggagagcctgttcgttgtcagtggtgatacgtttcacagttttccccactcagatttcgaggacgacatgatcattacaagcgatgtttcacgatatatagaagatcctggcttcgggtacgaagactttgcaaggcgaggggaggagcacctccccacatttcgggcccaggattatacctgggagaaccacggatttagcctcgtgaacagactgtactccgacatcgggcatctgctggacgaaaagtttcgaatggtctataacctcacttataatactatggcgacgcatgaggacgtagacacaactatgctgcggagagccctgttcaactatgtgcactgcatgttcggcattagatacgatgattatgattacggggaagtgaaccagctgctagaaaggtctctcaaggtatatatcaaaacagtcacctgctatccagaaagaacgactaaacgaatgtatgattcatattggagacaattcaaacattcagaaaaggtccatgtgaacttacttttgatggaggccagaatgcaggccgagttattatacgccctccgtgctattacgcgtcatttaacgtag

SEQ ID NO: 13193 - DNA, 891 bp, Artificial Sequence
  Description of Artificial Sequence: Synthetic coding sequence
atgggaaagaagtccagggttaagacccagaagtccggcacaggcgccacagccactgtctctcctaaggagatactgaacctcacgagcgagctactgcagaagtgctccagccccgctccaggccccggaaaagaatgggaggagtatgtacagataagaacactggtcgagaagattcgaaagaaacagaaagggctgagtgtgacattcgacggcaagagagaggattacttcccagatctcatgaaatgggcttcagagaatggcgcctctgtggaagggtttgaaatggtgaacttcaaggaggagggttttggcctgagagcgacccgcgacatcaaagccgaagagttgtttctttgggtgccccgaaaactcctgatgactgtggagtctgccaagaattcagtgttggggccgttgtattcacaggaccgcattcttcaggccatgggaaacattgcgcttgcatttcacctgttatgcgagcgggcctcaccaaactctttctggcagccgtacatccagaccctgccatccgaatatgatacacccctttacttcgaagaagatgaggtcaggtacctccaaagcacgcaagctatccacgacgtgttcagtcagtacaagaacactgcccgtcagtacgcatatttttataaggtgatccagacgcatcctcacgcgaacaagctcccacttaaagactctttcacttacgaagattatagatgggcagtttccagcgtaatgacacggcagaatcagattcccactgaagatgggagtcgtgtcacactagcgctgatccctctatgggacatgtgtaaccacaccaacggactcactcctgaggactcattcgccttagctgtggcctctgcctag

SEQ ID NO: 13194 - DNA, 1785 bp, Artificial Sequence
  Description of Artificial Sequence: Synthetic coding sequence
atgggaaagaagtcacgggtgaaaacccagaagtcagggactggcgctacagcaactgtgagccccaaggaaattcttaatttaacatccgagcttctacagaagtgtagcagtcccgcaccagggccaggtaaggaatgggaggaatacgttcagattcgcacgctggttgagaaaattcgcaaaaaacaaaagggtctgtcagtgacttttgacggaaaaagagaagactacttcccagatctaatgaaatgggcttcggagaatggggcttccgtggagggctttgagatggtgaactttaaggaggaaggatttgggctgcgggcaacaagggacatcaaggcagaggagctctttctgtgggtacccagaaaattgttgatgacagtggagtcggctaagaactcagtattggggcctctgtattcacaggatcgcatcttgcaagctatgggcaatatcgccctggcctttcatcttctttgcgaacgtgcttcacccaattctttttggcagccttatatccagactcttccaagcgagtatgataccccgctgtacttcgaggaagacgaggttaggtacctccaaagtacccaggctatccatgatgtgttctcccagtacaaaaacaccgcacgccagtacgcctatttttacaaggtaatccaaacccacccgcacgcaaacaaactcccattaaaagattccttcacatatgaggactaccgttgggcagtttcctctgtcatgacacgccaaaaccagataccaaccgaagatggatcaagagttacgctcgccctgatccctctttgggatatgtgcaaccacactaacgggctgatcaccactggatacaacctcgaagatgaccggtgcgaatgtgttgctctgcaggattttcgcgccggggaacagatctacatcttctatggcactcgtagtaacgccgaatttgttattcattctggctttttttttgacaataattcgcacgatcgggtgaaaattaaacttggcgtaagtaaatctgatagattatacgctatgaaagccgaggtgctggctagagcaggaatacctacctcctctgtttttgcactccattttactgagccaccaatcagtgctcagctactcgctttcctgagagtattttgtatgaccgaagaggaactcaaggagcaccttcttggagatagcgcgatcgacaggatatttactctgggcaattcagagttcccagtgagctgggataatgaggtgaagttgtggactttcctcgaggaccgggcatccctcctcctaaagacctacaaaacgactatagaggaagataaatcagtcctgaagaatcacgacctgagtgtccgggcgaagatggccatcaaactgcgactcggggaaaaagaaatccttgagaaagccgtgaagtcagctgccgttaatagagagtattaccggcagcagatggaagagaaggcaccgttacccaagtatgaagagtctaacctgggtctactggagtcttcagtcggagactctcgattgcccctggtactgagaaacctggaggaagaggcgggtgtgcaggacgccttgaacatccgcgaagcaatttccaaggccaaggccacggaaaacgggttagttaatggtgagaactcaatccccaacggcacgcgaagcgagaacgagagtctgaaccaggaaagcaagcgagctgtggaagacgctaaggggtcttcctccgattcaacagccggcgttaaggagtag

SEQ ID NO: 13195 - DNA, 975 bp, Artificial Sequence
  Description of Artificial Sequence: Synthetic coding sequence
atgcctgagttggctgtccaaaaggttgtcgtccatccattagtgctgttaagcgtcgttgaccactttaacaggatcgggaaagtcggcaaccagaagagggttgtgggagttctcctggggagctggcagaaaaaggtcctggacgtgtcaaattccttcgctgttcctttcgacgaggatgacaaggacgactccgtttggtttctggatcatgattatctggagaatatgtacggtatgtttaagaaagttaatgcaagggagcggatcgtcggatggtaccacaccggtccaaagttacacaagaacgatatagcaattaatgagcttatgaaacggtactgtccgaacagtgttctggtgataatcgatgtgaaacctaaagatcttggccttcctactgaagcttacatcagcgtcgaagaggtgcacgacgacggaacacctacttcgaagacttttgagcacgttacttcggaaatcggggctgaggaagcggaagaggttggtgtggagcaccttctaagagacataaaggatacaacggtaggaaccttgagtcagcggattaccaatcaggtccacggccttaagggcttgaacagcaaactcctggacattagatcgtacttggaaaaggtggctacgggaaaactgccaatcaaccaccaaatcatctatcaattgcaggacgtcttcaatctgctccccgatgtaagcctgcaggaattcgttaaagccttctatctcaagacaaacgaccaaatggtcgtcgtctacctcgcatctctgatccgaagcgtggtcgctctacacaacctcattaacaataagatcgcgaaccgggatgcagagaaaaaggaagggcaagagaaagaggaaagcaagaaggataggaaggaggacaaagaaaaggacaaggataaggagaagtccgacgtgaaaaaggaagaaaaaaaggagaagaaatag

SEQ ID NO: 13196 - DNA, 1350 bp, Artificial Sequence
  Description of Artificial Sequence: Synthetic coding sequence
atggcaacccaggctaagcgacccagagtggctggccctgtggacggtggagacttagaccccgtcgcatgtttcctatcctggtgcagaagagtcggcctcgagctatctccgaaagtggcagtgtcaagacaagggacagtagcgggctacgggatggtggcacgggaaagcgtccaggccggtgagctgctttttgtggtgccccgagcggcgctgctgagccagcatacttgctctataggaggtttgctcgagcgggaacgggtagcgttacagagtcaaagtggttgggtccctctgttactggccttgctccatgaactgcaggcgcctgctagccgctggaggccatacttcgctctgtggcccgagcttggaaggctcgagcacccaatgttctggcccgaagaagagcgccgctgcctgcttcagggaactggcgtgccggaagccgtggaaaaagacttggccaatatccggtccgagtaccagagcattgtcttgccattcatggaggcacaccctgatctcttcagccttagggtgaggtctctcgaactgtatcatcagctcgtggccctggtgatggcctacagttttcaggaaccgctcgaggaggaagaagatgagaaagaacccaattctcctgtgatggtgccggccgcagatattctgaaccatctagctaaccacaatgccaacctggaatattcagccaattgcctaaggatggtcgccacacagcccattccaaaaggccacgaaatttttaatacttacgggcagatggctaactggcagctgatacacatgtatggatttgtggagccttatccagacaataccgacgacactgccgacatacagatggtaaccgtgcgtgaggcagcactccaaggcacaaagaccgaagccgaacgccatctggtgtacgaacggtgggactttctctgtaaactggaaatggtgggagaggaaggcgccttcgtgatcgggagagaggaagtcctgacggaagaggagctcactacgactctgaaagtactgtgtatgcccgctgaggaatttagggagctcaaagaccaggatggagggggcgatgataaaagggaggagggctcattgacaatcactaacatacccaaactcaaagcttcatggagacagctgctgcagaacagtgtgcttctgaccttgcaaacctacgcgactgacctcaagacagaccagggactcctgtccaacaaggaagtttacgccaagctctcttggcgcgagcagcaggccctccaggtacgctacggacaaaaaatgatcctccatcagctgctggagctgacctcgtag

SEQ ID NO: 13197 - DNA, 372 bp, Artificial Sequence
  Description of Artificial Sequence: Synthetic coding sequence
atggccacccaggcaaaacggcccagggtggccggccctgtggacggaggtgacctggaccctgtcgcttgcttcctaagctggtgccggagagtgggactcgaactgtcgcccaaagtgagcgaaagggcagctgggcgcgccccagtcgctgctcacttactgcaccgcagacccgcaggcgcccgcgcctcttgtgcggccgaaccagtaggcctgggagccactgccgcaggggcagcacctcgagctgctggccccgggttaactttggaggctttgctctgcgccttagcgagagcggggcccctaggtgccccggacgtcctggtgcgcgctcttggaggggtgggggagcgcctccatcgctag

SEQ ID NO: 13198 - DNA, 810 bp, Artificial Sequence
  Description of Artificial Sequence: Synthetic coding sequence
atgcttttcttcactcagtgcttcggcgctgttcttgacctcatccacctgcgctttcagcattataaagccaaacgggtgttcagtgcagccggacagctggtatgcgtagtaaatcccactcacaacctgaagtacgttagctctaggcgcgcagtcacccagagcgccccagagcagggatcttttcatccgcaccatttatcccaccatcactgccatcacagacatcaccatcacttgagacaccacgctcatccccaccacctgcaccatcaggaggcgggactgcatgcgaaccctgttacaccctgtctttgtatgtgcccactgttctcctgtcagtgggaggggcgattggaagttgtggtaccacacctaaggcagatacacagggtcgatatccttcaaggggccgagatcgtcttcctggccaccgacatgcacctgcccgcacccgcagactggattatcatgcactcctgcctgggtcatcacttcctgctggtgttgcgaaaacaggagcgccatgaaggtcatcctcagttttttgcaacaatgatgctcatcggcactcccacgcaagctgactgtttcacctatcgcttagagctgaacaggaatcaccgacgcttaaagtgggaggcaacgccccggagcgtgttggaatgtgtggactccgtgattaccgatggggattgtctagtgctgaataccagcctggcccaactcttcagcgacaacggcagcttggccatcggaatcgccatcaccgcaaccgaggtgctgccatctgaagccgaaatgtag

SEQ ID NO: 13199 - DNA, 1983 bp, Artificial Sequence
  Description of Artificial Sequence: Synthetic coding sequence
atgcttgtgtgttattccgtacttgcatgtgaaatcctctgggatttgccttgtagtatcatgggttctcctctgggccacttcacatgggataagtatctcaaggagacttgcagtgtcccagcccccgtgcattgcttcaagcagtcctacacccccccatcaaacgaatttaagatatcaatgaagttagaagctcaggacccacgcaacaccacgtccacatgcatcgctaccgtggtcggtttaacaggggcccgtctcaggctgaggttggacggctcggataataaaaatgacttctggcgcctggtagattccgccgagatccagcccataggaaactgcgaaaagaatggaggcatgctacagccacctctcggtttcagattgaatgcaagcagctggccaatgtttctgctgaagacccttaatggcgcggaaatggctccgattcgcatcttccataaagagcctccttccccttctcataacttctttaagatgggtatgaagctggaagccgtggatagaaagaatcctcactttatctgcccagccacaataggagaggtgaggggctccgaggttttggtgacttttgacggatggcgtggggcattcgactactggtgcagattcgattcccgcgacattttcccagtgggatggtgcagccttaccggagataatcttcagcctcccggcacaaaagtcgtgatcccaaaaaacccatatcctgcgtctgatgtcaataccgaaaagcccagtatccatagtagcactaagaccgtcctggagcatcagccaggacagaggggacgaaagcccggaaagaagagaggacgcacgcccaagactcttatttctcaccctatctcagccccctcaaaaaccgctgagcctcttaagttccccaaaaaaaggggtccgaaacctggttcgaagcgtaaacccagaacactgctgaacccccccccagctagccctaccacgagtactcctgaaccggatacctccactgtacctcaggacgcggccacaatacccagcagtgccatgcaggccccaacagtctgcatttatctgaataaaaatggaagcactggaccccaccttgataaaaagaaagtgcagcagctgcccgatcactttggacccgctagagctagcgttgtattacaacaggccgtgcaagcatgcatcgactgtgcgtaccatcagaagacggtgttctcttttcttaagcagggccatgggggcgaagtgatctccgccgtcttcgaccgggaacagcataccctgaatttgccagctgtcaactcaattacatacgtgctgaggttcctcgagaaactgtgccacaacctgagatccgacaatctgtttggaaatcagcccttcactcagacccatctctctctgactgcaattgagtactctcatagccatgataggtacttgcctggggagacatttgtgctcggaaattctcttgcacggtccttagaaccccattccgactcgatggactccgcatccaatcccactaatctggtgtcaacttcacagagacaccgcccccttctgtcttcttgcggcctgcctccgtctaccgcatcagcagtgcgaaggctgtgttcaagaggagtgctgaaagggagcaatgagcggagggacatggagtctttctggaaacttaatcgctcgcctggctccgatcgctacttagagtcccgggacgcaagccggctcagcgggcgggatccctccagttggaccgtcgaagacgttatgcagtttgttagggaagcggatcctcagctgggcccgcacgccgatcttttcagaaaacacgagattgacggaaaggcactcctattgctcagatcagacatgatgatgaaatatatgggactcaaactaggacccgctctgaaactttcttatcacattgaccgcctgaaacaaggaaaattctag

SEQ ID NO: 13200 - DNA, 1947 bp, Artificial Sequence
  Description of Artificial Sequence: Synthetic coding sequence
atgcagccaaatgtcattgattggtcggatgtgagaaaacacaagtacggccatttgagcgagtccgcaagccaatatcaggaagcagccgatattctcgatctcgggcattttacctgggataaatatctgaaagaaacctgctcagtgcccgcccctgtgcactgttttaagcagtcgtatactcctcctagtaacgagtttaaaatcagcatgaagctggaggcacaggacccacggaacactacatccacctgtatcgccaccgtggtggggcttacgggggcccggctgcgcctgagactggacggtagtgataataagaatgacttctggcggttggtagacagcgctgagattcagcctatcgggaactgcgaaaaaaatggtggcatgctgcaaccacccctgggcttccgcttaaacgcatcttcatggcctatgttcctgctgaaaacactgaacggggccgagatggctcccattagaatatttcacaaagagccacccagcccaagccacaacttctttaagatgggtatgaaactcgaggcagtggatcggaaaaatccacattttatttgtccggccaccattggcgaggtgagggggagtgaagttctggtgacgtttgatggctggcggggcgcgttcgactattggtgcagattcgacagccgggatatattccctgttggctggtgttcactgactggggataacttacagcccccaggcaccaaggtggtcattcccaagaatccctacccagccagcgatgttaatactgagaaaccctccattcatagctctaccaagactgtactcgaacaccagccaggacagcgcgggagaaagccgggcaagaagagagggagaactcccaagacattaatatctcaccctatctctgcaccatctaaaacggcagagcctctcaagttccccaaaaagcgcgggcccaaacccgggagtaaacggaagcccaggactttgctgaatcctcctccagcttctccaactacgagtacgcccgagccagacacaagcacggtgccacaggatgctgctactatcccgtcctccgctatgcaagctccaactgtgtgtatttaccttaataagaacggcagcacaggtccgcatctggataaaaagaaagtgcagcagcttcccgatcatttcggccccgcccgtgcatcggtggtactccagcaagcagtacaagcctgtattgattgcgcctatcaccagaagaccgtcttcagttttctgaagcaggggcacggaggcgaagtgatctccgcagtgtttgaccgggagcaacatacgctcaacctgccagcagtgaactctataacatacgtactcagattcttggagaagctgtgtcataatctgagaagcgataatctgtttggtaaccagcctttcacacaaacacatctgtcgctgacagctatcgaatacagccattcgcatgacagatatttgcccggggagacattcgtacttggcaactcccttgcgaggtccctggaaccacatagtgactcaatggactctgcctctaaccccaccaacctggtgagtacaagccagcgccatcggcccttgctttcgtcctgtggtctgccacccagcactgcaagcgctgttagacggctttgtagcaggggaagcgaccgctatctcgagtccagggatgcgtcccgcctctccggtagggatccctccagctggacagtggaggacgtaatgcagttcgttcgggaggccgatccacaactgggcccccatgcggatctcttccgcaaacatgagattgacggaaaagccctgcttctgctgcgttccgacatgatgatgaaatatatggggctaaaactaggacccgctcttaagctctcataccatattgatcgcctgaagcaggggaagttctag

SEQ ID NO: 13201 - DNA, 1734 bp, Artificial Sequence
  Description of Artificial Sequence: Synthetic coding sequence
atgaagctggaggctcaggatccccgcaataccacctccacatgtattgcgacagtggtgggcctgaccggtgcaaggctgaggcttcggctcgacggcagtgataataagaacgatttttggcgcctggtggattccgccgagatacagccgattggcaattgtgaaaagaatggtggtatgctacagcctcctctgggcttccggttaaatgcctcctcttggccaatgtttctactgaagaccctgaacggcgcagagatggcacctatcaggatcttccataaggagccaccatcgcctagccataacttctttaaaatggggatgaagctcgaggccgtggatcgaaaaaacccacattttatatgccctgcaactattggggaggtgcgaggatccgaagtgcttgtaacatttgatggctggcgcggggcgttcgactattggtgcagattcgattctcgggacatcttcccagtggggtggtgttcactgactggggacaacctccagccccccggtaccaaagtggtgatcccaaagaatccctaccctgcgagcgatgttaacacagaaaagccctccattcacagcagcacaaaaactgttctcgagcaccaacccggccagaggggccgaaaaccaggcaaaaaaagaggacgcacacccaagaccctgatttcgcatccaattagcgcaccatcaaaaaccgcagaaccacttaagttccccaaaaagagaggccctaaaccaggaagcaaaagaaaaccccgcactctgttaaatccacctcccgccagcccaaccacctcgacgccggagcctgataccagtacagtgccacaggacgcggctacaattccgtcctcggccatgcaagcaccgactgtgtgtatctatctaaacaaaaatgggtcgacaggaccgcacctggataagaaaaaggtgcagcagctgcccgaccacttcggccccgccagggcatcggtcgtcctccagcaagctgtgcaagcttgtatcgactgcgcttatcaccagaaaactgttttcagcttcctgaaacagggtcacggaggcgaagtaatttctgccgtatttgacagagagcagcatacacttaacctaccagctgtgaattcaattacctacgtgctgcgcttcctggaaaaactgtgtcacaaccttagaagcgacaacctgttcggaaaccagccattcacgcaaacccaccttagcctgacagcaatcgagtactctcactcacatgataggtacttgccgggcgaaacgtttgtgctcggaaactccctggctagatcccttgaaccacattctgattcaatggactccgctagcaaccccaccaatctggtcagtacttcccagcgccacagaccattgctctctagttgtggactccctccatctaccgcgtctgctgtgaggaggctgtgttcccgcggtagcgacagatatctggagtcgagagacgctagccggctgtctggacgggacccatccagctggactgtagaagatgtaatgcagttcgtcagggaagccgatcctcaattaggacctcacgccgatctattccggaagcatgaaatcgatggaaaggcactgctccttctgcgctccgatatgatgatgaaatacatgggcctgaaactgggcccagcactgaaacttagctaccacatcgaccgtttgaagcaggggaaattctag

SEQ ID NO: 13202 - DNA, 1776 bp, Artificial Sequence
  Description of Artificial Sequence: Synthetic coding sequence
atgcagtcttatacaccaccgagcaatgaatttaaaatttccatgaagctggaggcccaagatccgaggaacacgaccagtacttgcatcgctactgtcgtggggttgacaggtgctcgtctgagactgaggttagacggctcagataataagaatgacttctggaggttggtggactcggcagagatccagcctataggcaactgcgaaaaaaatgggggtatgctccagccaccgctggggtttcgcctgaacgcgtcttcatggcccatgtttctccttaaaactctgaacggtgcagaaatggccccaattaggatattccataaagagccaccgtcgccaagtcacaatttcttcaagatgggtatgaagctggaggctgtggaccggaaaaaccctcactttatctgccccgcaaccatcggtgaggtgcggggctctgaggtgctcgtgacttttgatggatggaggggcgcatttgattactggtgccgcttcgatagtcgggatatttttcccgtcgggtggtgctctcttacaggagacaatcttcagcctccaggaaccaaggtggtcatccccaagaacccgtaccctgcgagtgatgtgaacactgagaagccgtcaatccactccagtactaaaaccgtgctggaacatcagcctggccagcgcgggagaaaacccggcaaaaagcgcgggcgaacaccaaagactctgatcagccatcccatcagcgctccaagcaaaaccgccgagccactcaagtttcccaagaagcggggccctaagccgggaagtaaaagaaagcctcggaccctgctgaacccgcctcctgctagccccaccacatctacacctgagccagatacatccaccgtgccccaagacgctgctacaattcccagttccgcaatgcaagcacccactgtgtgcatctacctgaacaaaaatggctctaccgggccacatctagataaaaagaaggttcagcagctgcccgatcacttcggccctgccagagcctcagttgttctgcagcaggccgtccaggcttgcatcgactgtgcgtaccaccagaagacagtgttctcgtttctaaaacagggccatggcggggaggttatttcagctgtattcgaccgtgaacaacacaccctcaacttgcccgccgtcaactctatcacctacgtgctgcggttcctagaaaagctgtgccataatctccgaagcgataatctgttcggtaatcagcccttcacgcagacacatctgagtctaactgcgatcgagtactcccatagccacgataggtacctgccgggcgagacctttgttcttggaaactcgctcgcaaggagcctcgaacctcactctgacagcatggatagtgcctctaacccgacgaatctggtctccacgtctcagaggcatcggccacttctcagttcttgtggtctgccgcctagcacggctagcgcggtgaggcgactttgcagtagagggagtgatcgctacctagagtctcgggacgcatcgaggctgtcaggtagagatccatcatcttggacagtggaggacgtgatgcagtttgtccgggaagctgatcctcaactcggccctcatgcagatttatttcggaagcatgagatcgatggtaaggcactgttgctcttgaggtcagacatgatgatgaagtatatgggactgaagctgggccccgctctgaagctgagctatcacattgatcggcttaagcagggcaaattttag

SEQ ID NO: 13203 - DNA, 1800 bp, Artificial Sequence
  Description of Artificial Sequence: Synthetic coding sequence
atgaaacttgaggctcaagaccccagaaatacaactagtacttgcatagcaacagtcgttgggctgacaggtgctaggctccgcttgagactcgatggatcggacaataagaatgatttctggagactcgttgactctgccgaaatacagccaattgggaactgtgaaaaaaacgggggcatgctgcagccacccctcggattccgattaaacgcatcctcgtggcccatgtttctgttgaagactctgaatggcgctgagatggccccgatccgcatatttcataaagaacctccctctccttcgcataattttttcaagatggggatgaaattagaggctgttgatcggaagaacccgcattttatctgtccagccaccattggggaagtgcgaggtagtgaagttctggtgaccttcgacggctggagaggggctttcgactactggtgtcgcttcgactcgcgggacatcttccccgttggatggtgtagcctgacgggcgacaatctgcagcctccaggcactaaggtagtgatacccaagaacccgtatcctgcttcggatgtgaatacagagaaacccagcatccactccagcactaagactgtcttggagcaccagcctggtcaacgaggccgaaagcccggcaaaaaacgagggcgcacacccaaaacgttaatttcccaccctatctcggccccgtcgaagacagcggaaccactgaaattccctaaaaaacgaggacctaagcccgggagcaaacggaagcccaggacgctacttaatccccctcctgctagccctaccactagcacccccgagcctgatacatctaccgttccccaggatgcagctacaatcccgtcctcagcgatgcaggccccaaccgtatgcatatatctcaacaaaaacggatctacagggccacatctggataaaaagaaagtccagcagctgcccgatcacttcgggcctgcgcgagcaagcgtggtcctgcagcaggcagttcaagcctgtatcgattgtgcctatcaccagaaaacggttttcagtttccttaagcagggacacgggggcgaggtcatctcggccgtgtttgacagagagcaacacaccttgaatctgcccgcagtgaatagcataacctatgtactaaggttcctcgaaaagctctgtcacaacctgaggagcgacaatttgtttggaaaccagcccttcactcagactcacctcagtctaacagcaattgaatactcacattcccatgatcggtatcttcccggcgaaacatttgtcttgggcaatagtctggcaagaagtctggaacctcattccgactctatggattcggcttctaatcctacaaaccttgtctcaacatcgcagaggcaccgaccgctgctatcaagctgtggacttcctccatccactgcctctgccgtgagaaggttatgctcccggggggtcctgaagggatctaacgagcggcgcgacatggaaagcttctggaaacttaatcgctcgcccggctctgaccggtacctggaaagcagagacgctagcagactctctgggagagatcccagctcttggacagttgaggatgtcatgcaatttgtaagagaagcggacccccagctgggaccacatgccgacctgtttcgcaagcatgaaattgatggcaaagctcttctgttattgagatccgacatgatgatgaaatacatggggctcaagttgggacctgcattaaaactttcctaccatatcgatagactaaagcaaggcaagttctag

SEQ ID NO: 13204 - DNA, 1734 bp, Artificial Sequence
  Description of Artificial Sequence: Synthetic coding sequence
atgaagctggaggcccaggaccccagaaacacaacatctacttgtatagctactgtggtaggattaaccggagcgaggcttaggctgcggctggacggctccgacaacaagaatgacttctggcgtttggtcgacagcgctgagatccaaccgattgggaattgcgaaaagaacggagggatgttacagccacctctcggattccgcctcaatgcttcatcctggcctatgtttctactgaagactctgaacggcgccgagatggcgccgatcaggatcttccataaggaaccaccgagtcccagccacaactttttcaaaatgggtatgaaactcgaagccgttgaccggaagaacccacacttcatctgtccagctactatcggagaggtgcggggatcagaagtcctagtgacatttgatggatggagaggggcctttgactattggtgcagatttgattccagagatattttcccagtcggatggtgttctctaactggcgataaccttcagcccccaggtaccaaggtagttatcccgaaaaacccctaccccgcctcagatgttaacacagagaaaccatcgatccactcctcaaccaaaactgtattggagcaccaacccggacagaggggccgcaaaccaggaaagaaacggggccgcactcctaagactcttatttcccatccaatctccgcaccgagcaaaactgctgagcccctcaaattccctaagaagcggggaccaaagcctgggagcaagcggaaaccaagaactttgcttaaccctccgcccgcgagtccaactacatccacccctgagcctgacacttctaccgtaccgcaggatgccgctactataccctccagtgcaatgcaggctccgaccgtgtgcatttatttgaacaagaatggttctacaggtccacatttggacaaaaaaaaggttcagcagctcccagatcacttcggtcccgcacgggcgagcgtcgtgctgcagcaggcagtgcaggcatgtatcgactgcgcataccaccagaaaacagtgttctcctttttaaaacagggacacggtggagaagtaatctctgcagtgtttgaccgcgaacagcatacactgaacttgcctgctgtcaacagtatcacttatgtcctgaggtttctggaaaaactgtgtcacaacctcaggtccgataacctgttcggcaaccagccatttacccagacccatctttctctgaccgctatcgagtactcccactcgcacgaccgctatctgcctggagagaccttcgtgctcggcaattctctagcaagatccctggagccccactccgactccatggacagcgcctctaatcctacaaatctggtgtccaccagtcaaaggcacaggccactactgtcatcctgcggtctgccaccctcaacagcctccgctgttaggagactctgctcgcgggggtctgaccgatacttagaaagtagggatgcatctcgtctctctggcagggatccttctagctggacagttgaggacgtgatgcagttcgtgagagaagctgatccccagctgggaccacacgctgatctgttccggaagcatgagattgatgggaaggctttactccttctgagaagcgatatgatgatgaaatacatgggattgaaattgggaccggccttaaaactctcctaccacatcgataggcttaagcagggcaaattttag

SEQ ID NO: 13205 - DNA, 1776 bp, Artificial Sequence
  Description of Artificial Sequence: Synthetic coding sequence
atgcaatcttacacgccgccgtcaaatgaatttaagatttccatgaagctcgaagctcaggacccgcggaataccacctccacttgtattgcaactgttgttggcctgaccggcgcacgcctgcgattgcgcctggacggaagtgacaataagaacgatttttggcgcctggtggactccgctgaaattcagcccattggtaattgtgagaaaaacggagggatgcttcagcctccgcttggattcagactcaatgcctcttcttggcccatgttcctcctgaaaacacttaacggtgctgagatggcccctatccgcatcttccacaaggagccaccgtccccgagccataatttttttaagatgggcatgaagctggaggcagtggaccgcaagaatccacacttcatctgccccgccactataggcgaagtgcgggggtctgaggtgctggtcacattcgacggttggcgaggagcttttgattactggtgccgattcgactctcgcgacatcttcccagttggttggtgttcgttgactggagataatctgcagcctccagggacgaaagtggtcattcctaagaatccctatcctgccagcgatgttaataccgaaaagccctctatacactcctccaccaagaccgtactcgaacaccaacctggccagagagggcgaaaacctggcaaaaagcgaggccgaacacctaagaccctgatctctcacccaatttcggcaccttctaaaaccgctgaacccctgaaatttcccaagaagcgaggccccaaacccgggagcaagcggaaaccgcggaccctgttgaacccaccacctgcatcacccacgacctccacccctgagccagacacctcaacagtgccacaagatgccgcaactattccgagttcagctatgcaagctcctaccgtgtgtatatacctgaataagaatgggtctacgggcccgcacctggacaagaaaaaggtgcagcagctgcccgatcattttgggcccgcacgtgcaagcgttgtgctccagcaggcggtccaggcttgcattgattgcgcctatcatcagaagacagtattttcatttctcaagcagggacatgggggggaggtaattagcgctgtgtttgatcgtgagcagcacacactgaatctgcctgctgtgaatagcatcacctatgttctaagattcctggagaaactctgccacaacttgaggtctgacaatctatttggaaaccagccctttacacagactcatctgagtttgacagccatcgaatacagtcactcccacgaccgatacctccccggagagactttcgtgctgggaaacagccttgctcggtccctcgagccccattccgatagtatggacagtgcctccaacccaactaacctggtctctaccagccaaaggcaccgtcctctgttgtcatcttgcggactccccccgtctacggcaagcgccgtgcgaagattatgttcgagaggatccgatcggtacctcgagtccagggatgcgtctcgactttcaggacgagatcccagctcttggactgtagaggacgttatgcagttcgtgagggaggctgacccccagctggggccccacgcggatctcttccggaagcacgaaatcgacggaaaagccctgctgctgctgcgttccgacatgatgatgaaatatatgggcctaaaacttgggccagccttaaaattaagttatcacatagacaggctgaaacaggggaaattttag

SEQ ID NO: 13206 - DNA, 1734 bp, Artificial Sequence
  Description of Artificial Sequence: Synthetic coding sequence
atgaagttggaagcccaggatcctaggaacacgacgtctacctgcatcgccaccgttgtgggcctgactggagctaggttgcgactcaggctggatggtagcgacaacaaaaacgacttttggcgcctggtggatagcgccgagatccagcccatcggcaactgtgaaaagaacggtggcatgctgcagccccctctagggtttaggctcaacgcatccagttggcccatgtttctgctaaagaccctgaacggtgctgaaatggccccaatccgaatattccacaaggagcctccatcccccagtcacaacttctttaaaatgggtatgaagctcgaggctgtagaccggaagaacccccacttcatctgccccgcaactatcggagaggtccggggctctgaagtgttggtgaccttcgacgggtggcgtggggcttttgactattggtgccgatttgatagcagagatattttccccgtgggctggtgttcactcactggagataacctccaaccaccaggcaccaaagttgtgatcccaaagaacccatatccagcttccgatgtcaacacagagaagccttccatccatagcagtaccaagacagtgcttgaacaccagcctggccagagaggacgtaagcccgggaagaagagaggaaggacaccaaaaactctgatctcacatcctatttccgcaccctccaaaaccgccgaaccactaaagttccctaaaaagcgaggacccaaacccggcagcaagcggaaaccacgcaccttactgaacccaccaccagcgtcacctaccacatccaccccagagcccgacacctccacagtgccacaagatgcagctaccattccatccagcgcaatgcaggcacccaccgtgtgtatttacttaaacaagaacggctcaactgggccgcatctggacaaaaagaaggttcaacagctccccgatcacttcggccctgcccgagctagtgttgtcctgcagcaggccgtgcaggcttgcatcgactgcgcctatcaccagaaaacggttttcagcttccttaagcaaggacacggaggtgaagtgatttccgccgtgtttgatagggaacagcacacgctgaacctgcctgctgtcaatagcattacttacgtgttgcggtttctggagaagttatgtcacaacctacggtctgataacctctttggaaatcagcctttcacccagacccacctttccttgactgctatcgagtatagccactcccatgaccggtatctgccaggggaaacgtttgtgctcggaaatagtctagctagaagccttgaaccccactccgattccatggacagtgctagtaatccaaccaatctggtatctacgtcccaaagacaccgtcctctactctcttcatgcgggcttcctcctagcacggcctctgccgtacgtagactttgcagccggggctctgatcggtatctagaatccagggatgcttccagactgtcaggaagagacccaagttcctggaccgttgaggacgttatgcaatttgtcagagaggccgacccacaactcggtcctcatgccgatcttttcaggaagcacgagatagatggcaaagccttgcttcttctccgctcagacatgatgatgaaatacatgggactaaagcttgggcccgcccttaaactctcataccacatcgacagactgaagcagggcaagttctag

SEQ ID NO: 13207 - DNA, 1857 bp, Artificial Sequence
  Description of Artificial Sequence: Synthetic coding sequence
atggggtcccccctcggacattttacatgggacaagtacctcaaggaaacatgctcagttcccgctcctgtgcactgttttaagcagagctatactcccccatccaatgagttcaaaatctccatgaaactggaggcacaggaccctaggaacacaacgagcacttgtattgctaccgtggtgggtttgacgggagctcgactccggctcaggctcgacgggtccgacaataagaatgatttctggcgtttggtcgatagcgctgaaattcagcccataggcaactgtgaaaaaaacggggggatgctgcaacctccccttggcttccgcttaaacgcatccagctggccaatgttcctgctgaaaaccctgaacggagctgaaatggccccaattagaatttttcataaagaaccaccgagtccttcccacaacttcttcaaaatgggcatgaaactagaggctgtggatcgtaagaatccacactttatatgccccgctacaatcggagaggtccgtgggtctgaagttctggttactttcgatggttggcgcggcgccttcgattactggtgtagattcgattccagggacatattccctgtcggttggtgtagcctgacgggagacaatctacagcccccaggaacgaaagttgtgattcccaagaacccataccctgcgagcgacgttaataccgagaagcctagcattcacagtagtactaaaacagtgctggaacaccagcctggtcagagagggcgcaagcctggcaagaaaaggggccgcaccccaaagaccttgatttcacatccaattagcgctccttctaagaccgctgaaccacttaaatttcccaaaaaacgggggccaaagcctggttctaaacggaaaccgcgcaccctgctaaatccgccaccagcatcgcctactacctctacacccgagcccgatacctctaccgtaccccaggatgcggctacgataccctcctcggccatgcaggctccaacggtgtgcatctatctgaataaaaatggttcaaccggtccccacctggataaaaagaaagtgcagcagctccctgaccactttggacctgcccgcgcctctgttgtgctgcaacaggccgtacaggcctgcattgactgcgcctaccaccaaaaaacagttttctccttcctgaaacagggacatgggggcgaggtgatttccgctgtgtttgatcgcgagcagcacacactaaacctgcctgcagtgaattccatcacgtatgtgctacgctttttagagaaactctgtcataatttgagatcggacaacctgtttgggaaccaaccattcacacagacacacctttctctgaccgcaatagagtatagtcacagtcatgataggtacctgccaggcgagaccttcgtgctcggcaactcgcttgctcggtctttggaaccgcatagtgactctatggactctgcctcgaatcccactaacctggtctctacttctcagcgtcataggcccttattgtcaagctgcggcctaccgccctcaactgcttccgccgtcagaagattgtgctccagaggctccgatcgctatctggaatccagggacgcctccagactgagcgggagggatccctcctcctggacggtcgaggacgtgatgcagttcgtgcgagaagcagacccgcagttgggaccacatgccgacctgtttcggaagcatgagatcgatggtaaggccttgctgctgttgcgttcggacatgatgatgaaatatatggggttgaagctgggaccagccctgaagctctcttaccatatcgatcggctcaagcagggtaaattctag

SEQ ID NO: 13208 - DNA, 1983 bp, Artificial Sequence
  Description of Artificial Sequence: Synthetic coding sequence
atgctggtgtgttactccgtgctcgcctgcgagattctatgggatctcccatgctcaatcatggggtcccccctggggcactttacttgggacaagtacctgaaggaaacctgctctgttcccgctcccgtgcactgctttaagcagagctatacacctccatcaaacgaattcaagataagtatgaagctggaagctcaggacccccgcaacacaacatctacttgtattgcaaccgttgttgggttgacaggagctcgcctccgactgcggttggatggttcagacaacaaaaacgatttctggagactggtggacagcgccgagattcagcccataggaaactgtgagaaaaacggaggaatgctgcagccgcctttgggattccgactcaacgcctcaagctggccgatgtttctgctgaagacactgaatggtgctgaaatggcacccattcgaatcttccataaggaaccaccgagcccatcacataattttttcaaaatgggcatgaaactggaggcagtggatagaaaaaacccccacttcatttgccctgctacaattggagaggtacgggggtctgaagtcttagttacattcgacggttggcgaggcgccttcgattactggtgcagatttgactcacgggatatctttccagtggggtggtgctccctcaccggagacaatctccagcctcctggtaccaaagtagtgataccgaagaatccctacccggcttctgatgttaataccgagaaaccttcaatacactctagtacaaagacagtgttagaacaccaacccggacaaagaggacgcaagccaggcaagaaacgcgggaggacccccaagactctcattagtcatcccatttcggccccgtcaaagactgccgaaccattgaagtttccgaaaaagcgcgggcccaagcctggcagtaagcgcaagccaaggactcttctcaaccccccacccgcgtcgccaactacgtcaacacctgagcctgatacaagcaccgtacctcaggacgcggctacaattccatcctcagccatgcaagcccccacagtatgcatttatttaaataagaatgggagtaccgggccgcatttggacaagaagaaggtgcagcagctgccagatcattttggcccagcacgcgcttctgtagtattacaacaggcagtccaggcttgcatcgactgtgcttatcatcagaagaccgtgttctccttcctgaagcaaggccacgggggagaagtcatcagtgctgtattcgatagggaacagcacaccctgaatctccctgctgttaattctataacctacgtgctgcgattcctcgagaagctttgtcacaacctgcggtccgataacctgtttggcaaccaaccatttacccagacccacctctccttaaccgccatagagtatagccattctcacgatagatatctgcctggggagacattcgttctggggaatagtttggcccgctccctggagccccattccgactcgatggacagcgcctctaaccccactaaccttgtgagtacctctcagagacatagacccctcctgtccagctgtggtttacctcccagtacggccagtgctgtccgcagactgtgcagcaggggggtcctcaagggaagcaatgaaaggcgcgacatggagtcgttctggaagttaaatcggagcccagggtccgatagatacctcgagtctcgtgatgcaagccgtctttcggggcgagacccaagctcctggaccgtcgaggacgtaatgcagttcgtaagagaagcagatccacagctggggcctcatgccgacctgtttaggaagcacgaaattgacggtaaagccctcctccttctcagatctgacatgatgatgaagtacatggggctcaagcttgggcctgccctgaagctaagttaccatattgataggctcaagcaaggcaagttctag

SEQ ID NO: 13209 - DNA, 1443 bp, Artificial Sequence
  Description of Artificial Sequence: Synthetic coding sequence
atgcaatcttatacacctccctcaaatgaattcaaaattagtatgaaattagaagctcaggatccacggaacacaacatcaacatgcattgccacagtggtggggctcactggcgcgcgccttagactcaggctggatggaagtgacaataagaacgacttctggaggttagtagactcagctgagatccaaccgattggcaattgcgagaagaatggcgggatgctgcagccgcctttagtagtcattcctaagaacccatacccggcctccgacgtcaatacagagaaaccgagcattcacagctcaaccaaaactgttctggagcaccagcccggacagcgcgggaggaaacctgggaagaagagaggtcggaccccgaagaccctcatttcccaccccatctccgcgccatctaaaacagctgagccactgaaatttccaaagaagcgcggacctaagccaggatccaaacgaaagccccgcactcttctgaaccctccacctgcgtcacctaccacatcaacgccagagccagatacttctacagttccacaagatgctgcaactattccttctagtgctatgcaggctcctacagtctgcatctacctgaataagaacgggagcaccggccctcacctggacaagaagaaggtccaacaactcccagatcattttgggcctgctcgcgccagcgtagtgcttcagcaggcagtccaggcgtgtatcgactgcgcctatcatcaaaagacagttttcagttttctgaagcagggccacggtggagaggtgatcagcgctgtctttgatcgagagcagcacacactcaatctaccggccgttaactccatcacctatgtgttgcggtttctcgaaaagctgtgtcacaacctgcgctccgacaacctgttcgggaaccagccttttacacagactcatctttctcttacagccatcgagtactcccatagccacgacaggtacttacccggagagactttcgtcttagggaactctctggcccgaagtctggaaccacacagcgactctatggattccgcctcaaatccaacgaacctcgtgagcacctcacaacggcacaggccactgctgtccagctgcgggttgcccccaagtaccgcttccgccgttagaagactttgcagtaggggaagcgatcggtatttagagtcccgcgacgcatctcgcttgagcggacgcgatcccagcagttggaccgttgaagacgttatgcagtttgtccgggaggccgatccccagctcggaccacatgccgacctgtttaggaagcatgagatcgacggcaaagcattgctcctgctgcggagcgatatgatgatgaaatacatggggttgaagcttggaccggccctgaaattatcttaccacattgaccgactaaaacagggcaaattttag

SEQ ID NO: 13210 - DNA, 1245 bp, Artificial Sequence
  Description of Artificial Sequence: Synthetic coding sequence
atgcagtcgcagaggattccagggcggaaaagaggtcggccgtccctccacagcacaccgatgaaaatggctgtgcacaatttgtactctgcaagcgcaggctcgctaccagcagtgaaaattcccaaaaagcgtggccgcaaacctgggtataaaattaaaagcagggttctcatgacccctcttgccctatctccgccacgctctacccctgaacctgatctgagttcgatcccccaagacgctgccacagttcctagtctggccgccccccaggctctcactgtgtgtctatatatcaataaacaggccaatgcaggcccttatctcgagcgcaagaaagtgcaacagctgcccgaacattttggccctgagcgtcccagcgccgtgctgcagcaggcggtccaggcctgtattgattgtgcccaccagcagaaacttgtgttctctttggtgaagcagggatatggaggagaaatggtgtccgtcagcgcttctttcgacgggaaacaacatctccgaagccttcctgtagtgaacagcataggatacgtactccgatttctcgctaagctgtgtcgatcgttactctgcgacgatctcttcagtcaccagccatttccaaggggctgtagcgctagtgagaaagtccaagaaaaggaggaaggccgcatggagtcagtgaagacagtaacaaccgaggaatatctggtgaaccctgtgggcatgaacaggtattccgtagatacttcggcttccacctttaatcataggggctcgctgcacccttcctcctcactgtactgtaagcgacaaaacagcggggatagtcacttgggcggagggcccgcagcgacagcgggcggcccaaggaccagtccgatgtcaagtggcgggccatctgcgccaggtctgagacccccagcttcctcacctaaacggaacacgactagcttggagggcaaccgttgtgcttcatctccctcccaggatgctcaagatgcccggaggcccaggtctaggaatccttctgcctggactgttgaagatgtggtctggttcgtaaaggacgccgacccccaggcactagggcctcacgtggagctgtttcgcaaacacgagatcgacggaaacgccctgctattgctgaagagcgacatggtgatgaagtacctcggtctcaagcttggtccagcactgaaactctgttatcatattgacaagctaaaacaggcaaagttctag

SEQ ID NO: 13211 - DNA, 918 bp, Artificial Sequence
  Description of Artificial Sequence: Synthetic coding sequence
atgccttgtcagcggaccgcttggattggttgtgatcgacagagaactccacccttccactggcgcgaaattaagagcagggtgttaatgactccactcgcactaagtcctcctaggagtacaccagagcccgatttatccagcatcccccaggacgccgctaccgttccgagcctcgcggcgcctcaggccctgaccgtgtgcctttatattaataagcaggcaaacgccgggccttatctggaaagaaagaaggttcagcagctgcctgagcacttcggccccgagcgccctagcgcagtccttcaacaagctgtgcaggcttgtatcgattgtgctcaccaacaaaagctcgtgtttagcctcgttaagcagggctacgggggcgagatggtttccgtgtctgcatctttcgatggaaagcagcaccttcgtagtcttccggtggtgaattcgattggctacgttttgcgttttctcgccaagctgtgtcgctccctcctctgtgatgacctgttctctcaccagccttttccaagagggtgttccgccagtgagaaagtgcaagagaaggaggagggacgtatggagagtgttaaaactgtcactaccgaggagtaccttgtgaatcctgtcggaatgaatcgctactcagtcgacacttcagcaagtacatttaaccaccgcggcagcctgcacccgtcatcatctttgtattgcaaacgccagaactctggagattcccacttgggcgggggtcctgctgccacagccggaggcccaagaacaagccctatgtctagcggtggaccaagcgctcccggcctgcggcctcccgcatctagtccgaagcggaacacgacatcacttgaggggaaccgttgtggtaatgtgatgcatgcttccgcctcccactag

SEQ ID NO: 13212 - DNA, 324 bp, Artificial Sequence
  Description of Artificial Sequence: Synthetic coding sequence
atggtgatccgggtgttcatcgcttcctcttcaggtttcgtcgcaattaaaaagaagcaacaggatgtggtcagatttttggaggctaataaaatcgaatttgaggaagttgatatcaccatgagcgaagagcaacggcagtggatgtacaaaaacgtcccccccgagaagaagccaacccagggaaaccccctccctccacagatttttaatggggaccgctactgcggcgattatgactccttctttgagagtaaggaatcaaataccgtcttttcattcttggggctgaagccacggctcgcttcaaaggctgaaccctag

SEQ ID NO: 13213 - DNA, 960 bp, Artificial Sequence
  Description of Artificial Sequence: Synthetic coding sequence
atggaagaactgacagcttttgtgagcaagtcttttgaccagaaggtaaaggaaaagaaggaagcgataacttatagagaggtcctcgagtcaggacctctgcgaggggcaaaagagcctactgggtgtactgaggccggcagggacgatcggagttccccagcggtgcgcgcagccggaggcggggggggtgggggaggcggcggaggcggggggggcggaggagggggcgttggtgggggcggtgcaggcggtggagccggcggtgggagatcacctgtgagggaattggatatgggcgccgccgagcgcagtcgggaacctggaagccctagactcacggaggttagcccagaactgaaggataggaaggaagatgctaaggggatggaggatgaagggcagacgaagataaaacaaaggagaagtcgtaccaatttcacgttggagcagctaaatgagctcgaacgtctgttcgatgagacgcactatcctgatgccttcatgagggaggaactcagccaacgccttggactgagtgaggcccgggtgcaagtctggtttcagaatcgaagagccaaatgccgcaaacaggaaaatcagctgcataaaggggtgctgatcggcgccgcttcccagtttgaggcatgtagagtggccccctacgtcaatgttggcgcactgcgtatgcctttccagcaggtgcaggctcagctccaactggactctgcagtggcccacgcccaccatcacctgcacccccatctggctgctcacgcgccctacatgatgtttcctgccccaccattcggcctgccgctggcgaccttggctgccgacagcgctagcgctgcttccgttgttgccgccgccgccgccgccaagaccacgtctaagaacagttccatcgctgacttgcgcttgaaggcaaagaagcatgctgcagcgctcggcctctag

SEQ ID NO: 13214 - DNA, 663 bp, Artificial Sequence
  Description of Artificial Sequence: Synthetic coding sequence
atgaacggcttcacccccgacgagatgtcgagaggcggagacgccgccgctgcggtagctgccgttgtggctgccgccgcagcggcagctagcgcaggaaatggcaccggcgcgggaaccggggccgaggttcccggcgccggggccgtgtcagcagctggcccaccaggcgctgccgggccaggcccgggtcagctctgttgcctgagagaagacggcgaaaggtgcggaagggccgccggaaacgcatctttcagtaagcggattcaaaagagcattagccagaagaaggttaagatagagctggataagtccgccagacatttatacatctgcgactaccataagaacctcattcagagcgtccggaatcgaagaaagaggaagggcagcgacgatgatggaggggatagcccagtccaggacatagatactcctgaggtggatctgtatcaactgcaggtgaacaccctgcgccgctacaaaagacactttaagcttcccacaagaccaggcttgaataaggcgcaactggtcgaaatcgtgggctgccatttccgttccatccccgtgaacgaaaaagatacactcacctattttatatattcagtgaaaaacgacaaaaataaatcagacctcaaggtcgacagtggcgtgcattag

SEQ ID NO: 13215 - DNA, 828 bp, Artificial Sequence
  Description of Artificial Sequence: Synthetic coding sequence
atgggccctgccggcgtggctgctagaccagggagatttttcggagtgtatttactctactgtttgaatccacgttaccggggtcgcgtttacgtcggattcaccgtaaacacggcccgcagggtacaacagcacaacggtgggcgcaaaaagggtggtgcatggcgcacatcgggccgcgggccctgggaaatggtgctggtcgttcacggtttccctagcagcgtggcagctctccgtttcgagtgggcatggcagcaccctcacgcaagtcggcggctggcccatgtggggccacgcctgaggggcgaaacagccttcgcttttcatttacgggtgctagcacacatgcttcgggctcctccatgggcccgtctcccgctcacccttcgatgggtgaggcctgatttaagacaggatttgtgcctgccaccaccaccgcacgtccccctcgccttcggaccacccccaccacaagccccagccccacgtcgtagagccgggccctttgacgatgctgagccagagcctgatcaaggcgatcctggtgcatgttgctctctgtgtgcccagacaattcaagatgaggagggcccgctgtgttgccctcacccagggtgcctgcttcgcgcccacgtgatatgtctcgccgaggaatttctgcaggaagagcctggtcagctcctgccgctggagggccagtgtccatgctgcgagaagtccctgttatggggcgaccttatttggctctgccagatggataccgagaaagaagtcgaggatagcgagctggaggaggcccactggactgacctgcttgaaacatag

SEQ ID NO: 13216 - DNA, 486 bp, Artificial Sequence
  Description of Artificial Sequence: Synthetic coding sequence
atgggtcctgctggcgtggcagcccgacccggccggttcttcggcgtttatctactgtactgcttaaacccgcggtatcggggcagagtgtacgtgggcttcacagtaaataccgctcgccgagtacagcagcacaatggtgggagaaagaaaggaggcgcgtggcgcacgagtggacgcggaccgtgggaaatggtgctcgttgtgcacgggttcccctcttccgtggcggctttacgagacgaggaaggccccctttgttgtccacacccgggatgtcttcttcgtgctcacgtgatctgcctggccgaggagtttctgcaagaggagccagggcagttgctgccactggagggccaatgtccttgctgcgagaaatctctgttatggggtgatttaatttggctgtgccagatggatactgaaaaagaagtcgaggacagtgagctggaagaagcacactggactgacctacttgaaacttag

SEQ ID NO: 13217 - DNA, 765 bp, Artificial Sequence
  Description of Artificial Sequence: Synthetic coding sequence
atggggcctgctggcgtggctgcccggcccgggcgattctttggagtctatctgctgtattgcctgaaccctagataccgcggtagggtatacgtgggttttacagttaatactgcccgaagagtgcaacagcataatggggggagaaaaaaagggggggcatggcgcaccagtggacggggtccatgggagatggtcctggtggttcacggcttcccatctagcgtcgccgcattgaggttcgagtgggcttggcagcacccacatgccagtcgacgattggcgcacgtgggaccacgcctgcggggggaaaccgcttttgcattccatctcagggtgctggcgcatatgctgagagcacctccttgggccagactgccactgacactgaggtgggtgcggccagatctcagacaggatctttgtttgcctccccctcctcacgtgccactggcatttggaccgccccctcctcaggctcctgctcctcggagacgtgcgggcccctttgatgacgcagagcctgagcccgatcagggggatcctggtgcctgttgcagtttgtgtgctcaaacaattcaggatgaagaggggccgctttgctgtccccatcctggctgtttgctccgagctcacgtgatttgtttggcagaagagtttttacaagaagagccaggtcagctgctgccactggagggccagtgcccgtgctgtgaaaaatcggcgttgggtcgacccgatctggccgtccccgacgggcactag

SEQ ID NO: 13218 - DNA, 828 bp, Artificial Sequence
  Description of Artificial Sequence: Synthetic coding sequence
atgggtcctgccggagtggcagctcggcctgggaggtttttcggagtgtacctgctctactgccttaacccaagatataggggtagagtgtacgtaggcttcaccgtaaataccgccagacgcgtgcagcagcacaacgggggcaggaagaagggaggagcctggagaacatccggtagaggcccatgggaaatggtgttggtagtgcatggattcccatcttcagttgccgccctgaggtttgagtgggcctggcaacacccacatgcctcccggagacttgctcacgtggggcctcgactgagaggtgaaactgcatttgcgtttcaccttagggtgctggctcatatgttgagggctcccccttgggcccggctccctctgactctgaggtgggtgagacctgacctgcggcaggacctgtgtctgcctccccccccacacgttccccttgcattcgggcctccacccccacaggctccagctcccagacgccgcgcaggaccatttgacgacgccgagccggagcctgaccaaggcgatccaggcgcctgttgtagtttgtgtgctcaaacaattcaggacgaggagggacctctgtgttgccctcacccaggctgcttattgcgcgctcacgtcatttgcctggccgaggaattcctgcaggaggagccaggccagctgctgcctctggagggacaatgcccctgttgcgagaagtccctgctgtggggagacctgatctggctttgtcagatggatacagagaaggaagtcgaggactctgagctggaggaagctcattggactgatctgctggaaacctag

SEQ ID NO: 13219 - DNA, 486 bp, Artificial Sequence
  Description of Artificial Sequence: Synthetic coding sequence
atggggcctgccggtgtagctgcgaggcctggccggttcttcggagtgtatctgctctactgcctgaacccgcggtatagaggccgggtgtacgtgggattcaccgtgaacactgctcgacgtgtccaacaacataacggagggagaaagaaggggggggcttggaggacttccggcagagggccttgggagatggtactggtggtgcacggatttccctcctccgtagctgcccttagggacgaggaagggccgctctgttgcccgcatcctggctgtctccttagggcccatgtgatttgtctcgccgaagagtttcttcaggaggaaccgggccagctacttcccctcgagggacaatgtccctgttgcgagaagagccttctgtggggagacttgatttggttatgccaaatggatactgaaaaagaagtggaagattctgagctcgaggaagcccactggaccgatctgctggaaacttag

SEQ ID NO: 13220 - DNA, 765 bp, Artificial Sequence
  Description of Artificial Sequence: Synthetic coding sequence
atgggacctgcgggagtagcagccaggcctgggaggttttttggcgtgtacctcctgtactgcctaaacccacggtacagagggagggtctacgtgggttttacagtcaacacggcaaggcgggtccagcagcataacggcgggaggaaaaagggcggcgcctggagaacttccggcaggggaccatgggaaatggtcctagtggtacacggtttcccatcgtccgtggctgcactgcgcttcgagtgggcttggcagcacccgcacgctagcagacgcctggcacacgtcggaccaaggcttcggggagagactgcattcgcctttcacctgcgggtactcgcccacatgctacgtgcccctccatgggctcgactacccctaacattgcgctgggtgcggcctgaccttagacaagatctctgcctgccaccacccccgcacgttccgctcgcttttgggcccccgcctcctcaagcacccgctccaagacggcgtgccggcccctttgatgatgccgagccagaacccgatcaaggagacccaggggcctgttgctccctctgtgcccagacaatccaagatgaggaaggccctctctgctgcccgcaccccggatgcctgctgcgggcacacgtgatttgcctggctgaagagtttctccaagaggagcctggccagctgctgcctcttgaaggtcagtgtccttgctgcgaaaagtcggccttagggcgccctgatctggcggttccggacggccattag

SEQ ID NO: 13221 - DNA, 372 bp, Artificial Sequence
  Description of Artificial Sequence: Synthetic coding sequence
atggtggtgcaggatcctctgctttgcgatttgccgatccaggtcacgctggaagaggtgaactcccagatcgctctggaatacgggcaagctatgactgtgagggtctgcaaaatggatggggaagtgatgccagtggtcgtcgtgcagtcggcaaccgtcctggatttgaagaaggctatccagcgttatgtgcagctgaaacaggagcgggagggaggtatccagcacatctcgtggagctacgtgtggcgcacataccatctgacatccgcaggggaaaaactgacagaagatcgtaaaaagcttcgagattacgggattcgcaacagggacgaggtgtcgttcatcaagaagctgcggcagaagtag

SEQ ID NO: 13222 - DNA, 399 bp, Artificial Sequence
  Description of Artificial Sequence: Synthetic coding sequence
atggatgtattccaggaggggttagccatggtggtgcaagatcctctactatgcgatctgcccatccaggtcacgttggaggaggtgaactctcagattgccctggagtatgggcaggccatgacagtccgagtttgcaaaatggacggtgaagtgatgcctgtggtggttgtccagtcagccaccgtgctcgatctgaagaaggctatccagcgttatgtgcagttgaaacaagaaagagaaggtgggatccagcacatctcatggtcatatgtctggaggacataccatttgacttcagccggtgaaaaattgacagaagaccggaagaagctgcgtgactatggcatcaggaatcgcgatgaggtgtcctttattaaaaagctgcgccagaagtag

SEQ ID NO: 13223 - DNA, 468 bp, Artificial Sequence
  Description of Artificial Sequence: Synthetic coding sequence
atgggccgctcacgctcaagatccccccgtcgtgagcgtcgtagaagtcgatccacttctagagagagagagaggcgccggcgggaaagaagcagaagtcgcgaacgggacagaaggagaagtcggtccagatctccacacaggaggaggtcccggagccctagacggcacaggtccacctccccttcaccatcacgcctgaaggagaggcgcgatgaggagaagaaggaaaccaaggagacaaaatccaaggagaggcaaattacggaagaagacctggagggaaagaccgaggaagaaatcgagatgatgaagctgatgggctttgccagtttcgacagcaccaaaggtaagaaagtcgacggaagcgtgaacgcttatgcgattaatgtgtcgcagaagcgcaagtaccgccaatatatgaacaggaagggcggcttcaatcggccgcttgattttattgcatag

SEQ ID NO: 13224 - DNA, 468 bp, Artificial Sequence
  Description of Artificial Sequence: Synthetic coding sequence
atggggcgcagccggagtcgttcgccacgcagggagcgacgtcgatctcgcagcacgtcaagagagagagaacggcggaggcgggagcggtcccggtcgagggaacgcgaccggcgcagatcaagatctcggagtccacatcggcggcgcagtcgctcgcccaggcgccatcggtctacctctcccagcccctcccgccttaaagagcgaagggatgaagaaaagaaagaaaccaaagagacaaaaagcaaagaaaggcagatcacagaggaggacttagagggaaagaccgaagaggaaatagaaatgatgaagttgatggggttcgcctccttcgacagcaccaaaggcaagaaagtggatggctccgttaacgcctacgccatcaacgtgtctcagaaaagaaagtataggcagtatatgaaccgcaagggaggcttcaatcggccacttgatttcattgcctag

SEQ ID NO: 13225 - DNA, 741 bp, Artificial Sequence
  Description of Artificial Sequence: Synthetic coding sequence
atgaatgactggatgcccatagcgaaggagtacgaccctttgaaggccggtagcattgacggcaccgacgaagaccctcacgatcgggctgtgtggcgcgcgatgttagcgcggtacgtccccaacaagggcgttattggggacccgctgttgacactttttgttgctaggctgaacctgcagaccaaggaggacaaacttaaagaggtgtttagcaggtacggcgacatccggcggctaaggctggttagagacctggttactggattctccaaggggtatgccttcatcgagtataaagaggagagggccgtgataaaagcctacagggatgctgatggtctggtgattgaccaacatgaaatctttgtggactatgaactggaacgaactcttaagggctggattcctcggagactgggcggggggctcggagggaagaaagagtctggacagctgaggtttggtggcagagatcgcccatttcggaaacccatcaacctgcctgtggttaagaacgacctttatagagaagggaagcgcgagcggcgggaacgatcaagatccagggagaggcattgggacagtagaactagggatagggaccatgataggggtcgggaaaagagatggcaagagagggaaccaacacgcgtgtggcccgataatgactgggaacgggagcgagactttagagatgaccggattaaggggagagagaagaaggagaggggaaagtag

SEQ ID NO: 13226 - DNA, 756 bp, Artificial Sequence
  Description of Artificial Sequence: Synthetic coding sequence
atgaaaccagccaatatgaacgactggatgccgattgcaaaagaatacgacccactgaaggccggttcaatcgatgggacagatgaggacccccatgatcgagccgtgtggcgggcgatgctggcccggtacgtgcctaataaaggcgttatcggtgacccactgctgactctttttgtggcccgattaaatcttcagacaaaagaagacaagttgaaggaagttttctcgaggtacggagacatacgcaggctacgtctcgtcagggacctggtgacaggtttttccaagggctatgcatttattgagtataaggaagagcgagccgtcataaaggcttaccgggatgccgatggcctagtgattgaccagcatgagatctttgtcgattatgaactggagagaaccttaaaaggctggataccaagaaggttaggcggggggctgggcggaaaaaaagagtccgggcagttgagatttggcggcagggataggccattccgcaagcccatcaatctgcccgtggttaaaaacgatctgtatagggaaggcaagagggaacggagagagcggtcaaggtctcgtgagcggcattgggactctcgtactcgggatagagatcatgaccgcggccgagagaagcgatggcaggaacgggagccaacacgagtgtggcctgacaatgactgggagagagagcgtgatttcagagacgacagaatcaaggggcgggagaaaaaagaacggggcaaatag

SEQ ID NO: 13227 - DNA, 741 bp, Artificial Sequence
  Description of Artificial Sequence: Synthetic coding sequence
atgaacgactggatgcctattgcgaaggaatatgatccactgaaagcaggctctattgatggcactgatgaagacccacatgacagagcagtctggcgagctatgttggctcggtatgtccccaataaaggagtcataggcgatccccttctgactcttttcgtcgctcgactcaacctccagacgaaagaggacaagctgaaggaggtgttcagcagatatggggatattcgcaggttgcgacttgtcagagatctggttacaggtttttcgaaaggatacgccttcatcgaatataaagaagagagagccgtgataaaggcctaccgcgatgcggatggactggtgatagatcaacacgagatctttgttgattatgagctagagaggactctgaaggggtggattccgagaaggctggggggcggcctgggtggaaagaaagaatcagggcagctccgtttcgggggacgagatcggcccttccgaaagccaatcaacctgcccgtggtcaagaacgacttataccgggagggaaaacgcgaacgcagagagagatccaggagtagagagcgccactgggatagccgaaccagagacagggaccacgaccgcggaagggaaaagcgatggcaggagagagagccaactcgcgtctggccggacaacgattgggaaagagaacgcgattttagagatgatcggataaaaggtagagaaaaaaaagagcggggcaagtag

SEQ ID NO: 13228 - DNA, 1371 bp, Artificial Sequence
  Description of Artificial Sequence: Synthetic coding sequence
atggaaccacgctgcccacccccttgtggatgttgcgaacgcctggtgctgaatgtagccgggctcagatttgagacccgtgccagaaccctggggcgctttcccgacactctgctgggggatccagccaggcgcggacgtttctatgacgatgccaggagagagtactttttcgacaggcacagacctagttttgatgccgtcctgtattattaccagtctggcggaagattacgccggcccgcccacgtgccgctggatgtgttccttgaggaagtcgccttctacggtctcggtgccgcagcgctggcccggctacgggaggatgagggttgccccgtgcctccggagcgacctctaccacgccgagcctttgcccgccagctttggctactgttcgagtttccagagtcaagccaagctgcgcgggtcctcgccgttgtgtccgttctcgtgatcctcgttagtatagtggtgttctgtctcgagacactgccggattttcgggacgaccgtgatggtacaggacttgctgcggctgccgctgctggtccgtttcctgcccctctgaatggatcctcacagatgccaggcaatcccccacgcctgccattcaacgatccgtttttcgtggtggagactttatgcatttgctggttcagctttgaactgctggtccggctgcttgtgtgcccatccaaagcgatcttctttaaaaatgtgatgaacttaatagacttcgtagcaattctgccatactttgttgcactcggcacggagctcgctagacagagaggggtgggccaacaggccatgtcactcgcaattctgagggtgattcgcctggttcgcgtgttccggattttcaaactcagcagacactcaaaaggccttcaaatcttaggccagaccctacgcgcctctatgagagagttaggtctattaatcttcttcttatttatcggcgtggtcttgttcagcagcgccgtatactttgctgaagtggaccgggtggattcacattttacgtccatcccagagtcattctggtgggctgtggtgacaatgaccactgtggggtacggggacatggcccccgtgacagttggcggtaagattgtgggtagtctgtgtgcgattgctggcgtgttgactatttcgctgcctgtgcccgtcatcgttagcaatttctcctatttctaccatagagaaaccgagggcgaagaggctggcatgttcagtcatgttgacatgcaaccatgtggccccctggagggcaaggctaatgggggcctagtggatggggaagtgccggaactgcctcctcccctatgggcccccccgggcaagcatctcgtcaccgaggtctag

SEQ ID NO: 13229 - DNA, 501 bp, Artificial Sequence
  Description of Artificial Sequence: Synthetic coding sequence
atgacgcaatttctacccccaaatctgctcgccctgtttgcaccccgcgaccctattccgtatctgccccctctggagaagctcccccatgaaaagcaccataaccaaccttattgtgggatcgcaccatatattagagagttcgaggatccgcgtgatgcacctcctcctactcgagcagaaactcgtgaggaaaggatggaacgcaaaaggcgggaaaagattgagagaagacagcaggaagtggagacagagttgaaaatgtgggacccgcataacgatccaaacgctcagggggacgcatttaagacactgttcgtggcacgggtcaactacgacacgacagagagtaagctgcggcgcgaatttgaagtgtacggccctattaaacggatccatatggtctactctaaacgtagcggaaaacccaggggttatgcttttatagagtatgaacacgaacgtgacatgcatagcaccactcagctggcctgtagttag

SEQ ID NO: 13230 - DNA, 114 bp, Artificial Sequence
  Description of Artificial Sequence: Synthetic coding sequence
gccgccgctgccgccgcatctctacggaccgacgcgcgggcccgacggtacgctacatggcaggatgacccagttccagctgcgcagcctagtggaccactgtgtccgccctag

SEQ ID NO: 13231 - DNA, 1026 bp, Artificial Sequence
  Description of Artificial Sequence: Synthetic coding sequence
atggaacaggctctgcaccgcttcggccgcggtctcgtatggctctccgtggcctggctcagcgtcggccgtgtgagggtgcgggacgacggggataccgggcgtggattctgtcgcgcaggccccgtgctcacaagaggaccttctggtgattcatcacctctgccgctgccaaccagtgtcacggctgcctacaaacacgctgacgggaagaagatagatggtcgtagggtgctagtcgacgtggagcggggccgcactgttaaagggtggcgcccaagacggctgggaggcgggttgggcggcactagaagaggtggcgccgacgtcaacatcagacactccgggcgagatgatacctctcggtatgacgagcgtcctggaccttcccctctcccccatagagaccgcgatagagatcgcgagcgcgagagacgtgagcgaagtcgtgaacgagacaaggagagagaaaggaggcgttcccggtcccgagataggcgccgtcggagcagaagccgagataaggaagaaaggagacggtccagggagcggagcaaggataaagacagggatagaaagcggcgcagctcccggtcaagggagagagcgcgtagagaacgcgaacggaaagaagagctgagaggaggaggaggcgatatggccgagccaagtgaggccggggatgctcctcccgatgatggtccgcccggagagttggggccagatggtcccgatgggcctgaggagaaaggtagggacagggatcgcgaacgccggcgcagtcacagatccgaacgtgaaagacgccgtgatagggacagagaccgtgatagagaccgcgagcacaagcgtggcgaaagagggagcgaaagagggcgagatgaagcccgcggggggggaggtggccaagacaacggactcgaaggactagggaacgattcaagagatatgtacatggagtctgagggaggcgatggttacctggcaccggaaaatggataccttatggaagcggctccagagtag

SEQ ID NO: 13232 - DNA, 1314 bp, Artificial Sequence
  Description of Artificial Sequence: Synthetic coding sequence
atgacccaatttctgcctccgaacctgctggctctgttcgcacctcgtgatccgatcccctatttgcctcccctagaaaaactgcctcatgagaagcatcacaatcagccgtactgcgggattgcaccctatattagggagttcgaggacccccgcgacgcccccccgcccacccgggcagagacccgagaagagagaatggagcgcaaacgacgggaaaagatcgaaagaaggcagcaggaagtggagactgaactgaagatgtgggacccccacaatgatccgaacgcccagggtgatgcctttaagactctctttgtggctcgtgtaaattacgacacgacagagtcgaagttgagaagagaatttgaagtgtacgggcctatcaaacggattcacatggtatattcaaaaagatccggaaaaccccgaggttacgccttcatagaatacgaacacgaaagggacatgcactccgcgtataaacatgccgacgggaaaaagatcgacgggcggcgagtcttggtagatgtcgagaggggccgcactgttaagggctggcggcccaggcgactgggtggaggtctcggggggacccggaggggaggggctgacgtcaatatccgacatagtggtcgcgacgacacaagcagatacgatgagagaccgggccccagtcctctcccacaccgtgacagagatagggaccgcgagcgggagcgacgggagagaagcagggagcgggataaagagagggaacgtagaagaagtagatcgagggatcgacgtaggcgctcgaggtccagagataaagaggaacggaggagaagcagggagagaagtaaggataaggaccgggacaggaaacgacgaagttcccgcagcagagagagggccaggagagaacgtgagagaaaggaagagttgcgtgggggcggcggagacatggcagaaccttccgaagccggcgacgcccctccagatgatggaccccctggggaattggggcccgatggccccgatggacccgaggagaaaggaagagacagagaccgagaacgacggcggtcccacagatctgaacgggagcgcagacgcgaccgggacagggacagggaccgcgacagggagcataaaaggggggagagaggatcagaaaggggtcgagatgaggccaggggcgggggcggggggcaagataacggtctggaagggctggggaacgactcacgtgacatgtacatggaaagtgagggcggcgacgggtaccttgctcctgagaacggctatttgatggaggccgcccctgaatag

SEQ ID NO: 13233 - DNA, 678 bp, Artificial Sequence
  Description of Artificial Sequence: Synthetic coding sequence
atggatattcgccccaaccatacaatttatatcaataatatgaatgataagattaagaaggaggagcttaagcgcagcttatatgccttgttttcccaatttggccacgtagtggatatcgtggcgctgaagacgatgaagatgcggggccaggctttcgttattttcaaggagctggggtcttctactaacgcactgcgccagctacaggggttccctttctatggcaaacccatgcgtatacagtacgctaagaccgactctgatattatttcaaaaatgcgcggtacatttgctgataaagaaaagaagaaagagaagaagaaagctaagactgtggagcagaccgcaactacaacaaacaagaagcctggccagggcacccctaatagcgctaacactcaggggaactccactccgaatccacaggtgccagactatcccccaaattatatccttttcctcaacaacctgcccgaagagacgaatgagatgatgctgagcatgctgtttaatcaattcccagggtttaaagaggtacggctggtcccggggaggcatgacatagcttttgtggagtttgagaatgatgggcaggccggggcggcacgcgacgctctccaggggttcaaaatcaccccatcccatgctatgaaaatcacctatgcaaaaaaatag

SEQ ID NO: 13234 - DNA, 678 bp, Artificial Sequence
  Description of Artificial Sequence: Synthetic coding sequence
atggatatccgccctaatcataccatctatatcaacaatatgaacgataaaatcaaaaaggaagaactcaaaagaagtctttacgcattattctcacagtttgggcatgtggttgacattgtggcgttgaagaccatgaaaatgcgcggtcaggccttcgtgatatttaaagagttgggtagcagtaccaatgcgctccgccaactgcaaggcttcccgttctatgggaaacccatgaggattcaatatgccaagaccgacagcgatattatatcaaagatgaggggaacctttgctgataaggagaaaaaaaaagagaagaagaaggcgaagactgtagagcagacggcaaccacaaccaataaaaagcctgggcaggggaccccaaattccgccaacacccagggcaactctactcccaacccccaggtgccagactatccaccaaactatatcttgttcctcaacaaccttcccgaggaaacgaatgagatgatgctcagtatgctgtttaatcagttccctgggtttaaggaggtgcggcttgtgcccggtaggcacgatatcgcctttgtggagtttgaaaatgacgggcaggccggggccgccagggacgctctccaggggtttaaaataacccccagtcatgcgatgaagataacttacgccaagaagtag

SEQ ID NO: 13235 - DNA, 2142 bp, Artificial Sequence
  Description of Artificial Sequence: Synthetic coding sequence
atgtccacacgtactccattgcccactgtgaacgaacgagacactgaaaatcacacctctcatggcgatggacgccaggaggtgacctctcgtacgtctcgatccggagcccgatgccgcaacagcatcgccagctgtgccgacgagcagccgcatataggaaactacaggctcctgaaaacaattgggaagggaaactttgcaaaagtcaagctcgccagacatatattgaccgggagggaggttgcaattaaaatcatagataaaacgcaactgaatcctacaagcctccagaagctgtttcgcgaggttcggatcatgaaaattttgaaccatccaaacattgtgaaactattcgaggtcattgaaacagagaaaacgctttacttgatcatggagtatgcgtcaggcggcgaggttttcgattacttggtcgcgcatggtcggatgaaggagaaagaggcaaggagtaagtttcggcagattgtgagcgccgtacagtactgccaccaaaaacggatcgtgcacagagatcttaaagctgagaatctgctgctcgacgccgatatgaacatcaaaatcgctgacttcgggttcagcaatgagtttactgtgggcggtaaactggataccttctgtggttcgcctccttatgcggctcctgaactctttcaggggaagaaatacgacggcccagaggtcgacgtttggtctctgggggtcatcctgtatactctagttagcggaagcctgccctttgacgggcagaatctgaaagagctacgcgaacgagtgttaagagggaaatatagaatcccgttctacatgtccactgactgcgaaaatttgctgaaacggttcctcgtgctcaaccctatcaaacgcggtacgcttgaacaaataatgaaggaccggtggatcaatgccggtcatgaggaggatgaactaaagcctttcgtagaaccagaactggatatttccgatcagaaaagaatcgacattatggtgggaatgggctactcccaggaggagatccaggaatccctaagcaaaatgaagtacgatgagattacggccacatatctgctgctgggccgaaaatcgtctgaggtgagaccaagctctgatctgaacaactccactggccagagccctcaccacaaggtgcagagatctgtgttttcgagccagaaacagcggaggtatagcgaccatgcaggcccagctatccctagcgttgtcgcctaccccaagagatctcaaacttcaacagccgacagtgatctgaaggaagacggaatctcctcgcggaaatcttctggctcagccgtgggaggtaagggtattgcgccagccagtccgatgttaggtaatgcctcaaaccccaacaaagctgatattcctgagaggaaaaagtcttctacagtgcccagctcgaacactgcttcaggtggcatgactagacgcaacacttacgtctgtagcgaaaggactacggccgaccggcattcggtgatacagaacggtaaggagaattcaaccatcccggaccagagaaccccggttgcttccacacatagtataagttcagctgctacaccagaccggattcgctttcctcgggggacagcaagtagaagcacattccatgggcagccccgtgaacgaaggactgccacatataacggaccgcctgcgtcaccctcactgagccacgaagctacccctctgtcccaaaccaggtcgaggggtagcactaacctctttagcaaattaacatcaaagctcacacggtctcgcaatgtctcggctgaacagaaggatgagaacaaggaggcgaagcctaggagtctgcggttcacatggagcatgaaaacgacaagttctatggatccgggagatatgatgcgcgagattcggaaagttctggacgccaataattgcgactacgagcagcgtgaacgctttttgctcttctgcgtgcatggagatgggcacgcagaaaacctcgtacagtgggagatggaggtgtgtaagctaccacgtctgtcgttgaatggggttaggttcaaacgcatcagcgggacatccattgcattcaaaaacatcgcatcaaaaatagccaatgaattaaagctctag

SEQ ID NO: 13236 - DNA, 1059 bp, Artificial Sequence
  Description of Artificial Sequence: Synthetic coding sequence
atggccccgaaacttattacggtgctgtgcttggggttctgcctcaatcagaagatttgtccacatgccggagcccaggataaatttagcctgagcgcttggccatcgccagtcgtccccctgggaggacgcgtcacgttgtcgtgccactcacatcttagatttgtgatctggacaatttttcagacaactggtacaaggagtcatgaactgcacactggactctcaaacaatataacgatcagtcctgtaactccagaacacgcgggaacgtatagatgcgtgggcatctacaagcatgcaagcaagtggtccgcagagtctaacagtctgaaaattattgttacgggcctgttcaccaagcctagcatttctgcacaccccagcagcctagtgcatgcgggcgccagagtctcacttcgttgccacagcgaactggcatttgacgagtttatcctgtataaggagggtcacatccagcactcacagcaacttgaccagggtatggaagcagggatccattacgtagaggctgtgttcagtatgggacccgtgacaccagcccacgctggagcgtaccggtgttgcggctgcttttctcactctagatatgaatggagcgcgcccagtgaccctctcgacattgtgattacaggcaagtacaaaaaacccagcctcagtacacaagttgatcctatgatgcggctaggcgagaagctcaccctcttctgtagcagtgaaattagctttgaccagtaccacctcttccgccacggagtggctcacggacagtggctgagtggcggccagcggcacagagaagcattccaggccaacttctctgtcggacgcgcaacccccgtcccaggcggcacatacagatgttatggcagcttcaacgattcaccttacaagccccctgtgacgcgatgcaatttcacccctcaagaaaccctgcgagtcctgctgtgccacagtcagaatcctccactgaacctcacacaccttgcgctgaaagactcacccgccacttgcatctgcagcctcgattcacaatag

SEQ ID NO: 13237 - DNA, 75 bp, Artificial Sequence
  Description of Artificial Sequence: Synthetic coding sequence
ttagcatccagctgggacctgtctccggagcccgtaccagaatccctcggccctcccgttggacccgggctatag

SEQ ID NO: 13238 - DNA, 375 bp, Artificial Sequence
  Description of Artificial Sequence: Synthetic coding sequence
atgctggttttggggtcccagaagttaacccagttgagggactcaatccgctgtgtaagcgatctgcagatcgggggggagttttcgaacactcccgaccaggccccggagcacatctcaaaagatctatataagtcagcatttttctatttcgagggcactttctataatgataagaggtatcccgagtgccgtgacctctctcgaacaatcattgagtggtcggaaagtcatgatcggggctacggcaaattccagactgcccgaatggaggattttacttttaacgacctgtgcattaagttaggatttccttatctgtattgccatcagggagactgcgagcacgtgattgtgatcacagacatccgctag

SEQ ID NO: 13239 - DNA, 732 bp, Artificial Sequence
  Description of Artificial Sequence: Synthetic coding sequence
atggctgagggctcacgcgggggtccgacatgttccggggtgggagggcgacaggacccagtaagcgggtccgggggctgcaatttccccgagtacgaattgcctgagctcaatacccgcgcattccatgtcggcgcctttggcgagctctggcgggggaggctccggggcgctggcgatctgtccctgcgggagccacctgctagcgccttacccgggagccaggccgcagacagcgatcgggaagacgcggcagtggctcgcgatttagattgtagtctggaggctgccgctgagcttcgcgccgtctgtggactggacaaactgaagtgcttggaggacggagaagaccccgaggtgattcccgagaatacagacctagtgacccttggggtgcggaaacgctttctggagcacagagaagagaccattactatagacagggcttgccgccaggagacgtttgtctacgaaatggagtctcacgccatcggaaagaaacccgagaattccgccgatatgatagaggagggcgagttaatcctgtccgtgaacattctatacccagtgattttccacaaggatctgtataaatctgcatttttttatttcgaaggcaccttctacaatgacaagcgctaccccgagtgccgtgacttaagcaggacgatcatagagtggagcgagtcccatgacagaggctatggaaagtttcagacagcccgtatgtag

SEQ ID NO: 13240 - DNA, 1236 bp, Artificial Sequence
  Description of Artificial Sequence: Synthetic coding sequence
atggcggaagggtcccggggcggccccacatgttccggagtgggagggagacaagaccctgtttccggcagcggaggctgtaacttccccgaatatgagctgccagagttaaacacccgggccttccatgtaggcgcttttggtgaactgtggagaggtcgactccgtggggcaggcgacctgagcctaagagaaccgccagcttcagctctccccggctcccaggccgccgattccgaccgggaagatgccgcagtggcaagagatcttgattgctctctggaggcagccgcggaactgagagccgtctgcggtctagataagctgaaatgtcttgaagacggtgaggatcctgaggtgatcccagaaaacaccgatcttgtgaccctgggcgtccgaaaaaggttcctcgaacacagggaggagacgataaccatcgatcgtgcgtgtagacaggaaacatttgtttacgagatggagtcccacgctatcggtaagaagccagaaaattcagccgatatgattgaggagggggaactgattctgtctgttaatattctgtatcccgtaattttccataagcacaaggagcataaaccttatcagacaatgctcgtgcttggatctcagaagctgacccagctcagggacagtatccggtgcgtgagcgacctgcaaatcggcggcgaattctctaacactcccgatcaggcacctgaacacattagtaaagacctatataaaagcgccttcttctactttgaaggaacattctacaatgacaaacgctacccagaatgtcgcgacctgtcccgcaccatcattgagtggagcgaatcacatgacagggggtacgggaagtttcagaccgctcgtatggaagattttacctttaatgacctttgtatcaaattgggcttcccttacctctactgtcatcaaggcgactgcgaacatgtgattgtcataaccgatatccgcttggtgcaccacgatgactgcctggacagaacgctgtatcctctcttaataaagaaacattggctgtggacacgtaagtgtttcgtttgcaagatgtacactgctcgatgggtgacgaataacgattcattcgcccccgaagatccgtgctttttctgtgatgtctgttttaggatgctccattatgattctgagggcaacaagctcggggagttccttgcctacccctatgttgaccctgggacttttaactag

SEQ ID NO: 13241 - DNA, 732 bp, Artificial Sequence
  Description of Artificial Sequence: Synthetic coding sequence
atggccgagggtagccgaggcggccccacctgttccggggtaggcggaaggcaggatcccgttagtggctccggaggatgcaacttcccggaatatgagttgcccgagctgaacacccgcgcctttcacgtgggtgcctttggcgagttatggcgcggtcgactgaggggggctggtgacttgtcattacgggaacccccggcctctgctcttcctggctcacaggccgctgacagtgatagagaggatgcagccgttgcccgtgatttggattgctctcttgaagccgccgctgagttaagggctgtctgtggtttagacaaactcaagtgcctggaggacggagaagatccggaggtgatcccggaaaacaccgacctcgttactcttggtgtgcgcaagcgttttctcgagcacagggaggagacaatcaccatcgaccgggcgtgtcggcaggaaaccttcgtgtatgagatggagtcccacgctatcgggaaaaaaccggaaaattcagcagatatgatagaagagggagagctgatcctcagcgtcaacatcctttatccagtgatttttcacaaggatctctacaaaagcgcctttttttatttcgaggggacgttctacaatgacaaacggtatcctgaatgccgcgatctctcccgcacgattatcgagtggagcgagagccacgacaggggatatggtaaatttcaaacagcgaggatgtag

SEQ ID NO: 13242 - DNA, 657 bp, Artificial Sequence
  Description of Artificial Sequence: Synthetic coding sequence
atggccgaggggagccggggaggcccgacttgtagcggggtgggtggtcggcaggatcccgtatccggcagtggggggtgtaacttccccgaatatgaactgccagagctcaacactcgcgccttccatgtgggcgcattcggtgagctttggagaggccgtcttcgaggagctagagacttggattgtagtctggaggccgctgcggagttgcgcgctgtgtgcggcttggacaagctcaaatgcttggaagatggagaagatcctgaagtgatccccgaaaacacggatctggtgacgttgggcgtgcgtaagcgattcctggagcatagggaggagaccatcactatcgacagggcctgcaggcaggaaaccttcgtgtacgagatggaatcccatgctatcggcaaaaaacctgagaattctgctgacatgatcgaagaaggcgagctgatcttgtccgttaatatcctgtatccagtcatctttcacaagcacaaagagcacaaaccttaccagactatgttggtccttgggagccagaagctgacccagttaagggactctatccgctgcgtgagcgaccttcaaattggaggcgagttttccaacacccccgaccaggccccggagcacatttccaaaaactatcactag

SEQ ID NO: 13243 - DNA, 1236 bp, Artificial Sequence
  Description of Artificial Sequence: Synthetic coding sequence
atggcggaggggtcccgaggtggtccaacctgttccggggtcggcggcaggcaggacccggtgtccgggtctgggggttgtaatttcccggagtacgagctgcccgaacttaacacccgcgcctttcatgttggagctttcggagaactatggcgaggtcgattgagaggcgccggtgacttatccctgagggagccccctgccagcgcgctccctggttctcaggccgccgacagtgacagggaggacgcagcagtggccagagacctcgactgctccctggaagcagctgctgagctgagggccgtatgcggactggataagctcaagtgcctagaggatggcgaagaccctgaggtgattccagagaataccgacctggtgaccctaggggtccgcaagcgtttcctggagcaccgcgaagagactattactatcgatcgcgcctgccgacaagaaacctttgtgtacgagatggagtcgcacgcgatcgggaagaaaccagagaattctgctgacatgattgaggagggggaactgattctgtcagtgaatatactatatcctgtgattttccataaacacaaggagcacaaaccataccagacaatgctcgttcttggctctcagaaactgacgcagctgcgcgactcaatccgttgcgtgtcggaccttcaaatcggtggagagttcagcaacactcctgatcaggcccctgagcacatttctaaggatctatataaatctgcctttttctacttcgaggggacattctacaatgacaaacgctaccccgagtgcagggatttatccaggactattatcgagtggtcagaatcacatgaccggggatacggaaaattccagaccgcccggatggaggattttacattcaatgatctgtgtattaaactgggattcccatatttgtattgtcatcagggagattgcgagcacgtgattgttattacagacatccggttagttcatcacgacgattgtctggaccgcacactgtacccactgttaattaaaaaacactggttgtggacacggaagtgcttcgtatgcaaaatgtataccgcacggtgggtcaccaacaacgacagcttcgcccctgaggatccgtgcttcttctgcgatgtctgcttcaggatgctgcattatgactctgaaggtaacaagctgggcgagttccttgcctacccttatgttgatcccggcacctttaactag

SEQ ID NO: 13244 - DNA, 1236 bp, Artificial Sequence
  Description of Artificial Sequence: Synthetic coding sequence
atggcggaagggtctaggggaggtcctacttgctctggagtgggcggccggcaggatccagtgtctgggagcggggggtgtaacttccctgagtacgagctgcctgaactgaacacgcgcgcatttcatgtgggggccttcggcgaactctggcggggccgcctcaggggcgccggagaccttagtcttcgcgaaccacccgcatccgcactgcctgggtcccaggcggctgatagtgatcgcgaggacgccgccgtggcacgtgatcttgattgttccttggaggccgctgctgagctgcgggcggtctgcgggctcgataagctgaagtgcctcgaggacggggaagacccagaagtgatcccagaaaacactgacctggtcaccctgggcgttcgaaaacgctttctggaacatcgcgaggaaacaattactattgatcgtgcatgcagacaggagacctttgtgtatgaaatggagtcccatgcgattggtaaaaaaccagagaattctgccgacatgatcgaagagggtgagttgatactttctgtgaatatactctaccctgtgatttttcacaagcacaaggaacataagccatatcagactatgcttgtgttggggagccagaagttgacccagctgcgtgacagcattcgttgtgtgagtgacttgcagatcggaggcgagttttcgaatactcccgaccaagcccctgagcatattagtaaagacctttataagtcagcatttttttactttgaggggaccttttacaacgacaaaagatatcccgagtgcagggacctgtctcgtacgattattgagtggtctgaatcccacgacagaggatacggaaaattccaaacggcaagaatggaagattttacttttaacgatctctgtattaagctgggcttcccatatctatactgccatcaaggcgactgtgaacatgtcatagtgatcacggatataagactggtgcatcacgacgattgtctcgatcgtaccctgtacccattattgataaaaaagcattggctgtggacgcggaaatgctttgtctgtaagatgtacacagcaaggtgggttacaaacaatgactcatttgcccccgaagacccttgtttcttttgcgatgtatgctttcggatgcttcattatgatagtgagggcaacaaactgggcgagttcctggcctacccttacgtcgaccccggaacatttaattag

SEQ ID NO: 13245 - DNA, 4410 bp, Artificial Sequence
  Description of Artificial Sequence: Synthetic coding sequence
atggacgtcgacgcagaaagagagaaaatcacccaagagatcaaggaattggaacgcatactagatccgggcagcagcggttcccatgttgagatttccgaatcatctctagagagtgatagcgaagctgactctctgccttctgaggatctggacccagctgaccccccgatctcagaagaggaacggtggggagaagcatctaacgacgaagatgatccaaaggataagaccctgccggaagatccagaaacctgtctgcagctgaatatggtgtatcaggaggtgatacaggagaagcttgccgaggccaaccttttgctcgctcagaatagagaacagcaggaagagctcatgagggatctcgccggaagtaaggggaccaaggtgaaggatggcaagtctctcccccccagtacatacatgggacacttcatgaaaccttactttaaggacaaggtcacaggagtcggaccgcctgcaaatgaggacacacgtgaaaaagctgcacaaggaattaaagccttcgaggagctgctcgtgactaaatggaagaactgggaaaaagcactcctcagaaagtccgtggtctctgatcggctgcaacggttgctacagcccaagttgctgaagcttgagtatctgcatcagaagcagagcaaagtgagctcagagctggagcgacaagccctcgaaaagcagggacgggaggcagaaaaagagattcaggatattaaccagttgcccgaggaagccctgctcggtaatcggctcgatagtcacgactgggagaagatctccaacattaatttcgagggaagcagatccgccgaagaaatccgtaagttttggcagaactctgagcacccatctattaataagcaggaatggagtcgagaagaagaggaacggttgcaggccattgccgcagcccacggccatctcgagtggcagaagattgctgaagagttaggcacctcccggtccgcatttcagtgtctgcagaagttccagcaacacaacaaggccctcaagcggaaagaatggaccgaggaagaagatcgcatgctaacacaacttgtgcaagaaatgagggtggggtctcacatcccctataggaggattgtctactatatggaaggaagagatagcatgcagttaatttatcgatggactaaatctcttgatccgggtctgaagaagggttactgggcccctgaagaggacgcaaagcttctccaggccgttgcgaaatatggcgagcaggactggttcaaaattagggaagaagtgcccggtagaagtgatgcccagtgccgcgaccggtatctgcggaggctccactttagcctgaaaaagggacgctggaatctgaaagaggaggagcagctcatagagctgatcgagaaatacggggtgggacactgggcaaaaatagcgagtgagctccctcacagatctgggtctcagtgcctttcaaaatggaaaattatgatgggtaaaaagcaagggctcaggcggaggcggcggcgggctcgccactccgtccgctggtcttccacctctagctccggttcttctagcgggtcaagcggtgggtctagcagctctagttccagtagtagtgaagaagacgaaccagaacaggcccaagcaggcgaaggcgaccgggcgcttctctctccacaatatatggtgccagacatggatctgtgggtccctgcccgccagagcacatctcagccttggcgcggcggggccggggcttggctcgggggacccgcagcatccctgtcccccccaaaggggagctcagcatcccaggggggctcgaaggaagctagtacaacagcagccgcccccggagaagagaccagtcctgtgcaagtgcccgcccgagcacatggaccagtcccccgctcagcacaggctagccatagcgccgacacccgccccgccggagccgagaagcaggctctggagggtggccggagattactaaccgtgccggtcgagacggtgctcagggtgttgagagccaatacagctgcgaggtcatgtacgcagaaggagcagcttcgccagccacctctgcctacatcttccccgggagtctcctctggcgacagcgtcgccaggtctcatgttcagtggctacggcacagggccacacaaagcggacagcgacgctggagacacgccttacacagaagactgctgaacaggaggcttctgttggcggtaactccatgggtcggcgatgtggtcgttccctgcacccaggcctcccagcgcccagccgtcgtgcagacccaggctgatgggctgcgcgagcagctacagcaagcaagactcgcaagtacccctgtgttcacacttttcactcagctgtttcatatcgacacagctggatgcctcgaggttgtgagagaacggaaggccctgccccctcgccttccacaggcaggcgctcgagatccaccagtccatttgcttcaggcctccagttcagctcagagcactccaggacatctcttccccaatgtgcccgcgcaagaagctagtaaatccgcaagccacaagggctctcgccgactggccagctcccgggtggaacgcactctcccgcaggccagtctgttggcttctacagggcccaggcctaagccaaagaccgtgagcgagctgctgcaggagaagcgactgcaggaggctcgcgcgcgcgaggctacccgaggcccggtggttttgccatcgcagctcctcgtgtcatccagtgtcattctgcagcctccgcttccacacaccccacatggcaggccagcgcccggtccaacagtgctgaacgtgcctctctctgggcctggcgctcctgccgccgcaaagcccggcacgtccggttcatggcaggaagccggtacctcggccaaggacaagagattaagcactatgcaagccctccccctggcccccgtatttagcgaagctgaaggcacagcgcctgctgccagccaggccccagccctcggaccaggacagatctctgtgtcctgtcctgagagcggactcggtcaaagccaggcccctgctgcgagccggaagcaaggcttacctgaggccccaccctttcttcccgccgctcctagtcctaccccacttccagtgcagcccctatccctcacccatattggtggccctcatgtagccacaagcgttccactgcccgtgacctgggttcttactgctcagggcctcctgcccgtccctgtccccgcagtggtctcacttccaagaccagcaggtaccccgggtcccgctggcctactggcaacattgcttccccctctgaccgaaacgcgagccgcgcagggtccgcgggccccggcattaagctcgagttggcagcccccagccaacatgaatcgagagccggaaccttcctgccgcaccgacacccccgcaccccccactcatgcactctctcaatcccctgcggaggcggacggtagcgtggcctttgtgcctggggaggcccaagttgcaagagagattcccgaacctaggacaagtagtcacgcggacccccctgaagccgagcccccctggtcggggcggctcccagcattcggtggcgtgattcctgccaccgaaccgagggggacccctggttccccgtctgggacccaggagccgcggggtcctttaggtctcgaaaaattaccacttagacagccggggcctgagaaaggagccctggaccttgaaaaacctccacttcctcagcctggacccgaaaagggtgccctcgatttgggccttctgagtcaagaaggggaggctgcaactcagcagtggctcgggggccagcgcggcgttcgcgtgcctctactcggctctagactgccataccagcctcccgcgctgtgttccctgagggccctctcagggctgctcctccataagaaagctttagagcataaggccaccagcttagtagttgggggagaggccgaacgcccagcgggggccctacaggcctccctcgggctggttagaggacagttacaggacaatccggcttacttgttgctgcgagcgcggttcctggccgcattcaccctgccggccctcctcgctaccctggctccccagggtgttcgaacaactctgagtgtgccctcacgggtgggttcggagtccgaggatgaagatcttcttagtgagttagaactagccgaccgcgacggacaacccggctgtacaactgcaacttgtccgatccagggcgctcctgattccggcaagtgttccgcgtcttcttgtttagataccagcaacgatcccgacgacctggacgtgttgaggacaaggcacgcccgccacacaagaaagcggcgacgcctggtttag

SEQ ID NO: 13246 - DNA, 207 bp, Artificial Sequence
  Description of Artificial Sequence: Synthetic coding sequence
atgctgtcccggctgcaagaacttcgcaaggaggaggaaaccctgttgcgcctgaaggctgctctgcacgaccagcttaatagactgaaaatgctagtgcatgtggataacgaggcatcaattaatcaaaccaccctggagctctccacaaagtctcacgtgacagaagaggaagaggaggaggaggaagaagaaagcgactcctag

SEQ ID NO: 13247 - DNA, 297 bp, Artificial Sequence
  Description of Artificial Sequence: Synthetic coding sequence
atgctttcccggcttcaggagctgcgaaaagaggaagaaactctgctgaggctgaaagcagcattacacgaccagctgaaccgcctgaaagtggaggagttggcgttacagtcgatgataagttctagacggggtgatgaaatgctgagttctcatacggtgccggagcagtcacacgatatgttagtccacgtggacaacgaagcgtccattaaccagacaacactggagctatcgactaaatctcacgtcactgaggaggaggaggaggaggaggaggaagagagcgacagctag

SEQ ID NO: 13248 - DNA, 297 bp, Artificial Sequence
  Description of Artificial Sequence: Synthetic coding sequence
atgttatcaagacttcaggagcttagaaaggaagaggagaccctgctgcggttaaaagccgcattgcatgaccaactaaacagactgaaggtggaggaactcgctctccagtctatgatctcctctaggcgaggtgatgaaatgctgagttcacacactgtgcctgagcagtctcacgacatgctggttcacgtggataatgaggcgtcaatcaaccagactaccctggaactctctactaaaagccacgtgactgaggaagaggaggaagaagaggaagaagagtctgatagctag

SEQ ID NO: 13249 - DNA, 5052 bp, Artificial Sequence
  Description of Artificial Sequence: Synthetic coding sequence
atgtctagtcgtaggaaacgggcacctccggtgcgagtggacgaggagaagaggcagcagctgcattggaatatgcacgaggatagacgcaacgaaccaattataatctccgatgacgatgagcaaccgtgtcccggctcagacacctcttcagcgcattatatcattttgagcgactctcttaaggaagaggtcgcacacagggataagaaacgctgttccaaagtggtgagcttcagtaaaccaatcgaaaaggaagaaacagtggggattttctcccccctgtccgttaaattgaatatcgtgatttcgccttaccacttcgacaactcttggaaggcatttctgggtgagttgacgctgcaactacttccagctcagagcctgattgaaaacttctctgagaggagcatcaccctgatgagcagcgaatcatccaaccagtttctgatatatgtgcactcaaaaggagaagacgtggaaaagcaaaagaaagaaccaatgagcatctgcgacaagggcatcctggtggaatcatcctttagcggggaaatgctagaggatctcggatggctgcagaaaaaacggcgcatcaagctctatcaaaaacccgaagggaaccacataattaaggtaggcatttacctccttgaagctggcctggccaagctcgatttcctgtctgacgcgaacagtcgtatgaagaagttcaatcagctcatgaagaaggtgatggaaaaacttcataactcgattatcccagacgtgctcgaggaagacgaagacgatcccgaaagcgaacccgaaggacaagacattgacgaactatatcactttgtgaagcagacacaccagcaggaaactcagtcaatccaggtggatgtgcagcaccccgctttgattcccgtgcttcggccgtaccagagggaagccgttaactggatgctccagcaagaatgtttccgcagttctcctgccacagagtccgcccttcacttcttatggcgggagattgtgactagcgaagggctaaagctttattataacccatacaccgggtgtattattagagaataccctaattctggacctcagttgctagggggtatactggcggacgaaatggggctcggcaagacggtggaggtcctcgcactgattctgacccacactcggcaggacgtgaagcaagatgccctgaccctacctgaaggaaaagtagtaaactactttatcccctctcactactttgggggtaagttaaagaagaccgagatccagaacatcgaattcgaaccaaaggaaaaggttcagtgtccaccaactcgggtgatgatcctgaccgcagtaaaagaaatgaatggtaagaaaggagtgagtatattgtccatttataaatacgtatcctctatctacaggtacgacgtgcaaagaaaccgtagcttactgaagcggatgctgaagtgcctgatatttgaaggccttgttaaacagatcaagggccatggattctccgggacttttactctgggaaaaaactataaagaggaggatatttgcgataaaactaaaaagcaagcagttggttctcccaggaagatacagaaggagacccgcaaatctggcaacaaggataccgatagcgagtacctgccgtccgatacatctgacgacgatgatgacccctactactattactataaatcccgtaggaaccgttcaaaattgcgcaagaagctggtgccatccaccaagaaaggcaaatctcagccatttattaatccagactcacaaggtcactgcccagctacatccgatagtggcatcaccgatgtcgccatgtcaaagagtacatgtatctccgaatttaaccaagaacacgagaccgaggattgcgcagagtccctcaaccacgcagacagcgatgtaccaccttcgaataccatgtcacctttcaacacgtccgactataggttcgagtgcatctgtggggaacttgatcagatcgaccggaaacctagagtccagtgcctgaaatgccacctttggcagcacgccaagtgtgtgaattacgacgagaaaaaccttaagattaagccattttattgcccacattgtctggtcgctatggaaccagttagtaccagagctacactgataatcagcccatcatccatctgtcaccagtgggtggacgaaatcaacagacacgtgagatcctccagtctccgtgtcctggtttaccagggagtcaaaaaagatggcttcctgcagccccacttccttgccgaacaagatattgtcatcatcacctacgacgttctgcggtccgagctcaattacgtcgatatacctcactctaacagcgaggatggcagaaggctccgcaatcaaaagcgatatatggctatcccttcacctctagtcgccgtggaatggtggcgaatttgcctcgatgaggcgcagatggtggagtgtcccactgtcaaggccgctgagatggcccaacgactatctggaattaatcgctggtgcatcagtggcacgccagttcagcgtggcttggaagacctgtttggcctagtcgtgtttctcggtatcgagccctactgcgtgaaacattggtgggttcgactcctgtatagaccatactgtaagaagaatccccagcatctgtatagctttatcgctaagattttatggaggtcagctaaaaaagatgtcatcgatcagatccagatcccacctcagaccgaagagattcattggctccacttttctcccgtggagaggcacttctaccacaggcagcatgaggtatgctgccaagatgtggtggtcaagctccgtaagatcagcgattgggcactgaaactttcttcgctcgataggcgcactgtgaccagcattctttacccattgctgcgtctgcggcaggcctgttgccatccacaggccgttagaggggaattcctccccttacagaaaagtaccatgactatggaggagctgttgacatctctccagaaaaagtgtggaaccgaatgtgaggaggctcacagacaactggtgtgcgccctgaacgggctggccggcattcacattatcaagggcgagtacgccctcgcggcagaactttatagggaagtgctgcgctcctctgaggagcataaaggcaagttgaaaactgatagcctgcagcgtctccacgccacgcacaatctgatggagctcttgatcgcccgacaccccggcattcctccaacattacgcgacggccgcctcgaggaggaggcaaaacagctaagagaacactatatgagtaagtgcaacaccgaagttgccgaagcacagcaagccctgtatcctgtgcagcagactatccatgaattgcagcgtaaaattcattctaactccccctggtggttgaatgtgatccatcgtgccatcgagttcactattgacgaagaactggtgcagagagttcgtaacgagattacaagcaattacaagcagcagacgggcaaactcagcatgagcgaaaaatttagagactgcaggggccttcagtttcttctcacaacccagatggaggaacttaataagtgccaaaaactggtgagagaagctgtcaaaaacctcgaaggccctccttctagaaatgttattgaaagtgcaacagtatgccatcttagacccgctcgcctcccattaaattgctgtgtgttctgcaaggcagacgagctcttcacagaatatgagtcaaagttattctccaatactgttaagggccaaaccgcaatctttgaagagatgatcgaagacgaagaggggctggtcgacgatagagcccccactacaacaagaggcctttgggccatcagtgagaccgagcgcagcatgaaagccatactgagtttcgctaagagtcaccggttcgacgtagagttcgtagacgagggctctactagcatggacctcttcgaagcatggaaaaaggagtataagttgctgcacgagtactggatggccctgagaaatagagtttcagccgtggacgagctcgcgatggccaccgagcggctaagggttagggatccgagagaacctaagcctaatcctccagtgcttcacattatagaaccccatgaagttgagcagaaccgaattaagcttctgaacgacaaggcggtcgctactagccagttgcaaaaaaagctggggcagctcttgtacctgactaacctcgaaaaatcacaggacaaaacctcaggcggtgtcaaccccgagccctgtcctatatgtgcccggcagttaggcaagcagtgggccgtgttgacatgcggacattgcttctgcaacgagtgtatttccatcattatcgaacaatattctgtgggcagccaccgcagctctattaagtgcgctatctgccgtcagacaacctctcataaagagatttcttacgtcttcacatcagagaaggccaaccaggaggaagacatccctgtgaagggctcccatagcacaaaggtggaagccgttgttcggactctcatgaaaatacagctacgagacccaggagcaaaggccctcgtattcagcacctggcaggacgtcctggacattatctcaaaggctttaacagataataacatggagttcgctcagatctccagggtgaaaacttttcaggagaatctgtcagcgttcaagcgggacccacagatcaacatactgctcctgcccctgcataccggaagcaatggattaacgataatcgaagcgacgcacgtcctcctggtagaaccaatcttaaatccagctcacgaattgcaagccattggacgcgtgcacaggattgggcaaaccaagcctacaatagttcatcggttcctaatcaaagccactattgaggagcggatgcaggctatgctgaaaacggcagaacggtcacacaccaactctagtgctaagcattccgaagctagcgtcttgaccgttgctgatctggccgacctcttcaccaaggagacggaggagttagaatag

SEQ ID NO: 13250 - DNA, 5064 bp, Artificial Sequence
  Description of Artificial Sequence: Synthetic coding sequence
atgagctcacggcgtaagcgtgctccccccgttcgcgtcgatgaagaaaagcggcagcaactccactggaacatgcatgaggacagaaggaacgagccaattataatatccgacgatgacgagcagccatgtccagggagtgatacctcatcggcccactacatcattctctcagatagcctgaaagaggaagtggcacaccgagacaagaaaaggtgttccaaggtggtgagtttttctaagcccatcgagaaagaggaaacagtgggtatcttcagcccactctcagtcaagctgaacatcgttatctcaccataccatttcgataattcatggaaagcttttctgggagagctgactttgcagctgctgcccgctcagagcctgatcgagaatttcagcgagagatcaattactctaatgtcctcagagtcttcaaaccaatttctgatttacgtccactccaaaggagaagacgtagagaagcagaaaaaagagcctatgagcatttgtgataaaggtattctcgtagagtcatccttctcgggagaaatgttagaggatcttgggtggctccagaagaagcgacgaatcaagctgtatcaaaagcccgaaggaaaccacatcataaaagttggcatctacctcctggaggcagggctagcaaaactcgactttctctcagatgcgaattcccggatgaagaagttcaaccagctaatgaaaaaagtcatggagaagttgcacaactctatcattcctgacgtcttggaggaggacgaggatgatcctgaaagcgaacccgaaggccaggatatagacgaactctatcacttcgtcaagcaaacccaccagcaggaaacacaaagcatccaggtcgacgttcaacacccagctctgatccccgtgttgcggccatatcaacgcgaggccgttaattggatgctacagcaagagtgcttccggtcctcccccgcaacagagagtgccctgcactttctgtggagagagatagtgacctctgaaggcttgaaactctactacaacccttataccggttgtatcatccgcgagtatcccaatagcgggccacagcttctcggcggtattctggcagatgaaatgggactgggtaagacagtggaggtgctggcacttatactgacccacacccggcaagatgtcaaacaagatgctttgacgctgcccgagggaaaagtcgtgaactatttcatccccagccattattttggcggtaagctgaagaagaccgagattcagaacatcgaattcgaacccaaggaaaaggtccaatgtccgccaacccgggttatgatcctgactgctgtaaaggagatgaacgggaagaagggtgtctccatcctgtctatatacaagtacgtaagttcgatctaccggtatgacgtccagcgaaacagatcccttctgaagagaatgctcaagtgccttattttcgaggggctggtcaagcaaatcaagggccacggcttttctggaacatttacgctgggtaaaaattacaaggaggaagacatttgcgacaagaccaaaaagcaagctgtcggatctccaaggaagattcagaaggaaaccaggaagagcgggaacaaggatacagactctgaatacctgccttctgacacctccgatgatgatgatgatccatactactactactacaaatccaggaggaataggtccaagctacgaaaaaagctagtgccctcgactaagaagggcaagtctcagccattcataaaccccgattcacagggacattgtcccgcaacatcagatagcggcatcaccgatgtggcaatgtccaagtccacctgtatatcggagtttaaccaggaacatgaaaccgaagactgtgctgagtcacttaaccatgccgattctgacgtcccaccctcaaataccatgtcccctttcaacacatctgattaccgcttcgagtgtatctgtggagagttggaccagatcgaccggaaacctcgtgttcagtgcctaaagtgtcatctgtggcagcacgcgaagtgtgtgaattacgacgagaagaatctgaaaattaaaccgttctattgtcctcattgcttagtagccatggaaccagtcagcacacgagcaaccttgatcatttcaccctctagtatatgccaccagtgggtggatgagataaacagacatgtgaggtcctcttcactgagggtgcttgtgtaccaaggagtgaagaaggacggctttctgcagccacactttctcgctgaacaggatatcgtgatcatcacatatgatgtccttaggagcgagctgaactatgtggatatcccccattcaaattctgaggacgggagaaggctgcgtaaccagaaacggtacatggcaatcccaagtccacttgtggcggtggaatggtggcggatttgtctagatgaagcccagatggtagaatgtcccacagtcaaggctgcggagatggcccaaaggctctctggaattaatagatggtgcataagcggcactccagtgcagcggggcctggaagatctctttggactcgtggtgttcttgggcatcgagccttactgtgtcaaacactggtgggtccgactcttgtatagaccttattgtaagaaaaatccacaacatctttactcattcatcgccaagatcttatggcgtagtgccaagaaagacgtgattgatcagattcaaattcctccccagactgaagagattcactggctgcacttctctccagtcgaaagacacttttaccacagacagcatgaagtgtgctgtcaggacgtggttgtaaagttacggaaaatttcagattgggcccttaagctgagttccctggaccgtaggaccgtaacaagtatcctttacccgttactccggctccgccaggcttgctgccatccacaagcagtgaggggtgagtttctgccactccagaagtcttttgagcagagtacattctccttctccaccatgactatggaggagctacttaccagccttcagaagaagtgcggcacagaatgcgaggaagctcatcgccagctcgtgtgcgctctgaacggacttgcaggtatccatatcattaagggagaatatgctctggccgccgagctttatcgggaagtgctgcgcagcagcgaagaacacaagggaaaactaaagacagacagcctgcagaggttgcatgctactcataaccttatggaacttctaatcgcacgccacccaggaatcccccccacactgcgcgacgggagactggaggaggaggccaaacagctgcgcgagcattacatgtcaaagtgcaacactgaagtggccgaggcgcagcaggcactataccccgtgcagcagactattcatgagctccaacgaaaaatacactcgaacagtccttggtggctgaacgtgatacatcgggccattgagtttacaatagatgaagagctggtgcagcgggtacgaaatgagattacctctaactacaagcagcagacaggcaagctaagtatgtctgagaagggattgcagtttctgttgaccacccagatggaggaactgaacaaatgccagaaacttgtgcgggaggcagtaaaaaatctggaagggccaccttcccggaacgtgatcgagagcgctacagtctgtcacctgaggccagccagactcccccttaattgctgtgtattttgtaaagccgatgaactcttcacagagtacgaatccaaattgttttcaaatacagtgaaaggccagaccgctatctttgaggagatgatcgaagatgaggaaggtctggtcgacgatagagccccaactactactcgggggctctgggccatttcagaaaccgaacgttcgatgaaagccatcttaagcttcgccaaatctcataggttcgatgtggaatttgtggatgaggggtcgacaagtatggacctgtttgaggcatggaaaaaagagtataaacttctccacgagtactggatggctctacggaatcgggtgtcggctgtggacgagttagcaatggctacggagcggctgagagtccgggacccacgggagcccaagcccaacccacccgtgttgcacataatcgaaccacatgaagtggaacagaataggatcaagcttctgaatgacaaagccgttgctacatcacagttgcagaaaaaacttgggcagctcctgtatctgaccaatcttgagaagtcccaggacaagacttctggcggtgtcaatcctgaaccttgtcccatttgtgcccgtcagctaggcaagcagtgggcggtcctgacctgcggccattgtttctgcaacgagtgtatttctatcatcatagagcagtattccgtgggctcacataggtcctccattaagtgcgccatatgtaggcagaccacctcacacaaggagatcagctacgttttcaccagcgagaaggctaatcaagaagaggacatccctgtgaaggggagtcattctaccaaggtggaagcagtggtgcggactcttatgaaaatccagctcagggacccaggagcaaaggcacttgtgtttagcacttggcaagatgtgctagacatcatcagcaaggctttaacggacaataacatggaatttgctcaaatcagtagagttaagacattccaggaaaacctgtccgccttcaagagagatcctcagataaatattctcctcctgcctctccacacagggtcgaatggactcaccattattgaggccacccatgttctgctggtggagcctatcctcaatcccgcacacgagcttcaggctattggtcgggtccaccggattgggcagaccaagccaacgattgttcaccgcttccttatcaaagccactattgaagagaggatgcaagctatgcttaagacagcggaaagatcacacactaatagttcagcaaaacactcagaagctagcgtgctgaccgttgccgacctggccgacctgttcacaaaagagaccgaagagctggagtag

SEQ ID NO: 13251 - DNA, 5052 bp, Artificial Sequence
  Description of Artificial Sequence: Synthetic coding sequence
atgtcctctcggcgtaaacgtgcacctccggtgcgggtggatgaagagaaaaggcagcagctccactggaatatgcatgaagacaggcgcaacgaaccgatcattatctctgacgacgatgagcaaccatgccccggctcagatacaagctccgcccattatatcattctgtcggactccctcaaggaagaagtcgcacaccgcgacaagaagcgatgcagcaaggttgtctctttctcaaagcctatcgagaaagaagagacggtaggtatattctctccacttagtgtgaagctcaacatcgtgatttctccgtaccacttcgacaattcctggaaggccttcctgggagaacttactctgcaactcttgcctgcccagagcttgattgagaacttcagtgaaaggagtattactctgatgtcctcggaatccagtaatcagttcctgatctacgtgcactctaagggtgaggatgtggaaaaacagaagaaagagcccatgtctatttgcgacaagggaatcctagtcgaaagctcattcagtggggagatgctggaggatttgggatggctacagaaaaagcggagaataaaactgtatcaaaagcccgagggaaaccatattataaaggtcggaatctatctactggaggccgggctggcaaaacttgattttctatcagatgccaactcgaggatgaagaaattcaatcaactcatgaagaaggtgatggaaaagttgcacaatagtatcattccggatgtgctggaggaagatgaggatgaccctgaatctgagccagaggggcaagacattgatgaactgtaccatttcgtgaaacaaacgcaccagcaggagacacagtccattcaggtcgacgttcagcatcccgctttaattcccgttctccgtccttaccagagagaggccgtaaattggatgctgcagcaggagtgcttcagaagttcacccgccactgaatcagcactacatttcctctggcgtgagattgtgaccagcgagggcctgaaattgtactacaacccctatacaggatgtatcatccgagaatacccaaacagcggaccacagcttttaggcggcatattggccgacgagatgggcctgggtaagacggtagaggtgctagcactcatcttgacacacacgaggcaggacgtgaaacaggacgcccttactctcccagagggcaaagtggtgaattactttatcccaagtcactacttcggtggcaaactcaagaagacagagatccagaacattgagtttgagcctaaggaaaaagtgcagtgccccccgacccgagtgatgatcctgaccgcagtcaaagagatgaacggcaagaaaggggtgagcatcctttctatctacaagtatgtcagcagcatctaccggtacgatgttcagaggaataggtcattgcttaagcggatgctaaaatgcttaatttttgaggggttagtgaaacaaatcaagggccacggtttctcaggcacctttacgttgggtaaaaactacaaggaggaggatatctgtgataaaacaaagaagcaagcggttgggtcacccaggaagattcagaaggagactcggaaatctggtaataaagatactgattcagagtaccttcccagcgacacatcggatgatgatgatgatccctattactattattataaaagcagaagaaaccggtcaaagctgcgtaaaaagctggtcccttctacaaaaaaagggaaatcccaacctttcatcaatccggactcccaaggtcattgccctgccacatctgactcggggattacagatgttgcaatgtccaaatccacttgtatctctgaattcaatcaagaacacgaaaccgaggattgcgctgagagcctcaatcacgctgactcagatgtgccacccagtaatactatgagcccctttaatacttcagattataggtttgagtgcatctgcggtgagttggatcagatagatagaaagccacgggtgcaatgccttaagtgtcatttgtggcagcatgctaaatgtgtgaactacgacgagaagaatttgaagattaaaccgttttattgcccacattgcttggttgcaatggagcccgtgagcactagggcaaccctcatcatttccccctctagcatttgccatcagtgggtggacgagatcaaccgacatgttcgtagtagttctcttagggtgctggtgtatcaaggcgtgaaaaaggacggattcttacagcctcacttccttgccgaacaagatatcgtgatcattacttatgacgtactaaggtcagaacttaactacgttgatataccccactcaaattccgaggatggcagaagattgcggaatcaaaaacgatacatggccattccctcgcctctggtcgctgtcgagtggtggcgcatctgtcttgatgaggcccagatggtggagtgtcctaccgtcaaagctgccgagatggcccagagactgtctgggatcaacagatggtgcatctctggaacccccgtgcagcggggcctagaagatttgtttggcttagttgtgttcttgggaattgaaccatattgtgtgaaacactggtgggtgcgacttctgtatagaccatactgcaagaaaaaccctcagcatttgtactccttcattgccaagatattatggaggagcgctaagaaggatgtgatcgaccagattcagatcccaccacagacagaagagatccattggctacacttctcccctgttgagagacacttctatcaccgccagcacgaggtctgttgtcaagatgtagtggttaagctcaggaagatcagcgattgggcactgaaactctcctcgctggacaggcgtactgttactagcatactgtaccccctcctgcgcttgcggcaagcctgttgccatccccaggctgtccggggcgaattccttcctctccagaaatcgactatgaccatggaggagctgctgacctctctgcagaaaaagtgtggaacagaatgtgaggaggctcaccgacaattagtgtgtgcccttaacggcctggctggtatccacatcatcaaaggggagtatgcactggctgccgaattgtatcgtgaggtgcttcgaagttcagaggagcacaagggtaaattgaaaaccgattcccttcagcggctgcacgccacccacaatttaatggagcttctgatcgctcgccatcccggcatcccgcctactctccgagacggaaggttggaagaggaagcaaaacagttacgggagcactatatgtccaaatgtaacacagaggtggctgaggcccagcaagccctataccctgtccagcagaccatccacgaattgcagaggaaaattcactcaaactcaccatggtggctcaacgtgatacatagagcgattgagtttaccatagacgaggagctggtccagagggtaagaaacgaaatcacttcgaattataagcagcaaactggaaagctttccatgtctgaaaagtttcgcgattgtaggggcctccagtttctactgaccacccagatggaggagctcaacaagtgccagaagctcgtacgcgaggccgttaaaaatctggaaggccctccatctcgcaatgttatagaatcagcaaccgtatgtcatcttcgacctgcacgcctgcccctcaactgctgcgtattttgcaaagcagacgagttgtttacggaatatgagagcaaactgttctcaaacacagtcaaggggcagaccgccatctttgaagagatgattgaggacgaggagggtcttgtggacgatagggctcctaccaccacacgcggcctatgggccatctctgagaccgagcggagcatgaaggccattttgtcttttgccaaatcccatcgctttgacgtcgagtttgttgatgaaggtagcacatcaatggacctctttgaggcatggaagaaggaatacaaactgttgcacgagtactggatggccttgagaaatcgcgtgtcagccgtggatgagctggcaatggcgacagaacgtcttagagtacgcgatccacgcgagcccaagccgaacccccctgtcctgcacatcatcgaacctcacgaggtggaacagaatagaattaagctgctgaacgacaaagctgtggcaacctctcagctccagaagaaactggggcagctgctttaccttacaaacctggaaaagtcccaggacaagaccagcggcggagtcaatcccgagccttgcccaatctgcgctcgacagttggggaagcaatgggccgttcttacctgtggacactgcttttgcaatgaatgtattagtattattatagagcaatatagcgtgggatcacatcgcagctctatcaaatgtgccatctgtagacagacaacatctcataaggaaatttcttacgttttcacttcggaaaaggccaaccaggaggaagacatccccgtgaaaggcagtcactctacgaaggtcgaggcagtggtgagaacactgatgaaaatccagcttcgggaccccggggcaaaggcactggtgttcagtacttggcaagatgtactggatattatatccaaagctcttacagataacaatatggaatttgctcagatcagcagggtgaagaccttccaggagaatttgagcgctttcaaacgcgaccctcagatcaacattctgctgctgcctttgcacacaggctccaacggcttgaccatcatcgaagcgacgcatgtgctgttagttgagcctatattgaatcccgcgcacgaactgcaggctatcggccgcgtgcatcgcattgggcagacaaaacccactatagtgcatcgctttctgattaaggcaacaattgaggagagaatgcaggccatgctgaaaactgcagaaagaagtcacaccaattctagtgctaaacactccgaagcaagcgtgctgactgttgccgatctggccgacctgttcaccaaggagacagaggagctcgagtag

SEQ ID NO: 13252 - DNA, 468 bp, Artificial Sequence
  Description of Artificial Sequence: Synthetic coding sequence
atggagttcgcccaaatttctagggtgaagacatttcaagagaatctgagtgcatttaagcgtgatcctcagatcaatattctgctactcccactgcataccgggtccaatgggctgacaatcatcgaggccacgcacgtgctgctggtcgagccgattctgaacccagcccacgaattgcaagccattgggagggtgcatagaattggccaaactaaacccactattgttcatagattcctgatcaaagcgactattgaagagcggatgcaggctatgctcaaaactgccgaacgtaggtttttcgaagaacaggccctgttttgtttccacgatatcacacccttctctcacccctggtcactgaccaccgccattctgcagctgcgggatctcgtaatttgcgaactgttcttcatttattttaagaattttcttatatgttttctgagctctttttccatttag

SEQ ID NO: 13253 - DNA, 4980 bp, Artificial Sequence
  Description of Artificial Sequence: Synthetic coding sequence
atgtcctcccgaaggaagcgagcgccaccggtgagggttgatgaggagaagcggcaacaactgcattggaatatgcacgaagacaggaggaatgagcccatcatcatttccgacgatgacgagcagccttgcccaggctccgacacaagcagcgcccactatattattctttcagatagcctgaaagaggaggttgcacaccgagataagaagaggtgtagtaaagtggtctcattctcaaagccgatcgagaaggaggagactgtcggaattttctctcctctgagtgtaaaattaaacattgttatctctccctaccacttcgacaacagttggaaagccttcctgggggagctgaccctccaactgctgccggcccagagcctgatcgaaaatttctccgaacggtcaataacccttatgagcagcgagtcgtcgaaccagttcctcatttacgtccacagtaagggtgaagacgtggagaagcagaagaaagagcccatgagtatttgcgataaaggaatcctggtggaaagcagcttctctggtgagatgcttgaggacctgggatggctgcagaaaaagcggagaattaagctctaccagaagcctgaaggcaatcacatcataaaagtgggtatttaccttctggaggccggtttggctaagcttgatttccttagtgatgctaattcacggatgaaaaagttcaaccagctgatgaaaaaggtcatggagaaattgcataactctatcatccccgatgtcctggaggaagatgaagacgatcccgagtcagagccagagggccaagatattgatgagctctaccattttgtaaaacagacgcaccagcaggagacccagagtattcaggttgacgtgcaacatcctgccctgatcccggtactccggccatatcagagagaagcagtaaactggatgctgcagcaggagtgcttcagaagttctcctgccactgagagcgctctgcacttcctctggcgggagatcgtcacctcagaggggctcaaattatactataatccttacacagggtgtataatccgtgagtatccaaactccggaccccaactgcttggaggaattctcgccgacgagatggggctgggcaagaccgttgaagtgctagcactgattctcacccacactagacaggatgtgaagcaggatgctctcacactgcctgaggggaaggtggtgaattatttcattccgagccactactttggcggaaaactgaagaaaacagagattcagaatattgagttcgaaccgaaggagaaggtgcagtgtccccccacgagagtgatgatcttaaccgccgtaaaagagatgaatgggaagaagggtgtttctattctctcgatttacaaatacgtgtcctccatctaccgctacgacgttcaaagaaaccgcagtttactgaagcgtatgctgaagtgcctgattttcgagggcctggtgaaacagatcaagggccacggattcagtggcactttcaccctcggtaaaaactacaaagaagaagatatctgtgacaaaaccaagaagcaggccgtgggttctcctagaaagatacagaaggagactaggaagagtggaaataaagacacagactcagagtacctgcccagcgacacatccgacgatgacgacgacccctattattattattacaaatctcgccgtaatagatctaagttaagaaagaagctggtcccatcaaccaagaagggcaaatcccagcccttcataaatccggattcacagggccactgtcccgccacatctgattctggcattacagacgtagcaatgagtaaatctacatgcatatccgaatttaaccaggagcacgaaaccgaggactgtgcggagtctcttaaccacgctgattccgatgtcccacctagtaatactatgagtcctttcaatacttccgactataggttcgagtgcatttgcggcgagctcgatcagattgacaggaaaccgagggtgcaatgcctgaagtgccacctatggcagcatgcgaagtgcgtgaactatgatgagaagaacctcaaaataaagcccttttattgccctcactgtctggtagccatggagcctgtgtcaactcgggccacacttattatttctccgtcctctatctgccaccaatgggtggacgaaatcaaccggcacgtaaggtcttccagcttgagggtccttgtttaccaaggggtgaaaaaggacggcttcctccagccccacttccttgccgaacaggatatcgttattatcacttatgacgtgctacgaagcgaactgaactatgtggacattcctcattctaatagcgaggatggtcggagacttcggaatcagaaacgatatatggccatcccaagcccattagtggctgtagaatggtggagaatctgtctagatgaagcccagatggtggagtgtccaactgtgaaagcagccgaaatggcccaacggttgagtggtataaaccggtggtgcatctcaggcacccccgtccagcgcgggctagaggatctgttcgggctcgtggtgtttctgggcattgaaccatattgcgtaaaacactggtgggttcgattgctgtatcggccatactgtaagaagaatcctcaacacctgtacagctttatagccaagatattgtggcgatccgctaagaaagatgtcatagaccagattcagatacctccgcagaccgaagagatccactggctgcatttctcacccgttgagcggcatttctaccatcgtcagcatgaagtatgttgtcaggatgtagtggtgaagctccgcaaaatatccgattgggctctgaagctgagcagcttggatcgaaggaccgtgacttcaatcctgtacccgttattgcgcctccggcaagcctgttgccaccctcaggctgtccgcggagaattcctaccacttcagaagtcttttgaacagtctacattctcattttcaacgatgactatggaggaactgctaacctctcttcagaaaaaatgtggaacagagtgtgaggaagctcacagacagttggtgtgtgccctgaacggactggccggtattcacatcataaaaggcgagtatgctctggccgcagaactgtacagagaggtgctgagatcaagtgaggagcacaagggcaaactgaagaccgactcacttcagagactgcacgccactcacaacttgatggaattgctgattgccaggcacccagggatccccccaactctgagggacgggaggctagaggaggaagctaagcagctgcgtgagcactatatgagcaaatgcaacaccgaggtggccgaagcccaacaagcactgtatccagttcagcagactattcacgaacttcagcgaaagatccactccaatagcccgtggtggcttaacgtcattcaccgagctattgagttcaccattgatgaagaactggtgcaaagggtccggaacgagataacttctaactacaagcagcagaccgggaaactgagcatgagtgagaaagggctccaattcctgctgaccacacagatggaagagctgaataaatgtcagaaactggtaagggaggccgtgaagaacctcgagggaccaccttctcgcaacgtgattgagtctgccaccgtctgtcacttgcgacctgcacggctgcccctgaattgctgcgtgttttgcaaggccgatgagctttttacagaatacgagtcaaagcttttctccaacacagtcaagggtcagactgcaatatttgaagaaatgatcgaagacgaagaggggttagtggacgatcgtgcaccgactaccacacggggcctgtgggcaattagcgagacagagaggtctatgaaggccatcctcagctttgctaaatcacacaggttcgacgtagaatttgttgacgaggggagcacctctatggacctattcgaagcctggaaaaaagaatacaagctcttacacgagtattggatggctctgcgcaatcgggtctctgccgttgacgaattggccatggcaactgagcggctaagggtgcgagacccaagagagccaaaacctaacccacccgtcctgcacattatagaaccacacgaagtggagcagaaccgcatcaaattgctcaatgacaaggccgttgccacttcacagctgcaaaaaaaacttggccagctgctgtacttgaccaacctagagaaatctcaggacaagacgtcaggtggcgttaatcctgagccatgtccaatatgcgccagacagctggggaagcaatgggcggtcttaacctgtgggcactgcttctgcaatgagtgtatcagcatcatcatcgaacagtacagcgtgggttcccaccgatcgtcaattaaatgcgccatatgtagacagacaacgagtcacaaggaaatctcttatgtcttcacgtcagagaaagccaatcaggaggaagatattccagttaagggatctcactccaccaaagtagaggctgtggttaggaccttaatgaaaatccaattgcgcgatcccggcgcgaaggccctcgtgttttcaacatggcaggacgttctcgacataatctccaaggccttgacagataacaacatggagtttgcgcagatttccagggtgaaaactttccaagaaaatctctcagcattcaagcgcgaccctcagataaacattttgctcttaccgctgcacacgggttccaatggactgaccattatcgaggccacacacgtgttgctggtagagcccatcctgaacccggcacatgagttgcaggcgatagggcgcgtccataggatcgggcagacgaagccaaccatcgtccatcgctttctcataaaggctacaatcgaagagcgaatgcaagccatgcttaagacggccgaacgcagcatctacatatag

SEQ ID NO: 13254 - DNA, 1983 bp, Artificial Sequence
  Description of Artificial Sequence: Synthetic coding sequence
atgtcaagcagacgcaagagggcccccccagtgcgggttgatgaagagaaacggcagcagcttcactggaacatgcatgaggacagaagaaacgagcctattatcatttcagatgatgacgaacagccttgccctggagaagatgttgaaaagcagaagaaagagcccatgagtatctgtgataagggtatcttggtcgaatctagtttttcaggggagatgttggaggatcttggatggctccagaaaaagcgccgaatcaagctttaccagaagcctgaaggcaatcacattatcaaggtaggaatttacctcctcgaggcgggacttgccaaattggattttctgtcagacgcgaactcccgtatgaaaaaatttaatcagctcatgaaaaaagtcatggagaaactgcataatagtattatacccgatgttctagaggaggacgaggacgatccagagagtgagccagaggggcaggacattgacgagctatatcacttcgttaagcaaactcaccaacaggagacacagtctattcaggtagacgtgcaacatcccgctctgattcctgtgctgagaccataccaaagggaagctgtaaactggatgctgcaacaggagtgcttccgcagtagtccagctacggaaagtgctcttcattttctgtggagagagatagtaacctctgaaggattgaaactgtattacaacccatacaccggatgcattatccgcgagtacccaaattctgggccccagctactcggtggaatcttggccgatgagatgggactgggcaagacggtcgaggtactcgcgctgatcctcacacacaccaggcaggacgtcaagcaggatgctctgactctgcctgaagggaaggtagtcaattacttcataccttctcattactttggtggcaagttgaaaaaaacggaaatccagaatatcgagttcgaaccaaaagagaaggtgcaatgtccacccacccgagtgatgatcctgacggcggtaaaggaaatgaacgggaagaagggcgtgagcatccttagtatctacaagtatgtgtcgagcatttatagatacgatgttcagaggaatagatcactgctcaaacgtatgctgaagtgtctgatcttcgaagggttggtgaagcaaattaaggggcatggattcagcgggacttttaccctgggcaagaactacaaggaggaagacatttgtgacaagactaaaaagcaggccgtcgggagcccacgcaagatccagaaggagacccgtaagtccggaaacaaagacactgacagcgaatacctgccctcggatacatcggacgacgatgatgacccctactactattactataagtcaaggagaaatcgctctaaactcaggaagaaactggtgccttcaaccaaaaagggcaagtcccagccctttatcaacccagatagccagggccattgcccagcaacgtcagactctggtatcacagatgtggccatgtccaaaagcacatgtatttcggagtttaaccaggagcacgaaaccgaggattgcgccgagagcctgaatcacgctgactccgacgttcctccctccaatacaatgtccccctttaatacgagcgattatagattcgagtgtatttgcggcgaattggatcagattgatcgaaagccacgtgtgcagtgtctcaagtgccacctctggcagcacgctaagtgcgttaactacgacgaaaagaacctaaaaatcaagccattctactgccctcattgcctcgtagccatggaaccagtgtctacccgggctaccctgatcatcagccctagtagtatttgccaccagtgggtggatgagatcaatagacacgtccgctcctcttctttgcgggtcttagtttaccaaggcgtcaaaaaagatggattcctgcagccccattttggaagaacaggttactcatatcattatttatag

SEQ ID NO: 13255 - DNA, 216 bp, Artificial Sequence
  Description of Artificial Sequence: Synthetic coding sequence
atggaacgagctcgggatcggctgcatctgagaaggaccacggaacagcacgtccccgaagttgaagttcaggtaaaaaggagacgaaccgcgagtctgtccaaccaggagtgccagctgtacccaaggagatcacagcagcagcaggtccctgtggttgacttccaggctgaattgcgacaagcatttctagccgaaactccgaggggcgggtag

SEQ ID NO: 13256 - DNA, 216 bp, Artificial Sequence
  Description of Artificial Sequence: Synthetic coding sequence
atggaaagagcgcgcgaccgcctgcatctccgcaggaccactgagcaacacgttccagaagtcgaagtgcaagtgaagagacggaggaccgcctctttaagtaaccaggagtgccaattgtatccgagacggtcccaacaacaacaagtgccagtggtggacttccaagcagagcttcgccaggccttcttagccgaaacacctcgcggcgggtag

SEQ ID NO: 13257 - DNA, 375 bp, Artificial Sequence
  Description of Artificial Sequence: Synthetic coding sequence
atgaccccacagggacgcggaaccgttgctgctgctgccgtggccgccaccgccagcatagcaggagctccgactcagtatccacccgggcgaggaacaccccctcctccagtcggtcgcgctactcccccccctgggatcatggcaccgccccctgggatgcgacctcctatggggccacctatcggtttgcccccggctaggggtacccctatcggaatgccacctcccggcatgcggccaccgcctcctggcatccgcggcgaggcttttctgctcgcactggtgtgttggtatgggtggccactggatttcggcatgagtgactatgccgcctaccttaaaaagacttgcttccaagatctgttcaactag

SEQ ID NO: 13258 - DNA, 216 bp, Artificial Sequence
  Description of Artificial Sequence: Synthetic coding sequence
atggagcgggccagagaccggctccacttacggagaactacagagcaacacgttccagaggtagaggtgcaagttaaacgaagacgcaccgcatccctaagtaaccaggaatgccagctttacccacggcgaagccagcagcagcaagtgccagtggtagacttccaggccgagctcagacaggctttcctggccgagacgccgcggggtggctag

SEQ ID NO: 13259 - DNA, 1611 bp, Artificial Sequence
  Description of Artificial Sequence: Synthetic coding sequence
atggccctcaccagttttctgccagcacctacccagctgtcacaagatcagctcgaagcagaagagaaggcccggtcacaacgcagccgccagacctccttagtctcttctcgtcgcgaaccgcccccttacgggtacaggaagggctggattccccgcctgctcgaagactttggtgatgggggggcattccctgagattcatgtcgcacagtaccccctggacatgggaagaaagaagaagatgagcaacgccctggccattcaggtcgacagcgagggaaaaataaagtacgacgctatcgcgcgtcagggacagtctaaagataaggtaatctactccaagtacactgacctggtgcccaaggaggtcatgaatgctgatgaccctgacctacagcgccccgacgaagaggctatcaaggagatcacggagaagacccgggtggcgctggaaaagtcagtcagccaaaaagtggctgcagcgatgcccgtccgtgccgccgataaactggctccggcccagtacatccgctatactccaagtcagcagggtgtggcattcaattcaggcgcgaagcaacgtgtcatcagaatggtagagatgcaaaaggatcctatggagcctccccgctttaagattaataaaaaaattcccagaggacccccctcacctcccgcccccgttatgcactccccgagtcgaaaaatgacagttaaagagcagcaggaatggaagatccctccctgtatcagcaattggaagaatgctaaagggtatacaatccctctggacaagagattagcagccgatggccgcggcctacagacggtgcatattaacgagaacttcgccaagctcgcagaggctctctacattgcagatcggaaggccagggaggctgtagagatgagggcccaggttgagcgcaaaatggctcagaaggaaaaagagaagcacgaagagaagctgagggaaatggctcaaaaggcccgcgagaggcgagctgggattaagacccatgttgagaaagaggatggtgaggctcgggagcgcgacgagatacggcatgaccggcgcaaagagcgccagcacgaccgcaacctctcccgcgccgcacctgataaaaggagcaagttacagcgcaatgagaatcgggatatctccgaggtgattgcattgggcgtgcctaatcctcgaacgagtaatgaggtccagtacgatcaaagactgttcaatcaatccaagggcatggactcagggtttgctggaggggaagacgaaatttacaacgtgtatgatcaagcttggcggggagggaaagacatggcacagagcatctataggccctccaagaacctggataaggacatgtatggggacgatcttgaagccaggattaaaactaaccggttcgtaccggacaaagagttctctggtagtgacaggagacagcgggggcgcgaaggcccagttcagtttgaggaggacccatttggactggataagttcttggaggaggccaagcagcacggcggttccaagaggccgagtgattcttcccggccaaaagagcacgaacacgagggaaaaaagaggcggaaggagtag

SEQ ID NO: 13260 - DNA, 867 bp, Artificial Sequence
  Description of Artificial Sequence: Synthetic coding sequence
atggctctcacctcgtttttgccggcccccactcagctatcccaggaccagctcgaggccgaagagaaggcgcggtcgcaaaggtcaaggcagacgagtctagtctccagcaggagggagccacctccttatgggtaccgtaagggctggattccacggctgctcgaggactttggtgacggcggtgcttttcctgaaatccatgtcgcacagtatcctcttgacatgggacgcaagaaaaagatgagcaacgccttggccattcaggtcgacagcgagggaaagatcaaatacgatgctatcgcgcgacaggggcagagtaaggacaaggtgatctattcaaagtatacggacctcgtgccaaaagaggtcatgaacgctgacgaccctgatttacaaaggcctgatgaggaagccataaaggagataacagagaaaacccgagttgcgctggagaagtctgtgtctcaaaaagtggccgctgctatgcccgtgcgggccgccgacaaactagccccggcacagtacatccgttatacccctagccaacagggagtcgccttcaacagcggcgccaaacaaagagttatccggatggtggagatgcagaaagatcctatggagccaccccggtttaaaattaacaagaaaattcccagggggccaccgtctcccccggcaccggtgatgcacagccccagtaggaagatgaccgtaaaggaacaacaggaatggaagatccctccgtgtatctctaattggaaaaatgccaagggctatacaatacctctggataagcgcctagcggcagatggccgtgggctccaaaccgtgcacaagaagaagaagaagaaaaaacggaagtag

SEQ ID NO: 13261 - DNA, 558 bp, Artificial Sequence
  Description of Artificial Sequence: Synthetic coding sequence
atggcactcaccagctttctgccggctccaactcagctgagccaggatcagctagaagctgaagagaaggccagatcacagcgcagccggcagacctctctggtctcttcacgtagggaacctcccccgtacggttaccgtaaaggctggattcctcgcctcttggaagactttggcgatgggggcgcatttcctgagattcatgtcgctcaataccccctggacatggggcggaagaaaaagatgtccaatgcactcgctatacaagtcgattccgaggggaagatcaagtatgacgcaatcgctaggcagggacagagcaaggataaggtcatttactcgaaatataccgatttagtccctaaggaagtcatgaatgctgacgaccctgacctacaaaggcccgacgaagaagcaattaaagaaatgactgtcaaggaacagcaggagtggaagattccgccttgcattagtaattggaaaaatgctaaaggttacaccattcctctcgacaagcgtcttgccgcagacgggagggggctacagactgttcattag

SEQ ID NO: 13262 - DNA, 2211 bp, Artificial Sequence
  Description of Artificial Sequence: Synthetic coding sequence
atggtagctgagatccagaacgtggagggacaaaatctgcaggagcaggtctgtcccgagcccatttttcgattcttccgggagaacaaagtggaaatcgcatccgctatcacgcgtccgttcccgttcctgatgggactgcgagacagaagtttcatttccgaacaaatgtacgagcattttcaggaagcattccggaacctggtacccgtaactcgggtgatgtattgcgtcctgagtgagcttgagaagacgttcggatggtcccacctcgaggctttgttcagccgaattaatctgatggcctatcccgacctgaacgagatctacaggtccttccagaatgtatgctatgagcacagccctctccaaatgaacaatgtcaatgatcttgaggacagaccccgcctgctaccctacggaaagcaggagaacagcaacgcttgtcacgaaatggacgatatcgcagtgccacaggaggcactcagctcctcccccagatgtgagcctggtttctctagtgagtcgtgcgaacaattggctctgcccaaggcaggtggaggagacgcggaagatgccccgtccctgctgcccggagggggagtaagctgcaaactggctattcagatagacgagggcgaaagcgaagaaatgcctaagttgttaccgtatgacaccgaggagaccttcgacctaaaaactcctcaggttactaacgagggcgagccagaaaagggcctttgcctgctgcccggggaaggtgaggagggctcagacgactgctccgagatgtgtgatggagaagagagacaggaggctagctcctctctcgccagacggggatctgtgtcgtccgagctcgagaatcacccaatgaacgaggagggggagtcagaggaactggctagcagcttgctctacgataatgtgcccggtgccgaacagagcgcctacgaaaatgagaagtgcagctgcgtgatgtgcttcagtgaggaggtacccggtagccccgaagcaagaactgagagcgaccaggcctgtggcacgatggatacggtggatatagccaacaactccacgctggggaagccgaaacgcaagcggaggaaaaagcggggccatgggtggtctcggatgaggatgagaaggcaggagaacagccagcaaaacgataattctaaagcagatggccaggttgtcagcagtgagaaaaaggccaacgttaatctgaaggatctatccaagatcaggggccggaagagagggaaacctgggacccgcttcacgcagtctgatcgcgccgcccagaagcgcgtacgatctcgggcatcacgtaaacacaaggatgagaccgtagatttcaaggcaccactgctgccagttacgtgtggcggagtgaaagggatcttgcataagaaaaagctccagcaggggattctcgtgaagtgcatacaaaccgaggatggtaaatggtttactcccactgagtttgaaatcaaaggcggtcacgcacgctccaagaattggagactgagcgtccgctgtggtggatggcccctaaggtggctgatggagaatggtttcctgcccgacccaccacgaattagatataggaaaaaaaagcgtattctgaagagccagaataacagctccgtcgacccctgcatgagaaacctcgatgaatgtgaggtctgccgagatggtggtgaactcttctgttgtgacacgtgtagtagggtatttcacgaagactgccacattccacctgtcgaagcggagcgtaccccgtggaactgtatcttctgcagaatgaaggaatccccgggcagccagcaatgttgtcaggaatccgaggtcctggagcggcaaatgtgcccggaggaacagctgaaatgcgagttcctgctcttgaaagtgtattgttgttctgagtcttctttcttcgcaaagatcccttattactactatatccgcgaggcctgccagggtcttaaagaacccatgtggctggataagatcaagaaacggttgaacgaacatgggtaccctcaagtcgagggatttgtgcaggacatgagactgattttccagaatcaccgggcctcttataaatacaaggattttggacagatgggatttagacttgaagccgagttcgagaagaatttcaaagaggtcttcgcaattcaggagacaaatggaaacaattag

SEQ ID NO: 13263 - DNA, 519 bp, Artificial Sequence
  Description of Artificial Sequence: Synthetic coding sequence
atggctcaacagggccagcagggccagatggcctctggagacagcaacctgaactttcggatggtcgctgagattcaaaatgtagaaggccagaatttgcaggagcaagtgtgccccgagccaatattcagattcttcagagaaaataaggtagagattgccagcgccattactcgcccctttccctttttgatgggcctgagggaccgttcttttattagcgaacagatgtatgagcattttcaagaggcttttaggaatctggtgcctgttaccagagtcatgtattgcgtactgtccgaacttgagaaaaccttcggctggagtcacttagaggcgctgttctcccgcatcaaccttatggcttacccggacctgaatgaaatttatcgctcattccagaacgaaaacttatcctcgtctgccgtgctgtgtcagcttgtgtcaccgaacaaggattggaggagtcacgaagaaagcctggcacacacaggcaccctgcgacgtagttgcatgtag

SEQ ID NO: 13264 - DNA, 1218 bp, Artificial Sequence
  Description of Artificial Sequence: Synthetic coding sequence
atggcccaacaggggcaacaaggacagatggccagtggcgatagtaacctgaattttcgtatggtggccgagatccagaatgtagaaggccaaaacctgcaggagcaagtgtgtcccgaacccatcttccggttcttcagggagaataaggttgaaatcgcctctgccattactcgtcccttcccattcctgatgggactgcgcgaccgcagcttcataagcgaacagatgtatgaacatttccaggaggccttccgtaatctagttccagttacccgcgtcatgtattgcgtgctgtctgaactggagaagacatttggctggtcacatctggaggcccttttttcccgtatcaaccttatggcatatccggatctcaacgaaatctaccgttcattccagaacgtgtgttacgagcatagcccactgcagatgaataatgtgaacgacctggaagatcggcccaggctgctgccctacggcaagcaagaaaattctaatgcctgtcacgagatggatgacatcgctgtcccacaagaagcgctaagcagctccccgcgctgtgagcctggattcagcagcgaaagttgcgagcaacttgctctgcctaaggccgggggtggtgacgccgaggacgcccccagcctactcccgggaggaggcgttagctgcaaactcgccattcagatagatgagggtgagtcggaagaaatgcccaagctattaccatatgacacagaagttctcgaaagtaacggaatgatcgacgccgcccgcacgtacagtaccgccccgggagagaagcagggcgaagaagaggggaggaactcaccccgcaagcgtaaccaagataaggaaaaataccaagagagtccagaggggagagacaaggagacatttgatctaaagacccctcaggtaactaacgaaggcgagcccgaaaaaggactttgcttacttccaggcgagggggaggagggcagcgacgactgcagcgagatgtgcgacggggaagagccacaggaagcatcttctagtcttgcccgatgtggaagtgaggggagtgacgattgttccgagatgtgcgatggcgaagagcggcaagaggcccagaagcaggggcgcaaggtgattaagcgggtggcccagtggatcctgtggattctgcagaccactcccctgtgggagaacccccgggggaaagaagataaaagatag

SEQ ID NO: 13265 - DNA, 2604 bp, Artificial Sequence
  Description of Artificial Sequence: Synthetic coding sequence
atggctcagcagggacagcagggccaaatggcctctggggactctaatctaaatttccgcatggtggctgagatccaaaatgtcgaaggacagaaccttcaggaacaggtgtgccccgagcccatctttaggttctttcgcgagaataaagtcgagatcgcctctgcaattacccgtccattcccatttctaatgggacttagagatcgaagttttattagtgaacagatgtatgaacacttccaggaagctttcaggaaccttgttccagtgacccgagttatgtactgtgtcctctcagaactggagaagacttttggatggtcacatctcgaagctctcttctccaggattaatcttatggcctaccccgaccttaatgagatctatcggagctttcaaaatgtctgttacgaacatagcccattgcaaatgaataacgttaacgacttagaagacagaccacggctgttgccttacggcaaacaggagaattccaatgcttgccacgaaatggacgacattgcagtgcctcaggaggcactaagctctagcccaagatgtgagccgggattctcaagcgagtcttgtgagcaattggccctgcccaaggcaggagggggcgatgctgaagatgcaccatccctgctccccggggggggggtcagctgcaaacttgccatccagattgacgagggtgagtccgaggagatgcccaaactactgccttacgacaccgaagtactggaatccaacggcatgattgacgctgctaggacttactcgaccgctccaggggagaaacagggtgaggaagagggtagaaattctccaagaaaaagaaaccaggataaggagaagtaccaggagtctcccgaagggcgggacaaggagacctttgacctgaagactccacaggtgacaaacgagggagaacctgaaaaggggctctgccttctccctggagagggtgaggaaggaagcgatgactgtagcgaaatgtgcgatggggaggagcctcaggaagcctccagcagtctcgcgcgatgcgggtccgtgtcctgtctgagtgctgagacctttgacctgaaaaccccacaagttacaaatgagggtgaacccgaaaaagagttgtcactgttgcctggcgaaggagaagagggcagtgatgattgctctgaaatgtgcgatggagaggagcggcaggaggcttccagctcactggctagaaggggctccgtttccagtgagctcgaaaatcaccccatgaatgaagaaggagagagtgaggaactggcctcatcgctgctctatgataacgtcccaggtgccgaacaaagtgcctatgaaaatgagaagtgcagttgcgtgatgtgtttttccgaagaggtgcccggttcccccgaggccaggacagaatctgaccaggcttgtggcacgatggataccgtggacatcgccaataattccaccctgggtaaaccgaagcgaaaaagaagaaaaaagcgcgggcacggatggtcccggatgcgaatgcggcgccaggaaaactctcagcagaacgacaatagcaaagccgatggtcaggtggtgtcctcagaaaagaaggccaacgttaacctcaaagatttgagcaaaatccgaggccggaagagaggaaaacctggaacaaggtttactcagagcgaccgcgccgcgcagaagcgggtgagatctagagcctctagaaagcacaaagacgagaccgtcgactttaaagcccctctcttgcctgtcacttgcggcggtgtgaaggggattctccacaagaagaaactccagcagggcattctggtgaagtgcatccagacagaggatggaaaatggttcacaccaacagaattcgagattaagggcgggcatgcccgaagtaagaactggaggttgtcggtacggtgtggagggtggcccctgcgttggttgatggagaatggatttctccccgatccgcctaggatccgctaccggaagaaaaaaagaatactaaaaagccagaataatagctccgtggatccttgcatgcgcaacctagatgagtgcgaggtgtgcagggatggcggagagttgttttgttgtgatacctgcagcagggttttccacgaggactgccacattccacctgtcgaggcggaacgtaccccttggaattgcatcttttgtcggatgaaggaaagcccaggttctcagcagtgctgccaggagagcgaggtccttgagcgccagatgtgtccagaggaacaactcaagtgtgagtttctgctgctgaaagtctattgctgctcagagagttcgttctttgccaagattccctattattactatattagggaagcatgccagggactaaaagaaccgatgtggctggacaagattaagaaacggctaaacgagcacggctatccccaggtggaggggtttgtgcaggatatgagactgatctttcagaaccatagggctagttacaagtacaaagattttgggcagatgggatttaggcttgaggccgagttcgagaagaatttcaaggaagtgttcgcaatccaggagacaaatggcaacaattag

SEQ ID NO: 13266 - DNA, 2523 bp, Artificial Sequence
  Description of Artificial Sequence: Synthetic coding sequence
atggcccagcaaggacagcagggtcagatggcctcaggagactcaaacttgaacttcaggatggtggccgaaatacagaacgtcgagggtcagaacctccaagagcaagtgtgcccagagcccatattcagattctttcgggagaacaaggtcgaaatcgcatcagccatcacccggccatttccattcttaatgggcttgcgagacaggagcttcataagcgagcagatgtacgagcactttcaggaggcatttcgaaaccttgtcccagtcacccgggtgatgtactgtgtgctgtcagaactcgagaaaacattcgggtggtcacacctcgaagccctcttttctagaataaacctgatggcttacccagatctgaatgagatttataggagctttcagaacgtttgctatgagcactctccgctgcagatgaataatgtaaacgacttggaggatcgtcctagattgctgccgtatgggaagcaggagaatagtaacgcttgccacgaaatggatgatatcgctgtcccgcaggaggccctgagcagctctccccggtgtgaacccggctttagcagcgagtcctgtgaacagttagcactccctaaggcaggggggggtgatgccgaagacgctccaagccttctgcccggcggcggggtgtcatgtaagctggcaattcagattgacgaaggagaatcagaagaaatgcctaaactcctcccctacgacactgaggtcttagagtcaaacgggatgatcgacgcagcccgtacctacagtactgctccaggtgagaagcagggcgaggaggaaggcagaaactctccccgtaaacgtaaccaagataaagagaagtaccaggagtctccagaaggcagagacaaagagacatttgacctcaaaacccctcaggttacaaatgaaggagaacccgaaaagggactttgtctcctcccgggtgagggcgaggaggggagcgacgattgctcagagatgtgcgacggcgaagagccacaagaagcaagctcctccctcgcccggtgtggctctgttagttgcctttcagccgagacctttgacctgaagactcctcaggttacaaatgaaggagagcctgaaaaagagttaagcttactgcccggagagggagaagtttcttctgagctggaaaaccatcctatgaatgaggagggcgaaagcgaggagttggcgtctagcctgctgtacgacaatgtgcccggggccgagcagtccgcctacgagaacgaaaaatgttcctgcgttatgtgtttttccgaggaggtgccaggttctccagaggcgcgaactgagtcggatcaggcttgtggcaccatggacacagtcgacattgccaacaatagtacactcggaaagcctaaaaggaagcggagaaaaaagaggggccatgggtggtccaggatgcgcatgagacggcaggaaaactctcagcaaaacgacaattccaaggcagacggacaggttgtgagttccgagaagaaagctaatgtgaatctgaaggatctttcaaagatccgcggtaggaagcgcgggaagcccggaactcggttcacgcagtctgatagggcggcacagaaacgcgtgcgatctcgcgcgagtcgcaaacacaaagacgaaaccgtggattttaaggccccactgctgcctgtcacttgtggcggcgttaaaggcattctgcacaaaaagaagttgcagcaaggcatactggttaagtgtatccagacggaggatgggaagtggttcacccctaccgaatttgagattaagggggggcacgctagatcgaaaaactggagattatcggtccggtgtggtggctggccattgcggtggctgatggaaaatggatttctgcctgatccacctcggatccggtaccgaaaaaaaaagagaatcctcaagtctcagaataattccagtgtcgatccatgcatgaggaacctcgacgagtgcgaagtttgccgggacggcggagagctgttttgctgcgacacctgttctcgggtctttcacgaggattgccacattccacccgtcgaggctgaacggacaccatggaactgcatcttttgcaggatgaaagaaagccctggatcccagcaatgctgtcaggaaagcgaggtgcttgaacgccagatgtgtcctgaagaacagctaaagtgcgagttcttgctgcttaaagtgtactgttgcagcgagtcaagtttctttgcgaaaattccttactactattacatccgcgaagcctgtcagggcctgaaggagcccatgtggctggacaaaattaaaaaaagactcaatgaacacggctacccacaggtcgagggatttgtgcaggatatgcgcctaatctttcagaaccacagggcctcttacaaatacaaggactttggccagatgggattccggttggaagccgagttcgaaaagaatttcaaggaagttttcgctatccaggagacaaatggaaataattag

SEQ ID NO: 13267 - DNA, 2307 bp, Artificial Sequence
  Description of Artificial Sequence: Synthetic coding sequence
atggcgcaacagggccagcaggggcagatggcatccggcgactcgaacctcaacttccgaatggtagccgaaattcagaatgtggagggtcaaaacctccaagagcaggtatgcccagaacccatttttcgatttttccgcgagaataaggtagaaatcgcctctgctatcaccagacctttcccattcttgatgggacttagggatcggagttttataagcgaacagatgtatgaacatttccaggaagcttttcggaacctcgtgccggtaacaagagtgatgtattgcgttctgtctgagttagaaaagaccttcggatggtcacatctagaggccttgttcagtcggatcaacctgatggcataccccgatttaaatgaaatttatcgatcattccagaacgtgtgctacgagcattcaccactccagatgaataacgtcaacgatcttgaggaccgcccaagattgctgccttacggtaaacaggaaaattcgaacgcctgccatgaaatggacgatatagcagtcccgcaagaggcgctgagttcgtcgcccaggtgtgaaccaggattcagctcagaaagctgtgagcagctcgcgttgcctaaagccgggggaggggatgctgaggacgcaccctccctgctgcccgggggcggagagaccttcgatctgaaaactcctcaggtcacaaacgagggggaacccgagaagggattatgcctcctaccgggagagggcgaagagggctccgatgactgttcagaaatgtgcgacggcgaggaaccccaggaggcaagtagttccctggctagatgtggatccgtctcctgcctgtccgctgaaacttttgacctgaagacaccacaggttacaaatgaaggcgagccagagaaggaactgagcctgttaccaggagaaggtgaggagggctccgatgactgcagtgagatgtgtgatggggaagaaaggcaggaggctagctctagcctggccagacggggcagtgtgtctagcgagttagagaatcatcctatgaacgaggaaggagaatctgaggaactggcttcttctctcctttatgataacgttcctggggccgaacagtcggcctacgagaacgaaaagtgctcatgtgtgatgtgcttcagcgaggaagtgcccggaagtccagaagcgcggaccgagtcagaccaggcgtgcggaactatggatacggtggacatagccaacaactccactctggggaaacccaagcggaagcgccgcaagaaacgtggccacggctggagcagaatgagaatgcggcggcaggagaatagtcagcaaaatgataacagcaaggccgatgggcaggtcgtaagtagtgaaaagaaggccaatgtgaatttgaaagacttgtctaagatccgcggaaggaaacgcggcaaaccaggaacacgcttcactcaatccgaccgggcggcccagaaaagggtgagatcacgagcctcccggaaacacaaggacgaaacagtggattttaaggcccccttactgccagttacatgcgggggggtgaagggaatcctgcacaaaaagaagctccagcaggggattttggtcaagtgtatacagaccgaggacgggaagtggttcactcccaccgaattcgaaattaagggcggacacgctagaagcaagaactggagattgtcagtccggtgcggagggtggcccctcaggtggctcatggaaaatgggtttctccctgatccaccacgcattcggtaccgtaaaaaaaagcgcatcctcaagtcccagaacaattcgagtgtggacccgtgtatgaggaatctggacgaatgtgaggtgtgcagagatgggggtgaactgttctgctgtgatacatgttcccgagtgtttcatgaggactgccacatcccccccgtggaggctgagcgtaccccatggaattgtatcttttgtcggatgaaagaaagccccgggagtcagcagtgctgccaggagtctgaagtcctggagcgtcagatgtgccccgaggaacagctcaagtgcgagttcttgttgttgaaagtgtattgttgtagtgaatctagcttttttgccaaaattccatactactattatatccgcgaggcatgccaagggctgaaagagcctatgtggctggacaagatcaagaagagactcaacgaacatggatacccacaggtggagggctttgtccaagatatgagacttatctttcagaaccacagagcctcctacaaggccgtgcacgggagacctggctgccggtag

SEQ ID NO: 13268 - DNA, 570 bp, Artificial Sequence
  Description of Artificial Sequence: Synthetic coding sequence
atggcgcagcagggtcagcaaggacagatggctagtggagacagcaatctgaattttcgtatggtcgctgagatccagaatgtggaaggacagaatctccaggaacaggtttgcccagagcccatcttcaggttctttagagagaacaaggtggagatagcaagcgccattacccgcccatttccattcctgatgggcctccgggaccgctccttcattagcgaacagatgtacgagcactttcaggaggccttcaggaatcttgtgcccgtgacccgcgttatgtactgcgtgctgagcgagttggagaagaccttcgggtggagtcacttagaagcccttttcagccgaattaacctcatggcataccccgatctgaatgaaatctatagatctttccagaatgtgtgttacgaacacagcccactgcagatgaataacgtcaatgatctggaagatagacctaggctgctgccctacggaaaacaggagaactccaacgcatgccatgagatggatttctgcttgatactccaggaatacgttacaggtaagaagagagagtactag

SEQ ID NO: 13269 - DNA, 1317 bp, Artificial Sequence
  Description of Artificial Sequence: Synthetic coding sequence
atggcaggggggggatccgatctctccacccgcggtctcaacgggggagtgtctcaggtggccaatgaaatgaaccacctccccgctcattcacaaagtctccaacgattgtttaccgaagaccaggacgttgatgaaggactcgtgtacgatacagtgttcaaacacttcaaacgccataagttggagataagtaacgcaataaaaaagacctttccgttcttggagggcttaagggacagagaattgatcaccaacaaaatgtttgaggattccgaagatagctgcagaaacctggtgcctgtgcagcgcgtggtgtacaacgtcctgagcgaacttgagaagacttttaatctctccgttctcgaggccctgttttcggaagtgaacatgcaggaatacccggatctcatccacatctacaagagctttaaaaacgccatacaggataagctgagcttccaggagtcagatcggaaagaaagggaggagagaccagatatcaaactttctcttaagcagggtgaggtacctgaaagcccggaagcaagaaaagagagcgaccaggcctgtggaaaaatggatacagtggatatagctaacaactccaccctgggtaaacctaaaaggaaacggagaaagaagaaggggcacgggtggtcacgtatgggaaccaggacacagaagaataatcaacagaacgacaactcgaaagctgacggccaactagtatccagtgaaaagaaggccaacatgaacctcaaggacctgtccaagattcgtggccggaagagagggaagccaggaacacacttcacccaaagcgacagagctcctcagaagagagtcagaagtcgcgcttccagaaaacacaaagacgaaactgtcgacttccaagccccactgctccctgtcacatgcggcggtgtcaaggggatactgcacaaagagaagctggagcagggaacgctcgccaaatgtatccagactgaggacggcaaatggtttacacctatggagtttgagattaaggggggctatgcccgatccaagaattggcggttatccgtgagatgcggaggctggccactgaggcgactcatggaggaaggttcactgccaaatcctcctcgaatctactatagaaataagaagcgcattctgaagtcccagaataactcatccgtcgacccttgtatgcgcaatctggatgagtgtgaggtgtgccgcgacggtggtgagctgttctgttgtgacacttgtagtagagtatttcacgaggactgccatataccccctgtcgaatctgaaaaatag

SEQ ID NO: 13270 - DNA, 1212 bp, Artificial Sequence
  Description of Artificial Sequence: Synthetic coding sequence
atggcagggggcgggtcggacctcagcacaagaggcctgaatggcggcgtgtctcaggtggccaatgaaatgaatcacctgcctgcgcatagccagtccctgcagagattgtttacggaggatcaggatgtggatgagggcctcgtgtatgacacagtgttcaagcactttaagagacacaagctggaaatctctaatgccatcaagaagacgttccctttcctggaggggctccgcgatcgagaactgattaccaataagatgttcgaagacagtgaggatagctgtcggaacctagtgcccgtacagcgcgtggtgtataacgtgctttcagagctggaaaagaccttcaacctgagcgtgctcgaggctttattctctgaggtcaatatgcaagaatatccagatctgatccacatctacaaatccttcaagaacgcaatccaggataaactatccttccaggagagcgatcggaaggagagggaggaacgacccgacataaaactgagcttaaaacagggagaggtgccagagtcccccgaagcacgcaaagaatctgaccaagcttgtggcaaaatggacacagtcgatattgcaaacaatagcacgctcggcaagccgaaacgcaaaagaaggaagaagaaaggtcacggttggagcagaatgggcacacgcacccagaagaataaccagcagaatgacaattcaaaagccgacgggcagctggtgagcagtgaaaagaaagcaaacatgaaccttaaggacctgtcaaagatacgaggaagaaaaagaggcaaacccgggacacatttcacacagagcgatagggcaccccagaagcgtgtcaggagcagaggcacactcgctaaatgcattcagaccgaagatggcaagtggtttacccctatggagttcgaaattaaaggcgggtatgcaaggtccaagaattggagactatccgtcaggtgcggaggatggccccttaggagattaatggaggaggggtcccttcccaacccccctaggatctattataggaataaaaagcgaatcttaaagtcccaaaacaacagctccgtggacccttgtatgcgcaacctagatgaatgcgaagtctgtcgagacggcggcgagctgttttgctgtgacacgtgctcgagggtctttcatgaggactgtcacatcccgccagtggagtctgaaaaatag

SEQ ID NO: 13271 - DNA, 1743 bp, Artificial Sequence
  Description of Artificial Sequence: Synthetic coding sequence
atggctggaggaggctcggacctgtccacccgagggttaaatggtggggtgtcgcaggtcgctaacgagatgaatcacttaccagctcacagtcagtcattacagagactgttcactgaggatcaggacgtcgacgaggggcttgtgtacgatacagtgtttaagcacttcaagagacacaaactggagatctcaaatgctataaaaaaaacattccccttcttggaggggttgcgggaccgcgagctgataactaataaaatgttcgaagattcggaagacagttgccgaaacctggttcccgtacagagagtcgtgtataacgtgctgagcgaattagaaaaaacctttaacttgagcgttctggaggccctgttctcagaagtcaatatgcaagagtaccctgatttgatccacatatataagtccttcaagaatgccatacaggacaagctgagctttcaggaatcggatcgcaaagagagggaggaaaggccggacataaaactgagcctgaagcagggtgaagttccagagtctcccgaggcacggaaagaatcggaccaggcttgtggtaagatggacaccgtcgacatcgcaaataattccaccctgggcaaacccaagaggaaaaggagaaagaaaaaaggacacggttggagccgcatgggaactcggactcaaaaaaacaaccaacaaaacgataactccaaagccgatgggcagctcgtatcaagcgaaaagaaagcaaacatgaacctcaaggacctgagtaagatccgtggacgcaagcgcggtaaacccggcactcacttcactcagtctgatcgcgctccgcaaaagagagtccgatcacgagcttccaggaaacacaaggatgaaaccgtcgactttcaggcaccgttgcttcccgttacgtgcggcggagtgaaaggtattctgcacaaggaaaaactagaacagggaacactggccaaatgcatacaaacagaggacgggaagtggttcacacctatggagttcgagatcaagggcggttatgcgcggagtaaaaactggagactttctgtccggtgtggaggttggccactcaggcggcttatggaagaaggatccctgccaaacccaccacggatctattatcggaacaagaagagaatcctgaagtcacagaataactccagtgttgacccatgcatgcggaatttagacgaatgtgaggtgtgcagggatggcggcgaactgttttgctgcgatacttgttctagggtcttccacgaagattgtcacataccccctgtggaatccgagaaaactccatggaactgtatcttctgcagaatgaaagaaagccctgggtcacagcagtgctgtcaggagagcgaggtactggaacggcagatgtgccccgaggagcagttaaaatgtgaattcctgctcctgaaggtttattgttgtagtgaaagctcattcttcgcgaaaataccatactactactacattagggaggcctgtcaaggcctgaaggaacctatgtggctggataaaattaagaagagacttaatgaacacggttacccccaggtggagggattcgttcaggacatgagacttatctttcagaatcaccgagcctcgtataagtacaaggactttggacaaatgggcctgagactagaagctgaattcgagaaggacttcaaggaagtgttcgcaatacaagaaaccaatggaaatagttag

SEQ ID NO: 13272 - DNA, 1317 bp, Artificial Sequence
  Description of Artificial Sequence: Synthetic coding sequence
atggccggcggcggatccgatctttcaactaggggcctcaatggcggagttagtcaggtcgcaaatgaaatgaaccacttaccagctcattctcagagccttcagcgactgttcaccgaagatcaggatgtggacgaggggctcgtctacgacacagtgttcaaacattttaagaggcacaaactggagatcagtaacgcaatcaaaaaaacatttccatttcttgaaggtctgcgtgacagagaactgattaccaataagatgttcgaagactccgaagatagctgccgcaatctggtccccgtgcagcgcgtggtgtataatgttcttagcgagctcgagaagactttcaacctaagcgtgctggaggctttgttttctgaggtcaatatgcaggagtatccagatttgattcatatctataagtctttcaagaatgctattcaggataagctgtcctttcaggagtccgatcgaaaggagcgtgaagaaagaccggatattaagctgagcctgaaacagggcgaagtcccagagagtccagaagctagaaaagagagcgaccaggcatgcgggaaaatggacaccgtggacatcgcgaacaattccactttgggcaaaccaaaacggaagcgtcgcaaaaagaaagggcatggctggtcgcggatgggcacgcgtacccagaaaaataaccagcagaatgataactcaaaggccgacggacaactcgtgagtagcgagaagaaagccaatatgaatttgaaggacttgagcaaaatacgcggacgcaagcgcgggaaacctggcacacattttacccagtcagaccgcgccccacaaaaacgcgtgagatctcgggcatccagaaaacataaggacgagacagtggactttcaggcgccccttttgcccgtcacctgtgggggagtcaaaggtatcctgcataaagagaaactggaacagggaaccctcgccaagtgcatacagacggaagatggcaagtggttcacgcctatggagttcgaaatcaagggtggatacgcgcgctcaaagaattggcgcctgtccgtgaggtgtggagggtggcccctgagaagactgatggaagaggggagtctgcccaatcccccacgcatctactataggaacaaaaaaaggatactgaaatcccaaaataactcctctgtagatccatgcatgagaaatctggacgagtgcgaagtgtgccgagatgggggtgagttgttctgctgtgacacgtgctctcgggtttttcatgaggattgccacattccgccagtcgagtccgaaaaatag

SEQ ID NO: 13273 - DNA, 390 bp, Artificial Sequence
  Description of Artificial Sequence: Synthetic coding sequence
atgttcgaggattcggaagatagttgccgaaatttggtgcctgtgcagcgcgtagtctacaacgtcctgagtgagctggagaaaacgttcaatttgtcagtgttggaagctttgttttcagaggtcaatatgcaggaatatcccgatctgatccacatctataagtctttcaagaacgctatccaggataaactgagcttccaggagagcgatagaaaggaacgggaagagcgccctgatatcaaactgagcctgaaacaaggggaggtgccagaatcccctgaagccaggaaggaatcagaccaggcttgtggcaagatggacaccgttgacatcgctaacaatagtactctggggaaacccaaaaggaagagatcaaagaacaagtag

SEQ ID NO: 13274 - DNA, 750 bp, Artificial Sequence
  Description of Artificial Sequence: Synthetic coding sequence
atggccgctaccgccgccgtgagcccctccgactaccttcagccagctgcaagtacgacacaggactctcagccaagcccccttgcccttctcgctgccacgtgtagcaaaataggcccccccgccgtggaagctgccgtaacgccacctgctcccccccagcccaccccgcgcaaactggttcccatcaagcccgcccctcttcctctcagccctgggaagaactccttcggaatactcagttcaaaggggaatatccttcagatccagggatcacagttatccgcttcatatcccggtggacagcttgtgttcgctattcagaatcccactatgattaacaaggggactagatccaacgccaatattcagtaccaggccgtgccacagatccaggccagtaactcacagacaattcaagtgcagccaaatcttacaaaccaaattcagattatccccggaacgaatcaggctattattacgccttcacccagtagccataagcctgtccccattaagcctgcacccattcagaagtcctcgacaaccacaaccccagtgcagtcaggtgccaacgtggtgaagctcaccgggggcgggggaaacgttaccctgacactcccagttaataacttggtgaacgctagcgatacgggcgctcctacgcaactactgacagcttcttgccaaacggggatgctgaactctacgaggatgttcctgtttctggcattcatcaacgtcctttag

SEQ ID NO: 13275 - DNA, 1842 bp, Artificial Sequence
  Description of Artificial Sequence: Synthetic coding sequence
atgagcgacccgcagacctccatggcagccactgcggctgtatccccaagtgactacttgcagcccgccgcttccactacacaggatagccagccaagccccttggcgctcctggctgcaacgtgctccaagattggccctccagccgtggaagccgctgtgacgcctcctgccccaccccagccgacccctcggaagcttgtcccaatcaaacctgcccccttgccactgtcacctggcaagaattcatttgggatccttagcagtaagggcaacatactccagatccagggctcccagctgagcgcctcataccccggggggcagctggtctttgcaattcagaatcccaccatgatcaacaaaggtacccggagcaacgccaacatccagtaccaagccgtcccacagatacaagcatcaaactcacagacaatccaagttcaacccaatttgaccaatcagattcaaatcatccccggtacaaaccaagccattatcacacccagcccctcgagccacaaaccggtgccgattaaacccgccccaatacagaaatcatcgacaacgaccaccccagttcagtccggggccaatgtggtgaagctcactggcggcggcggaaatgtgaccttgacactgcccgtgaacaatcttgtaaacgcatccgacacaggcgctcccactcagctgctcaccgaaagccctcccacccccctgtccaagaccaacaagaaggcaagaaagaagagtcttcccgctagccagccaccagtcgctgtagctgagcaggtggagaccgtgctgatcgaaacgacggccgataacattatacaggcaggaaacaacctgctgatcgttcagagtcctggcggcggccagcccgccgttgtgcaacaggttcaagtggtccctccgaaagcggagcagcaacaggttgtgcagataccccagcaggcgctgcgggtggtgcaggccgcaagtgcgactctacctactgttccgcagaaaccctcacaaaatttccaaatccaggccgctgagccgacccccactcaggtatacatacggacaccctctggcgaggtccagactgtcttagtacaagatagcccccctgcaactgcggctgccacatcgaacacaacctgcagctcaccggccagccgggccccccatctttctggtactagcaaaaaacactcagctgccattctccggaaggagcgaccactccccaagattgctcccgccggctctatcattagcctaaatgccgcccagttggcagccgccgcccaggcaatgcagacgataaatatcaacggagtgcaggtccagggtgtgcccgtgaccatcacgaacactggcggccagcagcagctcactgtgcagaatgtgtccggcaacaacctgactatctcaggactgtcacctacccagatccagttgcagatggagcaggctctcgccggggagacccagcccggggaaaaacgccgtaggatggcttgcacttgtcctaactgtaaggacggagagaaacggagtggcgaacagggcaagaaaaagcacgtgtgtcatatccctgactgcggcaagacgtttagaaagacgtctttactgcgggcacatgtgagactgcacactggcgagcgtccattcgtctgtaattggttcttctgtggcaagcgattcaccaggagcgatgagctgcagcgccatgcacgcacacatactggagacaaaaggttcgaatgtgcgcaatgtcagaagcgcttcatgcgtagcgatcatttgactaaacactataaaacacacctggtgactaaaaacctgtag

SEQ ID NO: 13276 - DNA, 1197 bp, Artificial Sequence
  Description of Artificial Sequence: Synthetic coding sequence
atggcagctgtggctgtgctccgtaatgattccctgcaggcctttcttcaggaccgaacgccatcagcatccccggatctgggaaagcatagcccacttgccctgttagccgccacatgctcccgtattgggcagcccggcgctgcggctccacccgactttctgcaagtgccttacgaccccgccttgggcagcccatcccgtctgtttcacccgtggaccgccgatatgcctgctcatagcccaggcgccttacctccaccccatccttcccttggcttgacccctcagaagacacatttgcagccaagctttggtgccgcgcatgaactcccgctgaccccccctgccgatccatcctacccgtacgagttctcaccggtgaaaatgctcccaagtagtatggccgcacttccagcctcctgtgcccccgcatacgtgccctatgctgcacaagctgcactgccaccgggatattctaatctgctaccccctccacctcccccaccacccccacctacatgtagacagttatcacccaaccccgcccccgacgacctaccttggtggagtatcccacaggccggagcaggtcccggcgctagcggagtccctggcagcggtctctcgggcgcatgtgccggcgctcctcacgcccctagattccccgcctctgctgcggcggcagcagctgcggcagctgctctgcaaaggggtctggttttaggcccaagcgatttcgctcagtaccaatcccagatcgcagcactgttacaaacgaaggcccctctcgcagctaccgcaaggaggtgtcgcagatgtaggtgtccaaactgccaggctgctgggggggctccagaggcagaaccgggaaagaagaagcaacacgtttgccacgtccccgggtgtgggaaggtttatggtaagactagtcacctgaaagcccacctgaggtggcacactggcgaacggccgttcgtgtgtaattggttattttgtggtaagtcctttactcgtagcgatgagctgcaacggcatctgagaacccacacaggagagaagcggtttgcttgtccagagtgcggaaagcgcttcatgagaagcgaccaccttgctaaacatgtgaaaacacaccagaacaaaaagttaaaagtggcagaagcaggggtgaaacgagaggatgctcgggacttgtag

SEQ ID NO: 13277 - DNA, 1131 bp, Artificial Sequence
  Description of Artificial Sequence: Synthetic coding sequence
atgctcaccgctgtctgtggctccctcggaagtcaacatacagaggccccacatgccagcccccccagacttgatttacaacccctgcaaacttatcaaggacatacttcacccgaggccggggattacccttctcctctgcaaccaggagagcttcagtctctcccgctggggccagaggtagacttttcccagggctatgaactgccaggggcttctagccgtgtaacctgcgaggacctcgagagtgattccccactcgctcctggacctttcagtaagctgctccagcccgacatgtcacaccactatgaaagctggttccggcccacacacccaggcgcagaagacgggagctggtgggatctgcatccaggtacaagttggatggatttaccccacacacaaggagcactgacgagtccaggacatcccggggctttgcaggcgggactgggtggatatgttggcgaccaccagttgtgtgcccctccccctcacccacacgcccatcatcttttgcctgccgccgggggacaacacctcctgggccctccagacggagctaaggctctggaagtggctgcccctgagagccaggggttggatagcagtctcgacggagcagcccggcccaaaggctcccgaaggtcggtgcctagatcctctgggcagaccgtgtgcaggtgcccaaattgcctggaagcagaaagacttggagccccatgcggtccggacggggggaaaaagaagcacctgcacaattgtcatatcccagggtgtggcaaggcatatgccaagactagccacctcaaagcccacctcagatggcacagcggcgatcgcccctttgtctgcaattggcttttttgcggcaagaggttcactcggagtgatgagctgcagagacatctccaaacccacaccggaaccaagaaattcccatgcgctgtgtgtagccgggtgtttatgaggagtgatcacctagccaagcacatgaagacccatgagggggccaaagaagaggcggcgggagctgcctcgggagagggaaaagctggcggggctgtcgagccaccaggcggaaaggggaaacgcgaagccgaagggtccgtggctcccagcaattag

SEQ ID NO: 13278 - DNA, 1131 bp, Artificial Sequence
  Description of Artificial Sequence: Synthetic coding sequence
atgctgacagcagtctgtggctccctcggatcccaacatactgaggcaccccacgcgagcccccctaggctggaccttcagccactacagacctatcaggggcacacaagccctgaggccggggactacccatcacctttacagcctggggagctgcagtcgcttccattagggccagaggtggatttttcccagggatatgaactccccggcgccagttcgagagtgacttgcgaggacctcgagtccgattcgccccttgcaccagggccgttctccaaactactgcagccagatatgagtcaccactatgagagctggttccgtccgactcacccaggtgcagaagatggatcctggtgggaccttcacccaggaaccagctggatggatttaccgcatacccagggggccttaacctcccctggccatcctggggcgttgcaggccggactaggcgggtacgtcggagaccaccagctgtgcgctccccccccccacccgcatgcacaccatctgttgccagccgcaggcgggcagcacttactggggcctcccgatggtgctaaagccctggaagttgcagctcccgagagtcaggggttggactccagtctcgacggcgctgccaggccgaagggttctcgccggagcgtccccaggagcagtggacagacagtgtgccgatgccccaactgtttggaagccgagaggctaggagccccttgcggacccgatggtgggaagaaaaaacaccttcataactgccacattccagggtgcggtaaggcgtatgcaaagactagccatctgaaagcccacttgcgatggcattcaggagatcggcccttcgtatgcaattggctcttttgcggcaagagatttactaggtctgatgaattgcagcgacatcttcagacacataccggtactaaaaagtttccatgcgcagtgtgctccagagtgtttatgaggagtgaccacctcgctaagcatatgaagacacacgagggggccaaagaggaggctgccggagctgcctcaggggaaggcaaagctggtggggctgttgagcccccgggaggcaaggggaagcgggaagctgagggctccgtagccccctcaaattag

SEQ ID NO: 13279 - DNA, 1455 bp, Artificial Sequence
  Description of Artificial Sequence: Synthetic coding sequence
atggcgacctcaatcctgggcgaggaaccaagattcggaacaacccccctcgctatgctggctgccacctgtaacaagatagggaataccagcccattgacgactttgcccgaaagcagcgcctttgccaaaggaggatttcacccatggaaaagaagctccagtagttgcaacctggggagttccctgtccggctttgccgtggccacaggcgggagaggctctggaggtctcgctgggggaagcggcgctgcaaactccgccttctgtctcgcttcaacgtcccctaccagctccgctttttcctcagattatgggggtctgttctcaaatagtgcagctgctgccgccgccgctgctggagtatcaccgcaggaggctggcggccagagtgcatttatcagtaaagttcacaccacggccgcggacgggctgtatccaagggtggggatggctcacccatatgagagttggtataaatccgggtttcattccacgctagccgccggagaagtgaccaacggcgcagcctccagttggtgggacgtccacagttccccgggctcttggctagaagttcagaacccagcaggggggttgcagagctctctgcatagcggagctccccaggcatccctgcactcgcaactcgggacctataaccccgacttttccagcctgactcactcagcattctcatcgactgggcttggaagctcagccgcagcggcatcccacctattaagcacctcccagcatctgctagcccaggacgggttcaagcccgtattgccatcttattccgatagttccgccgctgtcgctgccgcagccgcttctgcgatgatttcaggggccgcggcggccgccgctggcggttcctcagctcgatcagcacgtcggtacagtggtcgcgctacttgcgattgtccaaattgccaggaagcagaacggctaggacccgctggagcaagtttgcgtcgaaagggcctgcatagctgccacatcccagggtgcggaaaggtatacgggaaaacctcacacctcaaggcccacctgagatggcatacaggtgaacggccatttgtctgcaactggctcttttgcggaaagagattcaccagaagcgatgaactgcagcgtcacctgaggacccacacaggagaaaagagattcgcctgccccgtgtgcaataaacggttcatgcggagcgatcacctgtcaaagcacattaagacccacaatggcggtgggggaggtaagaaaggctcggactcagatacagatgcatcaaatctagagaccccgagaagcgagtcaccggacttgatactgcacgactctggagtgtccgccgctagagccgctgcagccgcagccgccgccgcagcagccgctgctgctgcagcgtctgctggtggtaaagaagcagcctcgggtcctaatgacagttag

SEQ ID NO: 13280 - DNA, 1125 bp, Artificial Sequence
  Description of Artificial Sequence: Synthetic coding sequence
atgagcagggtcccttctcctcccccacccgccgagatgtcctcaggccccgtcgcagaaagttggtgctacacccaaattaaagtggtgaagtttagttatatgtggactatcaacaatttttcattctgtagagaggaaatgggtgaagtgataaagtctagcacattttcatccggagctaacgataaactgaaatggtgtctgagggtgaaccctaaaggcctggacgaggaatctaaagactatcttagcctctacctcctcctggtatcctgccctaaaagcgaagtccgggctaagttcaagttcagtatccttaatgcgaagggagaagagactaaggcaatggaaagccagagggcctatcgcttcgtgcaaggcaaggattggggcttcaagaaatttatcaggagggactttcttctggatgaggcaaacggcctcctgccagacgacaagctaaccttgttctgtgaggtctccgttgttcaggatagtgttaacattagcgggcaaaacaccatgaatatggttaaagtcccagagtgccggctcgcggacgaactaggcggtctatgggaaaactccaggtttacggactgctgtttatgtgtcgccggccaggaattccaggcgcacaaggcaatcctcgctgcacggtctccagtgttctccgcaatgttcgagcacgagatggaagaatcaaaaaagaacagagtggaaataaacgatgtggagccggaagtgtttaaggagatgatgtgtttcatttacaccgggaaagcccccaacctcgataagatggcagatgacctcctcgctgccgccgataagtacgccctggaacggctgaaagttatgtgcgaggacgctctgtgcagcaacttatccgtcgagaatgccgcagaaatcctgatcctagccgacctgcattctgctgaccagctaaaaacacaggccgtagatttcatcaattatcacgcctccgacgtgttagaaacctctgggtggaaatctatggtcgtgtctcacccgcacctggtggccgaggcatacaggtctctggcctcagctcaatgcccttttctcgggcctccccggaagaggctgaaacagagctag

SEQ ID NO: 13281 - DNA, 1125 bp, Artificial Sequence
  Description of Artificial Sequence: Synthetic coding sequence
atgtcccgggtccctagcccacctcccccagccgagatgtccagcggcccagtcgcggagagctggtgctatacccagatcaaagtcgtcaaattttcctacatgtggacaataaacaatttttcattctgccgcgaagaaatgggagaggttattaagagctcaaccttcagcagtggggctaacgacaaactcaaatggtgcttgagggtcaatcctaagggtctggatgaggaaagcaaagactatttgtccctctatctgttgttggtatcctgtcctaagtctgaagttcgggcgaaatttaaattcagcatactaaatgcgaagggggaagaaacgaaggctatggagtcccaaagggcctataggttcgttcagggcaaagactgggggttcaaaaaattcattcgcagagatttcctgctggatgaggcaaacgggcttttgcccgacgacaagttaacactcttctgcgaagtgagcgtggtacaggatagcgtaaatatctcggggcagaataccatgaatatggtgaaagtacccgagtgtagactggctgacgagctgggcggcctgtgggaaaattctcggttcaccgactgctgcctatgtgtagcagggcaggaatttcaggcacacaaggctatcctggcagcccgcagcccagtcttttctgctatgttcgaacatgagatggaggagagtaaaaaaaatcgtgtcgagatcaacgatgtggagcctgaagtgtttaaagaaatgatgtgcttcatctacacaggcaaggcgccgaatctggacaagatggccgatgaccttttagccgccgccgacaagtatgccctagagcggctgaaggtgatgtgtgaggacgccctctgctcaaatttgtctgtggaaaacgctgccgaaatactgatccttgccgatctgcactctgcagatcagttaaagactcaggccgtcgatttcatcaattatcacgcctccgacgtgctggaaacctccgggtggaagtcaatggttgtatctcacccccacttggttgccgaggcttaccggtccctggcatctgctcagtgtccattccttggccccccgcggaagcgccttaagcaatcctag

SEQ ID NO: 13282 - DNA, 1125 bp, Artificial Sequence
  Description of Artificial Sequence: Synthetic coding sequence
atgtcccgggtgcctagccccccccctcctgccgagatgtcaagtggacccgttgctgagtcctggtgttacacacagatcaaggtagtgaagttctcctacatgtggactattaataatttctcattctgtcgcgaagagatgggggaggtaatcaaatcatcaaccttttccagtggcgctaatgacaaactgaagtggtgcctgagagtgaatccgaaaggcctcgatgaagagtcaaaagactacctgagtttgtacctgctcttggtgtcatgccccaagagtgaagtacgcgccaaatttaagttcagcatattaaatgctaaaggggaggagactaaggcaatggagtcgcagagagcatatagattcgtacagggcaaggattgggggtttaagaaatttataagaagggacttcttactggatgaggccaatggcctcctcccagacgacaagctgacacttttttgcgaggtcagtgtagtgcaggacagtgtcaacataagcggccagaataccatgaatatggtaaaagtgccggaatgtagactcgccgatgaacttggcggcctgtgggaaaattcccgctttactgattgttgcttatgcgtggccggccaggaatttcaagctcataaagctatcttggcagcccgcagccctgtgttttctgccatgttcgagcacgaaatggaggagtctaaaaaaaaccgagttgagatcaacgatgttgaaccagaggtcttcaaggagatgatgtgcttcatctatacgggaaaggcgcccaatctggataagatggctgacgatctgttggcggctgccgacaaatatgcccttgagaggttaaaagttatgtgtgaagatgccttgtgtagcaatctatccgttgagaatgccgcagaaattttgatcctagcagatttacattctgcggatcaactgaaaacccaggcagtagactttatcaattatcacgcctccgacgtgcttgagacttccggatggaagagcatggtggtctctcacccccacctggttgccgaggcgtaccgttccctagcttctgcccagtgcccctttttagggcccccgaggaaaaggctgaagcaaagttag

SEQ ID NO: 13283 - DNA, 99 bp, Artificial Sequence
  Description of Artificial Sequence: Synthetic coding sequence
atgagccgcgtgccctctccccctccgccagccgagatgagttccggacctgtagcagaatcgtggtgttacactcagataaaagtcgtgaaattttag

SEQ ID NO: 13284 - DNA, 777 bp, Artificial Sequence
  Description of Artificial Sequence: Synthetic coding sequence
atggagagccaaagggcgtataggtttgttcaggggaaagactggggattcaagaagttcatccgccgcgactttttgctcgatgaagcaaatggactcctccccgacgataaactgacccttttctgcgaagtctccgtcgtacaagatagcgtgaatatctcaggtcaaaacaccatgaatatggttaaggttcctgagtgtagacttgcggacgaactgggcggactctgggagaattctcggtttacagactgctgtctttgcgtggccggccaggaattccaggcccataaggccatccttgccgcccggtcccctgtgttttcagcgatgttcgaacacgagatggaggagtccaagaaaaacagggtggagatcaacgatgttgaaccggaggtgtttaaggagatgatgtgcttcatatacaccggaaaagctccaaacctggacaaaatggccgacgatctcttagccgccgccgataaatatgcactagaacggcttaaggtcatgtgcgaggacgccctgtgctctaacctgagtgtcgaaaacgctgccgaaattcttatcttagccgatctgcattcagccgaccagcttaaaacccaagcagtcgactttatcaactaccacgcatccgatgtcctcgagacaagcgggtggaagtctatggtggtgtcccacccacacttagtggcagaggcttatcggagcctggcatccgctcagtgccctttcctcggaccacctcgaaagagactgaagcagagctag

SEQ ID NO: 13285 - DNA, 1125 bp, Artificial Sequence
  Description of Artificial Sequence: Synthetic coding sequence
atgtccagggttccctctcctccacctcctgctgagatgtcctccggccccgtcgcagagtcctggtgttacactcagataaaagtcgtgaaatttagttatatgtggaccataaacaatttcagcttttgccgtgaagaaatgggcgaagtgattaagagcagcaccttctcaagtggagccaatgataaactgaagtggtgtctccgggtgaaccccaaggggctagatgaggagtctaaggactacctctcactgtacctgttactggtgagctgtcccaaaagcgaggtgcgagccaagtttaagttttcaattctgaacgccaaaggtgaggagactaaagctatggagtcccaacgggcctataggtttgttcagggtaaggactggggttttaagaaatttataaggcgcgattttttactggacgaagcaaacggcctgctgcccgacgataagctgaccctcttttgtgaagtttctgtcgtgcaggacagcgtgaacatctcagggcagaacaccatgaatatggtcaaggttccggaatgtagactcgctgatgaattaggcggcctctgggaaaattcccgtttcactgattgttgcttatgtgtggctggccaagaattccaggcacacaaggcgattcttgcagctagatcccccgtgttcagtgctatgttcgagcatgagatggaagagtccaaaaagaatcgagtggagataaacgacgtggagcccgaggtattcaaggagatgatgtgctttatatacacaggaaaagccccaaatctggataaaatggccgacgacctattggccgcagcagacaagtatgcactggaacgactgaaagtgatgtgcgaagacgctctgtgcagcaatcttagcgtggagaacgcggctgagatccttatactagctgatctccactcagccgaccagctcaaaacacaggccgttgatttcattaactatcacgccagtgacgtcctggagacatctggttggaagtccatggttgtttctcacccacatctggtggccgaagcctaccggtctctggcttccgcccagtgcccctttctcggtcctcctaggaagcgtttaaagcagtcttag

SEQ ID NO: 13286 - DNA, 1125 bp, Artificial Sequence
  Description of Artificial Sequence: Synthetic coding sequence
atgagccgggtgcccagtcctcccccccccgccgagatgtctagtggaccagtcgccgagtcctggtgttatacccagattaaagtcgtcaaattttcctatatgtggacaattaataatttttccttctgcagggaagagatgggagaagtgattaaaagcagtacattctcttccggcgcgaacgacaagcttaaatggtgtctgcgtgtgaatccaaagggcttggacgaagaatccaaggactacctatcactgtatctactgctagtcagctgtcctaagtctgaagtgcgagctaagtttaaattttccatattgaacgctaaaggcgaggagactaaagctatggagagtcagcgggcctacagattcgttcaaggcaaggactggggattcaagaaatttatccggagagatttcttactggatgaggctaacggtctactgcccgacgataagttaactctcttttgtgaggtttctgtcgtgcaggatagcgttaacatttcaggtcagaacactatgaatatggtgaaagttccagaatgtcgcctggccgatgagttagggggcctgtgggagaactcacgcttcacggactgctgcttgtgcgttgcagggcaggaatttcaggcgcacaaagcaatcctcgccgctcgcagcccagtgttcagcgctatgtttgagcatgaaatggaagagagcaaaaagaaccgcgtggaaatcaatgatgtggaacccgaagtatttaaagaaatgatgtgtttcatttacaccggtaaagcacctaatcttgacaagatggccgacgacctcttagcagcggcggataagtacgctcttgaacgccttaaggttatgtgcgaggatgctctttgctccaatttgtctgtcgagaacgcggccgagattctgattcttgctgacctacattcagcagatcagctgaaaacacaggctgtcgactttataaattatcacgcttccgacgtgctagagactagtgggtggaagagcatggtggtgagccacccccacctggtcgctgaagcctatcgcagtcttgcaagtgcccagtgtccttttctgggcccaccacgtaagagactgaagcaatcttag

SEQ ID NO: 13287 - DNA, 717 bp, Artificial Sequence
  Description of Artificial Sequence: Synthetic coding sequence
atgagccgagtaccctccccacctcctcccgcggagatgtcctccggacctgtcgccgaaagctggtgttacacacagatcaaagttgtaaaattttcatatatgtggacaattaataacttctcattctgtcgcgaagaaatgggggaggtaattaaatcgagtacttttagctcaggcgcgaatgataagctaaagtggtgtctaagagtcaaccccaagggtctcgatgaagaatccaaagactatctgtccctgtatcttctcctcgtctcctgtcccaaatccgaggtgcgggcaaaattcaagtttagtatccttaacgcaaagggggaagaaacaaaagccatggagtcccagagggcataccggttcgtgcagggcaaggattggggatttaagaagttcatccgcagggacttcctgctagatgaggcaaatggcctcctgcctgatgacaagctcacattgttttgtgaggtgagcgtggtccaagacagtgtgaatattagcggacagaatactatgaatatggtgaaggtccccgagtgcaggctggcagatgagctcggggggctttgggaaaattcgaggtttactgactgctgcctttgcgtagccggacaagagttccaagctcataaggccatccttgccgcacgtagccccgtgttttctgctatgttcgaacacgaaatggaggagtccaagaagtag

SEQ ID NO: 13288 - DNA, 561 bp, Artificial Sequence
  Description of Artificial Sequence: Synthetic coding sequence
atgtctcgggtgccgtcccctcctccacctgccgaaatgtcaagcggtccggtcgctgaaagttggtgctacacccagatcaaagtggtaaaatttagctatatgtggaccattaataacttctccttctgccgggaggaaatgggggaggtgatcaaatcctccacgtttagttctggagccaatgacaagctcaagtggtgtttaagagtgaaccccaagggactggatgaagagagtaaagattatctttccctgtatttgcttctggtgtcctgtccaaagagcgaggttcgggctaagtttaagttcagcatcttgaatgcaaagggtgaggaaaccaaagccatggaatctcagagggcttaccggttcgtgcaggggaaggactggggctttaaaaaatttatcaggcgggattttttacttgacgaagccaacgggctgcttcccgacgataaattaactctcttctgcgaggtttctgtggtgcaggactccgttaacatctccggacaaaataccatgaacatggtgaaggtgcccgagtgccgactgtag

SEQ ID NO: 13289 - DNA, 123 bp, Artificial Sequence
  Description of Artificial Sequence: Synthetic coding sequence
atgagtagggttccaagtccgcccccccccgctgaaatgagcagcgggccagtggctgagtcgtggtgttacacgcagatcaaggtcgttaagttctcatatatgtggacaatcaacaattag

SEQ ID NO: 13290 - DNA, 789 bp, Artificial Sequence
  Description of Artificial Sequence: Synthetic coding sequence
atgtcccgggttccttccccccctccccctgcggagatgtctagcggccctgtcgccgagtcatggtgctacacgcagattaaggttgtcaaattcagctacatgtggaccatcaacaattttagcttctgtcgagaagaaatgggagaggtgatcaagtctagtacgtttagctctggagccaatgataaacttaagtggtgtcttcgcgttaatcccaaggggttggacgaagaatcaaaggactatctgagcctgtaccttttactcgtatcttgccctaaatcagaggtgcgcgccaagttcaagttctccatcctgaatgcgaaaggggaggagacgaaggcaatggagtctcaacgggcatacaggttcgtgcagggcaaagactggggttttaaaaagttcatccggagagactttctgctggacgaagctaacgggctactgcccgatgataagctgactctgttctgtgaagtgtcagtcgtacaagatagcgtgaatatctctggacaaaacacaatgaacatggttaaagtccccgagtgcagactggcagacgaattgggtggactctgggaaaattctagattcactgattgctgcctgtgcgttgccggacaggagttccaggcccacaaagctatcttagctgctaggtctccagtgtttagtgccatgtttgaacatgagatggaggagagcaagaagaacagagttgagataaacgacgttgagcccgaggtgtttaaggagatgatgtgcttcatctacaccgggaagtag

SEQ ID NO: 13291 - DNA, 201 bp, Artificial Sequence
  Description of Artificial Sequence: Synthetic coding sequence
atgagcagggtgccaagtcccccaccacctgctgagatgtcaagcggtcctgtggccgaatcttggtgctacacacagattaaggtggtaaaattttcctatatgtggacaataaataacttctctttctgccgcgaggagatgggcgaagtcatcaagtctagtaccttcagttcgggagccaatgataaactgaaatag

SEQ ID NO: 13292 - DNA, 984 bp, Artificial Sequence
  Description of Artificial Sequence: Synthetic coding sequence
atgggagaggtgattaagtctagcacgttctcctcaggcgccaatgacaaactcaagtggtgccttagagtgaatccgaaggggcttgatgaggagagtaaagattaccttagcctgtacctacttctcgtgtcatgccccaaaagcgaagttagggcaaaattcaagttctcgattctgaatgcaaaaggcgaagagacaaaggctatggaatctcaacgggcatacagattcgtgcaggggaaagactggggattcaagaagtttattaggcgcgattttttgctggatgaggccaatgggctgttgcccgacgacaaactgaccctgttttgtgaagtgagcgtggtgcaggatagcgtcaatatatccgggcagaatacaatgaatatggtaaaggtgcctgagtgtaggttagccgatgagttaggcggcctgtgggagaattcacgcttcaccgactgttgtctatgtgtggctggacaggagtttcaagctcacaaggcaattctagcggccaggagccctgtcttttccgcaatgttcgagcacgagatggaggagagcaagaaaaacagggtggaaattaacgacgtggaacctgaggtatttaaagagatgatgtgctttatttatactggcaaggcaccgaatttagacaagatggctgacgacctcctagccgctgctgacaagtacgcgctggagcgccttaaagtgatgtgtgaagatgcactctgctcaaatctgagcgtggagaatgcggctgaaattttaatcttggccgatctgcactccgctgatcagttgaagacacaggccgtcgacttcattaattatcacgcgtcagatgtgctagagacatctgggtggaaatccatggtggtgagccatccgcacctggttgcagaggcctatcggtccttggcttctgctcagtgtccttttctgggccctcccagaaagcgtctgaagcagagttag

SEQ ID NO: 13293 - DNA, 417 bp, Artificial Sequence
  Description of Artificial Sequence: Synthetic coding sequence
atgagccgcgtgcctagcccaccacctcccgcagagatgtccagcgggcccgtggctgaaagctggtgttatacacaaatcaaagtcgtcaagttttcatacatgtggaccattaacaattttagcttctgcagggaagagatgggcgaggttatcaagtccagcacatttagcagcggcgcaaacgataagcttaaatggtgtctccgagtcaatcccaaggggcttgatgaagagtcaaaggattatctgtctttgtatctgctcttagtgtcttgtcccaaaagtgaggttcgcgccaaatttaagttttccattctgaatgcaaagggggaggaaactaaagccatggaaagccaacgcgcttacagattcgtccaagggaaggattgggggttcaaaaaatttatccgctag

SEQ ID NO: 13294 - DNA, 354 bp, Artificial Sequence
  Description of Artificial Sequence: Synthetic coding sequence
atgagccgggttccttccccaccacctcctgcagaaatgagctctggccccgttgctgagagctggtgttacacccaaatcaaagtagttaaatttagttacatgtggaccattaacaacttttctttctgccgcgaagaaatgggtgaagttatcaagtctagtacattttcgtccggcgccaatgataagctgaaatggtgtctcagagtgaaccctaaaggcctagacgaagagtccaaagactatctgtctctgtatctgctcttggtgagctgtccaaaatcggaggtgcgggccaagtttaagttcagcattctgaacgcaaagggcgaagaaacaaaggccatgtag

SEQ ID NO: 13295 - DNA, 1179 bp, Artificial Sequence
  Description of Artificial Sequence: Synthetic coding sequence
atgtcaagagagccaaccccacccctcccgggggatatgagcaccgggcccattgcggaaagctggtgctacacacaggtgaaagtagtaaaattttcctacatgtggacgattaataactttagcttctgcagggaggaaatgggggaggtcctgaagtcctctacattttcctctggccccagcgataagatgaaatggtgcctcagagtgaatcctaagggcttggacgacgagtccaaggattacctgagcctgtatctgctgctggtctcctgccctaaatcggaagttcgagcaaagtttaagttttccctgctgaatgcgaagagagaagaaaccaaagcgatggagtcccaacgggcctacaggttcgttcagggaaaagattggggttttaagaagtttatcaggcgtgatttcctgctcgacgaagcgaacgggctcctgccggatgacaaactaacactattttgtgaggtgagtgtggtgcaggactctgtgaatattagcggccatacaaacacgaacacgttgaaggttcctgagtgccgactggctgaggaccttgggaatctgtgggaaaacacacgctttactgactgttccttttttgtgcgaggtcaggagttcaaggcacataaaagcgttctggctgcacgcagccccgtgttcaacgcaatgtttgaacatgagatggaggaatctaagaaaaatcgcgttgaaatcaatgatctcgaccctgaagttttcaaagagatgatgcggtttatctacaccggacgcgccccgaacttggacaagatggctgataacctgctggccgccgcggataaatacgcattggaacggctgaaagtgatgtgcgaggaagccttgtgtagtaacttatcggtcgaaaatgtggccgacaccctggttttagctgacctgcattctgccgagcagttaaaggcccaggcaatcgacttcatcaacagatgctcagtcctgcgccaattagggtgcaaagacggcaagaattggaacagtaatcaggccaccgatatcatggagaccagtggatggaagagtatgatccagtcacatccccatctggtcgccgaggccttcagggcactggcatctgcccagtgtccccagtttggaatcccacgaaagcggctgaaacagagctag

SEQ ID NO: 13296 - DNA, 9675 bp, Artificial Sequence
  Description of Artificial Sequence: Synthetic coding sequence
atgcagaaggctagaggcactaggggggaagacgccggaacccgagcaccgccatctccaggggtgcccccaaaaagagccaaggtcggcgcagggggtggggcccctgtggccgtggctggagcgcctgtgtttcttcgcccgttaaaaaatgccgcggtttgtgctggcagcgacgtgcggctccgggtggttgtctccgggacacctcagccaagccttcggtggttcagggacgggcagctgctgccagctcctgctcccgagccatcatgtctgtggttgaggcgctgtggcgcccaggacgccggggtttatagctgcatggctcagaatgaacgtggaagagcgagttgcgaggccgttttaaccgtgctagaggtcggagattcagagaccgccgaagatgacatatccgacgtgcagggtactcaacggcttgagctacgggatgatggcgctttcagcacccccacaggcgggtccgacacgttggtcggtacctctctcgacaccccccccacgagtgtcaccggcacttctgaggaacaggtgtcatggtggggcagtggccagacggtgctcgagcaagaagccgggtccggtggaggaactcggagactgcccgggtctccccggcaggctcaagcaacgggtgccgggccacgccacttgggcgttgagcctctcgtaagggccagtcgagccaaccttgtgggggcttcatggggatccgaggattcgttgtcagtggcgagtgacctctatggaagcgctttttccctgtacaggggacgtgccttgtctatccacgtttctgtcccccaaagcggtctgaggagagaggagcccgatctgcagcctcagctagcgtccgaggctccgcggagaccggctcaaccaccgccctctaagtctgcattactgccccccccatcgcctcgcgttggaaagcggtcacctcccggaccgcccgcgcaaccggcagctacaccgacttcccctcacaggagaacccaagaacccgtgcttcccgaagacactacgactgaagaaaaaagaggaaaaaagagcaagtcaagcggccctagcctcgcagggacagccgagagccgtccacaaacacctctcagcgaggctagcgggcgcctgtcggctctgggaaggtccccgcgattagtgagggctggctccaggatcctggacaagctgcagttcttcgaggagagaaggcggagcctggaaaggagcgatagcccccctgctcccttacggccatgggttcctctgagaaaggctcgtagtctagaacagcctaagagcgagaggggtgctccatggggtactccgggtgcaagccaggaggagctacgggcacctggctccgtggcagaacggcggagattgttccagcaaaaagccgctagcctcgacgaacggactcgtcagcggtcaccagcctccgacttggagttgcgatttgcccaggagcttgggagaatccgacggagtaccagtagggaagaactggtccgtagtcacgagagcttgagggccacacttcagcgggctccatcaccaagagagcctggcgaacctcctttgttcagtcgacctagtactcctaaaacctctcgagctgtttccccagccgccgctcagcctccatctccatctagtgccgagaaacctggtgatgagccagggcgccccaggagtcggggcccagcggggcgcacagagccaggagagggcccccagcaggaagtgagacgcagagatcagtttcccctgacgagaagtagggccatccaggagtgcagatccccagttcccccccctgccgctgacccacctgaggcaaggactaaggcccctccaggacgcaagcgtgagccccccgctcaggcggtgaggttcctgccctgggctacacccggcctggagggcgcagctgtcccacagactctggaaaaaaacagggccggtccggaggctgagaaacgcctgcgacgtggtcctgaggaggatggcccatggggcccatgggatcgacggggcgccagatctcaaggcaaaggccgcagagcccggccaactagcccagagctggagtcgtccgatgatagttatgtgagcgccggagaagaacctctagaggcacctgtttttgaaattccacttcagaacgttgtggtggcacccggcgccgacgtgctcctcaagtgtataattaccgcaaaccctccccctcaggttagttggcacaaagatggctcagcactgcgcagtgagggcagactgctgctgcgcgcggaaggtgaacgacacacacttctgttgcgagaagctagagcagctgatgccgggtcctacatggctaccgccaccaacgaattgggccaagcaacctgcgctgccagtctgactgttagacctggtgggtctacctcaccctttagcagtcctatcacgtccgatgaggaatacttgagcccacccgaggaattccctgagcccggcgaaacatggccgcgcacacctactatgaaaccaagccccagccaaaaccggcgctccagtgacacagggagcaaagcaccacccacattcaaggtgagtctcatggaccagtcagtccgggagggacaggatgttatcatgagtatcagggtacagggggagccaaagccggtggtctcttggctgagaaaccggcagcctgtccggccagaccagagaaggttcgctgaggaagctgaaggcgggctatgccgtctgcggatcttggccgctgagagaggagatgcgggattctacacatgtaaagccgtgaatgagtacggtgctagacagtgtgaagcaaggctcgaggtccgggctcaccccgaaagcagatctcttgctgttctcgcccctcttcaggatgtggatgtgggcgccggggagatggccctcttcgagtgcctcgtagctggaccaaccgatgtggaagtggattggctatgccgcggacggttgctacagcccgcgctgttgaagtgtaaaatgcatttcgatggccgcaagtgtaagctcttattaacaagtgtgcatgaggacgacagcggcgtgtatacatgcaaactgagtacggcaaaggacgagctgacctgttctgcccggcttacggtgcgaccttcattggctccgttgtttactcgtttgctagaggatgtcgaagtcctggaggggcgggctgccagattcgactgtaaaatttccgggacccctcctccagtggtgacgtggacccatttcgggtgtccgatggaagagagcgagaatctgcgattgcgacaggatggcggtctgcacagcctccacatagcccacgttgggagtgaagacgagggcctgtacgcggtaagtgccgtgaatacccacggtcaagcacactgctccgcccagctgtacgtggaggagcccagaacagccgcttccgggccctcatccaagcttgaaaagatgccatcgataccggaggaaccagagcagggtgagctcgagaggttatccatccccgacttcctccgcccactgcaggacctggaggtcggacttgccaaggaagcaatgctcgaatgccaagtgactggactcccgtaccccaccatctcttggtttcacaacgggcaccggattcagtcatctgacgacaggaggatgacccagtaccgggacgtccataggctggtttttccggccgttggcccgcaacacgccggcgtctacaagtctgtgattgccaacaagctgggcaaggcagcttgttatgctcatctttacgtcactgacgtcgttccgggcccgcccgacggcgccccccaggtggttgcagtcacaggacggatggttaccttgacttggaacccaccacggagtctcgacatggccattgatcctgactctctgacctacacagttcaacatcaggtgctgggaagcgaccagtggacagctttagtcactggacttagagagcccggatgggccgctacgggtctccgcaagggcgtgcagcacatatttcgcgtattgagcaccacagttaaatcgagtagtaaaccttcccctccatcagagcccgtgcagctcttggaacatggtcctaccctagaagaggccccagccatgttggacaagccagatattgtctatgtcgtggaggggcaaccagcgtctgtcactgtgaccttcaatcacgtggaggcccaggtggtgtggagatcctgcaggggtgccctgttggaagcaagagccggagtgtatgaactgtcgcaacccgacgatgaccagtattgtcttagaatctgtagagtctcccggcgagacatgggcgctcttacctgtacagcccgcaataggcacgggactcaaacctgtagcgtgacactggaattggccgaagcgccacgcttcgagtccatcatggaggacgtggaagttggagccggtgaaactgcccgattcgcagtggtcgtagaaggaaagcccctccccgacataatgtggtataaagacgaagtcctcctgacagaaagcagccacgtctccttcgtgtacgaggaaaatgaatgctccctggtcgtactgtctaccggggcccaggatggcggggtgtacacatgcactgcacagaacctcgccggagaggtgtcttgcaaagcagagctggccgtccacagcgcccagaccgctatggaagttgaaggcgtaggcgaagatgaggatcatcggggacggcggctgtctgacttctatgacatccatcaagagattgggagaggcgctttctcctaccttagacgcattgtggagcgcagctctggcctggagttcgctgctaagtttatcccttcccaagccaaacccaaagccagtgcaaggcgggaagccagacttcttgctagactgcaacatgattgtgttctctactttcacgaagccttcgagcgacgaaggggcctcgtcattgtcacggagctctgcaccgaagaacttctggagagaatcgcccggaaacctactgtctgcgaatcagagattagggcttacatgagacaggttctggagggtatccattaccttcaccagtcccatgtactgcaccttgatgtgaaacccgagaacctgctcgtctgggacggagcagccggcgaacagcaggtgagaatatgcgacttcggaaacgctcaggagctcactcccggggaaccacagtattgtcagtatggcacacccgagttcgttgcccccgagatcgttaatcagtcccccgtttctggagtgaccgacatctggcccgtgggtgtggtagcctttctttgcctcactggcatcagcccatttgtcggagagaacgacagaaccaccttgatgaacatcagaaactacaacgtggcattcgaggaaacgacattcctctccctttcccgcgaagcgcgagggttcctgattaaggttttagtccaggataggttgagacccacagctgaggaaaccctcgagcatccttggttcaagacccaggcaaagggcgcagaagtgtccaccgaccatctcaaactctttttaagccgtcggaggtggcaacggtctcagattagttacaagtgtcacctggtgcttcgtccaattccggaactgctgagggccccacccgagcgagtgtgggttacaatgcccaggcgcccacctccttcaggaggcctgtcctcctctagcgactccgaggaggaggaactcgaagagctcccttcggtccctcgccccctacagcctgaattcagtggaagcagggtatcacttaccgacattcccactgaggacgaagccttaggtacaccagaaacaggcgccgccacacccatggactggcaggagcaaggacgggcaccttctcaggatcaggaagccccctcgccagaagctctgccttcacccggtcaggaacctgcagccggtgcctcccctagacgaggcgagctgcgtcgcggctcctctgctgagtctgcacttccacgagctggcccccgagagctagggagaggtctccacaaggcagcttcagttgagctccctcaacgccgatctccttctcccggggctacaaggctcgcaagaggagggttgggagagggcgagtacgcacagcgcctccaggcgcttagacagcggctgctccgcgggggtcccgaggatggaaaagtctctggactacgcgggcccctccttgagtcattaggcgggcgcgctcgtgatccaaggatggctagggcggcctcatccgaggccgctccgcatcaccaaccgccgctggaaaatcgtggcctgcaaaaatcatcctcctttagccagggagaggccgagcctaggggaaggcacagaagggcgggggctcctctggagatccctgttgctaggctcggcgcccgcagactgcaagagtctcccagcctctccgccctttcagaggcccagccctcttcccccgcccgcccaagtgccccaaaaccatctacacccaagtcagccgagccctctgctactacaccatctgacgctccacagccgccagcccctcaacccgctcaagataaggcaccagaaccccgacctgaaccagttcgcgcctccaagcccgccccgcccccgcaggccctccagacgctcgccttaccccttaccccttacgcccagattatacaatcgctgcagttaagcgggcacgcccaggggccctcacagggccccgcagcaccgccctcggagcccaaaccgcacgcagcagtcttcgctagggtggcatctccgccgccgggagcccccgagaaacgggttccatctgccgggggaccccctgttctggctgagaaagctagggtgcccactgttccccccaggcctggcagtagtcttagttccagcattgagaatctggaatctgaagccgtttttgaggccaagtttaagcgttctagggagtctcccctgagcctcggccttcggctgctgtctagaagcagatctgaggaacgagggcctttcaggggcgccgaggaagaagacggcatctaccggccatctccggcaggtaccccattggagctggttcggcggcccgagcgcagtagaagcgtgcaggacctccgagctgtgggcgagccaggcctggtgagacgactgagcctctccttaagtcagcgcctgcgtagaaccccccctgcccagaggcatcctgcctgggaggctcggggcggcgacggtgaatcttcagaaggggggtcctctgcgagggggtccccagtacttgccatgcggagacgtctcagcttcactcttgagaggctttcaagccggctccagaggtccggcagctccgaagacagcggcggcgcctcgggccgttcaaccccacttttcggtagactcaggcgtgctacgagcgaaggagagtcactgcggcggctcggtctacctcacaaccagcttgcggcccaggccggcgcgacgaccccatcagctgagtctcttggttctgaagcttctgccacttctggcagctcagctccaggagagtccaggagcagactgcgctgggggttttccagacctagaaaagacaagggcttatccccgcccaacctgagcgcatcagtgcaggaagagctgggacaccagtatgtccgatccgagtcggacttccctccagtgttccatataaaattgaaggatcaagttctgctcgaaggggaagccgcaacgctgttatgtttgccagcggcttgtcccgcaccccacataagttggatgaaggataaaaagtctctgcgctcggaacccagtgtgatcatcgtctcctgcaaggatgggcgacagctgctctctattcccagagctgggaaaagacatgctggtctgtacgaatgcagcgccactaatgtactgggatcgatcactagctcctgtacggtggcagtagcccgggtgcccggaaagctggcacccccagaggtgccacagacctaccaagacacagctttggtgttgtggaagccgggcgattctcgtgccccctgtacctatacgctcgaaaggagggttgacggggaatcagtttggcaccctgtgtccagtggcatccctgactgttattacaacgttactcatctcccagtgggggttaccgttcgctttcgtgtggcgtgcgctaatcgggctggccaaggccctttcagtaactcctcggagaaggtgttcgtgcgtgggactcaggactcttcggctgtgccgtcagccgctcaccaggaagctcctgtcacttcacgaccagcccgtgcgcgacccccagactcgcccacctctctggctccccccctcgctcctgccgctcccaccccccccagtgtgactgtgagcccttcatctcctcctacccctccttcccaagctctaagcagcttgaaggccgtgggacccccaccacagacaccgccgagacgccatcgggggcttcaagctgcccgcccagccgagcccaccctgccgagcactcacgtgaccccaagtgagccaaagccatttgtgctggatacaggtacaccaatccccgcctcaacgccacagggggttaagcctgtgtcttctagcaccccggtgtatgtggtcaccagttttgtttctgccccaccggcaccggaacctccggccccagaaccacctccggaacccaccaaagtgaccgttcaaagcctctctcctgcgaaggaagtggtgagcagcccgggctctagccctaggagcagtccaagaccagagggtaccacactccgtcagggaccaccccagaaaccctacacctttctggaagaaaaagcgcgtggtcggttcggtgtggtgcgcgcctgtcgcgagaatgctactggccggacttttgtggccaagatcgtcccatatgcagcagaaggcaaaaggagggtcctgcaggaatacgaggtcttgcgcaccctccaccacgagcgaatcatgtccttgcacgaggcttacatcaccccacgctacctggtgctaatcgcggagagctgtggcaaccgggaactcctttgtggattatccgaccgcttccgttatagtgaagacgacgtcgccacctacatggttcaattgctgcagggcctggactatctacatggtcatcacgtcctgcacttggatattaagcccgacaatttactgctggcccccgataatgcattgaagatcgtggattttgggtctgcacagccgtataacccacaggccctccgcccgcttggccaccggactggaactttggaattcatggcgccggagatggtgaagggtgaaccgatcggtagtgccacagacatctggggagcaggtgtcctcacgtatattatgctgagcggccgctcccctttttacgagcccgatccacaggagaccgaggcgaggatcgttggcggtcgtttcgatgcttttcagctgtatcctaatacttctcaaagcgcgacactatttctgcgcaaggttctctccgtacacccatggctaagcagaccctcgagttgtctgtccgtgtgtcacaaagagatcaagatggcctccagctag

SEQ ID NO: 13297 - DNA, 9804 bp, Artificial Sequence
  Description of Artificial Sequence: Synthetic coding sequence
atgcagaaggctcgcggaacaagaggagaggatgcgggcacgcgcgcaccaccaagtccgggggttccgccaaagcgagccaaggtaggcgcaggaggcggagcccccgtggctgttgcaggggcccctgtgtttctgaggccactgaagaacgcagccgtctgcgctggcagcgatgtccgcctgagggtggtggtttccggtacccctcagccgtcactccgctggttccgcgacggacagcttctgccggcccctgcacccgaaccttcctgcctatggttgcgccgttgtggcgctcaagacgctggtgtgtattcctgcatggcccagaatgagcgggggagagccagctgcgaagctgtgttaacagtgctggaggtgggggactctgagaccgcggaagacgatattagtgatgttcaaggcacacaacgcctggaactgagggacgatggcgccttttccacgccaaccggaggaagtgacaccctggtcggtacctctctcgacacaccaccaacatctgttacagggacctccgaggaacaggtatcatggtgggggtccggccaaacagtactcgaacaagaagccggctcagggggaggcacccggagacttcccggttcaccccgtcaggcacaggcgacaggtgccggtccaaggcacctcggagtggagcccctcgtaagggccagccgagctaacttggttggtgctagctggggctcggaagactctctaagcgtggcatccgatctttacgggtctgctttctccctctaccggggtagagcactctccatccacgtatcggttccacagtctggtctgagacgggaagagcccgatctgcagcctcagctggcctcagaagcacccaggaggccagcgcagccacccccctctaagtccgctctcctcccacctccaagccctcgggtgggcaaaaggtctccacccggccccccagcccaacctgctgctactccaactagcccgcatcggcgcacgcaggagcctgtgctaccagaggataccacaaccgaagaaaaacgcgggaagaagtctaagagctcaggtccttctctggcgggaaccgcagaatccagaccccaaactcctctctccgaagcaagcggcagactctcggccctgggacggtctccccgcctggtacgagcaggctctagaattctggacaagcttcaattcttcgaagaacgaaggaggagcctagagcggtctgacagccccccagctcctctcagaccatgggttcccttgcgaaaggccagatccttggagcagcctaaaagcgagcgaggtgcaccgtggggtacccctggagcatctcaggaagagctccgggctcccgggagtgtggcagagcgccgaaggttgtttcaacagaaagcagcttctctcgatgaacggacacggcaacggagtccggcgtctgacctggagctgaggttcgcccaggagctcgggcgaattagacgatccacatccagagaggagctggtaaggtctcatgagtcattaagggcaaccttgcagcgcgcgcctagtcctcgcgaaccaggggagccacctttattctcacggccttccacacctaagacatcccgcgccgtttctcccgcagcggcccagcccccaagcccttcctcagctgagaagcccggcgacgagcccggccgtccaaggtcccggggacccgccgggcgcaccgaacccggagagggcccccagcaagaagtcaggagacgggaccagttcccactaacgaggagtcgggcaatccaggagtgccggtctccagtgcccccccccgcggccgacccccccgaagccaggacaaaggcaccaccaggccggaagcgtgaacctcccgcacaggccgtaaggttcctgccttgggccacacccggcctggagggtgccgctgttccacagacgctggagaagaatagagccggtcctgaagcagagaaacgccttagacgcggcccagaggaggacggaccctggggtccctgggatcgccggggtgctcgctctcagggcaaaggccgcagggctcgcccgacgagcccagaactggagagttctgatgacagttacgtttctgctggtgaagaaccactcgaggctccagtcttcgaaattcccctgcaaaatgtggtggtagcacccggagcagacgtgcttttaaaatgcattatcaccgcgaaccctcctcctcaggtatcctggcataaagatggctccgccttgaggtctgagggcaggctgttacttagggcagaaggcgagcggcacacactgctgcttcgggaggcacgggcggccgatgcaggatcttacatggctacagccacaaatgaacttggccaggctacctgcgcggcttctctgactgttcggcccgggggatcaacgtctcctttctcctcgcccatcacttctgacgaggagtatctctcgcctcctgaggagtttcctgagcctggagaaacttggcctcggactcccacaatgaaaccttctccttctcagaatagaaggagctccgatacaggaagcaaagcccctccaacttttaaagtgagtcttatggaccaatccgtgagagaagggcaggatgtcataatgtcaattcgggtgcagggggaaccaaaacctgtggtgagctggctgcgcaatcgccagcccgttaggccggaccagcgcaggtttgccgaggaggccgagggcggcttgtgtaggctccgcatactggccgccgaacggggcgatgctggtttctacacatgcaaagctgtaaacgagtacggtgctcggcagtgcgaggcacgcctcgaggttcgcgctcatccagagtcccggagcctagccgtgcttgccccactgcaggatgtggacgtaggcgccggggagatggccctcttcgaatgccttgtggctggacccacggacgtagaagtggactggctctgccgcggcagacttctgcagccggctcttcttaagtgtaagatgcattttgacggacggaagtgcaagctgttactgacatcagtccatgaggacgattcaggcgtttatacgtgcaagctgtcaactgccaaagacgagctgacatgctccgcacggctgaccgttagaccatcacttgcaccacttttcacacgactgctagaagacgtcgaggtgctcgaggggcgcgcagccagattcgattgcaagatttctgggacgccccctcctgtcgtgacctggactcacttcggctgtccaatggaagagtctgagaacctgaggctgagacaggatggtggcctgcatagtcttcacatagcacatgtcggatcagaggacgagggactgtatgcggtatccgccgtgaatacgcacgggcaggcccactgtagcgctcagctatacgtggaggagccaaggaccgctgcttctggaccatccagtaagctcgaaaagatgccttctattccggaagaacccgagcagggggaactggagcgtctgagcatccccgattttctgcggcctctgcaggacttggaagtcggtttggcaaaagaggctatgttggagtgccaggtgaccggattaccgtatcccacgatttcctggtttcataacgggcaccggattcagtctagcgacgatagacggatgacacagtatcgggatgtgcatcggctggtgtttcctgcagtaggcccacaacatgccggcgtgtacaagtcagtcattgcgaataaactgggcaaagctgcgtgctatgctcacctttatgtcacagatgtagtccctgggcctcctgacggggccccccaggtggtagctgtaaccggcaggatggtcacgctaacctggaacccgcctaggtctttggatatggcaattgaccccgactctctcacctataccgttcagcaccaggtattggggtcagaccaatggactgcgttagtgactggcctccgcgagccgggctgggcagcaacaggactaaggaagggtgttcagcatatttttagggtgctcagcaccactgtaaagagctcctctaaaccatcgccaccgtccgagcccgtgcaattactcgagcatggccccacactggaagaagccccagcaatgctggacaagcctgacatcgtgtacgtggtggaaggtcaaccggcctcggtgaccgttacgttcaatcacgtcgaggcccaggttgtgtggcggagctgtcggggggctctgctggaggcccgcgccggagtgtatgaactatcccagccagatgatgatcagtactgtctgagaatttgccgcgtgtcccgtcgcgatatgggtgccctgacttgtaccgcccgcaacaggcacgggacacagacatgtagcgtgacactcgaactagctgaggcccctcgattcgaatccatcatggaggatgtagaagtcggggcaggggagacagcccgtttcgccgtcgtggtggagggaaagcctctcccggacataatgtggtataaagacgaggttctgctcactgagagcagccacgtatctttcgtctacgaagagaatgaatgctctctggtggttttatccaccggcgctcaggacgggggcgtctatacatgtacagcacaaaatctcgcaggggaggtgtcatgtaaggccgagctcgctgtacactcagctcagaccgccatggaggtagagggagtaggcgaggacgaggaccatcgcggccggaggcttagtgacttttatgatatccaccaagagatcggccggggcgcattctcgtatctcagacgaatagttgaaaggtcgagcggcctcgaatttgctgccaagttcatcccaagccaggcaaagccaaaagcgagcgcacgccgagaggcgagacttctcgccaggctccagcacgattgcgtcctttactttcatgaggccttcgaaagacggagaggcttagtaattgtgacagagctgtgtactgaggagctgctggagagaatcgctcgcaaacctacagtatgtgaaagcgagatacgcgcctatatgcgccaggtgctagagggcattcactacctccaccagtcccacgtcctgcatctggatgtaaaaccggaaaacctgctggtttgggatggcgcagccggggagcagcaggtccgaatctgtgattttggcaacgcccaggagctgacccccggtgagccccagtattgtcagtacggcacgcctgaatttgtggccccggagatagttaatcagagtccggtgtctggggttactgatatctggcccgtgggggtggttgcgtttctatgcctcactggcattagtcctttcgtgggcgagaacgaccggacaacgttaatgaatatccgaaattacaatgtcgcgttcgaggaaaccacgtttctgtctctctcgagagaggcacgcggcttcctcattaaagttctggttcaggatcgcctacggcccaccgcagaggagaccttggagcatccctggttcaaaacacaagctaagggtgccgaggtatcgacagatcacctgaagctgttcctgtctcggcgtcgctggcaacgaagtcaaatcagttacaagtgccaccttgtcctccgaccaatacccgaactcctgcgagccccgccagagcgagtgtgggtgacgatgccacggaggccaccaccgtcgggtggcctctcttccagctctgatagcgaggaggaggaacttgaggaactcccatccgtaccccggccactccagcccgaattctctggcagccgggtttcgctgaccgacatccctactgaggatgaggccctgggcacaccggagacaggcgccgctacccctatggattggcaagaacaggggagggcgcccagtcaagatcaagaagctccgagtcctgaggctctgccctccccaggacaggaacccgctgccggcgcatctcctagacggggggagctgaggcggggtagttccgcagagagtgctctgcctcgcgctggacccagagagttaggccggggccttcataaggcggcttcagtagagttaccccagagacggagtccttcccctggcgccacccgcctggctcgggggggcctaggcgagggcgaatacgcgcagcgtcttcaggctcttcgccaaagactcctgagaggtggaccagaagatgggaaagtgagtggcctgcgcgggccgttgctcgaatctctaggcgggagagctagagatccccggatggccagagcggcaagctcagaagccgctcctcaccaccagccaccactcgagaaccgaggacttcagaaatcttcgtctttttcccagggcgaagccgagcctaggggccggcaccgaagagcgggtgcccccctggaaatacctgtcgctcgcctgggcgcaaggcgcctccaagaatcaccttccctgagtgccttgtcggaggctcagccctcctcaccagcccggccctcagcccctaagccctctactcccaaaagcgcagaaccaagcgccactacaccctctgacgccccccaaccaccggctccccaaccagctcaggacaaggctcccgaaccccggcccgaacccgtcagggcttctaagcctgcgccacctccacaggcactgcagactctggcccttccactaaccccttacgcccagatcatacagagcttacagctgagcggccacgcccaaggaccttctcagggaccagccgccccgccctctgagcctaaaccacatgcagccgtgtttgccagagtcgcgagcccgccacccggcgcccctgaaaagcgcgtcccatcggccggtggaccaccggtcctcgctgagaaagctagggtgccgacagtcccacctagaccgggatcctccttgagcagcagcattgagaacctggagtccgaagcagtgtttgaagctaagtttaaacgctcgagagaatctccactttcactggggctccgtttgttgtcccgttctagaagcgaggagcggggaccgttccgcggtgctgaggaagaggacggcatctatcgaccttcccctgccggcacgcctcttgaactggtccggcggcctgaaagatccaggtccgtccaagatttgagagcagtaggagaacccggcctggtacgccggctcagtctgagcctcagccaaaggctgcgcaggaccccccccgcgcaaagacatccggcatgggaggctcgagggggtgatggcgaatcaagcgagggagggagcagcgcgaggggaagtcctgtgctggccatgagaaggagactctctttcacactggaacgactttcctcccggctgcagcggagcggctcttctgaggactctggaggggcttctggaagatcgaccccgctctttggtaggttacgccgtgcaacttccgaaggcgagtctctgcgccggctgggcctcccccacaaccaattagccgctcaggcaggcgccacaaccccctccgccgaaagcctcgggtcggaggcaagtgccacttcaggttccagcgctcctggagagtctcgctctcggctccggtggggtttctcaaggccacgaaaagataagggactgtcccctcccaacctgtccgccagcgtgcaagaagaactgggccaccagtacgtcagatcagagtctgattttccacctgttttccacatcaaattgaaagaccaggttctgttggagggggaagctgcgactctgctctgtcttccagcagcctgccccgcccctcacatcagctggatgaaggataagaaatctttgaggtccgagccgtctgtaatcatcgtgtcttgtaaggatggccgacagctcctctctattccgcgtgctggcaaaaggcacgcaggactttatgaatgctcagctacaaatgtgctaggcagcataaccagctcttgtacggtggcagttgcccgggtccctgggaagctcgcaccccctgaggtgccccagacctatcaggataccgccctcgtgctgtggaaacctggggacagcagagctccttgtacctacacacttgagagaagagtggacggagagtctgtgtggcacccggtatccagcggcatccccgactgttattataatgttacacacctgccagtcggcgtcaccgtcaggtttagagttgcctgcgctaatagagcagggcaggggccattcagcaattccagcgaaaaggtttttgtgcgcgggacacaggattccagcgcagtgccctccgcagctcatcaggaggcccccgtaacctcgcgtcctgctagagccagaccacctgattctcccacaagcctggcccctcccctggcacccgctgcccctacaccaccaagtgtgacagtctctccatcaagcccccccaccccacctagccaggctctgtcttcactgaaagcggtcggtcctccgccccagacacccccacggcgccacaggggcctccaggcagcccggccggccgaacccaccctcccgagcacacacgtaactccgtccgagccgaaacccttcgtgttggacactggaacacccatcccggctagcacaccccagggagtgaaaccagtgagctccagcacgcctgtctacgtggtgacctcttttgtctccgcaccccccgctccggagccacccgcgccggagccgcctccagaaccaactaaagtgaccgtccagagcctctccccagccaaagaagtggtgtcctccccgggaagctctcctagatccagtccaaggcctgagggtacaacattgcgccagggccctcctcagaagccttacactttcctcgaggagaaggcacgggggcggttcggggtcgtgcgtgcttgtagggagaacgctacaggccgcacttttgtggccaagatcgtgccttatgccgccgaggggaaacgccgcgtactacaagagtacgaggtcctccggacattacatcatgaaaggattatgtcgctccatgaagcgtacatcaccccccgttatttggtcctcatagccgagtcttgcgggaatcgagaactcctttgtggtctgagcgatcgattcaggtatagcgaggacgacgtcgcgacgtatatggttcagctcttacaaggtctcgactacttgcatggccaccatgtgctccacctagacatcaagcctgataatctgttactggcccctgataatgccttgaaaatcgtggatttcggcagtgctcagccatacaacccgcaagccctacggcccctcggccacagaacgggcaccctcgagtttatggctcctgagatggtgaagggagagcctattggatcggctactgatatctggggcgccggagtgttaacctacatcatgttgtctggcaggtccccattttatgaacctgatcctcaggaaactgaagcaaggatagtgggaggccgcttcgatgctttccaattgtacccaaacaccagccagtccgcgacgctgtttctgcgtaaggtgctctccgtccatccatggtccagaccttctctgcaagattgtctggcccatccatggttgcaagatgcatacttgatgaagctgagacggcagactcttacgtttacaactaacagactgaaggaattcctaggggaacagagacgacgacgcgcagaagcggcaacccgccataaggttttgctcaggtcataccctggcggtccctag

SEQ ID NO: 13298 - DNA, 342 bp, Artificial Sequence
  Description of Artificial Sequence: Synthetic coding sequence
atgaagccctctccctcccagaaccgaaggagtagcgacaccggaagtaaagccccacccacattcaaggtttctctgatggatcagtctgtgagagaggggcaagacgttatcatgtcaattcgagtgcaaggcgagcccaaacccgttgtgagctggctcagaaacagacagccagtgcgaccggatcagcgccggttcgccgaagaggccgagggaggcctatgtcggctaagaatccttgctgccgagcggggagatgcgggcttttacacctgcaaggccgtgaacgagtacggtgctcggcagtgtgaagcgagacttgaggtgcgtggagagtag

SEQ ID NO: 13299 - DNA, 342 bp, Artificial Sequence
  Description of Artificial Sequence: Synthetic coding sequence
atgaaaccgtcgccctcccagaaccgccggtcctcagacacagggtccaaagctcctccaacctttaaagtttccctgatggaccagtcagtgcgggagggacaagatgtgatcatgtctatcagggtgcagggggagcccaaacctgtcgtgtcctggttgcggaacagacagcctgtccgtcccgaccaacgccggttcgcagaagaggcagaaggtggtctatgcagattgcggattctcgccgctgagagaggcgatgcgggattttatacctgtaaggcagtgaacgagtatggcgctcggcagtgcgaggcgcgtcttgaggttaggggtgaatag

SEQ ID NO: 13300 - DNA, 342 bp, Artificial Sequence
  Description of Artificial Sequence: Synthetic coding sequence
atgaaaccgtccccctcacagaaccgtcgtagcagtgatactggaagcaaggctcctcccacctttaaggtgtccctgatggatcaatctgtcagagaggggcaagacgtcatcatgtccatcagagtgcagggcgagcccaagcctgtcgtgagttggttaagaaatcgccagccagtgcggccagatcaaagacgctttgccgaagaagccgagggcggattatgccgattgagaattttggctgcagagcgcggcgatgctggtttctacacctgtaaagcagtcaacgagtacggtgcacgccaatgtgaggcacgtctagaggttcgcggcgagtag

SEQ ID NO: 13301 - DNA, 513 bp, Artificial Sequence
  Description of Artificial Sequence: Synthetic coding sequence
atggcaacagctactaacgaactaggacaggcgacctgtgcggcaagccttaccgtgcggcccgggggtagtaccagtccgttcagctctcctatcacctcagacgaggaatacttatctccccccgaggagttccccgagccaggggagacctggccccggacacccacaatgaaacctagccctagccagaaccgccgcagttccgacacaggctcaaaggctccaccaactttcaaggtgagtctgatggaccaaagtgtgcgagaagggcaagatgtgattatgtcaatacgtgtgcaaggcgaacccaagcctgtggtgagttggctgcgaaacagacagccggttaggcctgatcagaggcggttcgccgaggaagcggaaggagggctctgtcgcctgcgtattttggctgccgaacgaggggatgcaggtttttacacttgtaaagctgtgaatgaatacggcgcacgccagtgcgaagcacgtctcgaggtgagaggagaatag

SEQ ID NO: 13302 - DNA, 1038 bp, Artificial Sequence
  Description of Artificial Sequence: Synthetic coding sequence
atgatttccccggtgctgattctgttttcgagcttcctttgtcacgtcgccatcgccggcaggacatgtcccaaaccggatgacttgcctttctccactgtggtgcccttgaaaacgttctacgaacccggggaagaaatcacatatagctgcaagcctgggtatgtctcgagaggaggaatgcgaaagtttatttgccctctcaccggcctgtggccgattaatacccttaaatgcaccccaagggtgtgcccctttgctgggatattggaaaacggggcagttagatacacaaccttcgaatatccaaatacaatatctttctcgtgcaatactggcttttatcttaacggtgcggactctgccaagtgcaccgaagagggtaagtggagccctgaactacctgtttgtgccccaatcatttgtcctccccccagcatacccacattcgcgaccctccgggtgtataaaccatccgcgggaaataactccttgtatcgcgatacagccgtgtttgaatgcttaccacagcacgcaatgttcgggaatgacacaattacgtgtaccacacatgggaattggaccaaattgcctgaatgtagagaggttaagtgtccatttccatccagacccgataacggatttgtgaattatcctgccaaacctaccctctattacaaggataaggctacatttgggtgccatgacggttactcattggatggtcctgaggagatcgagtgcaccaagctagggaactggtctgctatgccatcttgcaaggcgtcctgtaaagtaccagtgaagaaggcaaccgtcgtataccaaggagaaagagttaagatccaggagaagtttaagaacggaatgctgcacggagataaagtgagctttttctgcaagaataaggagaagaagtgctcatacacagaggatgctcagtgcatagacggaacaatcgaggttccaaaatgctttaaagagcactccagtctcgctttctggaaaacagatgccagcgacgtgaagccttgctag

SEQ ID NO: 13303 - DNA, 1278 bp, Artificial Sequence
  Description of Artificial Sequence: Synthetic coding sequence
atggcctccagcatcatctgccaggagcattgccaaatttctggacaggcgaagattgacatcctgttagttggtgacgtgaccgtgggctatctggcggacaccgttcaaaaactgttcgcgaacatcgccgaggttactatcacaattagtgataccaaagaggcagcggcactgttagatgattgtatcttcaacatggttttgttgaaggtgccctctagcctgagcgcagaggaattggaggcgattaagctgattagattcggaaagaaaaagaacacccactctttgtttgtctttatcattccagaaaactttaaaggctgcatttctggacatggcatggacatagccctgacagaaccgctgacaatggaaaaaatgtcgaacgttgtgaagtattggactacatgcccttctaatactgttaagacagaaaatgccacagggcctgaagaactgggcctgccgcttcaacggagctactccgaacaccttgggtactttcccacggacctttttgcgtgctccgaatctctccgaaatggaaacggtttggagcttaacgcatcattgagcgagtttgaaaagaataaaaagatctctctgctgcacagttctaaagaaaagcttcggagggaacggattaagtactgctgcgagcagctccgaaccctgctgccatatgtgaagggccggaagaatgatgcagcctccgtcctagaggctacagtggactatgtaaagtacataagagagaagatcagtcctgcagtaatggcacagatcacggaagctctccagtctaacatgaggttttgcaaaaagcagcagactcctatcgaactgagtctgcctgggaccgtcatggcgcagcgggaaaatagtgtgatgtccacatacagtccagaacgaggacttcagttcttgaccaacacctgctggaatggctgctctactcctgacgcggaatcttcactagacgaggccgtgagagtaccgagctcaagcgcatccgagaatgccataggagatccctacaagacccacatctctagtgccgccctctccctaaacagcctccacacagttaggtactactccaaggtcacaccaagctacgacgctactgctgttaccaaccaaaatatctccatccaccttccttccgcgatgcctcctgtttctaaactgctccccagacattgcacctctggtctgggccagacctgcactacacaccctaactgcctccagcagttttgggcttactag

SEQ ID NO: 13304 - DNA, 1509 bp, Artificial Sequence
  Description of Artificial Sequence: Synthetic coding sequence
atggagaccctccaggaatccttgaataccctgctgaagcagctggaagaggaaaagaagaccttggagtctcaggtgaagtactatgccctgaagttggagcaggaatctaaggcatatcaaaagatcaataacgaacgccgcacatacttggcagagatgtcccaggggtctggcctgcaccaggtgtccaaacggcagcaagtggaccagctgccccgtatgcaggagaatctggtgaaaactttgctgctgaaggaggagcttgatcctctgaaggccaaaatagatatcttactggtcggcgacgtcaccgtgggatacctggcggatactgtccaaaaactgttcgccaatattgccgaagtgacaattactatttcagataccaaggaggccgctgctctgctggatgattgcatatttaacatggtactcctgaaggtgccttcttcactctctgctgaggagctggaagccattaaactcattaggttcgggaagaaaaagaacacgcattcattgtttgtttttatcattcccgaaaactttaagggctgcataagcggccatggaatggacatcgctttgacggagcctctgacaatggaaaagatgtcgaatgttgtaaagtattggactacatgcccttctaatactgtgaagactgaaaacgctactggccccgaagaactgggtctgccgctgcagcggtcgtacagtgagcacctcggttacttcccaaccgatttattcgcttgttccgagtcactgaggaatggaaacggtcttgaactaaacgcaagcctgagtgaatttgagaaaaataaaaaaattagcctgctgcactcgtctaaagagaaactcagacgggagcgaataaaatattgctgtgaacagttgcgcacccttctgccctacgtgaaggggagaaagaacgatgccgcctcagttctcgaggctacagtagattacgtgaaatacattcgcgagaagatatcgcccgctgtaatggctcaaatcactgaagccttgcagagtaatatgcggttttgtaaaaaacaacagaccccaatcgagttgtctctgccagggaccgtaatggcccagagggaaaactctgtcatgagtacgtacagccctgaacgggggctgcagtttctgaccaacacatgttggaacggttgttccacccccgacgccgagagttccttagacgaggcggtgagagtgccaagctcatctgccagcgaaaacgccattggggacccgtacaagacccacatctcatccgccgccctgagcctgaacagcttgcatacggtccggtattattcgaaagtgacgccttcttacgacgcgactgccgttactaatcagaacattagcattcacctcccgtctgccatgccgcccgtgagcaagctacttccacgtcactgcacttcaggcctaggccagacttgcactacacatcctaactgcctgcagcagttctgggcctattag

SEQ ID NO: 13305 - DNA, 777 bp, Artificial Sequence
  Description of Artificial Sequence: Synthetic coding sequence
atgaaaactcctaatgcccaggaggcagaaggccagcagacccgagccgcggctggaagagccacaggcagcgctaacatgactaaaaaaaaggtgtcgcagaagaagcagcggggtcggccatccagtcagccccggcggaacatagtgggctgccggatatcccacggctggaaagagggagatgaacctataacacagtggaaaggtacggtattagaccaggtccctattaatccatctctgtatctggtgaagtatgacggcatcgattgtgtctacgggctcgagctgcaccgcgatgaaagagtattatcattgaagatcctttccgaccgtgtcgccagtagccacatctcagatgctaatttggctaatactattatcgggaaagctgtcgaacacatgtttgagggggagcatgggtccaaagacgagtggcgagggatggtcctggcccaggcccctattatgaaagcatggttttacatcacttacgagaaggacccagtgctttatatgtaccaacttttggatgattacaaagaaggggatcttcgaataatgcccgagagttcagagtctccacctactgaaagggagcccgggggcgtggttgacggcctcattgggaaacacgtggagtataccaaagaagacggaagcaagcgcattgggatggttattcaccaggtggaggcaaaaccgtccgtctattttatcaagttcgatgatgattttcatatttatgtgtatgatttggtcaagaaaagttag

SEQ ID NO: 13306 - DNA, 777 bp, Artificial Sequence
  Description of Artificial Sequence: Synthetic coding sequence
atgaaaactcctaacgctcaggaggcggaagggcagcagacacgtgcagccgctggcagggccactgggtccgctaatatgactaagaagaaggtttcgcagaaaaaacagcggggccgaccgtcatctcaacctagacggaatatcgttgggtgtcgcatctctcacggctggaaagagggtgacgaaccaattacacagtggaagggtacagtgctcgatcaggtgcctataaatccatctctgtatctggtgaagtacgacggtatcgactgcgtatatgggctggagcttcaccgagacgagcgcgtgctgagtctgaagatcctctcagatagagttgcaagcagccatatttccgatgccaacctggccaataccattattgggaaggctgtggaacacatgttcgagggcgaacacggaagcaaggatgagtggcggggtatggttctcgcccaagcgcccatcatgaaagcttggttctatatcacctatgaaaaggacccagtgctctacatgtaccagttgctggatgactacaaggaaggggacttacggattatgccggaatcttccgaatcacctcctactgaacgagagccaggaggtgtggtggatggcctgatcggtaagcacgtggagtatactaaagaagatggaagtaaaaggattggaatggtgattcaccaagtggaggccaagccctccgtgtattttatcaagttcgatgacgatttccacatttatgtatatgatttagtgaagaagtcatag

SEQ ID NO: 13307 - DNA, 474 bp, Artificial Sequence
  Description of Artificial Sequence: Synthetic coding sequence
atgaagactcccaatgctcaggaagcagaaggacagcaaacccgtgccgccgctggaagggccacagggtctgccaatatgactaagaaaaaggtgagccaaaagaagcaacggggcagaccgagcagtcaaccgcgccgcaatattgttggttgccggattagccatgggtggaaggagggcgatgagcctattactcagtggaagggaaccgtgcttgatcagctattggacgactataaggagggggatctgcgcatcatgccagagagctcagagagcccccccacggagcgcgagcctggaggggtcgtggacggcctgattggcaagcatgtggaatacacaaaagaggatgggagcaaaaggatcggcatggtaattcaccaagtcgaggctaagccttctgtatacttcattaagttcgatgatgacttccacatttacgtttatgatctcgttaagaaaagctag

SEQ ID NO: 13308 - DNA, 777 bp, Artificial Sequence
  Description of Artificial Sequence: Synthetic coding sequence
atgaagacaccaaacgcccaggaggcagagggccagcagacaagagccgccgccggcagggctaccggctctgccaacatgactaagaagaaggtctctcagaagaaacaacgaggccgccccagctcacagccacgtcgaaatatcgtgggatgccgcatatcgcatggatggaaagagggtgacgaacctattacgcaatggaaaggaaccgtactcgatcaggtgccaattaatccatcactctacctagtgaaatatgatggcattgactgcgtgtatgggctagagcttcacagagatgagagagtgctgtcacttaagatattatccgatagggtcgcatcgagccatatctcagacgccaatctggctaataccataatcgggaaggcagtggagcacatgtttgaaggcgagcacggaagtaaagatgagtggagaggcatggttttagctcaggcacccataatgaaggcatggttttacatcacttatgaaaaggaccccgttttatatatgtaccaactcctcgatgactacaaagagggagatcttagaataatgccagaaagcagcgagtctccacccactgagcgggaaccagggggggtggttgatggtttgatcggcaaacacgtggaatacaccaaggaagatggatctaagagaatcgggatggtgattcaccaggttgaggctaagccttctgtctactttatcaaatttgatgatgacttccatatttatgtctacgatctcgtgaaaaagagttag

SEQ ID NO: 13309 - DNA, 744 bp, Artificial Sequence
  Description of Artificial Sequence: Synthetic coding sequence
atgaagactcccaatgcccaagaggccgaaggtcagcagaccagagcagcggccggtagagcaacaggcagcgcaaacatgactaaaaagaaggtctctcagaagaaacaacgtggaagaccaagcagccagccccgcaggaatattgtgggttgtcggatttctcatggatggaaggagggtgacgagccaattacacagtggaaaggaacggtgctggatcaggtgcctatcaatcctagtctctatctggtaaagtacgatggtattgactgtgtgtacgggctggagcttcatagggacgaacgcgtgttgagccttaagatactgtcagatcgtgtggcttcctctcatatctccgacgccaacctggccaatacaattattggaaaagcagttgagcacatgttcgaaggtgagcacgggagtaaggacgaatggagaggtatggtgctcgcccaagccccaattatgaaagcctggttctacataacgtacgagaaagaccccgtcttatatatgtatcagttgctggatgattacaaggagggcgacctgagaataatgccagagagttctgagagccctccaaccgagcgggagccagggggagtcgtggacgggctgatcggcaaacatgtggagtataccaaagaagacggaagcaagagaataggaatggtgattcatcaggttgaagccaagccctctgtgtacttcattaaatttgacgatgatttttag

SEQ ID NO: 13310 - DNA, 1506 bp, Artificial Sequence
  Description of Artificial Sequence: Synthetic coding sequence
atggaaacaatcttggaacagcaacgacgttatcatgaggagaaagagcgattaatggacgttatggccaaggaaatgcttacgaaaaaatcaaccctgcgggaccagatcaattcagatcacagaacacgcgcaatgcaggaccggtacatggaagtctccggcaacctccgcgacctgtatgacgataaggacggtctgcgaaaagaggagctgaatgctatcagcgggcctaatgaattcgccgagttttacaaccggcttaagcaaattaaagaattccatcgcaaacatcctaatgagatctgtgtgccaatgtctgtagagtttgaagaactcctcaaggcacgcgaaaacccttctgaagaggcgcagaacctggttgagttcacagatgaggagggttacggccggtacttagacctgcacgactgttaccttaagtacataaacctgaaggcctccgagaagctagactacataacctacctgagcattttcgaccagctattcgatataccgaaagagcggaagaatgctgagtataagcggtacctggagatgctgctcgagtatctgcaagattataccgatagagtaaaacccctgcaggaccagaatgagttgtttgggaaaatccaggcagagtttgagaaaaagtgggaaaatggcactttcccaggctggccgaaggagacatcatctgcactgacacatgcgggtgcacatctagatctgagtgcattttcatcctgggaagagctggcgagcctcggcctcgatagactgaagtccgctttactggccttgggcctgaagtgcgggggtaccctcgaggagcgcgctcagcggttgttctcaaccaaaggaaagtccctggagtcactggacactagtttgtttgccaaaaatcccaagagcaaggggaccaaaagagatacagagcggaataaagacatcgcattcctagaagcccagatttatgaatacgtagaaatacttggagagcagaggcatttaacccatgaaaacgttcagcgcaaacaagcgcgaactggtgaggagcgagaagaggaagaggaagaacagatatctgaatccgaatcagaggatgaggaaaatgagattatctataaccccaagaaccttcctttgggatgggatggaaaacccatcccatactggctctacaagctccatggtttaaatattaactataactgtgagatctgtgggaactacacataccggggccccaaggcattccagagacacttcgccgagtggcgccatgctcacggtatgagatgtctcgggattccaaatacagcccatttcgccaatgtcacccaaattgaagacgccgtgagtctgtgggccaagctgaagctgcagaaggcttcagagcggtggcagcccgacacagaggaggagtacgaagacagctccggaaacgtggtcaacaaaaaaacgtatgaagacctgaagcgccagggtttactgtag

SEQ ID NO: 13311 - DNA, 1347 bp, Artificial Sequence
  Description of Artificial Sequence: Synthetic coding sequence
atggagaccatcttggagcagcagaggaggtaccacgaggaaaaggagaggctgatggacgtcatggcaaaggaaatgttgactaaaaagtccaccctccgtgaccagatcaatagcgatcacagaacacgcgcgatgcaggacatatgtgtccccatgtctgtggagttcgaagagttactgaaggcgcgggaaaatccttctgaggaagcccagaatctcgtggagtttactgatgaggaggggtatggtaggtatctggatctccatgactgctatctaaaatatataaacttaaaggcttccgaaaaactggactacatcacatatctgtccattttcgaccagctgttcgacatccctaaagaacggaaaaatgcagagtacaaacgctacctggaaatgctcctcgagtacctgcaggactacactgatcgagtgaagcctttgcaggatcagaatgaattgttcggtaaaatacaggcagagtttgaaaagaaatgggaaaatggcactttcccaggatggcccaaagaaacaagctccgcactgacacacgcaggcgctcacctggaccttagtgccttttcatcctgggaggaactggcatctctcggactggatagacttaaatccgccctgttggctctcggactcaaatgcggaggaacattagaagagagggcgcaaaggctgttctcgaccaaaggaaaatccctcgaatctctggacacatctctctttgcaaagaatcccaagtctaaaggtaccaaaagggatacagaacggaataaagatattgccttcttggaagcacaaatctatgagtacgtcgaaatactgggcgagcaacggcaccttacacacgaaaacgtccagcgcaaacaggcacgtacaggcgaggagagggaagaggaggaggaggagcagatctccgagagcgaaagcgaagacgaggaaaacgaaattatttacaacccgaaaaacctgcccctggggtgggatggtaaacccataccctattggctttataagctgcacggactgaacatcaactacaactgcgagatctgtggtaattatacttatcggggtcccaaagcctttcaacgccactttgccgagtggcgccacgcacacggaatgcgttgtctcggcattcccaacactgcacatttcgcaaacgttactcaaatagaggacgccgtgagtctttgggcaaagctgaagctccagaaggcctctgaaagatggcagcctgacaccgaggaggaatacgaagactccagcggcaatgttgtcaacaagaagacctatgaggatctaaaaagacagggactgctttag

SEQ ID NO: 13312 - DNA, 261 bp, Artificial Sequence
  Description of Artificial Sequence: Synthetic coding sequence
atgaccgaccggtacacaatccacagccagctggagcatctacaatcaaaatacatcggcacgggtcacgcggacaccactaaatgggagtggcttgtgaaccagcacagggactcctattgttcctacatggggcatttcgacctgctgaactattttgccattgctgaaaacgagtctaaagctcgtgtaagattcaaccttatggagaagatgctgcagccttgtggcccaccggcggataaacctgaagaaaattag

SEQ ID NO: 13313 - DNA, 3012 bp, Artificial Sequence
  Description of Artificial Sequence: Synthetic coding sequence
atgtacggtgcctccggtggacgtgcaaaacccgaacgcaaaagtggagcgaaagaggaagctggcccaggaggggcaggaggtggcgggagtagggtcgaattgctggtgtttggttacgcatgcaaactgttccgagacgatgagcgtgccctggctcaggagcagggtcaacacctgattccttggatgggcgaccacaaaattctcatcgatcgatacgatggaaggggccatctccacgatctgagcgagtacgatgcggaatattcaacttggaatagagactaccagttaagtgaagaggaagcgagaattgaggccttgtgtgatgaagaaaggtaccttgctctacatactgaccttctggaagaagaggcacggcaggaggaagagtataagaggctctcggaggccctggccgaggacggatcttacaacgccgtgggctttacctacggctctgactactatgacccctcagagccaactgaagaggaagagcctagtaagcaaagggaaaagaatgaagccgaaaacttagaggaaaatgaagagccgttcgtcgctcctctggggttatccgtacccagcgatgtagagctaccacctaccgctaaaatgcacgcaattattgagaggaccgcctcctttgtgtgtaggcagggtgctcaattcgagatcatgttaaaagccaaacaggcccgcaactctcagttcgattttctacgattcgatcactatctgaacccttactataagtttattcaaaaagccatgaaggaaggaaggtacactgtgctggccgaaaacaagagtgatgaaaagaagaaaagcggggtttcaagcgataacgaggatgatgacgatgaggaggacgggaactacctccaccctagtctcttcgccagcaaaaagtgtaatcggctcgaagagctcatgaagcctcttaaagtggttgatccagatcacccccttgccgctctcgttcggaaggcccaggctgactcgtccacgccaactccccataatgcagatggcgccccggttcagcccagtcaggtagagtacacagctgattccactgtcgcagcaatgtactatagttattacatgctcccggacggtacttactgtctggccccccctcccccgggcattgatgtcactacctactacagcacactgccagccggtgtcaccgtttctaattccccaggggttaccacgacagccccacccccacctggtactacgcccctgccaccccccaccacagcggagacctccagcggggccactagcacaacgacgactacgtccgcccttgcacccgtcgccgccatcatacccccaccacccgatgtgcagccagttatagacaaactggccgaatatgtggcccgcaacggtctgaagttcgaaacctcggtccgcgccaagaacgaccagcgttttgagtttttgcagccctggcaccagtacaatgcttactatgagttcaagaagcaatttttcctccagaaggaaggcggagactcaatgcaagcggtaagcgcacctgaggaggcccctaccgattcggccccagagaaaccatcggacgctggcgaggatggcgcccctgaggatgctgccgaagtgggtgcgcgagctggctcagggggtaagaaggaagcaagttcttctaaaacagtcccagatggaaaactagtgaaagccagctttgcacctatcagttttgccatcaaagcaaaagaaaacgatttgcttcctctggagaagaatcgggtgaagctggacgatgattccgacgatgatgaagaatctaaggaaggtcaggaatctagcagttccgctgccaacaccaatccggccgttgcgcctccttgtgtggttgttgaggagaaaaagcctcagcttacgcaggaggaactggaggctaagcaagccaagcaaaaactagaggatcggcttgcggcagcggcccgtgaaaagttagcccaggccagtaaagagtccaaggaaaagcagctccaggccgaacgaaaacggaaagcagccctgtttttacagactttgaaaaatcccctgccagaggccgaggcagggaaaatcgaagagagtccgttttccgtggaagaaagtagcaccacgccgtgtccgctgcttacaggtggtcgtccactgcctaccctcgaggttaagccccctgatagacccagcagcaagtctaaagacccacctcgggaggaagagaaagaaaagaagaaaaagaagcataagaaacgctcaagaacacgtagcaggtctccaaagtaccactccagttccaaaagtagatcccgcagccactctaaagccaagcatagcttgccttccgcctataggaccgtgagaagaagccgcgtgacagcttctcccggaaccctcagggccgaaccatgccagtccagcgcatcagtaacagcagcagctgaaccaggaagctaccaggcagccagcactactaccagatttgactccgcgtcaagcttcgaggggaaacctggtaagactagtcgttctaggtcccggagccctagaagacgcgctcactcgccagagcggaggagagaggagcgatccgtgccaaccgcctatcgcgtcagccgcagcccgggagctagtcgcaagcgaacgaggtctcgctcccctcatgaaaagaaaaagaaacgtcggtcgcgctccagaactaaaagcaaggcacgcagtcagtcagtctccccatccaagcaggccgccccacggcccgccgcgcctgccgcacactcagctcattccgcctccgtaagccccgtggagagtagggggtcctcgcaggagcgaagccgcggagtgtcccaggaaaaggaggcacagatttcttcagccatcgtttcctcggtccagagcaagatcactcaggatttaatggccaaggtgagagctatgctggcggcctccaaaaatctgcagaccagcgcatcctag

SEQ ID NO: 13314 - DNA, 2856 bp, Artificial Sequence
  Description of Artificial Sequence: Synthetic coding sequence
atgtacggtgcaagtggcggacgcgccaaacccgaacggaaatcaggggcaaaggaagaggctggcccaggcggagccggggggggaggatctagagtggagctgttggtgtttgggtatgcctgtaaactttttagagatgacgagcgggcgctggctcaggagcagggacagcacttgataccttggatgggagatcacaagatcctaatcgaccgttatgacggcagggggcaccttcatgacctatcagaatatgatgcggagtactcaacctggaatcgcgattatcagctctctgaagaggaggccagaatcgaggctctatgtgatgaggaacggtatttggctcttcatacagatctcctagaggaggaggcacggcaagaggaggagtacaaaagactatccgaggcattggctgaagatggttcctataacgcagttgggttcacgtatggatctgattattatgatccctccgaacctactgaagaagaagaacccagcaaacagcgcgagaagaacgaggcggaaaacctggaagagaacgaggagccatttgttgctcctctgggcctgagtgtgccgagtgacgttgaactgccgccaacagccaagatgcacgccatcatcgaaagaactgccagcttcgtttgtcgccagggggctcagttcgaaattatgctcaaggcaaagcaggccagaaacagccaattcgacttcctgaggttcgatcactacttaaacccctattataagtttatccaaaaggctatgaaggaaggaagatataccgtattggctgagaataagtctgacgaaaaaaagaagtcgggagtttcttcagacaacgaggatgacgacgatgaggaagatgggaattacctccaccctagcctgttcgcttccaaaaagtgcaaccggttggaggagctaatgaaaccattgaaggtggtcgaccctgatcaccctctggccgcactggttcggaaggcccaggccgactcttcgaccccaacaccccacaatgcggacggcgcacctgttcaacccagccaagttgagtacaccgctgatagcacagtcgccgctatgtactactcatattacatgctgcccgacgggacttactgtctcgccccaccaccacccggcatcgatgtcacaacttactattcgaccttgcccgccggtgtaaccgtgagcaactcccccggagtcacgacgactgctccccctcctcccggcacaactccacttccccccccaaccacggccgaaactagttctggggcgacgtcaacgacaacgacgacttccgcactagcaccagtagcagcaatcatccccccgcctcctgatgtacaacccgtaatcgacaagctcgctgaatatgtggctagaaacgggctcaaattcgaaacaagcgttagggctaaaaacgaccagcgattcgaatttctgcaaccttggcaccaatacaatgcctattacgaattcaaaaagcagttttttctacagaaggagggtggcgactcaatgcaagccgtcagcgcccccgaagaagctcctactgattcagcacccgaaaagccttccgatgcgggcgaggacggggctcccgaagatgccgccgaggttggggcccgcgcaggctccggcgggaagaaggaagcgagcagtagcaaaacagtccccgatggcaaactcgtcaaggctagcttcgcgcctatctcgtttgcaattaaggccaaagaaaacgaccttctgccattggagaagaaccgggttaagttagacgatgactctgatgacgacgaagaatctaaagaggggcaggagtcaagctcctctgccgccaacacaaacccggccgttgcccctccgtgcgtcgtggtcgaggagaaaaagccacagcttacccaagaggagcttgaagctaagcaggccaagcagaagctggaggacagacttgcagcggccgccagagagaaattggcacaggccagtaaggaatccaaggagaagcaattacaggctgagagaaagagaaaggctgcactattcctgcagaccctcaaaaatccactgcccgaagcggaagccggcaagatagaagagtcccctttttccgtcgaagagtcttctacaaccccgtgtcctctgctaacgggtgggaggccgctaccaactctggaagtgaagccgcccgacagaccctcaagcaagtcaaaggacccacctcgagaggaggagaaagagaagaagaagaagaagcacaagaaaagatcccgaactaggtcacgctctccaaaatatcatagttcaagtaagtctagaagcagatctcacagcaaagctaagcacagcttgcccagtgcctaccggaccgttcggcggagccgatccaggagccggtcacccaggagacgcgctcatagccctgagcgcagacgcgaggagaggtccgtgcctaccgcctatagagtcagccggagtcccggagccagccgaaagcgaactaggagccggtccccacacgagaagaagaagaagaggaggtctcgcagcaggaccaaatccaaagcacgcagccagtctgtgtcccccagcaagcaggccgccccccgccctgccgctccagctgctcattccgcacactccgctagcgtgtcccctgtcgagtctcggggaagcagccaggagagaagtaggggagtgtctcaggagaaagaagcccagatttcttccgccatagtgtccagtgtccagtccaagataacccaggaccttatggctaaggtgcgggcaatgctggccgcatcaaagaatcttcagacttccgcttcctag

SEQ ID NO: 13315 - DNA, 1644 bp, Artificial Sequence
  Description of Artificial Sequence: Synthetic coding sequence
atgggcgatcacaaaatcttgatcgaccgttacgacggacgtggacatctgcatgatcttagtgagtacgacgctgagtactccacatggaatagagattatcaattgtctgaagaggaggccaggatcgaggctctttgcgacgaagagcgatacctggcgctacacaccgacctgttagaagaagaagccagacaggaagaagaatacaaacgactgagcgaggctctagcagaagacggctcatacaatgccgtgggtttcacttacgggagcgattattacgatcctagcgagcccaccgaggaagaggaaccaagcaaacaaagggagaaaaacgaagccgagaatctggaggaaaatgaggagccgtttgtcgctccactcggactttctgtgcctagcgacgtcgagctcccgcccactgccaaaatgcacgccatcatagaaaggacagctagctttgtctgtcggcaaggggcccagttcgagatcatgctaaaagctaaacaagcccggaacagtcagttcgatttcctaaggttcgatcactacctaaatccttactataagtttatccaaaaagccatgaaggaggggcggtacaccgtcctggcggagaataagagcgatgaaaaaaagaaatccggtgtgtcctcggacaatgaggatgatgacgatgaagaagatgggaactacctgcatccttccctgtttgcatctaaaaagtgtaatcgcctcgaggagctgatgaaacctctgaaagttgtggaccctgatcaccctttggcggctctcgtgagaaaggcacaagcagattcatccacacctactccacacaacgccgacggcgcacctgtccagccatctcaggttgaatacaccgctgactcaactgtagctgctatgtattattcatactacatgctcccggacggaacctactgtttggccccgcccccacccggcatcgatgtgacaacctactatagcacactgcccgcaggtgtgacagtttctaacagtcccggtgtcaccacaaccgcacctccgcctccaggtaccacgcccctgcccccaccaacaacagccgaaacgtcttcaggcgccactagcaccactactacgacttctgcattggctcctgtggccgcaattattcctcctcctcctgacgttcaaccggtcatagacaagctggccgaatacgtcgcccgcaatggcctgaaattcgagacctcagtccgggccaaaaatgaccaacgctttgaatttctgcagccctggcaccagtataatgcctactatgagttcaagaaacagttttttttgcagaaagagggtggcgactccatgcaagcagtctctgccccagaagaagcccccactgacagcgccccagagaaaccctcagacgctggagaggacggagctcctgaagacgccgctgaggttggagccagagccggaagcggcggcaaaaaagaagcctcctctagtaagactgtgccagacgggaaactcgttaaggcgtcttttgcccccatctccttcgccatcaaggccaaagaaaatgaccttctgcccctggaaaaaaacagaaagaaaaggaagaaaaggaaaaggaaatccacaaagaagtag

SEQ ID NO: 13316 - DNA, 2091 bp, Artificial Sequence
  Description of Artificial Sequence: Synthetic coding sequence
atggaggtgtcaagccctagtccggcccagcgcctgaggcggaagaagcgtcccatggtccagggcccggcagggtgtcaggtgtttcaaccttcaccttccggaggcactgccggagatccgggcgggctgtccgaccctttttacccgccaaggtccggctctcttgcactgggtgacccttcctccgacccagcttgctcccagtccgggcccatggaggcagaagaagactctctaccggaacagccagaggactccgcccagctgcagcaagagaagccttctttatacatcggggtgaggggaaccgtcgtgaggagcatgcaagaggtcctgtggacccgattgagagagctgcctgacccggtgttaagtgaggaggtcgtcgaaggtatcgcagctggaatagaggcagctctgtgggacctcacacagggcacgaatggcagatataaaaccaagtaccgatctctgctattcaaccttcgagacccgcgtaatctggatctcttcctaaaagttgtgcatggtgatgtcactccctacgacttagtgcgtatgtcctccatgcagctggctccccaggaactggcgaggtggcgggatcaggaagaaaaacggggactgaacatcatcgaacagcaacagaaggagccctgtaggctgcccgctagcaagatgacccacaaaggtgaagttgaaatccagcgggacatggatcagaccttgactttggaagacctggtcggaccccagatgttcatggattgcagcccacaggctttaccaattgccagcgaggataccaccgggcaacacgatcatcattttctggaccctaattgtcatatctgtaaagattgggaacctagtaatgagcttctgggttctttcgaggccgccaagtcctgcggcgataatatcttccagaaggccttgtcgcaaactcctatgccggcacccgagatgccaaaaacccgcgagctctcacctacggaaccccaggatcgggtcccaccctctggacttcacgtgccagctgcccctactaaggctcttccctgtctgccaccatgggagggcgtgcttgatatgttttccatcaaacgcttcagggcccgcgcccaattggtgagcgggcactcctgtcgactcgttcaggccctgcctaccgtgatccgaagtgccggatgtattccatcgaacattgtgtgggacctgcttgcgagcatctgtccggctaaagctaaagatgtttgcgtggtccgactctgcccccacggggccagggatacgcagaactgcaggctcctgtattcctatctgaacgatcggcagcggcatggcctcgcctcggtggagcacatgggcatggtgctgctgcccctccccgctttccaacccctacccacacggctgcggcccctgggcgggcctggcctcgaggtcactcacagtagcctgctgctcgcagttctgctgccgaaggagggactgccagatactgctggcagttcaccatggttgggcaaggtccagaagatggtgagttttaattcaaaggtggagaagcggtactaccagcccgatgacaggcgacctaacgtcccccttaaaggtacgccacctcctgggggggcgtggcaacagagccaaggccgcggttccattgcgccccgcggtatcagcgcttggcagcgtcccccacggggtagaggtcggctctggccggagccggaaaactggcagcatccaggaagaggacagtggccgcccgagccagggttaaggcagtctcagcacccttattctgtcgcccccgccgggcacggcttcggtcggggacaacatttccatcgggactcatgcccccaccaggccctcttgagacacctggagtccttagcaacaatgtcacaccaactccaggcactgctgtgcccccaaacaaaatcttccatcccccgcccactccaacgcctgtcttcagcactcgccgcccctgagcctcccggccccgcgcgcgattcttcactgggccccactgacgaagctggcagtgaatgcccgtttccaaggaaggcttag

SEQ ID NO: 13317 - DNA, 1032 bp, Artificial Sequence
  Description of Artificial Sequence: Synthetic coding sequence
ggaacaaagtgtctggagagcctcctgggctccgtgccacccccgtgccccgggctgcacagcctgagggaactaccagacccagttctgtcggaggaggttgttgaagggatagccgccgggatcgaagctgctctttgggatttaactcaggggaccaatggccggtacaagacaaagtatcgcagtttactgttcaacttacgggacccacgcaacctggatctgtttctgaaggtggtccatggggacgtgacaccatatgacctggtgagaatgtccagcatgcagttggccccacaagagttggctcggtggagggaccaggaggagaagcgtggcctaaatataattgagcagcagcagaaggagccatgccgcctgccggccagcaagatgacccacaagggagaagtggaaatccaacgcgacatggaccagactcttacacttgaggacctgggcccccagatgttcatggattgctcccctcaagctttgcccatcgcatctgaggatacgaccggccaacacgaccaccactttttggacccaaactgtcacatctgtaaagattgggagcccagcaacgaactactgggcagctttgaggccgctaagagctgtggcgacaatatttttcaaaaggctctgtcccagacacccatgccacccccttgggaaggggtcctcgacatgttctccattaagagattccgggccagggcccagttagtgagtggccattcgtgccggttggtacaggctctgccaactgtgatccggtccgctgggtgtattccaagcaatattgtgtgggatctgctggcgagcatctgccctgcgaaggcaaaggtgtggagaagtttgactcaggtctgttgttggctttgttgtagtccccgtaaaggcttccaaacacagcaggggcctgctccggggtggggcaggttcaaacgatggagcccctcaaccgtgaggtggaggcgagacactatttcacagatgacaggtggccgcatgtgcccttag

SEQ ID NO: 13318 - DNA, 3651 bp, Artificial Sequence
  Description of Artificial Sequence: Synthetic coding sequence
atgagtcaggccggggacgtggagggcccgagcaccggggatccagtactgtcccctcagcacaattgcgagttattacagaatatggaaggggctagtagtatgcccggtctcagcccagatggacccggggcatcttccgggcctggcgttagggccggctcccgtagaaagattccaagaaaagaggcactccgaggcggatcttctagggctgcaggcgccgcggaggtgagacctggcgtactcgagttgctggctgtggtgcagagccggggcagtatgctggcacccggactgcacatgcagttgccatctgtgccgacacaaggccgggcattaacctcaaagcggctccaggtgtccctctgcgatattctggacgactcttgtccccgaaaattatgcagtcgctcagccggactgcccgaacgcgcgcttgcctgtcgagaacgcctcgccggggtggaagaagtttcttgtctgcgaccaagggaggcacgagacggaggcatgtcctcccctggctgtgacaggagatcgcccacactgtccaaggaagaacctccggggcgccccctgacatcatctcccgaccccgttcctgtgcgagtccgcaagaaatggaggcggcagggagcacacagcgagtgcgaagagggagcaggggatttcttgtggctggatcaatcaccaaggggggataatctgctcagtgtcggcgatcccccacaggtggccgacctggagtcactagggggtccttgtagaccgccatcccccaaggataccgggtcaggaccaggggagccgggcggttccggagcgggctgtgccagtggcacagaaaagtttggctacttgcccgctactggggacgggccgcagccaggctccccgtgtggtccagtgggttttccagttcccagcgggggggagtcccttagctccgcggcacaggcaccaccacagagcgccgccctgtgcctcggcgcctcagcgcaggcttctgctgagcagcaggaggccgtctgtgtcgttcgcacaggatctgatgaaggtcaggctcctgcgcaggatcaggaggaactggaagctaaggcccagcccgcttctcggggaagactagaacagggcttggccgctcccgctgatacatgcgcttcaagtcgggagccattgggtggactaagcagtagcctagacactgaggcttctcgggcctgctccggaccattcatggaacagcggcggagcaaggggaccaagaatctcaaaaagggccctgtcccttgtgcccaggacaggggaacagaccgctctagcgacaacagccatcaggaccgacccgaggagccctctcctggcgggtgcccgcgcctggaggaagttaagatcccccacggcgttaagctcgtctgctatctcggcagtggtccagttattcagctcctgggcgccatctctcacgggcaggccggtggacagttgcccccaaaactggaggtgctggaggacctgatggaagtgagcagcccgtcccctgcgcagaggctgcggaggaaaaaacggcccatggtgcaggggcccgcagggtgtcaagtgtttcagcccagtccttcgggagggactgccggcgacccaggtggactgtccgatcctttttacccccctcgaagcggaagcctggctctgggcgatcccagctccgatccagcctgttcccagtcgggccccatggaggccgaggaggatagtctccccgaacagcctgaagattcagctcagctccaacaagaaaaaccctccctgtacataggagttaggggtaccgtcgtccgcagtatgcaggaagttttgtggacccggctccgggagcttcctgacccggtcttgagcgaagaagtcgtcgaaggaatcgcagcagggattgaggccgccctatgggacctgacacagggtaccaatggcaggtacaagacaaagtaccgctccctgctcttcaatcttagagaccctaggaacctggacctgttccttaaagtcgtacatggtgatgtgaccccatatgatctagtgagaatgtcatctatgcagctcgcaccccaggaactggcacgctggcgggaccaagaggagaagcgaggcctgaacataattgagcagcagcagaaagagccatgcaggctccctgcctctaagatgacccacaagggcgaagtcgaaattcagagagacatggatcagactctgactctggaagacctggtcggccctcagatgtttatggactgctcgccacaggccttgcccattgctagcgaggacacgacaggacagcatgatcaccacttcctggatcctaattgccacatatgtaaagattgggagcctagcaacgagttgttgggctcattcgaggccgctaagtcttgcggcgataatatcttccagaaggcactgagccagacacctatgcccgcccccgagatgcccaagacccgtgaactgagtccaactgaaccccaagatagagtgccgcccagtggactacacgtgcccgcagcacctaccaaggccctaccttgcctgccgccttgggaaggcgtcctcgatatgttttctattaaaagattcagggcgagagctcagttagtcagtggccattcatgtagacttgttcaggctctccccacagtgatcagatccgccggatgcattcccagtaacatcgtgtgggaccttcttgcaagcatctgccccgccaaggccaaggacgtgtgcgttgtacgattgtgtccccatggcgcccgggacactcaaaattgccgacttctttacagctatttgaacgataggcagcggcacggacttgcctccgtggagcacatgggcatggtgctgttgccactgccggccttccagcctctgccaactcgcttaaggcccctaggaggaccaggattgtgggccctgcccgtgagccctctgctgtcacctggattggaagtcactcattccagcctgctgcttgctgtgttactccctaaggaaggcctacccgacaccgccggctctagcccttggctggggaaggtgcagaaaatggtgtcatttaacagcaaagtcgagaagcgctattaccagcctgatgacagacgccccaatgtaccactaaagggcacaccgccacctggaggggcttggcaacagtctcagggacgagggagtattgctccccgcggcatttccgcttggcagcgcccacctaggggacgcgggcggctgtggcctgaaccagaaaattggcagcaccccggtcgtggccagtggccacccgaacccggacttaggcaatcgcagcacccctatagcgtggcccctgccggacacggatttggtcggggtcaacactttcaccgagatagctgcccgcaccaggctctgctgaggcacctggaatccctggcaaccatgtcccatcagttacaggctctactctgcccacaaacaaaaagcagtattccccgcccgctgcaaagattgagttcagcattggccgcgccagaaccacctggaccagctagagattccagtcttggaccaactgacgaagccggctcggagtgcccttttccacgtaaagcttag

SEQ ID NO: 13319 - DNA, 1635 bp, Artificial Sequence
  Description of Artificial Sequence: Synthetic coding sequence
atgagtcaggccggcgatgtggaaggaccgtctacaggggatcccgtcctaagccctcaacataattgcgagctcctgcagaatatggagggggcgtcaagcatgcccgggctctcacctgatggcccgggagcgtcttccggccctggagtgcgagccggaagccgccggaagattccacggaaggaggcccttagaggtgggagctcacgggccgccggggctgctgaggttcgtccgggagtactggagctactcgcagtcgtgcagagtcgcggttctatgcttgccccgggcctgcatatgcagctcccatcagtgccgactcaaggacgcgccttgacttcgaaacgtcttcaggtgtccctctgtgatattctagatgacagctgcccgcggaagctgtgtagcagatcagcaggactacccgagcgagcacttgcttgccgtgagagactggccggagtggaggaggtatcatgtctccgtccgcgcgaggctcgcgatggaggtatgtcatcccccgggtgcgataggcgctcaccgacccttagcaaggaggagccccccggcagaccactaacttcatctcctgaccctgtcccggtaagggtgaggaaaaagtggcgcagacaaggtgcccactccgaatgcgaggaaggagccggggatttcttatggctcgatcagagccccaggggtgataacctcctgtcagttggcgacccaccgcaagttgccgacttagaatctctgggggggccctgcaggcccccatcacctaaagacaccgggagtggcccaggcgaacccggcggcagtggggcagggtgcgccagcggcacggagaaatttggctatttacctgccacaggcgacggacctcaaccgggctctccctgtgggcccgttgggttcccagtgccctctggcggcgaaagcctgtcaagtgcagctcaggcccctccccagagcgcagcgctgtgcctgggggcctccgctcaggcatcggccgagcagcaggaagctgtctgcgttgttagaactgggtcggatgagggtcaggccccagcccaggaccaggaggagctcgaggcaaaagcccagcctgccagtcggggaaggctcgagcaggggttggcggcccccgctgacacatgtgcttcttcccgtgaaccactgggcggactatcctcctctctagacaccgaggcctctagggcctgcagtgggccttttatggagcagcgtcggtctaaaggtaccaagaacctgaaaaaaggtcccgtgccctgtgctcaggaccgtggcaccgatcgatcttctgataactcccatcaggatcggccagaggaaccaagccccggaggatgcccgaggttggaggaggtgaaaatcccccacggggtgaaactggtttgctatgtctttcaacccagcccgagtggtggaaccgcgggggaccctggcggcttgtcggatccattctacccacctcgttcaggttctctcgcactgggcgacccttcttcagaccctgcttgttcccaaagtggtcctatggaggccgaggaggatagcctccccgaacaacctgaggactccgccttcggctccagccagactcagtgctag

SEQ ID NO: 13320 - DNA, 810 bp, Artificial Sequence
  Description of Artificial Sequence: Synthetic coding sequence
atgcaggaggtattatggacccgcctccgcgaactcccggatccggtgctctctgaagaagtggtagaggggatcgccgcaggcatcgaagccgccctctgggatctcacccaagggaccaacggtagatataagaccaagtatcggtctttattgtttaaccttcgagaccctaggaatctcgacttgttcctgaaagttgttcatggagatgtgactccgtacgatttggtgcgcatgtcctccatgcagctggcacctcaggaactggcccgatggcgagatcaggaagaaaagcggggtcctcagatgttcatggactgctccccgcaggccttgcccatcgccagtgaagacaccacaggccagcatgatcatcatttcttggatccaaactgtcacatttgcaaagattgggagcccagcaacgagttactgggatcctttgaggctgccaagagttgcggtgataacatttttcaaaaggccctctctcaaacccctatgcccgctccagaaatgccaaagacacgcgaactttccccgactgaaccccaggatcgctgtggtgtcggctccagggaggtcgacaatccagctggcctgagagggaggcctcccccgggagcaacagacatcgccctggcttttcccgtgtggccctgggccagcctgccatcactggggaatctcacctttccgatctgcgcaatggaactcatcatcccagcgtcatggcagccccccgcacagggacaggcctgggcttcagtgcccgttcctaccgttggcacccaagatttactttag

SEQ ID NO: 13321 - DNA, 63 bp, Artificial Sequence
  Description of Artificial Sequence: Synthetic coding sequence
atggaggtgtcgtcacccagccccgcacagcggctccggcggaaaaagaggccaatggtctag

SEQ ID NO: 13322 - DNA, 264 bp, Artificial Sequence
  Description of Artificial Sequence: Synthetic coding sequence
atggaggttagtagcccctcaccagcccagagactcagacggaaaaaacggcctatggtccagggccccgcaggctgccaggtttttcaacctagcccgtctggcgggacagcgggcgacccaggtggcctgtcggacccgttctatccacctaggagcggttctcttgccttgggagacccgagctctgatcctgcatgctcacaatccgggccaatggaggcagaagaggatagcctacctgaacagcctgaggatagctag

SEQ ID NO: 13323 - DNA, 3612 bp, Artificial Sequence
  Description of Artificial Sequence: Synthetic coding sequence
atgtcacaggccggggacgtagaggggccctccaccggtgatcccgtgctgagtccgcaacacaattgcgaactcctgcagaatatggaaggggctagttcaatgccaggcctgtccccagacggccccggagcctcttcaggacccggcgtcagagccgggagtaggcgcaagatacctaggaaagaagctctcagagggggttcgagtagagccgctggcgctgctgaagtgcgcccaggggtgctggagttgcttgcggtggtacagtctcgaggctctatgcttgcgcccggtctccatatgcagctgccatctgtgccaacccaggggagggccttaacgagtaaacggctacaagtgtccctttgtgatattctcgatgacagctgccctcggaaactgtgcagtcgcagcgccggcctgccggagcgggccttagcttgcagagaacgcttggccggggtggaagaggtgtcatgtttgaggcctcgtgaagctagagacggcggcatgtccagcccaggttgcgacaggaggagccctacattgagtaaggaggagcctcccggcaggccattaacctcgtcccctgaccccgtgcccgtgcgggttagaaagaaatggcgtaggcagggagctcacagcgagtgcgaagaaggagccggagacttcctttggctggatcagtccccacggggcgacaacctccttagtgtcggcgaccccccccaggttgctgatctggagagtctggggggaccctgtagacccccctctccaaaggatacaggcagcgggcccggagagcctggtggaagtggtgctgggtgcgcatcagggactgaaaaattcgggtacttgcccgccacaggagatgggccccaacccggtagtccatgcggaccagttggctttcctgtcccaagcggtggcgagtccctttcctctgctgcccaggccccaccacaatctgctgctctgtgcctgggggccagcgcacaggccagcgccgagcagcaggaggccgtgtgcgtagtgcggaccggaagcgacgagggccaggcacccgcccaggaccaggaggaactggaagcaaaagctcagcccgcatctcggggaaggttggaacagggtttggccgccccggcagatacatgcgcttcatccagagagccccttggggggctgagctcctctttagataccgaagctagcagggcctgttccggaccatttatggagcagcgtcggtcaaaaggaaccaaaaacctaaagaaggggcccgtgccgtgcgcccaggatcgaggtacagaccgtagttctgataatagccatcaggatcgccccgaagagccctcacctggtggctgccctaggctcgaggaagtgaagattccccacggcgtcaaactggtttgctatttgggttccggacccgtgatacagcttctcggggcaatttcacacggacaagccggcggacagctccctcctaagctagaagttctagaagatctgatggaagtcagttctccctcccccgcccagaggctcaggagaaagaagagaccaatggtgcagggacctgctggttgtcaggtcttccagccttcccccagtggaggtacagctggcgatcccggaggtctttctgatcctttttacccaccacggtctgggagcctggctttgggcgacccgtctagcgacccagcttgttcacaaagtggccccatggaggctgaggaggacagcctcccagagcagcctgaggatagcgcacagttgcagcaagagaagccttctctgtacatcggggtacgaggtacggtagtcaggtcgatgcaggaggttctctggactagactgcgagaactccccgatcctgtcctctcagaagaggtcgtcgagggaattgctgccggaatcgaggccgccctctgggacctgacgcaaggcaccaatggccgttacaagacaaagtatcggagcttactcttcaacctcagagatcctcgcaaccttgacctctttctgaaggtcgttcacggggatgtgaccccatacgatcttgttcgaatgagttcaatgcagttggccccccaagagcttgcccggtggagggaccaagaagaaaagcgcggcctgaatatcatcgagcaacagcaaaaagagccatgcagactgcccgcctccaagatgacacacaagggcgaggttgaaatacagagagatatggatcaaaccctgaccctggaagatctcgtcgggcctcagatgtttatggattgctctcctcaagccctccctattgcatctgaggacacaactggccagcatgatcaccacttcttagatccaaattgccacatatgtaaggattgggagccctctaatgagctgctagggagcttcgaggcagctaagagctgcggcgacaacatatttcagaaggcactgtcacagactccaatgcccgctccagagatgccaaagacccgggaactgtccccaaccgaaccccaagaccgggttcctcctagcgggctgcatgtgcccgcagctcctaccaaggctctcccatgcctgccaccttgggaaggcgtcttggacatgttcagtatcaagcggttcagagcccgtgcccagttggtgtctgggcattcctgtcgtctcgttcaggcattacccactgttatcagatcagcgggctgcatccccagtaacattgtctgggatctgctggcatcaatttgccccgctaaggcaaaggacgtgtgcgttgtacgcctgtgcccacacggcgccagggatacacagaattgtcggttgctgtacagctatttaaacgatcgccaacgccacggactcgcaagcgtggagcatatgggcatggtgctgttgcccctccctgcgtttcaaccactgccaactagattgcggccacttggcggcccaggactggaggtcacacactctagcctgctgttagcggtgctcctgcccaaggagggtctgcccgatacagccgggtcttctccttggctcggcaaggttcagaagatggttagttttaatagcaaagtggagaaacgctactatcagcctgacgaccgtagacccaacgtgcccttgaagggcactcccccaccaggaggggcatggcagcaatcccagggacgcggctctatcgcccccaggggcattagcgcctggcagcggcccccaagaggcagagggcgcttgtggccagagcccgagaactggcagcatccagggagggggcagtggcctcctgagcccgggctccgacagtcccagcatccgtactcagtggcccctgcagggcacggctttggaagaggccagcattttcaccgagatagctgtccgcaccaagccttactgcggcatttagagagcctggccaccatgagtcatcagttgcaagccctcctgtgcccgcagacaaagagctcaatcccccggcctctgcagaggctgtcttctgccttagccgcccccgaaccccccggccctgccagggattcgagcctgggaccaaccgacgaggctggatctgagtgtccatttccaagaaaagcgtag

SEQ ID NO: 13324 - DNA, 3939 bp, Artificial Sequence
  Description of Artificial Sequence: Synthetic coding sequence
atggaggaggaggacgagagtcgcggcaagacagaagagagtggggaggaccggggagacggcccgccagacagggaccctacattaagcccatctgcttttattctgcgagctattcagcaggcagtgggatcttccttgcagggggacctgccgaacgataaggacgggtcgagatgtcacggcctccgctggcgacggtgtagatctccacgttctgagcctcgcagtcaagagtctggcgggactgatacagctacagtgctggacatggccacagacagttttctcgcaggcctcgtgagtgtgctggaccccccagacacctgggtgcctagtaggctagacctgcggccaggcgagagcgaagacatgctcgagctggtcgccgaggtgaggattggagatcgggatccgattcccctccccgtgccgtctcttctccctcgcttacgggcctggaggacaggcaaaacagtgtccccacagagcaatagcagtcggccgacctgtgcacgacatctgacactgggaacgggcgatggcgggccagctcccccacctgctccctcctcggcttctagttctccctccccaagtccttcgtcctcaagtccttcacctcctcctccgcccccccctccagccccgccagcccccccagccccccgttttgatatctatgatccattccatccaaccgatgaggcttactctcccccccccgctcctgagcaaaaatacgacccatttgaacccaccggatccaacccttcctctagcgccgggacccccagcccggaagaagaagaggaggaggaggaagaagaagaagaggaagaggaggatgaggaggaagaggaaggactgagccagtccattagccgcatcagtgaaactcttgctggcatctacgacgacaactcgctgagtcaggactttcctggcgatgaaagtcccaggcctgacgcacagcctactcagccgacccctgctcctgggacacctccccaggtagacagcactagggctgatggcgccatgagacggagagtgttcgtggtgggtactgaagccgaggcctgccgcgagggcaaggtatctgttgaggttgtgactgctggcggagccgctttgccgcctccattgctcccccctggcgactccgagattgaagaaggcgaaatcgtccaacctgaagaagagcccaggctggctctttccctcttccgccccgggggaagagcagcccgccccacgcctgctgccagcgctacccccactgctcaaccactgcctcagcctccagctccacgcgccccagagggggatgactttctgagtctccacgcagaaagcgacggagaaggcgcactccaggttgatttgggagagcccgcgcccgctccacccgcagctgattcacggtggggaggattggacctgagaagaaagatcttaacacagcgccgggagaggtacaggcaacggagcccaagtccagccccggcccccgctccggccgccgctgctgggccccccacgagaaagaaatcccgccgtgagagaaagcgaagcggggaggccaaggaagccgcttcctcttcctcagggacacagcccgcacccccagcacctgctagcccgtgggatagtaaaaagcaccgcagtagggaccgcaagccggggagtcatgccagcagcagtgcccgacgtagaagtcgctccaggtccaggtctcgatctacccggagacggtctcggagtactgacagaagaagaggcggctcaagacgcagccggtctcgggagaagcgaaggcgtagacgccggtccgcttctccaccgccagctactagcagctcaagcagcagtaggagagagcgccatcggggcaagcacagagacggcggtgggtctaagaaaaaaaagaaacgctccaggtccaggggggaaaaacggtcaggagatggaagcgagaaggctcctgcacccgctcctccgcctagtggcagtacctcgtgcggcgaccgcgactcaaggcggagaggcgctgtgcctccatccatccaggatctcacggaccacgacctcttcgcaatcaagaggacaatcacggtcgggcgattagataaaagcgatccacggggacctagccctgcccccgccagcagtcccaaacgcgaggtactgtatgattctgaaggcctatctggagaagaacgaggaggtaagtcgtcccaaaaggatcggagaaggtccggcgccgcctccagttcaagctcttcccgggagaagggctctaggcggaaggcactcgacgggggagatcgtgacagagatcgggatcgagatagggacagagacaggagctctaagaaagcacggcccccgaaagagagtgctccctccagcggccctccccccaaacccccagtatcatcaggttctggctcgtcctctagttcctcttcctgttcaagccgcaaggtaaaactccagagtaaagtggctgtgttaatcagggagggggtgtcctccactactccagctaaagatgcagcctccgcaggtctgggctcaattggtgttaagtttagcagagatagagaatctaggagccctttcctaaaaccagatgagcgcgcgcccacagaaatggcaaaggctgctcccggtagcacaaagcccaagaaaactaaggtaaaggccaaagcgggggctaagaagaccaaaggtaccaagggcaaaacaaagccgtccaagaccagaaaaaaggttaggtcgggaggtgggtctggcgggagcggggggcaggtctccctgaaaaaatccaaagccgacagttgctcacaggctgctgggacgaaaggagcagaagagacctcatggtcaggcgaagagcgggccgctaaggtgccgtccactcccccaccaaaggccgctcctccacccccggcacttacccctgactcacagactgttgacagcagctgtaagacccccgaagtgagttttcttcctgaggaggccactgaagaagccggggtcagaggaggagccgaagaggaagaggaggaggaggaagaggaagaggaggaggaagaagaagaggagcagcagccagccactactaccgccacatccacagccgccgccgcacctagcacagcaccaagcgcaggttctacggccggcgactcaggcgccgaggatggcccagcttcgcgcgtgagccaactgcccactttacccccaccgatgccatggaacttacctgctggggtggactgtactacaagcggggttctggccttgacagcgcttctgttcaagatggaagaagcaaaccttgcctcccgtgctaaggctcaggaactgatccaggccaccaaccagatcctgtcccatcggaagccaccttcttcattaggcatgactcctgcaccggttccaacctctctgggactgcctcccggcccctcctcctatctgctccctggctcccttcccttaggcggctgtggatccacccctccaacaccaaccggtctggcggctactagcgacaagcgcgaggggtctagctcctccgagggtcgtggtgacacagacaagtacctgaagaaactccacacccaagagagagcagttgaggaagtcaagctagcaatcaagccctattaccagaagaaggacatcacaaaggaggaatacaaggatatcctgcggaaggccgtgcacaaaatttgtcatagtaagagcggcgagataaatccggtcaaagtcagcaatctcgttcgggcctatgttcaacgctacagatactttagaaaacacgggcgaaagccaggcgatcccccaggacctccccgccctccgaaagagccaggaccgccagacaagggggggcccggcctgccactcccacccttatag

SEQ ID NO: 13325 - DNA, 660 bp, Artificial Sequence
  Description of Artificial Sequence: Synthetic coding sequence
atggaagaagaggatgagagtcggggtaagactgaggaatctggtgaggatagaggcgacggtccacctgatagagaccccacactgtcacctagcgccttcattctaagggccattcagcaggcggtcggttccagcctgcaaggtgatctacccaacgacaaagacgggagtaggtgtcacggacttagatggcgaagatgccgaagcccgcggagtgaaccacgctctcaggagtccggcggcactgacacagctacagtcctcgacatggcaaccgatagtttcttagcggggcttgtctctgtgctcgaccccccagacacatgggttccgagtcgactcgacctccggcctggggagagcgaggatatgcttgagctggtggccgaggttaggataggtgaccgcgacccaatccccctgccagttccctctctgctgcctaggctgagagcttggcggaccggcaagacagtcagcccgcagagtaatagtagccggcccacatgcgcccgacacttgaccctgggcactggcgacggcccttgtcccacaccatgccctctcctctgtattctgctacccttcccctttagcctgatttttcttccatttccaagcccgactcccactgcaccctccccccaattccactag

SEQ ID NO: 13326 - DNA, 3444 bp, Artificial Sequence
  Description of Artificial Sequence: Synthetic coding sequence
atggacgctgtgaacgcgttcaaccaggagttgttctctcttatggacatgaagccacctattagccgggctaagatgatcttgattacaaaggctgcaattaaggccattaaattgtataagcacgtcgtccagatcgtggagaagtttattaagaagtgcaagccggaatacaaggtccctggcctctatgttatcgattccatagtacggcagtcacgacaccaattcggcactgataaggacgtcttcggcccgaggtttagcaaaaacatcaccgccaccttccagtacctgtacctttgtcctagcgaggataagtcgaagatcgtccgggtgctgaacctgtggcagaagaacggggtgttcaaaattgagatcattcagcccctgctagatatggccgcaggaacttccaacgctgcccctgttgctgagaacgtcacaaacaatgaaggatcgcctccgccccctgtgaaggtaagctctgaaccaccaacccaggcaacccctaactctgttccagcggtcccccaactgccctcatcagacgcatttgctgctgtggcacagttgttccagactacccaggggcagcaactgcagcaaatcctacagacatttcagcagccgccaaaaccacagtccccagctctggacaatgcagttatggctcaagtccaggccatcaccgctcaattaaagaccactccgacgcagcccagcgaacagaaagcggcgttccccccacctgagcagaaaacggctttcgataaaaagctccttgaccgcttcgattacgacgacgaaccggaggccgttgaagaaagcaagaaggaagacactactgcagttactaccaccgcccccgccgccgctgtccctcctgctcccactgccacagtgcccgcagcagccgctccagctgcggcatctcccccaccgcctcaggcccctttcggattccccggcgacggaatgcagcagcctgcttacacacagcaccagaacatggaccagttccagcctcgcatgatgggcatccagcaggatcccatgcaccaccaggtgccattgccacctaatggacaaatgcccggctttgggctgctccccaccccaccatttcctcctatggctcaaccggtgatcccacccaccccgccagtacagcagcccttccaggccagcttccaggctcaaaatgagccattgacgcagaaaccccatcaacaggagatggaagtggagcaaccctgcattcaggaagtgaaaaggcacatgtctgacaacagaaaaagcagatctcgcagcgcctcccgcagtcccaagcggcgaagaagtcggagtggaagtagatccaggcgctctaggcaccgtagatcaagaagtcggtctagagaccggagacgacacagtccacgtagcaggtctcaggagagaagggacagagagaaggaacgcgagaggcggcagaaaggactgccccaagtaaagcccgagacagcaagcgtttgtagtaccacgctttgggtcggccaactggataaaagaactacacagcaggatgttgcttcattgctagaggagtttggacccattgagagcattaatatgatccctccccggggatgtgcgtacattgtgatggtgcacaggcaagatgcataccgggcgttgcagaagttgagcaggggaaactacaaagtgaatcaaaagagcattaagatcgcttgggcactcaataaaggtattaaggcagactataaacagtattgggacgtcgaacttggggtcacctatatcccctgggataaagtgaagcccgaagagctggaatctttctgcgagggcggaatgttagattccgacaccctcaatcccgattggaaagggattcctaagaagcctgaaaatgaagtggcccaaaatggaggggcagagacgtctcacactgaacctgtgtcacctatccctaagcccttacctgtcccagtcccccctattcccgtgcctgccccaattacggtgcctccgccccaggtccctccccatcaaccaggtccccctgtggtgggcgccctacagccacccgccttcactccgccattgggcatccctcctccaggctttggtcctggcgtccctccacctcccccccctccccccttccttcggcccggcttcaaccccatgcacctgccaccggggtttctgcctccgggcccaccgcccccgataaccccccctgtatccatacctcccccacataccccacctattagcatcccaaattcaacaatcgccgggatcaatgaggataccaccaaggacttgtccatcggaaaccccatcccgactgtcgttagcggtgcacggggaaacgcagaaagtggtgatagcgtcaagatgtacggttccgccgtgccccccgcagcccccaccaatctgcctacccctcctgtaacacagccagtgagtctactggggacccagggcgttgccccaggcccggttatcgggctgcaggcaccgtccactggactgcttggcgccaggccgggactcatacccctacagagacctcctggaatgccacctcctcacctgcagaggttcccactaatgccacctcgccctatgcccccacacatgatgcatcgggggccaccacccgggcccgggggcttcgcaatgcctcctccccacgggatgaagggcccttttcccccccacggacccttcgttagaccaggcggaatgcctggactgggcggccccggacctgggccgggcggtcccgaggaccgcgacggcaggcagcaaccaccacagcagccgcagcagcagcctcagccacaggccccgcagcagccccagcagcagcagcaacagcaacctccgcctagccagcagcctcctcccacacagcagcagccgcagcaattccgcaatgacaacagacagcagtttaactctgggagagaccaagagcgatttggtagacggagcttcggcaatagagtggagaatgacagagagcgctatgggaacagaaatgacgacagagataacagcaatagagaccgacgagagtgggggcggagatctcctgacagggaccgacatcgcgatctggaggaaaggaaccgcaggagctctgggcatcgggaccgggagagagacagccgtgaccgcgagagtaggcgtgagaaggaggaggctagaggcaaagagaaaccagaagttaccgaccgggcggggggaaacaagacagttgaacctcccattagtcaggtaggcaatgtcgataccgcttccgaattggaaaaaggggtgtctgaggcagcagttctgaaaccctcggaagagcttccagccgaagcgaccagctcagtggagccggagaaggactccgggagtgccgccgaagctccacgctag

SEQ ID NO: 13327 - DNA, 3378 bp, Artificial Sequence
  Description of Artificial Sequence: Synthetic coding sequence
atggacgccgtcaatgcgtttaaccaggagctctttagtctcatggacatgaaaccacctattagtcgggccaaaatgatcctgatcactaaagcagcaatcaaggcgattaagttgtataaacacgtggtgcagatagtagagaagttcattaaaaaatgtaaaccagaatacaaagtccctgggctgtacgtgatcgatagcatcgtccgccagtcccggcatcaattcggcactgataaggatgtttttgggcccaggttttcaaaaaacataactgcaacgttccagtatctgtacctgtgcccctctgaggacaaatctaaaatcgtaagggtcctaaacttgtggcaaaaaaatggtgtttttaagatcgagatcatccagcctctgctggacatggctgcaggcacatcgaatgcagccccagtcgccgagaacgtcaccaataatgagggtagccctcctcctcctgtgaaggtgagcagcgaaccgcccacccaggccacccctaactctgtgcctgccgtgccacaacttccctcttccgacgcgtttgctgctgttgcacagctgtttcagaccacacagggccagcagttgcagcagattttacagacgtttcagcagccacctaagcctcagtcaccagccctggacaacgccgtcatggcccaagttcaagctatcaccgcccagctgaaaacaaccccaacacagccgtctgaacagaaggcagccttccctccacccgaacagaaaactgcttttgataagaagctgctagatagattcgactatgatgatgagcccgaagctgtcgaggagtctaaaaaagaggatacaaccgctgtcacgacaacagctccggccgccgcagttcctcctgctccaacagccacagttcctgccgccgctgcgccagcagcagcttcccccccccccccacaggctccattcggcttcccaggcgatggcatgcagcaacctgcttatacccagcatcaaaatatggatcaatttcaacccagaatgatgggcatccagcaggacccaatgcatcatcaagtgcctctaccccctaacgggcagatgcctgggtttggactgctgcccactccaccattcccacccatggcccagcctgtcattccaccaacgcctccagtgcagcaaccatttcaggccagctttcaagcacagaatgagcctcttacgcagaagcctcaccagcaggagatggaagtggagcagccttgcatacaggaagtgaagagacacatgtccgataaccgaaagtcacggagccggtcagcttctaggtcccccaaaagaaggcgatcgcggagcggatccagaagccggcggtccagacaccgaaggagcaggagtcgctctcgtgaccgacgccgccactcaccgaggtcccggagtcaggaaaggcgagatcgcgaaaaagagagggagcgtcggcagaaaggtctccctcaggtgaaaccggaaacggcgtctgtgtgttcgaccactctttgggtcggacaacttgacaagcggaccactcagcaggacgttgcctcattgctggaagagtttgggcccattgaaagtattaacatgatccctccccgcggatgcgcttacatcgtcatggtccatcggcaggatgcctaccgcgcccttcagaagttatctcgtggtaattacaaagttaatcaaaaatctattaagattgcctgggccctgaacaaaggcatcaaggctgactacaagcagtattgggatgtcgagctcggagttacgtacatcccctgggataaagtgaagcccgaggagttggaatccttctgtgaaggcggaatgctagactcagacaccctgaatcctgattggaaaggcatcccaaaaaagcctgaaaatgaggtggcccaaaacgggggcgccgaaaccagtcacactgaaccagtgagccctatcccaaagccgctgccggtgcctgtgccacccatcccggtacccgcgcccattactgtcccccccccacaggtgcctccccatcaaccaggccccccggttgtgggtgccctgcaacctcctgcctttacgcctccactaggtattccgccccctggcttcggacctggcgttcctcccccaccccccccaccccccttcttgcggcctgggttcaaccccatgcacctccctcccggttttctaccacccgggccccccccacctataacgccccccgtctccatcccccctccccacaccccgccaatcagtataccaaatctcgtgagcggggcccgtggaaacgctgagtctggggattcagtaaaaatgtacggctcagccgtgccaccagccgctcctacgaacttgcctactccaccggtgacccagccggtgtctttgctgggcacccagggagtcgcaccaggccccgtgatagggctgcaggcaccaagtaccggcctgctgggcgcgcggcctgggttgatccctctgcaacggccacccgggatgcctcctccccacctccaaagattccccttgatgcccccgcgacccatgccccctcatatgatgcacagggggcctccccctggacccggcgggttcgcaatgcccccccctcacggtatgaagggtccatttccaccacacggtcccttcgtgcgacccgggggcatgcccggcctaggcgggccagggcctggtccaggcgggcctgaggatcgtgacggacgacaacagcccccccaacagcctcagcagcagccacaacctcaggcaccacaacagccacagcagcagcagcagcagcagccccccccctctcagcagcctcctcccacccagcaacagcctcagcaattccggaatgacaatagacaacagttcaattccggccgggatcaggaaaggttcggaaggcgctcctttggaaatcgtgtggagaacgatagagagcgatacgggaacaggaatgatgatagggataatagtaatagggatcggagagaatggggtcgccgcagccccgacagagatcgacatagggatttggaagagcgcaatcggcggtccagtggccatcgcgatcgcgagagggacagtagggaccgcgagtctcggcgtgagaaagaagaggctagagggaaagagaaacccgaagtgacagaccgggctggcggcaataaaactgttgaacctcctatctcacaggtgggaaatgtggacaccgcctctgaactcgagaaaggcgtctccgaggcagccgtcttgaaacctagcgaagaactgcccgcagaggcaactagtagcgtggagcccgagaaggactccggaagcgcggctgaagccccccgctag

SEQ ID NO: 13328 - DNA, 3399 bp, Artificial Sequence
  Description of Artificial Sequence: Synthetic coding sequence
atggacgctgtgaatgcttttaaccaggaacttttctccctgatggatatgaaacctccaatctctagggccaagatgatcctaatcactaaggcggccatcaaagccattaaatgtaagccagaatacaaagtgcctgggctatacgtcattgattccatcgtgcgccagagtcggcaccagttcggaacggataaggacgtcttcggacctcgcttttccaagaacatcaccgccaccttccagtatctttatctgtgtccttccgaggacaagtcaaaaatcgttagagtcctgaacctgtggcagaagaatggtgtattcaagatagagatcatacagcctctgctcgatatggccgccgggacctccaacgcggcaccagtagcagagaatgtgaccaataacgagggttctcccccacccccagtcaaggtgagttccgaaccgcctacacaggcaacacctaattccgttcccgccgttccgcagttgccttcttctgatgcttttgccgccgtggcacagctgttccagacgacacaaggccaacagctccaacaaattttacaaacttttcagcagcctcctaagccccaatcgcctgctctagacaatgctgtcatggcacaggtacaggctataaccgcccagctgaagaccactccaactcaaccatcagagcagaaagcggcctttcctcctccggagcaaaagacagcgtttgacaaaaaactgctggatcggtttgactacgatgatgaacccgaggcagtcgaagaaagcaagaaggaggacacgaccgcagtgacaactacagcccccgctgctgctgtgccacccgcccctactgccaccgtacccgccgccgctgcccctgctgcagcgagcccaccccctccccaggctccgttcggcttccccggtgatggcatgcaacagcctgcatatacccagcatcagaatatggaccaatttcagcctaggatgatgggtatacagcaggaccccatgcaccaccaagttcccctgccccctaacggtcaaatgcccggattcggactgttacctacgccaccttttcctccaatggcacaacccgtgatccctcccacccctcccgtgcagcagcccttccaggcctcctttcaggcccagaacgagccactaacacaaaagccgcatcagcaggagatggaagtagaacagccgtgtatccaggaagtgaaacggcacatgtctgataatcgaaagtcccggtctagaagcgcttctagatctcctaaaagacgccgctcccggtctggctctcgttctcgacgttcaaggcataggaggtcaaggagcaggtctcgagaccgaagacgacatagccctaggtctcggtcccaggaaaggcgagatcgggagaaggaacgcgagcgtaggcaaaagggtttaccccaagtcaagccagaaaccgcctcggtgtgcagcactaccttatgggtggggcaactggacaaaagaaccactcaacaggatgtagcatcgctcctggaggagttcggccctatagagtctattaatatgatcccgcctagagggtgtgcttacatagttatggtgcaccgtcaggacgcctatagggccctgcagaagctatcccgcggcaactacaaagtgaaccaaaagagtattaagattgcctgggcgctgaacaaagggatcaaggcagactacaagcagtactgggatgtggaacttggcgtgacctatattccatgggacaaggtgaaacccgaggagcttgagagcttttgtgaaggtggaatgttagactcggacaccctgaaccctgactggaaaggcattccgaaaaagccagaaaacgaggtggctcagaacgggggcgcagaaacctcccacacagagcccgtgagtcctatccctaaacccctgccagtcccagtgcccccaatccccgtcccagccccgattacggtacccccacctcaggttccaccacaccagcctggccctcccgttgtcggagcgctgcagccgcctgccttcacccctcccctagggataccaccacctggtttcgggcctggtgtccctccacctcctcctcccccccccttcctgcggcctggtttcaacccaatgcatcttccaccaggatttctgcctcctggccctcccccccccataaccccgccagttagtatcccccctccacatacgcctccaatttcaatcccaaatagtacaattgcgggaataaacgaggataccactaaggacctatccataggcaaccccattcccactgttgtttcaggagcaagaggtaatgccgaatcaggcgatagcgtcaaaatgtacggcagcgcagtaccccccgccgctccaacgaacctccctacaccccccgtgacccaaccagttagcctcctcgggactcagggggtggctccaggccccgtgattggccttcaagccccgtctacaggcctcctgggcgcaagaccaggcctcatacccctgcagcgcccaccaggtatgccacctccccatcttcagaggtttccgctcatgcctcctcggcctatgccgccacatatgatgcaccgcggccccccaccaggccccggtggatttgcaatgccaccaccccatgggatgaaaggaccctttccccctcacgggccattcgtgcgacctggcggcatgcctggcctcggtggtcctggccccggtccaggcggtcctgaagatagagacggacgccagcaacctccgcagcagccacaacagcaacctcagccacaggcccctcagcagcctcagcagcagcagcagcagcaacccccccccagccaacagcctcctcctactcagcagcagccacagcagtttagaaacgataacagacagcagttcaactccggccgggaccaagagcgttttggtaggcgcagttttggcaaccgggtggagaatgacagggaaaggtatggaaaccggaacgacgaccgagacaactctaatcgggacagacgagaatgggggcgcaggtcacccgacagggatcgccatagagacttggaggagagaaatcggaggtcgagtggacatagggatcgtgagagagactcacgggaccgcgaatctaggcgtgagaaggaggaggccagaggtaaggagaagccggaggtgactgaccgcgccggtggaaacaagacagtagagcctcccatttcacaggtgggcaacgtcgacacagcgagcgagttggaaaaaggcgtgagtgaagccgcagtgctgaaaccaagcgaggaactgcctgccgaagctaccagcagtgtggaacccgagaaggactcagggtccgctgcagaagcccccaggtag

SEQ ID NO: 13329 - DNA, 3816 bp, Artificial Sequence
  Description of Artificial Sequence: Synthetic coding sequence
atggaggctgttaagacattcaatagcgaattgtactctctgaacgactacaaaccgccaatatcaaaagcaaagatgactcagattacaaaagcagctattaaagcaattaaattctataagcacgtggtgcaaagcgtggagaaattcatacaaaaatgcaagcctgagtataaggtgccagggttatatgtaatcgattccatcgtgagacaatccaggcaccagtttgggcaagaaaaggatgtctttgcccctcggttttccaataatatcattagcacgtttcagaatttgtacagatgtcctggtgacgataagagtaagatcgtccgggtgctcaatctttggcagaaaaataatgtgttcaagtctgaaatcattcagccactcttagacatggcagctggaataccccccccagtggttacacccgtcctggcctctactacaacagcaatgagcaacactcctggaacccccgtgactcccgtcacccccgccaatgttgttcaggggttaccagacccatgggtcagccagatcacgaacactgatacgttagccgctgtggcccagatactgcaatcgccccaagggcaacagctgcagcagttgatccagacactgcaaatacagcagcagaagccccagccatccatccttcaagcacttgatgcggggctggtcgtgcagctccaggcattaactgcccagctgaccgcagcggccgccgcagcgaacaccctgaccccattagagcaaggagtttctttcaacaagaagttaatggataggtttgattttggtgaggatagtgagcacagcgaggagccgaagaaagagatacccgcttctcagttgtcacatgttagcgagagtgtgaacaactccatatttcaccagatcgcagagcagttacagcaacagaaccttgagcatcttaggcagcagctgttggaacaacagcagccgcaaaaggcaacaccccaggattcacaggagggcacgtttggctccgagcacagtgcatcaccttcccaggggagcagccagcagcacttcctcgagccagaggtaaacctggacgacagcatagatattcagcagcaagatatggacatcgacgaaggccaggacggagtagaggaggaagttttcgagcaagaggcaaagaaggtagccgttcgttctcgatccaggactcatagtcgcagccgatctcgttcgccccgcaagcgccgatctcgctctaggagcgggagcaggaagcggaaacatcggaagaggagccgaagtcgctccagggaacggaaaaggaagtctagtagatcctacagctcagaaaggcgagccagggagcgggaaaaggagcgccagaaaaagggactgccacccataaggtctaaaactttatctgtgtgtagcaccacattgtgggtggggcaagtagataagaaggctacacagcaggaccttaccaacctgtttgaagaattcggacagattgagtctattaacatgattcccccacgaggttgcgcctatgtgtgcatggtgcaccgccaggatgcattccgcgcgctccagaaactgtcgagtggcagctacaaaataggctcaaaagtgatcaagattgcctgggctctgaacaaaggcgttaaaacagagtacaaacagttttgggatgtggacctgggcgtgacttacatcccttgggagaaagtcaaggtggatgacctggagggttttgccgaggggggaatgatagatcaggagacagtgaatacagagtgggaaactgtgaaaagtagtgagcccgttaaggaaacagtccaaaccacacagtctccgactcctgtggaaaaagagactgtcgtgactactcaggcggaggtgtttcctccccctgtggcaatgcttcagattccagtggcacccgcggtccctactgtttccctcgtgcctccagccttccccgtttccatgccagtgccgccgccaggcttctcaccaatcccgccccccccattcctgcgcgcttcctttaatccgtctcagcctccacctggcttcatgccccctcccgtgcctcctcccgtggtgccccccccgacaattcctcctgtcgtgcctactagtttagtgcagccatccctgtcaatgactcctgaaacggtaaaagacgtcggcttcgggagcttggtcatccctggggggtctgtggcctctaatctggccacttccgctcttcctgctggaaatgtcttcaatgcacccactaaacaggccgaacccgaggaaaaagtccctcacctcatagatcaccagatcagttccggcgaaaacactaggtcagtgatccccaatgacatttcgtccaatgccgctatactcggtggccaacctcccaatgttaccagtaattcaggaattttgggcgtgcaacgtccaaatgtctcttcaaactctgagatcctgggcgttaggcccagtaacgtgtcctcatcatcaggtatcatcgccgcccagccccctaacattctgaacaatagcggaatcttaggtatccaaccaccttcagtgtccaattcaagtggtctgctgggcgtactgccacctaatattccaaataactcaggactggtgggcgtccaacctcccaatgttcccaataccccgggcttgctgggcacacagccacctgccggcccccagaatctgccccccttgtcaatccctaatcagagaatgcccacaatgccaatgctggacattcgccctggccttatcccacaggctccaggaccccggttcccacttatacagcccggcatccctcctcagagaggtattcctccaccgtcagtgttagacagcgcactgcatcctcctcccaggggcccatttccccctggtgatatctttagtcagccggagcgccctttcctggctcctggtcgccagagcgttgataacgtgacgaatcctgaaaagcgaattcccctaggtaatgacaacattcagcaggagggagatagagattatagattcccccctattgaaacccgtgaaagtattagcaggccccctccagtcgacgtccgcgatgtggtaggtagacccatagacccgcgtgaggggcccggtaggcccccgctcgacggacgagatcacttcggccggccccctgtcgacatccgggagaacttagtaagacccgggatcgaccacctggggcggagggatcatttcggctttaatccggagaagccctggggacaccgtggcgattttgacgaacgcgagcatagggtgctgccagtgtatggtggccccaagggactccacgaggaacgcggacggttccgaagcgggaattacaggttcgaccctcgcagtggtccctggaaccgtggctttggccaggaggtgcacagagacttcgacgacaggcgaagaccatgggagcggcaacgcgacagagatgatcgggacttcgatttctgtcgcgagatgaacggaaatcggttaggcagggaccggattcagaacacctgggtacctcctccacacgcgcgcgtcttcgattactttgaaggggcgacgtcacagagaaagggagacaacgttccccaggtcaacggagaaaacaccgaacgccacgcacagcctccccccatccccgtccagaatgacccagaactctatgaaaaattgacttcctctaatgagattaacaaagaaaagtccgacactgtagcggacattgagtccgaaccagtagttgaatccacagaaaccgagggcacatag

SEQ ID NO: 13330 - DNA, 4014 bp, Artificial Sequence
  Description of Artificial Sequence: Synthetic coding sequence
atgcctcaaccattattacccgcgttgccccccctgagtagcccttcgggggccgggtcctgcgggccttccggaggggaatgcagcgggagaagattgttccgcaggagggcccgcggactgaggtccgataacatggaagctgttaagacctttaattcagaggattgtgcttcaacaccagcctgcaccgactgcttctcaagctcaatggacacaagaagcattctgtactcactaaatgattataagccccctatatctaaggcgaagatgacccagattaccaaggccgctataaaagccatcaagttttataaacacgtcgtccagtccgtggagaagttcatccagaaatgcaaaccggagtacaaagtgcccggattgtacgtgatcgactctattgtaagacaatcaaggcatcagttcggccaggagaaagatgtgttcgcccctcgctttagcaataacatcataagtaccttccaaaacctgtatcggtgcccaggcgacgataagtctaagatcgtgagagtcctcaatctgtggcaaaagaataatgtgttcaaaagcgagataatacagcccttgctggatatggcagcagggattcccccacccgttgtaactcctgtgctcgctagtaccacaaccgctatgagcaacacacctggaacacccgtgactcccgtcactcccgccaatgtggtccagggcctgcctgatccttgggtttctcagataacaaataccgataccctggcagccgtggcacagattcttcagagcccccagggacagcagcttcagcagctgatccagaccttacaaatccagcagcagaagcctcagccatctatattgcaggctctggatgcaggccttgttgttcaactccaggcactgaccgctcagctgaccgctgctgccgcagccgctaacaccctgaccccattggagcagggcgtgagcttcaacaaaaagctgatggacagatttgatttcggcgaggattccgagcattccgaagagccaaagaaagaaattcccgcctctcagctctcacatgtttccgagagcgtgaataacagtatctttcatcagatcgcagaacagctgcaacaacagaatctagaacatttgcggcagcaattgctcgagcagcaacagccacagaaagccacccctcaggatagccaggagggaaccttcggcagtgaacattcagcctcacccagtcagggatcatcacagcaacactttctcgaacctgaggttaacctggatgatagtatagatattcagcagcaagatatggatattgacgaaggacaggacggcgttgaggaggaagtgttcgagcaggaggctaaaaaagttgccgtgcgttcccggagccgaacccactctagaagcagaagccgatccccacgcaagcgaagaagccgcagcagatccggcagtcggaagaggaagcacagaaagcggagcagatccagatcacgtgagcggaagaggaagagctctaggtcctattcttctgagcgacgcgctcgcgagcgtgagaaggaacgccagaaaaaaggcctgcctccgataaggtctaaaaccttatccgtctgctccacaacactttgggtgggtcaggtagataagaaagcaacccaacaggacctgacaaacttgttcgaggagtttgggcagattgaatcaatcaacatgattcctccccgaggctgcgcttacgtctgcatggtccatcggcaggatgctttcagagccctgcagaaattgtcctcaggcagttataagatagggtctaaggttattaaaattgcctgggccctgaacaagggcgtaaagactgagtacaagcagttttgggatgttgacttgggcgtcacatacatcccttgggagaaagttaaggtcgacgaccttgagggctttgcggaaggcggcatgattgatcaagaaactgtgaacacggagtgggagacagttaagtcatctgagccggtcaaagagacagtccagaccacccagtcccctacacctgtcgaaaaggagaccgtggtcaccactcaggccgaagtctttccgccccctgttgccatgctgcagatccccgtagcccccgccgtacccaccgttagtttggttcccccggccttccctgtatctatgcccgtaccccctccaggcttctctccgattcccccacctccctttctgagagcttctttcaatcccagtcaaccaccccctggattcatgcctcctccagtgccaccacccgtggtgccccccccaacgatcccacccgtggtccctacgagtctagtgcagcccagcctgagcatgacacctgaaaccgtcaaggacgtcggcttcggctctttggtgataccaggcggctccgttgcatccaatctggccacctccgctctcccagcaggtaacgtatttaacgccccgactaaacaggcagaaccagaggagaaagtgccccatctgatcgatcaccagatttctagcggggaaaacactcgctcggtcatccccaacgatatcagctcaaatgctgccatcctgggcggccagccccctaatgtgacctcaaattctgggatcctgggcgttcagcgccctaatgtgagtagcaattcagagatcctgggagtccggccaagtaatgtgtcctcttcgtctggcattattgctgcacaacctcccaacatcctgaataactcaggaatcctaggcattcaacccccttctgtgagcaattcttccggattgcttggcgtactccctcctaatatacctaataattctggactggtgggcgttcagcccccaaacgtgcccaatacgcctggacttctggggacacagcctcccgcggggccccagaacctaccacctctttcaattcccaatcagcgcatgccaactatgccaatgctggacataagacccggcctgattccccaggcgcctgggccacgtttccccctgatacaaccaggaattccaccgcagcgcggcataccccccccctccgtcctggacagtgcactccacccaccccctagaggtcctttccctcctggtgatatattctctcaacctgaacgaccttttctggccccggggcgtcagagtgtcgacaacgtcacgaacccagagaagcgcattcccctcggcaacgataacatacagcaggagggagatagagattaccgattccccccgatagaaactagggagagcatctcacggcccccccccgtggatgtacgagatgttgtgggaagaccaatcgacccacgtgaaggcccggggcggcccccccttgatgggagagaccacttcggccggccaccagtagacatcagagagaacctcgtacgccctgggatagatcatcttggtcgcagggaccatttcggatttaaccctgaaaaaccctggggtcataggggcgattttgatgaaagggagcatcgggtccttccggtttacggggggccaaaagggctgcatgaagagcgcgggcgattccggagcgggaactaccgcttcgaccctcgttcaggcccgtggaacaggggctttgggcaagaggtgcatagagacttcgatgacagaaggaggccatgggaaagacaaagagacagggatgatagagacttcgacttttgtcgcgagatgaacggcaacagattggggagagaccgaatccagaatacctgggtgccacccccgcacgccagagtgttcgattacttcgagggcgccacttctcagcgcaaaggtgacaacgttccacaggtcaatggggagaacaccgagcgacacgcccagccaccaccgatccccgtccagaacgaccccgaactctacgagaaacttacctccagtaatgagattaacaaggaaaaaagtgatacggtggccgatatagagagcgagcctgtggttgagtcaaccgagactgagggtacctag

SEQ ID NO: 13331 - DNA, 3816 bp, Artificial Sequence
  Description of Artificial Sequence: Synthetic coding sequence
atggaggctgttaaaaccttcaatagtgaactgtattccctcaatgattataagccacctatctcaaaagctaagatgacacagattacaaaggcagcaataaaagcaatcaaattctacaagcatgtggtacaaagcgtggaaaaattcatccagaaatgcaagcccgaatataaagtgcctggcctgtatgtgatcgatagcatcgtgcggcagagcaggcaccaattcggacaggaaaaggacgttttcgcacctcgatttagtaataatatcatctcgacattccagaatctctaccgatgtcctggtgacgataaatctaaaatcgtccgcgtgctcaacctatggcagaaaaataatgtgttcaagtctgaaattatccagcctctcttggacatggccgcaggcattcctccccctgtggtgacccctgttctggccagcaccacaacagcaatgagcaacactcctggaactcccgtgacacccgtgacgcccgctaatgtcgtgcagggactcccagacccgtgggtctcccagatcacgaacactgacaccctggccgccgtggcccagatcctccagtcgcctcaggggcagcagctgcagcaactgatccaaaccctccaaattcaacaacagaaaccccagcccagcatcctccaagccctggacgccgggctcgttgtgcagcttcaggctctgacagcccagctgaccgccgctgccgccgcagctaacactttgaccccccttgagcagggagtgtcattcaataagaaattaatggaccggttcgattttggagaagattctgagcactcggaagaaccgaagaaggaaattcctgctagccaactctcccacgtctccgagtcagtgaataattccattttccatcaaatagccgagcagctccagcagcaaaacttggaacacttgcggcaacagctccttgaacaacagcaacctcaaaaggccactccccaggacagccaggaaggaaccttcggcagcgagcacagcgccagtccctcccaggggtcctcacaacaacactttctagagcccgaggtgaaccttgacgactccattgacatccagcaacaggatatggacatcgatgagggtcaggatggagtcgaggaggaagtgttcgagcaggaagctaagaaggtggccgtacgaagccgttcaagaactcactccaggtcacggtcgagaagcccacggaagcgaaggtcacgctcacgatcaggcagtagaaagcgcaaacatcgcaagcggtctaggtccaggagcagggagagaaaacgaaagagcagcaggtcatacagtagtgaacggcgggctcgggaaagggagaaggaaagacaaaaaaaggggcttcccccgataagaagcaagacactcagcgtgtgctcaactactctgtgggtgggtcaagtggataagaaggccactcagcaggacctgactaatctctttgaagagtttgggcagatagaatctatcaacatgatccccccacgaggctgtgcttatgtgtgcatggtccaccggcaggacgccttcagagctctgcagaaactgagttctggatcttataaaattggaagtaaagtaattaagatcgcatgggcattgaataaaggcgtcaaaacggagtacaaacagttctgggacgtggacctgggcgtgacatacatcccatgggaaaaggtgaaggttgatgatctcgagggtttcgccgaagggggaatgatcgaccaggaaacggtgaatacggagtgggaaacagtcaaatcttctgagcccgtcaaggagacagtccagaccacgcagagccctacccccgtcgagaaggagaccgtcgtgaccactcaggctgaagtctttccccctcctgtagctatgttgcagattccggtggcccccgccgttccgactgtcagccttgttcctcccgcgttccccgtttcaatgcccgtgccacctcccggattctcccctataccgcctcctccctttctgagagcaagcttcaatcccagccagcccccccccggtttcatgcctcctcccgtgcccccgcccgtggtaccacctcccacaataccccctgtggtgcccacatcgctcgtgcagccgtctctgtctatgacaccagagactgttaaagatgtcggctttgggtccctagtgataccggggggatctgttgcaagtaacctcgccacatccgctctgcctgcaggaaatgtgttcaatgcacccaccaaacaggccgagcccgaagaaaaagtgccacatctgatcgaccatcagattagctccggcgaaaacacaagatccgttatacccaacgacatatcttccaacgctgcgatcctcggcggtcagccacctaatgtcacatctaacagcgggattcttggcgttcagaggcctaacgtatcgagcaattctgagatcctcggcgtccgcccctctaacgtgtcctcttcaagtggcataattgccgcgcagccacccaatattctgaataacagtgggatcctgggtatccaacctccgtccgtctcgaatagctctgggttgctgggcgtgctgcctcccaacatccccaacaatagtggactggtcggagtgcagcccccgaacgtcccaaataccccaggcctgctggggacacaaccaccagccggcccccaaaacctgccccccttatccattccgaatcagagaatgccgactatgccaatgctggatattagacccggacttataccccaggcacccggacctcggtttcccttaattcagcctggcatcccaccccaaagaggtataccccccccaagcgtcctcgattccgcattacaccctcctcctcgaggtccctttcccccaggggatatcttcagccagccagagaggccgttcctggcccctggacgtcagagtgtcgataacgtgaccaaccctgagaaacgtatacccctggggaatgataacatccagcaagaaggggacagagactaccgttttccacctattgagacacgggaaagcatttcgcgtccaccaccagttgatgtgagagacgtcgtgggcagaccgattgatcccagggaggggccgggtcgccctcccttggacggaagagatcatttcggacggcccccggtggatattagagagaacctcgtcagacctggaattgaccacctggggagacgcgaccacttcggttttaaccccgagaagccctggggacatagaggcgacttcgacgaaagagaacacagagttctcccagtgtacggagggccgaaaggcctacacgaagagcgcggaagattccgctcaggcaattatcgctttgaccctcgttctggaccctggaatagaggcttcggccaggaagtccatagggacttcgatgatcggaggcgtccctgggagcgacagagagatcgagacgacagggatttcgatttctgccgggagatgaatggaaatcgccttggacgggatagaatccagaacacctgggtccctcctccccatgcacgtgtttttgactattttgaaggggccacatctcagcgaaagggtgataacgtgccacaggtgaacggggaaaacactgaaagacatgcacagccgccacccattccggtgcagaacgatccagaactgtacgaaaagctaaccagcagtaatgagattaataaggaaaagagtgatacagtcgcagacattgaaagtgagccagttgtcgagtctacggagaccgaggggacctag

SEQ ID NO: 13332 - DNA, 2262 bp, Artificial Sequence
  Description of Artificial Sequence: Synthetic coding sequence
atggaaagggccagacctgagccacctccgcagccacgaccactcaggcctgctccccccccactacctgtcgagggaacgagtttttgggctgccgcaatggaacctccacctagtagccccaccctcagtgcagccgcgtccgctacgttggcgtcctcttgcggagaggccgtggcatctggtctgcaaccggctgttcggcgcctcctgcaggtaaagcccgagcaggttctgttattgccccaaccgcaggcacagaatgaggaggcggctgcctcctctgctcaggcccgtttactgcagtttaggcccgatctacgactgttgcagccgccaacagcaagcgatggcgcaacttccagacccgagctgcatccagttcagcccctggccctgcatgttaaagccaaaaaacaaaagctgggaccctccctcgaccaaagcgtcggcccacgcggagctgtggagaccgggccgcgcgcatcccgagtggtcaaactcgaagggccagggcccgctcttggttattttaggggcgacgaaaagggcaagctggaagcagaagaagtgatgcgtgattcaatgcagggtggcgctggaaagtcacccgccgccatcagggaaggagttattaaaactgaggaacccgaacggctgttagaggattgcagattgggcgcagagcccgcatccaatgggctggttcacgggtctgccgaggtcattctcgcccctacttcgggagccttcggcccgcatcagcaagatctccgcattccgcttactttgcacactgttcctcctggcgcccggatccagtttcagggagctcccccttctgagttaatccgcctgacaaaagtgcccctgaccccggtgcctaccaaaatgcagagtcttcttgaaccttcagtaaaaatcgagactaaggatgtgccgctgacagttctgccgagtgatgccggtatcccagacaccccctttagtaaagacaggaacgggcatgtgaaaagaccaatgaatgctttcatggtgtgggctagaattcacaggcctgcgctcgctaaagcaaatccagctgccaataatgctgagataagcgttcagctgggactcgaatggaataagctaagcgaagaacagaagaagccttattacgatgaggcacagaagattaaggaaaagcaccgggaggagttccctggatgggtgtatcagcctaggcctggcaagaggaaacgattccctctttccgtgtcaaatgtgttttccggtaccactcaaaacatcatttcgacaaatccaaccacagtctacccatatagatcacccacatacagcgtggtcatccctagtctccaaaatcccatcacacatccagtcggagagacctccccagctattcaactccccactccagctgtgcagagtccatcacctgtgacgctgttccagccctctgtgtcaagtgcagcccaggtcgcagttcaggatcctagccttcccgtgtatcccgctctgccccctcagcgatttactggcccttcccagactgatacgcaccaactgcactcggaggctactcatacagtcaaacagccgaccccagttagtctggaaagcgcgaacaggatcagttcctctgctagtaccgcccatgccagatttgcaaccagcactattcaaccacctcgcgagtactcaagtgtgtccccatgcccacggagtgctcccattccacaagctagcccaatcccacatccacatgtttaccaacctccccctttgggccatcccgccacactattcggcactccaccccgcttttcgtttcatcatccctacttcctgccaggcccccactattttcctagtagtacatgcccttattcccggcccccattcggctacggcaattttccctcttccatgccagagtgcctgagttattatgaagatcgctatcctaagcacgagggtatctttagtactttgaaccgtgattatagttttagagactactctagcgagtgtactcacagtgaaaattcccgcagctgtgagaatatgaatggcacgtcatactacaactcccactcccactcaggcgaagagaatctcaatcctgtacctcagctggacattggcacattagagaacgtgtttacagctcctactagcactccgtcttcaatccagcaggtaaacgtgaccgactccgatgaggaagaagaagagaaggtgttgcgtgacctgtag

SEQ ID NO: 13333 - DNA, 1506 bp, Artificial Sequence
  Description of Artificial Sequence: Synthetic coding sequence
atggagcgggcccgccccgagccccccccccaaccacggccgcttaggcctgctccaccacccctacctgtagagggaacctctttttgggccgcagcaatggagccacccccatcaagcccaacactttctgccgccgcatctgccacacttgcctcgtcttgcggcgaagctgtggcctctggattgcagcctgcagtccggcggctgctgcaggtgaaacccgagcaggtattgttgcttccccaaccacaggcccagaacgaggaagcagccgctagctcggctcaggcacgcctgctgcagttcagacctgatctgaggcttctacagccacccaccgccagtgacggcgctacttctcgtccggagctccatccagtacagccgctcgccttacacgtcaaagctaagaagcagaagctcggaccatccttggaccaaagcgtgggccctcgcggtgctgtggagactggtccccgggctagtagagtggttaagttggaagggcccggtcctgctctgggctattttcgcggggacgaaaagggcaaactcgaggcagaggaagtgatgcgggacagtatgcaagggggagctggaaagagtcccgccgctataagagaaggcgtcattaagacagaggaaccggaaaggctgctcgaggactgtcgcctcggtgcagagccggcttctaacggactcgttcatggaagcgccgaagtgattctggccccaacttctggagcatttggtccgcaccagcaggacctgagaatcccgcttaccttgcacactgtgccgccgggggctaggatccaatttcagggtgcacccccctcggaattaatacgactgacaaaagtacctctgacaccagtgccaactaaaatgcagtccttgctcgagccatcagtgaaaattgagactaaagatgtaccattaacggtcttaccctcagacgcgggtataccggacacgcctttctctaaagaccggaatgggcacgtgaagagacccatgaatgcgtttatggtctgggcacgaattcatagacctgccttggccaaagccaatcctgccgccaacaacgccgaaatttccgttcaactgggtctagaatggaacaaactgtcagaggagcagaagaagccttactatgacgaggctcagaagatcaaagaaaagcatcgcgaggaatttcctggatgggtttaccagcctcgcccaggcaagcggaaaaggttccctctgagtgtatcaaacgtgtttagcggaacaactcagaacatcatatctaccaacccaaccacagtgtacccataccggtccccaacatattccgtcgtcattccatcgctacagaatccaattacccaccctgttgttcatgccctgaccgtgggtcttcccttggccatggagatctttagggtgcagtgtcagaatgccctagtaattatgaagaccggaacccagaatatgcgtgtgagtttccaactgtag

SEQ ID NO: 13334 - DNA, 585 bp, Artificial Sequence
  Description of Artificial Sequence: Synthetic coding sequence
atgccatccagtcccctcagggtggctgtcgtgtgctcctccaatcaaaacaggagtatggaggcccataacatactgagcaagagaggattctccgtcagaagttttgggacaggtactcatgtcaaactgccaggacctgcacctgacaagcccaacgtgtacgattttaaaacaacttatgatcaaatgtacaatgatctgcttaggaaagataaggagctttatactcaaaatggcatcctgcacatgctcgataggaacaaaaggattaaaccacggcctgagagattccaaaactgtaaagatctgtttgatctgattctgacgtgcgaggagcgcgtatatgaccaggtggtagaggatcttaactccagggaacaggagacttgccagcctgtccacgtcgtgaacgtcgacatacaggataaccacgaagaggcgactctgggcgcttttctaatctgtgagttgtgccaatgcatccagcacacagaggatatggagaacgaaatcgatgagctactgcaggagtttgaagagaaatccggacggacgttcttgcacaccgtgtgcttttactag

SEQ ID NO: 13335 - DNA, 462 bp, Artificial Sequence
  Description of Artificial Sequence: Synthetic coding sequence
atgccttcatcccccctgcgggtcgctgtggtgtgctcatctaaccagaaccgatctatggaagcccataacattctgagcaagagaggtttcagcgtcaggagcttcgggaccggcactcacgtcaaattgcctggcccagcccccgacaagccgaatgtgtatgattttaagaccacgtacgatcaaatgtataatgacctgctgcggaaagacaaagagctgtacccctccggcttacctttcaaaaatccgccatgcggaccgccttggaaggttctgagggtggctcgtgcccaagaagcctgccatccagtgcagtgcacacattggcttctgtgtctgtgtgagtctttggtgtcgatcccaggtgccagaagaatcgtgcatggcttggtcccagtgccacccatggctgtgggcgtggtcaggcgcacggataccgtttggggaagcccctag

SEQ ID NO: 13336 - DNA, 489 bp, Artificial Sequence
  Description of Artificial Sequence: Synthetic coding sequence
atgcctagttctcctctgagagtggcagtggtttgttctagtaaccagaataggagtatggaggcgcacaatattctgtctaaacgcggattctctgtcagatcctttggaacgggaacacatgtcaagctgcccggtcctgcgccggataagcccaacgtgtatgacttcaagacgacatacgaccaaatgtacaatgacttactccggaaggacaaagaactctacacacaaaacggcatcctccacatgttagaccgcaataaaaggatcaaaccaaggccagaacgatttcagaactgtaaagacctgtttgaccttattttaacttgcgaggagagggtctacgatcaggtggtcgaaggagaagaggcagccgcgtgctgggccggattgcaacagctctctcaaggcctgggcatgccagcgggaccacaccacgaccagtatagccccagtcgcgtggctggggcgggagaacagacatag

SEQ ID NO: 13337 - DNA, 336 bp, Artificial Sequence
  Description of Artificial Sequence: Synthetic coding sequence
atgctggacagaaataagagaattaagcctaggcccgagcggttccagaactgcaaagatctctttgatctgattctcacatgcgaggaaagagtgtacgaccaggtggtggaggaccttaattctcgcgagcaggaaacttgccagccggtccacgtagtgaatgtcgatattcaggataaccacgaagaagcgacactaggcgccttcctgatctgcgaactgtgtcaatgcattcagcacaccgaagacatggaaaacgagatcgatgagctgctgcaggagtttgaggagaagtctggacggacatttctgcacaccgtgtgcttctactag

SEQ ID NO: 13338 - DNA, 609 bp, Artificial Sequence
  Description of Artificial Sequence: Synthetic coding sequence
atgttcacagagctgaggagcaagctttccccacctcgtggacgtgcgggcgccgtgcgggcgggatttggagagagaagggacgtggacgccaccgcccatttctcattctgtcgcactctgctggagcataccgtttccgctgaatccattccatgtcacctgccaaggaccccaggcacatctctgacatggcatgattctcggtcacagcgagccgcgtcctcacgccccattaagctgctgcagcagcctggcactgacactccgcagggtagactctacagcgaccactatggattataccacacgtccccatcactgggggggctgacacggcccgtggtcctctggtctcagcaggacgtttgcaaatggctgaagaagcactgcccacacaattaccttgtgtacgtggaggccttctctcagcatgccattaccgggcgcgccctgctgcgcctgaacgccgaaaaacttcagcggatggggctcgcccaagaggcacagagacaggaggtgctccaacaggtcctcaggttacaggttagggaagaaggcagatctttgcagctcctgagccaagcgtcttttggaaagatgagctag

SEQ ID NO: 13339 - DNA, 321 bp, Artificial Sequence
  Description of Artificial Sequence: Synthetic coding sequence
atgtttacagagttacggagtaaactttctcccccaagaggccgagctggggctgttagggctggattcggggaaagacgagacgtcgacggatctgtgcatctgcagatcccatacagagcttttattcatagctttatagacaacgaatgcggggtgcccctctgcaaccagacctggatcaagacccctgcctcgcccgattccgccaccgcccacttttctttttgtaggaccctgcttgagcacaccgtttctgcagaatcaattccctgtcacctgccaaggacaccaggaacttctcttacctggcacgactag

SEQ ID NO: 13340 - DNA, 2046 bp, Artificial Sequence
  Description of Artificial Sequence: Synthetic coding sequence
atgtctaagggaatactccaggttcatccacctatctgcgattgtccgggctgccgaatctcctctccggtgaacagaggaagactcgcagacaagcggacagtcgccctgcccgccgcccgcaatctgaagaaagagagaacgccctcctttagcgcaagcgacggagatagcgatggaagcggcccaacctgtgggaggcgtccgggccttaaacaagaggacggcccccacattagaattatgaagcgaagagttcacacacactgggatgttaatatctcctttcgtgaggcctcctgctcccaggacggaaacctgcccacactgatttcaagcgtccatcgatcccgccacctcgtaatgcccgagcatcagagccgttgcgagtttcagcgcggatccctggagatcggactaaggccagcaggggacctcctgggtaagcgcctgggcagatcccctcggatcagctctgattgctttagcgagaaacgtgcccggtcagagtctccacaggaagccttgctcctccctagagaattgggtcccagcatggctccagaagaccactaccggaggttggtctccgctctctctgaagcatccacgtttgaggaccctcagcggctgtaccatctaggcctgcccagtcacggcgaggaccctccttggcacgacccaccacaccatcttccatcccatgacctgctgagggttcggcaggaggtcgccgccgcagcattgagaggcccatctggcctggaggcacaccttccctcctccaccgcaggccagcgtagaaaacaaggtctcgcccaacacagggagggcgccgcgccggcagctgccccttctttttccgagcgggagctcccccagcccccacctctgctctctccacagaatgcaccacacgttgccctgggaccacatctaaggcctccatttcttggcgtgccttcggctttatgccagacccctggttatggattcctaccaccagcgcaggctgagatgttcgcatggcagcaggagctgctaaggaagcagaacctcgctcgcttggagctgcccgcagatctgttgcggcagaaagagttggagagtgctcggccacaactgctggccccagagaccgctctgagaccaaacgatggcgcggaagagctccagcggcggggagcactcttggtcctgaaccacggggcagcaccgctattggctctgcctccccaaggcccacctggctccggtccacccaccccttctagggactccgccagaagagcacccaggaagggcgggccagggccagcgagcgcacgcccaagcgagagtaaggagatgacaggagcaaggttgtgggctcaggacggatccgaggatgaaccccctaaggatagtgacggcgaggaccccgagacagcagctgtggggtgtagagggcccaccccagggcaggctccagccggcggggccggagctgagggaaaaggactttttccaggatcgacactccccctgggcttcccatatgccgtttccccttactttcacacaggcgcagtgggagggttgtctatggacggagaagaggccccggccccagaggatgtgacaaagtggactgtcgatgatgtttgcagttttgtcggaggcttgagcggctgcggggagtacaccagggttttcagagaacaaggcatcgatggagaaactctgccactgctgacagaggagcacttattgacaaatatgggcctgaagctggggccagcccttaaaatccgggcccaggtggcccgtagactcggtcgtgttttctatgtggcttcctttcccgtggctctgcctctgcaacctcccaccttgcgggctcccgagagagagctcggaacgggagaacagcccctctctcctacgaccgctacgagtccatatggcggaggacacgccctagcaggtcagacatccccgaagcaggagaacggtacactggctctgctcccaggcgcgcccgacccttctcaacctctgtgctag

SEQ ID NO: 13341 - DNA, 540 bp, Artificial Sequence
  Description of Artificial Sequence: Synthetic coding sequence
atgtccaagggtattctccaggtgcaccctcccatctgcgattgccccggctgccgaatttcatctccagtcaatcggggcaggctcgccgataaacgcaccgtagccttacccgctgctaggaatttgaaaaaggaaaggaccccttcctttagcgcctcggacggtgacagtgatggctccgggccaacctgtggcaggcggcccggactgaagcaggaggatggcccccatatccgaattatgaagcggagagtgcacacacactgggacgttaacatctcattcagggaggcctcatgttcacaggacggaaacttgcccacgctaatctcatctgtacacagatctcgccacctcgttatgcctgaacatcagtctcggtgtgagtttcaacgggggtccctggagatcggcctccgcccagccggcgacctgctgggaaaaagacttgggaggagtcctcggatttcttcggattgctttagtgagaagagggcaaggtctgagagtcctcaggaggccctgttgttaccgtag

SEQ ID NO: 13342 - DNA, 330 bp, Artificial Sequence
  Description of Artificial Sequence: Synthetic coding sequence
atgtcaaaaggtattttgcaggtccatccccctatttgcgactgtcctggatgccggatttctagcccggtcaaccggggcagactggcagacaagcgcacggtggcactgccggctgcccgaaacctgaaaaaggaaagaacaccgtccttcagcgcaagtgatggtgatagcgacgggagcgggccaacttgcgggcggagacctggcctgaagcaagaggatgggccgcacatccgtatcatgaagcgacgagtgcatacccactgggacgtcaatatcagttttcgcgaggcctcctgctctcaggatggcaacttgcctacatag

SEQ ID NO: 13343 - DNA, 606 bp, Artificial Sequence
  Description of Artificial Sequence: Synthetic coding sequence
atggcagttgaggcgctacattgtggactaaatccccggggaattgatcaccccgcacatgccgaagggattaaattgcaaatcgagggcgagggtgtggagagccagtctatcaaaaacaagaatttccagaaagtgcctgatcaaaagggcacaccaaagcgcttgcaggctgaggccgagacagcgaaaagcgccaccgtcaagctgtcgaaaccggtggccctctggactcagcaagacgtttgcaaatggctgaagaagcattgccccaaccaatatcaaatctattccgaatcattcaagcagcacgacattacaggtagagccctgttgcgtctaacagacaaaaaacttgaaagaatgggtattgctcaggagaatttacgccagcacattttgcagcaggtgctgcagctgaaagtcagggaggaagtgcggaatctgcagctcctaacccaaggcaccttgctgttgccggatggctggatggacggcgagatccgacggaagactacccttctgctgggacagaccggagtaagagagaacctactcttgtttttgcatcggatctccatcattgaaaattccatccagatttag

SEQ ID NO: 13344 - DNA, 486 bp, Artificial Sequence
  Description of Artificial Sequence: Synthetic coding sequence
atggccgtggaagcgctgcattgtggcctcaatcctcgaggaatcgaccaccccgcccatgccgagggcataaagttacagatcgaaggcgaaggtgtggagtcgcagagcatcaaaaataaaaactttcagaaagtgccagaccaaaaagggacacccaagcggctgcaggccgaggcagagacggctaaatccgcgacagtaaagctttctaagccagttgcactttggacacagcaagatgtctgcaagtggttgaagaaacattgccccaaccagtatcagatctattcagagtcctttaagcagcatgacatcactggcagggccctgctgagactgactgacaagaaactcgaaaggatggggatcgcccaggagaatttaaggcagcacatcctgcaacaggtcttgcagctcaaagtgagagaagaggtgcgtaacttgcaactgctgacccaggcaagctcagaggggagtccttag

SEQ ID NO: 13345 - DNA, 279 bp, Artificial Sequence
  Description of Artificial Sequence: Synthetic coding sequence
atgcggtcttgcttgatgcccggcaacgagatgtctatgacatcaccggagggcactgagccgaaaggcaaacagcggcgctggcagcgccagaagacctttggggggggcacaatgcactcgcaggattcccaggaaatcgacggcaagtccctgctccttatgacgaggaatgatgtactcaccgggctgcaacttaagctcgggcctgccctgaagatctacgagtatcatgtgaagcccctccagacaaagcatcttaagaacaactcctcttag

SEQ ID NO: 13346 - DNA, 309 bp, Artificial Sequence
  Description of Artificial Sequence: Synthetic coding sequence
atgctttccgtagacatggagaataaagagaacggaagcgtgggtgtcaaaaattcgatggagaatggcaggccgccggaccccgctgattgggctgtgatggacgtcgtgaactactttaggacggtgggatttgaagaacaggccagcgctttccaggagcaggaaatagacgggaagtctctgctcttaatgaccagaaatgacgttctgacggggttacagctgaaactcggacctgcactgaagatttatgaatatcatgttaagcctttgcagactaagcacttaaaaaacaacagtagctag

SEQ ID NO: 13347 - DNA, 309 bp, Artificial Sequence
  Description of Artificial Sequence: Synthetic coding sequence
atgctgagcgtcgatatggagaacaaggaaaatgggagtgtcggcgtcaagaattccatggaaaatggacggccccctgaccccgctgactgggcggtgatggatgtggtgaattatttccgtaccgtcggatttgaggaacaagccagcgcattccaggagcaggagattgacgggaaatctttgctgctcatgacgcgcaatgatgttcttacggggctccaactgaagcttgggccagcgctgaaaatctacgagtaccatgtgaagcctttgcagacaaaacatctgaagaacaactcatcgtag

SEQ ID NO: 13348 - DNA, 309 bp, Artificial Sequence
  Description of Artificial Sequence: Synthetic coding sequence
atgctaagcgtggatatggagaacaaggaaaatggcagcgtaggggtgaagaattcaatggaaaatggtagaccaccagaccctgcagattgggctgttatggacgtggttaactacttcagaactgtcggatttgaggagcaggctagcgccttccaggagcaggaaatagatgggaaatccctgctgcttatgacccgtaatgacgtgctcaccggactccaactgaaacttgggcctgccctcaagatttacgagtaccatgtcaaacctctgcagacaaagcacctgaaaaacaattctagctag

SEQ ID NO: 13349 - DNA, 369 bp, Artificial Sequence
  Description of Artificial Sequence: Synthetic coding sequence
atggctaatagtttgctcgagggggtgtttgcggaggtcaaagaaccgtgcagcctgcctatgctcagcgtcgacatggagaacaaggagaacggaagcgtgggggttaaaaattctatggaaaacggacgacctcccgatccagccgactgggccgtcatggacgtggttaactactttcgaaccgttggctttgaagaacaggctagcgcatttcaagagcaggaaatcgacggaaaatctctgctgctcatgacaaggaatgatgtcctcacaggcttgcagctcaagctggggcccgctcttaagatctacgaatatcacgttaagccattgcaaacaaagcacctaaaaaacaattcaagttag

SEQ ID NO: 13350 - DNA, 351 bp, Artificial Sequence
  Description of Artificial Sequence: Synthetic coding sequence
atgcggggcgtagcagaggtcaaggaaccttgcagcctgcccatgctcagcgtggacatggagaacaaggaaaacgggtccgtaggcgtgaagaactcaatggagaatggtcgcccccccgatccggctgactgggcggtgatggatgtagttaactatttccgcacagtcggcttcgaagagcaggccagcgcatttcaggagcaagagatcgatggcaagagcctgctgctcatgactcgaaatgatgtgttgaccggtctccagctgaagttgggcccggccctcaagatctacgaataccatgtaaaaccactccagacaaagcacctcaaaaataacagctcatag

SEQ ID NO: 13351 - DNA, 309 bp, Artificial Sequence
  Description of Artificial Sequence: Synthetic coding sequence
atgcttagcgtagacatggaaaacaaagagaatggctcagtgggtgtgaaaaactcgatggagaatggccggccaccagacccagccgactgggcagtgatggacgttgtcaattatttcaggaccgtgggtttcgaggaacaggcatccgcatttcaggaacaggaaatagacgggaagagcctcctccttatgacgcggaatgatgtcctaaccggccttcaactaaaactcggccctgccctgaagatttatgagtaccacgtgaaacccctccagaccaaacaccttaaaaataactcttcatag

SEQ ID NO: 13352 - DNA, 3666 bp, Artificial Sequence
  Description of Artificial Sequence: Synthetic coding sequence
atgatcacatccgaactcccagtgctgcaagactccactaatgaaacaaccgcccatagcgacgccggcagtgagctggaggagaccgaagtgaagggcaagcgaaagcgggggcgccccggcagaccgccttctaccaataagaagccgcgtaagtcaccgggagagaagtccagaatagaggcaggaattaggggcgccggaagaggacgcgcaaacggccatcctcagcagaacggcgagggagagccagttactctattcgaggtggtgaagttgggaaagtccgctatgcaatccgtcgtggatgattggatcgagtcctacaagcaggatagagacatcgcactgctggacctcattaacttctttattcagtgctccgggtgccggggtacagttcgtatcgagatgttcaggaacatgcagaacgctgagattatcaggaaaatgactgaggagttcgatgaggattctggtgattatcccctcacaatgcccggaccccagtggaagaaattcagatctaatttctgtgaatttatcggggtgctgatccgacaatgccagtacagtatcatctatgacgaatatatgatggacacagtgatttcactgctcaccggccttagtgattcccaggtgcgcgccttcagacacacgagtacactggccgccatgaagttgatgaccgcgctggttaacgtcgcccttaacctctccatccaccaagacaatacccaaagacagtacgaggctgaaaggaataagatgatagggaagagagctaatgagagattggagctgctgttgcagaagcgtaaggagttgcaggagaatcaggatgagatcgagaacatgatgaatagtatcttcaaaggaatctttgtgcataggtaccgtgacgctatcgccgagatcagggccatttgtatagaggagattggggtctggatgaaaatgtattctgacgcctttttgaacgactcatatcttaaatacgtgggctggaccttgcacgacaggcagggtgaggttcggctgaaatgcctgaaagctctgcagtcgctgtacaccaatagggaactcttccccaagctggagctgttcaccaatagattcaaagataggatcgtgtccatgacactggataaagaatacgacgtggccgtagaggccatcagactcgtgaccctcatcttgcatgggtccgaagaagcattgtccaatgaagattgcgagaacgtctaccatttagtctactccgcccataggccagtggcggtcgccgccggggagtttctacacaagaaactgttctcccgccacgatccgcaggcagaggaggcactggctaagagaagaggtagaaacagccccaatggcaatttgatcaggatgctggtattattttttctcgaatccgagttgcatgaacacgcggcgtacctggtggattctctctgggagagtagtcaagaactgctcaaggactgggagtgtatgactgagctcctactcgaggaaccagtgcagggggaagaggctatgagcgacagacaggagagcgcactgatcgaactaatggtgtgcaccatcaggcaggccgccgaggcccacccccctgtggggagaggcacaggaaagcgagtgctgaccgccaaggagcgaaaaacccagatcgacgaccgcaacaagctcacagaacacttcataatcactcttccaatgcttttgtctaagtactctgctgacgctgagaaggtcgcgaatctgctgcaaatcccgcagtacttcgacctggagatatactcaaccgggcgcatggagaagcacctggatgcgctgctgaagcaaattaaattcgtggtcgaaaaacatgttgagtcagacgttctcgaggcatgttccaagacctacagtatcctttgcagcgaagagtataccatccagaatcgcgtcgatatcgcaagaagccaactgatcgacgagtttgtggacagatttaaccatagtgtcgaagatttgctgcaagagggcgaggaggcagatgatgacgatatctacaacgttctatcaaccctgaaacgtctgacctcattccacaatgcccatgatcttacgaagtgggacctattcgggaactgctaccgcctgctgaaaacaggcattgaacatggagcgatgccggaacagattgtggtgcaggcactgcaatgttcccactacagcatcctctggcagctggttaagatcacagacggtagcccctctaaggaggacctgctggtgctccgtaagaccgtcaagtcttttctggccgtgtgccagcagtgtttgtcaaacgttaacactcccgtcaaggagcaagctttcatgctgctttgcgacctgttgatgattttttctcaccagctgatgaccgggggaagagagggtctccaaccattggtgtttaacccagatacggggctgcagagtgagcttctaagcttcgtaatggatcatgtgttcatcgaccaagacgaagagaaccagtcgatggagggggacgaagaggacgaagccaacaagatagaagctttgcacaagcggcggaacttgttggctgcgttcagcaaactcatcatttacgatatcgtggacatgcacgctgcagccgacatttttaagcactatatgaaatactacaatgactacggggacatcataaaggaaaccctttcgaagacacgtcagatcgataaaatccagtgtgcaaaaactctgattctgtctctccaacagctttttaacgagctggttcaagaacaggggccaaacttggatcgcacgagcgctcatgtgtccggaataaaggaactagcaagaaggtttgccctgacttttggcctcgatcagatcaagaccagagaggccgttgcaaccctccacaaggatggcattgaattcgcctttaagtatcagaaccaaaagggccaagagtatcctccgcccaacttggcatttctggaggtactcagcgagttttcttccaaactcctcagacaggacaagaagacagtgcactcatatctcgagaagttccttacagagcagatgatggagcgaagagaggatgtctggcttcccttgatttcctaccgcaacagtctggtgaccggcggggaagacgataggatgtctgtaaattctggatcgagtagcagcaagacgagctccgtaagaaataagaaagggcgtccacctctgcacaagaagcgggtcgaagatgaaagtctagataacacttggctgaaccggactgacaccatgatacagactcctggacccctccccgcaccccagttgacctccacggtgctgagggaaaattcccgtcccatgggggaccagattcaggagcccgagtccgaacacgggtcagagcccgacttccttcataacaggggcctcatggaagaggacgccgagcctatctttgaagacgtgatgatgagtagccgcagccagcttgaggacatgaacgaggagtttgaggataccatggtgatcgatctgcccccatccagaaaccggcgggaaagggctgagctgagaccagacttttttgattcagccgcgatcatcgaagatgatagcggcttcgggatgccgatgttctag

SEQ ID NO: 13353 - DNA, 3777 bp, Artificial Sequence
  Description of Artificial Sequence: Synthetic coding sequence
atgataacgtcggagctccccgtactgcaggattccactaatgaaactaccgcccattcggatgccggcagcgaactggaggagaccgaggtgaaagggaagagaaagagaggaagacccggccgacctccaagcacaaacaagaaaccgcgaaaatctcctggcgagaagtcacggatcgaagccggcatcaggggagccgggagagggagagcgaacgggcatccacagcagaatggggagggagaaccagtcactctttttgaggtggtgaaattaggcaaaagcgcaatgcagtccgtcgtggacgattggatagagtcatataagcaagatcgtgacatcgcccttctggatcttattaatttcttcattcaatgttccgggtgccggggcacagtgcggattgagatgttccgaaatatgcagaacgccgagattattcggaagatgacagaggagtttgacgaagacagcggtgactatcccctaaccatgcccggcccgcagtggaagaaattccgcagtaatttttgtgaattcatcggcgtgctcatacgccagtgtcagtattccataatttacgatgaatatatgatggatacggtaattagtttactgaccgggctgagcgacagccaggtaagagcctttcgacatacgtcaacgctcgccgccatgaaactgatgacagctctggtcaacgtggcgctgaatctcagtattcaccaggataacacccagcggcagtacgaagcagagagaaacaaaatgatcggtaagagggcgaacgagcgtcttgagttgttgcttcaaaagcggaaagagctccaagagaatcaggacgaaattgagaacatgatgaatagtatcttcaaggggatattcgtccacagatacagagatgccatcgctgaaatcagagcaatatgcatagaggagatcggagtgtggatgaagatgtacagtgacgcattccttaacgattcatatctaaaatacgtgggctggacgctgcatgaccggcagggggaagtaagactgaagtgcttgaaggcccttcagtccctgtatactaaccgggaacttttccctaagctggagctgttcaccaatcggttcaaagatcgaattgtgagcatgaccctcgataaggagtacgatgttgcagtcgaagctattaggctagtgacccttatactccacggaagtgaggaggctctgagcaacgaagattgcgaaaatgtctaccacctcgtgtatagtgcccacagaccagtagccgtggccgcaggagaattcttacataagaagttgttcagcaggcacgacccgcaggccgaagaagctttggctaagcgacgtgggcgtaacagtcctaacggaaacctcattcggatgctggttctgttttttctcgaatctgaactgcatgagcatgccgcttatttagtcgacagtctctgggagtccagccaagagcttttgaaagactgggagtgtatgacagagctcctcctggaggagccagtccagggtgaggaagcaatgagtgatagacaggagagcgctctcatagagctgatggtatgtaccattcgccaggctgcggaggcccacccgcctgtagggcgtggcaccggaaaacgcgtcctgacggctaaggaaaggaaaacccagatagatgacagaaacaagcttactgaacacttcattatcacattacctatgcttctctccaagtactcagctgacgccgaaaaggtggccaatttacttcagatcccccaatactttgatctggaaatctattccacagggagaatggagaaacacttagacgccctcctcaagcagatcaaattcgttgtggagaagcatgttgagtctgacgtgctagaggcatgctccaagacctacagtatcctgtgctccgaagaatacaccatccagaacagagttgacatcgcacgcagccaattgattgacgaatttgtggaccggttcaaccattctgtagaagacttgcttcaggagggagaggaggccgatgacgacgacatctacaacgttctgtccacactgaagcgactgacctcatttcataacgcccacgacctcactaaatgggatctctttgggaactgctatcgtttactcaagaccggtatagaacacggggccatgccagaacagattgttgtgcaagctctccagtgttcccactatagtatcctctggcaattggttaaaatcactgatggcagtccctccaaggaggacctgctcgtacttaggaagacggtgaagtctttcctggccgtctgccaacagtgtctgagcaacgtgaacacacctgttaaggaacaggcctttatgttgctgtgcgatttgctgatgatattttcacaccagctcatgacaggtgggcgtgagggcttgcagcccttggtctttaacccagacaccggcctgcagagcgaactcttgagctttgtgatggatcatgtattcatagatcaggatgaagagaaccagagcatggaaggcgacgaggaggacgaggcaaacaagatcgaagcattgcataagcgtcggaatctcctggccgccttttcaaaactgatcatctatgacattgttgacatgcacgccgctgcagatatcttcaagcattacatgaagtattataacgactacggtgacattattaaagagacactcagcaaaacaagacagatcgacaagatccagtgcgccaaaacactaattctctcactacagcaactgttcaacgagctggtccaggaacaggggccgaacctggaccgcaccagcgcacatgtttcaggaattaaggagctagcacgaaggttcgcgctcacttttggcctcgatcaaattaagacccgggaggccgtggccacactgcacaaagacggaatcgagttcgccttcaagtaccagaaccagaaaggccaggagtatccacctccaaacctggcatttctagaggttctttccgagttcagctccaagctattacggcaagacaaaaagaccgtgcattcctacctcgaaaagtttttaaccgagcagatgatggagaggagagaagatgtgtggctcccccttatatcgtatcgtaacagtctggttacaggcggtgaggacgataggatgtcggtcaattccggatcctcaagctctaagacgagctccgtccggaacaagaagggccgcccacctctacacaaaaaacgtgtggaggacgagtcactggataatacgtggctgaataggacggatacaatgatacagacccccgggcctctgcccgcaccacaactgacgtccactgtattgagggagaattcgaggccgatgggcgaccagatacaggagccagagagcgagcacggctcagaacccgacttcctgcataatccccaaatgcagatttcgtggctcgggcagcctaaactggaggatcttaaccggaaagataggaccggcatgaattatatgaaagtacgaactggggttagacatgcagtccgaggcttgatggaggaggatgccgagccgatctttgaggatgtcatgatgagctctaggtcacagctggaggatatgaacgaggagtttgaagacacaatggtgatcgacctgccgccgagtcgcaaccggcgggagcgagctgagttacgacccgacttttttgattcggccgcgatcatcgaagatgatagcggatttgggatgccaatgttttag

SEQ ID NO: 13354 - DNA, 2997 bp, Artificial Sequence
  Description of Artificial Sequence: Synthetic coding sequence
atgaagctgatgaccgccctggtgaatgttgcccttaacctttctattcaccaggataacactcagcggcagtatgaggcagagagaaacaaaatgataggaaagagagccaatgaacggctcgagctccttctgcagaagcggaaggagctccaagaaaaccaggacgaaatagagaacatgatgaatagcatttttaaaggcatctttgttcatagatatagagatgccattgctgaaattcgagctatttgtatcgaggagatcggggtttggatgaagatgtatagtgacgcctttttgaacgattcctatctgaagtacgtggggtggacactccatgatagacagggggaggttaggctcaaatgtttaaaggcactgcagagcctctacactaatagggaactcttccctaagctggaactgtttacgaaccgattcaaagatcggatcgtgtcaatgaccctcgataaggagtacgacgtggctgtcgaggctatacgtctagtgaccctcatcttgcacggaagcgaagaagcacttagtaacgaggactgcgaaaatgtgtaccaccttgtctattctgcccacaggccagttgccgtggcagcgggggaattcctccacaaaaaactgttctccagacatgaccctcaagcagaggaagccctggccaagagaagaggccgcaactctcccaacggaaatttgatcaggatgctggtcctgtttttcctcgaatccgagctgcatgagcatgcagcatatctggtcgatagcctgtgggaaagttcccaggagctgctgaaggattgggaatgcatgacagaactgttgctcgaggaaccagtgcagggggaggaagctatgtcagaccggcaggaatctgcccttatagaactgatggtgtgcacaattaggcaggcagcagaagctcacccaccggttggacgaggcaccggtaagcgagtcttaaccgcaaaggaacgcaagacacagatcgacgatcggaataagctcacggagcactttataatcactctgcctatgttgttgagcaagtattctgctgacgccgaaaaggtcgcgaacctcctacagatacctcagtactttgatttggaaatttatagcacgggccgaatggaaaagcacttagatgctctgttaaagcagataaagttcgtcgtcgagaaacacgtggagagcgacgtgctggaggcttgctccaaaacgtattccattctctgttccgaagagtacactatccagaaccgcgttgacattgccagatcccagctgattgacgagttcgtggataggtttaatcactctgtggaagatctactgcaggaaggcgaagaagccgatgacgacgacatatataacgtgctctccacgctcaaacgcctcacaagttttcataacgctcacgatctgacgaagtgggacttgtttgggaattgttatcggctgttgaaaaccggaatcgagcacggagctatgcctgagcagatagtggtgcaggctttgcagtgttcccactacagtattctctggcagttagtgaagataaccgatggctcacccagtaaggaagatttgcttgtcctgagaaagactgtcaaatccttcctggcggtgtgtcagcaatgcctgtctaacgtaaacactcccgtcaaggaacaggccttcatgctgttgtgcgatcttttgatgatattctcccaccagctgatgactggcggacgagaagggttacagcccttggtctttaatcccgacactgggcttcaaagtgaactgctttcctttgtgatggaccacgtctttattgatcaggacgaagagaaccagtcgatggagggggacgaggaggatgaggctaacaagatagaggccttacataagaggaggaatctgttagccgctttttcaaagctgatcatttacgatatcgtggatatgcacgccgcagccgacatttttaagcattatatgaaactgttcaatgagttggtgcaggagcagggcccaaacctggaccggaccagcgcccatgtgagcggcatcaaggaactggcccgccgctttgctcttacattcggactcgatcagatcaagacccgggaagcagtggcaactctgcacaaggacggaatagagttcgcattcaagtaccagaaccagaaaggccaggagtacccacctccaaacctcgctttcctggaggtgttatctgaatttagtagcaagctgttgcggcaagacaaaaaaaccgtccattcatacttggaaaaatttctgacagaacagatgatggaacgacgggaggacgtttggttgccactgatctcctaccggaattccttagtgacgggaggtgaggacgaccggatgagtgttaattccggcagctcaagttctaaaacatcatccgtgagaaataaaaagggccgacctcctcttcataaaaaacgcgtggaggatgaatctctggataatacgtggctgaacagaacagatactatgatccagactccagggccgctgccagccccccaattgacctcaaccgtgctgcgggagaatagccggccaatgggggaccaaattcaggagccagaaagcgagcacgggtccgaaccagacttcctccataaccctcagatgcagatcagctggctaggacagcctaagctggaagacctcaataggaaggaccggaccggtatgaattacatgaaggtgcggactggcgtgcgtcatgctgtccgcggtttaatggaggaagatgcagaacccatcttcgaggacgtgatgatgagtagccgctctcagctggaggacatgaatgaggaattcgaagatacaatggtcatcgatctgcccccctcccgcaataggagagagcgggccgagctccggcctgattttttcgatagcgctgctattattgaggacgattctggatttggaatgccaatgttctag

SEQ ID NO: 13355 - DNA, 2529 bp, Artificial Sequence
  Description of Artificial Sequence: Synthetic coding sequence
atgactctggacaaggagtacgatgtggccgtcgaggccatccggttggttactctcattttgcagctgttcagccggcatgaccctcaggctgaggaagccctggctaagcgccggggacgcaactcccccaatgggaacctgatacgaatgctcgtgctgttctttctcgaatccgaattgcacgaacacgctgcctaccttgtcgactccctgtgggaatcgtcgcaagaactgctcaaagactgggaatgcatgaccgagctgctgctggaggaacccgtgcagggggaagaggccatgtccgatcggcaggaatcggcactgatcgaactgatggtctgcactatcagacaagccgctgaagctcacccccctgtagggagggggacgggtaaaagggtccttactgcaaaggagcgtaaaactcaaatcgacgataggaataaactgactgagcactttatcatcaccttgccaatgctgctatctaaatattcggctgacgctgagaaagtcgccaacctactccagatccctcagtacttcgaccttgagatatactctacaggccgcatggagaagcatctcgacgccttgctaaagcagataaaatttgtggtcgagaaacatgtcgagtccgacgtactggaggcctgcagcaagacgtactctattttatgttcagaagaatatacaatccagaatcgcgtggatatcgcaaggtcacagctgatcgacgaattcgttgatcggttcaatcacagcgtggaagatttactccaggagggagaagaggccgacgacgacgacatctataacgtgctttccacattaaagcgcctcacaagcttccacaacgcccacgacctgacaaagtgggatctatttggaaactgctatcggcttctcaagaccggcattgagcatggagccatgcccgagcaaatcgtcgtccaggccctccagtgctcccattacagcatactgtggcagctggtgaaaattacagacggcagcccctctaaagaggatctactggtgctgcggaagacggtcaaatctttcttggccgtgtgccagcagtgcttgagcaacgtcaacactcccgtgaaggagcaggcattcatgctgctctgcgatctgctaatgatcttttctcatcagcttatgacagggggccgcgaggggcttcagcccttggtgttcaatcctgacactggtcttcagtctgagctccttagtttcgtgatggaccacgtgttcatcgaccaagatgaggaaaatcagtccatggaaggcgacgaggaagatgaggcgaataagatagaggctctgcataaaaggcgaaatctgctcgctgccttcagcaagctcattatttacgacatcgtagacatgcatgctgccgcggacatttttaagcactacatgaagtactataatgactacggagacattatcaaagaaaccctcagcaaaacccgccagattgacaaaatccaatgcgctaagacactcatcctgtctctacagcagctcttcaatgaactggtgcaagagcaagggcctaacctggataggaccagtgcgcacgtgtccgggataaaggagttggccagacgcttcgcgttgacctttggcttggaccagatcaagaccagagaggcggtagctaccttgcataaagatgggatcgaattcgcctttaagtaccagaaccaaaaagggcaggaatatccaccacctaaccttgcttttctggaggtgctgagtgagttctccagtaaactgctgagacaagataaaaaaaccgtacactcttacctggagaaattcttaactgaacagatgatggagaggcgagaggacgtctggctgcccctcatttcatatcgcaattctctcgtgaccggaggggaggacgacaggatgtcagtcaattctggtagcagcagcagcaagacatcctctgtgaggaataagaagggccggccacccctacacaaaaagagagtcgaggacgaaagtctcgacaatacatggctaaacagaaccgacactatgatccagacccctggcccactgcctgccccacagcttacaagtactgtcctccgagaaaactctcggcctatgggcgatcagatacaagagccagagtctgaacatggcagtgagcccgatttccttcacaacccacagatgcagatctcatggttgggtcaacctaagctggaggacctgaataggaaagacaggacagggatgaactatatgaaggttcggactggtgtgcgacacgctgtgaggggtttgatggaggaggatgccgaacctatttttgaggatgtgatgatgagcagcagaagccagctggaggatatgaatgaagagtttgaagatactatggtaatcgacctgcctccatcgaggaatagacgagagcgagcagagctccgtccggattttttcgactccgccgctattattgaagacgacagtgggtttggcatgcccatgttttag

SEQ ID NO: 13356 - DNA, 405 bp, Artificial Sequence
  Description of Artificial Sequence: Synthetic coding sequence
atgatcttttcgatgctccgcaaactgcctaaggtgacctgtcgggacgtattaccagagattcgggctatatgcatcgaagagatcgggtgttggatgcagagctactcaacctcatttctcaccgattcctacctaaaatacattggttggacactacatgataagcacagagaagtgcgagttaagtgcgtcaaggccctgaagggcctgtacggtaacagagacctgacggcacgactggagctgttcactggccggttcaaggactggatggtgtcaatgattgtggatcgcgagtattccgtggccgtcgaagctgttcgcttgctcattctcatattaaagaacatggagggggtgctcatggacgtcgactgtgagtcagtgtaccctattgtttag

SEQ ID NO: 13357 - DNA, 618 bp, Artificial Sequence
  Description of Artificial Sequence: Synthetic coding sequence
atgatcttctctatgctgaggaagctccccaaggtgacttgtcgcgacgtactgcccgagatcagagccatctgcattgaggagattggatgctggatgcagagctattccacaagtttccttactgattcatatctgaagtatattggatggaccctgcacgataagcaccgtgaggtcagagtcaagtgtgtcaaggcactgaaggggctctacggcaatagagatttaacagcccggctggaactttttaccgggcgattcaaggattggatggtgtccatgattgtggaccgggaatattctgttgctgtagaggctgtgcgtctgctgatccttatccttaagcttttttacccagaatgcgaaattcggaccatgggtgggcgagagcaacgccagtcccctggggcgcaaaggacattttttcagttactcctgtcattctttgtcgagtcgaagctgcacgatcatgcggcctatctggtagacaacttgtgggattgcgctggaacgcaactcaaggactgggagggtcttacgtcactgctcctcgaaaaagaccaaagcacgtgccatatggagcccggtcccggcaccttccatttactgggttag

SEQ ID NO: 13358 - DNA, 456 bp, Artificial Sequence
  Description of Artificial Sequence: Synthetic coding sequence
atgcagcatagagaggtgagggtcaagtgtgtcaaggccttgaaagggctttacggcaacagagacctgacagctagactcgagctgttcaccggtcgattcaaggactggatggtttccatgatcgttgacagagaatatagtgttgcagtggaggccgtgcgccttcttatccttattttaaagttgttttatcccgaatgtgaaattaggaccatggggggcagagaacaaaggcagtccccaggcgcccaacgaacatttttccagctcctgctgtcgttttttgtggagagcaagctccacgatcacgcagcgtaccttgtagataatttatgggactgtgccggcacgcagttgaaggactgggagggtctgaccagcctgctgctggagaaagatcagtctacctgccacatggagcctggacccggcaccttccacctgctggggtag

SEQ ID NO: 13359 - DNA, 387 bp, Artificial Sequence
  Description of Artificial Sequence: Synthetic coding sequence
atgatcttttctatgctgcgaaagctcccaaaggtgacttgcagagacgtccttccagagattcgcgccatatgcattgaggaaataggttgttggatgcagtcttattcaacgagctttctgacggattcctatttgaaatatattggctggactttacacgataagcatagagaagtgagggttaagtgtgtcaaggccctgaagggcttatacggcaacagggacctcacagcacggttggaactgttcaccggcaggttcaaagactggatggtctcgatgatcgttgatagagaatacagcgtggctgttgaagcagttcggctcctgatactgatcttgaagatcggctcccaaacaccggctacccgcgaatgtatttag

SEQ ID NO: 13360 - DNA, 378 bp, Artificial Sequence
  Description of Artificial Sequence: Synthetic coding sequence
atgcagcaccgtgaagtgagagttaaatgtgtgaaagctctgaaggggttatacggaaatcgtgacctcactgctcgacttgaactcttcacgggtagattcaaagattggatggtgagtatgatagtggatagggaatacagcgtcgcagtcgaagccgtaaggctgcttattttaattcttaagctcttttaccccgagtgcgagattcgtacaatgggaggaagggagcaacgccagtcgcctggcgctcaaagaacatttttccagcttctgctcagcttttttgtcgagtcaaaagtgacctataccgagaggacgctggcagtcgtccaccgcacttacaagtgggctggcgttgggggtagcaggttatag

SEQ ID NO: 13361 - DNA, 240 bp, Artificial Sequence
  Description of Artificial Sequence: Synthetic coding sequence
atgggcggccgtgagcaacgtcagtcacccggggcccagcggacattcttccagttgttattaagcttcttcgttgagtcaaagttacacgatcatgcagcgtaccttgtggataatctctgggactgcgctggcacgcaactgaaagactgggagggcctgacaagtttgttattggagaaagatcagagcacttgccacatggaacccggtcccggcacatttcacctgctgggctag

SEQ ID NO: 13362 - DNA, 405 bp, Artificial Sequence
  Description of Artificial Sequence: Synthetic coding sequence
atgatcttctctatgttgcggaagctccctaaggttacatgtcgtgatgtactgccagaaataagggcgatttgcatcgaagagattggatgctggatgcagtcatattcaacctcatttttgaccgatagctatctaaagtatatcggatggacacttcatgataagcaccgtgaagtgagggttaagtgcgtaaaggcactcaagggcctctatggtaatagggacctgaccgcaaggttagagctattcaccggccgcttcaaggattggatggtgagtatgatcgtagaccgcgagtacagtgtggcggtagaggcagtgaggttattgattctaatccttaagaacatggagggcgtcctgatggacgtggactgcgaatctgtctaccccattgtgtag

SEQ ID NO: 13363 - DNA, 405 bp, Artificial Sequence
  Description of Artificial Sequence: Synthetic coding sequence
atgattttttcaatgttacgaaaactgcctaaagttacctgccgcgacgttctacctgaaatccgggctatttgcatcgaagaaattgggtgttggatgcagagctattctacctcatttctcaccgatagctatcttaagtacattggttggacactacatgacaagcatcgcgaggtcagagtgaaatgcgtcaaagctctcaaggggctgtacggcaaccgcgaccttaccgcccgactagagttgttcactgggcgatttaaggattggatggtgagcatgatcgtcgacagagagtattcagtggcggtggaagcggttcgactgctgattctcattctcaagaacatggaaggcgtcctcatggatgtcgattgcgaatccgtgtacccaatcgtttag

SEQ ID NO: 13364 - DNA, 405 bp, Artificial Sequence
  Description of Artificial Sequence: Synthetic coding sequence
atgattttctctatgctgaggaaactccctaaagtcacttgccgcgatgtccttccggagatccgtgccatctgtatcgaagagattggctgctggatgcagtcttatagcacctccttcttaactgatagctatctgaagtacattggatggactctgcatgacaaacaccgggaggttagggtcaaatgtgtgaaggccctaaaagggttgtacggtaatcgtgacctgaccgcccgactcgaactattcaccggacgctttaaggattggatggtgtcaatgatagtggatcgcgagtactcagtggcagtcgaggcagtaagactattgattctgattctgaagaacatggagggggttttgatggacgttgattgcgagtcagtctaccctatcgtctag

SEQ ID NO: 13365 - DNA, 618 bp, Artificial Sequence
  Description of Artificial Sequence: Synthetic coding sequence
atgatcttctccatgctgcgtaaactgcccaaagtgacttgcagggacgtcctgcctgaaatccgagctatatgcatcgaagagatcggctgttggatgcagtcttactcaactagttttctgactgacagttatttgaaatacatcggctggacactgcacgacaagcacagggaggtgcgcgtgaagtgcgtcaaggcacttaagggactgtatggtaaccgcgatctcaccgccaggctggagctatttacaggctgctttaaagattggatggtgtccatgattatggatcgcgaatatagtgtggcagttgaggctgtgaggcttctgatccttatactgaagctcttttaccctgagtgtgaaattcgcacaatgggcggacgcgaacaacggcagtcacctggggctcagcgcactttcttccaacttcttctcagcttctttgtggagtctaagcttcacgaccacgctgcttatctcgttgataacctttgggattgtgctggcacccagctaaaggactgggagggcctcacatctctcctcctggagaaagatcagtctacatgtcacatggaaccgggccccggcacatttcatctgctcggatag

SEQ ID NO: 13366 - DNA, 405 bp, Artificial Sequence
  Description of Artificial Sequence: Synthetic coding sequence
atgatattcagtatgctgcggaaattacccaaggttacttgcagagatgttctgccagagatccgggccatatgcatcgaggagatcggctgctggatgcagagctactcaacgagtttccttactgactcctatttaaaatatataggatggaccctccacgataaacatagagaagtccgcgtgaaatgtgtgaaagcgctcaagggactttacggcaacagagatctgacggctagactggaactgttcactggatgctttaaggattggatggtttctatgatcatggatcgggaatatagtgtggcagtggaagccgtgcgcctgctgattctgatcctcaagaatatggagggcgtcctgatggatgtcgattgtgaatcggtctatccaattgtgtag

SEQ ID NO: 13367 - DNA, 456 bp, Artificial Sequence
  Description of Artificial Sequence: Synthetic coding sequence
atgcagcatagagaggtccgtgtgaaatgcgtcaaagccctcaagggactttacggcaacagagaccttactgcccgcctagagctcttcacaggctgctttaaagactggatggtgtccatgatcatggacagagaatatagcgtggccgtcgaggcggtacggctactcattctaatacttaagctgttctacccggagtgcgaaattcggaccatggggggaagggaacagcgccagagtccaggcgctcaacgcaccttcttccagttgctactgtccttttttgtggagtctaagctccacgatcacgcagcttacctggttgataatctgtgggactgcgccggcactcaacttaaggattgggagggcctgactagtctgttgctggaaaaagatcagtcaacctgtcacatggaacctggtcccggaacctttcatcttcttgggtag

SEQ ID NO: 13368 - DNA, 351 bp, Artificial Sequence
  Description of Artificial Sequence: Synthetic coding sequence
atgatcttctctatgctgcggaaactccccaaggtgacatgcagagacgtgctgcccgagatcagggctatctgtattgaggagatcggatgttggatgcagagttattccaccagctttctcacggattcctacctcaagtacattggttggacattacacgacaagcaccgggaggtgcgagtgaagtgcgtgaaggccctaaagggtctgtatgggaaccgagatcttaccgctcgcctggagctgttcaccggctgctttaaggattggatggtttccatgatcatggatagagagtacagcgtggcagtggaagcagtgaggctgctgatcctcattttaaagtag

SEQ ID NO: 13369 - DNA, 3708 bp, Artificial Sequence
  Description of Artificial Sequence: Synthetic coding sequence
atggcacatctcgagcttctgctggtcgagaatttcaaatcctggcggggcaggcaggtgatcggtccatttagacggtttacctgcattatcgggccaaatgggtcggggaagtctaacgtaatggatgccctgagctttgttatgggagagaaaattgccaacctgagagttaagaacatccaggaacttattcatggcgcccatattggcaagccgatctcctccagtgcctctgttaagatcatctacgtggaggagtccggcgaggagaagacattcgctagaatcatcaggggaggctgctccgagttccgcttcaatgataatttagtcagccgcagcgtctatatcgccgagcttgaaaagatcggcattattgttaaggctcagaattgcttggtctttcaggggactgttgaatctatcagtgtaaagaagcctaaggaaaggacccagttcttcgaggaaattagcaccagcggagaactgatcggagagtatgaggagaaaaagcgcaagctccagaaagcagaagaggatgctcagttcaatttcaataaaaaaaagaacatcgccgcagaacgacgccaggccaagctggaaaaagaggaagctgagcgttatcagtcattgttggaggagctaaaaatgaataaaattcaactgcaactgttccagctgtaccacaatgagaagaagatccacctcctcaacactaagctggagcacgtgaaccgtgatttgagcgttaaacgggaatctctgtcccatcacgagaatatcgtgaaagcccgtaagaaggagcacgggatgctcacccgtcagctccagcagacagaaaaggaactgaagagcgtggagacacttctgaaccagaaacgtccacagtacatcaaggctaaagagaacacatcacatcatttgaaaaaactggatgtcgccaagaagtccatcaaagatagcgagaagcaatgcagcaaacaggaggacgacatcaaggcgctcgaaactgaactggccgacctcgatgcagcatggaggtcctttgaaaaacagatcgaggaagagatactccacaaaaagcgggacatcgaactggaggctagccagctggaccgttataaagagcttaaagagcaggtcaggaaaaaagtcgccaccatgactcagcagttagaaaaactgcagtgggaacagaaaaccgatgaagagcgtttggcctttgagaagcggagacacggggaagtccagggaaatctcaagcagatcaaggagcagatcgaagatcataagaaacgaatcgagaagcttgaagaatatacgaagacgtgcatggactgtctcaaggaaaaaaaacaacaggaggagaccctggtcgacgagatcgagaagaccaagtccagaatgtcagaattcaacgaggagctgaacttaataaggagcgagttgcaaaacgctgggatcgatacccacgaggggaaaaggcagcagaaaagggccgaggtcttggaacacctgaaacgactctatccagactcagtctttggccggctcttcgatctgtgtcaccccatacataagaaataccagttggcagtaacgaaggtttttgggcgcttcataactgctatcgtagtggcttccgagaaggtggccaaggattgtatccgcttcctgaaggaagaaagagctgagcctgagaccttccttgccctggactacttggatattaaacctataaatgaacggctccgcgagctgaagggctgcaaaatggtgatcgacgtcatcaagactcagttccctcaactcaaaaaggtgatccagttcgtttgcgggaacgggttagtgtgcgaaactatggaagaggctagacacattgccctgtccggacccgagcggcagaagactgttgccctcgacggaacactatttctaaagtccggcgtcatcagcggcgggagttcagacctgaaatacaaggccaggtgctgggacgaaaaagagctgaaaaacctacgcgacagacgcagtcagaaaatccaagaactgaagggattgatgaaaacgttacggaaagagacagacttaaagcagatccagactttaatacaaggaacccagaccagattgaaatattcccaaaatgagttagaaatgataaagaagaagcatctggttgcattctaccaagaacagagtcaactgcagtccgaacttctgaatattgaaagtcagtgcattatgctgagcgagggtattaaagaacgtcagcgccgcatcaaggaattccaggagaaaatcgataaagtggaggacgatatctttcagcacttctgtgaggagatcggcgtggagaacataagggagtttgagaataaacacgtcaagagacagcaggagatagatcagaaacggcttgaattcgagaaacaaaaaaccaggcttaacgtgcagttggaatacagcagatcacacttgaagaaaaagctgaataaaataaatacactaaaagagactatccagaaaggatctgaagacattgaccacctgaaaaaagcagaggagaattgcctccaaacggtcaatgagctcatggccaagcagcagcagcttaaggacataagggtgacccagaactcgagcgcagagaaggtacagacacaaattgaagaggagagaaagaaattcctcgctgtggaccgagaggtcggaaaattgcagaaagaagttgtcagtattcagactagccttgaacaaaaaagactggaaaagcataatcttcttcttgactgcaaagttcaggacatcgagattatcctgctaagcgggtccctggatgacatcatcgaagtcgagatgggcacagaagctgagtctacacaggcaacaatcgacatctatgaaaaggaggaagccttcgaaatcgactacagctctttgaaggaggacctgaaggctctccagagtgaccaggagatcgaggcccacttgcggctattgctgcaacaagtggctagccaggaggatatcctcctgaagactgctgcccccaacctgcgcgctctggaaaatctaaagactgtccgcgataagttccaggaaagcaccgacgctttcgaggcgtctagaaaggaagcgcgcctctgtcgtcaggagtttgagcaagtgaagaagcggagatacgacctatttactcaatgctttgagcatgtctcgatctcaattgaccagatttacaaaaaattgtgtaggaacaactctgctcaggcatttctcagtcccgagaatcccgaagagccttacctggaaggaatcagttacaactgtgtggccccaggaaaaagattcatgccaatggataacctgtctgggggtgagaaatgtgtggccgcattagcattgctgtttgctgttcactccttcagaccagcaccattcttcgtgctggatgaggtggacgctgccttggataataccaacattggaaaggttagttcctacatcaaggagcagactcaggatcagtttcagatgattgttatttcgttgaaggaggaattctacagtagagccgacgctttaattgggatttaccctgaatacgacgactgtatgttcagtcgagtgttgaccttagatttgtctcagtacccagataccgagggacaggaatcctccaagaggcatggagaatctagatag

SEQ ID NO: 13370 - DNA, 3486 bp, Artificial Sequence
  Description of Artificial Sequence: Synthetic coding sequence
atggcccacctggaactgttgctggtggagaactttaagagctggagggggcggcaggtaatcgggcctttccgacgatttacgtgcattatcggcccaaacgggtctgggaagtcaaacgtgatggacgcattatctttcgtcatgggggagaagattgctaatttaagggtgaaaaatatccaggagctgattcacggcgctcatatcgggaagccaatatcttctagtgcaagtgttaagatcatttacgtggaggagtcaggggaggagaagactttcgcaaggatcatcagaggaggatgtagtgagttcaggtttaacgacaatttggttagtcgatctgtatatatcgcggagctggagaaaatcggaatcatcgtcaaagctcaaaattgcctggtgttccaaggaacagtcgaaagcatctcagttaaaaagcccaaggaacggacacagtttttcgaggagataagcacatccggcgagttgattggtgagtatgaagagaaaaaaaggaagcttcagaaggccgaagaagatgctcagtttaactttaataagaagaagaatatcgccgcggagaggcgccaggccaagttggaaaaagaagaggcagagaggtatcagagcttgctagaggagttaaagatgaacaagattcaactccagttgttccagctgtaccataacgagaagaaaatccatctactcaatactaaactcgaacatgtaaaccgggatttgtccgtgaagcgggagagcctgtctcaccatgaaaacattgtgaaggcacgcaagaaagaacatgggatgctgacgcgacagctacaacaaactgaaaaagaactgaagagtgttgagactctgctcaaccagaagagacctcagtacattaaagccaaagagaacacaagtcaccatctgaaaaagttggacgtagctaaaaagtccattaaggattctgagaagcagtgttccaagcaggaggacgacatcaaggcgctggagaccgaactggccgatctggacgctgcctggcggtccttcgaaaaacaaattgaggaagagatcctgcataagaagagggatattgagctggaagcctcgcagcttgaccggtataaagagcttaaggaacaggtcaggaagaaggtggctaccatgacgcagcagctggagaagttgcagtgggaacaaaagaccgacgaagaacgactcgcattcgaaaaaaggcgccacggcgaggtgcaaggcaatctgaaacaaatcaaggagcagattgaagatcataagaaaagaatcgaaaagctcgaagaatatacgaagacctgcatggactgtctgaaggaaaagaaacagcaggaagagactcttgtggatgagattgagaagacaaaatcccgaatgagcgaattcaacgaagagctgaacctgattcgctccgagcttcagaacgctgggattgacacccatgaagggaaacgccagcagaagcgggctgaggttctggagcacctgaaaaggctgtaccctgactccgttttcggccgactctttgatttgtgccaccctatccacaaaaaatatcagttggctgttacgaaagtgttcggccgcttcatcactgccatcgtggtcgcaagcgagaaagtcgctaaagactgtatcaggttcctgaaggaggagcgcgcagaaccggagacgtttttggcactagattacctggatattaagccaataaatgagcgccttcgcgagctcaagggctgcaagatggttatcgacgtgattaagacacagttcccgcagttgaagaaggtgatacagtttgtgtgcggcaatggcctggtgtgcgagactatggaagaggctaggcacatcgcccttagtgggcccgagcgacagaagaccgtcgcactggatggcacactgttcctgaaatctggcgtgatttcaggcggtagctctgatctcaaatataaggcaagatgttgggacgaaaaggaactcaagaacttgagggacagaagatcgcagaagatccaagagctgaaagggctgatgaaaacactgcggaaggaaaccgacctcaagcaaatccagactctgatccaagggactcagaccaggttaaagtactcccagaatgaactcgaaatgataaaaaaaaagcacctcgtagccttttatcaggagcagtcacagctgcagtctgagctgttaaatatagaatcccagtgtatcatgctttccgaaggcatcaaggaaaggcagcggaggatcaaagagtttcaggagaagatcgacaaagtggaggatgacatattccagcatttttgcgaggagattggggtcgagaatatccgggaatttgagaataagcatgtcaagcgccaacaggagatcgaccagaaacggctggagtttgaaaagcagaagactagactaaatgttcagttagaatatagtcgaagtcacctcaaaaaaaaactcaacaagattaacaccctgaaagaaacaatccaaaagggctccgaagatattgaccacctgaagaaagccgaggaaaactgcttgcaaacagtgaacgagctcatggcaaaacagcagcagctgaaggatatccgcgtgactcaaaactcctctgccgagaaagtgcagactcagatagaagaggagaggaaaaagttcctggctgtggatcgtgaagtgggcaaactccagaaggaagtggtgtcaattcaaacctcactcgagcagaaacgtctggagaagcacaatttgttactagactgtaaggtccaggatattgaaatcattctcctttcaggtagcctcgacgatatcattgaggtggagatgggcaccgaagcagaatcaactcaggccacaatagacatatacgaaaaggaagaagcattcgagattgactattcgtccctcaaagaggacctgaaggcactgcagtcggatcaagagattgaagcacatttgcggttgcttctgcagcaagtggccagccaggaggatatactgctgaaaacagcagccccaaaccttagagccctggagaacctcaagacggtccgggacaaatttcaggagtcaacggatgcctttgaagcttcgcgaaaggaggctcggctttgccggcaggagtttgaacaggtgaagaagcgacgctatgaccttttcacgcagtgcttcgaacacgtcagcataagtattgaccagatttataaaaagctgtgccgtaataactctgcacaggtgtcaagttatattaaagagcaaacacaggaccaattccagatgatagttatttcactgaaggaggagttttacagccgagctgatgccctgattggcatctatcccgagtatgatgactgcatgttctcccgagtccttacactcgacttgagccagtatccggatacagaaggacaggagagctcaaagcggcacggtgaatctcgctag

SEQ ID NO: 13371 - DNA, 5754 bp, Artificial Sequence
  Description of Artificial Sequence: Synthetic coding sequence
atggccgccgcggacggcggtgggcccggtggcgccagtgtaggaacagaagaggacggcggcggcgtaggccacaggaccgtgtatctgtttgataggcgggagaaggaatccgagctcggggaccgccctctacaggtcggggagaggtccgactacgccggtttcagggcctgcgtgtgccagaccctcgggatcagcccggaagaaaagttcgtaatcaccacaacttcaaggaaagaaatcacatgtgacaatttcgacgaaactgttaaggatggtgtgactctatacctgctccagagcgtgaaccagctgttgttaaccgccactaaagagcgcatagacttcctccctcactatgacacactggtgaagtccgggatgtacgaatattatgcttctgaagggcaaaatcctctccctttcgcccttgctgaattaattgacaattcactaagcgccaccagcagaaacatcggggtgcgcagaatacagatcaagttgctcttcgacgaaacgcagggaaagcccgccgttgccgtgattgataatggtcgcggaatgacttccaaacaactgaacaactgggctgtgtatagactgagcaaatttaccaggcagggagactttgaaagcgatcactctggctacgttcgaccggtacctgtgccccgaagcttaaacagtgacatctcctattttggggtggggggtaagcaggccgtctttttcgtgggacagagtgccaggatgatttccaaacccgccgatagccaggacgtacatgagctggtcctttccaaagaagacttcgaaaagaaggagaagaataaggaggctatttactccgggtatattaggaataggaagccctcagactctgtgcatattacaaacgacgatgagagatttctccatcatctgattattgaggagaaagagaaagattcattcacggccgttgtcattacaggtgtacagcccgaacacatccaatatctgaaaaattatttccatttgtggactaggcaacttgcgcatatctaccattattacatccatggaccaaaggggaacgaaattaggacctctaaagaagtggagcctttcaacaacatcgacattgagataagcatgtttgagaaaggcaaggttccaaaaatagtgaatttgcgcgagattcaggacgatatgcagactctgtacgtgaatacagccgccgacagctttgaatttaaggcgcatgtggagggcgacggcgtggtcgaaggtatcattaggtaccatccgtttctctatgaccgggagacttaccctgacgacccatgcttcccttctaaactgaaagacgaagacgacgaggacgactgtttcattctcgagaaggcagccagaggcaagagacccatcttcgaatgcttctggaacggtaggctgattccttacacctctgtggaggactttgactggtgtactccgccaaaaaagagaggtctggcccctatagaatgttacaatcggatttcaggagctctgttcactaacgataaatttcaggtgtccactaacaagctgacctttatggaccttgagttgaagctcaaggacaagaacactctgttcacaagaatcctgaacggacaggaacagcggatgaagattgatagagagttcgccctgtggctaaaagactgccatgagaaatatgataagcagatcaagttcaccctctttaagggggttattacgcggccggacctgccaagtaagaagcagggtccatgggctacctacgcggctattgaatgggacggcaagatatataaggcaggtcagctggtcaaaacaatcaagaccctgccactcttttatggctctatagttaggttcttcctgtacggggatcacgacggagaagtctatgctacaggcggagaggttcaaattgcaatggagccgcaggcactttacgatgaggtgagaacagttccaatagccaagctggatcggactgtggccgaaaaggcagtcaaaaaatatgtggaagatgaaatggccaggcttcccgatagactgagtgtcacatggcctgaaggcgatgagctgcttcccaacgaggtgaggcctgccggcacccctattggcgcccttcgaatagagatccttaacaagaagggtgaggccatgcagaagctgcctggtacaagtcacggaggatcaaagaagttgctcgtagaattaaaggtgatcctgcacagcagctcgggaaataaggaaattatttcccatatcagtcaacacggcgggaagtggccatactggtttaagaagatggaaaacatacagaaactaggcaactataccctgaagctgcaggtggtcttaaacgagtctaacgccgacacatacgcagggagacccctcccaagcaaagcgatcaaattttcagtcaaggaaggcaaacctgagaagttttcatttggcctgctggacctcccctttcgagtgggagtgcccttcaatatcccgctagaattccaggacgagtttggacatacttctcagttggttacggatattcagcctgttcttgaggccagtggcttaagcctccactatgaggaaatcaccaaagggccaaattgcgtgatccgcggtgtaacagccaaaggccccgttaattcctgccaaggcaagaactacaacctgaaggtgactctgcctggactgaaagaggattcccagatcctcaagattagactcctgccaggccacccacgcagactgaaagtcaagcctgattccgagatactggtcatagaaaacggcaccgcctttccattccaggtcgaggtgctcgatgaatccgacaacatcaccgcccagccgaagcttattgtgcactgtaagttcagcggcgcaccaaatctgccggtttacgttgttgattgttcttcctccggtacctctatcctgacaggcagcgcaatacaagtgcagaatataaagaaggaccagactctgaaagcacgaattgaaatcccgtcttgcaaggacgtagctccggtcgagaaaactatcaagctgctgccctcatcccacgttgcccgccttcagattttctcagtcgaagggcagaaggccatccagatcaagcatcaggatgaagtgaactggatagcgggcgatattatgcacaatctaattttccagatgtacgatgaaggcgagcgggagattaatatcactagtgcactcgccgagaagataaaagtgaattggactcccgaaatcaacaaggaacatttactgcaaggtctgctgccagatgttcaggtgcctacctctgtgaaggacatgagatattgtcaggtaagcttccaagacgatcatgtctcgctagagagcgctttcactgtcaggccactacccgacgaaccaaaacacctgaaatgcgagatgaaaggcggaaaaacggttcaaatggggcaggaactccagggagaggtcgtcattatcatcaccgaccagtacggaaatcagattcaagctttctcgcctagctcgctatctagcctctctatcgctggcgtcggactggacagtagcaacctaaaaaccacattccaagaaaacactcaatcaatttccgtacgcgggatcaagttcatacctggccctcccggaaacaaggacctgtgtttcacctggcgagaattttcagacttcatccgggtgcaattgatctctggaccccccgccaaactgttattgatcgactggccagaactgaaggagtcaattcctgtaatcaatggcagagatcttcagaacccgatcatcgttcagctgtgcgatcaatgggataacccagctcccgtgcaacacgtgaagataagcctaacaaaggcttcgaacttgaagcttatgccctcaaatcagcagcacaaaacagatgaaaaaggtcgcgctaaccttggcgtgttctccgtgttcgcacccagaggagaacacactctccaggtgaaggctatttataacaagtcaattatcgaaggtcccatcattaagttaatgatcctaccggatccagaaaaaccagtcagattgaacgtgaaatacgacaaggatgcatccttcttagccgggggactctttacagactttatgatctcagtgatttccgaggatgatagcataattaaaaatattaacccagccaggattagcatgaaaatgtggaaactgtcaactagtggtaaccgaccaccagctaatgcagaaaccttttcttgtaataaaatcaaggataacgataaggaggacggttgcttctacttccgcgacaaagtcattcccaataaagtgggaacctactgtattcaatttgggttcatgatggacaaaactaatatattgaattctgagcaagtgattgtggaggtacttccaaaccaacccgtgaagctggttccaaaaatcaagccccccaccccggccgtaagcaatgtgaggagcgtggcctcccggacactggtgcgagacttgcacctcagtattactgacgactacgacaaccacacaggaattgatctggtagggaccataatagctaccatcaaaggctcaaacgaagaggacactgacactcccttgttcattggcaaagtccgaacactggagtttccttttgtgaacggttccgccgagatcatgtccttagtcttagccgagtccagccctggtagagacagcacagagtactttatcgttttcgagccaaggctgcccctgctctcaagaaccctggagccctatatcctgccattcatgttttataatgacgtgaaaaaacagcagcagatggctgccctgaccaaggaaaaagatcaacttagccagtcgatcgtgatgtataaaagcctttttgaagccagtcagcagctgctgaatgaaatgaagtgtcaggtagaagaggccagactcaaggaggctcaactgaggaacgaactcaaaattcacaacattgacatccccacaacccagcaagtgccacatatcgaggccctactgaaacggaaactctccgaacaagaagaactcaaaaagaagccaagacgttcatgcacactcccaaattacaccaagggttctggagacgtcctcggtaaaatcgctcaccttgctcagattgaagacgatcgcgccgccatggtcatctcatggcacctcgcctcagatatggactgtgtcgttaccttaactactgacgccgctcggcggatttatgatgagacgcagggacggcagcaggtgctgcccctcgactcaatctataaaaagaccctgcctgattggaagcggtctctcccccacttcagaaacggcaaactgtacttcaagcccatcggagatcccgtgttcgcacgcgatcttctcacattcccagacaacgtggaacattgtgaaactgttttcggcatgctgcttggagacacaatcattttggacaatcttgacgcggcgaaccattataggaaggaagttgtcaagatcacccattgtccaaccctgctcacaagagatggggaccggatccgtagtaacggaaagtttggcgggctacagaacaaggcccccccaatggataagctcagggggatggtgttcggcgcaccagttcccaagcaatgcctcatactgggtgaacagatcgtccacgcctgcgtgccgtcttattcgggcgggtag

SEQ ID NO: 13372 - DNA, 6018 bp, Artificial Sequence
  Description of Artificial Sequence: Synthetic coding sequence
atggctgcagccgacggcggggggccaggaggcgcctccgtgggaaccgaggaggacggtggcggagtgggtcatcggacagtttatctttttgaccggagagagaaagagtcggaactgggtgatcgtcccctacaggttggtgaaaggagcgattatgccggctttcgtgcctgtgtttgtcaaaccttgggcatatctccagaggagaagtttgtgattaccaccacgagcaggaaggaaattacttgcgataatttcgatgaaaccgttaaggacggtgtcacattgtaccttctgcagtccgtgaatcaactgttactgacagccacgaaagagcggatcgactttctgccccactacgatactctggtcaaatcggggatgtatgagtattatgccagcgagggccaaaaccccctgcccttcgcgctggctgaacttatcgataattccttatctgctacttctcgaaatattggtgttagaaggatccagataaagttgctgttcgacgagacgcaggggaaaccagccgtggctgtcatcgataacggccgtggaatgacctcaaaacagttaaataactgggccgtctaccgactttccaaatttactcgacaaggagattttgagtctgaccactccggatatgtgcggcctgttcctgtgccccgatccctgaatagtgatatctcatacttcggcgttggggggaagcaggccgttttctttgtgggccagagcgcccgaatgatctccaagcccgctgattcccaagatgtccacgagctcgttctgtccaaagaagattttgaaaaaaaagaaaagaataaggaggcgatctactcaggatacattaggaacagaaagccttccgactccgtccacattaccaatgatgatgaacgattcctccaccacctgattatagaagaaaaagagaaggatagcttcacagctgttgtaattaccggggtgcaacccgaacacatacagtatctaaaaaattactttcatctctggacccggcagctggctcatatctatcattattacatccacggcccaaagggaaatgagataagaacttctaaggaagttgaaccctttaataatatagatatcgagatctcgatgttcgagaaaggaaaggtgcctaaaatcgttaatctacgggagattcaggacgatatgcaaaccctctatgtgaacacggccgccgacagtttcgagttcaaggcgcacgtggaaggagatggtgtagttgagggtataatccggtatcacccttttctttacgatcgggagacttatccggatgatccatgctttccttcaaaacttaaagacgaggacgacgaagatgactgtttcattctggaaaaagcagcacgcggtaaaagacccatcttcgagtgtttttggaatgggaggctcataccctacacgagtgtggaagatttcgactggtgtactcccccaaaaaaaagaggccttgcgccaatcgaatgttacaataggatctccggagctctgttcacgaacgataagttccaggtgtcaactaacaaattgacattcatggacctggagcttaagctcaaggataagaacactctctttacccggatcctgaacgggcaggaacagcgtatgaaaatcgatagggagtttgctctgtggttgaaagattgtcacgagaagtatgataaacagataaagtttacgttattcaaaggagtgatcacacggcctgacctgccgagtaagaagcagggtccttgggccacttacgcagcaatcgagtgggacgggaagatctacaaggccggccagctggtgaagactattaagactctccccctcttttatggcagcatcgttcgtttcttcctgtatggggatcacgatggcgaggtgtacgcaactggcggggaggtccagatcgcaatggagccacaagccctgtacgatgaagtgagaaccgtcccaatcgctaagcttgacagaacagtcgctgagaaggccgtaaaaaagtacgtcgaagacgaaatggcaagattgcctgatagactgtctgtcacctggcccgaaggggacgaattactccccaatgaggttcgcccagctggcacacctatcggggctttaaggattgagattctgaacaagaagggcgaagctatgcagaaattgccaggtacgtcccatggagggtcaaaaaagctgctcgtagagctgaaagtgatcctccactcaagcagtgggaacaaggaaataatatcccacatttcccagcatggaggaaagtggccctattggttcaagaaaatggaaaacatccagaaactgggaaactacacactgaagcttcaggtcgtgttgaatgaaagcaatgcagacacatacgctggccgcccgctcccaagtaaagcgatcaagttttcagtgaaggagggaaagcccgaaaagttctcctttgggctgctcgacttaccattcagagtgggagtgccctttaatatcccactcgaattccaggacgagttcggccatacaagccagctggtcaccgatatccagcctgtgctcgaagcgagcgggctgtccctccattacgaagagatcaccaaaggcccaaactgtgttattcggggagtgaccgccaagggcccagtgaacagttgccagggaaagaattacaacttaaaggtgacactgcccgggctgaaagaagacagtcagatactcaagatccgcctgcttccgggtcatcctcggcggctcaaggtcaagcctgattcggagattctggttatcgaaaatggcacagcttttccgttccaagtggaggtgctggatgagagcgacaatattactgcccagcccaaacttatcgtccattgtaaattttccggcgcacctaacttaccagtgtacgttgttgattgtagttcaagtgggacttcgatattgactgggtcagcgattcaggttcaaaacatcaaaaaggaccagaccttaaaggcaaggatcgagataccttcttgcaaagacgttgcccctgtggaaaaaaccatcaaactgttgcctagctctcacgtcgctaggctccagattttctccgttgagggccagaaagccatccagataaaacaccaggatgaagtaaattggatcgctggcgatattatgcataatctcattttccaaatgtatgacgagggcgagcgagaaatcaacattacttctgccttggcagagaaaattaaggtgaactggacccccgagatcaacaaagaacatcttctgcaaggcctcctgccagacgtgcaagtgcccacttcggtcaaagatatgaggtattgccaggtttccttccaggacgaccatgtgtccttggagtcagctttcacagttcgcccattacccgacgaaccaaaacacttaaagtgtgagatgaagggaggcaaaaccgtgcagatgggacaggaactgcagggagaagtagtgatcattattactgatcagtacggtaatcagatacaggcattttcgcccagctccctttccagtctttcgattgctggcgtggggctcgattcctcaaacctgaaaactaccttccaggaaaatactcagtctatcagcgtgaggggtattaagttcatccccggacctccgggaaataaggacttgtgcttcacctggcgagaattcagtgacttcattagggtccagctcatttctgggccccccgccaaattactcctgatcgactggcctgaactgaaggagagcatcccagtgatcaacggccgcgacttacaaaaccctattatcgtacaactgtgtgaccagtgggacaaccctgcaccagtgcagcacgtaaagatcagcctaacgaaagcttctaatctgaaactcatgccctccaaccagcagcataaaactgatgaaaaggggagggccaacctgggggtcttctccgtcttcgctccccgaggggaacacaccctacaagtgaaagccatttataacaaaagtataatagaggggcctattatcaagctgatgatcctcccagatcctgaaaagcccgtgagactcaacgtcaagtacgacaaagatgcctccttcctcgcaggtggcctcttcacggatttcatgatttccgtcattagtgaggatgactccatcataaaaaacattaaccccgccaggatttctatgaaaatgtggaaactatcaacaagtggaaatcgacctcccgccaatgcagaaaccttcagttgtaacaagatcaaggacaatgacaaggaggatggatgtttctattttcgggacaaggtgatccctaacaaggttgggacatattgtattcagttcggcttcatgatggacaaaactaatattttgaactcagagcaagtaattgtcgaggtgctcccgaatcagccagtgaaattggtgcccaagattaaacctccaactccagccgtgtcaaatgttcggagcgtggctagcagaactttggtcagggaccttcacctcagcatcaccgacgactacgataaccacactggcatcgacttggtgggaaccattatagctaccatcaagggctccaacgaagaggacacagacaccccacttttcatcgggaaggttcggactctggagttcccttttgttaatgggtccgctgagatcatgtccttggtcctggcggaatcttcacctgggcgggactccacagagtacttcatcgtctttgagccacgactgcccctgctgtcaagaaccctagagccttatatcctgccatttatgttctacaatgatgtgaagaaacagcagcaaatggccgccttgaccaaagagaaggaccagctgagccagagtatcgtcatgtacaagtctctcttcgaggctagccagcagctgttgaacgaaatgaagtgtcaggtagaggaagcccggctcaaggaggcacagctcagaaacgaattgaaaatccacaatattgatattccaactacccagcaagtgccccacattgaggccctgttaaaaagaaagctgagcgaacaggaggagctcaagaaaaagccacgcagatcctgtacactccccaattacaccaaaggatccggcgatgtactcggtaagatcgcgcatttagcccaaatcgaggacgatcgtgcggcaatggttatctcctggcacttggccagcgatatggattgtgtggtgaccctcactacagacgccgctaggagaatttatgacgaaacccagggtcgtcaacaggtgttgcccctggatagcatctataagaagaccctacctgactggaagcggtccctgccacattttcgtaacggcaagctgtacttcaagcctatcggagacccggtgtttgccagagatcttctgactttcccagacaacgtagagcactgcgagacggtgtttggcatgctcctgggggacactattatactagacaatctggacgccgcgaatcactacaggaaagaggtggtcaaaattacacactgccccactctcctgacccgcgacggcgatcgcattcggagtaacggtaaatttggcggacttcagaataaggcccctcctatggataaactgcggggcatggtgtttggggcgcccgtccctaaacaatgtcttatcctgggggagcagatcgatctgctgcagcagtaccgctctgccgtctgtaagttagacagtgtcaacaaggacttgaacagccagttggaataccttcgaacacctgacatgcgcaagaagaaacaggagctggatgagcacgaaaagaatctgaagctgatcgaggagaaattggggatgacaccaattaggaagtgcaatgatagccttcggcactctccaaaggtcgaaacaaccgattgccctgtgccacctaaacggatgcgaagagaggctacccgccagaaccgtatcattacaaagacagatgtgtag

SEQ ID NO: 13373 - DNA, 384 bp, Artificial Sequence
  Description of Artificial Sequence: Synthetic coding sequence
atgcccaagtcgaaggaactggtgtcctcatccagttcaggtagcgatagtgactcggaagtcgacaagaaacttaagcgaaaaaaacaggttgcgcctgagaagccggtgaagaaacagaagacgggagagacctcccgagcactgtcaagtagtaagcaatcctcctcaagccgggacgacaatatgtttcagataggcaagatgcggtatgttagcgtgagagactttaagggaaaggtcctgattgatatccgcgagtattggatggacccagagggcgaaatgaagccaggccgtaaagggatatcactaaaccccgaacagtggtcccagctcaaggagcagatttccgatattgacgacgccgtccggaagttgtag

SEQ ID NO: 13374 - DNA, 384 bp, Artificial Sequence
  Description of Artificial Sequence: Synthetic coding sequence
atgcctaagtctaaagagctcgtgtccagctcttctagcggctcggacagtgatagtgaagtggataaaaaactgaagcggaagaaacaagtcgccccagaaaagcccgtgaaaaagcaaaagacgggagagaccagccgagccctttcaagctccaagcagagctccagcagccgcgacgacaacatgtttcagattggcaaaatgcgatatgtgtccgttcgggatttcaaaggcaaggtgcttatcgatattagagagtactggatggatcctgaaggggagatgaaaccagggcggaaaggcatcagcttgaatccggagcagtggtctcagctcaaggagcagatatccgacatcgatgacgcagtgcgcaaactttag

SEQ ID NO: 13375 - DNA, 384 bp, Artificial Sequence
  Description of Artificial Sequence: Synthetic coding sequence
atgcctaagagcaaggaactggtctcctcctccagttctgggtccgattcggacagtgaggtggataagaaattaaaaaggaaaaagcaggttgcaccagagaaacccgttaagaagcagaagacaggggagacatcccgagctttgtccagcagcaagcagtcctcctccagcagagacgacaatatgttccaaataggaaaaatgcgttacgtatctgtgcgcgattttaagggcaaagtccttattgatatccgtgagtattggatggaccccgaaggagaaatgaagcctggaagaaaaggaatttccctaaatcctgagcagtggtctcaactgaaagaacaaatctcagacatcgatgacgccgtgaggaaactgtag

SEQ ID NO: 13376 - DNA, 201 bp, Artificial Sequence
  Description of Artificial Sequence: Synthetic coding sequence
atgcctaagagtaaggagctggtttcttcctcttcttctgggagcgatagcgattctgaggtggataaaaagctgaagaggaaaaagcaggtggcacccgagaagccagtcaagaagcagaaaactggcgaaaccagtcgtgctctaagctcttcaaagcagagcagttcgagtcgggatgacaatatgttccaggtttag

SEQ ID NO: 13377 - DNA, 384 bp, Artificial Sequence
  Description of Artificial Sequence: Synthetic coding sequence
atgccaaagtccaaggaacttgtttccagttcatcgagtggctcggattccgatagcgaagttgataaaaaactgaaaaggaaaaaacaggttgcgcccgaaaagccagtgaaaaagcagaagaccggtgagactagccgagcgttatcatcttctaagcagagctcatcatctagagatgacaacatgtttcagattggcaaaatgaggtatgtatctgtccgcgattttaaggggaaggtcctgattgacatcagggagtactggatggaccctgagggcgaaatgaagcccggacgtaagggcatcagcctgaatccagaacagtggtcccagttaaaagagcagatcagtgatattgatgatgctgtgaggaaattgtag

SEQ ID NO: 13378 - DNA, 384 bp, Artificial Sequence
  Description of Artificial Sequence: Synthetic coding sequence
atgccaaaatcgaaggagctggtgtcttccagctcctcaggatccgactccgatagcgaagtcgataagaaacttaagcgcaagaaacaggtggcgccagaaaagcctgtgaaaaagcaaaagacaggagagacttcgagggcactttcttcctctaaacagtcatctagctcgagggacgataatatgttccagatagggaagatgcgatatgtttccgtgcgagacttcaaaggaaaagtgctcattgatatcagggagtattggatggatccggaaggcgagatgaaaccagggagaaaaggaatcagcctgaacccagagcagtggtcccagttgaaggaacagattagcgacatcgatgatgccgttcggaagctttag

SEQ ID NO: 13379 - DNA, 372 bp, Artificial Sequence
  Description of Artificial Sequence: Synthetic coding sequence
atgccgaagtcaaaggaactcgtttcctcttcatcaagtgggtccgactccgactctgaagtggataaaaagctcaaaaggaagaaacaggtcgcaccagagaaacccgtgaagaaacagaagacaggtgagaccagcagagctctgtcctccagcaagcagtcttccagctcgcgagacgacaacatgttccagatcggaaagatgcgttatgtctccgtgagggactttaagggtaaggtgttgatcgatattagggagtactggatggaccctgagggcgagatgaagcctggaaggaaggggatttcccttaatcccgagcagtggagccagttgaaggaacagattctggttgccctgtggcagtag

SEQ ID NO: 13380 - DNA, 2241 bp, Artificial Sequence
  Description of Artificial Sequence: Synthetic coding sequence
atggcatggatacggtccacgtgcatcctgttctttacacttcttttcgctcacatcgcagccgtgccaattaagtaccttcccgaggaaaacgtgcatgacgcagactttggagaacagaaagatataagtgagataaatttagctgcaggcctggatctgttccagggtgatatcttattgcagaagtctcgtaacggtcttcgcgaccccaacacccgatggacattccccataccttatatcctcgctgataatcttgggcttaacgcaaagggagccatcctgtatgcgttcgagatgttccgattgaagagctgcgtagactttaagccctacgagggcgaatcttcctacatcatattccagcagttcgacggctgttggtccgaggtcggagaccagcacgtggggcagaacatctctattggacagggatgcgcttataaagccatcattgagcacgaaattctgcatgccctggggttttaccatgaacagagtagaactgaccgggacgattacgttaatatctggtgggaccagattctgtccgggtatcaacacaactttgacacctacgacgatagcctaataaccgatctgaacacaccctatgattatgaatctctaatgcactatcagcctttcagcttcaataaaaacgcttccgtgccaacaataacggccaagattcccgaattcaattcaattataggccaaagactggacttctccgcaattgatctcgagaggcttaacaggatgtacaactgcaccacgacccacaccctcttggaccattgcacatttgagaaagctaacatttgcgggatgattcaagggactcgcgacgacaccgattgggcccatcaggactccgcccaggccggcgaagtcgaccacacactgctgggccagtgtaccggagctggttatttcatgcagttttcaacaagctcagggtcagcagaggaagccgcgctcctcgagagccgaattctctatccaaaaaggaaacagcagtgtctgcaatttttctataaaatgaccggatctccttctgatcgattagttgtctgggttcgcagagatgatagcaccggtaacgtcagaaagctcgtgaaggtgcagacatttcagggagatgatgaccacaactggaagatcgctcacgttgttttgaaggaggagcaaaagttccggtatcttttccagggaactaaaggcgacccacagaattcgacaggcggaatctatttggatgatatcaccctgactgagacgccttgtcctactggggtctggaccgtcagaaacttctctcaggtactggaaaatactagtaagggggacaagctgcagtctccacggttttacaattccgagggatatggcttcggggtgaccttgtatccaaacagcagagagagctcggggtacctgcgcttagcattccatgtatgcagtggcgagaacgatgcaattttagaatggcctgtagagaatcggcaagtgataattacaattctcgatcaggagccagacgttagaaataggatgtctagctctatggtatttaccacgtccaagagccacacgtccccagctatcaacgacacagtgatttgggatagacccagccgggtcggcacgtaccatacagactgcaattgttttcgatctatcgatctggggtggtctgggttcatctctcatcaaatgctaaagcggagaagtttcttgaaaaacgacgacctgattatattcgtggatttcgaggacatcacacacctgtcccagaccgaggtgcctacgaagggcaaaagactctcgccgcagggactgattcttcaggggcaggagcagcaagttagcgaggaaggttccgggaaagctatgttggaagaagcgcttccagtgagtctgtcccaggggcaaccgtcacggcagaaacggtccgtcgaaaacacagggccacttgaagaccacaactggccccagtatttcagggacccatgtgaccctaatccttgccaaaacgatggcatttgcgtgaatgtcaagggaatggctagttgccgttgtatcagtgggcatgcgtttttttataccggagagagatgccaagctgtccaagtacatggttctgtactgggcatggttataggcggcaccgccggtgtgattttcttgacttttagtataattgccattttgtctcagcgccctcgcaaatag

SEQ ID NO: 13381 - DNA, 2826 bp, Artificial Sequence
  Description of Artificial Sequence: Synthetic coding sequence
atggaaggagcaagtcgggtctgccgacaggggagggtagcacttcctgccgaagaggactacctgcctcttaaaccccgagtgggcaaggctgcaaaagagtatcccttcattttggacgcttttcagcgagaagccatccagtgtgtggataacaaccagtctgtgctggtcagtgctcacacttcagcagggaagaccgtctgtgcggagtatgctattgccctcgctctgcgggagaaacaaagggttatcttcacctcacccataaaagccctctccaatcagaagtatagggagatgtacgaagaatttcaagacgtgggcttgatgaccggggatgtaaccattaaccctaccgccagctgtctggtgatgaccacagaaatcctgcgatccatgctctatcgcgggtcagaggtcatgagagaggtggcatgggtaattttcgatgagatccattatatgagggactccgagcggggggtagtgtgggaagagaccataatcctattgccagataacgtgcattatgtctttttgtcggctaccattccaaatgccaggcagttcgccgagtggatatgtcacctccacaagcagccctgtcatgtcatctacactgattatcggcctacccccctgcaacactatatctttccggccggaggggacggcctgcacctcgtggtagacgaaaatggcgactttcgcgaggataactttaataccgccatgcaggtcctccgcgatgctggggatctggctaagggcgaccagaagggaaggaaggggggaactaagggcccaagcaacgtcttcaagatcgtgaaaatgataatggaaaggaactttcagccagtaatcatctttagcttttcgaaaaaggattgcgaggcctatgctctacagatgacaaagctggattttaacacggacgaagagaagaagatggtcgaggaggttttttccaacgccatcgactgtctgtccgacgaagataagaaacttccacaagtggagcacgtgctccccttactgaagcgaggaatcggcatccaccatgggggtcttctgccaatactcaaggagactattgagattttattctccgaaggactcataaaggcccttttcgcaactgagacattcgcaatgggcattaacatgcctgcccggactgtactgtttaccaatgcacggaagttcgatggtaaggactttagatggatttcctctggcgagtacattcagatgtctgggagggccggacgcagaggtatggacgacaggggaattgtcatcctaatggtcgatgagaagatgtcaccaaccatcggaaagcagcttctgaagggaagtgccgatcctcttaattcagcctttcatctgacttataacatggtgctgaatctgctaagggtagaagagatcaatccggagtatatgttggaaaagagcttctatcagttccaacactacagggcaattcccggtgtagtcgaaaaagttaagaatagcgaagaacagtataataagatagtgattcccaatgaagaatcagtagtcatttactataaaattagacaacagctcgccaagctgggtaaagaaattgaggagtatattcacaaacccaaatattgcctgccttttctgcagcctggtcggctggtgaaagtcaagaacgagggggacgattttggctggggggtggtagttaacttttctaaaaagagcaacgtgaaaccgaatagtggcgagctcgaccccctctacgtagtcgaggtgctcttgcggtgtagtaaagagtctcttaaaaattctgccacagaagccgccaagcccgccaaacccgatgagaaaggggagatgcaagtagtacccgttttagtccacttgctgtctgcaataagttctgtgaggctttacatacccaaagacttgaggcctgttgacaaccggcagtctgtgcttaaatctattcaggaagttcagaaacgttttccagacggcatcccactgctcgaccccattgacgatatgggcatccaggatcaaggcctgaaaaaagtgatccagaaggtcgaagcgttcgaacatcggatgtactcacatccattgcataacgatcccaatctggaaaccgtctacacgctatgcgagaaaaaggctcagatcgctatcgatatcaagtcagcaaaacgcgaactgaaaaaggcgcgcacagttctacaaatggacgagctcaagtgcaggaagcgcgtgttaaggcgcctaggctttgcgaccagttctgatgtgatcgagatgaagggccgcgtcgcctgcgaaatttcatctgccgacgaattgctcctcacagaaatgatgtttaacggattatttaacgacctgtctgccgagcaggccaccgcactcctctcttgctttgtgtttcaggaaaattccagcgagatgcctaagctaaccgagcagctagccggcccattgcggcagatgcaggaatgcgccaaacgcatagccaaagtgtccgcggaagcaaaattagaaatcgatgaggagacctacctatccagcttcaaaccacacctgatggacgttgtttacacctgggccactggcgcgacattcgcccacatctgcaagatgaccgacgtcttcgagggcagtataatccggtgtatgcgccggctcgaagagctactgcggcagatgtgtcaggctgctaaagctataggtaatactgaacttgaaaataaattcgcagaaggaattacgaaaattaaaagggacatagtcttcgccgctagtttgtatctgtag

SEQ ID NO: 13382 - DNA, 3144 bp, Artificial Sequence
  Description of Artificial Sequence: Synthetic coding sequence
atggatgccgaagcggaggacaagactttacgtacgcgctccaagggaaccgaggtcccgatggattctttgatacaagagctgagcgtggcgtacgattgcagcatggctaaaaagaggacagccgaggaccaggcactgggagtgccggtcaataaacggaagagcctcctcatgaagccgcgtcactactcacctaaggcggattgccaagaggatagatcagatcgcacagaggacgatgggcccctcgagactcatggtcatagcacagccgaggagattatgataaaaccgatggatgagagcctgctttccacggctcaagaaaattccagtcgcaaagaggaccggtacagctgttatcaggagctcatggtgaagagtctgatgcacctgggcaaattcgagaaaaatgtctccgtgcaaacggtgtcagagaaccttaacgactctggcattcaaagcctaaaagccgaaagtgatgaggccgacgagtgtttcttaatccattcagacgacggccgagacaaaattgatgattcacaaccgcccttttgtagcagtgatgacaacgagagcaattctgaatctgctgagaacggatgggactccggcagcaatttttccgaggaaaccaagccgccgagggttccaaaatacgtcctcacagatcataaaaaagacctgctggaggttcctgagattaagaccgagggcgataaatttataccgtgcgagaacagatgcgatagtgaaactgaaagaaaagaccctcaaaacgcgctggccgagcctctcgacggcaatgcgcagccatcttttccggacgtggaagaggaagatagcgagtctttagctgtaatgactgaagaaggttccgatctcgaaaaggcgaaggggaatctctccttgctggagcaagcaattgctttacaggccgaacgcggctgcgtgtttcacaatacctacaaggagttggacagatttttgctggagcacctagcgggcgagaggcgccagacaaaggtcattgacatgggcggacgccaaatctttaataataaacattctcctcgccccgagaaacgggagacaaagtgcccaattcctgggtgcgacggtactggacacgtgactggactctaccctcatcatcgctccctgtccggatgtccgcataaggtccgagtgcccctggaaatcttagccatgcacgaaaacgttctgaaatgtccaactcctgggtgtacaggaagaggtcacgtgaatagtaaccgaaacacgcatagatccctttcaggctgtcccatcgccgccgccgagaagctggcgatgtcacaggataaaaaccaactggatagcccacagacaggccaatgtccggaccaggcccaccgtactagcctagtgaagcagatcgaatttaattttccttctcaggcgatcacgagcccaagggccaccgtatctaaagaacaggagaaattcggaaaggtaccctttgattacgcaagtttcgacgctcaagtgttcggtaaaagaccacttatccaaacagtccagggccggaagacccctccattccctgaaagcaagcacttcccaaaccccgtaaaattccctaatcggctgccctccgcgggagcacacacgcagtcgccggggcgggcatcctcatactcctatggacaatgctcggaggacacccatatcgctgccgctgcagccattttgaacctgagcactaggtgtcgggaagcaacagacattttgtcgaataaacctcagagtctgcatgcaaaaggcgctgaaatagaggttgatgaaaacggcaccctagacctgagtatgaagaaaaatagaatcctagacaaaagcgcgccactcacctcaagtaatacaagcattcctacccccagcagctccccctttaaaacatcatctatcctagtgaatgcagccttttaccaggcgctatgtgatcaggagggctgggatactcccatcaactattccaaaacacatggcaagacagaggaggaaaaggagaaggatcccgtgtcttctctggagaatcttgaagagaagaaatttccaggtgaggccagcatcccaagcccaaaacctaagctgcatgcacgtgaccttaagaaggagcttataacttgccccaccccagggtgtgatggatccggccacgtgaccgggaactatgcttctcataggagcgtgagcggctgcccgctcgctgataaaaccctgaagtcgcttatggccgcaaatagccaggaacttaagtgtcccacacctggctgtgacggctccggacacgtcacggggaattacgcctcacacagaagtctctccggctgcccacgggctcgcaagggaggcgtaaagatgacaccaactaaagaggagaaagaggacccagagctcaaatgccccgtcataggatgtgatgggcaaggccacatctcaggcaagtacacttcccatcggactgcctcaggatgtcctcttgcggccaagcgccagaaggaaaaccctttaaatggcgcatcgctatcctggaagcttaacaagcaggagctgccccactgccctctccctggttgcaatggacttgggcatgtgaataacgtgttcgtaactcatcgcagtcttagcggttgtccgttaaacgcccaggttattaaaaagggtaaggtctccgaggaacttatgactatcaagcttaaagccacagggggcattgagagcgatgaagagatccgccacctggatgaggaaattaaggagttgaatgaatccaacttgaagatcgaagctgacatgatgaaattgcagacacagataacttccatggaatcaaatttgaaaactatcgaggaagaaaataagttaattgagcagaacaatgaatctcttctgaaggagctcgccgggctgtctcaggcactgatctctagtctcgccgacatccagctgccccagatgggaccaatttcagaacagaactttgaggcctacgtaaatacacttaccgacatgtacagtaacctagaaagggactattcacctgagtgtaaggccctgctcgagtctatcaagcaagcagtgaagggcatccacgtatag

SEQ ID NO: 13383 - DNA, 1863 bp, Artificial Sequence
  Description of Artificial Sequence: Synthetic coding sequence
atggacgcggaggcagaggacaagacactgagaacacggtctaagggcaccgaagtcccaatggatagtctgatacaggagctgtccgttgcctacgactgcagcatggcgaagaagagaactgcagaagaccaggccctgggagtgccagtcaataagcgaaagagtctgctgatgaaaccccggcattactcaccaaaagctgattgtcaggaggatcggagcgataggaccgaggacgatggcccactcgagacccatggtcacagtaccgccgaagaaatcatgattaaaccaatggatgaatcccttttgtctactgcacaggaaaattcctcaagaaaagaggaccgttacagctgctatcaagaactaatggtcaagagcctgatgcacctgggtaagttcgagaaaaatgtttctgtgcaaaccgtatcagaaaacctgaatgactccgggattcagtccctgaaagctgagtcagacgaggctgatgaatgctttctgatccactccgacgatggtagagacaaaatagatgattcacagcctcccttttgttcttcagatgacaatgaaagtaactcagaaagcgccgaaaatgggtgggactcagggtcaaacttcagcgaagaaactaaaccaccacgcgtaccgaagtacgtgttgacggatcataagaaagaccttttagaggtgcccgaaatcaagactgagggagataaatttattccctgtgaaaatcgttgtgacagcgagacagagaggaaagacccacagaatgccctggcagagccactagacggcaacgcacagcccagctttcccgacgttgaagaggaggactccgagagccttgctgttatgacggaagaaggctcagacttggaaaaagccaagggaaacttgtcactactcgagcaggccatcgcattacaggctgaacgcgggtgtgtcttccataatacatacaaggagctggatcggtttttgttggaacacctggcaggagaaagaaggcagacaaaggttatcgatatggggggcagacaaatattcaacaacaaacactccccccgccctgaaaagagggagaccaagtgcccaattcccgggtgcgacggtacgggccacgtcacaggactatacccacaccatcgtagcttatccggctgtccccacaaggtgcgagtgcccctcgagattctggctatgcacgagaacgttctcaagtgccctacccctggctgcacaggaagggggcacgtgaattccaaccgaaacacccacagaagcttgtcgggctgtcctattgccgccgccgagaaactagcaatgtctcaggacaaaaaccagctggactcaccgcagactggtcaatgcccggaccaggctcatcgaacctctcttgttaaacagattgaattcaactttccttcccaggccattacaagccctagggccaccgttagcaaggaacaagaaaagttcggaaaggtcccgttcgactatgccagcttcgatgctcaggtgtttggaaagcggcccctgatccagacagtccagggtagaaaaacccccccattccccgaatcgaagcactttcccaaccccgtgaaatttccaaacagattgccaagtgccggcgcacatactcagtctccaggccgagccagctcctatagttatggtcaatgttccgaagatactcacatcgctgccgccgccgcaatcctcaacttatcgactagatgccgggaagctactgatatacttagtaataagcctcaaagccttcatgccaagggggccgaaatcgaggtggacgagaatggcactttagacttgagcatgaagaaatag

SEQ ID NO: 13384 - DNA, 42 bp, Artificial Sequence
  Description of Artificial Sequence: Synthetic coding sequence
atggacgctgaggccgaggacaagacactgcgcaccagatag

SEQ ID NO: 13385 - DNA, 990 bp, Artificial Sequence
  Description of Artificial Sequence: Synthetic coding sequence
atgtccgcggctggactgctggctcctgcgccggcccaggcaggcgcaccacccgcccctgagtattatccggaggaggatgaggagctggagtcagctgaggacgatgagcgatcttgcagggggcgagagagcgacgaggatactgaggatgcgtccgaaaccgatctagccaaacacgacgaagaagattatgtcgaaatgaaggagcagatgtatcaagataaactggcatcactgaagcgccagctgcaacaattgcaggagggcactctgcaagagtatcagaagcgcatgaagaagttggatcagcagtataaggagagaatcaggaatgccgataccttgttattgcaggcacagactgagcaagtagagagaaactatataaaagagaaaaaggcagctgtcaaggaatttgaagacaagaaagttgaactcaaggaaaatctgatcgcagaactggaggagaagaagaaaatgatcgagaacgagaagctgactatggaactcaccggggactccatggaggttaagccaatcatgaccaggaaactacgcaggcgcccaaacgatcctgtgccaatccctgacaagaggagaaaacccgcaccggctcagttgaattatttactaacggacgaacagatcatggaggacctccgaacgttgaataagttgaaatccccaaaacggccagctagcccatcaagtcctgaacacttaccggccactccggctgagagccctgcacagagattcgaggctaggatcgaggatggcaagctgtactacgacaagagatggtatcataagtctcaagccatctatcttgagagcaaggataaccagaagctttcttgtgtaatcagcagcgtaggagcaaatgagatctgggtccgaaagacgtctgacagtacaaaaatgcggatctacctgggccagctgcaaaggggactctttgtgattcgcagaagatctgcagcatag

SEQ ID NO: 13386 - DNA, 987 bp, Artificial Sequence
  Description of Artificial Sequence: Synthetic coding sequence
atgtctgccgcaggactactcgcgcctgcccctgcacaagcgggcgctccgcccgctcccgagtactaccctgaggaggacgaggagctggagtcagctgaggacgacgagcggtcctgtagaggacgggaatcggacgaagacaccgaggacgcatcagaaacagacctggctaagcatgacgaggaagactacgtcgaaatgaaagagcagatgtaccaggacaagctagctagtttgaagaggcaactgcagcagttgcaggagggaactctacaggagtatcagaagcgcatgaaaaaactcgaccagcagtataaggagcgcattcgcaatgctgagctgtttctccagctggagaccgagcaggtagaacggaactacataaaagaaaagaaagccgctgtcaaggagtttgaagataagaaggttgagcttaaagaaaacctgattgccgagctggaggaaaaaaaaaaaatgattgaaaatgaaaagcttaccatggagctgacaggcgacagcatggaagtgaagcccattatgaccaggaagctccgccgcagacctaacgatccagttcctatcccagataagcggcggaaacccgctcccgcccagcttaattatcttcttaccgacgagcagatcatggaggatctgcggaccctgaataaattgaaatcacctaagagaccggccagtcccagctctcccgagcacctacccgcaactcctgctgaatctccagctcagcgtttcgaggctaggatagaggatgggaagctgtattacgataaacgatggtaccataagtcccaagccatttacctagaaagtaaagataatcagaaactcagctgcgtgatcagtagcgttggagccaacgagatttgggttcgcaagacatcagacagtaccaagatgagaatttatctcggccagctgcagcgggggttgttcgtcatcagacggaggagcgccgcatag

SEQ ID NO: 13387 - DNA, 591 bp, Artificial Sequence
  Description of Artificial Sequence: Synthetic coding sequence
atggcctccaatgtcacaaataaaactgaccctctgttcagttccagcttcgatctggactatgacttccagagagactactacgacagaatgtatagctaccccgccagagtgcctcccccacccccaatcgctcgcgctgtagtacctagtaagagacagagagtgtccgggaacacttctaggcgagggaagagcggattcaattccaagagcgggcagcgggggagtagcaaaagcgggaaattgaaaggggatgatctgcaggccataaaaaaggagttaacccagattaagcagaaggttgacagtctgcttgaaaatcttgaaaagatcgagaaggagcagtccaagcaggcggtggagatgaagaacgacaaatcagaggaagaacagagttcgtcatccgtcaaaaaagatgaaactaatgttaagatggagtccgagggcggagcagacgacagcgccgaagagggcgacctactggacgatgatgacaatgaggatcgcggcgatgatcaagtcaagactacaggaaaggagcggaaaaggtggtggaggggagcccagggccacatggaatgtctctag

SEQ ID NO: 13388 - DNA, 1197 bp, Artificial Sequence
  Description of Artificial Sequence: Synthetic coding sequence
atggccgttacacttgacaaagatgcctactatcgcagggtgaaaagactgtatagtaattggagaaagggagaagacgagtatgcaaacgtggatgccattgtggttagtgttggtgtcgacgaagagattgtgtacgctaaatccaccgccttacagacctggttatttggctatgagctgacagacacaattatggtcttctgtgatgacaagatcatctttatggcctcaaaaaagaaagtcgagtttctgaagcaaatcgctaacacgaaagggaacgaaaatgccaacggggcccctgcgatcactctgctgattagagaaaagaatgagtccaataagtctagtttcgacaagatgattgaagcaattaaggaaagcaagaacgggaagaagataggcgtatttagtaaggataagtttcccggcgagttcatgaaatcttggaatgattgcttaaataaggagggctttgataaaatcgatatctccgccgtggttgcatatactatcgccgtgaaggaggacggtgagctgaacttgatgaaaaaggccgcctcaatcacctccgaagtgtttaacaagttctttaaagagcgggtcatggaaatcgtagatgctgatgaaaaagtacgacacagcaaactggccgaatccgtggagaaggccatcgaggagaagaagtacctcgccggggccgacccctccacggttgagatgtgttacccccctattatccaatctggagggaactacaacctgaaattctctgtggtatccgataagaaccacatgcatttcggcgccatcacctgcgccatgggcatccggtttaaaagctactgctcaaacctggtgcgaacattgatggtagacccgagccaagaggtgcaagagaactataacttcctgctgcagctgcaggaggagttgctgaaagagctccggcacggggtgaagatctgcgacgtatataacgctgttatggatgtggtcaaaaaacagaaacctgagctgctgaacaaaattactaaaaatctgggattcggtatgggcatagagttccgggagggatccctcgtgatcaactccaagaaccagtacaaattgaagaagggcatggtgttttcaattaatctaggattttccgacctgactaacaagaagaaaaaaaaaaagaaaaaggctaagtag

SEQ ID NO: 13389 - DNA, 954 bp, Artificial Sequence
  Description of Artificial Sequence: Synthetic coding sequence
atgaataatacagctgcatcgcccatgagtactgctaccagttcttccggccggtctactgggaagagcattagcttcgccactgagctgcagtccatgatgtacagcctcggagacgcgagaagaccgctgcatgaaaccgctgtgctggtggaggacgtggtgcatacacagctgattaatctcctccagcaggctgccgaagtgtcccagctgcggggggcccgcgtgattacgcctgaggatcttctgttcctgatgcgcaaggataagaagaagctgaggcggttgcttaaatacatgttcatcagagactataaatctaagattgtgaagggaatcgacgaggacgacctgcttgaggataagctaagcggcagcaataacgctaacaagcggcagaagatcgcacaagacttcctgaattcgatcgatcagacaggggagttacttgctatgttcgaggatgatgagatcgatgaagtcaaacaggaacgaatggagcgtgccgagaggcagacccgcataatggattccgcgcaatatgccgaattctgcgagtcccggcagctgtcctttagcaagaaggcctccaaattcagggattggctggactgttcatccatggaaatcaagccaaacgtggttgccatggagatccttgcttatctggcatacgagaccgtggcacaactcgtggacctcgcactcctcgtcagacaggatatggtgaccaaggcaggagacccattctcacatgccatctcggcgaccttcatacagtatcataattccgccgagtctacagccgcctgcggagtcgaagcccactcagatgccattcagccttgccacatacgcgaagccattcgccgttatagccatcggatcgggccgttgagcccatttactaacgcttatcggagaaacggcatggcctttctcgcctgctag

SEQ ID NO: 13390 - DNA, 327 bp, Artificial Sequence
  Description of Artificial Sequence: Synthetic coding sequence
atggagatcttggcatacctagcatacgagactgtcgcccagctggttgacctcgctctgcttgtgagacaggacatggtgaccaaggccggggatccgtttagccatgccatttcggccacattcatccagtaccacaatagcgctgaatcaactgcagcctgcggtgttgaggcccacagcgacgccatccagccatgccatattagagaggcaatcagacgctactctcatcggatcggccccctgagcccttttaccatctcattttccctgaccgaatgcctcccccaagaatgggacggttttagcagtttgttgatgtag

SEQ ID NO: 13391 - DNA, 954 bp, Artificial Sequence
  Description of Artificial Sequence: Synthetic coding sequence
atgaataatacggctgcaagtcccatgtcaacagcaacatcctccagtggtaggtcaaccggcaagagcataagtttcgctactgagttgcagtcgatgatgtatagcttgggcgacgctagaaggcccctgcatgaaacagctgtacttgtcgaagatgttgtccatactcagctgattaacttactccagcaagccgctgaggtatcccagctgcggggcgccagggtcattaccccggaggatctgctctttctgatgcgaaaggataaaaagaagctcaggcggttacttaagtacatgtttattcgagattacaagtcaaaaattgtgaaagggatcgatgaagacgacttgctagaggacaagttgtcagggagcaataacgctaataaacgacagaaaatagctcaagatttcctgaacagcatcgatcagactggtgagctcctggctatgttcgaggatgacgagatcgatgaagtgaaacaagaacgcatggaaagggcagagcgtcagacacgcatcatggattccgcccagtacgcggagttttgcgaatctagacagctgagcttcagcaaaaaggccagtaagtttagagattggctggattgcagttcaatggaaatcaagcccaatgttgtcgccatggaaattctggcttatctggcatatgagaccgtagcacagttagtcgatctcgcactcctggtacgccaagacatggtgactaaggccggggatccgttctcccacgctatcagtgccacttttatacagtaccataattccgcggaatctaccgcagcatgcggggttgaagctcattctgacgctattcagccatgccacatcagggaggccatacggagatacagccacagaattggccccctcagcccttttactaacgcatataggcggaatggtatggcatttctcgcatgctag

SEQ ID NO: 13392 - DNA, 987 bp, Artificial Sequence
  Description of Artificial Sequence: Synthetic coding sequence
atggtggtcttcggcaccactttcttcaactttgattcgtttatcgggaagacagactcgattgagataatcgggaaatctgtgtttccatactgttaccacaatattctccccctgctcaatgacagcggtaggtactctcttggagacgctcgcaggcctctgcatgagaccgcagttctcgtggaagacgtagtccatacccagctgatcaacctgcttcagcaggccgctgaggtgtcccagttgcggggcgcccgtgttattacccccgaagacctgctgtttcttatgcgcaaggataaaaagaagctccgccgactcctcaaatacatgtttatcagagactataagtcaaagatagtcaaaggcatcgacgaggatgatttgctggaggataagctgtcggggagcaataacgctaacaaacgccaaaagatcgcacaggattttttaaacagtattgatcagacaggtgagctgcttgccatgtttgaagacgatgagatcgatgaagtgaagcaggaacgcatggagcgagccgaacgacaaactaggattatggactccgcccaatacgccgaattttgcgagagccgtcagctatcttttagcaaaaaggcctctaaattcagggattggctggattgcagcagcatggaaatcaagccgaatgttgttgcgatggaaatcctcgcatacctcgcctatgagacagtcgcccagctggtggatctagcgctccttgtccgccaagatatggttaccaaggccggcgaccctttttctcatgccatcagcgctacttttattcagtaccacaacagcgccgagtctaccgccgcgtgcggagtggaggcccatagcgacgctattcaaccctgtcacattcgtgaagctataagaaggtacagccatagaattggtcctttgagcccattcaccaacgcatataggcgcaacggaatggccttcctggcttgctag

SEQ ID NO: 13393 - DNA, 987 bp, Artificial Sequence
  Description of Artificial Sequence: Synthetic coding sequence
atggtcgtatttggtaccacttttttcaatttcgactcattcatcggaaagaccgatagcattgaaatcattggaaagtcggtcttcccatactgctatcacaatatccttcctctcctcaacgattcaggccgatatagcctgggagacgctagacggccattgcacgaaacagcagttctcgtggaggatgtagttcatactcagctgattaatttgctgcaacaagcggcagaagtgagccaactgaggggggctagagttatcacccctgaggacctgctctttttgatgaggaaggacaaaaaaaagttgcgtcgattattaaaatacatgtttatacgtgattataaaagcaaaatcgttaagggcatcgatgaggatgacctgctcgaggacaaactttctggatcaaacaatgccaataagcggcagaagatcgcccaggactttctgaatagcattgaccagactggagaactgttggctatgtttgaggacgacgagatcgatgaggttaaacaggaaagaatggaaagagcggagcgacaaacacgcattatggacagtgctcagtacgccgaattttgcgagtccaggcaactgtccttttctaaaaaggcctctaagttcagggattggctggactgcagttccatggagattaagcccaacgtggtggcgatggaaattctggcctatctagcttacgagacggtggcacagttagtggatttggctctattggtacgacaggatatggtcaccaaggccggcgatcctttctcgcacgccatctctgctacatttatacagtaccacaacagcgccgaatctacagctgcatgcggtgtcgaagcccacagcgacgctattcaaccttgccatatccgcgaggccattagaagatattcacaccgcataggtcccctgtctccctttacaaatgcataccgacgaaacggtatggcattccttgcatgctag

SEQ ID NO: 13394 - DNA, 954 bp, Artificial Sequence
  Description of Artificial Sequence: Synthetic coding sequence
atgaacaataccgccgcatcccctatgtctaccgctacttcaagctcaggaagatcaacaggaaagtctatttcttttgccaccgagctccagtcgatgatgtacagcctgggagacgctcgaagacctttgcacgaaactgccgtgctagtggaggacgtagtgcatacccagttgattaatttgctgcagcaggctgcggaggtgtcccagctgcgcggcgcgcgcgtcattacaccagaggatctgttgtttctgatgcgcaaagacaagaaaaaactgagacgcctgctgaagtacatgtttatccgcgattataagtccaaaatcgtgaagggcatcgatgaggacgacttattagaggacaagctttcaggatcaaataacgcaaataaacggcaaaaaatagcccaagacttcctgaattctattgaccagactggggagctcctggctatgttcgaggatgacgagatcgatgaggtcaagcaggagcgaatggaacgcgccgagcggcagaccagaatcatggactccgcccagtatgctgagttctgcgaaagcagacagctatccttttctaagaaggcaagcaaatttcgggattggctcgactgcagtagtatggagatcaagcctaacgtggtcgctatggaaatactcgcctacctcgcctatgagacggttgcccaactggtggacctggctctgcttgttaggcaggacatggtcaccaaagcaggagacccgttttctcatgcaatttctgccacgttcatacagtaccacaacagcgcagaatccacggctgcctgtggggtggaagcccatagtgatgccatacagccgtgtcacattcgcgaagccatccgtcgttacagccatagaatagggcctctcagcccatttacaaatgcttataggaggaatggtatggcctttctggcttgctag

SEQ ID NO: 13395 - DNA, 624 bp, Artificial Sequence
  Description of Artificial Sequence: Synthetic coding sequence
atggcaggcccagcaacccagagtccaatgaagcttatggctctgcagttactattgtggcactccgccctctggaccgttcaggaagctactccacttggtcctgcatcttcattgccccaaagctttttgctgaaatgcctcgagcaggtccggaaaatacagggcgacggagccgccttacaggagaagctggtgtctgagtgtgccacatataagctgtgccaccctgaagagctagtgctcctaggccatagcttaggcatcccctgggcccctctatcaagttgcccttcccaagctctccagctcgctgggtgtctgtcccaactccatagtggtctgttcctttatcaagggctgctccaagcgctcgaggggatttcccctgaattggggcctaccttggacactctgcagcttgatgtcgcagacttcgccacgactatctggcagcagatggaggaactgggcatggctccagccctgcagccgacacagggagccatgcccgcctttgccagcgccttccaaagaagagcgggcggagtgctggtggcaagccacctccagagctttctggaggtatcttatcgcgtcctgcgccatctggcacagccatag

SEQ ID NO: 13396 - DNA, 2220 bp, Artificial Sequence
  Description of Artificial Sequence: Synthetic coding sequence
atggcccctcagaaacatggcggcggtggtggaggaggcagcggcccatcagcgggctcaggcggtggcggttttggtgggagcgctgcagtcgccgcggccacagcttctggtgggaaatccggcggcggcagctgcgggggagggggctcctattctgcgtcaagtagttctagcgccgccgcagcggccggtgccgcggtgttgcccgtgaaaaaaccaaaaatggaacatgttcaagccgatcacgagttatttcttcaagcattcgagaagcccacacaaatctacaggtttctgaggacacgcaatctgatagctcccatcttcctccaccggacactcacctacatgtcgcaccgcaattcgaggacaaacattaaacggaaaacattcaaggtcgatgacatgctctcaaaagtagagaaaatgaagggagagcaggagagccattcactctcagcccacttacagcttactttcacgggttttttccacaagaacgacaaacccagcccgaattccgaaaacgagcaaaattctgttaccctggaggtgctgcttgttaaggtgtgccacaagaagcgtaaggacgtcagttgtccaattcgccaagtcccaacgggcaagaagcaagtgcctctcaatcctgaccttaatcaaacaaaacctggcaacttccccagtctcgctgtgagtagcaacgaattcgagccttccaactctcatatggtcaaatcatactctctcttgttccgagtgacacggcctggaaggcgagagttcaacggaatgataaacggagagacaaacgaaaatatcgatgtgaacgaggagctgcctgctagaagaaagcgaaaccgggaagatggtgaaaaaactttcgtggcacagatgaccgttttcgacaagaatagaaggctacagctgctggacggagagtatgaagtcgcgatgcaagaaatggaagagtgtcccattagtaagaaacgggccacctgggagacgattctcgacggaaaaagattaccaccatttgaaactttttcccagggccccacgctgcaatttactctccggtggactggcgagaccaacgataaaagcacggctcccattgcaaagccactagcgactagaaacagcgaaagtctacaccaggaaaacaagcccggttctgtgaaacccacacagaccatcgctgttaaagaatctctgactactgacctgcagacacggaaagaaaaggacacaccaaatgaaaaccggcagaaacttagaatcttctaccaattcctctataacaataatactaggcaacagacagaggcaagggacgacctgcattgcccctggtgcaccttgaactgtcgcaagttgtacagtctattgaagcatttgaagctatgccacagccgcttcatatttaattatgtgtaccaccctaaaggtgcccgcatcgacgtgagtatcaacgaatgctatgacggtagctatgcaggcaacccccaggacatccacagacagccgggatttgccttttcccggaacggacccgtgaaacgaactcccataactcacatcttggtctgcagacctaagaggactaaagcctctatgagcgaatttctggaatcggaagacggggaagtggagcagcagcgtacctatagtagcggccacaataggttgtacttccactcagacacctgtctacctttgaggccgcaagaaatggaagttgattcagaagatgagaaggacccagagtggctccgcgaaaagaccatcacccagatcgaagaattttccgacgtgaatgagggtgagaaggaggtcatgaagttgtggaacctccatgtgatgaaacacggcttcatagccgacaatcaaatgaaccacgcttgtatgctcttcgtggaaaactacggacagaaaatcataaaaaaaaatttatgccggaactttatgttacatctcgtgtccatgcatgatttcaatctaatttccatcatgtcaatcgacaaagcagtgacaaaactccgagaaatgcagcaaaagcttgagaagggagaatcagctagtcctgccaatgaagagattacagaggagcagaatgggacagccaacggcttcagtgagattaacagcaaggagaaagctctagaaacagacagcgtgagcggagtaagcaaacaatctaaaaaacagaaactgtag

SEQ ID NO: 13397 - DNA, 1938 bp, Artificial Sequence
  Description of Artificial Sequence: Synthetic coding sequence
atgagtttgaaaatggacaacagagacgtggctgggaaggccaatcgatggttcggcgtggcgccccccaaatcaggcaaaatgaatatgaatatcctgcatcaagaagagctcatagcacaaaagaagcgcgagatagaagcaaaaatggaacagaaagcgaaacagaaccaggtggcttctcctcaaccgccccacccaggcgagataaccaacgcacataacagttcttgcatcagcaataagttcgccaacgacggttccttcctgcaacagttcttaaagctgcagaaggcccagactagtaccgatgccccaacatcggccccaagtgcaccgccatctacccctacgccctccgcaggcaagaggtccctactgatttcaaggcgcacggggcttggcctggcttctctccccgggccagttaagagttattcacacgctaagcagcttcccgtcgctcatcgccccagtgtttttcagtctcctgacgaggacgaggaggaggattacgaacagtggctggagataaaggtcagtccacccgaaggcgctgaaacccgaaaagttatagaaaaattggcacgatttgtggctgaagggggaccagaactcgaaaaagtcgcaatggaggactataaagacaatccagctttcgcgttcctgcatgataagaatagccgagaattcctgtactaccggaagaaagtggccgaaatccgtaaagaggctcagaaaagccaggccgcgagccagaaggtgtcccctccagaagatgaagaggtgaagaacctggcagagaaattggctcgattcattgcagacggaggccccgaagtggagactatcgcacttcagaataatagagagaaccaggccttctcctttctatatgaacctaactcccagggttacaagtattaccggcagaaactcgaagaatttagaaaggccaaagctagttcgactggcagctttactgccccagatccgggactaaagaggaaatcgcctcccgaggcgttatccggcagcttacccccggccaccacctgccccgcgtccagcaccccggctccaacaatcatccccgctccagcagcccctggtaaacctgctagcgctgctacagttaaacgaaagaggaagtccaggtggggtcccgaggaggacaaggtggagttaccacccgctgaactggtgcagcgggatgtggatgccagcccatccccgctgagcgtgcaagatctgaagggtttggggtatgaaaaggggaagcctgtggggctggtgggggtgactgagctcagtgatgcccagaaaaagcagctcaaggagcaacaagagatgcaacagatgtacgatatgatcatgcagcataagcgcgcaatgcaagatatgcagttactgtgggaaaaagccgtgcagcagcaccagcatggctatgacagcgacgaggaggtggatagcgaactggggacctgggaacatcaattgcgacgcatggagatggacaaaaccagggaatgggcagagcagctcacaaagatgggaaggggaaaacacttcataggagattttttgccccccgacgagctcgagaagttcatggaaacatttaaagcccttaaggagggtagggagcctgattattcagaatataaggagttcaagctcacggtcgagaacatcgggtaccagatgctcatgaagatgggctggaaagagggagagggcctagggtcagaaggacaggggattaagaatccagtaaacaaggggaccaccacagtggacggagctggattcgggatcgaccgacctgcggagttatcgaaggaggatgatgaatacgaggcgtttcgcaaacgaatgatgcttgcctacaggttccgccctaatcctctcaataacccccgcaggccttattactag

SEQ ID NO: 13398 - DNA, 669 bp, Artificial Sequence
  Description of Artificial Sequence: Synthetic coding sequence
atgtcactgaagatggataaccgagacgttgcagggaaggcaaaccgctggtttggtgtcgctccaccaaagtccggaaaaatgaacatgaacatcctgcatcaggaagaacttatagcacagaaaaaaagagaaattgaagccaaaatggaacaaaaggccaaacagaaccaggtcgcttcccctcagcccccccaccctggtgagattactaacgcccacaatagctcctgtatctcaaataagtttgcaaatgacggttcatttctgcagcaattcctcaaactccagaaggcccagacctctacagatgcccctacaagcgccccttcagcccccccctctactcctaccccatctgctggtaaacggtctcttctgatctcgcggcgcactgggctcgggctggccagcctgcctggccctgtcaaaagctacagtcatgccaagcagcttccagtagctcaccgccctagcgtatttcaatcacccgacgaggacgaggaggaagattatgaacagtggcttgaaattaaggtctgcctgacaaagacagtcagaccgacccccccctcatcttggtgcttcgttcctggactggggactcctgatagtctgctgcacttaacacttttcagcccccacccactctgcagatgtggaccttag

SEQ ID NO: 13399 - DNA, 558 bp, Artificial Sequence
  Description of Artificial Sequence: Synthetic coding sequence
atgtcactcaaaatggacaatcgcgacgttgctggcaaggccaacaggtggtttggcgtagcacctccaaaatccggaaagatgaacatgaatatccttcaccaggaggagctgatagcccagaagaagcgggagattgaagccaaaatggaacaaaaagcgaagcagaatcaggttgcttccccccagccaccccatcccggagagatcactaacgcacacaattccagctgtatttccaataagttcgccaacgacgggtctttcctccagcagtttttgaagctgcagaaagctcaaacctccactgacgctcctacatcggccccttcagccccgccttccaccccgacaccttctgctggaaagcgttccctgctgatttcccgacgtaccggcttggggctggcaagtctccctggacccgtcaaaagctacagccatgccaagcagcttccagtggcgcacagaccctcagtgtttcagtcccctgacgaggatgaggaagaggattacgagcagtggctggaaatcaagggacgccggtggctgcgatag

SEQ ID NO: 13400 - DNA, 3093 bp, Artificial Sequence
  Description of Artificial Sequence: Synthetic coding sequence
atggcagctaggaggatcacacaagagaccttcgacgcagtgcttcaagagaaagctaagcgttaccacatggacgcctccggggaagccgtgtccgagaccctacagttcaaggcccaggatcttctccgcgcggtgccacgctctcgggcagagatgtatgatgacgtgcactccgacggtagatacagcttgtctggatccgttgcacactcccgtgacgccggccgggagggtctgcgctcagatgtgttcccaggacctagttttcgctccagtaatcccagcattagtgatgatagttacttccgaaaagagtgcggcagggatctggagttcagtcatagcgactcccgggaccaggtgattggccaccgaaaattaggtcacttccggagtcaggactggaagttcgcgctgaggggctcctgggaacaggacttcggtcaccccgtatctcaagagtcttcttggtcccaagaatacagttttgggccaagcgcagtgctgggcgatttcgggagctctcgactgatcgagaaagagtgccttgagaaggaatcccgggattatgacgtggatcatcccggcgaagcagacagcgtgctgcggggcggctcccaggtgcaggccagggggcgagccctgaacattgtggatcaagaaggttcgctgctggggaagggcgagactcaaggcctgttgaccgcaaaaggtggcgtaggcaaactcgtgaccctgagaaacgttagcaccaagaagatccctacggtcaacagaattacacccaaaacgcaggggacgaatcagattcagaaaaacacaccttcgcctgacgtcaccctgggtactaacccaggcacagaggacatccagttcccaatacaaaaaataccgcttggacttgatcttaagaatcttaggctgccgcgacggaaaatgagctttgatattatcgacaagtccgacgtgttttcccggtttggaatcgagatcatcaaatgggccggtttccacactataaaagatgatattaaattttcacagctgttccagacactcttcgaactggagaccgagacctgcgcaaaaatgctggcaagtttcaaatgctctctcaaaccagagcatcgagacttctgtttcttcacgataaagtttctgaaacactccgcccttaagacacccagggtggacaacgagtttctgaacatgttgttagacaaaggagccgtgaaaactaaaaactgcttcttcgaaataattaaaccattcgacaaatatattatgaggctgcaggataggctgctcaagagtgtgaccccactcctgatggcctgcaatgcttatgaactttccgtaaagatgaaaactctttccaaccccctagacctggcattggccttggaaacaaccaattccttatgcaggaagagtttagccttattgggacagacattcagtctagcaagcagtttccggcaggaaaagatcctcgaagctgtcggtttacaggatatcgccccaagcccagctgctttcccaaactttgaggatagcactttgtttggcagggagtatattgaccacctcaaggcatggctggtgagcagtgggtgcccccttcaggtgaaaaaggccgagcccgagccaatgagggaggaagaaaaaatgatccctccaaccaaaccagaaatacaggccaaggcaccctcctccctgtcagacgcggtgccccagcgagctgaccacagggtggttggcactattgaccagttggtgaagcgcgtgattgagggatccctttctcctaaggaacgtactctgttaaaagaggatcctgcctattggtttctaagtgatgagaactcccttgagtacaaatattataagctgaaactggctgagatgcagcgaatgtccgagaacctgcggggggccgatcagaagccaacaagcgccgactgcgctgttagggcgatgctgtactctcgggcagtgaggaacctcaagaaaaaactgttgccttggcaacggagagggctcctgcgcgcgcagggacttaggggttggaaagcccgccgcgctactacaggcactcaaactctgctgagctcggggaccagacttaaacaccatggccgccaagcccccggtctgtcccaggccaaaccttcactccccgaccgcaatgatgctgccaaagactgtccaccagatcccgttggacctagcccacaggacccctccctagaggcgtctggccccagcccgaagcccgcaggcgtggacattagcgaagccccgcagacctcttcaccttgcccatccgcagacatcgatatgaagaccatggaaacagccgagaagctggcacggtttgtggcacaggttggacctgagatcgagcagttctcaattgaaaactcaacagacaatccagatctgtggtttctgcacgatcaaaacagtagtgcttttaagttctacaggaagaaggtgtttgagctttgtccctccatctgcttcacatccagcccccataatttacatactggcggaggtgataccactgggtcccaggaatcacccgttgatctgatggagggcgaggcagagttcgaggacgagccgccccctcgcgaagcggagctggaatccccagaggcgtcgtcaggcacttgcttcccacgtaaacggatttcatcaaagtccctgaaagtgggaatgattcccgctccgaaacgagtctgcctgatacaggagcctaaagttcacgaacctgtaaggattgcctacgatcgaccccgggggcgccccatgagcaaaaagaagaaaccgaaggacctggacttcgcccagcagaagctaacagacaagaacctgggatttcagatgctacagaaaatgggttggaaggaaggacatggcctgggcagcctgggaaaaggtatccgagaacctgtgtccgttggaacaccatctgaaggggaggggttgggggccgacgggcaggagcacaaggaggacacttttgacgtattcagacagcgcatgatgcaaatgtatcgacacaagcgtgctaataagtag

SEQ ID NO: 13401 - DNA, 3249 bp, Artificial Sequence
  Description of Artificial Sequence: Synthetic coding sequence
atggctgctcggcgcattactcaggaaactttcgatgccgtgctgcaagaaaaggccaaaaggtaccacatggacgcaagcggggaggctgtttccgagaccttgcagttcaaagcacaagatctgctgcgggctgtgccccgtagtcgggcagaaatgtatgacgacgtgcactcagacggaaggtactccctgtcaggcagcgttgcacatagccgggatgctggccgcgagggattgagatctgacgtgtttcctgggccctcctttcgcagtagcaatccaagtatctcagacgatagttacttccgaaaggagtgcgggagagacctcgagttcagtcactccgacagccgggaccaggtcattggccataggaaactgggccactttagatctcaggactggaagttcgccctacgtggcagctgggaacaagattttggacaccctgtatcacaagagagctcctggagccaggagtacagtttcgggcctagcgccgtgttaggagatttcgggtccagcaggctcattgaaaaagaatgcctcgagaaggagtcccgcgactatgacgtcgaccacccaggtgaggctgatagcgtgctgaggggcggatctcaggtgcaggctcgcggccgggccctgaatatagtagatcaggaaggctcactcctcggaaagggagagactcaaggcctgctgaccgccaagggcggagttggcaagctggtgaccctccgcaatgtttctaccaaaaaaatccctacggtgaaccgtatcactcctaaaacgcaggggaccaaccagatacagaaaaataccccctcacctgatgtgacattgggcaccaaccccgggacagaggatattcagtttccgatccagaaaattcctttaggcctcgacctgaaaaacctcagactgccgagaaggaaaatgtcgttcgatattatcgacaagagcgatgtattctcgcgttttggcattgagatcataaaatgggctggctttcacaccattaaagacgatatcaaattttcacaattattccagaccttgttcgaacttgagactgaaacttgcgctaaaatgcttgcttccttcaagtgctccctcaagcctgaacatcgggacttctgtttttttaccattaagtttttgaaacacagcgcactaaagacacctagggtggacaatgaattcctgaacatgctgctggacaagggggctgtgaaaaccaagaactgctttttcgaaatcattaaaccttttgataaatacataatgcgccttcaggacagactgcttaaatcagtgacgccactgcttatggcttgcaatgcctacgaattaagcgtgaaaatgaagactctgagcaatcctcttgatcttgctctggcactagagactacaaatagcctgtgtcgcaaatctctggctctcctaggccagaccttttccctcgcctcaagttttcgacaagagaaaattctcgaggccgtaggtttgcaagacattgctccttcacccgccgcttttcctaatttcgaggattcaacccttttcggtcgagaatatatcgaccacctgaaggcgtggctggtctccagcgggtgccccctccaggtgaagaaagcagagcccgagcctatgcgggaagaggagaaaatgatcccgcccactaagcctgaaattcaggctaaagcaccatcatccttgtccgatgctgttccacagagggctgatcatcgcgtggtcggtactatagaccagctggttaagagggtgattgagggaagcctcagtcctaaagaacggacattactgaaggaagaccctgcgtactggttcctatcagacgagaactccctcgagtacaagtactacaagctaaaactggctgagatgcaacgtatgtccgagaacctgcgaggggctgatcagaaacctaccagcgcagattgtgcggttcgtgctatgctatactccagagcggttcgtaacctcaagaaaaaattattgccctggcagcgtaggggcctgctcagggctcagggtctacgcggatggaaggccagaagagctaccacaggtacccagaccttgttgtcatccggcacacgactgaagcaccatggtcgacaggctcctggtcttagccaagccaaaccttctctgccagatcgaaacgacgcagcgaaggattgtccacctgatccggtcggcccttccccacaggatccatctctggaggctagtggaccgtctcctaaacccgctggtgtagacatcagcgaagccccacagacgtcctctccatgcccttctgccgatatcgacatgaaaaccatggaaaccgctgagaagttagccagattcgtcgctcaggtaggccctgaaatcgaacaatttagcattgagaactctactgacaatcctgacctttggtttctccacgaccagaatagcagcgcgttcaaattttaccgcaaaaaggtgttcgaactgtgcccaagtatatgctttacatcctctccacacaacctgcatactggaggaggcgacacaacgggaagccaggagtcgcctgtagacttgatggaaggggaggcggaatttgaggacgagcctcctccgagggaggcagagcttgaaagtcctgaggtgatgccagaggaggaagacgaggatgacgaagatggcggcgaagaagcacccgcccccggcggtgccgggaagtctgagggctccactcccgccgatggactgccgggcgaagcagctgaggatgacttagcaggagcccctgctctgtcacaagccagttccggcacctgtttcccgcgcaagcggatttcgtctaagtctctgaaagttggaatgatccctgccccaaagcgtgtgtgcctgattcaggagccgaaagtgcacgagcccgtgcgaattgcttatgataggccccggggcaggcccatgtcaaaaaagaaaaaacccaaggacctggactttgcacaacagaagctgaccgacaagaacttaggctttcagatgctgcagaagatgggttggaaggaagggcatggactggggtctctcggcaagggtatcagggaaccagtgtctgtcggcaccccctcagaaggagagggcctgggcgccgatggtcaagagcacaaagaagacaccttcgacgttttccgccaacgcatgatgcagatgtaccgccacaagcgagccaataaatag

SEQ ID NO: 13402 - DNA, 3249 bp, Artificial Sequence
  Description of Artificial Sequence: Synthetic coding sequence
atggcagctagaaggattacccaagagacatttgatgccgtgctgcaggaaaaagctaaacgttatcacatggatgcatcaggcgaagcagttagcgagacactacagtttaaggcccaggacctactgcgagctgtgcctcgatccagggcagagatgtacgacgacgtccacagcgacggcagatactcactgtcagggtcagtggctcactctcgagacgcaggccgagaaggcctgagatccgatgtttttcccggtcccagcttcagaagttctaacccctctatttcggatgactcttactttcgcaaggaatgcggtcgcgatttggagttttcccattcggattctagggatcaggttattgggcaccggaagctgggtcacttccgctcccaagattggaagtttgcacttaggggatcatgggaacaggactttgggcaccccgtttctcaggaatcttcctggagtcaggagtatagctttggaccctcagccgtgcttggagactttggctcatcgaggctgatcgagaaagaatgcctcgagaaagagtccagggactatgacgtggatcatccaggtgaggctgatagcgtacttcgggggggttctcaggtacaagctcgcgggagggctcttaacatagtggaccaggagggcagcttattgggcaagggagagacccagggattgctaacagcaaagggaggtgtaggaaaactggtgacactacggaacgtgagcaccaaaaagattcccaccgtgaatcggataactcctaaaacccaggggaccaaccaaatccagaaaaacacaccctctccagatgtcaccctcggcaccaacccaggaaccgaagatattcaatttcctattcagaagatcccgctgggcctcgacctgaaaaacctacgtttgccaagaagaaagatgtcatttgacattatcgacaagtccgatgtattcagcaggttcggtattgagataatcaaatgggcgggattccacacaattaaggacgatatcaagttctcacagctattccagactctgtttgagttggagacagagacgtgcgccaaaatgttggctagtttcaaatgttccctcaaaccggaacaccgcgatttttgtttcttcactattaaatttctcaaacattcggcactgaagacacccagagtcgacaatgagtttttgaacatgctgcttgacaaaggggccgtcaagaccaagaattgcttttttgagattatcaaaccattcgacaaatatatcatgcgactgcaggacaggctcctcaaatctgtgacaccgttgctcatggcttgcaatgcctacgagctctctgttaagatgaaaaccttatcaaaccctctagacctggccctggcactggagacgacgaactccctatgtcgtaagtccctggccctattaggccagacgttcagccttgcctcatcctttcgccaggagaagatcctggaggctgtcggacttcaagacatcgctccttctcctgctgcttttccaaatttcgaggattccaccctctttggtagggagtacatcgaccacttgaaagcttggctggtttcctcgggctgtccactgcaagtcaaaaaagccgagcccgaaccgatgagagaagaagaaaaaatgatcccccccactaagccggagatccaagccaaagccccgtcttccctatcggatgccgtgccgcagcgtgctgaccatagggtcgtcggaactattgatcaattagtgaagagggtcatagaaggaagcctttcaccaaaggaacgcactcttctcaaagaggatcccgcctattggtttctgtctgacgagaactcgcttgagtataagtattacaagctgaagctcgcagagatgcagcgcatgtcggagaacctgcgcggtgccgaccagaagcctacatcagcagattgcgctgtccgggccatgctatacagcagagctgtgagaaatcttaagaaaaagctgctcccatggcagcgcagagggctgcttcgagcccaaggccttcgcgggtggaaagcccgccgtgccactactggtactcaaacactgttgtccagtggcacacgactgaagcaccatggtaggcaggccccaggtctctcacaggccaagccttcactgcccgacagaaacgatgctgctaaagactgtcctcctgacccagtcggacctagcccccaagatccaagtctcgaagcctcgggtcccagccctaaacctgcaggtgtcgatatctccgaggcaccccagaccagcagcccctgtccatcagctgatattgacatgaaaaccatggaaactgcggaaaaactggcccggtttgtcgcacaggttggccccgagatcgagcagttcagcatcgaaaacagtacagacaatcccgacctatggtttctgcatgatcaaaactcttccgcctttaaattttaccgcaaaaaggtcttcgagttatgcccaagcatctgcttcactagctcacctcacaacctgcataccgggggcggagatactaccggcagccaagagtccccggtcgatcttatggagggagaggcggaatttgaggacgagccacccccgagagaggcagagttggaaagtccagaagtgatgcccgaggaagaagatgaagatgatgaggacggcggagaagaggccccagcaccagggggcgcgggcaaaagcgaaggctcgactcctgcagatggtttgcctggcgaggcagccgaagatgacttggccggtgctcctgccctcagtcaggccagtagcggaacctgcttcccaaggaagaggatctctagcaaaagccttaaagtcggtatgatccctgctcccaaacgggtttgcctgatccaggaaccgaaggtccatgaacccgtcaggatcgcctatgaccgacctcgggggaggcctatgagcaagaaaaaaaaacctaaggacctggactttgcccagcagaagctaactgacaaaaatttagggtttcagatgttacagaaaatgggctggaaagaaggacacggtctggggtctctcgggaagggaatccgtgagccggtgtcagtcgggacaccctccgaaggagaggggcttggtgccgatgggcaagagcataaggaggatactttcgatgtcttccggcagcgcatgatgcagatgtaccgacataaaagggctaataaatag

SEQ ID NO: 13403 - DNA, 2586 bp, Artificial Sequence
  Description of Artificial Sequence: Synthetic coding sequence
atgacagcgaccttcgccaaaaatgtggctggaatctggaattttctgactctgatcttaggaactcggagtttagcaaccggaaattgggggatttcagttctcaggaccggtaatctgcgttccgtggtactgggaaataaaaccctggcaatacagtttctgaagagtcctcttggccaccggtccattgtgctaatccccttgggccttgacctgaagaacctgcgcctgcccaggcggaaaatgtcctttgatataatcgataagagcgatgttttctcccgctttgggatcgaaataatcaaatgggccggttttcacacaataaaggacgacataaaattcagtcaactatttcaaactctgttcgagctggaaaccgaaacatgcgctaaaatgctcgccagttttaaatgctcactaaaacctgagcacagagacttttgcttctttacgataaagtttctgaaacattcagccctgaagacaccaagggtggacaatgagtttctgaatatgctcctcgacaagggagcagtgaaaaccaagaactgtttttttgaaatcattaaacctttcgataaatacatcatgcgcctccaagacagattgttgaagtccgttacacccctgctgatggcctgcaatgcctacgagctgagcgtgaaaatgaaaactctgagcaaccccctggatctggctctggctctcgagaccacaaattccctctgtcggaaatctctggcgttgctggggcagacattctcgcttgcttcatccttcaggcaggaaaagatcctcgaggctgtgggtttgcaggatattgcacccagtccagcagccttcccgaattttgaagactctacgctttttgggcgcgagtatatcgaccatcttaaagcttggcttgtgtcatccgggtgtcccctacaggtaaaaaaggcagagcccgaaccaatgcgcgaagaggagaaaatgattccacccacaaaaccggaaattcaagcaaaggctccctcatccctgtcagacgctgtgccgcaacgagctgatcatcgcgtagtgggaaccatcgatcagcttgttaaacgcgttattgagggaagcctttcaccgaaggaacgaaccctgctgaaagaagatcccgcctactggttcctcagcgatgagaattcccttgaatacaaatactacaagcttaaattggccgaaatgcagagaatgagcgaaaatctgcgcggagctgaccagaagcccacgtcagccgattgtgctgtgagagctatgctgtacagcagagccgttagaaacctgaaaaagaaactgctcccctggcagagacggggcctcctccgtgcccagggcctgcggggatggaaagcacgccgggccacaaccggaacacaaaccctgctgagctccggtacccggctgaaacaccatggtaggcaggccccgggcctgagccaagcgaagccatctctgcctgaccgcaacgatgcggccaaagattgtccgccggaccccgtcgggccaagtccacaggatccttcattagaggccagtgggccatcgcccaaaccagcaggcgtggacattagcgaggcaccacagacttcgagtccatgcccgtccgccgacatcgacatgaagacaatggaaaccgcagaaaaactcgctcgctttgtcgctcaggtgggccctgagattgagcagttcagcatcgaaaactctaccgataaccccgacctgtggttcctgcacgaccagaactcctctgccttcaaattctatcgaaaaaaggtttttgagctttgcccatctatttgtttcacatctagcccccacaatctgcataccggcggaggtgacacaactgggtcgcaagagtcacccgtggatctgatggagggtgaagccgaatttgaggatgagccccctcctcgcgaggcagaattggaatctcctgaagtgatgcctgaggaggaggacgaagacgacgaagacggtggtgaagaagccccagcacccggcggggcagggaaatccgagggttctacgccagccgacggccttcctggagaggcagctgaggacgatctggcaggcgccccggctctttcacaggcaagtagcggaacgtgcttccccagaaaaaggattagtagtaagtcactcaaggtaggaatgatacccgctcctaagcgggtctgccttattcaagaacctaaggtccatgagccggtgagaattgcgtacgacaggcctcgtggccgaccgatgtctaagaaaaagaaaccaaaggatctcgattttgcccagcagaagctcactgataagaatctaggcttccagatgctgcaaaaaatggggtggaaagaaggacatgggctggggagcctgggcaagggcatccgcgagccagtctccgtctacgccgccggctcactgggctgggagtgggtcggacctcaatcattccacctgcagcctgccgcgtggctcctccactcccaggacggactgcagctagctgttgatttctgtttcctgaatcgtagacacttacagatgaggagctag

SEQ ID NO: 13404 - DNA, 534 bp, Artificial Sequence
  Description of Artificial Sequence: Synthetic coding sequence
tgaatgaagcacactgcaacagcacggttccagaggaaccatcgactaatatctgaaatcctttccgaaagtgtggtgcccgacgtgcggtctgtggttacaacagcgcggatgcaggttctgaaaagacaagtccaaagcttgatggttcaccagagaaagctggaagccgagttgctgcaaatcgaggagcgacatcaggagaagaagagaaagtttttagaatcaaccgactcctttaacaatgagttgaagcggctttgtggactgaaggtcgaggtggacatggaaaaaattgccgccgaaattgcacaagccgaggaacaggcccgcaaacgccaggaagagcgcgaaaaagaagctgccgagcaagctgagagatcacaaagctcgatagtgcccgaagaggagcaggccgctaacaagggcgaggaaaaaaaggacgacgagaatattcctatggagacagagaaaaattgccagctctgcccaaggaaaacgctcacctctagatataccgactttcccgactag

SEQ ID NO: 13405 - DNA, 1236 bp, Artificial Sequence
  Description of Artificial Sequence: Synthetic coding sequence
atgtcaaagcgcccttcttatgccccacctcccacccccgctcctgccactcagatgccgtctacaccgggattcgtcggatataatccgtacagccacctagcatataataattatcggcttggcggcaaccctgggacgaactctcgggtaaccgcatcttcgggtattaccatcccgaagccccccaagccccccgataagccactgatgccttacatgaggtatagtaggaaagtatgggatcaggttaaggccagcaacccagatttgaagctgtgggaaatcggaaaaatcatcggtggaatgtggagagacctcaccgacgaggaaaagcaggaatacctgaatgagtacgaggcagagaaaatcgagtacaacgagtccatgaaagcctaccacaattcaccagcctatctagcctacatcaacgccaagtccagagcagaagctgcccttgaagaggaatccagacaacggcagtctcgcatggagaagggggagccctatatgtctatccagcctgcggaagaccctgacgattatgacgacggcttcagcatgaaacatactgccactgcaaggttccagcgcaaccatcgcttaatctccgagattctgagtgaatccgtcgtgcctgatgtcaggtccgtggtgactacagcacgcatgcaagtactcaagcgacaagtgcaatcgctcatggttcaccagagaaagctagaggccgagttgcttcagattgaggaacggcaccaggagaagaagcgtaaatttctggaaagcaccgattcatttaataacgagttaaaacgactttgcgggcttaaggtggaggtggatatggaaaagattgcggccgagatcgcccaggctgaggagcaggcacggaagaggcaagaagagagggagaaagaggccgcagaacaagccgaacgttcccagagctctatcgtccccgaggaggagcaggctgcaaataagggcgaggagaagaaagatgacgaaaacatacccatggagacggaagaaacacatttggaagaaaccaccgagtctcaacagaacggagaggaaggcacttctaccccagaggacaaagagtccggtcaggagggcgttgattcgatggccgaagaggggacttctgatagcaacaccggctccgagtcaaatagtgccacagtagaggagcctcctaccgatccaattcctgaggatgagaagaaggagtag

SEQ ID NO: 13406 - DNA, 987 bp, Artificial Sequence
  Description of Artificial Sequence: Synthetic coding sequence
atgtcgaaacgcccaagctacgctccaccccctacccccgctcctgctacagcttctagcggcataactatccccaagccacccaaaccacctgataagcccctgatgccatacatgaggtacagtcgcaaggtttgggaccaagtgaaggctagcaaccctgatttgaaactgtgggaaattggtaagatcatcggaggtatgtggcgagacctgacagatgaggagaaacaagagtacctcaacgagtacgaggctgaaaagatagagtataacgagagcatgaaggcataccacaattcccctgcctacctcgcttacattaatgccaagtctagagccgaggcagcactcgaggaagagagtcgtcaacgtcagtcccgcatggaaaaaggagaaccttatatgtccattcagcctgccgaggatcctgatgattacgatgatggattttctatgaagcacactgctaccgctcgatttcagagaaaccatcgcctgatttcggagattcttagtgagagcgttgtgccagatgtcagatcagtggtgactaccgcacggatgcaggtccttaaacgccaggtgcagtctctaatggtgcatcaacggaagctggaagctgaactccttcaaatagaagaacgccatcaggagaaaaagagaaagtttctggaaagtaccgactcatttaataacgagctgaagagactgtgcggtctcaaagtcgaagttgacatggaaaagatcgctgcagagatcgcccaggccgaggagcaagcccggaagcggcaggaggagcgcgaaaaagaagccgccgagcaagccgagagatcccagtctagcattgtgcccgaagaggaacaggccgcaaacaagggggaggagaagaaggacgatgagaacattcctatggaaactgaaaaaaattgtcagctgtgccctcgtaagaccctcacctccagatatacggacttcccagactag

SEQ ID NO: 13407 - DNA, 570 bp, Artificial Sequence
  Description of Artificial Sequence: Synthetic coding sequence
tgagccgaggaccctgatgactatgatgacggcttcagcatgaagcacaccgctacagcgcgattccagcgcaatcatcgccttatcagcgagatcctttccgagtcggtcgttcccgatgtcaggagtgtagtaactacagcccggatgcaagtgctgaagaggcaggtacagtccctgatggtacaccagcggaagttagaggctgagctccttcagatcgaggagcgccaccaggagaagaagaggaaatttctggaaagcacagactcttttaacaatgagttaaagcggctatgcggactgaaggtggaggttgacatggagaagatagcagccgagattgcccaggccgaagagcaagccaggaagagacaggaggagcgcgagaaggaggctgcagagcaggcagagaggagccagtccagtatagtgccagaggaggaacaggccgccaataaaggagaggaaaagaaggatgatgagaatattccaatggagacggagaagaactgccagctctgcccaaggaagacactgacatccaggtacactgatttcccagactag

SEQ ID NO: 13408 - DNA, 1182 bp, Artificial Sequence
  Description of Artificial Sequence: Synthetic coding sequence
atgcccagcacccctggctttgtcggctacaatccatactcccatttggcttacaacaactacaggctgggaggcaaccccgggacgaatagcagggtgaccgcaagtagtggaatcaccatccccaagccccccaagccacctgacaagccgctgatgccatatatgaggtactctcgtaaagtatgggaccaagtcaaggcatcaaatcctgacctcaagctgtgggaaatcggaaagatcatcggaggcatgtggcgcgatcttaccgatgaagaaaagcaggaatacctcaatgaatacgaggcggaaaaaatcgagtataatgagtccatgaaggcgtaccacaactctccagcatatctcgcctatattaatgccaaatcacgggctgaggctgctctggaggaggagagccggcaaagacagagtaggatggagaagggcgagccatatatgtctattcaacctgccgaagacccagatgactacgacgacggctttagtatgaaacataccgccacggcgaggttccagcggaaccatcggcttatttccgagattttatcagagagcgtggttcccgatgtcaggtctgtggtgacaacagcaaggatgcaggtcttgaaacgccaagtgcagagcctgatggtgcatcagaggaagttggaggccgagttacttcagattgaggagagacaccaagagaagaaacgtaagttcctggagtcaactgattcctttaataatgaactgaagaggctgtgcgggctgaaggtggaggtggacatggaaaagatagccgcagagatagctcaggcagaagaacaagcacggaaacggcaagaagaacgcgaaaaggaagctgcagagcaggcagagcgttctcagtcgtcaatcgtgcctgaagaggagcaagccgccaacaaaggcgaggagaagaaggacgatgagaatatccctatggaaacagaagagacgcatctggaagaaaccactgagagccaacagaatggcgaagaaggaactagtacccctgaagacaaagagagcgggcaagagggtgtggactctatggcggaggaaggcacttcggattccaacaccggctcggagagtaactcagcaacagttgaggagccaccaacagaccccataccggaggacgaaaagaaggaatag

SEQ ID NO: 13409 - DNA, 474 bp, Artificial Sequence
  Description of Artificial Sequence: Synthetic coding sequence
ctctcagagtcagtcgtgcccgacgtcaggtccgtggtaactaccgccagaatgcaagttctcaagcggcaggtgcagtctctgatggtccatcagagaaagctcgaggcagagctcctccagatcgaggagaggcatcaggaaaaaaaacgaaaatttctggagagtacagactcattcaataacgaactcaagcgcctatgtggactgaaagtggaggtggacatggaaaagatagccgccgaaatcgcgcaggcggaagagcaggccaggaaaaggcaggaagaacgcgaaaaggaggcagccgagcaggcggagcgatcccagtcatccatcgtaccggaagaggagcaggctgcgaataaaggcgaagaaaaaaaggacgatgagaacattcctatggagactgaaaagaactgtcagctgtgtcctcgcaagacgctgacttcacgttacacggacttcccggattag

SEQ ID NO: 13410 - DNA, 1026 bp, Artificial Sequence
  Description of Artificial Sequence: Synthetic coding sequence
atgccctatatgagatattctagaaaagtttgggaccaagtgaaagccagtaacccagatcttaaactgtgggaaattggcaagattataggtggcatgtggcgtgacttgaccgacgaggaaaagcaggaatatttgaatgaatatgaggcggaaaagattgagtacaacgaatcgatgaaagcctatcacaacagccccgcatatctcgcttacatcaatgccaagtcaagggccgaggccgccctggaagaagagagccggcagaggcaatcacgtatggagaagggcgagccatacatgtcaatacaacccgccgaagatccagatgattacgacgatggcttctccatgaagcacaccgcaacggcaaggttccagcgcaaccatagactgatttccgaaatactcagcgagtctgtggtgccagacgtgcggagcgttgttacaacagcaaggatgcaggtcttgaaacggcaggtgcagagtctaatggtccaccaacgcaaactggaggcggagctattgcagatcgaagaacggcaccaggaaaaaaaacgcaagttcctggagtcaaccgacagctttaataatgagcttaagaggttgtgtggactcaaggtggaagttgacatggaaaaaattgccgcagagatagcccaggcggaagaacaggcgagaaaacgacaagaagaaagggagaaggaggccgcggagcaagccgagcgcagccagtcatctatcgtaccagaggaggagcaggctgccaacaagggagaggaaaagaaagatgatgaaaacatccccatggaaacggaagagacacatctggaagagaccacggagtcgcagcagaacggagaggagggcacatccacccccgaggataaggaatctggacaggagggagttgacagcatggctgaagaggggacaagcgactcaaacaccggaagcgaaagcaacagcgctaccgtcgaggagccaccgacagaccctatccctgaagatgagaagaaagaatag

SEQ ID NO: 13411 - DNA, 708 bp, Artificial Sequence
  Description of Artificial Sequence: Synthetic coding sequence
atgcagagacgcgggcagcgtgatttgtggaggcacaacaagtcctgcgcaagaaaccgttgcccacgaccccctcgagagaggggaggggccggttttccctgggtgagagctcagctgtccgtacggcagttcacactgagagtgcgggtgcccgggccggtccaccttcggggtaggtctcctactcctgctttggaccccttggctcccctgaacccccttatccgcggtccccggaccccaggcctgagaagatggatccagtctctggcactattgctgccaaattgtagcagtagccgcatccccacagtacctagacctcatagcggactgtgggttcagtcggacttccccttaggattcttgtcccggacagaaccaagactcaccagatcgtgccggggagctttcaggtctccacgccccctgccgaagtcagggcaggctgacggaactagcgaggaaagcctgcaccttgatatccagaaattgaaagagaagcgggatatgctcgataaggagataagccaatttgtgtcggaaggttacagcgtggatgaactagaggaccacataactcagctgcacgaatacaatgacataaaggatgttggccagatgttgatgggtaagctggccgttatacgtggagtgacgacaaaggagctgtatcctgagtttgggctggatatgaatgattag

SEQ ID NO: 13412 - DNA, 924 bp, Artificial Sequence
  Description of Artificial Sequence: Synthetic coding sequence
atgaagaacctggtggtcccaatgtgggagggtaaatggaagaccgctaaacgggcccgaatgaattataaggtgaaactggaggagattagtggcctcctggtggacgccctgtacaccaacaccatttattacctgattaaagtagattatcgggaagtgtggctgataaggctgttctataatttctcgtttcttgaaaaaaaccaggattttacatttaagatggaaagcccctccgactctgctgtagtcttgccatctacgccacaggcttcagccaatcccagcagtccatatactaattcttcgaggaagcagccaatgtccgcgacacttagagagcgcctgaggaaaacacgcttcagctttaactcttcatacaatgtagtgaagagactgaaggtcgaaagcgaggagaatgatcaaaccttttcagagaagccagccagtagtacagaggaaaattgtttggagtttcaggagtccttcaaacacatcgacagtgagtttgaggagaataccaatctgaagaatacgttaaagaatctgaatgtttgtgagtctcaaagtcttgattcaggatcatgttctgccctgcaaaatgaattcgtctcagaaaagctccctaagcagcgactgaatgctgagaaggcgaaactcgtgaagcaggttcaagagaaggaagatctcttgagacggctaaagctcgtgaaaatgtacagatccaagaatgatctcagccagttgcagttgctcatcaagaagtggcgctcctgctctcagctactcctctacgaactgcagagcgctgtgtctgaggaaaataagaaattgtcccttacccagcttattgatcactacgggcttgacgataagcttctccactacaacaggtccgaggaggagtttatagacgtctag

SEQ ID NO: 13413 - DNA, 738 bp, Artificial Sequence
  Description of Artificial Sequence: Synthetic coding sequence
atggccgagggggagaagaatcaggactttacatttaagatggagagcccaagcgacagtgccgtggtactcccttctaccccgcaggctagtgccaacccatcatccccctacacaaattcaagtaggaagcaacctatgagcgcgactctccgggaacgactgcggaaaacaagattctcatttaactcaagctacaatgtggtaaagaggctcaaggtcgagagtgaagagaacgatcagaccttcagcgagaaacccgccagtagcactgaggagaattgtctggagttccaggagtcatttaaacacatcgactccgaattcgaagagaatactaatctgaaaaatactctgaagaacctgaacgtgtgtgagagccagtcactcgattcaggctcgtgttctgcgctacagaatgaatttgtctccgagaagcttccgaaacagcggttgaacgccgagaaagctaagcttgtcaagcaagtgcaggagaaagaggatctcttgagacgtctgaagttggtgaaaatgtatcggtccaagaatgatctgtcccagctgcaactgctgataaagaaatggcgttcctgtagccagcttctgttgtatgaactgcaatcggcagtcagcgaggaaaataaaaagctatcccttacccagctgatagaccactacggcctggatgacaaactgctgcattacaaccgttctgaagaggaattcatagatgtgtag

SEQ ID NO: 13414 - DNA, 699 bp, Artificial Sequence
  Description of Artificial Sequence: Synthetic coding sequence
atggaaagtccctccgattctgcagtggtcctcccttcaactcctcaggcctctgctaatccatcatcaccctacaccaattcaagccgaaagcagccgatgtccgcaactctacgtgagaggctcagaaagacgcgctttagcttcaatagtagttataatgtggttaagagactgaaagtggagtccgaggaaaatgatcagacgttttcagaaaaacccgcaagctctacggaggaaaactgtctggagttccaggaatcttttaagcatattgattcagagtttgaggagaacacgaacctgaagaacacgcttaaaaatcttaacgtgtgcgagtcccagagcctggacagtgggtcatgttctgcacttcaaaacgaatttgttagcgagaaacttcccaagcaaagactcaacgctgagaaagcgaaactggtgaaacaggtccaggaaaaagaagacctgctccgccggcttaaactggtcaagatgtatcgcagtaagaatgatctgagccaactccagctgcttattaagaaatggcgcagctgcagtcagctgctgctgtacgaactgcagtctgcagtgagtgaagaaaataagaagctgtccctgacccagctcattgatcactatggcctcgacgataagctgttgcactataaccgctccgaggaagaattcattgatgtgtag

SEQ ID NO: 13415 - DNA, 1059 bp, Artificial Sequence
  Description of Artificial Sequence: Synthetic coding sequence
atgtttcgcggcctgtcgtcttggttagggttgcagcagccagtcgccggaggcggccagccaaacggagacgccccccccgagcaaccctccgaaacagttgcagagtctgccgaggaagaactccagcaggccggcgatcaggaactgctgcatcaggctaaagatttcgggaactacctctttaacttcgccagcgccgccaccaaaaaaatcactgaatccgtggcagaaacagcacagactatcaagaagtccgttgaagaaggaaaaatcgacggcattattgataagaccattattggcgacttccagaaagaacagaaaaaattcgtcgaggaacagcatactaaaaagagcgaggccgcagtccccccctgggtggacaccaacgacgaagagactatacagcaacaaatcctcgcactttccgccgataaaaggaatttcctcagagaccccccagctggggttcaattcaatttcgacttcgaccagatgtacccagtggcactagtcatgctgcaggaagatgagttgttgagcaaaatgagatttgcactcgttcctaagctggttaaagaagaggtgttctggcggaactacttctatagggtgagcttaattaagcaatcagcccagctgactgctcttgctgctcagcagcaagctgccggtaaggaagagaagtctaatggacgggaacaggatctccccctggctgaggctgtgagacctaagacacctccagtggtgatcaaatcccaactcaagacccaagaggatgaagaggaaatcagcacctcccccggcgtcagtgagttcgtctctgatgctttcgacgcctgtaacctgaatcaagaagatctgaggaaggaaatggagcagctggtgttggataagaaacaggaagaaaccgctgtcctagaagaggactccgccgactgggagaaggagctgcagcaggagctccaagagtatgaagtggtcactgagtcagaaaaacgggatgagaactgggataaagaaatcgagaagatgttacaagaggagaattag

SEQ ID NO: 13416 - DNA, 2439 bp, Artificial Sequence
  Description of Artificial Sequence: Synthetic coding sequence
atgcaagcaaagaacaaagatgccctgcagcctattaaagaggacaggactggaaaagcccaggatgacgcattttggttgcagagcctgattactgacgcttttcatgataaaggatttcagaagatcaaggaatatttccagcagaaagaatctcatttccctcagaagtataataggttgctcctatacagattagaccggtctatcaataaagagctcgacaagaacgagtttcagtcagtgagcctgctgctgaaatgtatacagcgattcctggtggacgggctgaaagaagatgagcctctgcttataaggcagggacttattcctaaactggtcagttggttcgagaggacaaccggcatcctcacatctgaaggattagcatcagacacatcactcatatgtgttatcgaggacttttttgacaccgccttgataatcagcagatctagctctgaaggaaaaattcagatgcttgatagctttctgctatcactcggtttcctggtgaccgagaaaacggtaaatcacttgctgcagcaagagggactaaaaacttttaattgcatactgcacgccgtcccacgcgaggaacgaaagaagttcccgctgtctgagggaatgtgccatttaatgaaagaccttgctaggacgttactaaccgtgggcgactatgaccagcaggtggcaatttctgaagcactgtgcaggctaacaattaagaagagtcgagatgagctggttcataagtggtttgacgacgaggtgattgctgaggcgttcaaggaaattaaggatagggaattcgaaacagatagtcgtagattccttaatcacctgaataatagactcggggatcaaagaagagtctactccttcccttgtattgcagctttcgcagatgaacacgagatgcgaaagccagctgacgagaaactcgaaaagttttggattgattttaatttgggatcccagagtgtcactttttatattgacaacgccgagaacactttgtgggattctgtgaccctgccaaaggaggccgttatgaattttagcattactgaaaccgaaaaaatcaagatttttattatttatctcaagaaaccaatgatcatctcttacaaggaagtgatgaaaatcgagatacactttgaccttcagttcaacatctcacaggtttcgattcaggccctgggcgaagacaagcagatgttacctgatcagacaaagatttccagcgagctgttttccaaatctgacaaagaagaccgcgagagcccaagcgggctagagcgtgaaacagagcaagctgaagagtccaccaacatggtggaatttatgagcgctgaagacgatagatgcctaattacgttacacctcaacgatcagtctgagccacccgtgatcggagaacctgcttcagactcccaccttcaaccagtcccaccttttggggtccctgattttcctcaacagccaaaaagccactaccgcaaacatttatttagcgagtctaatcaggactccagcacatccgagttatcctggacatcaaaccagaagaagaaaagtttaaaatcatacagcagtcggaaaaagaccaggactcggtcaaacctgaggattctgcccgtgtttcccccgtcctccgggtcagggcacgagaaagatcaggcgaaattactgagcccttctgagaaggagattccggagcagaacaatactacttcaccgaagacatccgaacagaagtttcaggactctttcgcatttctgactgccgaggactccgcccagaagacagagctgcaagatccccacagcctgtctgagcttagttccctgaagcactcagaagatgaggaaaaaccaaaaatagtcaaccaagaaagtttaaccgagtcgacaagtctgaagcataaactgaggaatttagaggacaaggatatccctgagggtagcttcgcaaaatctcagcagagcagactggaggaggaggtggccccagggagtcctttttctattacagaagaaagggaattgcctgaagggatttcaacatcctcactcgaagtggtgcccgaaaacctcaatggtagtgcaatcctaccaacttttgagaacttcacaaaaaagaggaagagaaaatatgagctacggtatcggaaaaggccattcaacagcgagaatgctaaaaaggcaccggactgtttgatcaaactgctgaaccagatgcagctgttcaggctcaacaagttggagcggttccagaatctggtactgcaggaactgtccagcctcaaacaggacattcaggctctggagcatctggagaaggaggttctggagttttggggcaagcagagtgcagacctgcagtccttctgtgacctccaagtcctgcgcttcaacagcactcagaccagctag

SEQ ID NO: 13417 - DNA, 867 bp, Artificial Sequence
  Description of Artificial Sequence: Synthetic coding sequence
atgctggattcttttttactctccctgggatttctggttaccgaaaagaccgtgaaccaccttctccagcaagaggggctaaaaacttttaactgtatactccatgccgtgcctcgtgaggagagaaaaaaatttccccttagtgaaggtatgtgccatctaatgaaggacttggctaggacactgctaacagtgggtgactatgaccagcaagtggccatttctgaggcattgtgtcggctgactataaagaaatcaagggacgagcttgtccataagtggtttgatgacgaggtcatcgccgaagcttttaaggaaatcaaagatagggagttcgaaaccgattctcgtcggttcctcaaccacctgaataaccggcttggagaccaacgtcgggtgtattctttcccttgcatcgctgccttcgctgacgagcacgaaatgagaaaaccagcagatgaaaaacttgagaagttctggattgacttcaacctcgggtcccagtccgtaaccttttatatcgacaatgccgaaaacacgttgtgggactctgtaactctccccaaggaggccgtcatgaattttagtattactgaaacagagaaaatcaaaattttcattatttatttgaaaaagccgatgatcatttcatacaaggaggtgatgaagattgagattcactttgatctgcagtttaacatttctcaggttagcattcaggctctcggcgaagacaaacaaatgctgccagatcagacgaaaattagctctgaactgttctccaagagtgacaaggaggaccgggagtccccatctggactggagagagagaccgaagttagcctacagaagacatctcttctgtag

SEQ ID NO: 13418 - DNA, 1845 bp, Artificial Sequence
  Description of Artificial Sequence: Synthetic coding sequence
atgggtgactggatgaccgtcaccgaccctggtctaagtagcgaatcaaagacaattagccaatataccagcgagacaaaaatgtcgccaagcagtctatattcacaacaggtgctgtgcagctcgatccctttgtcaaagaacgtgcacagcttcttttcagcattctgcacggaggacaatattgagcagagcatcagctatctggaccaggaactgacgaccttcggtttccccagtctgtatgaggagtccaagggtaaggaaacaaaacgcgagctgaatatcgtagcagtactgaactgtatgaacgagctccttgtgctccagaggaagaacttgctggcacaggaaaacgtagagacgcagaatcttaaactggggtccgacatggaccatctccagtcttgctacagcaaactcaaagaacaactggagacctctcgccgggagatgatcggactacaggaacgcgatcgtcaacttcagtgtaagaaccggaacctgcaccagttactaaaaaacgaaaaagatgaagttcagaaactgcagaacatcatcgccagccgggcaacgcagtataaccacgatatgaagcgaaaggaaagggaatataataagcttaaggaacgcctgcatcagctggtaatgaacaaaaaagacaaaaagatcgccatggacatcctcaactacgtgggacgggctgacggtaaaaggggcagttggcggactggcaagactgaagcccgaaatgaggacgagatgtataaaatccttctgaacgactacgagtatcggcagaagcagatccttatggagaacgctgagttgaagaaagttctgcagcaaatgaaaaaggaaatgatctccctcttgtcgccccaaaaaaaaaagccgagggagcgtgtggacgattctactggtactgtgatctccgacgtcgaagaggacgcgggggagctgagcagggagagtatgtgggacctgtcttgcgaaacagttagagaacagttaaccaatagcattaggaagcagtggcgaattctgaagtcccacgtggaaaagctcgataaccaagtctccaaggtccacttagaaggtttcaatgatgaagacgtaatttccaggcaggaccatgaacaagagaccgaaaagttagagctggagatccaacaatgcaaagaaatgatcaagacacagcaacagctcctgcagcaacagcttgctacagcttacgatgatgacaccacttccctgctgagagattgctatcttctggaagagaaggagagactgaaagaagaatggtcgctgttcaaggagcagaagaagaattttgagcgggagagaagaagctttactgaggccgccattagactgggtcttgagcggaaggcatttgaggaagagcgggcctcctggctcaagcagcaattcctgaacatgacaacttttgaccatcagaactccgagaatgtgaagctgttttccgcttttagcgggagttcagattgggataaccttatcgtccattctcgccaaccgcagaagaaaccccactccgtatctaatggaagccccgtgtgtatgtccaaactcaccaaaagtctccccgccagtccatcaaccagtgatttctgtcagaccagatcttgtatctcagagcattcgtcgatcaatgttcttaacatcactgccgaggaaattaagccaaaccaggtcggtggtgagtgcaccaatcaaaagtggagtgtggcctctcgaccaggtagccaagagggctgttactccgggtgcagcttgtcctacacaaattctcatgtagagaaggatgacctgccttag

SEQ ID NO: 13419 - DNA, 1683 bp, Artificial Sequence
  Description of Artificial Sequence: Synthetic coding sequence
atgggtgattggatgactgtcacggaccccgggctttccagcgagtcaaagaccatatcccagtacacgtcagagaccaagatgtctccaagttctctttactcacagcaggtcctctgctcgagcattcccttatctaaaaatgtgcactctttcttttccgccttttgtacagaagataacattgagcagagtataagttatctggatcaggagctcacaacctttgggtttccgtccctgtacgaggaaagtaaaggaaaagaaaccaagcgggaattgaatattgttgccgtgcttaattgtatgaatgagctgttggttctgcagaggaagaacttgttggcccaagaaaacgtagagacccagaatctcaaactgggaagcgacatggaccacctacagtcttgctatagcaaactcaaagaacagctcgagacttctcggcgcgagatgattggtctccaggaacgtgatagacagctacagtgcaaaaataggaatctgcaccaactgttgaaaaatgaaaaggatgaagtgcaaaagctccaaaatataatcgcctctagggccacacagtacaaccatgatatgaagcgcaaagagcgcgagtataacaagctgaaggaacggcttcaccagctagtgatgaacaaaaaggataaaaagatagccatggacattctaaactatgtcgggcgtgccgacggaaagaggggcagttggcgaacaggaaaaactgaggctcggaatgaggatgaaatgtacaagatcctcctcaacgattacgagtaccgacaaaaacaaatcttaatggaaaatgcagagctgaaaaaagtgttacagcagatgaagaaagaaatgataagcctgctgtcaccccaaaaaaaaaagccacgagagagggtggatgactcaacagggaccgtgattagtgatgtggaggaagacgctggagaactttcaagagaatccatgtgggatctgtcctgtgagacggtgagagaacagctgacaaactccattaggaagcagtggagaatactaaaatctcacgtcgagaaacttgataatcaagtcagtaaggtacacttggaaggattcaacgacgaagacgtcattagtcgtcaagatcacgagcaggagaccgaaaagttagagcttgagattcaacaatgtaaagaaatgataaagacacaacaacaacttctccagcagcagctcgccaccgcctacgacgatgacactacctcactgcttcgggactgctacctgctggaagagaaggagcggctaaaggaggagtggagtcttttcaaggagcagaaaaaaaatttcgaacgggaaaggcgatcctttaccgaagcagcaattagattgggtctggagaggaaggcctttgaggaggaaagagccagctggttaaagcaacagtttctgaatatgacaacattcgatcaccaaaacagcgaaaacgtaaagctgttctctgctttctcaggctcaagcgactgggataatctgatcgttcattctaggcagcctcagaaaaaaccacactcagtctcaaacggatctcctgtgtgcatgagcaaactaacaaagtccctaccagcctcacctagtacatctgatttttgccagacgaggtcttgcatcagcgaacaccgcgccaaaaactag

SEQ ID NO: 13420 - DNA, 543 bp, Artificial Sequence
  Description of Artificial Sequence: Synthetic coding sequence
atgggcgattggatgactgtcacggacccaggtctgagcagtgaatctaaaactatcagccaatatacttccgagacgaagatgtctccctcttccttgtattcacaacaggtgctgtgttcttccattccgctgagcaagaacgtccacagctttttcagcgctttctgcacggaggataacatcgaacaaagtatatcttaccttgaccaggagctcaccaccttcggttttccttctctctatgaagaaagcaagggtaaggaaacaaaacgcgagctaaatattgtggcagtcttgaactgcatgaatgagttgctagttctccagcgaaagaacctgctagcacaggaaaacgttgagactcagaacctaaaactggggtccgatatggaccacctccagagctgttacagcaagctgaaggagcagcttgaaacaagccgccgggaaatgataggactgcaggaaagggaccggcagctacagtgtaaaaatcgaaatctccaccagctgctgaagaacgagaaggacgaagtgtag

SEQ ID NO: 13421 - DNA, 1764 bp, Artificial Sequence
  Description of Artificial Sequence: Synthetic coding sequence
atgagcccttcctctctatactcacagcaggtactctgttcatcaattccgctttccaagaacgttcactcttttttctccgctttctgcacagaggacaatatcgagcagtccataagctacctggatcaggaactgacaacttttggctttccaagcctgtacgaagagagtaagggtaaagagacgaaaagggaactgaacatcgtggctgttctcaactgcatgaatgagctactggtcctgcaaagaaaaaatctgctggcccaagaaaacgtcgagactcaaaacctgaagctgggctcagacatggaccatctgcagagctgctacagcaagttgaaagaacagctggagacctcaaggcgggagatgatcggactgcaagaacgggatcgccagctccagtgcaagaaccggaacctgcaccagctgctgaagaacgaaaaagatgaggtgcagaagctgcagaacattattgcttcacgggctacacagtataaccatgacatgaagcggaaagagcgcgaatacaacaagctgaaggagcggctccaccagctcgttatgaataagaaagacaagaagatcgctatggacattttgaactacgtcgggcgagctgacggtaaacgaggtagctggcgcaccggtaaaactgaagcccggaatgaagatgaaatgtacaagattcttctgaacgactatgaatatcgccaaaaacaaatcttgatggaaaacgccgagctgaaaaaagtgctgcaacagatgaagaaggagatgatctccttgctgtctccccaaaagaagaagccccgcgagcgtgtagacgactcaaccggaactgtgatctccgatgtcgaagaggatgctggtgaactcagccgggaatccatgtgggacctcagttgtgagacagttcgcgaacagctcaccaactctatccgcaagcagtggcgcattctgaagagccacgtggagaagctggacaaccaagtatccaaggtgcacctagaaggattcaacgacgaagacgtgatttcgcgccaggatcacgagcaagagactgaaaaactggagttggaaatacagcagtgtaaggaaatgattaagacccagcaacagctgctccagcagcagctcgccacggcttatgatgatgacaccaccagcctcttgcgggattgctatcttctggaagagaaagagcgtctcaaggaggagtggtcgcttttcaaggagcagaagaagaatttcgaaagagagaggcgttctttcactgaggccgccattcgcttaggcttagagcgcaaggcgttcgaggaggagagagccagctggctcaagcagcaattcctgaatatgaccacattcgatcaccagaactccgagaacgtgaagcttttttcagcattctcagggtcaagtgattgggataatctgatagtgcacagcagacagcctcagaaaaaacctcactccgtgtccaacggatcccccgtctgcatgagcaaactgaccaaatctctgccggcctccccttccacctcagacttctgtcaaacccgaagttgtatatccgaacattcgagcatcaatgttttaaatatcacagctgaggagatcaagccgaatcaggtgggcggcgagtgcaccaatcagaagtggtccgtggcgagtcggcctggctcacaggaaggctgctattctggctgtagtcttagctataccaacagccacgtggaaaaagatgatctcccctag

SEQ ID NO: 13422 - DNA, 1515 bp, Artificial Sequence
  Description of Artificial Sequence: Synthetic coding sequence
atgggagactggatgaccgtcacagaccctgaatcaaaaaccataagccaatacaccagcgaaactaaaatgagcccctccagtttgtatagccagcaagtgctatgttcaagcataccactgtccaaaaatgtgcatagctttttttccgccttttgtacagaggataacatcgaacagtctatcagttatctggatcaggaactgaccaccttcggatttccaagtctgtacgaagaatccaagggtaaggaaacgaagcgggagctgaacatagtagcggtgctaaactgtatgaacgaactgctagtactacagcgaaagaaccttttagctcaggaaaacgtggagacacagaacttgaaactaggatccgacatggaccacctgcaaagttgctacagcaagttgaaagagcagctggaaactagtaggagagagatgattggactgcaggaaagggatcgacagttgcagtgtaaaaaccggaacctacaccaactccttaagaacgagaaggacgaggtccagaagttgcagaatatcatcgcatcgagggccacgcagtataatcacgacatgaaacgaaaagagcgtgagtacaacaagttaaaagaacggctgcaccagctggtcatgaataaaaaggataaaaaaattgcgatggacatcttgaattacgtaggccgggcagacggcaagcgggggtcttggaggaccgggaagaccgaagcccgcaacgaggacgaaatgtacaaaatcctgctgaacgattatgagtatcgccagaaacagatcttaatggagaacgcggaactgaaaaaagtcctccagcagatgaaaaaagagatgattagtctgctgtccccccagaaaaagaagcccagggagcgggttgatgactccactggaactgtgatcagcgacgtggaggaggacgccggggaattgagtcgcgagtccatgtgggacctctcttgtgaaacggtccgagagcagcttaccaatagtattagaaagcaatggcgcattctgaagtctcacgtcgagaaactggataaccaagtgagtaaggtgcacctcgaggggttcaacgatgaggatgtgatctcccgccaggaccacgagcaggagaccgagaaactggaactcgaaatccaacagtgcaaagagatgattaagacccaacaacagcttcttcagcagcagctggcgacagcttatgatgacgacactacaagcctattgcgcgactgctatctcttggaagaaaaagagcgcctgaaggaagaatggagcctattcaaggagcaaaagaaaaacttcgagagggagcgccgaagttttaccgaggctgccatccggcttgggctggaaatcggatttttactgctgagtgtgctccacaagaagtccctgcttgggatacatcactcgagcaccgtcagtaggtgtggtgtaagacggcaatgtaatcaggattacatctgctgcctgaaaaaaaagggcatctag

SEQ ID NO: 13423 - DNA, 672 bp, Artificial Sequence
  Description of Artificial Sequence: Synthetic coding sequence
atgaacggcgatgatgcattcgcccgccgaccaaccgtcggtgcacaaatcccggagaagatccagaaggccttcgacgacattgccaaatatttcagcaaagaagaatgggagaagatgaaggctagcgaaaaaatcttctatgtttatatgaagaggaagtacgaggccatgacgaaactgggctttaaggcaacgctacccccctttatgtgcaataaacgcgccgaggactttcagggcaatgaccttgacaatgacccaaatagaggaaaccaggtcgagcggccgcagatgacctttggaagactccaaggtatcagccccaaaataatgcccaagaaacccgccgaagaggggaatgattccgaggaggttcctgaggcaagtggccctcaaaatgatggaaaagaactctgccccccaggaaaaccaacaacatccgagaagatccacgaaaggtccgggaatcgggaagcccaagagaaggaggagcgccgaggcacggcccatcgttggtcaagccagaacactcacaacatcggcaggttctctctgagtacaagcatgggggctgtgcacggcaccccgaaaactataacacataatagggaccccaaaggcggtaacatgccaggtccaaccgattgtgtgagggaaaacagctggtag

SEQ ID NO: 13424 - DNA, 567 bp, Artificial Sequence
  Description of Artificial Sequence: Synthetic coding sequence
atgaacggagacgacgcattcgctaggcgcccgaccgtcggagcacagattccagagaagattcagaaggcttttgacgatatcgctaaatattttagtaaggaggagtgggagaaaatgaaggcctccgagaagatcttttacgtatacatgaagcgaaaatacgaagcaatgacaaagttaggttttaaagctacccttccccccttcatgtgtaacaaacgggcggaggatttccaggggaatgatctggacaacgacccgaatcggggaaatcaggtcgaaagaccacaaatgactttcggaagactgcagggaataagtcccaagataatgcctaaaaagcctgcggaggaggggaatgatagtgaggaggttcctgaggcgtcggggccacagaatgacggcaaggagttgtgtccacctgggaaacctacaacctccgaaaagatacacgagaggtcgggacctaaacggggagaacacgcttggacccacaggctccgggaaaggaaacaattggtgatctacgaggaaataagcgatcccgaagaggatgacgagtag

SEQ ID NO: 13425 - DNA, 567 bp, Artificial Sequence
  Description of Artificial Sequence: Synthetic coding sequence
atgaacggcgatgatgcctttgctagaaggccaagagacgacgctcagatctctgagaagctgcgcaaagcctttgatgacatcgcaaagtacttctccaagaaggagtgggagaagatgaagtcttcagaaaaaatagtatacgtctacatgaaactgaactacgaggtaatgacaaagctggggttcaaggtgaccttaccaccattcatgcgctctaagagggccgcagactttcacggtaacgatttcggtaacgaccgcaatcataggaatcaggtggagcgacctcagatgacctttgggtccttgcagcgcatcttcccgaagattatgcccaaaaaaccggcagaggaggaaaacgggctgaaggaggtgccagaagcgtctggcccgcagaatgatggcaagcagctttgccctccagggaatccatccaccttggaaaagattaataagacctcaggccccaagcgcggaaaacacgcctggactcaccgcctgcgggaaagaaaacagctcgtggtgtatgaggagatctcagaccctgaggaagacgatgagtag

SEQ ID NO: 13426 - DNA, 462 bp, Artificial Sequence
  Description of Artificial Sequence: Synthetic coding sequence
atgaatggagatgatgcatttgcacgtcggccacgcgacgacgcccaaatctcagaaaaacttaggaaagccttcgatgatatcgccaagtacttcagcaaaaaggagtgggaaaagatgaaaagctctgagaagattgtctacgtctatatgaagctgaactacgaggtgatgaccaagctcggttttaaggttacactgccccccttcatgagaagcaaaagggctgcggactttcacggcaacgattttggcaacgataggaaccacaggaatcaggtggagagacctcaaatgacctttggctccctgcaacggatctttcctaaggatcctaaaggaggcaacatgccagggccgaccgattgcgtaagagagagctcttggtggttcatgaaaagatctgccactctgcggaagatgacttccaacagcccgcggggctacgatacatgtccttag

SEQ ID NO: 13427 - DNA, 690 bp, Artificial Sequence
  Description of Artificial Sequence: Synthetic coding sequence
atgaacggcgacgatgcctttgtcagacgtccccgtgtgggtagccagatccctgagaagatgcagaagcatccttggcgtcaggtgtgcgacagaggcatccacctggtcaacctgtcccctttttggaaggttggccgagagccggcctcaagcatcaaggctctgctgtgcggaagaggcgaggcaagagccttcgacgatatcgctaaatacttttcagagaaggagtgggagaaaatgaaggcctcggaaaaaattatctatgtgtatatgaagcgtaagtatgaagcaatgaccaagttgggcttcaaagccaccctcccgcctttcatgcggaacaagagagtggcggacttccagggtaacgactttgataatgacccgaatcgcggaaatcaggtagagcatcctcagatgactttcggccgcttgcagggcatattcccgaaaattacacccgagaaaccggccgaggaaggaaatgactctaaaggtgtgcctgaagcctctgggccccagaacaacggcaaacagctgcggcccagcggtaaattaaatacatcggagaaggttaataagacgtctgggcctaagcgcggaaaacacgcctggactcaccgggttcgggaacggaagcaacttgtgatctacgaggagatttccgacccacaggaggacgacgaatag

SEQ ID NO: 13428 - DNA, 567 bp, Artificial Sequence
  Description of Artificial Sequence: Synthetic coding sequence
atgaacggcgatgatgcctttgttaggaggcccagggtagggagtcaaatcccagaaaagatgcagaaggctttcgatgatattgccaagtatttctcggaaaaggagtgggagaagatgaaagcaagtgaaaagatcatttacgtttacatgaaaaggaagtatgaagcaatgactaagcttggcttcaaggcgacgctgcctccattcatgcgtaataaaagggttgccgacttccaggggaatgactttgataacgatcctaacagaggaaaccaggtagaacatccccaaatgacttttgggcgactccaaggaatctttcccaaaatcacacctgaaaagcctgctgaggagggtaacgacagcaaaggagtgcctgaggcctctggaccccagaataacggcaaacagctgaggccgagtggtaaattaaacaccagcgaaaaggtgaataagacttccgggcccaaaagaggtaagcacgcatggacccaccgagttagagaacggaagcagttagtcatctacgaggagatttcagatcctcaggaagatgacgaatag

SEQ ID NO: 13429 - DNA, 567 bp, Artificial Sequence
  Description of Artificial Sequence: Synthetic coding sequence
atgaacggcgatgacgcttttgtccgcagacctagagtcggtagccagatccctgaaaagatgcagaaagcgttcgatgatattgcgaaatattttagcgagaaagagtgggagaaaatgaaagctagtgagaagatcatctatgtgtacatgaagcgaaaatatgaggccatgacgaaactcggctttaaggcgaccctacccccgtttatgcggaataagcgtgtggcagattttcagggtaatgactttgataatgatccaaataggggaaaccaggtggagcaccctcagatgacattcggcagattacagggcatcttccctaaaataacacccgaaaagcctgctgaggaaggcaacgacagcaagggtgtgcctgaggctagcgggcctcagaataacgggaaacagctgagaccttccggcaagctgaacaccagtgagaaagtgaataagacaagcggccccaagcgcggaaaacatgcatggacccatagagttagggagcgcaagcagctcgttatttatgaggaaatcagcgacccacaggaggacgacgaatag

SEQ ID NO: 13430 - DNA, 387 bp, Artificial Sequence
  Description of Artificial Sequence: Synthetic coding sequence
ttgataaccagcgccgctgaatgtcctcacgcaacagaggtgtccttggaatttggaaacctctaccagcaacgtaagatcctcatgtactcacttagcgtggagcatcctcagatgacttttgggcgtcttcagggcatctttccaaaaatcaccccagagaaaccagccgaggaagggaatgactctaagggagtacctgaagcctctgggccgcaaaataacgggaagcagctgagacccagcggaaaactgaatacatctgagaaggttaataagacaagcggccctaagcgtggcaagcatgcatggacacatcgcgtgcgtgagcggaaacagctggtcatttacgaagagatctccgatccccaggaagacgatgagtag

SEQ ID NO: 13431 - DNA, 273 bp, Artificial Sequence
  Description of Artificial Sequence: Synthetic coding sequence
atgactttcggcaggctgcaaagaattatacccaaaatcatgcccgagaagcccgctgaggaggggtcggattctaagggcgtacctgaggccagtggcccccagaacgatgggaaaaagctctgtcccccgggcaaggcatctagcagcgagaaaattcatgagaggtccggccctaagagggggaagcatgcctggacacaccggctgcgcgagcgcaagcagctagttatttacgaggaaatctccgaccccgaggaagacgataagtag

SEQ ID NO: 13432 - DNA, 567 bp, Artificial Sequence
  Description of Artificial Sequence: Synthetic coding sequence
atgaacggagacgatgctttcgccaagcgtccacgtgacgatgcaaaggcctccgaaaagcggtccaaagcttttgatgatattgccaagtacttcagtaaagaagaatgggaaaagatgaagttcagtgagaaaattagctgcgtccatatgaagaggaaatacgaggcaatgacgaaacttggattcaacgtcacattgtctctttttatgcgaaacaagcgggctacagatagccagcggaacgattcggacaacgatagaaacagaggtaatgaggttgagcggccccagatgaccttcggccgattacagagaattatccctaaaatcatgcctgagaagccagctgaggagggctcagacagcaagggtgtaccggaagctagtgggccacaaaacgatgggaagaaactgtgtcctcctggaaaggctagcagctctgagaaaatccacgaacgatcaggacctaaaagaggcaagcatgcctggacccatagacttcgtgaaagaaaacaactggtaatctacgaagagatcagcgaccctgaggaagatgacaagtag

SEQ ID NO: 13433 - DNA, 567 bp, Artificial Sequence
  Description of Artificial Sequence: Synthetic coding sequence
atgaatggagatgacgccttcgctcggcggcctagggccggcgctcagattcccgaaaagatccagaagtcattcgatgatattgctaagtactttagcaagaaggagtgggaaaagatgaaaagcctggaaaagatttcctatgtatacatgaagaggaagtacgaagctatgaccaagcttggatttaaggccacactcccgccttttatgcataacacgggagctacagatcttcaaggtaatgactttgataatgatcggaaccaggggaaccaggtggagagaccccaaatgaccttctgcagattgcagaggatctttcctaaaatcatgcccaaaaagccagctgaagaaggaaacgattctaaaggcgttccggaagcgagcgggagtcagaatgatgggaaacacttgtgccctccaggaaaaccgagtacttctgaaaagatcaataagacttctggaccaaaacggggaaaacacgcttggacccatcggctgcgggagcgaaagcagctcgtaatctacgaagagatatccgatccggaagaagatgacgagtag

SEQ ID NO: 13434 - DNA, 567 bp, Artificial Sequence
  Description of Artificial Sequence: Synthetic coding sequence
atgaatggtgatgacgccttcgccaggaggcccagggctgggtcacagatccccgagaagattcagaaggcattcgacgatattgcaaagtatttcagcaaaaaagagtgggagaagatgaaaagctctgagaagattatttatgtgtatatgaaaagaaagtatgaagcaatgacgaagttgggctttaaggccaccttgccaccttttatgtgtaacaccggcgccaccgatctgcaaggaaacgactttgacaacgaccgcaatcataggaatcaggtagaaagaagtcagatgacgttcggcaggctacagggaatctttcccaaaatcatgccgaaaaagccagccgaggttggaaacgatagcaaggaagtgccagaggcgtcaggactgcagaatgacggaaagcagctctgcccacccgggaagcccactacatccgagaagataaataaggcgtctggcccaaaaaggggaaagcacgcgtggacccacaggctgcgtgagcgtaagcagctggtaatctatgaggaaatcagcgaccctgaagaagatgatgaatag

SEQ ID NO: 13435 - DNA, 567 bp, Artificial Sequence
  Description of Artificial Sequence: Synthetic coding sequence
atgaatggtgatgatgcattcgccaggcggcctagagcgggttcacagatccccgagaagattcaaaaggcatttgatgacatcgccaaatattttagcaagaaggaatgggaaaagatgaagtcctcggagaaaattatttatgtctacatgaaacggaagtacgaggcaatgaccaagctcggctttaaagcaactttaccacccttcatgtgcaacaccggcgcaacagacctgcaagggaatgactttgacaatgatcgcaaccacaggaatcaggtcgagcgctctcaaatgacctttggccgcctccagggcatctttccaaagattatgcctaaaaagcccgccgaagtgggcaacgactccaaagaggttccagaggcttctgggctgcagaatgacggcaaacaactttgccctcccggtaaacctaccaccagcgaaaagattaacaaggctagcggacccaagagggggaaacacgcatggacacataggctgagggaaaggaagcagcttgtcatctacgaggagatatcagaccccgaggaggacgatgagtag

SEQ ID NO: 13436 - DNA, 5481 bp, Artificial Sequence
  Description of Artificial Sequence: Synthetic coding sequence
atgcgcccggggtgcgacctgctgctgagggcagccgctactgtgaccgctgcaatcatgtctgattccgacagcgaggaggactcaagtggaggtggaccattcaccctcgcgggaattttatttggcaatatttctggcgccggacagctcgagggtgaaagcgtgctggatgatgaatgcaagaaacatctcgccgggctgggggctttaggtctgggatcactgattaccgagctgacagccaacgaggaacttacaggaaccggcggcgccctggtcaatgacgagggatggattagatcaactgaagacgctgtggactacagtgatatcaatgaggttgccgaggacgaatctcaacggcatcagcagaccatgggatcattgcagccattgtaccacagcgattatgacgaagacgattacgacgcagactgtgaagacatagactgtaagctcatgccacccccaccgcctccaccaggccctatgaagaaagataaagatcaagacgcaataacttgtgtgtccgagtcaggggaagacatcatactgccttcaatcattgcgcctagcttcctggcctccgagaaggtggacttctcatcttattccgatagtgagtctgaaatgggccctcaggaagcgacacaggccgaatccgaagatggtaagcttacactgcctctggcaggaattatgcagcacgacgccacaaagctgttgccttctgtgacagagcttttccccgaattccgccctggaaaagtactgagattccttcacttgttcggccccggcaagaacgtgccgtctgtgtggcggtctgcccgcagaaaaaggaagaaacacagggagcttatccaggaggagcagatccaggaggtcgagtgctctgtagagagcgaggtgtcccaaaaaagcctttggaattatgattacgcaccaccccctcctccagaacaatgtctcgctgacgacgagataaccatgatggtgcccgttgaaagcaagtttagccagagtaccggagacgtggataaggtgacggatactaaacctcgcgtagcagaatggagatacggacctgctcgcctctggtatgacatgctcggcgtgtccgaggatggctcaggttttgattacggcttcaagctgagaaagactcagcatgagcccgtgatcaagtctagaatgatggaggaattccgtaagctcgaagaatccaacggtactgacctgcttgctgacgagaactttctcatggttacccaattacattgggaagattccatcatttgggatggagaagacattaagcacaaaggtaccaaaccacagggggcctctctcgccggttggctgccctcgatcaaaacaaggaacgtgatggcgtataacgtccagcaggggttcgcccccacactcgacgacgacaaaccatggtactccatctttcctatcgataacgaagaccttgtgtatggacgctgggaggataatattatatgggatgcccaggctatgccccggcttttggagccacctgtgctggccctcgaccccaatgacgagaatctgatcctggagattcccgacgaaaaggaggaagccacttctaacagtccctccaaggagagcaaaaaggaatcatcactcaaaaaatcccggattctattgggtaagactggggtgatccgagaagagccacaacagaatatgtcacagccagaagtcaaagacccctggaacctgtctaacgacgagtattactttcctaagcagcaggggttaaggggtaccttcggaggtaacatcatccagcactctattccagctatggagctttggcagcccttctttcctacccacatgggccctatcaagatccggcagtttcaccggccgcctctgaagaagtatagctttggggcgctgagccagcccgggccacactcagtgcaaccgctgctgaaacatataaaaaaaaaggcaaaaatgcgggaacaggagagacaggcctcaggcggtggcgagttgtttttcatgcggactccccaggatttgactgggaaggacggagacttgatcttggctgaatactccgaggaaaatggacctctgatgatgcaggtgggtatggccacaaaaatcaaaaattactataagcggaagccagggaaagaccccggagcccccgattgcaaatatggggagactgtttactgtcatactagcccgttcttaggaagtctgcaccctggtcagttgttacaagcattggagaacaacttgttccgggctcccgtgtacctgcacaagatgcctgagaccgacttcctgattattcgaaccagacagggttattacatacgggaactagtggatattttcgttgtcggccaacaatgccccttgttcgaggtgcccgggcccaactctcgcagggccaacatgcatatccgtgatttcctccaagtgttcatttaccgcctgttttggaagtctaaggaccgccccaggagaatcaggatggaagacatcaaaaaagctttcccatcgcatagtgagtcaagcatcaggaagaggctcaaattatgtgcagactttaagcgcaccgggatggattccaattggtgggtgctgaaaagcgactttcggctcccaacagaggaagagatacgagccaaagtgtctcccgaacagtgttgtgcctattacagtatgatcgctgcaaaacaacggctcaaggatgccggatacggcgagaagagcttttttgcacccgaagaggagaacgaggaagatttccagatgaagatcgatgacgaagtacacgccgcaccctggaataccaccagagccttcattgctgccatgaaagggaagtgcctgctggaggtgacaggggtggcagacccaacaggatgcggagagggcttctcttacgtgaaaataccaaacaagcctactcaacagaaagacgataaagaaccccaggccgtaaagaagaccgtaactggcacggacgccgacctgagacgactgtcccttaagaacgctaagcaactgctgcggaagtttggcgtcccagaggaagagatcaagaaactgagccgctgggaagtgattgacgttgtccggaccatgtccaccgaacaagcacactccggagaaggacccatgtccaagttcgccagaggcagtagattttctgtggcagagcatcaagagaggtacaaggaagagtgtcagcgcatttttgacctccagaataaagttctgagttcaacagaggtattgagtaccgacacggattccatcagtgccgaggactcggattttgaagagatgggaaaaaacatcgagaatatgttacagaataaaaagacatccagccagctcagtagggaatgggaagagcaggagagaaaagagctgcggcggatgttattggttgctgggtctgctgcaagcggtaataatcatagagatgacgtgactgcgagcatgacgagtctcaagagtagcgctacaggacactgcctgaagatctatcgtacattccgggacgaagaggggaaagagtacgtgagatgtgaaaccgtacgaaagccagctgtgatcgatgcgtacgttaggattcgtacaacaaaggacgagaaatttatccaaaaatttgcgcttttcgatgagaagcacagggaagaaatgcggaaggaaagacgccggatccaggagcagctgcggcggctcaaaaggaatcaggaaaaggagaagttaaagggtccaccagaaaagaagcccaagaaaatgaaggaacgtcccgacctcaaacttaaatgcggcgcttgtggagccataggccacatgcggacaaataaattttgtcctttgtactaccagacaaacgtcccgccatctaagccagtcgcaatgactgaagaacaggaggaggagctggaaaaaacggtcatacacaatgacaacgaggagcttatcaaggttgaggggacaaaaatcgtgttcggaaagcagcttatcgagaatgtgcacgaagtgcgacgaaaatctctggtgttgaagttccccaaacagcaactgccacccaagaagaagcggcgcgtcggaactacggtacactgcgattatctcaacatcccacacaagagcatccataggagacggaccgaccctatggtgacactcagctctatcctggaaagcattattaacgacatgagggatcttcccaatacacacccttttcacacacccgttaatgcaaaggttgtaaaggactattataagataatcacccgtccaatggacctgcagaccttgagagaaaacgtgcgcaaatgcctctaccccagccgtgaggagtttcgtgaacacctggagcttatcgttaagaattcagcaacgtataacggaccaaagcactctctcacacagatttcacagagtatgctggacctctgcgatgaaaagcttaaggaaaaggaggacaagctggcacgcttggagaaagctatcaacccattgctcgatgacgatgaccaggtcgcgttctcttttatcctggacaacatcgtcacgcagaagatgatggctgtgccggatagctggcccttccaccaccccgtgaataagaagttcgttcccgactactataaaatgatcgttaatcctgtcgatctggaaactattcggaagaacatctccaaacacaagtaccaaagccgagagtctttcctggatgatgtcaacctaattctggctaatagcgtcaagtacaacggaccagaatctcagtatacgaagacagcccaggaaattgtcaacatttgctatcaaacgatcactgagtacgacgagcatctgacccaattagagaaggatatttgtactgccaaggaggcagccctcgaggaggctgaacttgagagtttggaccccatgacacccggaccctacacatcgcaaccacctgatatgtacgacaccaataccagcctgtcaacctcaagagacgcctcagtctttcaggatgagtctaatctgtctgtgctcgatatatcgactgctaccccggagaagcaaatgtgtcaggggcagggtcgccttggggaggaagactcggacgtggacgtggaggggtatgacgatgaagaagaggacggaaagccgaagccccccgcaccagagggcggtgatggggacctggctgatgaggaggaaggcactgtgcaacagccagaagcctccgtgctgtatgaggatctattgatctccgaaggagaagatgatgaggaggatgccggatccgacgaagaaggggataatcccttctctgcgatacaacttagcgagagcgggagcgatagcgatgtgggctacggtggaatccgacctaaacagccatttatgctccagcacgccagtggggagcataaagacggtcacgggaaatag

SEQ ID NO: 13437 - DNA, 375 bp, Artificial Sequence
  Description of Artificial Sequence: Synthetic coding sequence
atggccgacgaggaggaagatccgacttttgaggaagaaaacgaagagatcggtgggggcgccgaggggggtcaaggtaaacggaagcgtcttttctccaaggaactgcggtgtatgatgtatggcttcggtgacgaccaaaatccatatacggagtcagtggatatcctggaggacctggtaattgaattcattacagagatgacacataaggccatgagtattggaaggcagggccgggtccaagttgaagacatagtgttcttgattcgcaaagatccgcgaaagttcgctagggtgaaagacctcttgacaatgaacgaggagctgaagagagcacgtaaagcatttgacgaggccaactatggcagttag

SEQ ID NO: 13438 - DNA, 375 bp, Artificial Sequence
  Description of Artificial Sequence: Synthetic coding sequence
atggcagacgaagaggaggaccctactttcgaggaggagaacgaggagatcggagggggcgccgagggtggacagggaaagcgaaagcggttgttcagtaaggaactgcgctgtatgatgtatggcttcggtgatgatcaaaatccatacacagagtccgtggacatcctggaggacctggtgattgaatttatcacagaaatgacccacaaggcaatgagtattggcagacaaggtcgcgtgcaggttgaggacattgtgttcctgatccgtaaggaccctcggaagttcgcccgggttaaggaccttctgactatgaacgaagaattgaaacgcgcccgaaaggctttcgatgaagcaaattatggtagctag

SEQ ID NO: 13439 - DNA, 3600 bp, Artificial Sequence
  Description of Artificial Sequence: Synthetic coding sequence
atgcccctaaccggagttgagcctgccaggatgaaccgtaagaaaggggataagggtttcgagtccccgcgaccctataagctgacccaccaggttgtgtgtataaataacataaatttccaaaggaaaagcgtggtagggtttgtggagctcacaatatttcccacagtcgcgaacctgaatagaattaagttgaattcaaagcaatgccggatctaccgggtgcggatcaacgatctcgaagctgcatttatctataatgaccccactctcgaggtctgccattccgagtctaagcagaggaatctcaactacttttcaaacgcgtacgccgcagccgtctcggctgtggaccccgatgccggcaatggtgaattgtgcataaaggtgccctccgaactgtggaaacatgttgacgaacttaaagtactcaagattcacataaactttagtcttgaccagcctaaaggaggactacatttcgtggtgccttctgtagaaggttctatggccgaaaggggggctcacgtgttttcctgtggatatcagaattcgactcgtttttggtttccttgcgttgacagctactccgagctatgcacttggaaacttgaatttacggtggatgctgccatggtggctgtctcaaacggcgatttggtcgagactgtatatacacatgatatgcgcaaaaagacttttcactatatgctcactattccaacggctgcctctaatatttctctcgccattggcccttttgagatcctggtcgacccttacatgcacgaggtgacgcatttttgccttcctcagctgttaccccttctgaaacataccaccagttaccttcatgaagtgttcgaattttatgaggagattctgacgtgtcggtacccatactcatgtttcaaaacggtttttatcgacgaagcttatgtggaagtagctgcctacgcaagcatgtcaatattcagcaccaatctgttacacagcgccatgatcatagatgagacaccccttacacgacgatgtctcgcgcagtctctggcacagcagttttttggatgtttcatcagcaggatgtcatggagtgatgaatgggtgctgaagggaatcagcggctacatatacggactctggatgaaaaaaaccttcggcgtcaatgaatacaggcattggatcaaagaagaactggataaaattgttgcctatgaactaaagactggtggcgtcctgctccatcctatttttggggggggaaaggagaaagacaacccagcatctcatctgcacttttcaatcaagcatccacataccctgtcatgggaatattattctatgttccagtgcaaagcccacctcgtcatgagactcattgaaaataggatttcaatggaattcatgctgcaggtctttaacaaactactatctttagcatccacagcctcatctcagaaatttcaaagtcatatgtggtctcagatgctggtgagcacttcaggttttctgaagagcatcagcaatgtcagcgggaaggacatccagccgctgatcaaacagtgggttgaccagagcggggtggttaaattttacggctcctttgcatttaacaggaaacgaaatgttctggagctagaaatcaagcaagattacacgtcccctggcacacagaaatatgtgggaccactcaaggtcaccgtgcaggagttggacggtagtttcaatcatacattgcaaattgaggaaaacagcctgaagcacgatattccttgtcattcaaaaagtaggcgcaataaaaaaaagaagattccgctgatgaacggcgaggaagtagacatggacctctcggctatggatgctgattcacccctgctctggatcaggattgaccccgatatgagtgttctccggaaggtcgagttcgaacaggccgacttcatgtggcagtatcagctgaggtacgagagggacgtagtggcccagcaggagagcattctggctcttgagaagtttccgaccccagccagcaggctcgcactgacagatattctggaacaggagcaatgcttctatcgggttcggatgtccgcctgcttttgcttagctaagatcgccaacagtatggtctctacgtggaccggaccccccgccatgaaaagcctattcactcgaatgttctgttgcaaatcttgccccaacatcgtgaaaacgaacaatttcatgtcctttcagtcctattttcttcagaagaccatgccggtggctatggccctactgcgagacgtgcacaacctgtgtccaaaagaagtgttgacctttattctcgacttaattaagtacaatgacaaccgaaagaataaattttctgacaactattacagagccgagatgattgacgctctggctaatagcgtcaccccagctgtgtcggtgaacaacgaggtgaggaccctggacaatcttaacccagacgtccgactgattttggaggaaatcacccgcttcctgaacatggaaaaactcctgcctagctacaggcacacaattacagtgtcctgtttgcgcgccatccgtgtgttgcagaagaacggccacgtgccaagtgatcccgcacttttcaagtcttacgccgaatatggccactttgtggacatccgcatagctgcccttgaagcagtggtggattacacgaaggtggacagatcttatgaagagctgcaatggctattgaacatgatacagaacgaccccgtcccttacgtgcggcataagattttgaacatgctgactaaaaaccccccttttacgaaaaacatggagtctcccctgtgcaatgaggcattggtggaccagctgtggaagctcatgaattcgggcacttcacacgattggcgccttcggtgcggagccgtcgatctctattttaccctgttcggattgagcaggcccagctgtttaccactaccagaactcggccttgtactcaatcttaaagagaaaaaggcagtgctgaacccgacgatcattccagaatccgttgccggtaatcaggaggctgctaacaaccctagctcccacccccagcttgtcggctttcagaatccatttagctcgagccaggatgaagaagaaatcgatatggatacagttcacgatagccaggcgtttatttcacaccatcttaacatgctcgaaaggccctccacgccgggcctttccaaatacaggccggcatcttcccgctctgccctcatcccgcagcacagtgctgggtgtgactccactcccactaccaagcctcaatggtctctagagctggcaagaaaggggacagggaaagaacaggcacctctggaaatgagcatgcaccccgccgcctcagcccctctcagcgtattcacaaaagagtcaaccgcgagcaagcactcagatcatcaccaccatcaccatcacgagcacaagaagaaaaaaaaaaagcacaagcataagcataagcacaaacacaagcacgatagcaaagagaaagacaaggagccttttacattttcctcaccagctagcggccggagtattagatcaccctccctgtccgattag

SEQ ID NO: 13440 - DNA, 1770 bp, Artificial Sequence
  Description of Artificial Sequence: Synthetic coding sequence
atgaagagagttcggaccgaacaaatccaaatggccgtctcctgctacttgaaacgccggcaatacgtcgatagtgacgggcctttaaagcaggggctccggctctcccagaccgcagaagagatggccgctaacctgaccgttcagagcgagagcggttgtgccaatatagtgagcgccgctccgtgtcaagctgaaccacagcagtatgaagtccaattcgggagattgcgaaacttccttactgactcagacagccaacacagccatgaggtgatgccgctcctgtatcctctttttgtgtatctgcacctcaatctggtgcaaaactctccaaagtctaccgtcgaatctttctactcaagattccatgggatgttcctgcagaacgcctcgcagaaagacgtaatagaacagctgcaaacaacacagacaatccaagacatcctgagcaattttaaactcagggcctttctggataataagtatgtcgttaggctccaggaagactcatataactacctgattagatatctccagagcgataataatactgccctttgcaaggtgttaactttgcatattcacctcgatgtgcagccagcaaaaaggacggattatcagctctacgctagcggctcttcatccaggtcagaaaataatgggctcgaacctcctgacatgcctagcccgatcctgcagaatgaggccgctctggaggttcttcaggagtccatcaaaagggtgaaagacggtccgccatccctcacgacgatatgcttttatgcgttttataataccgagcaacttctgaacaccgccgaaatcagccccgattcaaaattgctggcagctgggttcgacaattcctgtattaagttatggtctctccggagcaaaaaacttaaatcggagcctcaccaggttgacgtctcccggatccacctcgcctgcgacattttggaggaagaggacgacgaggacgacaatgctggaactgaaatgaaaatcctgaggggtcactgtggcccagtttatagcaccagattcctggcagattcttctggactcctcagctgcagcgaggatatgtctattcggtactgggacctcgggtcctttaccaacacggtcctgtatcagggacacgcttatccggtgtgggaccttgatatttccccatactccttgtattttgcctctgggtcacacgatcggacagctcgactgtggtccttcgatcgcacctatcctctgaggatttatgcggggcatctggccgatgtagactgcgtcaagtttcaccccaactctaattatttggcgaccgggagcacggacaaaacggtacgactgtggagtgcgcaacagggaaacagtgttcgattattcacagggcatcgagggcccgttctcagcctcgctttcagccccaacggtaagtacctggcctcagccggagaagaccagaggctcaaactctgggacttagcctctggaaccctgtataaggagctgagaggccatacagataatattacaagcttgactttttccccggattcaggcttaatcgctagcgccagcatggacaatagcgtgcgtgtgtgggacatccgcaatacatattgttctgccccggcagatgggtctagctcggaactcgtcggcgtctataccggccaaatgagtaatgtcctgagtgtacagtttatggcgtgcaatctcctgttagtaacaggtataacccaggagaaccaggagcattag

SEQ ID NO: 13441 - DNA, 255 bp, Artificial Sequence
  Description of Artificial Sequence: Synthetic coding sequence
atgaagcgcgtccgcacggagcaaatacagatggccgtgtcttgctatctcaagcgccgccagtacgtcgacagcgatggaccattgaaacaaggcctgcgccttagccagactgccgaggagatggccgccaacctcactggaaatgggggcggcagctcgggtggtgtatccctggagcaagagaattctagacagtatccttgcggaattacatctccactccttaaaactgtgccggagagagccgactag

SEQ ID NO: 13442 - DNA, 978 bp, Artificial Sequence
  Description of Artificial Sequence: Synthetic coding sequence
atgaagcgcgtgcgtacagaacaaatacagatggccgtgtcttgctatttaaagaggagacagtacgtcgactctgacggtccgcttaagcagggacttcggctgagccagactgctgaagaaatggcggctaatttaactgtgcaatccgagtccggatgtgcgaacatcgtttcggccgccccatgccaagccgaaccacagcaatacgaagttcagttcggcagactcagaaacttccttacggattctgactcacaacactctcacgaagtgatgcctttactgtacccattatttgtgtatctccacttgaatctcgtccaaaattcccctaaaagcactgtggaatccttctacagtaggttccatgggatgtttcttcaaaatgcttcccagaaggatgtcattgagcaactacagaccacacagaccatccaggacatcctgagtaacttcaagctgagagcttttctcgataataagtacgttgtcagactccaggaggatagctacaactaccttattagatatttgcagagcgacaataacactgcactctgcaaggtgttgacactgcacatacacctggatgttcagccagctaaacggacggactaccagctatacgcatctggttccagctctcgctcggagaacaacggcctggaaccacccgatatgccaagcccaatcctgcagaacgaggccgctctcgaggtcctgcaggagtcaatcaaacgcgttaaagatggccccccatctttgactacaatctgcttttatgcattttataacacagaacagttgctgaacaccgctgagatatcaccggacagtaagcttctagcagccggcttcgacaacagctgcatcaaactttggtcactgagaagtaaaaaactgaagtccgaaccccaccaggttgatgtgtctcgaattcacttagcctgcgatatcttggaggaagaagtgtag

SEQ ID NO: 13443 - DNA, 1770 bp, Artificial Sequence
  Description of Artificial Sequence: Synthetic coding sequence
atgaaaagagtgagaacggagcagattcagatggccgtgtcatgctatttaaagcggcgccagtatgttgatagtgacggtcctctgaagcaggggctgcgcttatcacagaccgccgaagaaatggcggctaacctcacggtgcaatcggaaagcggttgcgccaatatcgtctctgcagcaccatgtcaagccgagccacagcagtatgaagtgcagttcggtcgactacggaattttctgaccgactccgattcccaacattcgcacgaagtaatgcctcttctgtaccctctgttcgtgtatctgcacctgaacctggtccagaattcccccaaatctacggtggaaagtttttatagcaggtttcacggcatgttcctccaaaatgctagccaaaaagatgtgattgaacaattacagacaacacagactatccaggatattttatcgaatttcaagttgagagcttttttagacaacaaatacgtggtacgactgcaggaggattcatataattacctcatcagatatttgcagtccgataacaatacggcattgtgtaaagtgttgactctgcatatccacctggacgtccagccagccaagagaacggactatcagttgtatgcctccggcagcagttccaggtccgagaataatgggttagaacctccggacatgccttctcctatcttacagaatgaggccgcgttggaggtactccaggaatctatcaagcgggtaaaagatggacctccgtctttgactaccatttgtttttatgcattttacaatactgagcagctacttaacactgcagagatctcccccgactctaagctgctcgccgccggtttcgataacagctgtattaagctatggagtctgagatctaagaagctgaagagcgaaccacatcaggtggacgtaagcagaattcatttggcgtgtgacatactggaggaggaggatgatgaggacgacaatgcaggcacagagatgaagattctccgtggccattgtggcccagtgtacagcacaagattcctcgccgattccagcggcctgttgagctgttcagaggatatgagcattcggtactgggatctcggctctttcaccaatacagttctatatcagggccatgcctatcccgtgtgggacctcgatatttcaccgtattcactctattttgcctcaggatctcacgataggactgcacggctgtggtctttcgataggacataccctctgagaatttatgcgggacaccttgctgatgtggattgcgtgaaattccacccgaatagcaactatttggcgactgggtctactgacaagaccgttaggctctggtcagcccaacagggcaacagcgtccggttatttactggccatcggggaccggtgttgagtcttgcttttagtcctaatggtaagtacttggcttctgcaggtgaggatcagagactcaaattatgggatctggctagtgggaccttgtataaggaactgcggggccacacagacaacatcaccagcctgacattctcaccagactcaggactgatcgcctccgcgtcaatggacaacagcgtgcgtgtctgggacatccggaacacatactgctctgccccagccgacggaagctcctccgagcttgtaggagtgtacaccggtcagatgagcaacgtgctgtctgtgcagttcatggcatgcaaccttctcctggtgactggcatcacccaggagaatcaagaacactag

SEQ ID NO: 13444 - DNA, 1869 bp, Artificial Sequence
  Description of Artificial Sequence: Synthetic coding sequence
atgtctgagcgcgaagagcgccgcttcgtggagatcccccgggagtctgttagattgatggccgaatcaaccggattggagctttctgatgaggtggcggccctcttagcagaggatgtttgctaccgtctgcgagaagccacacagaacagtagccagttcatgaagcatactaagagacgcaaacttactgtcgaggactttaaccgtgccctgaggtggtcctccgtggaagctgtttgcgggtacggttctcaggaagccctgcccatgcgcccggctcgagaaggcgagctgtatttccccgaagatcgcgaggtgaatctggtggagctcgcactggctacgaatatcccaaaaggttgcgctgaaactgctgtgagagttcacgtatcgtacttagatgggaaagggaatctggcaccccagggtagtgttcccagtgccgtgtcctcattgaccgacgacctgttgaagtactatcaccaagtgacccgagccgtcctcggggatgatcctcaactgatgaaggttgccctgcaggatctccagacaaatagcaaaatcggggccctgctgccttacttcgtctacgtggtgagtggcgtgaaatctgtgagccatgacctggagcagctgcaccgtttgcttcaagttgcacggagtctattccgcaaccctcacctgtgcctgggcccttacgtccgctgcctcgtcgggtccgtcctgtactgcgtgctagaacctctggctgctagcatcaaccctcttaatgaccactggaccctgcgcgatggcgctgccttgctcttatcccacatcttctggacccacggagacttggtgtcaggactgtaccagcacatcctcttgtccctccagaagatcctggcggaccctgtcaggcccctgtgctgccactacggcgctgtcgtggggctgcatgctctagggtggaaagctgtcgaacgagtactgtatccccacctgagtacgtactggacaaaccttcaggccgtcttggatgattacagtgtctctaacgctcaggtgaaagccgacggtcataaagtgtacggcgccattcttgtggctgtggaaaggctgttgaagatgaaggctcaggccgctgaaccgaatagggggggcccaggggggcggggctgtcgaagactggacgatttgccatgggacagcctgctgttccaggagtcatcatcaggcggaggcgccgagcctagttttggctccggtctcccgctgccacccggaggcgccggcccagaggatcccagtctgtcggtaacccttgccgacatctaccgggagttatatgctttctttggcgactctctggcgacccggttcggcacaggacaaccggcccccacggccccacgcccgccaggagacaagaaggaacctgctgctgcccctgactccgtgcgtaaaatgccacagttgaccgcatcagcaatcgtgtcccctcatggggatgaatcgcctcgcggttccggaggcggaggcccagcttctgccagtggacccgccgctagtgagagccgacccctaccccgtgtccaccgggccagaggagccccacgccagcagggtcccgggactggtactagggatgtattccagaagtctcgcttcgctccgcggggggcgccccatttccgattcattattgccggccgacaggccggccggagatgtaggggacgccttttccagactgcttttccagctccctacggcccgtcccctgcatccaggtatgtacagaaattgcccatgatcggcagaacttcaaggcctgctagacgatgggcactttcagattattcactttaccttcccctgtag

SEQ ID NO: 13445 - DNA, 153 bp, Artificial Sequence
  Description of Artificial Sequence: Synthetic coding sequence
atgtcagagcgggaggaacgaaggtttgtcgaaatcccaagggaaagcgtgagacttatggccgagtcgactggcctggaattgtctgatgaggttgccgctcttcttgcagaagatgtctgctacagactaagagaagcgacccagaactag

SEQ ID NO: 13446 - DNA, 438 bp, Artificial Sequence
  Description of Artificial Sequence: Synthetic coding sequence
atgagtgaaagggaggagcgacggtttgtggagatccctcgcgagtccgttagattaatggcagaaagcacagggttagagctgtctgatgaggtggctgctttactcgccgaggacgtctgctatcggttgagggaggccacacagaattcctcccaattcatgaaacacaccaagcggcgtaagctgaccgtcgaagacttcaaccgcgcgttaaggtggagctctgtcgaggccgtgtgcggctacggtagccaagaggccctaccaatgcggcccgccagagagggcgagctctacttccctgaagacagagaagtcaacctagtggaactggctctagccaccaatattcccaaagggtgcgctgagactgctgttcgagtgcatgttagttacctcgacgggaaggggaatttggcaccccagggttcctag

SEQ ID NO: 13447 - DNA, 1473 bp, Artificial Sequence
  Description of Artificial Sequence: Synthetic coding sequence
atggccacagaattcatcaagtcatgctgtggaggatgcttttatggagaaactgagaagcataatttctctgtagagcgagacttcaaagccgctgttcccaactcacaaaacgccaccataagcgtgcctcccctgacttcagtgagcgtcaagccacagcttgggtgtaccgaagattacctgttaagtaagctgccatccgatggaaaagaggtacccttcgtcgtgccgaaattcaagctgtcctacatccaaccaaggacacaggagacacctagccaccttgaggaactcgaaggctccgctcgcgccagctttggggacaggaaggtggaactcagttcctcttcacagcacggcccatcttacgatgtatacaaccctttttatatgtaccagcatatttccccagacctgagtcggaggttccctccaaggagtgaggtgaaacgcttatacggatctgtgtgtgatctccgaacaaacaaactaccaggctcgcccggcctctcaaagagcatgtttgacctgaccaacagctctcagaggttcattcagcgccacgattcactttcaagcgttccctcatcttcaagctcacgcaaaaattcccaggggtccaaccgctcattagatactattactctgtctggagacgagagggacttcgggcgtctcaatgtcaagctgttctataatagctcggtcgagcagatctggattacagttctgcaatgccgcgatctgagctggccctcttcatacggagatactccaacagtgagcataaagggaatactgacactgcctaagcccgtccactttaaatcaagcgccaaagagggctctaacgctatcgagttcatggagacctttgtcttcgccataaaactgcagaatttacagactgttcgtcttgtgttcaaaatccaaacacagaccccacgcaaaaagactatcggagagtgtagtatgtccctgaggacactctcaacccaggagatggactatagcctagacatcacaccaccaagtaagatttctgtctgccacgccgaacttgagctaggtacatgcttccaggccgtgaatagccgcatccaattacagattttggaggccagatatctgcctagcagttctacacctctaaccctcagcttctttgttaaggttggaatgtttagtagtggcgagttgatctataaaaagaagacacggctgctaaaggcctctaacgggcgcgtaaaatggggggaaaccatgatcttcccactcatccagagcgagaaggaaatcgtattcctgattaagctgtattcgcgatcttcggtccgcaggaagcacttcgttggccaaatctggatttccgaggacagcaataacatcgaggctgtcaaccagtggaaagagaccgtgattaatcccgagaaagtcgttatccggtggcacaagcttaacccctcgtag

SEQ ID NO: 13448 - DNA, 1473 bp, Artificial Sequence
  Description of Artificial Sequence: Synthetic coding sequence
atggctactgaattcatcaaatcttgctgcggtggctgtttttatggagagactgaaaagcacaacttctctgtggagagagatttcaaggccgcagtcccaaactctcagaacgctaccatttctgtgcctccactgacaagtgtgtcggtgaagccccagctgggatgcaccgaggactaccttttatccaagctgccttccgatggcaaggaagtacctttcgtggtaccaaaattcaaactcagttacattcaaccgcgcacccaggagaccccaagtcatctggaggaactcgaaggtagcgcccgtgctagctttggcgacaggaaagtcgagctgtcttcttcatcccagcatggacctagttatgacgtgtacaatcctttttacatgtaccagcacatctccccagacctgagcagacgcttccctcctcgttccgaagtgaagagattatatggctcagtgtgtgacctgcggactaacaagctgcctgggtctccagggctgtctaaatctatgtttgatctgacaaattcctcccagcggtttatccagcgacatgactctctgagctcagtgccttctagttcctcctcacgcaaaaatagccaggggtcaaaccgcagcctggacaccataactctaagcggagacgagcgagactttggcaggctgaatgtaaaactgttttacaacagctctgtggagcagatctggattaccgtgttacagtgtcgcgacctctcttggccttcgtcttacggggatacacccactgtgtctattaaagggatccttaccctaccaaagccggtgcatttcaagagctccgcgaaggaggggtccaatgcaattgagttcatggagactttcgtgttcgcaattaagcttcagaatcttcaaactgtgagattggtgttcaaaattcagacccagactcctagaaagaaaactatcggcgagtgttctatgtcactgcggactctcagtacacaggagatggattactctctggatatcactccgccatctaagatttccgtctgtcacgcagagctggaacttgggacctgctttcaggcagtgaactcccgaattcagctacagatattggaagcccggtatttgccatcatccagtacgcccctaaccctcagctttttcgtgaaggttggtatgttttctagcggcgaactcatatacaagaaaaagacacggcttctgaaagcaagtaatgggcgggtaaagtggggcgaaaccatgatttttcctttaattcagagcgagaaagaaattgtatttctgataaagctttacagcaggtcttcggtaagacggaaacactttgtgggccagatctggatctccgaagactccaataatattgaggctgtgaatcaatggaaggagaccgttatcaaccctgagaaggtcgtgatccggtggcacaaactgaacccctcttag

SEQ ID NO: 13449 - DNA, 1473 bp, Artificial Sequence
  Description of Artificial Sequence: Synthetic coding sequence
atggcaaccgaattcatcaaatcttgctgtggagggtgcttctatggggaaaccgaaaagcacaatttttcagtggaacgcgacttcaaagctgcagttcctaacagtcagaacgcaacaatttccgtgcctccccttactagcgtaagtgtgaagccacagctgggctgtaccgaggattatcttcttagcaaactccctagcgacggaaaggaggtcccctttgttgtacctaagttcaagctcagctacatccagccaaggacccaggagacaccgagccatctcgaggaattagaagggagcgctagagcttccttcggcgatcggaaggtcgagctgtctagcagttctcagcatgggccgagttatgacgtctataaccctttttacatgtaccaacacatctcgccagatctatcacgacgcttcccccctagatccgaggtgaagcgcctttacggcagcgtgtgtgacctgcgtacgaataaactccctgggtcccctgggctgtcaaagtctatgttcgatttgacgaattcgtcccagcggttcatccagcgtcatgattctctgtcatcggttcccagttcctcttcatctcgtaagaactcccagggtagtaaccggagcctggatacaatcacgctctcaggcgacgagagagactttggcaggctgaacgtgaaactgttctataactcttctgtcgagcagatttggatcactgtattgcagtgccgggacttgagctggcccagctcatacggagacacacctacagtgtccatcaagggcatccttacactgcccaaacctgtccacttcaagtcaagcgctaaggagggctccaacgcaatcgagtttatggagacgtttgtctttgctatcaagttgcagaaccttcagaccgttcggctcgtgttcaagatacagacacagactccaagaaagaaaactatcggagagtgttccatgtctcttagaactctgagcacacaggagatggactacagcctggatattacccctccctctaagatatcagtatgccatgccgaattagaactgggcacctgctttcaagcggttaacagcaggatacagttacagatactcgaggcacgatatctgccctcctcgagtacacccctcaccctgtccttcttcgttaaagtgggtatgttcagcagcggggaactcatatataagaagaagacccgcctccttaaagccagcaacggtcgtgtgaagtggggggagaccatgatttttcctctcattcagtccgaaaaggaaatcgtctttctgattaagctgtactcgcgctcatctgtcaggcgcaagcattttgtcggacaaatctggatatcagaagattcaaataatatcgaggctgtcaaccagtggaaagaaacagtgatcaatccagaaaaggttgtgatcagatggcacaaactgaatccctcatag

SEQ ID NO: 13450 - DNA, 1281 bp, Artificial Sequence
  Description of Artificial Sequence: Synthetic coding sequence
atggcgaccgagttcatcaagtcgtgctgcggcggctgcttttacggggaaacagagaagcataactttagtgtcgagcgagacttcaaagccgcagtgccaaattcccagaatgctaccatctcagtcccccccctgacctcggtttccgtaaagcctcaactcgggtgcaccgaggactaccttttaagcaagctaccctcggatgggaaggaggttccatttgtcgtgccaaagttcaaactctcctacatacagccgcggacccaagaaacccctagccatctggaggaacttgaaggttctgcacgcgcttcttttggagacagaaaagtcgagcttagcagctcttctcagcatggtccatcatatgacgtgtataatcctttctatatgtatcagcacatcagccccgatctgtctaggcgatttccccctaggagtgaagtgaaaagactgtacggctcggtctgtgatctccgaaccaataagctgcctgggagtcctggcctctccaagtccatgtttgacttgacgaacagtagccaacggttcattcaacggcatgatagcttatctagtgtgcctagttcttcatcttctcgaaagaattcacagggctccaatagaagcctggacactatcactctatccggcgacgagagagattttgggagactcaatgtcaagctgttctacaattcctcagttgaacagatatggatcaccgtcctgcaatgcagagatcttagctggccttcgagttatggcgataccccaaccgtgagtattaagggcattctaaccctgcccaagccggtgcacttcaagtcttcggctaaagaagggagcaatgtgtgtcatgccgaactcgagctgggaacttgcttccaagctgtaaacagtcgcattcagcttcaaattctcgaggcaaggtatctcccatctagtagtacgcccctcactctgtccttcttcgtgaaagtggggatgttctcttccggggagctcatctataagaagaagacccgcctgttgaaagcatccaatggacgggtaaaatggggagagaccatgatttttccgttaatacagagcgagaaggagatagtattccttattaagctgtactcaaggtcgtctgtgcggcgtaaacatttcgtgggccagatttggatttctgaggacagcaataacatcgaagccgtgaatcagtggaaagagactgtgatcaaccccgagaaggttgttattcgttggcacaaactgaatcctagctag

SEQ ID NO: 13451 - DNA, 1767 bp, Artificial Sequence
  Description of Artificial Sequence: Synthetic coding sequence
atggacctcgaggaagccgaagagttcaaagagcggtgtactcaatgtgccgctgttagttggggtctcaccgatgaggggaagtactactgtaccagctgccacaacgtgaccgaaagataccaggaagttacaaacaccgatctgattcccaatactcagattaaagctctcaatcgcggactcaaaaaaaagaacaacacagagaaggggtgggattggtatgtgtgcgagggcttccagtacatcttataccagcaagccgaggccctcaagaacctgggggtgggaccagaactcaaaaacgatgtcctccacaacttttggaagcgatacctgcagaagtccaaacaggcgtactgtaagaacccagtgtacactacaggccgaaagcccactgtccttgaggataacctgtcccatagtgattgggcctccgagccggagctgctgtcagatgtgtcgtgccctcccttcttggagtcaggggcagaatcccagagcgacattcacacacgcaaaccttttccggtatcaaaggcctcacagagcgagacctccgtgtgttccggttccctcgacggggtggaatactctcaacgaaaggaaaaaggaattgtcaagatgaccatgccgcagacgcttgcgttctgttatctgagccttctgtggcagcgagaggctattactcttagcgacttgctgcggttcgtcgaggaggaccacattccctacatcaatgccttccaacactttccagaacaaatgaagctctatggccgggatagaggcatctttggcatagagtcatggccagactatgaggatatttataagaaaaccgtagaagtcggcactttcctggacttgcccagatttccagatatcaccgaagattgttatctgcatcccaatatactgtgcatgaaatatctgatggaggtgaacttaccagatgagatgcactccctcacatgccatgtggttaagatgaccggcatgggagaagtcgatttcctgaccttcgatcctattgccaaaatggcaaaaaccgtgaaatacgatgtacaggccgtggcgatcatcgtggtggtcctgaaactgctatttctactggacgacagttttgagtggagcctttctaacctagcagagaagcacaatgagaaaaacaagaaggacaagccttggttcgactttagaaagtggtatcagatcatgaaaaaggccttcgatgagaagaagcaaaagtgggaggaggctcgcgctaagtatctctggaagtccgagaaacccctgtactacagctttgtggacaaacctgtggcttacaagaaacgagaaatggtcgtgaatctgcagaaacaattcagcacactggttgagtccacagctacagctggtaagaagagtccttcctctttccagtttaactggactgaagaggatactgataggacctgtttccatggccattcactccagggggtgctgaaggagaaggggcagtcactgctgactaaaaactccctgtactggctaagtacccagaagttttgccgctgttactgcacccacgtcacaacctatgaggagtcgaattactcactgtcatatcaatttattctaaacctattttctttccttttgcggattaagacatcccttctccacgaggaggtctcactcgtggagaaaaagctgttcgagaaaaaatacagcgtaaaacgcaagaaatccagatcgaagaaagtgaggcgccactag

SEQ ID NO: 13452 - DNA, 1002 bp, Artificial Sequence
  Description of Artificial Sequence: Synthetic coding sequence
atgaagctatacggcagggacagaggaatcttcggaatagagtcgtggcccgactacgaagatatctacaagaagaccgtggaggtcggcacattcctagacctccccagattcccagatatcaccgaggactgttatctgcaccctaacatcttatgcatgaaatacctgatggaagtcaatctgccagacgaaatgcactccctgacctgccatgtcgtaaagatgaccggcatgggagaggtggactttctcacctttgacccaatcgctaaaatggctaaaacagtgaaatatgacgtgcaggccgtggcaataattgtcgtggtgttgaagctgctctttcttctagatgacagctttgaatggtctctgtctaacctagcggaaaaacataacgagaagaataaaaaagataagccatggttcgatttccgaaagtggtatcagatcatgaaaaaggccttcgatgaaaaaaaacagaaatgggaagaagcaagggcaaagtatctgtggaaatccgagaaacccctctactactctttcgttgataagccagtggcctacaagaagagagagatggttgtgaacctgcagaagcagttctcaacactcgtggagtcgacggctacggcaggcaaaaagtcaccaagctcctttcagttcaactggacagaggaagatactgaccgcacttgtttccacggccatagcctccagggcgtgctgaaagaaaaaggccagtctctcttgactaaaaacagtttgtattggttgtctacccagaagttctgtaggtgttattgcacacacgtcactacctacgaggaatctaactattcactgtcctaccagttcatccttaacctgttctccttccttctacgcattaagacttcactactacacgaggaggtcagtctggttgagaagaaactcttcgagaagaaatactctgtgaagcgcaagaagagccgcagcaagaaagtgagaagacactag

SEQ ID NO: 13453 - DNA, 894 bp, Artificial Sequence
  Description of Artificial Sequence: Synthetic coding sequence
atgtcgaggtttaaattcatagacatcggaatcaacctgaccgatcctatgttccgcgggatctacagaggtgtgcagaaacatcaggacgacttgcaggacgtaattggaagagccgtggagataggcgtgaagaagtttatgatcaccggaggtaacctgcaggacagtaaggacgctctgcacctcgcgcagactaacgggatgtttttctctaccgtgggatgtcacccgactcgttgcggagagtttgagaagaacaacccagatctgtacctaaaagagcttctgaacctggccgaaaacaataaggggaaggtggtggctatcggggaatgcggactcgacttcgataggcttcagttttgtcctaaggatacacaacttaagtactttgaaaaacagtttgaactctccgaacagacaaaattacccatgtttctgcactgtaggaattctcatgctgaattccttgatataatgaagaggaaccgcgaccgatgcgttgggggcgtggtccactcattcgatgggaccaaggaagcggccgctgccctcatcgacctggatctctacataggttttaacggatgctctttgaaaaccgaagctaacctggaggttctaaagtctataccgtccgagaaactgatgatcgagaccgacgccccttggtgcggggtaaagtccacgcacgccggatcgaagtatatcagaacagcctttcctaccaaaaagaagtgggagtcagggcactgcttgaaggacagaaacgaaccctgccatataatacaaatcctggagatcatgtcggcagttcgagacgaagatccactggagctggccaacacattgtataataatacaatcaaggtcttcttccctggcatttag

SEQ ID NO: 13454 - DNA, 753 bp, Artificial Sequence
  Description of Artificial Sequence: Synthetic coding sequence
atgatcaccggaggaaatctgcaggacagcaaggatgctctgcatttagcgcagactaacggcatgttcttcagcactgtgggatgccatcccaccagatgtggagagttcgagaaaaacaacccggatctctacttgaaagagcttctgaatctagctgagaataacaaggggaaagttgtcgcaataggtgaatgtggccttgacttcgatcgcctgcagttctgtcccaaggacactcaactgaagtattttgaaaagcagtttgagctatccgagcagaccaagctgcctatgtttttgcattgccgaaatagccacgccgaatttctggacataatgaaacgtaatcgggatcgttgtgtggggggagtggtccactcttttgacggtactaaagaggccgctgcagccttgatcgacctcgacctgtatattgggtttaatggctgtagcctcaagacagaagctaaccttgaagttcttaagtctattcctagcgaaaagttgatgatcgagaccgacgcaccatggtgcggcgtgaaatccacacatgccggaagtaagtatattagaaccgctttccccaccaagaaaaaatgggagtccggccactgtctcaaggatcgcaatgagccctgtcacataatccagattttggagattatgtctgccgtacgggatgaagatcctttagaactcgccaatacactgtacaacaataccatcaaggtattcttccccggcatttag

SEQ ID NO: 13455 - DNA, 333 bp, Artificial Sequence
  Description of Artificial Sequence: Synthetic coding sequence
atgatcacaggcgggaaccttcaggactctaaagacgcattacaccttgcccagaccaacggaatgtttttctccacggtgggttgccacccgacccggtgcggcgaattcgagaaaaacaaccccgatctctacctgaaggagttacttaacttggcggaaaacaacaagggcaaagtcgtcgccattggcgagtgcggcctggacttcgatagattgcagttttgccctaaagacactcaactgaagtattttgagaagcagtttgaactgtcagagcaaacgaagctgccaatgtttttacactgtcgcaattcacatgccgaattctag

SEQ ID NO: 13456 - DNA, 2286 bp, Artificial Sequence
  Description of Artificial Sequence: Synthetic coding sequence
atggcaagtgagcggggcaaagtgaagcataattggtcatccaccagcgagggctgtcctagaaaacggtcgtgccttagggagccgtgtgacgttgcgccaagtagtaggcccgcccagagaagcgcttcacgctccggagggcctagctcacccaagcgtctgaaagctcaaaaagaggacgacgtggcatgctcccgacgactcagttgggggtcttcgaggcggcggaacaacagttcctccagcttctccccccacttcttaggacccggtgtgggaggggctgcatctaagggctgcctgatcagaaataccaggggttttctcagcagcggcggaagccctctccgacctgccaacgctagcctcgaggagatggcgtccttggaagaggaagcttgttccctgaaagtggacagcaaggactccagccacaacagcactaactcagaatttgctgcagaggccgaaggacaaaatgacaccattgaagagcccaacaaagtgcagaagcgaaagcgggacaggctgagagatcagggctccaccatgatatatctgaaggcgatccagggcatcctcggtaaatctatgcccaaacgcaagggcgaggccgccacaagagctaaaccttccgctgccgaacatcctagccacggagagggacctgcgcggagcgagggtcccgccaagaccgctgaaggggcggctagatcagtcaccgtgacagcagcacagaaagagaaggatgcgaccccagaggtcagtatggaggaggataaaaccgtcccagagaggagttctttttatgatagacgggtcgttatcgatccgcaggagaaaccctcagaggaaccgctgggagaccggcgcaccgtgatagataagtgttccccacctttggagtttctggatgactctgatagccacctggagatacagaaacacaaggacagggaagtggttatggagcatcccagttccggttccgattggtcagatgtggaggaaatttctaccgtccggttttcccaggaagagccggtctcacttaagccatccgccgtccccgagcccagttcatttaccactgactacgtaatgtacccaccccacttgtactcctctccatggtgtgattatgcctcttattggactagttccccaaagccgagctcctacccatctaccggctcatcatccaatgacgccgcacaggtgggcaaatcctccaggagtagaatgagtgactacagccccaactctaccggcagtgtgcagaataccagccgtgatatggaggcaagcgaggaagggtggagccaaaattcccgctctttcaggttcagccgatcgtccgaggaaagagaagtgaaagaaaagagaacattccaagaggaaatgccccctcggccatgcgggggccatgcatctagctccctgccaaagagccacttagaaccgtcgctggaagagggctttattgacactcattgccacctcgatatgctgtatagcaagctgtctttccaggggacctttacgaaatttcgcaaaatctatagttcttctttcccaaaggagttccaggggtgtatatccgatttctgcgatccgcgtaccttgactgactgtttatgggaggagctgctgaaggaagatctggtatggggcgcgtttggatgccaccctcactttgcccggtactactccgagagtcaggaacggaacctgcttcaagccctgcgccacccaaaggccgtggcatttggagagatggggcttgactattcttataaatgcaccaccccagtccccgaacaacataaagtgtttgaaaggcagttgcaacttgcagtttccttgaagaaaccactggtgatccattgtcgggaggccgatgaggaccttctggagattatgaagaaatttgttccaccggattacaagattcacagacattgtttcactgggtcttatcctgtcatcgaacccctacttaagtattttcccaacatgtccgtgggctttacagccgtccttacttactcttctgcgtgggaggctcgagaggcgctgagacagatcccgctggaaaggatcattgtggagaccgacgcaccttacttcctacctcggcaggtgccaaagtctctgtgccagtacgcacatccgggccttgcactccacactgttagggaaattgccagagtgaaggaccagcccctgtcactgactctggcggccctgcgtgagaatacaagcagactgtactctctgtag

SEQ ID NO: 13457 - DNA, 2286 bp, Artificial Sequence
  Description of Artificial Sequence: Synthetic coding sequence
atggccagtgagagaggaaaagtaaagcacaattggtcatccacctctgaggggtgtcccaggaagaggagctgtttgagggagccttgtgacgtggcgccaagcagccggcccgcccaacgctctgcttcgcgctcaggcggaccgagcagtcccaagagactcaaggcccagaaagaggacgacgtggcttgctcccgcaggctatcatggggctctagtagacgtcgtaataattcttcctcgtcattcagtccccacttcctgggcccaggagtcggcggcgccgctagtaaaggctgtctgatcaggaacactcgggggttcctgagcagcgggggatctcctttgcgacccgccaacgcctcactggaggagatggcctctctcgaagaggaagcttgctcgttaaaagtagatagcaaagactccagtcataattcaaccaactcagagttcgccgccgaagccgagggacaaaatgatacaattgaggagcctaacaaagtacagaagaggaagagagaccgtttaagagaccagggatcaactatgatttatctgaaagctatccaaggaattctgggtaaatccatgccaaagcgcaagggtgaagctgcaaccagagcaaaaccatccgcagctgaacatccaagccacggtgagggccctgccaggtccgagggcccagctaagacggctgaaggcgcagcgcgatccgtcactgtgactgctgcgcaaaaagaaaaggacgcaacccccgaggtatctatggaagaagataagaccgtgcctgagcgctcctctttttatgacagaagagtcgtcatcgacccccaagagaaacccagcgaggagccattgggcgacagacggactgtaatcgacaagtgttctccaccgctggaattcctcgacgacagtgactcccaccttgaaatccaaaagcacaaagaccgggaagtagtcatggagcatccatcatccgggagcgactggagcgatgtggaagaaatatcaaccgtgcgttttagtcaggaggagccagtgagcttgaagccctccgcagttcctgagccctccagctttacgactgactatgttatgtatccccctcatctctactcatccccatggtgcgattacgcttcatactggacaagttcccccaaaccttcttcctacccttccaccggttcctcctccaatgacgctgcacaggtcggaaaaagcagcagaagtaggatgtcagattactcccccaattcaacgggctcagtgcagaacacgtccagggacatggaggcgagtgaagaggggtggagtcagaatagcaggtccttccgcttcagtcgctcctctgaagagcgcgaggttaaagagaagcgaaccttccaagaggaaatgcctcctaggccctgtggtggccacgcttccagctccctgcctaaatcccacttagaacctagtctggaagagggatttattgacactcattgtcacctcgacatgttgtattccaaactgagctttcagggaacatttaccaaatttaggaagatctacagctcatctttcccaaaggagtttcaaggatgtattagtgatttttgtgatccaaggacattaaccgattgcctctgggaagaattgctgaaggaagatctagtgtggggagcctttgggtgtcatccccacttcgctaggtactacagtgaaagccaggagcggaatctactgcaggccttgagacacccaaaagcggtggcctttggcgaaatgggcctggattactcctacaagtgcaccacaccagtgcccgagcagcataaagttttcgagcgccaacttcaactggctgtttccctgaagaagcctcttgttattcactgcagggaggccgatgaagatctgctggagatcatgaaaaaattcgtccctcctgactataagattcacagacactgttttacagggtcttaccccgtgatcgagccattgttgaagtactttccgaatatgtcagtcggcttcaccgctgtccttacctattccagcgcatgggaggcgcgcgaggcactgcgccagatccccctcgagaggatcatcgtggagacagacgccccctacttcctgccacgacaggtgcccaaatcactgtgtcaatatgctcacccagggctcgctttgcacaccgtgcgcgaaatcgcccgggtcaaagatcaacccctgtctttgaccctggctgcgcttcgagagaacaccagcaggttgtattcactctag

SEQ ID NO: 13458 - DNA, 822 bp, Artificial Sequence
  Description of Artificial Sequence: Synthetic coding sequence
atgagggcagcaggcgtgggactagtcgattgtcactgccacttaagcgcccccgattttgaccgagacctcgatgacgtcttagagaaggctaaaaaggccaacgttgtggccctggttgctgtggccgagcattccggagagttcgagaaaatcatgcagctgtcagagcgctacaacgggtttgttcttccctgcctgggggttcaccccgttcaggggttgcctcccgaagatcagcggtctgtgaccttaaaggacctggatgtcgcattgccaatcatcgagaactacaaagaccggctgcttgcaattggagaagttggactggacttcagccctaggttcgccgggaccggagaacagaaagaagagcagaggcaggtgctcattcgccagatccagctggcgaaacgcctcaatctccctgtaaacgtacattcccgctccgctggccggcccacaattaacttgctgcaagaacaaggagcggagaaggtgctgctacacgcctttgatggccgcccatctgttgccatggagggtgtgcgggccgggtacttcttctcaattcctccttccattattcgtagcggccagcagaagttggtgaaacagctccctctgacctctatttgtcttgaaaccgactctcctgcgctaggcccagagaagcaggtgcgcaacgaaccgtggaatatcagcatcagcgccgaatatatcgcccaagtaaaaggcatctctgtcgaagaggtgatagaggtaactacacagaacgcactgaagctctttccaaaactgagacatcttcttcaaaaatag

SEQ ID NO: 13459 - DNA, 825 bp, Artificial Sequence
  Description of Artificial Sequence: Synthetic coding sequence
atgcgggccgcaggagtcggactggtcgattgtcattgtcacctctcggcaccagattttgaccgagatctggacgacgtccttgaaaaagcaaagaaagctaacgtcgtcgcccttgtggctgtagcagaacatagtggcgaatttgagaagatcatgcagctctcggagcgttataatggctttgtgttaccatgtctgggagtccatccagtgcaaggactgcctcccgaagatcagaggtcagtgaccctgaaagatctcgatgtggccctacctatcattgagaattataaagacaggctcctggcaatcggcgaggtgggactcgacttttcacctaggtttgcagggacaggagagcaaaaagaggaacaaagacaggtattgattaggcagatccagctggcgaagcgtctgaacctgcccgttaatgtacactcccggtctgctggtcgacctacaatcaatctgctccaggagcaaggcgctgaaaaagtactactgcatgctttcgacgggagaccaagcgtggccatggaaggagtccgtgctggatatttctttagcattccaccaagtattattaggtctggtcagaagcagaagctggtaaagcaactgcccctgacttccatatgcctggagacagattcccctgccttgggtccagagaaacaagtacgcaacgaaccatggaacatcagcatatccgccgaatacattgcgcaggtgaaggggatatctgtggaggaggtgatagaggtcacaacccagaacgccctcaaattattccctaagctccggcacttgctgcagaagtag

SEQ ID NO: 13460 - DNA, 762 bp, Artificial Sequence
  Description of Artificial Sequence: Synthetic coding sequence
atgcgcgcagccggcgtcggtctggtagattgtcattgtcatttgtctgcgccagactttgaccgtgatctagacgacgttctcgaaaaggctaagaaagctaatgtggtagccctggtggccgtggctgagcattccggggagtttgaaaagattatgcaactgtctgagcggtacaacggtttcgtgttgccctgcctcggcgtccatcctgtgcagggcctcccacccgaggatcagcgcagtgtaaccctgaaagtagggctggacttttctccacggttcgctggtaccggagagcagaaggaggaacaaaggcaggttctgattcgccagatccagctggctaagagacttaacctgcccgttaacgtccacagccggagcgccgggagacccactataaacctccttcaggagcagggggccgaaaaggttttactgcatgcattcgacggccgcccaagtgtggctatggagggggttcgcgctggatatttcttttctatcccgccgagtatcattaggagtggacagaagcagaaactggtcaagcaactgccactcactagcatttgcctggaaaccgattcacccgcgttgggaccagaaaagcaggtgagaaacgagccatggaacatcagcattagcgcagagtacattgctcaggtcaaaggcatttctgtcgaggaggttatcgaggttaccacccagaacgctctgaagctgtttccaaagctccgccaccttctccagaaatag

SEQ ID NO: 13461 - DNA, 723 bp, Artificial Sequence
  Description of Artificial Sequence: Synthetic coding sequence
atgcgggcagccggtgtgggcttggtggactgccattgtcacctgagcgcacctgactttgaccgtgatttggacgacgtgctggaaaaggccaaaaaggccaatgtcgtggctctcgtagcagtggccgaacactccggagaattcgagaagattatgcagttgtcagagcggtataacgggtttgtattgccttgcctgggagtccaccctgtgcaaggcctccccccagaggaccagaggagcgtcaccctaaaagacctcgacgtggctctgccgatcattgagaactataaggaccgactgctcgcgataggagaagtcgggctggactttagccctcgatttgcagggaccggggagcagaaggaagagcaaagacaggtccttattcgccagattcaactggccaagcgcttaaatctccccgttaatgtccactcgagatcggcagggcgaccaacaatcaacctgctgcaggagcagggagcggaaaaggtcctgctccatgcatttgatggtcgtccctccgtcgccatggaaggagtacgggccggctacttcttctctatccctccaagtatcattcgcagtggccagcttctgtcactgttctcaaagaaacaaaagctggtcaagcagcttcccctaactagcatctgcctcgaaaccgacagccccgctttgggccctgagaagcaacagaatatcttaccccgctag

SEQ ID NO: 13462 - DNA, 846 bp, Artificial Sequence
  Description of Artificial Sequence: Synthetic coding sequence
atgcgagccgcaggcgttggattggtggactgccactgtcatctctccgcacccgactttgacagggacctggacgacgtgctagaaaaagctaaaaaggccaatgtggtcgccctcgtcgcagtggccgagcatagcggggaattcgagaaaatcatgcagctgtccgagagatacaacggctttgtcctcccatgcttaggtgtgcacccagtgcagggattgcctccagaggatcagaggagtgtcacacttaaggatctagacgtagcgctgccgatcattgagaactataaagatagacttctagcaattggagaggttggtctggacttcagtccccgctttgctggtaccggagaacagaaagaagaacaacgccaggttctgatcagacaaatccagctcgctaagaggctgaatttaccagttaacgtgcacagccgatccgccgggagaccgaccattaaccttctccaagagcagggggccgagaaggtgctgttgcatgcctttgatgggcgcccctccgtcgccatggaaggagtccgggctggttatttctttagcataccacctagcattattcggtccgggcagcttttgagtcttttcagcaaaaagcagaaacttgtaaaacagcttccactcacatcaatctgcctggagacagattcacctgcccttggccctgagaagcaggtacggaacgagccttggaacatctctatcagcgctgagtacattgcacaggttaaaggcatctctgtggaggaggtgattgaggtcacaacccaaaacgccctgaagctatttccaaaactgcggcacctgctccagaagtag

SEQ ID NO: 13463 - DNA, 1824 bp, Artificial Sequence
  Description of Artificial Sequence: Synthetic coding sequence
atggctgagaaaagacggggcagcccctgctccatgctctctcttaaggctcatgccttttctgtggaggctttaatcggtgccgagaaacagcagcaactccagaagaaacggcgcaaattaggtgcagaagaagcggccggtgctgtggacgacggaggttgtagtcgtggcgggggagcgggtgaaaagggctcaagtgagggagacgaaggagctgcactaccacctccagccggggcaacatctgggccagcccgatccggagccgaccttgagaggggtgcagctggtgggtgcgaggatggattccagcagggcgcatctcccctggcctccccaggagggagccctaagggcagcccggcacggtccttggcgcggcccggcacccctctccccagccctcaggcccctcgcgttgacctgcagggcgcagagttgtggaaaagattccacgaaattgggacggagatgattattacaaaagccggacgccggatgttccctgcaatgcgagtgaagatttcaggactcgacccacaccagcaatactatatcgctatggacatagtgccagttgataacaaacggtaccgctatgtataccattcctctaaatggatggtcgcaggcaacgctgatagtcctgtgccacccagagtgtacatacatccagattcccccgcttctggggagacatggatgcggcaagtcatctcattcgataaattaaagttaacaaataacgaacttgatgatcagggccacatcattttacatagtatgcataaataccagccacgggtacacgttatccgaaaggactgtggagatgacctgagccccatcaagccagtgccctctggcgaaggggttaaagctttcagcttccctgaaacagtgtttaccacggtgacagcgtaccagaaccagcagatcaccagactaaagatagaccggaaccctttcgcgaagggattccgcgattccggcaggaatcgtatgggcctagaggccctcgtagagtcttacgcattctggcgtccgagtctgcggaccctgaccttcgaggacattcctggcatccccaaacagggaaatgcatcatcttcaacacttctgcaggggacaggaaatggcgtgcccgcaactcacccgcacctgttgagtggctcctcctgctcttccccagcctttcatctgggaccaaatacgagtcaattgtgtagcctggcacctgccgattattcagcttgtgcccggagcggactcaccctcaacagatacagcacctctcttgcagagacctacaatagactaactaaccaggccggagagacattcgccccacctaggaccccttcatacgtcggtgtgagttcctccacctctgtcaacatgtccatgggagggacggacggggatacattttcatgccctcagacaagcctgagcatgcagatttctggtatgagtcctcaactgcagtatataatgccgtccccatctagcaatgcctttgccaccaaccagactcatcagggcagttacaacaccttccgacttcatagtccatgtgccctttatgggtacaactttagcacaagcccgaaactcgctgcatctcccgaaaagattgtcagttcccagggtagcttcctcggatcaagtccatcaggaaccatgaccgacagacagatgttgcccccagttgagggagtccacctgcttagtagcggcggccagcagtcttttttcgacagccggacgttgggttctctcactctctcttcctctcaagtgagtgcccatatggtctag

SEQ ID NO: 13464 - DNA, 918 bp, Artificial Sequence
  Description of Artificial Sequence: Synthetic coding sequence
cgcgggcgccatatctggaagctcggttttcccaaaggagggtgtgaagacgggtttcagcagggtgcatcccctttagcaagcccagggggatctccaaaggggagccctgctcggtctctggctagacccggaacccccctgcctagcccccaggcccctagagttgaccttcagggggccgagctatggaagcggtttcacgagattggaacggagatgatcattactaaggctgggcgtcggatgttcccggccatgagagttaagatctctggactagaccctcaccagcagtactacatcgctatggacatcgtgcccgtcgacaacaaacggtaccgatacgtgtatcattcctctaaatggatggtggcaggtaatgcggacagccccgtgccgccccgagtttatatccaccctgattcacccgcgagtggcgaaacgtggatgcggcaggtaatatccttcgataaactgaagctgacgaataatgagttagatgatcagggacacattatcctgcactcgatgcacaaatatcagcctcgggtgcatgtgatccgaaaagattgcggagacgatcttagtcctataaaacccgtgccatctggtgagggcgtgaaggcttttagtttccctgaaacagtgttcacaaccgtcactgcctaccagaaccagcagattacaagactaaagattgaccgcaatccttttgctaagggatttagagactctgggcgaaataggatgggcctggaggctctggtggaatcctatgccttctggcgcccgtctttaagaactctaactttcgaggacatccccggcattccaaagcaggaatacagggacctgaaaacggactatatctttccagaaagagataacctcgtgtcccgtgagaccaaactgtag

SEQ ID NO: 13465 - DNA, 2049 bp, Artificial Sequence
  Description of Artificial Sequence: Synthetic coding sequence
atgcagctcgaacactgcctgagtcctagcatcatgttatcaaagaaatttttaaacgtctcctcttcttacccccactcaggcggatcagagctagtccttcacgaccatccgattatttctactactgataatctggagcgttcttcacccctgaaaaagatcacacggggaatgactaaccagagtgatactgacaattttcccgactcgaaagattctccgggagatgttcagaggtctaagctgtctcccgtgctggatggcgttagcgaactccgccacagctttgatgggagtgccgcagatcggtatttgctatcacagagcagccaaccccagtccgccgccaccgcaccttccgcaatgttcccgtaccctggtcagcatggacctgcccaccccgccttttccatcgggagtcccagccgctatatggcccatcatcccgtgatcacaaacggtgcctataacagcctgctgtctaactcaagcccacagggctatccaaccgcaggatatccctatccccagcagtatggccactcatatcagggcgccccattctatcagttctcttccacgcagccaggcctggtgccagggaaagcccaggtgtacctctgtaaccgacccctctggttgaaattccataggcatcagacagagatgattataaccaaacaggggaggcgtatgtttcccttcctgtccttcaatatcagcggcctcgatcccacggctcattataatatcttcgttgatgtcatactcgcagaccccaaccactggaggttccagggaggcaagtgggtgccttgtggcaaggccgacaccaatgtgcaggggaaccgcgtatacatgcatcctgacagcccaaataccggagcccactggatgagacaggagatctccttcggaaaactgaagttaaccaacaataaaggggcttccaacaacaatggacaaatggtcgttttgcaatccctgcataagtatcagcctcggctacacgttgtcgaggtcaacgaggacggtaccgaagatacgagccagccgggcagagttcaaactttcacttttcccgaaacgcaattcattgctgtcacagcatatcagaacactgatattacacaactgaagatcgatcataatccatttgcgaaagggtttcgcgacaactacgacactatctacaccggatgcgacatggaccgcctcaccccttcacccaatgacagccccagatctcagattgtccctggagcccggtatgcaatggcaggcagcttcctgcaggatcagttcgtctctaactacgcaaaggcacggttccatcccggcgcgggggcaggacctggtcctggcacagaccgcagcgtcccacatacaaacggactgttaagcccacagcaagcagaagaccctggggctcccagtccgcaacgctggtttgtcacccctgccaacaaccggctcgattttgcggccagtgcctacgacacagcaactgactttgccggcaacgccgccactttgctgagttatgccgctgctggcgtgaaggcactgcctctgcaggctgccggttgcaccgggagacccctgggctactatgccgatccatccggctggggagcaaggtcgcccccacagtactgcggtaccaagtctgggtccgtcctgccttgctggccgaacagcgcagcggccgctgccaggatggcaggggcaaatccgtacttgggtgaggaagcagaaggactggcggcggagaggagtcccctgcccccaggagcagcagaagatgctaagcccaaggacctctcagacagcagttggattgagaccccttccagcatcaaaagtattgacagcagcgacagtggcatatacgagcaggccaaacgccggagaatttctcccgccgacactcccgtatccgagtccagttcccccctcaagtccgaagtgttggcacaacgggactgtgaaaagaattgtgccaaagatatttccggatactatggcttttattcgcacagttag

SEQ ID NO: 13466 - DNA, 1188 bp, Artificial Sequence
  Description of Artificial Sequence: Synthetic coding sequence
atgcatcccgacagcccgaataccggagctcactggatgcggcaggaaatcagctttggaaaactgaagcttaccaataacaaaggagcgtcaaacaacaacggtcagatggtggtcctgcagtctctgcataaataccagccgagactgcatgtcgtggaggtaaacgaagatggcaccgaggataccagtcagcccggccgggtgcagaccttcaccttcccagaaacccagttcatcgccgttactgcctatcaaaacacagacattacacaactgaaaattgaccacaatccctttgctaaagggtttcgtgataactatgacactatttatacaggatgtgatatggatagactgaccccaagtcctaatgactcacctcgctcacaaatcgtgccaggggcccgctacgccatggccggctcttttctgcaagaccagtttgtctccaactacgccaaggccagattccacccgggcgcaggagccggaccaggtcccggaacagaccgtagcgtgcctcatacgaatgggctgttaagtcctcagcaggcagaagatccaggcgccccatctccacagcgctggtttgtgactccggctaataacagacttgattttgccgcaagcgcttatgataccgctactgatttcgcaggaaacgctgccacgctgttgagttatgcagccgcaggggttaaggctctgccactccaggctgccgggtgtactgggcgaccgttgggatattacgctgatcctagtgggtggggcgccagaagtccaccccagtattgcggcaccaagtctggttctgtgttgccttgctggcctaacagcgcggctgccgctgctagaatggctggagccaacccctacctgggagaagaggcagaaggcttggcagccgagcggtcaccgcttccgcccggggctgccgaggacgccaaacccaaggatctctccgatagctcctggattgagacacctagctcgattaaatctattgacagcagcgactctggaatctacgagcaagcaaaaagaaggcgaattagcccagccgatacacccgtttccgaatcatcctccccactgaagtctgaagtactagctcagcgtgattgcgaaaagaactgtgcgaaagatattagcgggtattacggattttatagccactcttag

SEQ ID NO: 13467 - DNA, 1056 bp, Artificial Sequence
  Description of Artificial Sequence: Synthetic coding sequence
atgcaccccgactccccaaacactggagcccattggatgcggcaggaaatctcattcgggaagctaaaactaacaaacaataaaggtgcctcgaataataacggtcagatggtggtgcttcagtctcttcacaagtaccagcctaggctgcacgtggtggaagtgaacgaagacggaaccgaagacacctctcagccaggaagggttcagactttcacttttccagagacccaattcattgccgtcacagcataccagaataccgatatcacccaactcaagattgaccataaccccttcgccaagggtttccgggacaactacgacaccatttatactggatgtgacatggatagagccggacctgggcctggcacggatagaagcgtccctcacactaacggactgttatccccccagcaggcggaggaccccggggcaccaagcccccagaggtggtttgtgacacctgctaacaatcgcctggacttcgccgcctcggcatacgacacagcaacagacttcgccggtaatgccgcaacgctgttgtcttatgctgccgcaggggtaaaggcacttcctctgcaggctgctggctgcacggggagaccattaggctactacgccgatcccagtggttggggagccaggtcccctccccagtattgtgggacgaaaagcgggtccgttctgccctgctggcccaacagcgcagccgcggccgctcgaatggcaggggccaacccgtatcttggcgaagaggccgaaggactggcagccgagagatcccccctacctcctggtgctgcagaagatgccaagccgaaggacctgtcagatagcagctggatcgagacaccaagctctatcaaatccatagactccagcgactctggaatctatgagcaggcaaagcggcgtcggattagccctgccgacacacccgtttcagaatctagctctcctctcaaaagtgaagtcctcgctcagcgggactgcgagaagaattgtgcaaaggacattagtggttactacggcttttactcgcacagttag

SEQ ID NO: 13468 - DNA, 2739 bp, Artificial Sequence
  Description of Artificial Sequence: Synthetic coding sequence
atgtctctacccattgggtctgccgaagtagcgtccgagcgagtcgagctatggagatcaggcttcagatggtggcagaggtgcctgtgcttttgtaggtaccgtagggtcgcaatggcagcagtggatagcgacgtcgagtcccttcccagaggcgggttccggtgctgtttatgccatgtcacaactgctaaccgccccagtcttgacgcgcatctgggaggcaggaaacaccgacacttggtggagctgcgggcggcgaggaaagcccaaggactacggtctgtgttcgtcagcgggtttcctagggacgttgactcagcccagctgtctgaatactttctcgctttcggtcccgtcgcatcagtagtgatggacaaagataagggcgtgtttgccatcgttgaaatgggagatgtgggcgctcgtgaggctgttctctctcagtcccagcacagcttggggggccacagactcagagtgcggcctcgggagcaaaaagagtttcaaagtcccgcgtcaaagagtcccaagggggctgcgcctgactcccatcaactcgcaaaagcccttgcggaagccgccgacgtgggtgcccagatgattaagttagtgggtcttcgggagctaagtgaggctgagcggcaactcaggtctctcgtggtcgcgctgatgcaagaggtgtttacggagtttttccccggctgcgtggttcacccttttgggtcttctataaattcattcgacgtgcatgggtgtgacctcgacctgttcttggacctgggcgacctagaggaaccccagcccgttccaaaagcccccgagtctccgagtctcgacagtgcactagcctccccgcttgacccacaggctcttgcatgcacccccgcaagtccgccagactcacagccacctgctagccctcaggacagcgaagccctcgacttcgagacaccttcgtccagcctggcacctcagacccctgacagtgccctggcttcagaaactcttgcttcaccgcagtctctgccccctgctagccccctgctggaggaccgagaggaaggagatctgggcaaagcatcagaactggcagagactcccaaggaagagaaagctgaaggtgccgctatgttggagctcgttggctcaatcctgcgagggtgcgtccccggcgtctatagggtccagaccgtcccttccgcccgcaggcccgtggtgaaattttgtcataggccaagtggcctgcacggagacgttagcctgtctaatcgcctcgctctccataatagtaggtttctgagcttgtgctcggaacttgacggcagagtgcgcccattagtatacaccctccgctgttgggctcaaggccgtggattgtctggttcggggcctctcctgtccaattatgcacttaccctgcttgtgatttactttcttcaaacaagagatccgccagtcttgccaaccgtctcacagttgacccaaaaagctggggaaggggagcaggtagaggtggacggatgggactgtagttttccacgtgatgcaagccgattagagccgtccattaacgtggagcctctcagtagcttgctggcccagtttttctcttgtgtatcctgctgggacctgcgggggtctctgctgtccctccgcgagggtcaggcattacctgtggcagggggtctcccatctaatttgtgggagggcctacgtctcgggccactgaacctgcaggatccttttgacctgagccacaacgtggctgccaatgttacttctcgcgttgcaggaaggcttcagaactgctgcagggcggctgctaactactgcaggtccctgcaataccaacggcggagttctagaggacgcgactggggactgctgcccctactgcagcccagttctccctcctcattgctaagcgcaaccccaattccactgcccctggcgccatttactcagctgaccgccgccttggtgcaggttttcagagaagctcttggctgtcatatcgaacaggcaaccaaacgaacgcgctctgaagggggtgggaccggcgaaagcagccagggggggacgagcaaacgcctcaaggttgatggccagaagaactgctgcgaggagggtaaagaagagcagcagggctgcgccggagacggcggcgaggatcgggtggaggaaatggtaattgaagtgggggagatggtgcaggattgggccatgcaatcgcctgggcaacctggggacttgccactgaccaccggcaagcacggcgccccaggagaggaaggacagccttctcatgcagcattagcggagaggggccccaaaggtcatgaggcggcacaggaatggtctcagggggaggcaggcaagggggctagcttgcccagttctgcctcctggcggtgcgctttatggcatagagtctggcagggacggaggcgagcacgaaggcggctccaacaacagactaaggagggtgccggaggaggagcgggaacacgcgccgggtggctggctaccgaagctcaggttacacaagaacttaagggcctgtcgggaggtgaggaaagacccgagactgagcccctgctgagctttgtggcatccgtgtcacctgccgatcgcatgttaacagttacccccttacaggacccccaggggttgtttccggatctccaccactttctccaggtattcctcccacaggccatcagacatctgaaatag

SEQ ID NO: 13469 - DNA, 2625 bp, Artificial Sequence
  Description of Artificial Sequence: Synthetic coding sequence
atggccgccgtggacagtgatgtcgaaagtttaccgaggggaggctttcggtgctgtctttgtcacgtgacaacagcaaatcggccaagcctggatgcgcatctcggaggtcgcaagcatcgacacctcgttgagttgagagcggctcgtaaagcacaggggcttaggtctgtattcgtgagcggatttccacgagacgtggacagcgctcagctaagcgagtatttcctggcatttgggccggttgcctcagtcgtgatggataaggataagggggtatttgccattgtcgaaatgggcgatgttggagctcgcgaggctgtgctgtcccagtcacaacatagtttagggggccatcgtctgagagtcagaccgagggagcaaaaggaatttcagagtcctgcatctaagtcgcccaagggggcagcaccggattctcatcagctggctaaagccctcgccgaggctgctgatgttggggcccaaatgatcaaattggttggactgcgcgagctatctgaggccgaaaggcagctgaggtcactggtagtggccctcatgcaggaggtttttacggagtttttcccggggtgcgtagtccacccatttggctctagcatcaatagctttgatgtacacggctgtgacttggacctgtttcttgacctgggcgacctggaggagccgcagccagtgcctaaggcccccgaaagcccatcactcgattccgccctggcaagtccgctggaccctcaggctctggcgtgtactcccgcttctccccccgacagtcagccaccagcttctccccaggacagcgaagcactggatttcgaaaccccatcctcttcccttgcaccacagacacctgattccgcattggccagcgagactcttgcttctccccagtcccttccccccgcttccccattgttggaagaccgagaagagggggacctggggaaggcatccgaactcgcagagacaccgaaggaggaaaaggccgaaggagccgccatgctagaactggtgggtagcattctcagggggtgtgtccctggcgtgtatcgggttcagacagttccatccgctcgacgtcccgtcgttaagttctgccaccgccctagcggactgcacggtgatgtttccctgtccaaccggctggcacttcataattctcgctttttaagtctgtgttcagaattagacggcagagttagacctcttgtgtacacgctccgctgttgggcgcaagggagaggcctgagtggcagtggacctttgctgtctaattacgcactgaccctactggttatttattttttgcagaccagagaccccccggtcctgccaaccgtaagccaacttactcaaaaagctggcgaaggagaacaagtggaagtcgacgggtgggactgttccttcccacgagacgcctccagactcgagccaagtattaacgtggaaccattgtcaagcctactagctcagtttttttcttgtgtaagctgctgggatctgcggggctctttactgtctctgagagagggtcaggcattgcctgtggctggaggtcttccatccaatctgtgggagggcctgcgtttgggcccactcaacctgcaggacccattcgatctttctcacaatgtggctgcaaatgtgaccagccgtgtggccggacggctgcagaactgctgccgcgcagctgccaactattgtaggagcttgcagtatcagaggaggtctagccggggaagagattggggcctccttcctctgttgcaaccaagttccccgtcttccctcctctctgccacaccaattccgctccccctggctccctttacacaactgaccgccgctctcgtgcaagtgttccgtgaggctctcggttgccacatcgaacaggcaaccaaaagaacacgaagtgaggggggaggaacaggcgaatcttcacagggcggtacgtccaagagactgaaagtggacggccagaaaaattgctgcgaggaaggcaaagaagaacagcagggatgtgctggtgacgggggcgaggatagagtggaagaaatggtgattgaggtcggtgagatggtgcaggactgggcgatgcagagtccaggacagccaggagatttgcctcttactaccggtaagcatggagccccaggtgaggagggccagccctcccatgctgcactggcagagaggggtcccaagggccacgaggcagcacaagagtggtctcaaggtgaagccggcaagggcgcctcactgccgtcctcagcttcatggagatgcgccctgtggcaccgggtgtggcaggggcggcggcgggcgaggcgcagactccagcagcagaccaaagagggagctggcggcggcgctgggacccgggctggatggctcgcgactgaggcacaggttacacaggaacttaagggcctctcggggggggaagaacggcctgaaaccgaacccctgcttagttttgtggctagtgtgtcaccagcagacagaatgctcaccgtcactcctttacaggatccccaggggctgttccctgatctgcatcatttcctgcaagttttcctgcctcaggccattcgccacctcaagtag

SEQ ID NO: 13470 - DNA, 495 bp, Artificial Sequence
  Description of Artificial Sequence: Synthetic coding sequence
atgtgtcctccggttagcatgcgttacgaggaggaaggcatgtcttacttatatgcctcttggatgtaccaattacagcatggcgaccagcttagtatttgcttcacctgcttcaaggctgccttcttggactttaaggacctgctggagtcagaagactgggaggaggataactgggatccagagctgatggaacatactgaggccgaatccgagcaggaggggagcagtggcatggagctaagctgggggcagagccccgggcagcctgtacaggggggatcagaggcttgggggcccggcacactcgctgctgcacccgaaggcctggaagatgccggactggacccacactttgtgccaacagagttgtggccccaagaggctgtgccgctaggcctcggcctggaagatgcagactggactcagggccttccttggcgattcgaggagctgctgacgtgctctcactggcctagtttttttcccagttag

SEQ ID NO: 13471 - DNA, 1236 bp, Artificial Sequence
  Description of Artificial Sequence: Synthetic coding sequence
atgttgtccttaagagaacaacagctgcaggtatggtttaagaatcgtagagcgaagctcgcgagggagagacgtctgcaacaacagccacagagagtccccggacagaggggccgaggagccagggccgcccctctggtgcctgcagcctccgcttcagctccccagcgaggtcctagcgggatcctgcctgcagcagaaccaaccatctgcagtttgcaccaggcctggggtggaccgggatgccgggcccaaaaaggcatccccgctgccctttctccggggccgggcccgattccagcgcccattcctgggcccgcacagatccccggccctctgccagggtccatccctgggcccatcccaggcccggcacaaataccttcgcccattcccgccccgatacccggtcctatcagcggacccgtccagattcctggaccctttagaggacccataccgggacccatctctggtcccgcacccatccctggtcctatctcaggacctttcagcgggcctaacccgggaccaatacccgggccaaaccctggtccaattcctggcccaattagcggaccgatcccagggcccatctctgtacctatccccgggcccattcccggacctattagcgggccaataagcggtcccaatccagggcccattcccggtcccattccaggtcctatctcggggccaaaccccggaccaattcccggccccatcagcggaccaaatcctggacttatccctggccccattcctggtccaatctctggccccggccctatcattgggccaatccccagccctgcacagatcccgggccccgggcgtttgcaaggccctggtccgattctctcaccagggaggatgcgaagccctgggtccctgccaggtctggcccctattctgggccctggtagcggcccaggcagcggttccgttcccgctcccatccccggacccggctcactgccagcccctgcacccttatggccacagtcccctgatgcgtcagacttccttcctgacactcagttatttccccacttcacggaactgctcctccctttggaccctctggagggcagcagtgtctctacaatgactagccagtaccaggaaggggatgattcaatgggcaagaagcattctgggagtcaaccacaggaagagggggggtcggtcaatgagaatcatagcgggccacgcttactgcttgacctgtag

SEQ ID NO: 13472 - DNA, 1527 bp, Artificial Sequence
  Description of Artificial Sequence: Synthetic coding sequence
atggatgaagcagggaatcaccattctgagcagactatcacccggaccgagaaccagactccccacgcgctagcccacagacgtatgggcccttgtctaagttgctctcagctatactcgcagtacctcggactgtctcaaacccacagttcaccccctctggccctggacccccctagaagacagcgacaggagcgaaccgtctacacagagtcccagcagaaggtattagagttttactttcagaaagatcagtaccctaactacgaccagaggctgaacctggctgaaatgctgagcctgcgggaacaacagctgcaggtttggtttaaaaatagacgcgcaaaactggcacgtgaacgcaggcttcagcagcagccgcagcgcgtgccggggcagcgcggccggggagccagggctgcgcctttggtgcccgccgccagtgcctctgcacctcagcgagggccaagtggaattcttcctgctgccgagccaacgatatgcagcctgcatcaagcttggggcggacctgggtgccgcgcccagaagggaatccctgcagctctgagcccaggccctggccccatccctgctcctatccccgggcccgcgcagattcccggtccgctgcctggctcaattccagggccaattccaggaccggcccagattccttcccccatccccgcacccatccccgggcccataagcggtccagttcagatccccggcccatttcgaggaccgataccgggacctatctccggccctgcccccataccgggcccaatctcgggccctttctctggtcctaatcctggccctatccctgggccaaatcctggaccaatccccggcccaatttccggacccatcccagggcccatatcagtgccgatccccggccccatcccaggaccgatttctggtcccatttcaggaccaaacccgggccccatacccggaccgatccccggcccaatttcgggcccgaatcctgggcctatacctggaccaataagtgggcctaatcccggtctgattccggggcccatccccggccccattagtgggcccggaccaattatcggccctattccatcccctgcccaaatacccggacctggcaggctccaaggaccagggccgatcctctccccagggcgcatgaggagtcctggaagtttgccagggctcgctcccatcttaggccctggtagcggccccggctccggctccgtacctgctcctatccccggtccaggctctcttcctgcacccgccccactttggcctcaatcgcccgacgcatctgactttttgccagacacacagctctttcctcactttactgagttactgctgccgctggatcccctggaaggatcctcagtgagtacaatgacgagccagtaccaggaaggagacgattcaatgggaaagaaacattccggaagccagccacaggaggaaggaggttctgtgaacgaaaaccacagtggcccacgcttgttgttggacttatag

SEQ ID NO: 13473 - DNA, 1206 bp, Artificial Sequence
  Description of Artificial Sequence: Synthetic coding sequence
atgctctccctgcgagaacagcagctgcaggtgtggtttaagaatcgccgtgcaaagctggcacgagagcggcggctccagcagcaacctcagcgggtacccggccagagaggccggggtgcccgtgccgcccccctggtccctgcagcgtctgcttctgctccccaacgagggccctctggaatcttgcccgccgctgagcccacgatctgttctctccaccaagcctggggtggtccaggttgcagggcccagaagggaattcccgccgctctttcccctggacctgggcccatacccgcccccatccccgggccagcccaaattccaggtcctctgcccgggtcaatccccggtcctattcctggtcccgcgcagatcccgagcccgatcccagccccgatacccggacctatctcaggaccagtgcagatccccgggccattccggggtccaatccccggtcctatctctggcccgttcagtgggcctaaccccggaccaatccctggccctaatccaggtcctatccccggccctatcagtggacctataccaggccctatttctgtccccatcccaggcccaattcccgggcccatctctgggccaatcagcgggcccaaccctggccccattcccggtcctatccctgggccaatttcaggcccaaatcctgggcccatcccgggccccataagtggcccaaatccgggactgatcccgggcccaattccaggccctatttcagggcccggccccattataggcccaattccctcacccgcccagatacccggacccggccgcctgcagggaccaggccctatcctctcaccaggaaggatgcgtagtcccggctctctccccgggttggctcccatactggggcctgggtccgggcccggcagtggtagtgtgcccgctccaattcccggtcccggctctctaccagcccccgcacccctgtggccccaatccccggacgcttcagatttcctccccgacactcagcttttcccccacttcaccgaattgctccttcccttggacccgctggagggttcttccgtgagcaccatgacgagccaatatcaggagggagacgacagtatggggaagaagcactcaggatctcagcctcaagaggaaggtggaagtgtgaacgaaaaccacagcggtccccgattgctgctggatctgtag

SEQ ID NO: 13474 - DNA, 1206 bp, Artificial Sequence
  Description of Artificial Sequence: Synthetic coding sequence
atggtattagcacaaagcagggtgagcgccggcgtcggctccccacactgttcaggcagcggggggggcggttctgatagtttcccctggcctgcaagtcaccccggaaatcctcagtgttcattctccaccgctttcttagcctccccgaggttatccaggggcaccctcgcttaccttccacctgccccatggtcctcactggctacccccagtgccctcttgggaagctcttgtgccccgcctcctcccccagctaggtgcccccaaccccgggccttgagcccggaactgggtaccaaagctggacctcggagaccacatcgatgggaactgcctcgcagcccgtctcaaggcgctcagggaccggcacctagacgaagattactggaaaccatgaagggtatcgtcgcagcctcgggctctgagacggaggacgaggatagcatggatattcccttggatctgagctccagtgcaggcagtggcaaacgcagaaggcgcggcaacttacccaaggaaagcgtgcagatcctgcgggactggctgtacgagcacaggtataacgcttatccgtctgaacaggagaaagctctcctgagtcagcaaacccatctgtcaacccttcaggtgtgtaattggttcatcaatgccaggagaagactgcttccagacatgctgaggaaggacgggaaggatcctaatcagtttaccatttcaagacggggagctaaaattagcgagaccagttcggtcgagtctgtaatgggcataaaaaacttcatgcccgcccttgaggagactcctttccactcttgcacggctggccccaacccgacgctgggcaggcccctatctccaaagccaagctcccctgggtcagtgctggcaaggcctagcgtaatatgtcacaccaccgtgacagctctgaaggacgtgccctttagcctttgccaaagtgtgggtgtggggcagaacaccgacatccaacaaatagccgcaaagaattttaccgatacatcattgatgtacccagaagatacatgtaaatccggtccctcaaccaacacacaatcaggcctgttcaacacgcctccacccacaccgccagatctgaatcaggattttagcggtttccagttattagtggacgtagcactcaagagggctgctgagatggagctgcaggctaagctcactgcatag

SEQ ID NO: 13475 - DNA, 819 bp, Artificial Sequence
  Description of Artificial Sequence: Synthetic coding sequence
atgaagggcaaaaaggggatcgtagcagcttccggttccgagactgaagacgaggattccatggatatcccactggacctatcatcatccgctggttctggcaaaaggcgccgaagaggcaacctgcccaaggaatccgtgcaaatcctgcgcgattggctctacgaacatcgctataacgcttatcccagtgagcaggagaaggctctgctgtcacaacagactcaccttagtaccctgcaagtttgcaattggttcataaatgcacgcagaaggttgctgcccgacatgttgcggaaagacggcaaggacccaaaccaatttacaataagccgcagaggtgcgaagataagtgagacgtcctccgtagaaagcgtgatgggtattaagaactttatgccagcattggaagagactccgttccattcttgcacagccgggcctaatccaacgcttggtcgcccactttcaccaaaaccatcatcccctggttctgtgctggcacgacctagcgtcatctgccacactacggtgacagccctgaaggacgtgcccttttcgctgtgccagtctgtgggcgtaggtcagaataccgatatccaacagatagccgccaagaactttactgacacaagcctgatgtatcccgaagacacctgtaaatctgggcccagtaccaatacacagagcggactgtttaatacacccccccccacgcccccagatctcaatcaggatttttccggctttcagctcctggtagatgtggccttgaaacgggctgctgagatggagctgcaggcgaagctgaccgcctag

SEQ ID NO: 13476 - DNA, 759 bp, Artificial Sequence
  Description of Artificial Sequence: Synthetic coding sequence
atggacatccctctcgatctgagtagtagcgctggttcgggaaagagaagaaggcgaggcaacctgccaaaagaatcagtgcagatcctacgcgattggctgtatgaacataggtataacgcctacccttccgagcaggagaaggccttgttgtcccagcaaactcatctcagtacattgcaggtctgcaactggtttatcaatgctcgaagaagactgttgccagacatgctccgcaaagacggtaaggaccccaatcagttcacaatctctcggaggggagctaaaatcagcgagacgtcatcggtcgaatctgtaatggggataaaaaacttcatgcctgccctcgaagaaacccccttccacagctgtaccgcaggaccaaatccaacactgggaaggccactttccccaaagccctcaagtcctggctcggtgcttgcgcgtccatcagtgatctgccatactactgtcaccgctctgaaagacgttccgttctcactgtgccagtcggtgggggtaggccaaaatacagacatccagcagattgccgcaaaaaactttaccgacacatctttgatgtaccctgaggatacttgcaagagcggccctagcactaacactcagagcggactgtttaacactccgccacctacaccccccgatttgaaccaggacttcagcgggttccaattgctggtcgacgtggcccttaagagagcagccgaaatggaacttcaggcgaagctaactgcatag

SEQ ID NO: 13477 - DNA, 759 bp, Artificial Sequence
  Description of Artificial Sequence: Synthetic coding sequence
atggacataccgctggatctcagcagcagtgccgggtccggaaagcgacggagacgcggaaatctccctaaggagtctgtgcaaatcttgagggactggttgtacgagcatagatataacgcctatccatcagaacaggaaaaagccctcctcagccaacagacccatttgagcacactgcaggtatgtaactggtttatcaacgcacgacgccgactgctgcctgacatgctcaggaaggacgggaaggatccaaaccaatttacaatcagccggcggggtgcgaagattagcgagacctccagcgtggagtctgttatgggaatcaagaacttcatgcctgctctggaagagactcctttccattcttgcaccgccggtccaaatcctacgttggggcggcctctgtctccgaaaccttccagccccggttccgtgcttgctaggccctctgtcatttgtcatacaactgtgaccgcactgaaagacgtacccttctctctatgccagagcgtcggagtggggcagaacacagatattcagcagattgccgctaagaatttcacggatacatcactgatgtaccctgaagacacctgtaagtcaggtccttctactaacacacagtctggcctgtttaacacaccccctcctacaccacccgatctgaaccaggacttcagcggtttccaattgctagtggacgtggctcttaagcgggctgctgagatggagctgcaggccaagctgactgcctag

SEQ ID NO: 13478 - DNA, 759 bp, Artificial Sequence
  Description of Artificial Sequence: Synthetic coding sequence
atggacatccccctggacctttcatccagcgccggatctgggaaacgccgccgcagggggaatctccccaaggagagcgttcaaatcctgagagactggctctatgaacacaggtacaacgcataccccagcgagcaggaaaaggctttgctttcccaacagacccatttatcaacactgcaggtctgcaactggtttattaatgcaaggcgcaggttactcccggatatgctgcgtaaggatgggaaggatcccaaccagtttaccattagtaggaggggtgcgaagattagtgagacttcatctgttgagtccgtgatggggataaaaaacttcatgcccgcacttgaagagaccccttttcactcctgcacggctggcccaaaccccacacttggccgtccactttcgcccaagccctccagtccgggctcagtgctggcgagaccaagcgtaatctgtcacactactgtgactgctctcaaggacgtgccattttcactttgtcagagcgtgggcgtcggccagaataccgacatccagcagattgctgcaaaaaattttacagacacctccctaatgtatccagaagacacgtgtaaaagcggtcctagtacaaacacacagagcggcctgttcaacactccaccaccgactccacctgatctaaatcaagacttctcaggattccagttacttgtggacgtcgcccttaaaagagccgccgagatggagcttcaagcaaagttaacagcctag

SEQ ID NO: 13479 - DNA, 759 bp, Artificial Sequence
  Description of Artificial Sequence: Synthetic coding sequence
atggacatccctcttgacctctcatctagtgcagggtctggaaaacggcgcaggaggggcaatctcccgaaggaatccgtgcagatattacgggactggctgtacgagcatagatacaatgcctacccttccgagcaggagaaggctctgctgtcacagcagacacatctcagcacgctgcaagtgtgtaactggttcattaacgctcggcgtagactgctgccagacatgctgcgaaaagacgggaaggatccaaaccaatttactattagtcggcgaggcgctaagattagcgaaacttcatctgtcgaaagcgtcatgggtattaaaaattttatgcctgctctcgaggagacaccttttcatagctgcaccgccggccccaatccaactttgggacggccactctccccaaaaccttcgagcccagggtctgtcttggcccgacccagcgtgatatgtcacactaccgtcaccgcactcaaagacgtgccattctctctttgccagtccgttggcgttggtcagaatactgacatccaacagatcgccgcaaagaacttcactgacactagtctcatgtacccggaagatacgtgtaagagcggcccctcaaccaacactcagagcggacttttcaatactccaccccctacgccaccagacctgaatcaggacttctctggctttcagctcctggttgacgtcgctctgaaaagagccgccgagatggaattgcaggccaagctgactgcatag

SEQ ID NO: 13480 - DNA, 819 bp, Artificial Sequence
  Description of Artificial Sequence: Synthetic coding sequence
atgaaggggaagaaggggatcgttgccgcctccggatctgaaaccgaggacgaagactcaatggatattcccctggatctgtcctcttctgccggtagcggtaaacgccgccggcgcggaaacctgcctaaggagtctgtccaaatattgcgcgactggctgtacgagcaccggtataatgcttacccttccgaacaagaaaaagcacttttaagccagcagactcatttgtcaactctgcaggtgtgtaactggttcattaatgctaggaggcgcctcctccccgatatgcttaggaaagatgggaaagaccccaaccagttcacgatctcaagaaggggtgcaaaaatcagcgagaccagttcggtggagtctgtgatggggattaagaacttcatgcccgccctcgaagagacccctttccatagttgcacagcaggccctaaccccacactcgggaggccactgtccccaaaaccatcatctccagggtccgtgcttgccagaccctcagtcatttgtcacactaccgtcactgctctgaaggatgttccattctcactgtgccagtccgtgggagtgggccagaatacagatatccagcagatcgccgcaaaaaatttcacagacacttcgcttatgtatccggaggatacctgtaagtctggcccaagcacgaatacacaatcgggcctgtttaatacgccccccccaactcctcctgatctgaatcaggacttttccggctttcagctcctcgtggacgtggccttgaaacgcgcagctgagatggagttacaagccaaactcactgcttag

SEQ ID NO: 13481 - DNA, 759 bp, Artificial Sequence
  Description of Artificial Sequence: Synthetic coding sequence
atggacattccattggatcttagtagttcagctggcagcgggaaaagacgtcgacgcggcaatctgcctaaggaatccgtgcaaattctgagagactggctatacgaacaccggtacaacgcatatcccagtgaacaggagaaggctctactctcccagcagacacatctttcaaccttacaggtgtgtaactggttcattaacgccaggaggcggctccttcccgacatgctgcggaaggatggaaaagacccgaatcagttcacgattagtcgccgcggggctaaaatttctgagacctcgtctgttgagtctgtaatgggcatcaagaactttatgcctgcactcgaagaaacacccttccacagttgcaccgctggtcctaaccctaccttgggacggcccctttcccctaaaccgagttcacccggatccgtgttggcacggccctccgtgatctgccataccaccgtgacagccctgaaagacgttcctttctcactctgccaatcagtcggtgtggggcagaacactgatatccagcagattgccgccaaaaactttactgacacgtctttgatgtatccggaggatacctgcaaaagcggacctagcacaaacactcagtcgggactttttaatacaccccctcccactccgcctgatctcaaccaggatttctctggcttccagctgttagtggatgtggcactaaaacgcgcagcagagatggaactacaggccaaattgactgcatag

SEQ ID NO: 13482 - DNA, 861 bp, Artificial Sequence
  Description of Artificial Sequence: Synthetic coding sequence
atgacgtgtagtgggaaaagttgcgccttggccaggagtagcctgacttcctcacagggcattgtcgccgcctccggcagcgagacggaagatgaggacagcatggatatacctctcgatctgtcctcctctgccggctctggaaaaaggagaaggagaggtaatctgcctaaagagagtgtgcagattcttcgggactggctgtacgaacacagatacaacgcatatccttctgaacaggagaaggcactgctttcccagcagacacacctgtcgaccttacaggtgtgtaactggtttatcaatgcgcgacggaggctcctcccagacatgctgcgaaaagacggcaaggaccccaatcaatttaccatcagccgcaggggtgccaagatctcagaaacttcatccgtcgagtcagtcatgggcataaagaatttcatgcctgctctcgaggagacccctttccactcctgcaccgctggtccaaatcccactctagggcggcctctctctccaaaacccagctccccagggtccgtactcgcccgaccctcagtgatctgccataccacagtcaccgccctgaaggacgtcccattctcactgtgtcagagcgtgggagtcggtcagaacacagacatacaacaaatagctgcgaagaattttacagacaccagtctgatgtaccctgaagatacttgtaagtccgggccctcgacaaacacacagtcgggcctgttcaacactccaccaccaacccctcccgacctgaatcaggacttctctgggtttcaacttctcgtggatgttgccctgaaacgcgcagccgagatggagttgcaggcaaagctgactgcttag

SEQ ID NO: 13483 - DNA, 279 bp, Artificial Sequence
  Description of Artificial Sequence: Synthetic coding sequence
atggacatcccacttgacctgagctcgagcgccggctctggaaagagaaggagacggggcaacctgcccaaggaaagcgtgcagatcctgagggactggctttatgagcaccgatataacgcttacccctcggaacaggagaaggccctgttatcacagcagacccatctgtcgaccctccaagtatgtaattggtttatcaacgcacgaaggcggctcctacctgatatgctgaggaaggacgggaaagatcccaaccaatttacgatcagtcgatag

SEQ ID NO: 13484 - DNA, 402 bp, Artificial Sequence
  Description of Artificial Sequence: Synthetic coding sequence
atggacattcctcttgatctgtcttcgagcgctggttctggaaagaggcgacgccgggggaacctacctaaagaatctgtccagatcctaagggactggctctacgaacatcgatacaatgcttatcccagtgagcaagagaaagcactgctgagccagcagactcacctttctaccctacaagtctgcaactggttcattaatgcccggcggcggctgctcccagatatgcttcggaaggacgggaaggaccctaaccagttcactatctcaaggaggggagccaagatcagtgagacatcatctgtcgaaagtgtgatgggtatcaagaatttcatgcccgccttggaagagacacctttccacagttgcaccgccgggcccaacccaacgctggggtag

SEQ ID NO: 13485 - DNA, 741 bp, Artificial Sequence
  Description of Artificial Sequence: Synthetic coding sequence
atggacatacctctggacctctcatccagtgcaggatccggcaagagaagaaggcgggggaacctcccaaaggagagcgtccagattctacgagattggttgtatgaacataggtacaacgcctatcctagcgaacaagagaaggcccttctatctcagcagactcatctgtccaccctgcaggtctgtaattggtttatcaacgccaggaggcgtttgctgccagacatgctgcgtaaagatggcaaagacccaaaccaattcaccataagtaggcggggcgctaagatatctgagacaagctcagttgaatccgtgatgggtattaaaaatttcatgccggctctcgaggagacacctttccactcctgtactgcggggccgaacccgacgttggggaggccattgtcgcctaaaccgtcatcaccaggcagcgtgctcgcccgtccctccgtcatctgtcacactacggttaccgccctcaaagacgtaccattttcattatgtcagtccgttggtgtggggcagaacaccgatatacagcagatcgccgccaaaaacttcaccgacacatctctgatgtatcctgaggatacctgcaaatctggtccctcaacaaacacacagtcaggtctgtttaatacaccaccccctacaccaccggatctgaaccaggacttcagcggattccagctcctggtggatgtggctctgaagcgcgccgccgaaatggagctgtag

SEQ ID NO: 13486 - DNA, 660 bp, Artificial Sequence
  Description of Artificial Sequence: Synthetic coding sequence
atggacatacctctggacctgagcagttccgcagggagcggaaagagaaggcggagaggcaacctacccaaggagtctgtgcagatcctccgtgactggttgtacgagcataggtacaatgcatacccctcagagcaggagaaggctctcctgtcacagcagactcatctttccactctgcaggtctgtaactggttcatcaatgcccgacgcaggctgcttcccgacatgctccggaaggatggcaaagatcccaatcaatttactatttctaggcgaggagccaaaatcagtgagacctcctccgtcgagtccgtgatgggcatcaagaattttatgcctgcactggaagaaacgccgttccactcttgtacagccggcccaaacccaaccttggggaggccgctttctcctaagccttcaagtccaggttccgtccttgcccggcccagcgtgatctgccataccactgttactgcattaaaggacgtgcccttctcgctgtgccagagcgtgggcgtcggccagaacactgacatccaacagattgcagcaaagaattttaccgacacttccctcatgtatcctgaggacacctgcaaatctggcccatctacaaacactcagtccggtctgtttaacacaccaccccccacctag

SEQ ID NO: 13487 - DNA, 396 bp, Artificial Sequence
  Description of Artificial Sequence: Synthetic coding sequence
atggacattccactagacctgtcctccagcgctgggagtggaaagagacgccgccggggcaacttgcccaaggagtccgttcaaattctccgcgactggctgtacgaacaccgctacaatgcttatccttccgagcaggagaaagcgctattatctcaacagactcatctctccactctgcaggtgtgtaattggtttattaatgccaggcgcagactgctgccggatatgctgaggaaagatggtaaagaccccaatcaatttaccataagtcgaagaggtgcaaagatctccgaaacaagcagcgttgagtccgtgatgggaattaaaaatttcatgccggctctggaggagacgccttttcattcctgcactgccggcccgaatcccacatag

SEQ ID NO: 13488 - DNA, 417 bp, Artificial Sequence
  Description of Artificial Sequence: Synthetic coding sequence
atggacataccactggatctgagcagttctgccgggagcggtaaacggagacgtcgtggaaatctgccaaaggaaagcgtacaaatcttacgtgattggctgtacgaacatcgatataacgcctatccatcagagcaggagaaggcacttctcagccagcagacccatctgagcacactgcaggtgtgcaactggttcatcaatgcccgaaggcgactgctgccggacatgcttcgcaaggatgggaaagacccaaaccagttcaccatcagtcggaggggggcaaagatctcagagacctcttccgtcgagtcagtcatgggcattaagaacttcatgcccgcccttgaggaaacaccgtttcacagctgcaccgcaggaccgaacccgacgctagggcgccccctgtctccttag

SEQ ID NO: 13489 - DNA, 759 bp, Artificial Sequence
  Description of Artificial Sequence: Synthetic coding sequence
atggacataccccttgacctctcctcctcggccggctcaggcaagcggcgcagaaggggcaatctgccaaaggagtctgtccagatactacgggactggctttatgaacatcgctataacgcctacccatccgagcaggagaaagcgcttctgtcccaacagacgcatctgagcactcttcaggtctgcaattggtttataaatgccagacgtagattgttgcccgatatgctgagaaaagatgggaaagacccaaaccagttcactattagccggcgaggtgcaaagattagcgagacaagtagcgtggagtccgttatgggtattaaaaacttcatgccagccctggaagaaacaccgttccactcctgtaccgcagggcccaatcctactctcggcaggcctctgagtcccaaaccctcctctccaggcagtgtgcttgccagacctagcgtgatttgccacaccacagtaaccgccctcaaggatgtgccttttagcctgtgtcagagtgtcggggtcggacaaaacacagacatccagcagatcgccgccaagaatttcacagatacaagcctcatgtatccggaggatacttgtaaatctggaccctcgactaacacacaaagcggactgttcaacactccacctcccacaccacctgatctgaatcaggacttctcgggctttcagttgttggtagatgttgctctgaaaagagccgccgaaatggaactgcaggcaaagctgacagcttag

SEQ ID NO: 13490 - DNA, 507 bp, Artificial Sequence
  Description of Artificial Sequence: Synthetic coding sequence
atggacatccctctggacttgtcctcatccgcaggatccggcaagagacggcggagaggcaacctgcctaaagagagtgtgcagattctgcgcgattggttatacgaacaccgctacaacgcctatcccagcgagcaggagaaagcactcctgtctcagcagactcacctgtccacgcttcaggtgtgtaattggttcattaacgcgagacgaagactcctgcctgatatgctccggaaagacggcaaggatccaaaccaattcactatttctcgccgaggggccaagatttcggaaacatcgagtgtcgagtccgtgatgggcatcaagaactttatgcccgccctggaggagactccgtttcactcctgtacggccggccccaaccccactttgggcagaccattgagtccaaaaccgtccagccccggatctgtcctggctcggccttctgtgatttgtcacaccaccgtgacagccctgaaggacgtcccttttagcttgtag

SEQ ID NO: 13491 - DNA, 2523 bp, Artificial Sequence
  Description of Artificial Sequence: Synthetic coding sequence
atggccggcccagggagtacaggcggccagatcggggcggcggcactggcaggtggagcgaggtccaaggtggccccaagtgtcgacttcgatcatagctgctcagactctgttgagtacctcacccttaactttggtccgtttgagaccgtacaccggtggcgccggctgccaccttgcgatgagttcgtcggggcccgtcgttccaagcatacagtggtcgcctacaaagacgcaatttatgtgtttggaggggataacgggaagaccatgcttaacgaccttctcaggtttgatgtgaaggactgcagttggtgtcgggccttcaccaccggaacaccaccggccccgcgttaccatcattctgcagtggtgtacggatcctccatgttcgtgtttggaggctacactggggatatttacagcaactcaaacctgaaaaataaaaatgaccttttcgaatataagttcgctacaggtcagtggaccgaatggaagatcgaggggcgactaccggtggctagatctgctcatggagctacagtgtacagcgacaagctgtggatctttgccgggtatgatggcaacgccaggctgaacgacatgtggactattgggcttcaggatcgggagctcacttgttgggaagaggtcgcccagtcgggtgagatcccgccatcatgctgcaatttccccgttgctgtgtgcagggataaaatgtttgtgtttagtgggcaatccggcgcaaagatcactaacaatttgttccagttcgagttcaaggacaagacttggacgcggatccccaccgaacatttgctccgcggcagccccccacccccccagcggaggtacggacacacgatggtcgcgttcgacagacacctctatgtgttcgggggcgccgcagacaacacactgcccaacgagctccactgctacgacgttgactttcagacgtgggaggtggtccagccaagttcagacagcgaggtcggtggcgccgaggttcctgaacgcgcttgcgcctccgaagaagtgccaaccctaacctacgaggagcgcgtaggcttcaagaaaagccgcgatgtcttcggcctggattttgggactacctccgctaagcagcccacgcaacctgcttcagagctgccatccgggcgcctgtttcatgccgccgctgtgatcagtgatgcaatgtacattttcggtggaaccgtggataataacatccgctcaggcgagatgtatcgctttcaattcagctgctaccccaagtgcactctgcatgaggactatgggagactgtgggaaagtcggcagttctgcgacgtagaatttgtactgggagagaaggaggaatgtgtccaaggacacgtggcaattgtgaccgcacggtcccgctggctgcggaggaagatcacacaggctagggagcggcttgcccaaaaattagaacaggaggccgctccggttcctagggaggcccctggggtcgccgcaggaggcgcacggccgcctctcttgcatgttgccattagagaagctgaagcccgcccttttgaagtattgatgcagtttctttatactgacaagatcaagtacccacgcaaagggcatgtggaagacgtgttgctgattatggacgtgtataagctcgccctaagcttccaactatgccgtcttgaacagctatgcaggcagtatatcgaggcttctgtggatctgcaaaacgtgctggtcgtgtgtgagtcagcagcccggcttcagctgagtcagcttaaggagcactgcctgaatttcgttgtcaaggaatcccacttcaaccaggtgatcatgatgaaggaatttgagcgcctctcgagccccctgatcgtggaaattgtccgcaggaaacagcaaccccctcctcggacacctctcgatcagcctgtagatataggcaccagcttgatccaggacatgaaagcttatctcgagggagctggagctgaattttgcgatattactctgctgctcgacggacaccccaggccggctcacaaggcaatcttggctgcccggagtagctatttcgaggccatgttcagaagctttatgccagaggatggccaggtgaacatttccattggggaaatggtgcctagtaggcaggctttcgagtccatgcttagatacatatactatggagaggtgaacatgccacccgaagattcactttatctttttgcagccccatattattatggattttacaacaaccgtttgcaggcgtactgtaaacaaaacctggaaatgaatgtgaccgtgcagaacgtgctgcaaatcctcgaagccgcggataaaactcaggcacttgatatgaagaggcactgcttgcatattattgtgcatcagttcacgaaggtcagcaagctccccacactgcgctccctgtcgcagcagttgctcctagatatcatcgactctcttgcatctcacatctccgataaacagtgcgcagaactaggcgccgatatatag

SEQ ID NO: 13492 - DNA, 930 bp, Artificial Sequence
  Description of Artificial Sequence: Synthetic coding sequence
atgccgcgccattgctcagctgcaggatgttgcaccagggacacacgcgaaaccaggaacagaggaatctccttccataggcttccgaagaaggataacccacgaagagggctgtggctggccaactgccagcggttggatcctagtgggcaaggcctttgggaccctgcctcggagtacatctatttttgttcgaagcacttcgaagaagactgttttgaactggtgggcatttctgggtaccatagactcaaggagggagccgtgccgaccattttcgaaagcttctcgaagctgagaaggacgaccaaaaccaagggacactcttacccacccggacctgcagaggtgagccgtttgcgacggtgccgcaagcggtgctctgaaggccgcggtccaacgacgccgttttcccctcccccccctgctgatgtaacctgttttccagtggaggaggccagcgccccagctacgttgcctgcgtccccggcaggacggctcgaacctgggttaagctcccccttttctgatctgctcgggcccttaggagcccaggccgacgaggcaggatgttcagcacaaccatctcccgaacggcagccttcccccctagaaccacgcccagtgagcccttcagcatacatgctgcgcctgcctccaccagctggcgcctatatacagaatgaacattcctaccaggtaggctctgctctcctttggaagcggagggccgaagcagccctggacgccctggataaagcccagcgccaactacaggcttgtaaaagaagagagcaacgattacgcctgcggttgactaaacttcagcaagagcgggcgcgcgaaaagcgcgcccaggccgacgcccgacagaccctcaaggaacacgttcaagatttcgccatgcagctgtcctcatcgatggcatag

SEQ ID NO: 13493 - DNA, 1140 bp, Artificial Sequence
  Description of Artificial Sequence: Synthetic coding sequence
atgggagactcccggcgacgatccctgggaaatcagccctccagcgaagccgccggacgatccgagcgcgagcaggatggagaccctaggggcttgcagagtagcgtatacgaatcacgcagggtcacggatccggaaagacaggatctcgacaacgctgagctcggccccgaagaccccgaggaggaactcccccccgaggaagtcgccggtgaagaatttcccgagaccctggaccccaaggaagccttaagcgaattggaacgcgtgttggataaggacctggaggaagacattccagaaatctctcgcctcagtatctcccagaagttaccctcaacaacaatgacaaaagccaggaagcgccgtcggaggaggcggctgatggagttagctgaaccaaagatcaactggcaggtgctcaaggaccggaaggggcgctgcggaaaggggtacgcctggatatctccatgtaaaatgagcctccatttctgcttgtgttggccttctgtatattggaccgagagatttttagaggatacaacgttaactatcacggtcccagccgtaagcagaagggtagaagaactgagcaggccaaaaagattctacctcgagtactacaacaataataggaccacgcctgtatggccaatccctagatccagcttggaataccgcgcttccagccgcttgaaggaacttgccgcccctaaaattagggacaacttctggagcatgccaatgtctgaagtaagccaggtgagccgtgccgcccagatggctgtgcctagctctcgaatcctccaactgtcgaagcctaaagcgccagctacactgctggaggaatgggatcctgtgcccaaacctaaaccacatgttagcgatcataaccgcctgctgcatctggccaggccaaaagcacagtcagacaagtgcgtccctgatagagaccctaggtgggaggtccttgatgtgacgaaaaaggttgtcgcgtccccacgaatcattagtctggccaagccaaaggtccgaaagggactgaacgaggggtatgatagacggcccctcgcgagtatgagtcttccaccaccgaaggcctccccggagaaatgtgatcaaccacggccgggcctgtag

SEQ ID NO: 13494 - DNA, 1068 bp, Artificial Sequence
  Description of Artificial Sequence: Synthetic coding sequence
atgggcgactccaggcggcgctcacttggaaaccagccttccagtgaagccgccggccggtctgagagagaacaggacggagacccgcgcggcctgcagagttcagtgtacgaatcccgccgtgtcactgatccagaaaggcaggacctcgacaatgcagaacttgggccagaggatcctgaggaggaacttcctcccgaagaggtggctggcgaggagtttcctgagacactcgaccctaaagaggctctgagcgagttggaacgagtgcttgacaaggacctggaagaggatatccctgagatatcccgcctctcaattagccaaaagctaccaagcaccacaatgaccaaggccaggaaacggcgacgcagacgcagactgatggaactggctgagcctaagatcaactggcaggtactgaaagatagaccgtctgtgtactggacagaacgattcctggaagacaccacgctcacaatcaccgttccagccgtgtcccgtagagtggaagagctgagcagacccaagaggttttacctggaatactataacaataaccgaacaaccccggtatggccaatacctagatctagcttagaatatcgcgcctcatcccggctgaaggagcttgcagcaccaaaaataagagataacttctggagcatgcctatgtccgaggtgtcgcaggttagtcgggccgcacaaatggcagtgccaagctcccgtatcctccagctctccaagcctaaggcccctgccaccttattagaggagtgggatcccgtacccaaacctaaacctcatgtttcagaccataatcgtttgctgcatctagcacgccccaaggcgcagtctgataagtgcgtgcctgacagggacccacggtgggaggttttagacgtgactaaaaaggtggtggcaagccccaggattatttccctcgccaagcctaaggtgaggaaagggctgaatgaaggatacgacagaaggcccctagctagcatgagcctgccgccccccaaggccagtcctgagaaatgtgaccagcccagacctggactgtag

SEQ ID NO: 13495 - DNA, 450 bp, Artificial Sequence
  Description of Artificial Sequence: Synthetic coding sequence
atgtcttttctgcttcccaaactcacctccaagaaagaagtggaccaggccattaagagcacagccgaaaaagtgttggtgttgcgttttggacgggacgaggatccagtgtgcttgcaacttgatgacatactttcaaagacaagcagcgatctgtcaaaaatggccgccatctatttggtagatgtcgatcagaccgccgtttatacccagtattttgacatcagctatattccttccaccgtgttctttttcaacggtcagcatatgaaagtggactatggctcaccagatcacactaagtttgtgggatctttcaaaacaaaacaggatttcatagatcttattgaagttatttataggggagcaatgagaggcaaactcattgtgcagagcccaattgacccaaaaaacattccgaagtacgacctcctgtaccaagatatctag

SEQ ID NO: 13496 - DNA, 450 bp, Artificial Sequence
  Description of Artificial Sequence: Synthetic coding sequence
atgtcattcttgttacctaagctcacctccaagaaagaggtagatcaggccatcaagtctaccgccgaaaaggtgctggtgctgcgcttcggtagggacgaggaccccgtgtgcctccagctggacgatatcctctctaaaacttcctcagacctgtctaaaatggcggccatatatcttgtggacgttgaccagaccgctgtgtacacgcagtatttcgatatctcatacattccaagcacagttttcttcttcaatggtcagcacatgaaggttgattatggaagtcctgaccatacaaaattcgtaggatccttcaaaactaaacaagacttcattgacctcatcgaggtgatctaccgcggggccatgagagggaagttgattgttcagtcaccaatcgatcccaagaacatcccaaagtacgatctcctgtaccaggacatctag

SEQ ID NO: 13497 - DNA, 450 bp, Artificial Sequence
  Description of Artificial Sequence: Synthetic coding sequence
atgagctttctcctgcctaagcttactagtaagaaggaagtcgaccaagctattaagagcacagcagaaaaggtcctggtgctgaggttcggacgagatgaggaccctgtatgcctccagctcgatgacatcctgagtaaaactagctctgatctgagtaaaatggcagcgatttatcttgtagatgtcgatcagaccgcagtctatacgcaatactttgacattagctatattccaagtacagtgtttttttttaatgggcagcacatgaaagtagactacggaagcccagaccacactaagtttgtggggtcattcaaaactaagcaggattttatcgatttaattgaggtgatctatcgtggtgctatgcgaggaaagttaatagttcagtcccccatagacccaaaaaatatccctaagtacgacttgctgtaccaggacatatag

SEQ ID NO: 13498 - DNA, 891 bp, Artificial Sequence
  Description of Artificial Sequence: Synthetic coding sequence
atggagcgggctgtccccctggcagtcccactcggccaaacggaggtgtttcaagccctgcagcgcctgcacatgaccatattttctcagagtgtcagcccttgtggtaagtttctggctgcaggcaacaactacgggcagattgcgatattttctctcagctccgctctgagcagtgaggctaaggaggaatcaaaaaaacccgtggtgaccttccaagcccacgacgggcctgtgtattcaatggttagcaccgatcgccatctgttaagtgccggtgacggcgaagtcaaagcctggttgtgggccgaaatgctcaaaaaggggtgcaaggagctgtggcggaggcagccaccatacaggacaagtctcgaggtgcccgagattaatgcacttctcctggtgcccaaggaaaacagcttgattcttgctgggggagactgtcaattacataccatggatctagaaaccggaacattcacaagagtccttagaggacacactgattatattcattgtcttgcactgcgggagaggagcccggaggtcctgtccggaggggaagacggggcagtgaggctctgggatcttcgaacagcaaaggaggtgcagactattgaagtatataaacatgaggagtgttcgcgtccgcataacggcagatggatcggttgcctcgcaaccgattctgactggatggtgtgtgggggaggaccagctcttaccctttggcatctgcggtcttctactcccaccaccatattccccatcagagctccccagaagcacgtgactttctatcaggatttagtactgacagcagccgggaacagctgccgggtcgatgtctttacgaatctcggctacagggcgttttctctcagcttctag

SEQ ID NO: 13499 - DNA, 1026 bp, Artificial Sequence
  Description of Artificial Sequence: Synthetic coding sequence
atggagcgggctgtgcccctcgctgtgcctctggggcaaaccgaagtgttccaggctctgcagcgattgcatatgactattttcagccagtccgtcagtccctgtggcaagttcctggccgctggaaataactatggacaaatcgctatattctccctgagtagtgctcttagctccgaggccaaagaagaaagcaagaaacccgtggttacgttccaggcgcacgatggccctgtctactccatggtcagtaccgaccgccacctgctgagtgctggtgacggcgaagtaaaagcttggctttgggccgagatgcttaagaaaggctgtaaggagctttggaggagacaacccccctacagaacttccctcgaggtaccggagattaacgctctgctcctggtgcccaaagagaattcattgatcttggccggaggggactgtcaactgcacaccatggacctggagaccggcaccttcactagggtgctgcgtggacatacagattacatacactgccttgcattgagagaacgaagcccagaggtgctgtctggcggagaggatggggcagttcgcctctgggacctgcggaccgcaaaggaggtgcaaacgatcgaagtttataagcatgaggagtgtagccggcctcacaatggccgctggattggatgcctggcaacagattccgattggatggtctgtggcgggggccctgccctcaccctgtggcacctgagatcatcaactcccacaaccatattccccatacgcgcccctcagaagcatgtcacgttctatcaagacctgattctaagcgccggccaggggcgctgcgtgaaccaatggcaactgagcggagagctgaaagcccaagtccccggcagcagtcccggactgttgtccctctctttgaatcaacagcccgctgcgcccgaatgcaaggttttaactgccgctggaaactcctgcagggtagacgtgtttaccaacctgggataccgggctttttccttgtctttttag

SEQ ID NO: 13500 - DNA, 2868 bp, Artificial Sequence
  Description of Artificial Sequence: Synthetic coding sequence
atgtctaaaaccaacaaaagcaaatcagggtctaggagctcccggtctcggtctgcttcccggtccaggtcaaggtctttcagcaagagtagaagcagaagccgctcactatctcgatcacggaaaagaagactcagcagtaggagtcgaagtaggtcatatagccccgcccacaaccgggagaggaaccatccacgcgtataccaaaatcgggacttccgtggccataaccgcggctatcgtaggccatactatttccgaggtcgcaacagaggtttctatccctggggacagtataatcgaggcgggtacggaaactatcgttcaaactggcagaactaccggcaggcctactcaccaagacgtggccgctctaggagtaggtccccaaagcggcgcagcccgagccccagaagtaggtcccacagccggaatagcgataaaagctcttctgataggtccagaagaagctcgagcagtagaagttcctcgaatcattcgcgcgtggagagttctaagagaaaaagcgcgaaggagaaaaagagtagctctaaagattcaagaccctctcaggcagccggggataaccaaggggatgaggccaaagagcagacttttagcgggggcacctcccaagatactaaggcttccgaatcctccaagccttggcccgacgccacctacgggacagggagcgctagtagggcctcagcggtcagcgagctgtctccaagggaacgcagcccagccctgaaaagtcctctccagtctgtagtcgtgaggcgccggtccccgcgaccaagcccagtccctaagccaagcccaccactcagcagtaccagtcagatgggctcaaccctgccctccggtgctggttatcagtctggtacccaccagggccagtttgaccatggctccggttctctgagccccagtaagaaaagccccgtgggcaagagccctcccagtacagggtctacatatgggagcagtcagaaggaggaaagcgccgcctctgggggagctgcttacacgaaacggtatctggaagaacagaaaacagagaacggtaaggataaagaacaaaagcagaccaacacggacaaggaaaagatcaaagagaagggctcattttctgatacagggctgggagacggtaagatgaagagcgatagtttcgcacccaagaccgactccgaaaaaccattcagaggcagccagtccccaaaacggtataagttacgagacgacttcgaaaagaagatggccgattttcataaggaggaaatggatgaccaggataaagacaaggccaaaggccggaaagagtccgaattcgatgacgaacccaaatttatgtccaaagtcataggagcaaacaagaatcaggaagaggaaaaatctggaaagtgggagggccttgtatatgcaccccctggaaaagagaagcagagaaaaactgaggagcttgaggaggagagctttcccgagagaagtaaaaaggaggataggggcaaacgttccgaaggcgggcatcgggggtttgtgcccgagaagaactttagggtcacagcctataaagctgtgcaggaaaaaagtagtagcccccccccacgaaaaacatccgaatcgcgtgataaactcggcgcgaagggggatttccccaccggtaaatcttctttttccataacgcgggaagctcaggtcaatgttaggatggactctttcgatgaggatcttgcacgtcctagcggtctgctggcgcaggagcgaaaactctgccgtgatctggtgcacagtaacaagaaagagcaggagttccggtctattttccagcacatccagtccgctcaaagccagcgctccccgagtgagcttttcgcacagcatatcgtgactattgtgcaccatgtcaaggagcatcacttcgggtcaagcggcatgacactgcacgaaaggtttacaaaatacctgaagaggggcacagaacaagaagcagcaaagaataagaaaagccctgagattcaccgtcggattgatatcagtccaagcacattcagaaagcacggtctggcccacgacgaaatgaagtcaccgagggaacctggatacaaggccgaaggaaagtataaagacgaccccgtggacctgaggctggacattgagaggaggaagaaacacaaggagcgggacctgaagaggggtaagagtagagaaagtgtcgactctagggacagcagtcacagtagagaacggagtgcggagaaaacagaaaagacccacaagggaagcaaaaagcagaaaaaacaccgccgggcgagggacaggagtcgcagctccagttcatcatcacaatcctctcactcttacaaagctgaagagtacacagaggaaacagaggagcgagaagaatctaccacagggttcgacaaatcacgcctgggtacaaaagattttgtcgggccttcagaacggggaggtgggcgagccaggggcacattccaatttagagccaggggacgtggttggggtcgtggtaactactctggcaacaacaacaacaatagtaataacgattttcaaaagaggaatcgcgaggaagagtgggatcccgaatacaccccaaagtcaaaaaaatattacctgcacgacgatcgcgaaggggagggcagcgataagtgggtaagcaggggcaggggtcgcggcgcctttccccggggcagaggccgattcatgtttcgaaaatctagtacctctcccaagtgggctcacgataagttctctggtgaagaaggggagatcgaagacgacgagtcagggacagaaaatagggaggagaaagataatatacagccaactactgagtag

SEQ ID NO: 13501 - DNA, 2868 bp, Artificial Sequence
  Description of Artificial Sequence: Synthetic coding sequence
atgagtaaaacaaacaaatcgaaaagcggatcccgttccagccggtcccgaagtgcctcaagatctagatctcgcagcttcagcaaaagccgcagcagatcacggtctctttcacgcagcagaaagcgaaggctttctagcaggagcaggagcaggagttattccccagcgcataatagagaaagaaatcacccccgcgtgtaccagaatagggacttccgcggacataatcgtggataccggcggccgtactatttcagaggaagaaatagaggcttttacccctgggggcagtacaatcggggcggctatgggaattataggtcaaactggcaaaactatcggcaggcctattcccccaggagggggcgaagccggtcacggtctccaaagcgtaggtccccatcaccacgatccagatcacattctagaaattctgacaagtcctcctccgatcgatctaggagatcctctagcagcagaagttcatcaaatcactctcgtgtggaaagcagcaaacggaagagtgctaaggaaaaaaagtccagctccaaggattctcggccctctcaggctgcaggagacaatcagggagacgaagctaaggagcagacgttttctgggggaacatctcaggacaccaaggctagcgagtcctctaaaccttggcctgacgcaacctatgggaccggaagcgcatcaagagcttcagcagtgtccgagctaagcccccgggaacgctcccctgcactcaaatctcccctccaaagcgtcgtggtgcggcgacggtctccgcgcccaagtcccgttcccaagccaagtccacctctttccagtacctctcagatgggttccactcttccttctggcgcaggctaccagtcaggcacacatcaaggtcagtttgatcatgggagcggatccctgtccccttctaagaagagtcccgtcggcaagtcaccaccttccaccggaagtacatacggttctagtcagaaggaagaaagcgccgcctccggtggggccgcctacacaaagagatatctcgaggagcagaagaccgagaatggaaaggacaaggaacaaaaacagaccaatacagataaggagaagattaaggagaaaggaagcttcagcgataccggcttaggcgatggcaaaatgaagtcagattccttcgctccgaagaccgattctgagaagccgttcaggggctcccaatctcctaaaagatataagttgcgagacgatttcgagaagaagatggccgattttcacaaggaggaaatggatgaccaggataaggacaaggcaaagggtaggaaagaatccgagttcgacgacgagccgaagtttatgtccaaagtcatcggggcaaacaaaaatcaggaggaggagaaatccggaaaatgggaaggcctggtgtacgcaccaccagggaaggagaaacaacggaagacggaagagctggaggaggaatccttccccgagaggtctaaaaaggaagatcgcggtaagagatccgaaggcggccaccggggcttcgtgcccgaaaagaactttagggtcacagcttacaaggccgtgcaggagaaatccagttccccccccccacgcaagacctccgagtctcgcgacaagcttggggctaaaggcgactttccaacggggaaaagcagcttctcaattacacgagaggcgcaggtgaacgtgaggatggacagctttgacgaggatcttgctaggccgtcgggtctcctcgcccaggagagaaagttgtgccgagacctcgtacactcaaataagaaggagcaagagtttcgctctatttttcagcatatacagtcagcacagtcacagcgctctcctagcgagctgtttgcgcagcatattgtgaccatcgtccatcatgtgaaggagcaccatttcggatccagtggtatgacgctccatgagcgtttcaccaaatacttgaaaagagggacagagcaagaggcagctaagaacaagaagtcccccgaaattcaccgccggattgacatcagcccaagcacctttcggaaacacgggctggcccatgatgagatgaagagtccccgggaaccaggttacaaagcagaaggtaagtacaaggacgatcctgtggatctccgactggacattgagcggaggaaaaagcacaaggagcgggatctcaagcggggcaagagtcgtgagtcagtggattccagagactcatctcactcccgcgagcgcagtgccgagaaaactgagaagacacacaagggatccaaaaagcagaagaaacatcggcgcgcccgggaccgttcccgctcttcctcttccagcagtcagtcatcccattcatataaagctgaggaatacactgaggaaacagaagaaagggaggaatctaccacagggttcgacaagtcccgcttaggcaccaaggacttcgtgggcccatcagagcgtggcggcggccgggcccgcggcacatttcagttcagggctcgggggagaggctgggggcgcggtaattattcaggcaataataataataactccaataacgatttccagaagcggaatagggaagaggaatgggatccagaatataccccaaaatccaaaaaatattatctccacgacgacagggagggggagggatccgacaaatgggtttctaggggtcgcgggcgaggagcctttcctagaggtaggggacgctttatgtttagaaaatccagcacttctccaaagtgggctcatgacaagtttagcggcgaagagggggagatagaagacgatgagtcaggcaccgaaaatcgcgaggaaaaggacaacattcaacctaccactgagtag

SEQ ID NO: 13502 - DNA, 123 bp, Artificial Sequence
  Description of Artificial Sequence: Synthetic coding sequence
atgagtaagaccaataagtccaaaagcggcagcaggtcgtctcggagtcggagcgcttcccgttccagatcacgcagttttagtaagtctagaagtcggtcgagaagtctgagtagatcttag

SEQ ID NO: 13503 - DNA, 1416 bp, Artificial Sequence
  Description of Artificial Sequence: Synthetic coding sequence
atggagctttctagcaagaaaaagctgcatgcactcagcctggccgaaaaaatccaggtcctggaactgctcgatgagagtaagatgtcacagtcggaggtggccaggaggttccaagtgtctcagccacagatatcacggatctgtaagaacaaagagaagttgctcgccgactggtgctcaggtaccgccaaccgggagaggaagaggaaacgcgagtccaagtacagcggaatcgacgaagctttgctctgctggtatcatatcgcaagagccaaggcgtgggatgtgactggacccatgctgctccataaggccaaggagctggcagacattatgggccaggatttcgttccatccatcggatggctagtgcggtggaagcgcagaaacaacgtaggctttggcgctcgccacgttcttgctccatctttcccacccgaacctcctccccccggcctcacaagtcaggcccagctccccctgtccctcaaagacttttctccggaagatgtatttggctgcgcggagctgccactcctttatcgggccgttccaggttcgttcggcgcgtgtgatcaggtgcaggttttactctgtgctaactcaaggggcacagagaaacgccgagtcctgcttgggggcctgcaagccgctcctcgatgttttttcggcatccggtccgaagcgttgccggccagttatcacccagacctcggaataccatggcttgagtggctcgcccaattcgaccgggatatgggacagcagggccggcaagtggccttgttgctggccgctagagtggtcgaggagctcgcaggacttcccggtctgtatcatgtcaaattgctcccactagctgcttcaagcaccaccccgcctttaccctcttccgtggtccgagctttcaaggctcactaccgacacaggctgttgggaaaactggctgcaatccagagcgagcgggacggcacctctctcgcagaagccggcgccggaataactgttctcgatgcccttcatgtggccagtgccgcttgggccaaggtaccgccacagcttatatttagcagcttcattcaggaggggttagcccccggcaaaacaccgccatcaagccataaaacgagcgagatgccccctgtgccaggaggtctgagcctcgaggagtttagccgcttcgtagacctggagggcgaggagccccggtctggggtctgcaaggaagaaatcggcacagaggacgagaaaggggaccgtgaaggtgcgtttgaaccgctgcctacaaaggccgatgccctgagagccctgggcacactgcgacgctggttcgagtgtaatagcacgtctcctgagctcttcgagaagttttatgactgcgaggaggaggtggaacgcctctgctgtctgtag

SEQ ID NO: 13504 - DNA, 1539 bp, Artificial Sequence
  Description of Artificial Sequence: Synthetic coding sequence
atggctgaagcctccgtagacgcttcaactctgcctgttactgttaaaaagaagaaatccctgtctatagaagaaaaaattgacatcatcaacgctgtagaaagcggaaaaaaaaaggctgaaattgccgcggagtacgggatcaaaaagaattcccttagcagcattatgaaaaacaaggataaggttctcgaagcattcgagtccctgcgcttcgaccccaagcggaagcgactccggacggctttctacaccgatttagaagaagcactgatgcgatggtatagaatagcccagtgtttgaacgttccagttaacgggccaatgttacggttgaaggctaatgattttgcccagaaactggggcacaacgattttaagtgcagcaacggttggctggatagatttaagagtcgatacggacttgtgttccgcgcccaaccagtagaagccactggcgtcccagtcgacccatcgacagtgtggtaccagaatgttctcccatactacctgaatgattatcatccaaagaacgtgtttaacatcaaagaaactggactgctatacaggatgctgccgacaaatacattcgcctttaaaggcgagacgtgctctgtgggtaaactctgtaaagacaggatcacactcgtggtgggaaccaatatggacggaagcgaaaagctgcctctgttggttatcgggaaaaagaggacaccacactgctttaagggccttaagagtctccccgtgtgttacgaggctaacaggatggcctggatgacctctgatgtttttgaacagtggatgagaaagctggacgaggaatttcaagcccagcagagacgggtagtgatttttgtagagagcttccctgcccacccagaggtaaagaatcttaagtcgatcgagctggctttcttcccctcttgcctcagcagtaagtgtattgccatgaaacagggggtaataaaatccctgaaaatcaaatatcggcattgcctcattaagaagtttttatcctccgtggaggggtccaaagagttcaccttttcactcctggatgcagttgacactctccatttatgctggcgcgccgtgactcccgagacaatcgtgaagtcatatgaggaggctgggttcaaatcgcagaagggcgagagcgacatcactaatgccgaaaaagatactggactagacttggtggcagatgctctcggagctggcgtggagtttcccgagggattgtccatagaggagtatgcagcgctggatgacgacctggagacatgtgaggcagcccctaatggggattccatttgtacgaaggagagcaaatcagatgaaactggattctacacctctgatgaagaagatgacgacggctctccaggaaccgaactgcctctgccatctaaatcagaggcgatcaccgccctcgatacgctcaagaagtttctgcgatcccaggacatgaatgacggcctccagaacagcctggcagacctggaaaattttatcaacagcttatcacccaaatag

SEQ ID NO: 13505 - DNA, 1782 bp, Artificial Sequence
  Description of Artificial Sequence: Synthetic coding sequence
atggcctttcgaaaggcttactcaataaaggataagctccaggccatcgagagagttaaggggggggagaggcaagcatctgtgtgcagagacttcggagttccagggggaaccttacggggatggctgaaggacgagccaaagctgagatggttcctggagcaactgggaggtgaagtgggaacgcagcgaaaaaagatgagacttgccaatgaagaggagattgacagggctgtttatgcatggttcctagccctgagacaacacggggtccctctcagcggccctttgatccaggcccaggctgaggcatttgccaggcaaatctacgggcccgagtgcacattcaaggcttctcacggctggttctggcggtggcagaagcggcacggcatcagcagccagagattctacggagaggcggggccccccgctccttcacctgccccaggtcctcctgtgaaggaggagcccgccctgcctagcggtgctggaccactccctgacagggctcccgctccccccccgccagccgagggaggttacggcgacgagcagatctacagcgccagtgtgacaggtctgtattggaagctccttccagagcaggctgcaccccccggtgccggggatccaggggcgggcggatgcggtcggagatggcggggggacagagtgaccgttctcttggccgccaacctgaccggctcccataagctgaagccattggttattggtcggctgcctgatccccctagtctgaggcatcataatcaggacaaattccctgcaagttatcgctatagcccagacgcctggctgtcccggccactgctccgcggttggttcttcgaggagttcgtgccgggggtcaaaaggtatcttcgccggtcatgcctgcagcagaaggccgttttactggtggcacacccaccctgtccaagcccggcagcgagtatgccagctctggacagcgaggacgctccagttaggtgccgtcctgagcccctggggccccctgaggaattacagaccccagacggggctgttcgagttctctttctgtctaagggctcatcacgggcacacatcccagcgcccctcgagcagggggttgtggccgcattcaagcagttatacaagagagaattgcttcggctggctgtaagctgcgcatctggctcccctttggattttatgcgaagcttcatgcttaaagatatgctttacctggctggcctctcctgggacctggttcaagctggctcaatcgaacggtgctggctgctgggacttcgagctgcttttgaacctcgacctggggaggattccgccggacagcccgcccaggcagaagaggctgctgagcatagtcgtgttcttagcgatctgacgcatctggctgcccttgcctataaatgcctggctccagaagaagttgcagagtggcttcacctggatgatgatggcggtccaccagagggatgtagggaagaggtaggaccagcgttgccccctgctgccccaccagctccagccagcttgccctccgccatgggtgggggggaggacgaagaagaagccacagactacgggggcacgtccgtgcccaccgctggggaggccgtcagaggcctggagacagctctgagatggctggagaaccaggaccctcgggaggtgggtcccctgcggctcgtgcaattgcggtctctgatatccatggccagacgactgggggggatcgggcacaccccggcagggccatacgatggagtttag

SEQ ID NO: 13506 - DNA, 1929 bp, Artificial Sequence
  Description of Artificial Sequence: Synthetic coding sequence
atgtatcccgctggacctccagctgggccggtgccgcggaggggtcgccggcctctgccagggccccccgcaccagcaccagcccccgttccggctgcccgtccccctccacctgcgccggggccgagacctagggtggcagtgaagatggccttccggaaagcttattctatcaaggataagttgcaggcgatagagcgcgttaagggaggtgaacggcaggcatccgtctgtagagatttcggtgtgccgggtggcacactgcgtggctggcttaaggatgagccaaagctaaggtggtttctggagcagctgggaggcgaggtaggcacacagagaaaaaaaatgcgccttgcaaatgaggaggagatcgatcgtgcagtctatgcatggttcctggcgttgagacagcatggggttcccctgtccgggcccttgatccaggcacaggccgaggctttcgctcgccaaatctacggccctgagtgcactttcaaagcaagtcatggttggttttggcgctggcagaaaaggcacggaatttcctctcagcggttttacggcgaagccgggccacccgcccccagtcctgctccaggcccccccgtgaaggaggaaccggccctccctagtggcgccgggccgcttcctgatagggctccagcacccccccctccagccgaaggtggatatggtgacgagcagatttattcggccagtgtcactggcttgtactggaagcttcttccggagcaggccgctccgcccggcgctggggatccgggtgccggcggttgcggaagacggtggcgcggtgacagggtgacagtgctgcttgccgccaacctgacagggtctcacaagttgaaaccactcgtaattggaagactacccgatcccccctccctgcggcaccacaatcaagacaaatttcctgctagttatcgctattcgcctgatgcgtggctgtctcgccctctgcttagagggtggttctttgaggagtttgttccaggagtaaaacgatatcttcgcaggtcttgccttcagcaaaaagcagtactgctagtagctcaccccccatgccccagccctgccgccagcatgcctgcattggactctgaggatgctcccgtacgatgtcgcccagaaccactaggccctccagaggagctgcagacccctgatggcgccgtgagagtgttgtttctgtccaaagggtcctcccgcgcccatataccagctccactggagcagggcgttgtagccgcatttaaacagctttacaaacgagagctcctccgcttggcagtgagctgtgctagcggctcacccctggatttcatgcgctcatttatgttaaaggacatgctgtacctggctggcctcagctgggacctggtccaggcaggtagtatagaaaggtgctggctactcggtctccgggccgcctttgagcctagacctggcgaagattcagccgggcaacctgctcaagccgaggaggcagccgaacactcccgagtactgagcgacctcacacatttagcagcactggcttacaagtgcctggccccggaggaggtcgcagagtggttacatctagatgatgacgggggacctcctgaggggtgccgagaagaggtaggccccgcccttccccctgcagcccctcctgcccccgcttcactgccgtccgctatgggggggggtgaggatgaagaggaagcaaccgactacggaggcacaagtgtgccaacggctggcgaagctgttcggggcctggagactgccttgcggtggctggaaaatcaggacccgagagaggtaggcccattgcgattggtgcagttgagaagtctcatttctatggcccgcaggctggggggcatcggtcacactcccgctggcccatacgatggcgtgtag

SEQ ID NO: 13507 - DNA, 1566 bp, Artificial Sequence
  Description of Artificial Sequence: Synthetic coding sequence
atggctaataaagggaacaagaagaggcggcagttcagcctggaagaaaaaatgaaggtggttggggcagtggactctgggaaacgcaagggcgatgtcgccaaagagtttggaattacaccctccactcttagcacttttctgaaagatagaacaaaattcgaggagaaggtcagggaagcttctgttggaccccagaggaaacggatgaggagcgccttgtacgacgacatcgacaaggccgtcttcgcctggttccaggagatccatgcaaaaaacatcctagtgacaggctcagtcattagaaaaaaagctctgaatctggctaacatgctggggtacgataacttccaggcctccgtggggtggctgaacagatttagagaccgtcatggaatagccctgaaggccgtctgcagggaggattctgatcggctaatgaatgggttaggtattgataagatcaacgaatggcatgccggtgagatcataaaactgattgcagactacagccctgatgatattttcaacgcggatgagaccggagttttttttcagctgctcccacagcataccctcgcagctaaaggcgaccactgtcgtggaggaaaaaaggcaaaacagaggcttacagcactgttctgttgtaatgcttccgggaccgaaaagatgagacccctcatcgttggcagatccgcaagtccgcattgcctgaaaaatatccacagtctgccctgcgattatcgcgccaaccaatgggcatggatgacacgcgatctgttcaacgagtggctcatgcaggtagatgccagaatgaagcgcgcagagaggcgtatactgcttctgatcgacaactgttctgcccacaacatgctaccccacttagagcggattcaggtcggatacctaccaagtaattgcaccgcggtgctgcaacccctgaacttaggtatcatacacacaatgaaagttctgtaccagagccacctgctcaagcagatcctgctgaaacttaacagtagcgaagatcaagaggaggtggacatcaaacaggcaatcgacatgatcgccgcggcctggtggagtgtgaagccaagcacggttgtaaaatgctggcagaaagccgggatcgtacctatggagttcgccgagtgcgatacagaatccgccgcatccgaaccagatattgcgatcgagaagctctggcatactgtagccatcgcaacttgtgtccctaacgaggtgaactttcaggactttgtaacagcagacgatgacctgattatcagtcaggacacagatattatccaggatatggtcgctggggaaaacactagtgaggccggctccgaagacgagggcgaagtttctctacccgagcagccaaaggtgacaataaccgaggctatctctagtgtccaaaagctgagacagtttttgagtacatgcgtggatatccctgatgccattttcggacagttaaatggcatcgatgagtacctgatgaagcgggtaacacaaactctgatcgattctaagatcacggatttcctgcagacaaaatag

SEQ ID NO: 13508 - DNA, 1566 bp, Artificial Sequence
  Description of Artificial Sequence: Synthetic coding sequence
atggctaataaaggaaacaagaagaggcggcagtttagcctggaggaaaagatgaaggttgttggcgctgttgacagcggaaaaagaaagggagatgttgcgaaggaatttgggattacgccctccaccctgtccaccttcctcaaagaccggaccaagttcgaagagaaagtgagggaagctagcgtcggccctcagagaaaacgaatgcggtccgccctatacgatgacatagacaaggccgtgtttgcatggttccaagaaatacacgccaagaacattctcgtcacggggtccgtcatccgcaaaaaagccctcaatttggctaatatgctgggctacgacaacttccaggctagcgtcgggtggttgaatcgctttagggaccgccacgggattgcactgaaggccgtgtgccgggaggactcggatcggttgatgaacggtttgggcatcgataaaatcaacgaatggcatgcgggagagataatcaagctcattgccgattattccccagacgacatcttcaatgctgatgaaaccggtgtgttcttccagctgttaccacagcacactctcgccgccaaaggggatcattgccgtggaggcaaaaaggcgaagcagaggctaactgcactcttctgttgcaacgcaagtgggaccgagaagatgcggccactgattgtcggcaggagcgcctcccctcactgtctaaagaatattcatagtctcccatgtgattaccgagcaaatcagtgggcctggatgacacgggatctttttaacgagtggcttatgcaggttgatgccagaatgaaacgcgccgaacgccgcatcctgctactaatcgataattgcagcgcacacaacatgctaccccatcttgagcgtattcaagtgggctacctgccctccaactgtaccgccgtactgcaaccgctcaatctgggcattattcatacaatgaaggttctctatcaaagccacctcctcaaacaaattctgctgaaactcaactcaagcgaagatcaagaggaagtcgacattaaacaggccatcgatatgatcgccgccgcctggtggagtgtgaaaccatctacagtggtgaagtgctggcagaaggccggaatcgtgccgatggagtttgcagaatgcgacactgaaagcgccgcctctgagcctgatatcgctatcgaaaaactatggcacacagtggctatcgctacttgtgtgccaaacgaagtcaacttccaagacttcgtgacagccgacgatgatctcataatctcccaggatactgacatcatccaggacatggtagctggagagaatacgtcggaggcagggtccgaggacgaaggagaagtatctctgcccgaacagcctaaggtaactatcaccgaggccatctcttccgtgcaaaagctgcgacagtttctcagcacttgcgtggacattcccgacgccatcttcgggcagctaaatggaattgacgagtacctgatgaagagggtgacccaaaccctcatcgacagtaaaattacagattttctacagacgaagtag

SEQ ID NO: 13509 - DNA, 684 bp, Artificial Sequence
  Description of Artificial Sequence: Synthetic coding sequence
atgcctggatgccgtatctccgcttgtggccccggtgcacaagaggggacagcggagcagcgatctccccctcctccctgggatccaatgccaagcagccagccccctccccccacaccaactctgacgcctacacccacccccggacagtcaccccccctgccggacgccgcaggggcttctgccggagctgctgaggaccaggagctacagcgctggcggcagggcgcctccggcatcgcaggcctagcaggacccggcggcgggtccggggccgcggctggggctggaggacgggctctggaattggccgaagcccgacgaagattactggaagttgagggaaggcggaggctggtgagcgaactcgagagccgagtgctgcagctgcaccgagtgtttctggctgcagagcttcgcttggcgcacagggccgagagcttatcacggctcagtgggggagtagctcaggctgagttgtatctggccgctcacgggtcgaggttaaagaaaggccctagaagaggtcgaagaggccgtccccccgctttgctagcttccgcacttggcctgggcgggtgtgtgccctggggagcaggccgcctgaggagagggcacggacccgagccggattccccatttaggcgtagccccccaaggggaccggcaagtccccagagatag

SEQ ID NO: 13510 - DNA, 153 bp, Artificial Sequence
  Description of Artificial Sequence: Synthetic coding sequence
taagggaggccaccagctctgctagcctcggctcttggccttggaggatgcgttccctggggggcaggacgactgcgaagaggacacggtcccgagccagactcccctttccgccggagtcctccccgcggccctgcttctcctcaacgctag

SEQ ID NO: 13511 - DNA, 375 bp, Artificial Sequence
  Description of Artificial Sequence: Synthetic coding sequence
tatcttctgttagaatactgcgagggtaacgatcttgacttttacctgaagcaacacaagctcatgagcgagaaggaggcgcgaagcatagtaatgcagatcgtaaatgcgctccgatatcttaacgagatcaagccaccgataattcactacgacctcaaaccaggcaatatcctgctggtcgatgggaccgcctgcggagaaatcaagatcacagacttcggcttgtccaagatcatggacgatgactcctatggagtcgatggtatggatctaaccagccagggtgccggcacctactggtaccttcctcccgagtgtttcgtcgtgggaaaggagcctcccaaaatcagtaataaggttgacgtgtggtag

SEQ ID NO: 13512 - DNA, 1242 bp, Artificial Sequence
  Description of Artificial Sequence: Synthetic coding sequence
atgtccgtgcaatcatccagtgggtctctggagggcccgccttcgtggagtcagttgtcaacctccccaacgcctggatcagccgcagctgccaggtcactgctgaaccacactcccccaagcggacggcccagagaaggagctatggatgagttgcatagcctggaccccagacgtcaggaactcttggaggcgaggttcaccggcgtggcgagcggaagtactggctccaccgggtcctgtagcgtgggagccaaggcctcaaccaacaacgagagcagtaaccattcctttggcagtcttgggagcttgtctgacaaagaatcagaaaccccagaaaaaaagcagtccgaatccagccgtgggaggaaaaggaaagctgagaaccaaaatgagtcatctcaaggaaagtcaatcgggggacggggtcacaaaatctctgattactttgagtaccagggcggaaatggaagctcccctgtcaggggcattccccccgccatccgttctcctcaaaactcccactcacacagcacccctagtagttctgttcggcccaattcgccctctccaacggcactcgcttttggcgaccacccaattgtgcagccgaaacagttatctttcaaaataattcaaaccgacctgacaatgctgaagctcgctgcactggagagtaacaaaatacaggaccttgaaaagaaagagggtcggattgatgacctcttacgcgccaattgtgacctgagaaggcagatagacgaacagcagaagttgttggaaaaatataaagagcggctgaataagtgtatctccatgtcaaagaagctgctgatcgagaagagcacccaagagaagctatcgagtcgggaaaaatctatgcaggatcgtttgaggctcggccatttcacgacagtcagacacggagcctcattcaccgaacagtggaccgacggcttcgccttccaaaacctggtgaaacaacaggaatgggtgaaccagcagagagaggacattgagcgccagcgcaaactgcttgctaagcgcaagccgccgacagcgaacaatagccaggccccttctactaatagcgagcccaagcaaagaaagaataaagcagtgaacggggccgaaaatgacccgttcgtgcgtccaaacctgccccagctgctgacacttgcagagtaccacgaacaagaagaaattttcaagctgcggttggggcacctgaagaagaggtag

SEQ ID NO: 13513 - DNA, 2301 bp, Artificial Sequence
  Description of Artificial Sequence: Synthetic coding sequence
atgagtgtacagagctcttccgggagcttagagggtcccccttcatggtcacaactatccacatcccccacaccaggatcagcagctgcagcccggagtctgctgaaccacacaccgccatccggaaggcctcgggagggcgctatggacgagcttcattcccttgacccccggcggcaggagcttttggaagcccggttcactggggtcgcttcggggtctacagggagcacaggaagctgctcggtaggcgctaaggcctccacaaataacgaatctagcaaccactcttttgggtctcttgggagcctttccgacaaggaatccgagacacctgaaaagaaacagtcagagtcttcgaggggtaggaagcgcaaggccgagaaccaaaatgaatcctcccagggcaagagcatcgggggccgagggcacaaaattagtgattacttcgagtaccagggcggaaatgggtcgtctcctgtgcggggaattccccccgccattcgtagcccacaaaactcacacagtcatagtaccccttcttcctctgtgagacctaattcccctagtccgaccgccttagcctttggtgaccacccgatcgttcaaccgaaacaactgagctttaaaattattcaaaccgatctaacaatgctcaagcttgccgccttggagagcaataagattcaggatctggaaaaaaaggaaggccgcatcgacgacctgttgcgcgcaaactgcgaccttagacgccaaattgatgagcaacagaagctcctggaaaagtacaaggagagacttaacaagtgcatctctatgtcaaaaaagctccttattgagaagagcacacaggagaagttatcctcgcgggaaaagtctatgcaagatcgcctgcgcctggggcactttaccaccgtgcgccatggggctagcttcaccgagcaatggaccgatggattcgcatttcagaacctggttaaacagcaggaatgggtgaatcagcagcgggaggacatcgagcggcagcgaaaactattagctaagcggaaacctccaaccgcgaacaattctcaggcgcctagtaccaactcagaaccaaagcagcgcaaaaacaaggcggtaaatggcgccgagaatgacccatttgtgcggcctaatcttcctcaacttcttactctagccgagtatcatgaacaagaagagatctttaagctccggctcggacacctgaagaaggaggaggctgaaatccaggcagagttggagcgactcgagagggtaaggaacctccacattagagaattaaagcgcataaataacgaagataactcgcagtttaaagatcaccctacgctgaacgagcggtacctactgctgcatctcttaggcagaggcggtttttcggaagtgtacaaagccttcgatctctacgagcagcggtacgctgccgtaaaaattcaccagttgaataaatcctggcgcgacgaaaaaaaggagaattatcataaacatgcctgtagagaatacaggatccataaagagctggaccacccacgcatcgtgaagctgtacgactacttttctcttgataccgacacgttttgcacggtgctggagtattgtgaaggcaacgaccttgatttttatctgaaacagcataaactaatgagtgaaaaagaggccagaagcattgttatgcaaatcgtgaatgccctgcgctatctgaacgaaatcaagcctcctattattcattacgacttaaaacccggaaacattcttcttgtggatgggaccgcttgtggagagattaaaataacagacttcgggctgagcaaaatcatggacgatgacagctatggtgtggatggtatggacctgacatcccagggcgcgggaacctactggtacttgcctcctgagtgtttcgtagtgggaaaggaaccgccaaagataagcaacaaagtcgacgtttggtcagtgggggtgatctttttccagtgcttgtatggcagaaagccttttgggcataaccagtcccagcaggacatattgcaagaaaacaccattctcaaggctactgaggtgcagtttccggtgaagccagtggtgagctcagaggcaaaagcttttatcaggaggtgtctggcttataggaaggaggaccgatttgatgttcaccagctggcgaacgatccctatcttttaccacatatgagaaggagcaactcttccggaaacttacatatggctggcctcaccgcctcccctacccctcccagctctagcattataacttattag

SEQ ID NO: 13514 - DNA, 2013 bp, Artificial Sequence
  Description of Artificial Sequence: Synthetic coding sequence
atggccgtcctgtttctatatgacctgaagaccacaggaaagaccccagagaaaaagcagtccgaaagtagtcgcgggcggaaacgcaaggcagaaaatcaaaatgaatcttctcaaggcaaaagcatcgggggcagagggcacaagatttcagactattttgaataccagggcggtaatggctcatctcctgttagaggcattccacctgctatccgcagcccacaaaacagccactcgcactccacacctagctcatccgtgcggcctaactctccctcccctaccgcactggcttttggggaccatcctatcgtgcagccaaagcagctgagctttaagatcattcagaccgacctgactatgctaaagctggctgcactagaatcaaataagattcaggatttggagaagaaggagggaagaattgacgacttactgcgtgcgaactgtgatctccgacgacagatagatgagcagcaaaaactcctggaaaagtacaaggaacgcctgaataaatgcatttcaatgagtaagaagctgctgatcgaaaaaagtacccaggaaaagctctcatcgcgcgaaaaaagtatgcaggatcggctgagactgggtcactttacaactgtgaggcatggagcgtcattcacagaacagtggacagacgggtttgccttccagaatctggtgaagcagcaagagtgggtgaaccaacaacgggaggacatcgaaaggcagaggaaactgcttgcaaagaggaagccgcctacggcaaacaacagtcaggccccatcgactaattctgaacctaagcaacgaaagaataaagccgtcaatggcgccgaaaacgacccgtttgtgagacccaacttaccacagctactgacgcttgccgagtaccacgaacaggaggagatctttaaactgcggttggggcatctgaagaaggaggaggccgaaatacaggctgaactggagagactggaaagagtgcgtaacctgcacattagggaactcaaacgcatcaacaacgaggacaacagtcaatttaaagaccatcctacactcaatgagcgctatctcctgctccacttactaggcaggggtggattttcagaagtgtacaaagcctttgacttgtatgagcagcggtatgctgccgtcaaaatccatcagctcaacaaatcatggagggacgagaagaaggagaattaccataaacacgcatgtcgggagtacagaatccataaggagctcgatcatcctcgaatcgtgaagctctatgattactttagcctcgacactgatacattttgtaccgtccttgagtactgcgagggtaatgatttggacttctatcttaaacagcacaagttgatgagtgagaaagaagctaggtccatcgtgatgcaaattgtcaatgctcttcgatatctgaatgaaatcaaacctcccatcatacattatgacctgaagcccggtaacatactactggtggatggcaccgcatgcggagagataaaaataacagacttcgggctgtcaaagatcatggacgatgattcatacggtgtagacgggatggaccttacgtcacagggtgcagggacttactggtaccttcctcccgagtgttttgtcgtgggaaaagaacctccaaagatttcaaataaggtggatgtttggtcagtgggcgtcatatttttccaatgcttgtatggccgtaaaccatttggacacaaccaatcgcagcaggatatcctgcaagaaaacacaatactgaaggccactgaggtacagttccccgtaaaaccagtggtgtctagtgaagccaaagctttcattagacgttgcctagcctacagaaaagaagaccggtttgacgtgcatcagctagccaatgacccgtatctccttccacatatgagacggtctaattctagcggcaacctacacatggccgggctgactgcttcaccaacacccccgtcttccagcatcattacatactag

SEQ ID NO: 13515 - DNA, 2157 bp, Artificial Sequence
  Description of Artificial Sequence: Synthetic coding sequence
atggacgagctccatagtctcgacccccggcgccaggagctccttgaagcccggtttactggagtggcttccggatccactggctcgaccggctcttgcagcgtcggagccaaggcaagtactaacaatgagtcttctaaccactcctttggttcgctcggctctttaagcgacaaagagtctgaaacccccgaaaaaaaacagagcgagtcgtccaggggccgcaagagaaaggccgaaaatcagaacgaaagttcccaaggtaagtccatcggtggccgcggccacaaaattagcgactacttcgaataccagggggggaacggttcatcacctgtccgcgggatacccccagcgattaggtcccctcaaaattcccacagccactcaacaccctccagcagcgtgcgacctaacagccctagccccacagccctcgcctttggcgatcacccaatcgtccagcctaagcaactatccttcaagatcattcagacagatctgacgatgctgaagctggccgcacttgagtctaataaaattcaggaccttgagaagaaggaagggcggattgatgatctgctcagagctaattgtgatctgagacgccagatcgacgagcagcagaagctcctggagaaatataaggaacggttgaacaagtgtatctccatgagcaagaagcttctgattgagaagtcaacacaagaaaaactgtcttctcgcgagaagtctatgcaggaccgactgcgattagggcacttcactaccgtgaggcatggcgcctccttcacagagcagtggacggatggctttgccttccagaacctggtgaagcagcaggagtgggtgaaccagcagcgcgaggacatcgagaggcaacgaaaactcctggccaagaggaagccacctaccgcaaacaacagtcaggctcccagtaccaactctgagcccaaacaacggaagaacaaagcggtgaacggggcagaaaacgatccttttgtacgacctaacctcccccagctattgacactagccgaatatcacgagcaggaggagatctttaaattgaggcttgggcaccttaaaaaggaggaggccgagattcaggccgaactcgaacggttggagcgcgtcaggaacctgcatatcagggagttaaagcgtataaacaatgaggataactcccaatttaaggaccatcctaccctgaacgagagatatcttctcctccacctgttagggcggggaggattttcagaggtatacaaggctttcgatctatacgagcagcggtacgccgcagtgaagatacaccaactgaacaaaagttggagagatgaaaaaaaggagaattatcataaacatgcctgcagggagtaccgcatacacaaagaactggatcatccccggatcgtaaagctctatgattatttcagcttagatactgacacgttttgtactgtgctggagtactgcgaaggtaatgacctagatttttatttgaagcagcataaattgatgtcagagaaggaggccaggtctatcgttatgcagatcgtcaatgctctccgctatctgaatgagatcaagccacccatcatacattacgatcttaaaccaggaaatatcctgcttgttgatggcactgcctgcggggaaattaaaatcactgacttcggcctgagtaaaatcatggatgacgactcctacggcgtggacggcatggatctgacatcacagggcgcaggcacctactggtacctcccccctgaatgcttcgtcgtgggcaaagagccaccaaaaatatcaaacaaggtcgatgtctggtccgtgggggtgattttctttcagtgtctgtatgggcgtaagcccttcgggcacaaccaatcccagcaggatatcctgcaggagaacacaattctgaaagcgaccgaagttcagtttccggttaagcctgttgtgtcgagcgaggccaaggcgttcataagaaggtgtttagcctatcggaaagaggataggtttgacgtgcatcaactcgccaatgacccatatcttctgccccatatgcgccgatcaaacagttcaggtaacttgcatatggccgggcttacggcaagtcccactccccctagtagtagtatcatcacttattag

SEQ ID NO: 13516 - DNA, 2157 bp, Artificial Sequence
  Description of Artificial Sequence: Synthetic coding sequence
atggacgagctgcatagcttggatccgcgccgccaagagctgctggaagctaggtttaccggagtcgcctcaggtagtactggctcaaccggatcgtgttccgtaggagccaaggcaagtacaaataacgagtctagcaaccatagtttcggctcgctcgggtctcttagcgataaagagagtgagacacccgagaaaaaacagtccgagtcctcaagagggagaaagcggaaagctgaaaatcagaacgaatcctcacaggggaaatccattggcgggcggggccataagatcagcgattatttcgagtatcaaggtggcaatggtagcagccccgtcaggggcattcctcctgccattagatccccccaaaactcgcactcccactccaccccatcatcttcagtccggccaaattctccctctccgaccgccttggcattcggtgaccaccccatcgttcagcctaagcagctgtcttttaagataatccaaactgatcttaccatgctgaagttggctgcccttgagagtaataaaatacaggaccttgaaaagaaagaaggtagaatcgacgaccttctccgggcaaattgcgatctgcgcaggcagatcgatgagcagcagaaattactcgagaagtataaagagaggctgaataaatgcattagcatgtccaagaaactactgatagagaagtccacgcaggagaagctcagcagccgggaaaagtctatgcaggaccgtcttcgtctcgggcactttactactgtacggcacggcgccagcttcacggagcaatggaccgacggcttcgcctttcagaacctggtcaagcagcaggaatgggtcaaccagcagcgtgaggacatcgagagacaacgcaagttgctcgctaagcggaagccgcccacggcaaataacagccaagctcctagtacaaattcagaacccaaacaacgtaagaacaaggccgtcaacggcgcagaaaacgatccattcgtaaggccaaacctgccacagttattgactcttgccgaatatcacgagcaggaggaaattttcaagcttaggctgggccatcttaagaaggaggaggcggagatccaggcagaacttgagcgccttgaaagggtgcgtaatctccatatcagagaactaaagcgcataaacaatgaggataattcgcagttcaaagaccatcctacactgaacgagagatatcttctacttcacctgttggggaggggggggttcagcgaggtgtacaaggcctttgacctgtacgagcagcggtacgcggctgtgaagattcaccagttaaacaagtcatggcgggatgagaagaaagagaattaccataagcacgcttgccgtgagtatcgcattcacaaagagttagatcacccccgcatcgtcaaactttatgactattttagcctggacaccgacaccttctgtaccgtgctggaatactgcgagggtaatgatctggatttttatctgaaacagcacaaactaatgtccgagaaagaggcgcgctctattgtgatgcagattgttaatgcgctgaggtatcttaatgagattaaaccccccataattcactacgatttaaaaccagggaacatcctacttgtagacgggacagcctgcggcgagattaagatcaccgatttcgggttgagcaagattatggatgacgattcctacggtgttgatggaatggacttgactagtcaaggagcaggcacatactggtatctacctcctgaatgcttcgtggtgggaaaggagccccccaaaattagcaacaaagtggacgtctggagtgtgggcgtgattttcttccagtgtttatatggccgcaaaccctttgggcataatcagagtcagcaggatatactgcaagaaaacaccatactaaaggcaacagaagtgcagtttcctgtgaaacctgtggtgtcaagcgaggcgaaggcctttatccgtcgttgcttagcatacagaaaagaagatcgcttcgacgtgcaccagctggcaaatgacccctacttactcccacacatgaggcgctccaactcttccgggaacctgcacatggccggcctgacagcctcacccactcccccctcaagctcaattatcacttactag

SEQ ID NO: 13517 - DNA, 2319 bp, Artificial Sequence
  Description of Artificial Sequence: Synthetic coding sequence
atgatggaagaactacactctctcgatccgagacggcaggaactcttggaggcacgctttactggcgtgggcgtgagtaaaggcccgcttaattctgagagctcaaaccagtcactatgctccgtggggagcctaagcgacaaagaagtggagacccctgagaaaaagcagaatgatcagcggaacaggaaaaggaaagccgaaccttacgagacatcgcagggaaaggggaccccccgtggccacaagatttccgattattttgaattcgccggcggttctgcaccaggtacttcccccggccgttcagtccctcccgtcgcaagatcctccccccaacatagtctcagcaaccccttacccaggcgggtagagcaacccctctacggtctggatggtagcgccgcgaaagaggccaccgaggaacagtccgccttgcctactttaatgtctgtgatgctcgccaagcctcggctggacaccgaacagctggcccagagaggagcaggtctgtgcttcaccttcgtgtcagcccagcagaatagtccttctagcacaggcagcggaaatacggagcattcctgcagcagccagaagcaaatatccatacaacaccgccagacccagagtgacctcacgatcgaaaagatatcagcactggaaaacagcaagaactcagacctagaaaaaaaggaagggcgcatagacgacctactccgcgcaaattgcgatctgcgacgtcagatagatgagcagcagaagatgcttgagaaatacaaagagcgtctgaaccggtgcgtcacaatgtccaaaaagttgctgatcgaaaagtcaaaacaggaaaagatggcgtgtcgcgataaatcaatgcaagacagactaaggcttgggcattttaccacagttcggcatggggcgagtttcaccgaacagtggaccgacggctacgccttccaaaatctgataaagcagcaggagcgcatcaattcccagcgtgaagaaatcgagcgccagaggaaaatgcttgccaaaaggaaacctcctgcgatgggccaggcacctcccgctactaatgaacagaaacaaagaaagtcgaagacaaacggcgccgaaaatgaaactccaagttctggaaacacagagctgaaagacaccgcaccagctttaggggcacattctctgctgcgcctgaccttggccgaatatcacgaacaggaagagatcttcaagttacggcttgggcatctgaaaaaagaggaagcggaaattcaggccgaactggagagactcgagagagtcaggaatttgcacatccgagagctgaaacgcatccataatgaggacaatagccagttcaaagatcatcccacactcaacgataggtatctcctcctgcacttgctaggccgcggcggctttagcgaggtgtataaagcatttgaccttacggaacagcggtacgtcgctgtgaagattcaccaattgaataaaaactggagggacgaaaaaaaggagaattatcacaaacacgcatgtcgcgaataccggattcataaagagctagaccaccctcgtattgtcaaactgtatgattactttagtctggatacagactctttctgtactgtgctcgagtactgtgaagggaatgacctggatttctatcttaagcagcataagttgatgagcgagaaggaggccagatccatcatcatgcagatcgtgaacgctctgaagtatctgaatgagataaaacctcctattatccactacgatctaaagcccggcaatatcctgcttgtgaacggcaccgcgtgtggcgagatcaagattactgactttgggttgagcaaaattatggacgatgacagttataattctgtggacggcatggagctgactagccaaggcgccgggacatactggtacctgccacccgaatgtttcgtggtaggcaaggagcctccaaaaattagtaacaaggtcgacgtgtggtcggtaggcgttatattttaccagtgtctgtatggccggaaacccttcggccacaaccagtcccagcaggacattttacaggagaatacaatacttaaggccactgaggttcagttcccccctaaaccagttgtcacacctgaagctaaggcatttattagaaggtgtttagcctacagaaaggaagaccgtatcgatgtgcagcagctagcatgtgatccctatttgctcccacacattcggaaatccgtgtctactagctctccggcaggtgccgccatcgcctctactagcggggcaagcaacaactctagttcaaattag

SEQ ID NO: 13518 - DNA, 2157 bp, Artificial Sequence
  Description of Artificial Sequence: Synthetic coding sequence
atgatggaggaacttcattctctggaccctcgcagacaggaactcctcgaagcacggtttactggcgtcggcgtctctaagggccctctgaactcggagtcatctaaccagagtttatgctcagtaggtagcctgtccgataaagaagtcgagacgcccgagaaaaaacagaatgaccagcgcaatcgcaagcgcaaggcagagccgtacgagacctctcagggcaagggcacgccaagggggcacaagatttcagactacttcgagagaagagtggaacagccactgtatggcctggatggttcagcggccaaagaggctaccgaggagcaaagtgctctgcctacgttgatgtcggttatgctcgccaagcccaggctggacaccgagcagttggctcagcgtggagctgggctttgtttcaccttcgtctccgcacagcagaactctccatccagtacaggcagcggcaacaccgagcacagttgcagctctcagaagcagatcagtattcagcatagacagacgcagtctgacctgactatagagaaaatctctgccttagagaacagtaagaatagcgatctcgagaagaaggagggacgcattgatgacctcctccgagcaaactgcgatcttcggcgccagatcgatgaacaacagaagatgctggaaaagtacaaggaacgcttaaaccggtgcgtcactatgagtaagaaactgttaattgagaagagtaagcaggagaagatggcgtgtcgagacaagtccatgcaggaccgcttacggctaggccactttaccacagttcgacacggggcttcattcaccgaacagtggaccgacggatacgccttccagaatctgattaaacagcaggaaaggattaatagtcaacgggaggagattgaaagacagcggaagatgctcgcaaagcgtaagcctcccgctatgggtcaagctccgcccgccaccaacgaacagaaacaacgaaagagtaagacaaatggggccgagaatgagaccttgactctggccgaataccacgagcaggaggaaatctttaagttgcgactgggtcatctgaagaaggaggaggctgagatccaggcagaactggaacgtctggaacgcgtgagaaacctacatataagagagcttaaaagaatccataatgaagataactcgcaattcaaagatcaccctactctcaatgaccggtacctgcttttacacctgctgggccgcggagggtttagcgaggtctacaaggcatttgacttgactgaacagcgatacgtagccgtcaaaattcaccaactgaataagaactggcgagacgagaaaaaagagaactaccataaacatgcttgtagggagtataggatccataaggagctggaccaccctagaatagtcaagctttatgactactttagcctggacactgacagcttctgcactgtcctcgaatactgtgaggggaacgatttagacttttacttaaagcaacacaagctgatgagcgagaaggaggccaggtcaattatcatgcaaatcgttaacgccctgaagtatttgaatgagataaaacctcctataattcactacgatctgaagccggggaatatcctcctggtgaatggcacagcctgtggagaaattaaaatcactgatttcggcttgagcaaaattatggatgatgactcttacaactccgtcgacgggatggagctgacaagtcagggagctgggacatattggtatttgccaccagaatgctttgtcgtcggaaaagaaccacctaagatctccaataaagtggatgtctggagcgttggcgtgatattctaccaatgtctgtatggtcgaaagccattcggccataatcaatctcagcaggatattctgcaggagaatactatactcaaggcaaccgaagtacagtttccgcctaagcctgtcgttacgccggaagccaaggcgtttatcagaaggtgtctggcttataggaaagaggatcgcatcgacgtgcaacagctggcctgtgacccctacctgctgccccacatccggaagtccgtctcaacaagctctcccgccggagcagccatcgcgagtaccagcggtgcaagtaataatagtagttcaaactag

SEQ ID NO: 13519 - DNA, 2253 bp, Artificial Sequence
  Description of Artificial Sequence: Synthetic coding sequence
atgatggaggagctacacagtctcgaccctaggcgacaagaactcctcgaggccaggtttaccggtgttggcgtgtctaagggtcccctgaacagtgagagtagtaaccagtcactgtgttcagtggggtcactgtccgataaggaggtggaaacccctgagaagaagcagaacgaccagagaaaccgcaagcgtaaggccgagccgtacgaaacatcacagggaaagggcaccccgcgaggccacaagatcagcgactactttgaattcgccggcggctccgcacctggcacaagtcctgggcgaagcgtgcctcctgtagcccggagtagtccgcagcattcactttccaacccactacctagacgagtggagcagcccctgtatggtctggacggctctgccgccaaggaggccactgaggagcagagcgctctccccactttaatgtcagttatgttggcaaagcccagactcgataccgagcagttagcccaacgtggcgctggcctgtgttttactttcgtcagcgcgcagcagaactctccgagctctactgggtccgggaacacagaacattcctgttcttcacaaaagcagataagcatccagcatcgccagacacagagcgatcttacaattgagaaaataagtgcactagagaactccaagaatagtgaccttgagaagaaagaagggcggattgatgatcttctgagggccaattgtgacctccgcagacagatcgatgagcagcagaaaatgctcgagaagtataaggaaaggctgaatcgttgcgtgacaatgagtaaaaagctcctgatagaaaagagcaagcaggaaaagatggcttgtcgggacaagtccatgcaggacaggctgcgactaggccattttaccactgttaggcacggagccagcttcactgaacaatggacggacgggtatgcgttccagaatctaataaagcagcaggagcgcataaattcacagagagaagagatagagaggcagagaaaaatgctcgctaagcgcaagccacctgccatgggccaggcccctcctgcaaccaacgagcagaagcagagaaagtcaaaaaccaacggcgcggagaatgagacactgacactggcagagtatcacgagcaggaagagattttcaaactgcgcttgggacatctcaagaaggaggaggccgaaatacaggctgagctggagaggctggagcgagtgcgaaatctgcatatcagagagctgaaaaggattcataacgaagataatagccagtttaaggatcatccaaccctgaacgatcgttacctgttattgcatctgttgggcagagggggttttagcgaagtgtacaaagccttcgatctgactgaacaaagatatgtcgcggttaagatccatcagctgaataagaattggcgcgacgaaaaaaaggagaactaccataaacatgcctgcagggagtatcggatccataaagaacttgaccacccccggatcgtcaagctgtatgactatttcagcttagacactgacagtttttgcactgtcctggaatactgcgaaggcaatgacctggacttttatctgaaacagcacaagctcatgtccgaaaaggaggcccgctcaatcattatgcagattgtgaatgctcttaagtacctaaatgagatcaaacctcctatcattcactatgatcttaagcccggaaatattctgctcgtcaatggaaccgcttgtggggaaatcaaaataacagattttggtcttagcaaaatcatggatgacgactcctataatagcgtcgacggaatggaactgacaagccagggcgctgggacttattggtacctgccgccagaatgctttgtggtcggcaaggaacctcctaagatctccaataaagtagacgtatggtccgttggggtgatattttaccagtgtctgtacggacgcaagcctttcgggcacaatcaaagtcaacaggacatacttcaggaaaataccatactgaaggccactgaggtgcagttccccccgaagccggtagtgacaccggaggcaaaagctttcattcgacgatgcctcgcctacagaaaggaggacaggatagacgtccaacagctcgcatgtgacccctacttattgcctcatataaggaaatccgtgtccactagttcacctgcgggggcagctatcgcgtccacctccggcgcaagcaacaattcctcctccaactag

SEQ ID NO: 13520 - DNA, 2157 bp, Artificial Sequence
  Description of Artificial Sequence: Synthetic coding sequence
atgatggaagaacttcactcgcttgacccccggaggcaagagctcctggaggcacgctttactggcgtgggagtgtccaaaggccccctgaactctgagtcttccaatcagtcgctgtgttctgtgggctccctgtctgacaaggaggtagagacccccgaaaaaaaacagaacgaccagcgaaacagaaagcggaaagccgagccatatgagacctcacagggtaagggaacacctcgggggcataagataagcgattacttcgaacgccgggtcgagcagcccctatatggcttggatgggtcggcagccaaagaggccacagaggagcaatcagccctgcccactctcatgagcgtgatgttagctaaacctcggctagataccgaacagctggcccagagaggagctgggctatgttttaccttcgtcagcgcgcagcagaattcaccatcaagcactgggagcggcaacactgagcactcttgcagcagccaaaagcagatctctattcaacatcggcagactcaatccgacttgacaatcgagaaaatcagtgcgctggagaacagcaagaatagtgatctcgagaagaaggagggcaggattgatgacctgctgcgcgctaactgcgatctcagaagacagatcgatgagcagcagaagatgctggaaaagtataaggaacgattaaatagatgtgtgacgatgtctaagaaactgcttatcgaaaaatccaagcaagagaaaatggcctgtcgggataagtctatgcaggataggctgcgactgggacacttcacaaccgtaagacacggtgcctcctttactgaacagtggacagacggctatgcatttcagaacctcatcaaacagcaagaacgcatcaactcccagcgggaagaaattgagaggcagcgcaaaatgctggccaagagaaagccccccgctatggggcaggcccccccagctacaaatgagcagaagcaacggaaaagcaagacgaatggcgccgaaaatgaaacgcttacattagccgagtaccacgagcaggaagagatttttaagcttcgcctcggccatttgaagaaagaggaagccgaaatccaggctgagctggaacggcttgagcgagtgagaaacctgcatatcagagaactcaaacgcattcataatgaggataactcccagttcaaagaccatcccacactgaatgaccggtatctgctgttgcacctcctggggcgcggcggcttctccgaggtgtataaggcattcgatctgacagagcaacgttacgtggctgtgaaaatccatcaactcaataaaaactggagagacgagaagaaggagaactatcacaagcacgcttgccgggagtaccggatccataaagagcttgatcatccacggatagtgaaactatatgactatttctctctggataccgactctttctgtaccgttttggagtactgtgaggggaacgatctcgatttctacctcaagcaacacaagcttatgtccgaaaaggaggctagatcgattataatgcagattgttaacgcactgaaatacctgaacgaaatcaagccgcccatcattcattacgatttgaagcccgggaacattctgctagttaacggtacggcttgtggagaaataaaaattaccgacttcgggctgtccaagatcatggatgacgattcctataattccgttgatggcatggaattaacaagccagggcgccggtacatattggtatctgcctccagagtgttttgtggtcgggaaagaaccccctaagatcagtaataaggttgatgtatggtccgtgggggtcatcttttaccagtgcctctatggaagaaaaccgttcggccataatcaaagccaacaggatattcttcaagagaacacaatattgaaggccacagaagtgcagtttccaccgaagccagtggtaacgccagaggcgaaagcctttatccggcggtgcctcgcctatagaaaagaagaccgcattgacgtgcaacagttggcttgtgatccttatctcctcccacacatcagaaaatccgtgtctacatcttcccccgccggggctgctatcgccagtacaagtggagcaagcaataactcgtcttctaactag

SEQ ID NO: 13521 - DNA, 1521 bp, Artificial Sequence
  Description of Artificial Sequence: Synthetic coding sequence
atggatgtacggttgtatccttctgcccctgctgtaggggctcgtcctggcgcggagcccgccggattagctcatcttgactattaccacggcgggaaattcgatggtgactctgcctatgtgggcatgtctgacggtaatcccgagctgttatccacatcgcagacctacaacgggcaatccgaaaacaatgaggactacgaaattcccccaatcacccctcctaacctaccagagccgtcattactccatttaggggatcacgaggcctcgtaccattccctatgccacggattgacccccaatggtctacttccggcctattcctaccaagccatggaccttcccgccattatggtcagcaacatgctggcccaggacagtcacttgctgtctggtcagcttccaacaattcaggaaatggtccattctgaggtggccgcgtacgatagcggccggcccgggcctctcttaggtcgcccagcaatgctggcatcccacatgagcgccctgagtcagagtcaactgatatcacagatggggatccgcagcagtatcgcccatagcagcccctcacctccgggctctaaaagcgctactcccagcccttcttcctccacacaagaagaagagtccgaggtccactttaagatcagtggagaaaaaagaccgagcgccgacccagggaaaaaggctaagaacccaaagaagaaaaagaaaaaggaccccaacgaaccccagaagcccgtttctgcctacgccttattttttagagatactcaggcggctatcaagggacaaaacccatcagctactttcggagacgtctctaaaatcgtcgcaagtatgtgggactccttaggggaggaacagaagcaggcttacaagcgaaagaccgaagctgcgaaaaaagagtatctgaaagctctggctgcctatagagcatccctcgtcagcaagtcctcccctgatcagggtgaaaccaagtctacacaggccaacccgcccgcgaagatgctgccaccaaagcagccaatgtacgcgatgcctggactcgccagtttcctgactccctctgacctccaggcctttcgatccggcgccagccctgcatctctcgcccgcaccctcgggtcgaaaagcttactgcctggactttccgccagcccaccaccgccccctagtttccctctgagtcctacccttcaccaacagctctctctgccaccgcacgcacagggagccctgctgtccccccctgttagtatgtcccctgcaccacagccacctgttctgccgacacccatggccctccaggttcagctcgctatgagccccagtccccctggaccacaagatttcccgcacatttcagaattcccaagcagctcgggtagctgcagtcctggtcctagcaatcccacgtcatcaggggattgggattccagctatcctagtggggaatgcggcatttctacatgttctctgctgcctcgggataaatccctctatctgacttag

SEQ ID NO: 13522 - DNA, 1467 bp, Artificial Sequence
  Description of Artificial Sequence: Synthetic coding sequence
atgcagcagacccggactgaggccgtcgctggggcattctcaagatgtttaggattttgtggcatgcgcctgggacttctactgctggctcgccactggtgcatcgcaggagtgttcccccagaaattcgacggagactctgcctatgtgggcatgtctgacggcaatccagaactgctctccacatcccagacatataatggacagtctgaaaataatgaggattacgaaatacctcccattacgcctccgaatctccctgaacccagcctgcttcacttgggtgatcacgaggcatcctaccacagcctgtgccacggcctgactcccaatggactgctgccagcctacagctatcaggccatggatctgccagctatcatggtttcgaatatgctggcacaggacagccacctgttgagcggtcaacttcctacgattcaagaaatggtgcattccgaagtggccgcctacgacagtgggcgccccgggccgctgctggggaggcccgctatgcttgcctctcacatgtcggcccttagccaatcccaactaatttcgcagatggggatccggtcatcaatagcacattcctcccccagcccacccggcagcaagagtgccacccccagcccgagcagctcaactcaggaagaggagagcgaggtacattttaagatcagtggcgaaaaacgaccctctgccgatcccggcaaaaaggccaaaaaccccaagaaaaaaaagaaaaaggacccgaacgaaccccagaaaccagtgagcgcctatgcactgttcttccgggacacacaagcagcaatcaaggggcagaacccaagcgctacgtttggtgatgtctccaaaattgtcgcctcaatgtgggactcgcttggggaggaacagaaacagagtagtccggaccagggcgagactaagtcaactcaggctaatccgccagcaaagatgctgcctcccaagcagccaatgtacgctatgcctggtctggcgtctttcttaactccaagtgatctccaagcattccggtcaggagcctcccctgcctccctcgcccgcactctgggcagtaaatcacttctgcccggtttgtcagctagccccccaccccccccaagcttccccctatcgcccacactgcatcagcaacttagtcttcctccccatgctcagggagccctgctgtctccacccgtgtctatgtctccagctccgcaaccaccggtgttgcctactcctatggctctgcaggtccagttggccatgtcaccctcacctccaggcccccaggacttcccacacataagcgagttccccagttcttccggaagttgctcacccggtcccagcaatcctaccagttctggtgattgggatagttcttatccttctggcgagtgcggcatctctacctgcagtctgctgcctagagataagtctttgtacctgacatag

SEQ ID NO: 13523 - DNA, 591 bp, Artificial Sequence
  Description of Artificial Sequence: Synthetic coding sequence
agacggagaaggaagcggagaacgccaatgtctcgccgtagcctctgcaggcctacccattcttcgtctgagaccctgcgccccccctctcgcgtgaggacccctgtgccgctgagcgtgacatgcccgaagagctggcctccctgtggaactgcgtgggaacggaacaggtcccgcactagtcggacttccctttctagtccagccgccagggatccagcacacctggcccacccgacccccccggctgctggcaccgggactgcggccacccccgtgggctccgtggcctctgccccagccgcttgttctcccgggactaaccggagcaccagccccaacccagcctctctaccctcattgcgactggcaggacgacattgttccgaacccgagggcttaaccgccgagaaacgcccgtggcctgaagcaggatggccaatcggtgaatcctcagacacgcctattgcaagaggtttgtctctcttcttaaatttgcctcccgattccgccgaggcagcacactgcccaccgccggcgcagaggacgtgccgtaacctgccaccagctgacctgctggcccctgggtag

SEQ ID NO: 13524 - DNA, 1395 bp, Artificial Sequence
  Description of Artificial Sequence: Synthetic coding sequence
atgtctgacggtaatcccgagcttctgtctactagtcagacatataacggccagagtgaaaataatgaggattacgaaattcccccaatcactccccccaacctgcctgaacctagcctgctgcatctgggagaccatgaggcttcatatcattctctgtgccacgggctgactcccaatggattgctgcctgcgtatagctatcaggctatggatcttcccgctatcatggtatctaacatgcttgcacaggacagtcacctgctttccggccagctaccgactatccaggagatggtgcattcggaggtagccgcatatgatagtggacggcctggcccgcttcttgggaggcccgccatgctggcttcacacatgtccgccctgtcccagtcacagctcatcagtcagatgggcattcgctcttctattgcccatagctccccgagcccacccgggagcaaatccgccacgcctagtccctcgtccagcacccaggaggaggagtctgaagtccactttaaaatcagtggggagaaacgcccttcagccgatccgggaaaaaaggctaaaaatccaaagaagaaaaagaagaaggaccccaacgagccccaaaagccagtctccgcatacgctctgtttttccgcgacacccaggccgctattaaaggacagaatccttcagctacctttggcgacgtatcaaagattgtggcctctatgtgggattcacttggggaagagcagaaacaggcatataagcgtaagactgaggcagctaaaaaggaatatctgaaagctttggccgcgtatcgcgcctcgctggtaagcaagtctagccccgaccagggcgaaactaagtcgacccaggctaatcccccagccaagatgctgcctcctaaacagccgatgtatgctatgccagggctggcctcttttctgacaccatctgatcttcaagcttttaggtcaggggcaagtcctgcttccctggcacggacgctcggtagtaagagcctgctccccgggctgagcgccagtccccccccacccccttcattcccacttagcccaacactgcatcagcagctgtcgctgccacctcatgcccagggtgctctgctgtccccacccgtttctatgtcaccggccccccaaccacccgtactgcccaccccaatggcgcttcaagtgcagttagctatgagcccttcgcccccagggcctcaggatttcccccacataagtgagttcccctcaagctctgggagctgctcccccgggcctagcaatcctaccagctcaggggactgggattcgagctaccctagcggggaatgtggcatttctacgtgcagcctcttacctcgtgataaaagcctgtatctgacctag

SEQ ID NO: 13525 - DNA, 591 bp, Artificial Sequence
  Description of Artificial Sequence: Synthetic coding sequence
cgacgaagacgcaaacgcagaacccctatgagtcggcgctccctctgtcggccaacccattcctccagcgagacactgaggcccccaagtcgcgtgaggacacccgttcctctgtccgtgacctgtcccaaaagctggccaccatgtggaaccgcttgggaaagaaatcggagccgcacaagtaggacgtcgcttagcagcccagctgcgcgtgaccccgcccacctggcacaccccaccccgccagctgctggcacaggaactgctgctacgcccgtcggatcggtggcctctgctcccgctgcgtgctctcctgggactaaccgcagcaccagcccgaatcctgcatcactgccatcgctgagactcgcagggcggcactgtagcgagcccgaaggtctgactgcggagaaacggccatggccagaggccgggtggccgattggcgagtcctccgatacacccatcgctcgggggctctcactgttccttaatctgccccctgactctgctgaagccgcccattgtccgccaccggctcaaagaacgtgtaggaacctccctcccgctgatctgttggcaccgggctag

SEQ ID NO: 13526 - DNA, 1395 bp, Artificial Sequence
  Description of Artificial Sequence: Synthetic coding sequence
atgagcgacggcaatcctgagctgctgtccacttcacaaacctataacggccagagtgagaataacgaagactacgagattccgccaatcactcctccaaatctcccggaaccgtcactactgcacttgggtgatcacgaagctagttatcacagcctttgccatggattgacacctaacggtcttctccccgcgtactcttatcaggccatggacttgccagctataatggttagcaacatgttagcgcaagatagtcacctcctcagtgggcagcttcccactattcaagagatggtccactcggaagtggcagcgtatgattctggccggcccggcccccttctaggtaggccagccatgcttgccagccacatgtcagcactgtcgcaaagccagctcatttctcagatgggtatccgctcttctatcgcacattcatcaccctctccccctggaagcaagtccgcgactcccagccccagcagcagtacccaggaagaagagagcgaggtgcactttaagatttcaggagagaaaaggcctagcgctgacccgggcaaaaaagcgaagaaccctaagaagaagaaaaaaaaagacccaaacgagcctcaaaaacccgtttccgcctacgcgttgttctttcgcgacacccaagccgcaatcaagggccaaaatccttcagcgacttttggtgacgtaagcaaaatcgttgcatcgatgtgggacagcctcggggaagaacagaagcaggcctacaaacgcaagactgaagccgctaaaaaagaatatctgaaggccctggctgcatacagggctagtctggtttccaaatccagtccagaccagggggagaccaagtcgactcaggccaatcccccggcaaagatgttgccaccaaagcaacctatgtatgccatgcctggcctggcctcctttcttacaccttccgacctacaagccttcagaagtggggcttccccagccagtctcgccagaacgctaggttccaagtcacttctgcccgggttgagcgcgtccccccctcctcccccgagttttccactgtctcccactctacatcagcagctttctttgccaccacacgcgcagggggccctgttatccccgcccgtaagcatgtcaccggccccccagcctcctgtgctacccaccccaatggcgctgcaagtacaactagcgatgtccccatcacctcccggccctcaagatttcccacacatcagcgagttcccctcaagctcaggttcgtgctctcctgggcccagtaatcccaccagcagcggagattgggattcctcctaccccagtggggagtgcggcataagcacttgcagtctcctcccaagggacaagtccctgtacctaacctag

SEQ ID NO: 13527 - DNA, 1155 bp, Artificial Sequence
  Description of Artificial Sequence: Synthetic coding sequence
atggagcaggaacgggagggatttagtgaggaggtaaccttccagattcaggaaatggttcacagcgaggtggcagcttatgattccggccgtcctggtcccctgctggggcggcctgctatgttggcctcacatatgagtgctctttcccagagtcagctcatatctcagatgggcattcggtcgagcatcgcacattcctccccctccccccctggcagtaaatccgccacgccaagcccgagttccagcacgcaagaggaagagtcagaagtgcactttaaaatcagtggagagaagaggccgagcgccgacccaggcaagaaggcaaagaaccccaaaaaaaaaaagaagaaggatcccaacgaaccccagaagcccgtttctgcctacgctttgttttttagagacacacaggcagctatcaagggccagaatccctccgccaccttcggagacgtgagtaaaatcgtggccagtatgtgggactctctcggtgaagaacaaaagcaggcctacaagagaaagaccgaagccgcgaaaaaggaatacttaaaagccctggctgcatatcgggccagtttagtctctaagagctctcctgaccagggagaaacaaaaagtacacaagccaatccaccggccaaaatgctgccaccgaagcagcctatgtatgccatgccagggctggcaagctttcttacaccatcagacctgcaggcgttcagatctggtgctagtccagcgtccctcgcgcgcaccttggggtccaaatccctcttacccggactcagtgcttccccacctccccctcctagttttccactgtctcccaccctccatcagcaactgagcctgccgccccacgcccagggcgccctgcttagcccccccgttagtatgtcccccgctcctcagccacctgttctccccacacccatggccctacaagttcagcttgccatgtctccttctccacccggtccccaggactttccccatatctctgaattccccagcagttccggcagctgttcccccggacccagtaatcccacctcctccggcgattgggactctagttacccatccggtgaatgcgggataagtacttgcagtctgcttcctcgcgacaagtctttgtatctgacatag

SEQ ID NO: 13528 - DNA, 537 bp, Artificial Sequence
  Description of Artificial Sequence: Synthetic coding sequence
atgtccgatggtaatcctgagctgctgtcaaccagtcagacttacaatggacaatctgaaaataatgaagattatgagataccacccattactccacccaatctccctgaacccagcctgctccacctgggcgatcacgaagccagttatcactctctctgtcacggccttaccccaaatggtcttctgcctgcctactcctaccaggctatggacctgcccgccattatggtgagtaacatgttggcacaggactctcatttattatctgggcaattgcctacaattcaggagatggtgcatagcgaagtggccgcctacgatagcggcagaccaggcccgctcctgggacgtcctgctatgctggcatctcatatgtctgccctaagtcagtctcagcttatttctcagatgggtatccggtcaagcatcgcccattcctcacccagccccccggggagcaaatcagccacgccttctccgagtagttctactcaggaagaagagtcagaggttcatttcaagatttcggggtag

SEQ ID NO: 13529 - DNA, 366 bp, Artificial Sequence
  Description of Artificial Sequence: Synthetic coding sequence
atggccgccgcccgggctacgacacccgccgacggagaggagccagccccagaggctgaagccctagctgcagctagagaaaggtcgagccgatttctatctggactcgagctagttaaacagggggccgaggctcgggtatttcgaggcaggtttcaaggaagagcagctgtcatcaagcaccgctttcctaaggggtatcgccaccccgccctggaagcccggctcggcagacgccgcacagtgcaggaagcgagggcgcttctcagatgtaggcgggccggaaaggagtatctgcctcagctcagcttcctttggacaatgctgccaacagcttatatctggaagaaactgaaggcccagtag

SEQ ID NO: 13530 - DNA, 762 bp, Artificial Sequence
  Description of Artificial Sequence: Synthetic coding sequence
atggccgccgccagagccaccacacctgcagatggagaagaacctgcacccgaggcagaggccctggccgcagcgagggagaggagttccaggttcctgtcaggactcgaactggtcaagcagggcgccgaggctagggttttccggggccgattccagggtagggcagcagtcataaagcatcgtttccctaaaggatataggcatccagcactggaggctcggctgggaaggagaagaaccgttcaagaagcaagggcattgctacgctgcaggcgggcaggcatcagtgcgccagttgtgttcttcgttgactacgccagcaactgcctatacatggaagaaatagagggtagtgtgaccgtgcgtgattatatccaaagcactatggagaccgagaagactccacaaggtctgtcaaacctggcgaaaaccatcggacaggttctggcccgcatgcatgatgaggatctcatacatggggacctgaccaccagcaatatgttactgaaaccccccttggagcagctgaatatcgttctcatcgatttcgggctatcattcattagcgctctccccgaggacaaaggtgtcgatctgtatgttctggagaaagcctttctgtccacgcacccaaacaccgaaacagtgttcgaggcttttctcaaaagctacagcaccagctcaaaaaaagcgagacctgtgttaaaaaagctcgatgaggtgcgacttcggggacggaaacgcagcatggtgggctag

SEQ ID NO: 13531 - DNA, 1146 bp, Artificial Sequence
  Description of Artificial Sequence: Synthetic coding sequence
atgatctccgcgcaccgtaaactttgtctacccgggagcagtaatagccctgctagtgcatttagggtcgccggtacaactgcagttaagatgagtgataagaatcaaatcgctgctagagcaagcctgatcgagcagctaatgagtaagcggaattttgaagatctaggcaaccacttgaccgaactcgaaaccatatacgtcactaaggaacatctgcaggaaactgacgtcgtacgagccgtgtatagggtcctcaagaattgcccatccgtggccctgaagaagaaagccaaatgtctgctgagtaagtggaaggccgtctacaagcagactcatagtaaagctcgaaactctcctaagctcttcccggtgagggggaataaggaggaaaattcaggaccctcccacgacccgagccagaatgaaacccttggcatttgttcctccaacagcctctcttcacaggacgtggcaaagctcagtgagatgattgtccccgagaatagggccattcagctgaaacccaaggaggaacatttcggtgatggggaccctgagtctactggaaaacgatcaagtgaactgcttgaccccacaactcccatgaggaccaaatgtattgaactgttgtatgcggccctgacttctagttccacggatcaacctaaggccgatttatggcagaatttcgctagggagatcgaggagcacgtgtttacgttatactccaagaatataaaaaaatacaagacctgtatccggagcaaggtggctaatttaaagaaccctagaaactctcatttgcagcagaacctgctgagcggaactacaagcccgagagaattcgctgagatgaccgtgatggagatggccaacaaggaacttaaacaactgagagcctcatacaccgaaagctgcatccaggagcactatctccctcaggttatcgatgggacacagacgaacaagattaaatgccgaagatgtgagaaatataattgcaaagtgacagttattgaccgtggcacactgttcctacccagttgggtgaggaacagtaaccccgatgagcagatgatgacgtatgtcatttgcaatgagtgtggtgagcagtggtaccactccaaatgggtttgttggtag

SEQ ID NO: 13532 - DNA, 1056 bp, Artificial Sequence
  Description of Artificial Sequence: Synthetic coding sequence
atgtccgacaagaatcagatcgccgcacgggcatctctgatcgagcagcttatgagcaaacggaatttcgaggacttggggaatcatttgacggagcttgagacgatatacgttactaaggaacaccttcaagagactgatgtcgtccgagctgtttacagggtgcttaaaaactgcccctccgtggcactgaagaagaaggccaaatgtctgctgagcaaatggaaagcagtgtataagcagacccattctaaagccagaaatagcccaaagctattcccagtgagaggaaataaggaggaaaattcagggccgagtcacgatccatcccagaacgaaactctcggaatttgcagctccaactctctttcttcacaggatgtcgccaagctgtcagaaatgatcgtcccagagaacagagcaatacaactcaagcccaaggaagaacatttcggggatggtgatccagaatcaaccggcaaacgatcgagcgagcttctggatcccactaccccgatgagaacaaaatgcatcgaactgttatacgctgccctgactagttcatcaaccgatcagcccaaggccgacctgtggcagaatttcgcacgggagattgaagagcatgtgtttactctgtatagcaagaacataaagaagtacaagacatgcattaggtctaaggtggccaatctgaagaacccaagaaattcccacctccaacagaaccttttgtcgggcactacctcacccagagagttcgccgaaatgactgtgatggagatggccaacaaagagcttaagcagctgcgcgcaagctacacagagagctgcatccaggaacactatttacctcaggtgatcgatggcacgcagacaaacaaaatcaaatgtagaagatgcgagaaatataattgcaaggtgaccgtaattgatcgcgggaccctgttcctgccgagctgggtgcggaattccaatccagacgagcagatgatgacctatgtgatctgtaatgaatgcggcgaacagtggtatcatagcaagtgggtgtgctggtag

SEQ ID NO: 13533 - DNA, 1056 bp, Artificial Sequence
  Description of Artificial Sequence: Synthetic coding sequence
atgtccgacaaaaaccagatcgccgccagagctagccttatcgagcagctgatgtccaagcggaattttgaagaccttggaaatcacctgaccgaactggagacaatctacgtcacaaaagagcacctgcaggaaaccgacgttgtgcgagccgtttacagagttctgaaaaactgtccctcggtcgccctcaagaaaaaggcaaagtgtcttctcagcaagtggaaagccgtgtacaaacagacccactccaaggcccgcaattcccccaagctgtttcccgtcaggggtaataaagaggaaaactctgggcctagccatgatccgtcgcagaacgaaactctcggaatctgcagctctaattccctgtctagtcaagacgtggccaagttatctgagatgatagtgccagaaaatcgagctattcagctaaaacctaaagaagagcactttggtgacggcgaccctgagtctacagggaagaggtccagcgagcttcttgaccctacgacccccatgcggaccaaatgcatcgagcttctgtatgccgcccttacctccagctcaactgaccagcccaaggcggacctgtggcaaaactttgcccgggagatcgaagaacacgtgttcactctctattcaaagaatatcaaaaaatataagacatgtatcagatctaaggtcgcgaacctcaaaaatcctagaaactcacatctccaacagaacctgcttagtggaaccacaagtccacgcgaattcgctgagatgaccgtaatggagatggcaaataaggaactgaagcagctgcgcgccagctacacagaatcatgtatccaggaacactatctgcctcaagtgatcgatgggacacagacaaacaaaatcaaatgtcgaagatgtgagaaatataactgtaaggtcactgtaatagatcgtgggactctcttcttgccctcttgggttcgtaactccaaccccgacgaacagatgatgacttacgtgatatgtaatgaatgtggcgaacagtggtaccacagtaagtgggtttgctggtag

SEQ ID NO: 13534 - DNA, 1056 bp, Artificial Sequence
  Description of Artificial Sequence: Synthetic coding sequence
atgagtgataaaaaccagattgccgctcgggccagcctgatcgaacagcttatgtcaaagcgtaatttcgaagacctggggaatcacctgaccgagcttgagacaatttacgtgaccaaggagcaccttcaagagacggatgtggtacgggccgtttatcgggtgttaaagaactgtcccagtgtggccctaaagaaaaaggcaaagtgtcttctctctaagtggaaggccgtctacaagcaaacacattctaaggcccggaactctcctaagctgttccctgtgagggggaacaaggaggagaactcgggtccatctcatgatcctagccaaaacgagacactggggatctgtagcagcaattctctgtcctcccaggacgtagccaaacttagtgaaatgatcgtacctgagaacagggcaatccagctgaagcccaaggaagaacacttcggcgatggagatcccgagagcaccggtaagaggtccagtgaactgctagaccctactacccccatgaggacgaagtgcattgagctcctttacgcggccctgacttcctcttccacagaccagcctaaagccgatctttggcagaatttcgcgcgggagatcgaagaacatgtctttacactttacagtaaaaatattaagaaatataagacctgtattcgaagtaaagtggccaacttaaaaaatcctcgaaactctcatctgcagcagaatctgcttagcggtacgactagtccccgcgaattcgcagagatgacggtgatggaaatggcaaacaaagaactgaagcaattacgggctagctacactgagagctgcattcaggagcactacctcccccaagtcatcgacggcactcagactaacaagattaagtgccgcagatgtgagaaatacaattgcaaagtaaccgtcatcgaccgcgggaccttattcctcccctcttgggttcgcaactcaaacccggacgaacagatgatgacatacgtgatatgtaatgagtgtggagagcagtggtaccactcaaagtgggtatgctggtag

SEQ ID NO: 13535 - DNA, 1476 bp, Artificial Sequence
  Description of Artificial Sequence: Synthetic coding sequence
atgaagacgtttacatggacacttggtgtcctcttctttctgctcgttgacactggccattgtcgcggggggcagttcaagattaaaaagattaatcaaaggaggtatcctcgggcaacagacggtaaggaggaggcaaagaagtgcgcctacactttcctggtccccgaacagcgcattaccggacccatttgtgtgaataccaagggccaggatgcctccacaatcaaagacatgataaccaggatggacctagaaaacctgaaggatgtcttaagccggcagaaaagggagatcgacgtccttcagctggtcgtggacgttgatgggaatattgtgaatgaggtgaaactacttcggaaagagtcgcggaatatgaactctagagtgactcaactgtacatgcaactgttgcacgaaattatcagaaagagggataatagcctcgagctctcacagctggagaacaaaattctgaacgtgacgacggagatgctgaaaatggccacgcgctatagggagcttgaagttaagtatgcctcattgactgaccttgtgaataatcagtcagtaatgattacactcctggaggagcagtgtctcaggatcttttctagacaagatacccatgtgtctccacccttggttcaggtggtccctcaacacatccccaatagccagcagtatactcctggcctgttaggtggaaacgagattcaaagggacccaggatacccacgcgacttaatgcccccacctgacctggccacttcacccaccaagtcgccctttaagattccgccagtgacatttatcaacgaggggcctttcaaagactgccaacaggcaaaggaggcagggcactccgtgagtggtatctatatgatcaagccggagaacagtaacggtccaatgcagctgtggtgcgagaactctcttgatcctggggggtggactgtgattcagaagcgtaccgatggctccgtcaacttttttaggaactgggagaactacaagaaaggcttcgggaacatcgatggagagtattggttaggtttagagaatatctacatgctgtctaatcaagataactacaaactgttgatcgagttggaggactggagcgacaagaaagtctatgctgagtattcctcttttaggctggagcctgagtccgagttctatcgtctgcgattaggaacctatcagggcaatgccggagactccatgatgtggcacaatggtaagcaattcacaacccttgatagagacaaggatatgtacgccggaaactgcgcgcacttccacaaaggcgggtggtggtacaacgcctgcgcccacagcaatcttaacggcgtgtggtataggggcggtcattatagaagcaaacatcaagatggcatcttctgggctgagtatcggggggggagctattccctgcgggcggtgcagatgatgatcaagcccatcgactag

SEQ ID NO: 13536 - DNA, 717 bp, Artificial Sequence
  Description of Artificial Sequence: Synthetic coding sequence
atggccgttttttcaggggtgctggagtccgcccttttcctcgatcagaacaccttgcaggcacggcagggaagccgcagtccgctcacgatggacaagtttgttattcggaccccaagaatccagaactcgccgcagaaaaaggatagtggcggtaaggtctataaacaagcgacaatcgaatccctgaaacgagtcgtggtagtggaagacattaagagatggaaaactatgctggaactccccgaccagacaaaggagaatctggttgaggccctccaggagctaaagaaaaagatccctagccgtgaagttctcaagtctacccgcattggtcacactgttaataagatgcgtaaacactccgatagtgaagtcgcttctctcgcaagggaagtgtatactgaatggaagacgtttactgaaaaacattctaataggccgagtattgaagtgcgctccgatcccaagaccgagagtttgaggaagaatgcccagaaattgctctctgaagctctggaattaaagatggatcatttactagtcgaaaatatcgagagggagacctttcatctgtgttccagactgatcaacgggccttataggaggaccgtgagagcactggtattcactctgaagcatcgggccgaaatcagggcgcaggtcaaaagcggcagcctgcccgtcggcaccttcgtgcagacgcataagaagtag

SEQ ID NO: 13537 - DNA, 741 bp, Artificial Sequence
  Description of Artificial Sequence: Synthetic coding sequence
atggacctgcttcgggagctgaaagccatgccaattaccttgcacctgttgcagagtacgagggtgggtatgtctgtgaacgctctgcgaaagcagagtagcgacgaggaggtcatcgctctggccaagagtttaattaagagctggaaaaaacttctcgacgccagtgacgccaaggcacgcgagcggggacggggcatgccactgccgaccagtagccgcgacgcatccgaggcccccgaccctagtaggaaacgaccagagctcccaagagcgccctctaccccacgcatcacaacgtttccgcctgttccggttacttgcgacgccgtccgaaataagtgccgggaaatgctcacagcagcattgcaaactgatcacgatcacgtggcgattggagctgactgcgagcggttgtccgcacagatcgaagagtgtatcttccgggacgtggggaatactgatatgaaatacaaaaatagagtgagatcccgcatatctaacctcaaagatgctaaaaacccagacctccgccgtaatgtgctgtgtggcgctattacccctcaacaaatagcggtgatgacatcagaagagatggcaagcgacgagctcaaggaaatccggaaagccatgacgaaggaggctattcgagaacatcagatggccaggactgggggcacacaaacagacttattcacgtgcggcaaatgtcgcaagaagaattgcacttatacccaatag

SEQ ID NO: 13538 - DNA, 900 bp, Artificial Sequence
  Description of Artificial Sequence: Synthetic coding sequence
atgatgggcaaagaagaggaaatcgcccgaattgccagacggctggacaaaatggtgaccaagaagtctgccgagggcgccatggatcttttgcgcgagctgaaggctatgcccattacactgcacttgctgcaatccacccgggtggggatgagcgtaaatgcactgcgtaagcagtcatcggatgaagaggttatcgctttagcaaagagtttaatcaaatcctggaagaagctgctcgatgcgagcgacgccaaggcgagggaaagaggccgtggtatgcccctgcccacatcatctcgggacgcttccgaggcacctgacccgtcacgaaagcgtcctgagctgcctagggccccatccaccccaaggattactacctttccaccagttccggtgacctgcgatgctgtccggaacaagtgtcgggagatgctgaccgccgcccttcagactgaccatgaccatgttgccattggtgcagactgcgaacggctgtccgctcaaattgaggagtgcatcttccgcgacgtcggaaataccgatatgaagtacaaaaatcgagtccgcagccgaatcagtaacctgaaggacgcgaaaaatcctgatttgcgtcgcaatgtgctgtgtggcgcaatcacccctcaacagattgccgtcatgacaagcgaagagatggcctctgacgaattgaaagaaatccgtaaggccatgaccaaggaggctattagggagcaccaaatggctcgcactggaggcacacagactgacctttttacttgtggcaaatgccggaagaaaaactgtacctatacacaagtgcagacccgctcaagcgacgaaccgatgaccacttttgtagtctgtaacgaatgtggaaacagatggaaattctgttag

SEQ ID NO: 13539 - DNA, 819 bp, Artificial Sequence
  Description of Artificial Sequence: Synthetic coding sequence
atggacctgctaagagagttaaaggcaatgcccataaccctgcacctgttacagagcacaagagtgggaatgtcagtgaatgcactgcgcaaacagtcaagtgacgaggaagtgatagcgctggccaaatccctgatcaagagctggaagaagctcctcgatgccagcgatgctaaggccagggaacgaggccgaggaatgcccttgcctacctcgtcaagggacgcttccgaagctcctgatccttcacggaagcggcctgagctccccagagctcctagtaccccccgaattactacatttcccccagtcccggtgacgtgtgacgccgtcagaaataaatgccgcgagatgcttacggcagcactgcagactgaccacgaccacgttgcaatcggagccgattgcgagagactgagcgctcaaatcgaggaatgcatttttagggacgtagggaataccgatatgaagtataagaatagggtaaggtcaagaattagcaatctgaaggacgccaagaatccagatctgcgcaggaacgtgctctgtggcgccatcacgccccagcagattgccgttatgaccagcgaggagatggcctcagatgagcttaaagagattagaaaggccatgaccaaagaggcaattagagagcaccaaatggctagaacaggagggactcagaccgacctattcacctgtgggaagtgcagaaaaaaaaattgcacctatacgcaggtgcagacccggagcagcgacgagcccatgacaacttttgttgtgtgtaacgaatgtgggaacaggtggaaattttgttag

SEQ ID NO: 13540 - DNA, 729 bp, Artificial Sequence
  Description of Artificial Sequence: Synthetic coding sequence
atgatgggcaaggaggaggagatcgcacgcattgcccgaagactagataaaatggtgaccaagaagagcgcagagggtgcaatggatctactgagggagcttaaggccatgccgattaccctccacctccttcagtctacccgagtaggcatgagcgtgaacgctctgagaaagcagagctcagacgaggaagtgatcgccttagctaagagcttaatcaagtcatggaagaagctgttggatgcatccgacgcgaaggcccgggaaaggggacgggggatgccccttccgacctcgagccgggacgcgagcgaggcgcccgatcccagcaggaagcgccccgaactaccacgggcaccatcaacaccaagaattactacctttccaccagttcctgtcacttgcgacgccgtgcggaataaatgcagggagatgctcaccgctgccttgcagacagatcatgaccacgttgcaatcggagctgattgcgagcgcttatctgcccaaattgaggaatacattctgtgggtgggtgccgtcggactaggattctggtggagccaagaggcggcttggccgggggctctgtggtggctgttggacgctacagctcagctctctaggggccacttgcccggatggtctccagcctgggtggtaagactgtcacatctgagacgcgccccaggcccagccgaaggtctaatactctctgcctgtggcgcgtag

SEQ ID NO: 13541 - DNA, 249 bp, Artificial Sequence
  Description of Artificial Sequence: Synthetic coding sequence
atggacctgctcagggagctgaaagccatgcctattacccttcacttgctgcaaagtaccagagttgggatgagcgtgaacgcattaaggaaacagtcctctgacgaggaggttatcgctcttgcgaaatcactgatcaaaagctggaagaagttgttagatgcttcagacgccaaagcccgtgaaaggggaagggggatgcccctcccgaccagtagtcgcgatgctagtgaagcccccgatccatag

SEQ ID NO: 13542 - DNA, 741 bp, Artificial Sequence
  Description of Artificial Sequence: Synthetic coding sequence
atggacctactgagggaactgaaagccatgccaatcacattgcatctacttcagagtacgcgggtcggtatgagcgtgaacgccctgcgcaagcagtcctcagacgaggaggtgatagctctggctaagtctctgatcaagtcttggaagaaacttctggacgcgtcagacgccaaggcaagagaacgcggccgcggcatgccactccctaccagcagccgggatgcctcagaagcaccagatcctagtaggaaacgaccagagctgccacgggctccttctactcctaggatcactacattcccgcctgtccctgttacttgtgatgccgtgaggaataagtgcagagagatgctgaccgccgcattgcagacggaccacgatcatgttgcgattggagctgactgtgagcggctgtctgcccagattgaagagtgcatatttcgggacgtgggaaacaccgacatgaagtacaagaaccgcgtccggtcgaggatatcaaatttgaaagacgctaagaacccagacctgagaagaaatgtgctgtgtggcgctatcacccctcagcagatagccgtcatgaccagcgaagagatggctagtgatgagctgaaggagatcagaaaagctatgacaaaggaggcgatccgtgaacatcagatggctagaaccggcgggacacaaacagacctgtttacatgtggcaaatgtaggaaaaaaaactgcacatatactcagtag

SEQ ID NO: 13543 - DNA, 813 bp, Artificial Sequence
  Description of Artificial Sequence: Synthetic coding sequence
atggatctgttaagagaacttaaggccatgcctattacattgcacctgctccagagcactagagtggggatgtccgtgaacgccctccgcaagcagtcttctgacgaagaggtgattgcactggccaaatccctcatcaaatcctggaagaagctgctggatgccagcgacgccaaggcacgagagcgcggaagaggtatgcctttacccacctcttcgagggatgcttcagaggccccagacccttctaggaaacggcccgaactgcctcgagcccccagcacgccgcgcataactactttccccccagttcccgtgacatgtgatgctgtgaggaataagtgtcgagagatgctgacagcggctctgcagactgaccacgaccatgttgccatcggcgctgattgtgagcggctctccgcacaaatcgaagaatgtatcttccgcgacgtgggtaacacggacatgaagtataagaacagggtaaggtccaggatcagcaacctcaaggacgccaaaaatcctgacctacgccggaacgtcttgtgtggcgccatcaccccccagcagatcgcggtcatgacctccgaagagatggctagcgacgaactgaaggagatccggaaagcaatgactaaagaggcaattagagaacaccagatggcacggactggcggaactcagaccgacctcttcacctgcggcaagtgtcggaagaagaactgcacctacactcaggtacagactagatcaagcgatgaacccatgacaaccttcgttgtgtgtaacgagtgcggtaataggtggaaatag

SEQ ID NO: 13544 - DNA, 465 bp, Artificial Sequence
  Description of Artificial Sequence: Synthetic coding sequence
atgggacaggaggaagagttactgaggatcgctaagaaactcgagaagatggttgcgcgaaagaacaccgagggcgccctggacctgctcaagaagctgcactcttgccaaatgtctatccagctgcttcagaccacaaggataggcgttgcagtcaacggcgttcggaaacactgttcagacaaggaagtggtttcactggccaaagtgctgattaagaattggaaacgtctgctcgacagccccgggcctccaaagggggagaagggtgaagagagagagaaagcaaaaaaaaaagagaagggtctggaatgctccgattggaaacccgaggcaggactctctccgccgagaaagaagcgggaagaccctaaaaccaggcgtgacagcgtcgattccaaatcttcggcctcaagcagcccaaagagaccgtcggttgagagggcttgttccctcatgcagtag

SEQ ID NO: 13545 - DNA, 1047 bp, Artificial Sequence
  Description of Artificial Sequence: Synthetic coding sequence
atgggccaggaggaggagttactccggattgcgaaaaagctggaaaagatggttgccagaaagaacaccgagggagcccttgacttactgaagaagctccattcctgccaaatgagcatccagctgctgcagacgacaaggatcggtgtagccgtcaacggggtgcgtaagcactgttctgataaggaggtcgtgagcctggcaaaagttttaattaaaaattggaaaaggctgctcgacagtcctggaccccccaagggagaaaagggggaagagcgagagaaggccaaaaagaaggagaaggggcttgaatgtagcgattggaagcccgaggcggggttgtctcccccgcgtaaaaaacgtgaggaccctaagacacggagggactccgtagactccaagtctagtgccagttcctctcctaagcggccttccgttgaacgttcaaacagctctaaaagtaaagctgaatctcccaaaaccccatccagcccgctgactcctaccttcgcgtcctctatgtgcttgctggcaccatgttaccttactggagacagtgtgcgggacaagtgcgttgagatgctcagcgccgccctaaaagctgacgatgactataaggattacggtgtcaactgtgataaaatggcctccgagattgaggatcacatttaccaggagctgaagtctaccgacatgaagtatcgaaatagagtgagatcccggattagcaatctgaaggatccacgcaacccagggctcaggaggaatgttctgagcggcgctattagcgctggactgatagctaagatgactgcagaggaaatggctagcgatgaacttcgagagctgcgtaacgctatgacccaggaagccattcgagaacaccagatggctaagacaggcgggaccactacagacctcttccaatgctcaaaatgcaagaagaaaaactgcacttataatcaggtgcagacgagaagcgctgacgaaccaatgacgacttttgtgttgtgtaatgaatgtggtaacagatggaaattctgttag

SEQ ID NO: 13546 - DNA, 684 bp, Artificial Sequence
  Description of Artificial Sequence: Synthetic coding sequence
atggagaaattgtttaacgagaacgagggcatgccttccaaccaggggaagatcgacaacgaggaacagccgcctcacgaggggaagccagaagtagcttgcattctggaggataaaaagctcgagaacgagggcaatacagaaaatacggggaagagggtggaagagcctctgaaggataaagagaaaccggagagcgccgggaaagcaaagggagaagggaagtctgaacggaagggcaaatccgagatgcaaggtggcagcaagaccgaaggtaaacctgaacgcggaggacgcgccgaaggggagggcgagccagattcggaacgagaacccgagtccgaaggggagccagaaagcgagacccgggctgctggaaaacggccagctgaggatgacattcccaggaaagccaaacgaaagacaaacaagggtctagctcagtatctcaaacagtataaggaggccatccacgatatgaatttcagtaacgaggacatgatacgggagttcgataacatggctagagtcgaggacaagcgccgcaagtccaagcagaaattgggagcatttctatggatgcagcgtaatctccaagatccattctacccacgaggacctagggaattccgcggtgggtgccgagctccccgccgcgacactgaagacattccctatgtgtag

SEQ ID NO: 13547 - DNA, 684 bp, Artificial Sequence
  Description of Artificial Sequence: Synthetic coding sequence
atggaaaagctgttcaatgagaatgaaggcatgccctctaatcagggaaaaatcgataacgaagagcagccgccacatgagggcaagcctgaagttgcctgcatcctggaggacaagaagctggagaacgaaggcaacacagaaaacactggaaagcgcgttgaggaaccactgaaggataaggagaagcctgagagtgcaggtaaagctaagggcgaaggaaagtcagagaggaagggcaagagcgaaatgcaaggagggtcaaaaaccgagggtaaacccgagcggggcggaagagcagaaggcgagggcgaacccgactctgaacgggaaccggagtcagagggcgagcctgagagcgagactagggccgccggtaagcggccagccgaagacgatatccctcgcaaggccaaaagaaaaacaaataagggtcttgcacagtatcttaagcagtataaagaggcaatccacgacatgaattttagcaatgaagacatgatcagggaattcgataacatggcacgtgtggaggacaaacgcagaaaatccaagcagaagcttggggcctttctatggatgcaacgcaacctccaagacccgttttatccccggggaccaagggagttcaggggcgggtgtcgggccccgcggcgagacacagaggacataccttacgtttag

SEQ ID NO: 13548 - DNA, 603 bp, Artificial Sequence
  Description of Artificial Sequence: Synthetic coding sequence
atggagaaaccctacaacaagaacgagggaaaccttgagaacgaaggaaaaccggaggacgaagtggaaccggatgacgagggaaaatccgacgaggaggaaaagccagatgtggagggcaaaaccgaatgcgaaggaaagagggaggatgagggcgagccaggcgacgagggacagctggaagacgaaggctcccaggaaaagcagggtagatccgagggggaggggaagccgcagggcgagggtaagccagcttcccaggcgaagcctgaaagccagccccgggccgcggaaaaacggccagccgaggactatgtgcctagaaaagccaagcgaaagaccgaccggggaaccgatgattcaccaaaggattcccaggaggacctgcaagagcggcatcttagcagcgaagaaatgatgcgtgaatgcggagatgtctcaagagctcaagaggagctgcggaaaaaacaaaaaatggggggtttccattggatgcagcgtgacgttcaggatccgttcgctccacggggacagagaggtgtgagaggtgttcgggggggcggtagggggcagaggggtttacacgatataccgtacctgtag

SEQ ID NO: 13549 - DNA, 603 bp, Artificial Sequence
  Description of Artificial Sequence: Synthetic coding sequence
atggagaagccgtacaacaaaaatgagggaaaccttgagaacgaaggcaagccagaagacgaggtggaacccgacgacgagggtaaatccgacgaggaggaaaaacctgacgttgaggggaagacagagtgcgaaggcaaacgcgaggatgaaggtgaaccaggcgacgagggacagctggaggacgaaggtagccaggagaaacaaggccgttccgaaggggagggaaagccacagggagagggcaagccagcgagccaggccaaacccgagtcccagccacgggccgcagaaaagcgacccgctgaagattacgtcccccgcaaggcaaagagaaagaccgaccgtggaaccgacgacagtcccaaagattcccaggaggatctgcaagaacggcaccttagttctgaggagatgatgagggagtgtggagacgtcagccgtgcacaggaggaactgcgcaaaaagcagaaaatgggagggtttcattggatgcagagagatgtgcaggatccttttgccccccgcggccagaggggggtgaggggcgttcgcggagggggcaggggacagaggggacttcacgacatcccatacctatag

SEQ ID NO: 13550 - DNA, 603 bp, Artificial Sequence
  Description of Artificial Sequence: Synthetic coding sequence
atggaaaaaccttacaacaaaaatgaggggaatctggaaaatgagggtaagccagaggacgaagtcgagcctgacgatgagggtaaatctgatgaagaagagaagcctgatgtcgagggaaagacagagtgcgagggaaaaagggaggatgaaggtgagcctggcgatgaggggcagttagaagacgagggatctcaggaaaagcagggccgtagtgagggcgaaggtaagccgcagggtgaaggaaaaccggccagtcaggccaagcccgaatctcagccaagggccgctgaaaaacgcccagcggaggattacgtgccacggaaggccaagcggaagacagacagaggaaccgatgacagccctaaagacagtcaagaggacctccaggagcgccacctgagctcagaggagatgatgagagaatgcggcgatgtcagccgggctcaggaggaacttaggaagaagcagaagatgggcggtttccattggatgcaaagggatgtccaagacccgtttgccccacggggacagaggggagttcgcggggtcagagggggcggcagaggccagagaggacttcacgatataccatacctgtag

SEQ ID NO: 13551 - DNA, 1077 bp, Artificial Sequence
  Description of Artificial Sequence: Synthetic coding sequence
atgcctgcaggcgggcaggccccacagctgacccctgtcatccccgctttctgggaggcccgggggctgcctaattccaagggtcgcgataaagtccacatctgccagtgcgaggagtggaagggccacatcagttatgtcgagagagatatcacaacttcggaaattaagtccctcccccaggtcagcgtgagggctttccacgctgcatctggtacattagagtggcgtaagggaaacggctatggacggggaaagggttggggctggggacgcgtggagtcccgcgaagcaggaccgtctgtggaccgcgatggcggcttacgggtttgctgtagtcaaaggtctgctaagcctgaaaaagaagagcaacccgtgcagaacccaaggagatcagtcaaggatcggaagcgacgaggaaatctcgacatggagaaactatactccgagaatgagggcatggcctcgaaccagggtaaaatggagaacgaggagcagccacaggatgaacggaaaccagaggttacttgtaccctcgaggacaagaagctcgagaatgagggcaagactgagaacaagggcaagaccggggatgaggagatgctaaaagataagggaaagcccgagtccgaaggtgaggccaaagagggcaaaagtgaacgtgagggcgaatctgaaatggagggtggatcagaacgggagggcaagcctgagatagaaggtaaacccgagagcgaaggcgaacctggctctgaaacccgcgccgccggaaaaagacccgccgaggatgacgttccacggaaagcaaagcgcaagacaaataagggcctcgcccattacctgaaggaatacaaagaggctatccatgacatgaatttttcaaatgaagatatgatacgggaattcgataatatggcgaaggtgcaggatgagaagcggaagagcaaacagaagctcggagctttcctgtggatgcagagaaaccttcaagaccccttctaccctcgcggccctcgcgagttcaggggcgggtgtcgtgcaccccggcgggatattgaagatattccatacgtttag

SEQ ID NO: 13552 - DNA, 561 bp, Artificial Sequence
  Description of Artificial Sequence: Synthetic coding sequence
atggagaagctgtatagcgagaacgagggaatggcttccaaccagggtaaaatggagaacgaggagcagccacaggacgagcgcaagcccgaagtgacatgcacactcgaagataaaaagctggaaaacgaagggaagacagaaaataaagggaagactggcgatgaggagatgcttaaggacaaagggaagccagagatcgagggcaagcccgaaagcgagggggaacctggcagcgagacacgcgcagccggcaaaaggccagccgaggatgacgttcccaggaaagccaagcgtaaaaccaacaaaggactggcacactacctcaaagagtacaaggaagccatccacgacatgaacttctcaaacgaggatatgatccgagagttcgacaatatggccaaggtccaggatgagaaacgtaagagcaaacaaaaactgggggcatttctctggatgcaaaggaacctccaggatcctttttaccccagggggcctcgggaattcagagggggctgtagggctcctagaagggatatcgaagatatcccttacgtctag

SEQ ID NO: 13553 - DNA, 648 bp, Artificial Sequence
  Description of Artificial Sequence: Synthetic coding sequence
atggagaagctgtacagtgagaacgaaggcatggcctccaaccaaggaaaaatggagaacgaggagcagccacaggatgaacgcaaaccagaggtaacatgcactcttgaagacaaaaagcttgagaatgaaggcaaaacagaaaacaagggaaagactggagatgaagagatgctaaaggataagggaaagccagagtctgagggcgaagccaaggagggaaaatctgagcgtgagggcgagtcagagatggaaggaggcagcgagcgggagggaaaacctgaaatcgaaggcaagccagaaagcgagggggaacccggctctgaaacccgcgccgcaggaaagcgccctgctgaggacgacgtgccacgcaaagccaagcgcaagactaacaagggacttgcccactacctgaaggagtacaaagaggcaattcacgacatgaacttcagtaacgaggacatgatacgagagttcgataatatggctaaagtgcaggacgagaaaaggaaaagtaaacagaagctcggcgcctttttgtggatgcagcgcaacctccaagatcctttttacccacggggtcctagagagttccgcggtggctgccgcgcacctaggcgggatattgaagacatcccatatgtgtag

SEQ ID NO: 13554 - DNA, 177 bp, Artificial Sequence
  Description of Artificial Sequence: Synthetic coding sequence
atggagaagctctactctgagaatgaaggcatggctagtaatcagggtaagatggaaaacgaagagcagccacaggacgagcgcaagcctgaagtaacgtgcaccctggaggacaaaaagctggaaaacgagggtaagacagaaaacaagggaaaaacgggagatgaagagatgtag

SEQ ID NO: 13555 - DNA, 153 bp, Artificial Sequence
  Description of Artificial Sequence: Synthetic coding sequence
atggagaagctctattcagagaacgaaggcatggcctccaaccaaggaaagatggagaatgaagagcagccccaagacgagaggaagcccgaggtgacctgcaccttagaagacaagaaactagagaatgaggggaaaactgagaataagtag

SEQ ID NO: 13556 - DNA, 276 bp, Artificial Sequence
  Description of Artificial Sequence: Synthetic coding sequence
atggagaagctgtactcagagaacgaggggatggcctccaaccagggcaaaatggagaacgaagagcagccccaggacgagaggaagcctgaggttacctgcactctcgaggataaaaagctggagaatgaggggaagacagagaataagggtaagacaggggatgaggaaatgctcaaagataaaggcaagcctgaaagcgagggtgaagcaaaagaagggaaatccgagcgggagggtgagagcgaaatggagggtggctctgaacgagagtag

SEQ ID NO: 13557 - DNA, 648 bp, Artificial Sequence
  Description of Artificial Sequence: Synthetic coding sequence
atggagaagttgtactccgaaaatgagggaatggcatcaaaccagggaaaaatggagaatgaagaacagcctcaggacgagcgcaaacctgaagtcacttgcaccctcgaagacaaaaagctcgagaacgaaggaaagaccgaaaacaagggaaagacaggagacgaagaaatgctgaaggacaaaggtaaacctgaaagcgaaggtgaggcaaaggagggcaaaagcgaaagggaaggggagtcagagatggagggcggatcagagcgcgaaggtaaacctgagatcgaggggaaaccggaatcggagggggagccagggagtgaaacgagagcagcaggaaagaggccagcggaagacgatgtgcctcgaaaagccaagaggaagaccaacaagggactagcacactatctgaaggaatacaaagaagctatacatgatatgaactttagcaacgaagacatgataagggagttcgataacatggcgaaggtccaagacgagaagcgaaaatctaagcagaaattaggtgcttttctctggatgcaaagaaacctgcaggaccccttttatccccgtggacccagggaatttagaggtggttgcagagccccaaggcgggatatcgaagatatcccctacgtttag

SEQ ID NO: 13558 - DNA, 390 bp, Artificial Sequence
  Description of Artificial Sequence: Synthetic coding sequence
atggagaagctgtactctgaaaatgaaggcatggctagtaaccagggtaagatggaaaacgaagagcaacctcaagatgagagaaagccagaagtgacatgcacgttggaagacaaaaagctggagaacgaggggaagactgaaaacaagggtaagacaggcgacgaggagatgctgaaagataaaggaaagcccgagagcgaaggagaagctaaggaagggaaaagcgaacgagaaggagagtccgaaatggagggaggaagcgaacgtgagggaaaacctgaaatcgaagggaagccagaatctgagggcgagcctgggtccgaaaccagagctgccggtaagagacctgctgaggatgacgtgccccgtaaggctaaacgcaaatag

SEQ ID NO: 13559 - DNA, 648 bp, Artificial Sequence
  Description of Artificial Sequence: Synthetic coding sequence
atggaaaagctgtatagcgagaatgagggcatggccagtaatcaaggaaagatggaaaatgaggagcagcctcaagacgaacggaagccggaagttacttgtacattggaggataagaaactcgagaatgagggtaagacggaaaacaagggaaaaaccggtgatgaagaaatgttgaaagacaaaggcaaacctgaaagtgaaggcgaagcaaaggaagggaagagcgaacgcgagggcgagagcgagatggagggggggtcagaacgggaaggcaaacccgagattgagggcaaacctgaaagcgaaggtgaacctggcagcgagaccagagcagcaggaaaacggccggcggaagatgatgtcccaagaaaggcaaagagaaagaccaacaaggggttagctcactatctgaaggagtacaaggaggccattcacgacatgaatttttctaacgaggacatgattagagagtttgacaatatggcgaaagtacaggatgagaagagaaagagtaagcagaagctgggggccttcctgtggatgcagcgcaaccttcaagatcctttttacccgaggggcccgagagaattccggggcggatgccgcgcccccagaagggatatagaagacataccttatgtgtag

SEQ ID NO: 13560 - DNA, 648 bp, Artificial Sequence
  Description of Artificial Sequence: Synthetic coding sequence
atggagaagctgtatagcgaaaatgagggcatggctagcaaccagggtaaaatggagaatgaagaacaaccacaggacgagaggaaaccagaagtcacatgtacactcgaggataagaaactggaaaacgaaggcaagaccgaaaataagggcaaaaccggggacgaggagatgttgaaggataaagggaaacccgaatccgagggggaggctaaagaaggaaaaagcgaacgtgaaggagaaagtgagatggaaggaggatctgagcgggagggaaagccagaaatcgaggggaaacctgaatctgaaggtgaacctgggtccgagacacgcgcggctggaaagaggccagccgaagacgatgttccaagaaaggcaaaaaggaaaacaaacaaaggactagcacattatctgaaggaatataaagaagctattcacgatatgaatttttccaacgaggatatgattagggaatttgacaacatggctaaagtgcaggatgagaagcgaaaatcaaagcagaagctaggcgctttcctgtggatgcagcgcaacctgcaagacccattctacccgagagggccacgtgagttcaggggcgggtgcagggccccaaggcgcgatatcgaggacatcccctacgtttag

SEQ ID NO: 13561 - DNA, 231 bp, Artificial Sequence
  Description of Artificial Sequence: Synthetic coding sequence
atggaaaaactctactcagagaacgagggaatggcctcaaatcagggcaaaatggaaaatgaagaacagccacaggacgagagaaagcccgaagtaacatgcactctggaggataagaagctggagaacgaagggaagacagagaacaaggggaaaactggcgatgaggagatgctgaaagacaaaggtaagccagaatccgagggggaagccaaagaaggcaaatcgtag

SEQ ID NO: 13562 - DNA, 648 bp, Artificial Sequence
  Description of Artificial Sequence: Synthetic coding sequence
atggaaaaattgtacagcgagaatgagggcatggcctctaaccagggaaaaatggagaacgaggaacagccccaggatgaacgcaagccggaagtgacttgcaccctggaagataagaaattagaaaatgagggcaagaccgagaacaaaggtaagacgggcgatgaggaaatgttaaaagacaaggggaagccagagtcggaaggtgaagccaaggaaggcaaaagcgaacgtgagggtgagtctgagatggagggcgggtccgagagggagggcaagcccgagattgaggggaaacccgaaagcgaaggtgagcccggatctgagacccgggcggccggaaagagacccgccgaggacgacgtgccaaggaaggccaaacgaaaaaccaacaaaggcttggcccactacttgaaagagtataaagaagctatccatgacatgaacttttctaatgaagacatgatccgggagtttgataacatggcaaaagtgcaggatgaaaaaaggaaaagtaaacagaaactaggagccttcctctggatgcagagaaacttacaggaccctttctatccacgagggccccgggagtttcgcgggggctgccgggccccacgcagggacattgaagatattccatacgtctag

SEQ ID NO: 13563 - DNA, 621 bp, Artificial Sequence
  Description of Artificial Sequence: Synthetic coding sequence
atggaaaagctgtacaaggagaatgagggcaagcccgaaaacgagcgcaacctggagagtgaaggtaagccagaggatgaggggtccacagaagacgagggtaaatccgacgaggaggagaaacctgacatggagggcaagacagagtgtgaaggcaagagggaggatgagggggagccgggcgacgagggacagctcgaggacgagggaaaccaggagaaacagggcaagtcggaaggcgaggataaacctcagtctgaggggaagcccgccagccaggctaaacccgagtcacagccaagggcggcagagaaaaggccggccgaagactacgtgccccggaaggcgaagcgaaaaactgacaggggaaccgacgatagccccaaggattcacaggaagacttacaagagcgacacctctcgtcagaagagatgatgcgggaatgcggcgatgtgtcacgggcgcaggaggagctccgcaagaagcagaaaatgggcggtttccattggatgcagcgggacgtgcaggatccatttgctcctcgcgggcaacggggcgtccggggcgttagaggcggtggcagaggacagaaagacctagaggacgtgccatacgtgtag

SEQ ID NO: 13564 - DNA, 552 bp, Artificial Sequence
  Description of Artificial Sequence: Synthetic coding sequence
atggagaaaccctacaataagaacgagggcaaccttgaaaacgaagggaagcccgaggacgaggtggagccagacgatgagggcaaatccgacgaagaggagaagcccgatgcagagggaaaaacagaatgtgaagggaagcgcaaggccgagggcgaacccggagatgaagggcagctagaggataagggaagtcaggagaaacaaggtaaatcggagggagaaggtaagcctcagggcgaaggaaagcctgccagtcaggcaaagcccgagggtcagccacgggctgcagaaaaaaggcccgccggtgactacgtcccccgaaaagccaagaggaaaacggacagggggacagacgattcccccaaggactcccaggaagacctccaggagaggcatttgtccagtgaagaaatgatgagggagtgcggcgatgtaagccgagctcaggaggaactgcgtaagaaacaaaagatgggggggttccattggatgcaacgggacgtgcaggacccctttgcacagggcgataatggcgtctctggtgaatag

SEQ ID NO: 13565 - DNA, 552 bp, Artificial Sequence
  Description of Artificial Sequence: Synthetic coding sequence
atggaaaagccctacaataaaaatgaaggaaacctcgaaaacgaaggcaagccagaggacgaggttgaaccggacgacgagggcaagtccgacgaggaggaaaagcccgatgctgagggcaaaactgaatgtgaaggcaagcggaaagcagagggtgaacctggggacgaaggccaactagaagacaagggctctcaagagaagcagggcaaatcagaaggtgagggtaagcctcagggcgaagggaagcctgccagtcaagcgaagccagaaggacagccacgcgctgctgagaagcgacccgccggagactacgtcccccgaaaagccaagcggaagacggatcggggtacagatgacagtccaaaggacagtcaagaggacctacaggagcggcacctgtcatcagaggaaatgatgagggagtgcggcgacgtcagtagagctcaggaggagcttagaaaaaaacagaaaatgggcgggttccactggatgcagagggacgtgcaggaccccttcgcccagggagataatggtgtgtcaggtgagtag

SEQ ID NO: 13566 - DNA, 600 bp, Artificial Sequence
  Description of Artificial Sequence: Synthetic coding sequence
atggagaaaccttataataaaaacgaggggaaccttgaaaacgaagggaaaccagaggatgaagtcgaacctgacgatgaagggaagagcgatgaggaagagaagcctgacgccgaggggaaaacagaatgcgaaggtaagcgcaaggcggagggcgaacctggagatgagggtcagctcgaagataaggggagtcaggagaagcagggcaaaagtgaaggagagggcaagcctcaaggggagggcaagccagcttctcaggcaaaacctgaaggacaaccacgggcagcagagaagcggccggcgggggattacgtcccgcggaaagcaaagaggaagactgacagaggaaccgacgactccccaaaggactctcaagaggatctgcaggaacgtcacctgagtagtgaagagatgatgcgggaatgtggcgatgtgagccgcgcacaggaagaactccggaaaaaacagaagatggggggcttccattggatgcagagggatgtgcaggatccttttcccagaggtcagagaggcgtgcgcggtgtccggggcggaggacgcggccagcgtggccttcatgatattccctacttatag

SEQ ID NO: 13567 - DNA, 354 bp, Artificial Sequence
  Description of Artificial Sequence: Synthetic coding sequence
atgcagaagtcttgtgaagagaacgaggggaagccacagaacatgccaaaagcagaggaggatagacccctggaagacgtgccccaggaggccgagggcaacccgcagccttctgaagaaggtgtgtcccaggaggccgaaggaaacccacgcggtggtcccaatcagccaggtcaaggcttcaaggaagatacccccgtcagacatctcgatccagaagaaatgatccgaggcgtcgacgaactggagcgtttgagggaagagatacgaagggtgagaaataaatttgttatgatgcattggaaacagcgccattcccggtctcgcccctatcccgtttgtttccggccatag

SEQ ID NO: 13568 - DNA, 354 bp, Artificial Sequence
  Description of Artificial Sequence: Synthetic coding sequence
atgcagaagagttgcgaagagaacgaggggaaaccacagaacatgcctaaggcagaagaggaccgtccccttgaagatgtgccccaggaggcagagggcaaccctcagccgtcggaggagggagtttctcaggaggcagaagggaacccccgcggcggtccgaaccaacctgggcagggatttaaagaggacacccccgtccgccacctggatccagaagaaatgataaggggcgtcgacgagttagagcgactgcgtgaagagatcaggagagttcgaaataaattcgtcatgatgcattggaagcagcgtcacagcagatctagaccctatcctgtttgcttcaggccatag

SEQ ID NO: 13569 - DNA, 225 bp, Artificial Sequence
  Description of Artificial Sequence: Synthetic coding sequence
atgcagaagtcatgtgaagaaaatgagggaaaaccacagaatatgcctaaagccgaagaagatagaccactggaggatgtaccacaggaagatacccccgtgcgacacttggaccctgaggagatgataaggggagtagacgagttggagcgcctgagggaagagattagaagggtaaggaacaaattcgtcatgatgcactggaaacaacgccattcacggtag

SEQ ID NO: 13570 - DNA, 1155 bp, Artificial Sequence
  Description of Artificial Sequence: Synthetic coding sequence
atgccccagttggattcaggaggaggtggggcaggcggcggcgatgatctcggtgcaccagacgaactccttgccttccaggatgaaggtgaagaacaggatgacaagagccgggacagcgctgctggccctgaacgagatcttgcagagttgaagagcagcctagtcaacgagtctgaaggggctgctggtggggccggcatcccaggagtccctggtgccggagcaggcgctcggggcgaagcagaagctcttggaagggagcatgcagcccagcggctctttcccgacaagctgcctgaacccctggaggatgggcttaaggcccctgagtgtacttctggcatgtacaaagagaccgtctactcggctttcaatttactcatgcattatcccccgccctctggagctggacagcatccgcagccgcagccccctcttcacaaggccaaccaacccccgcatggtgttcctcagctgtcactgtacgaacatttcaacagcccacaccccaccccagccccagcggatatatcccagaaacaggtacacaggcctctgcaaactcccgacctgtctggattttactcactaacaagtggctcaatgggacagctcccccacacggtctcctggtttacccatcccagcttgatgctcggttctggggtacccggtcatcccgccgcaatacctcaccctgctattgtccccccttctggcaagcaagaactgcagccctttgacagaaatctcaaaacccaggcagagtctaaggccgagaaagaagccaagaagccaacaatcaagaaacccttaaacgcatttatgttgtatatgaaggaaatgcgcgctaaggtcatcgctgagtgcactctgaaagaatcagccgctattaaccagattcttggtcgccgctggcatgccctgagtcgtgaggagcaggcaaagtactatgagctcgcacgcaaagaacgccagctgcacatgcagctctaccctggttggagtgccagagacaattacggcaaaaaaaaacgaaggtcacgcgagaagcatcaggagagcacaacagagacgaactggcctcgagagctaaaggatggcaacggtcaagagagtctgtctatgtcctcctcatcgtcgcctgcctag

SEQ ID NO: 13571 - DNA, 1098 bp, Artificial Sequence
  Description of Artificial Sequence: Synthetic coding sequence
atgccacaacttgactccggcggcgggggggctggcgggggcgatgacctgggggccccagacgagcttttggctttccaggacgagggagaggagcaagacgacaaatctcgcgacagcgcagcaggacctgagagggatttggccgagctaaagagttccctcgtaaatgaatctgaaggtgcggctggaggcgccggtatacctggtgtccctggggctggcgccggcgcccggggagaggcggaagccctgggccgggagcacgccgctcaaagactgtttcctgacaagctgccggagccattagaagacgggctgaaagcgccagaatgcactagcggtatgtataaggagaccgtgtattcagctttcaacctgcttatgcactaccctcctccaagtggtgcgggtcagcatccacagcctcagcctcctctacacaaggccaaccaacctccgcacggcgtgccgcaactgtccctctatgagcactttaatagtccacatccaacacctgctcctgccgacatcagtcagaagcaggtccatcgaccactgcagacccctgacctaagcggcttctatagccttactagcggttcgatgggacagctcccacacacagtcagttggtttacgcatccatcacttatgctcggaagcggcgtgcctgggcatccggctgcaattccccacccagccattgtgccaccatcgggtaaacaggagctccagccctttgatagaaacttaaagacgcaggcagagtcaaaagccgagaaggaagccaaaaaaccaaccattaaaaagcccctcaacgcgttcatgctgtatatgaaggagatgcgcgcaaaggtaatcgcagaatgtaccctaaaggaatccgcggcaattaatcagatactgggacggagatggcatgccctgtccagggaagagcaggccaaatactatgaactggcacgcaaagagcggcagctccacatgcaattgtatccaggatggagtgccagggataattacgggaagaagaagagaaggagcagggagaaacatcaggaatccacaacagacaatagccttcattactcttag

SEQ ID NO: 13572 - DNA, 1155 bp, Artificial Sequence
  Description of Artificial Sequence: Synthetic coding sequence
atgcctcagctggactcaggcggcgggggtgctgggggcggggatgacctgggggcacctgacgaactcctggcatttcaggatgagggtgaggagcaggatgacaagagccgtgattcagcggccggtcctgagagagatctggctgaattaaaatcatcactggttaacgaatctgaaggggccgctgggggcgctggaataccgggtgtgcctggcgcaggcgctggagcccgcggggaagcagaagccttaggccgggagcacgccgcccagagactcttcccagataagctgcccgagcctctcgaggatgggctgaaagcgccagagtgcactagcgggatgtacaaagaaacagtgtactcggcctttaacctcctcatgcactacccaccaccatctggggctggccagcatccacaaccccaaccgccactccacaaagccaaccaacccccgcatggggtccctcagctcagtctgtatgagcacttcaactcgccacatccaaccccagccccagctgatataagtcagaagcaggttcatagacccctgcaaaccccagacctcagcggattttattccctgacgtcaggttctatgggacaactaccacacacagtgtcctggtttacccatccctcactgatgctcggctctggtgtgccagggcacccagctgccatcccacaccccgcgatagttcctccatcaggcaaacaggaactccagcccttcgacagaaacttgaaaactcaggcagaaagcaaagcggaaaaggaagctaaaaagcctacaatcaaaaagcctctcaatgctttcatgctctatatgaaagaaatgcgggctaaggtgatcgccgagtgtaccctgaaggaatctgccgctatcaaccagatactcggccgtcgttggcacgccctgtccagagaggagcaggcaaagtactatgagctggcccgaaaggaacggcagttgcatatgcagctctacccggggtggtctgcgcgcgataactacggcaagaagaaaagacggtctagggaaaaacaccaggaatctaccaccggggggaagagaaacgccttcggtacataccccgaaaaggcagcggctccggcccccttcctaccaatgacagtgctgtag

SEQ ID NO: 13573 - DNA, 1485 bp, Artificial Sequence
  Description of Artificial Sequence: Synthetic coding sequence
atgccacagctcgattccggtggtggcggcgccggaggcggtgatgatctgggtgccccggatgagctccttgccttccaggacgagggggaagaacaggacgataagtctcgggactctgccgccgggccggaacgcgatctcgcagaactgaaatcaagtctggtgaacgagtcagagggggccgcagggggcgccggcattcctggcgtgcccggggccggagcaggcgcacggggggaagccgaggccctgggcagggagcatgcggcccagcgtctattcccagataagttgcctgagccactggaggatgggttgaaagctcctgagtgcacctcaggaatgtacaaggagactgtgtactctgctttcaatctcctgatgcactatccaccaccttccggcgccggccagcatcctcagccccagcctcccttgcataaagcaaaccaacctcctcacggagttccacaactgtcattgtatgagcattttaacagtccgcatcctacgcccgcgccagccgatatctcacaaaagcaggtccataggcccttacagaccccggacttgtcgggattttatagcctgaccagtggtagtatgggtcagctgccgcacaccgtctcctggttcacacatccatccctgatgctgggcagcggtgttcccggtcaccctgctgctattccccaccccgcaattgtaccgccttctgggaaacaagaactgcagccttttgacagaaacctgaagacccaagctgagtctaaggccgaaaaggaggccaagaagcccaccattaaaaaacctttaaacgcctttatgttgtacatgaaggagatgcgcgccaaggttattgccgagtgcaccctcaaggaaagcgcagccataaaccagatattagggagacggtggcacgctctttctagagaggagcaggcgaagtattacgaactggcccgcaaggagcggcagttacacatgcaattatatccaggctggtccgctcgtgacaactacggcaaaaaaaagaggaggtcaagggaaaaacaccaagaatctacaactgatccggggtctcccaaaaagtgtagggctaggtttgggcttaaccaacaaacagattggtgcggtccgtgtcgacggaaaaagaaatgcatccgatatctccccggcgaggggcggtgtcccagtcctgtgcccagcgatgactccgcacttgggtgtcctggcagcccagccccacaggactccccttcctaccacttgctccctagattcccgacagaactactgacctcgcctgcgaggcatttgcatccacaagtttcccctctattgtccgccagccaaccacagggcccgcatcggccccctgccgcaccatgtagggctcaccggtactcgaatagaaatctgagagatagatggcctagtcggcaccggacaccagggagactccaggagcctactccctag

SEQ ID NO: 13574 - DNA, 807 bp, Artificial Sequence
  Description of Artificial Sequence: Synthetic coding sequence
atgtacaaggaaactgtgtacagcgcctttaacttgcttatgcattaccctcccccctcgggggcgggccagcatccacagccccagcccccactgcataaagcaaaccaaccccctcatggcgtccctcagttaagtctgtatgaacatttcaacagcccccatccaactccagcacccgcagacatttcccagaagcaggtgcaccggcccctgcagaccccagatctgagcgggttctacagtttaacttctgggagcatggggcagctgccgcacactgtgtcctggttcactcatccctccctgatgctgggctcgggcgtcccaggccacccagccgcaatcccacaccccgcaatcgtccccccttccgggaagcaggagctgcagccatttgatagaaatttgaagactcaggccgagtccaaggccgagaaagaggccaagaagccgaccatcaagaaacccttaaacgcttttatgctctatatgaaggaaatgcgagccaaagtgatagctgaatgtaccctgaaggagagcgccgccattaatcagatactaggccggcggtggcacgccctgtccagagaggagcaagccaagtactacgagctggcccgcaaagagagacagttacatatgcagctttatcctggttggagcgcacgcgacaactatggaaagaagaagcggcgctcccgggaaaaacaccaagagagcactacggatcccggtagcccaaagaagtgtcgagcccgtttcggactgaaccagcaaactgactggtgtggaccatgtcggtag

SEQ ID NO: 13575 - DNA, 1110 bp, Artificial Sequence
  Description of Artificial Sequence: Synthetic coding sequence
atgcctcagctagactcaggtgggggaggtgcaggaggtggtgacgacctcggggcgcccgatgagttgctggcttttcaggatgagggcgaggagcaggatgataagtcccgggactcagccgccggcccagaacgggacttagccgagctcaagagctcactggtcaatgaatcggagggcgccgctgggggcgcaggcatccccggagtgcctggcgccggcgcaggtgccagaggcgaagcagaggcactaggccgagagcacgccgctcagcggctgtttcccgataagcttcctgaacctttggaagacgggctgaaggcccccgaatgcactagtggcatgtataaggaaaccgtctactccgccttcaacttgctcatgcactatccaccccccagcggggccggacagcatcctcagcctcagccccccctgcacaaagccaatcagccgccacacggcgtcccccagctttctttgtacgagcattttaacagcccccatcccacacctgcccctgcagatatctctcagaagcaggtgcataggcccttgcagaccccggatctgagcggattctattctttgacatccggttctatgggtcagctccctcatacagtttcgtggttcacccaccccagcctgatgctgggaagcggggtgcccggtcatcccgccgccattcctcaccccgcgattgtgccccctagcggtaaacaggagctccagcctttcgataggaacctgaaaacacaggcagaatccaaggctgagaaagaggctaaaaaacccaccatcaagaagccactgaatgccttcatgctctatatgaaggaaatgcgagctaaagttattgccgagtgcactttaaaggagtctgccgctattaaccagattctgggacggaggtggcatgctctgagtagggaggagcaagctaagtactacgaactggcaagaaaggaaagacaactgcatatgcagctgtatcctggatggtccgcccgcgataattacggtaaaaagaagcggagaagccgcgagaagcatcaagagtctaccaccgatggtattcctgcctgtacaatcctgagtccctag

SEQ ID NO: 13576 - DNA, 810 bp, Artificial Sequence
  Description of Artificial Sequence: Synthetic coding sequence
atgtataaggaaacggtttactccgcattcaatttgctaatgcactaccctccgccatcaggagcaggccagcaccctcagccacagccccccttacacaaagctaaccagcccccgcatggtgtcccccagctatctttgtacgagcactttaacagcccgcacccaaccccagcacctgccgacatctcccagaagcaggtgcacagacccttgcaaactcccgatctgtccgggttctatagcttgacgagtggcagtatgggacaactgcctcataccgtttcatggttcactcatccttcattaatgctaggtagtggagtgcccggccaccctgcggctatccctcatcccgctatcgttcctccatccgggaagcaagagctccagccctttgacaggaatctaaagacacaggccgaaagcaaagctgagaaagaggccaagaaacccacaatcaaaaagcctctgaacgccttcatgttatatatgaaggaaatgcgcgccaaggtcatagccgagtgcactctgaaggaatccgccgctattaaccaaattctggggaggcgctggcacgccttaagcagagaggaacaagcaaagtactacgagctggcccggaaggagcgccagcttcatatgcagctgtatccgggctggagtgctcgggataattatgggaaaaagaagcgtcgttcacgagagaagcaccaggagagcacgaccggaggaaagcggaatgcatttgggacctatcctgaaaaggcagcggctcccgctcccttcctcccgatgactgttctttag

SEQ ID NO: 13577 - DNA, 1446 bp, Artificial Sequence
  Description of Artificial Sequence: Synthetic coding sequence
atgccccagttggactctggcggcggcggcgcgggtggaggcgacgatttaggcgctcctgatgagctactggcttttcaagacgagggtgaagaacaggacgacaagtccagagacagcgcggcagggcctgagcgggacttggctgaactgaagtcctcactcgtaaatgagtcggaaggggccgcaggaggggccgggatcccaggagtgcccggggcaggcgcgggggcccggggtgaggccgaggctctcgggagggaacatgccgcacagcgcctgttcccagacaaacttccagaaccgctcgaagacggcctgaaagcgcctgaatgtacatctgggatgtacaaggagacagtgtattcagcttttaatctgcttatgcactatccgccgccttcaggtgcgggccaacacccacaaccacagcctcccctgcacaaagcgaatcagccgcctcacggagtgccccaactttccctctatgagcatttcaattcccctcaccctactcctgctcctgccgatatttcccaaaagcaggtgcaccgacctctgcagacccctgacctttctgggttttacagtttaacttctggctccatgggccagctgccacacacggtgtcttggttcactcatcccagtttgatgttgggttccggcgtgccaggtcatcctgccgccataccgcatcctgctatagtgcctccttcaggcaagcaggagctacagcccttcgaccgcaacctcaaaacccaagcagaatcaaaggcagaaaaggaggccaagaaacccactatcaagaagcccctgaacgcattcatgctatacatgaaagagatgagggcgaaagtcatagcagagtgcaccctgaaagaaagcgctgccatcaaccaaatccttggacgaagatggcatgccctgtctcgcgaggagcaagccaagtattacgagctggcccgaaaggaacgacagctgcatatgcagctgtatcccggatggagcgccagagacaattacggaaagaagaagcggcgcagccgcgaaaaacatcaggaatcaacaacagatccaggatctcctaaaaagtgccgtgcaaggttcgggctaaaccagcagacagattggtgcggcccttgtcgccgcaaaaagaagtgtatccggtacctgccaggcgaaggtcggtgtccctcccctgttccatcagatgatagtgccctagggtgtcccgggtcacctgccccccaggacagcccgagctaccatctgctgcccaggttcccaacagaactgctgaccagccccgctgagcccgctccaacatctcccggcctgagtacagccctgtctctgcccacgcctgggccgcctcaggctccgaggagcacactccaaagtacacaggttcagcagcaggaatcccagaggcaggtggcatag

SEQ ID NO: 13578 - DNA, 1101 bp, Artificial Sequence
  Description of Artificial Sequence: Synthetic coding sequence
atgtataaagagacagtttactccgccttcaacctgctaatgcattaccccccgcctagtggagccggccagcacccgcaaccccagccgcccctgcataaagccaaccagcctccacatggggtcccgcagctttcactgtatgagcacttcaactctccacatcctacacccgcccctgctgacatcagtcagaagcaggttcaccgcccgctgcaaacgccggacctgtccggcttttatagcctcacatccggttcgatgggacaacttccacataccgtgtcatggttcactcatcctagcttgatgttggggagcggcgtgcctggacatcccgcagcaatcccgcatcctgctatcgtgcccccaagcgggaaacaggagctgcagccatttgacagaaacctgaaaacacaagccgaatcgaaagccgagaaggaggctaagaagcccacgataaaaaagcctctgaatgccttcatgttatacatgaaagagatgcgcgctaaggttattgccgagtgtacgctcaaggagtcagccgcaatcaatcagatattgggccggagatggcatgccttaagccgtgaggagcaggctaagtactatgagctcgcccgaaaagagcgccagttgcacatgcagctctacccgggatggagtgccagggacaactatggtaaaaagaagcgccgcagccgcgaaaaacatcaagagagtacaactgatcctggctccccaaagaagtgtagagcaaggtttggattaaaccaacagaccgattggtgcggaccatgcaggcgcaagaagaagtgcattcgctatcttcccggtgagggtcggtgcccaagccccgttccttcggacgactcagcgcttggatgtcccggaagcccagctccccaagatagcccctcgtatcacctcctgccaaggtttccaacggagctgctcacctcacccgcagagcccgctcctacttctcctggactgagcaccgctctgagtttgccaacgccggggccaccgcaggctcctagatctacactgcaatctacacaggtgcaacagcaggagagccagcggcaggtggcttag

SEQ ID NO: 13579 - DNA, 372 bp, Artificial Sequence
  Description of Artificial Sequence: Synthetic coding sequence
atgtataaggagactgtgtacagtgcgtttaatcttcttatgcattatcctcctccctccggggctggtcagcacccacagccgcagcctccacttcacaaagcgaaccaaccaccgcatggagtgccccagctgtcattgtacgagcacttcaatagtcctcatcccacaccagctcctgccgacatctcccagaagcaggtacaccgccccctacaaactcctgatcttagtggcttttacagtctgactagcggctcaatgggacaacttcctcacaccgttagctggttcacacacccatcactcatgctgggtagcggggtgcctggacacccagccgcgatcccacatccggccatcgtgccttag

SEQ ID NO: 13580 - DNA, 810 bp, Artificial Sequence
  Description of Artificial Sequence: Synthetic coding sequence
atgtacaaagagactgtgtacagcgccttcaacctgctcatgcactacccaccaccgtccggcgcaggccaacaccctcagccgcagcctccactgcataaagcgaatcagccgcctcacggagtgccacagctctcgctgtatgaacactttaactcaccccacccgacacctgctccagccgacatctcccaaaagcaagtccatcgaccattgcagactccagacctgtccggcttttactcactgacctcaggaagtatggggcagttgcctcacacagtatcttggtttacccaccccagcctcatgcttgggtccggagtcccaggacaccctgctgccattccccatccagccattgtgcctcctagtggcaagcaagaactgcaaccattcgacagaaacttgaaaacacaggccgagtccaaagcagagaaagaggctaagaagcccacaatcaagaaaccccttaacgctttcatgttgtacatgaaggaaatgagagctaaagtcatcgctgagtgtaccctgaaggaaagtgctgctatcaaccagatccttggccggcgctggcacgcattgagccgtgaggagcaagctaaatactacgaactcgcacgaaaagagagacaactgcatatgcaactgtatcccgggtggagtgcgcgggataattatgggaaaaagaaacgccggtctcgtgagaaacaccaggagtctacaaccgagacaaattggccacgagaactgaaggatgggaatggccaagaaagccttagcatgagtagctcctcttcacccgcatag

SEQ ID NO: 13581 - DNA, 444 bp, Artificial Sequence
  Description of Artificial Sequence: Synthetic coding sequence
atgtacaaggagaccgtctactctgcttttaacctgcttatgcattacccaccgcctagcggcgccggacagcatccccagccccagccaccacttcacaaagccaatcagcctccacacggtgttccacagctgtccttgtatgagcactttaatagccctcatccaacacctgcgccagctgatatctcccagaaacaggtacatagaccattacagacacctgacctatccggattttacagccttacaagcggcagcatgggacagctgccacatactgtgtcttggtttacacatccaagccttatgcttgggtccggggtgccaggacaccccgcagcaataccacaccctgccattgtgccaccctctggaaagcaggaactccagccgttcgaccgcaacctgaaaactcaagccgagtcaaaggctgagaaatag

SEQ ID NO: 13582 - DNA, 1767 bp, Artificial Sequence
  Description of Artificial Sequence: Synthetic coding sequence
atgccgcaactgggagggggtggaggcggcgggggcgggggctcgggcggcggcgggggctcatctgctggcgccgctgggggtggtgacgacctgggagctaacgatgagctgatacctttccaggatgagggcggggaagagcaggagccatcgtcagactcggcatcagcccaacgtgatctggatgaagtgaagtccagcctcgtgaacgaaagcgagaatcagagcagcagctcggactccgaggcggagagacgcccccagcccgtaagggacacattccaaaagccccgcgactactttgccgaggtgcgccgcccccaggacagcgctttctttaaggggccaccctatccgggttacccatttctaatgatccctgatttgtctagtccctatctgagtaacgggccccttagcccgggcggggcaaggacttatcttcagatgaagtggccactgcttgatgtaccatcctctgctacggtcaaggatacgcgtagtcctagcccggcgcatctgtcaaataaggtgccagtagtccagcacccacatcacatgcatcctctgacacccctgataacgtacagtaacgaccacttctctcccggttccccaccaacgcacctcagccccgaaatcgatccaaagacaggaattccaaggcccccgcaccccagtgaactgtccccttactatcccctcagccctggagcggtgggacaaattccgcatcctttgggctggcttgtgccacagcagggtcaacctatgtactccctgccgccgggaggattcaggcacccatacccagcattggccatgaacgcttccatgtcctcgcttgtttctagtcgtttctccccacatatggtcgcacccgcacaccccgggctgcctaccagcggaatacctcaccccgccattgtctctccaattgttaaacaagagccggccccgcctagcctgtcccccgccgtctctgtaaaaagcccggtgactgttaaaaaggaggaggagaagaagccccacgtgaaaaagcctttgaacgcattcatgttgtatatgaaggaaatgcgcgcaaaggtggtggctgagtgtacattgaaggagagcgctgccatcaaccaaattctgggcaggaaatggcacaacctctcgcgagaggaacaggccaaatactacgaacttgcccgtaaagagcggcagctccacagtcagctctaccctacctggtccgcaagggacaactatggcaagaaaaaaaaacgcaaacgcgagaaacagttaagtcagactcagtcgcaacagcaggtacaagaagctgagggcgccctggcgtcgaagagcaagaagccctgtgtgcaatatcttccccctgagaaaccttgtgattcccccgcttctagccacggcagtatgctcgactcacccgccacgccttccgcagccctggcaagtcccgctgcgccggcagctacacactctgagcaggcccagcctttgtccctaaccaccaaacccgaaactcgagcacagctggccctgcactcggctgctttcttgtctgccaaggcagccgcctcttcctccgggcagatggggagccaacccccgttgttatcgcgccctctcccattgggctctatgcccaccgctctgctcgcttcccccccaagtttcccagcaactctccacgcccaccaggccctcccggttctccaagctcagcccctttcactcgtcacgaagtctgcccactag

SEQ ID NO: 13583 - DNA, 1017 bp, Artificial Sequence
  Description of Artificial Sequence: Synthetic coding sequence
atggagtacttcatggttcccacacagaaggtccctagcctgcagcacttccgtaagaccgagaaagaagtcattggcggtctctgttcgttagcaaacataccccttaccccagaaacccagcgtgaccaagagcggcgaattagacgtgagattgccaattctaacgaaagacgcagaatgcagtcaataaacgcgggcttccagagtttgaagactcttatcccgcacactgatggggagaaattatccaaggctgccattttgcagcaaacagccgaatatattttcagcctggagcaggaaaaaaccaggcttctgcagcaaaatacacagctaaagcgctttattcaggaacttagtggatcaagccctaagagaagacgagcagaggataaagatgagggaatcggcagtcctgacatttgggaagatgagaaggcggaagatctgagaagggaaatgattgaacttcggcagcagctcgacaaggagagatcagtgagaatgatgctcgaggaacaagtccgaagccttgaagcccacatgtacccagaaaagcttaaagtgattgcgcaacaggtacagcttcagcaacaacaagaacaggtgcgattacttcaccaggaaaaactcgagagagagcagcaacagctccgtactcagctgttacctccgcctgctccgacccaccacccgacggttattgtgcccgcccctcctcctccaccctctcatcacatcaacgtggtcaccatgggtccgtcgagcgtcataaatagtgtaagcacctcacgccagaacttggacactattgtgcaggctatccagcacatcgaggggacacaggagaagcaggagctcgaggaggagcagagacgggcagtgatcgtgaagcccgtccgcagctgtccagaggcccccacctctgatacggctagcgactcagaagcctccgactcagacgccatggatcagtcccgcgaggagccgagtggcgacggggaactgccctag

SEQ ID NO: 13584 - DNA, 741 bp, Artificial Sequence
  Description of Artificial Sequence: Synthetic coding sequence
atgtatcaggtaagcggacagcgacccagcggttgtgacgcaccatatggcgcgccctctgccgctcccggtcctgctcagacccttagccttttacccgggttggaagtagtgaccgggtccacccacccagcagaggctgcaccggaggagggcagcctagaggaagccgccacacccatgccacagggcaatggtccaggcatcccccagggcctagattccactgatctcgatgtacctaccgaagccgtgacatgccagccgcaaggaaatcccctcggatgcacaccgctgctaccgaatgactccggccatccaagcgagctgggcggcacccgccgcgccggcaatggcgccttagggggaccgaaagcacatcggaagctccaaacacatccttccctggcctctcagggatctaaaaagagtaagtcatcctccaaaagtactacctcccagattcccctgcaggcccaggaggattgctgcgtgcattgcatactgtcctgcttattttgtgaattcctgacattgtgcaatattgtcctcgattgcgcaacttgcggcagttgcagctctgaagacagctgtctttgctgttgctgttgtggcagtggtgaatgcgctgactgtgacctgccctgcgatttagactgtgggatcttggacgcctgctgcgagtccgccgactgtctggagatctgcatggagtgctgtggcctctgtttctctagctag

SEQ ID NO: 13585 - DNA, 1689 bp, Artificial Sequence
  Description of Artificial Sequence: Synthetic coding sequence
atgtccgaggaggacaggacctttagttttgggcctggcaccagaaagctgggcttcatgtcgcagctgtcccccgcgtgcagtgtgactcttgggaagagcctgcccctcagcgggctgggcgtgttcagctctaagatggacgcagtgcccgtgatacttgctagcccttgccagccactgtgttttgaggaggatacatgtctcatctatctgctgccacttctgatccaccgggagcccgccccggccgcaactatggcttcaaggattggcctacggatgcaactgatgagggagcaggctcagcaagaggagcagagagaaaggatgcaacagcaagctgtgatgcattacatgcagcagcaacaacagcagcaacagcagcagcttggaggacctccaacgcctgctattaatactccagtacattttcagtccccgccaccagtaccaggggaggttttgaaagtccagtcctacctcgaaaatccaacctcttaccaccttcagcaatcccagcatcagaaggtcagggagtatcttagtgagacatacggaaacaagtttgctgcccacatttcaccagcacagggctcccccaagccacctccggcagcatccccgggagtgcgcgccggccacgttctgagcagtagcgcgggaaacagcgctcctaatagcccgatggccatgctccatattggttctaatcctgaaagagaactggacgacgtaattgacaatatcatgaggttggacgacgtgctcggctatatcaaccccgagatgcaaatgcccaacactctccctttgagcagctctcacttaaacgtctactcttcggatcctcaggtcaccgccagcctggtgggtgtaacctcctcatcgtgccccgccgacctaacacagaagcgtgagctaactgatgccgagtccagagcgctagccaaagagcgtcaaaagaaagacaatcataatctgatcgaaaggcggcggagatttaacatcaacgacagaattaaagagctggggatgttgataccaaaagcgaacgacctagacgtgagatggaataagggcactatcctcaaggctagcgttgactatataagaaggatgcaaaaggacctgcagaagtcccgggaacttgaaaaccatagccgtaggctggagatgactaataaacagctttggttaagaatccaggaactggaaatgcaggcccgagtgcacggtctgcccactacatccccatcaggcatgaatatggccgaactggcccagcaagtcgttaaacaggagctccccagcgaagagggtcccggggaggctttgatgctgggagctgaagtaccggatccagagccactccccgccctccccccacaggctccactgccactgccaacacagccaccatcccccttccatcatctcgacttttctcactctctctccttcggcggccgggaggacgagggaccacccggatatcccgaaccattggcccccggacacgggtcgcctttcccaagcctgagtaaaaaggacctggacctcatgctgcttgacgattcattgcttcccctcgccagcgacccccttctatccaccatgagtccagaggcatcaaaagcaagtagtcgtcgttcctcgttttcaatggaggagggcgatgtgctttag

SEQ ID NO: 13586 - DNA, 1473 bp, Artificial Sequence
  Description of Artificial Sequence: Synthetic coding sequence
atgaccgcttcttcaggatgggagcctgcgcctgctgcaaccatggcctcccgaattggcctgagaatgcagctcatgcgcgagcaggctcaacaggaagagcagagagagcgtatgcagcaacaggctgtcatgcactatatgcagcaacagcagcagcaacagcagcagcaattagggggtccacctacccctgctattaatacacccgtccacttccaatccccccctccagtgcccggtgaagtcctcaaggtccaatcatatcttgagaatccaacctcctatcaccttcagcagtctcagcaccagaaggtgcgagaatatctcagcgagacctacggaaacaagttcgccgcccatatcagccctgcgcagggtagcccaaaacctccgcccgccgcgtcccctggggtccgcgcgggacacgtgctcagcagctccgctgggaattcagcgcctaactctcctatggccatgctacacattgggtcaaatccagagcgcgaacttgacgatgttatcgataatatcatgaggttagacgatgtgctgggatacataaatccagaaatgcagatgccaaacaccttgcccctgtcctctagccatcttaatgtttactcttcagatcctcaggtgacggctagcctggtcggagtcacttcaagcagttgtcctgctgaccttacacagaagagagaattaactgacgctgaaagtagagccttggcaaaggagaggcagaagaaggacaaccacaatctaatagaaagacgccgaaggtttaacatcaatgaccgtattaaagagttgggcatgctgatccctaaagcaaacgacctggacgtgaggtggaacaaaggcactatactaaaggcttccgttgactatattagacgcatgcagaaagacttacaaaagtctcgagaactcgagaaccacagcaggaggctcgagatgaccaataagcaactgtggctgcgcattcaggagttggagatgcaagcaagggttcatggcttgccaaccacatccccatcagggatgaatatggccgaactagcacagcaggtggtaaaacaagaattaccatccgaggaaggtccgggtgaagcgctcatgcttggcgccgaggtgcctgatccagaacctctgcctgcactacctcctcaggcccctttacccttgccaactcaacctccgagtcctttccatcatctcgatttctcccattctctgtcattcggcgggcgggaggacgaaggtccaccaggatatcccgagcctctagccccaggccacggctccccattcccctccctctctaaaaaggacctcgacctcatgctcctagatgacagtctgctgcctttagcttcagaccccctactgtccactatgtctcccgaagcttccaaggcatcgtctaggcgaagctctttttctatggaggaaggagatgtactgtag

SEQ ID NO: 13587 - DNA, 1431 bp, Artificial Sequence
  Description of Artificial Sequence: Synthetic coding sequence
atggcctcaaggattggactccggatgcagctcatgcgcgaacaggcccagcaagaggaacaacgggaacgtatgcaacagcaagctgtgatgcactatatgcagcaacagcagcaacagcaacagcagcagctcggagggccacccactcccgccatcaacactccggtccactttcaaagtccacccccagtacccggcgaggtgctcaaagttcaatcctacctcgagaaccctacttcctatcatcttcagcagagccagcaccagaaggtaagagagtatctcagtgaaacctatgggaacaaattcgctgcgcacatctcaccagctcagggatcccccaaaccacctcctgctgcaagccccggcgtcagagccggacacgtgctgagttctagcgctggcaactcggcgcccaactcacctatggccatgctgcacattggatctaatccagaacgggagctggacgatgtgatcgacaacatcatgcgtctggatgacgtgctcggctacattaatccggagatgcaaatgcctaacaccctgccactgtcttcctcacaccttaacgtctatagctctgatcctcaggtaacagccagtctggtgggggtcacaagtagctcgtgtcccgccgacctgactcagaaacgggagctgacagacgccgagagccgggcccttgccaaggaaaggcagaagaaggataatcacaaccttatagagcgccgccgccgatttaatataaatgaccgtatcaaggaactgggcatgctgattccaaaggctaatgacttggatgtgagatggaacaaggggacaatcctgaaagcctctgtggactatataagaaggatgcaaaaagatctacagaagtccagggagctcgagaatcactcaagacggctggagatgactaacaagcagctctggctgagaatacaagaactggaaatgcaggctcgggtccatggactgcctaccacctccccgagtggcatgaacatggctgaactcgctcaacaggtagtcaagcaggaactgccctccgaagaaggccctggagaggcgctgatgctgggggccgaggtgccggacccagaaccactgcctgctctaccaccacaggcccccctcccactaccaacacaacctccttctcccttccaccatctggacttctctcatagcctctctttcggcggtagagaagatgagggcccgccgggctacccagagccccttgcacctggccatgggtccccattcccttcgctgtccaagaaggatctcgatctgatgctccttgatgatagcttgctgcccctggcgtctgatccgctgctctctactatgagccccgaggctagcaaagcctcatctcggagaagtagttttagcatggaagaaggcgatgtcctctag

SEQ ID NO: 13588 - DNA, 807 bp, Artificial Sequence
  Description of Artificial Sequence: Synthetic coding sequence
atggctagcaggatagggttgaggatgcagcttatgagggaacaagcacagcaggaagaacagcgtgagcggatgcaacaacaggccgtgatgcattatatgcagcagcagcaacagcaacagcagcagcagcttggtggccctcctacacctgccattaacacacctgttcacttccaatcccctccacccgtgcctggtgaagttctgaaggtgcagtcatacctggagaatccgaccagctaccacctgcaacagtctcagcatcagaaagtgagggaatacctgtcagagacttacggtaacaagtttgcggcacatatctcccctgcacagggctcacccaagccccctcccgcagctagcccaggggtgcgggccggtcacgtgctgagttcatccgcgggcaatagcgctcctaattcccctatggccatgctgcacatcggatcaaaccctgagcgtgagctggacgacgtgattgataatatcatgcgcctcgacgatgtcctcggatatatcaatcccgagatgcagatgcccaacaccctgcccctgtcatcttcgcacctcaacgtgtattcctctgaccctcaggtcactgcttctctggtgggagtcacctcctcctcatgcccagccgacctgactcagaaaagggagctgactgatgctgaatcaagagccttggcaaaggagcgacagaaaaaggataaccacaatctgatcgagcggcgccgccgcttcaatatcaatgacagaatcaaagaactgggcatgctgatccctaaagctaatgatctctag

SEQ ID NO: 13589 - DNA, 1431 bp, Artificial Sequence
  Description of Artificial Sequence: Synthetic coding sequence
atggccagtaggatagggttacggatgcaactgatgcgggagcaagctcagcaagaggagcagcgagaaaggatgcaacaacaggccgtgatgcactacatgcagcaacagcagcagcaacagcaacaacagcttggaggaccccctacgccggcgattaacacaccagttcactttcagtcgccacctcctgttccaggagaggttctgaaggtgcagtcttacctggagaaccctacctcttatcacctgcagcagtctcagcaccaaaaggtgcgagagtacctaagtgagacttacggcaataagttcgccgcccacattagtcccgcccagggcagtccgaagcctcccccagcagccagccctggagttagagccggtcacgtcctctcgtcatctgccggcaatagtgctcccaattctcctatggcaatgttacatatcgggtccaaccctgaaagagagctggatgatgtgattgacaacattatgaggctcgacgacgtgcttgggtacattaatcctgaaatgcagatgccaaacactctgcccttgtcgtcatcacatttaaacgtttacagttccgatcctcaagtgactgccagcctggtgggcgtcacgtcttcttcttgtcctgcagatcttacccagaagagagagctcacagacgctgagtcacgggcactggcgaaggagcgacagaagaaagacaaccataatttaattgagcgaagacgaaggttcaacataaatgaccgcattaaagaattaggcatgctaatccccaaggcgaacgacctggatgtcaggtggaacaagggcacgatcctgaaagcaagcgttgattatataagacggatgcaaaaagatctgcaaaagtcacgtgagctcgaaaaccactctcgcagactagaaatgactaataaacagctctggctacgcattcaagaactggaaatgcaggcccgggttcatggtctgccaacaacgagccccagcggaatgaatatggcggaacttgctcagcaagtggtgaaacaggaactgccttccgaagaggggcccggggaggctctcatgctcggggctgaagtgccagatccagagccactgcccgcgttgcccccacaggctccgctgcccttacccacacagcccccctcacctttccaccatctcgacttcagccacagtctgagcttcggagggagggaggatgaggggccaccaggctaccccgaaccactggcaccaggacacggatctccatttccgtccctcagcaaaaaggatttggatcttatgcttctcgacgacagtctgctgccactggcctcagaccctctactgtccacaatgagccctgaggccagcaaagcgagtagtcgccgctccagttttagcatggaggagggcgacgttttatag

SEQ ID NO: 13590 - DNA, 735 bp, Artificial Sequence
  Description of Artificial Sequence: Synthetic coding sequence
atggccagtcggatcggcctgcgcatgcagcttatgagggaacaggcccaacaggaagagcagcgtgaaagaatgcagcaacaagcggttatgcattacatgcagcagcagcagcagcagcaacagcagcaactcggagggcctcctacgcccgccattaatacaccagtgcacttccaatctccacccccagttcctggcgaggtcctcaaagtacagtcttacctagaaaatcctacatcataccatcttcagcagagccagcatcagaaggttcgcgaatatctttccgagacatatggaaataaatttgctgcccacatttcccccgcgcagggtagcccaaaacctcctccagccgcttcacccggcgtgagagctgggcatgtgctgagcagttccgctggtaacagcgcaccgaacagtcccatggccatgttacatatcggctccaaccctgagcgggagctggatgatgtgatcgacaatatcatgagactggacgacgtgcttggatacataaatcctgaaatgcagatgcctaacacattgccgctgtcatccagtcaccttaatgtgtattctagtgacccccaggtaaccgcttcactggtgggagtcacctccagctcttgtcctgctgacttgacgcaaaagagagagctgaccgatgctgaaagcagggcccttgctaaagagcgtcagaaaaaagataaccataatttgattgagtag

SEQ ID NO: 13591 - DNA, 807 bp, Artificial Sequence
  Description of Artificial Sequence: Synthetic coding sequence
atggcaagccgaattggcctgaggatgcaattaatgcgagaacaggctcagcaggaagagcagcgtgagagaatgcagcagcaggcagttatgcactatatgcaacagcagcagcagcagcagcagcagcagctcggtgggcccccaacgcctgccataaacacacccgtgcacttccagtccccacctccggtgccaggagaggtccttaaagtacagagttacctggaaaaccctacttcctatcatctgcagcagtcccagcaccaaaaggtccgagaatacctgtcagagacctatgggaataagtttgccgcccacataagccccgctcagggcagtcctaagcctcctcccgcagctagcccaggcgtccgagccgggcacgtgctctcctcaagcgcaggcaactcggcccctaactctcccatggccatgctgcatattgggtcaaacccagagcgagaattagatgatgttatcgataacatcatgcgcctggatgacgtgcttggatatatcaatcctgaaatgcagatgcctaatacgctgcctttgagctcttcacatctgaacgtgtattcgtcagacccgcaagtcaccgcaagcttggtcggagtcacttcgagctcttgccccgccgacctgacccagaaaagagagttaacagatgctgagtcaagggcactggcaaaagaaaggcaaaagaaggacaaccacaatctcattgagcgtagaagaagatttaacattaatgaccggatcaaagaactcggtatgctcattcccaaagcgaacgacctatag

SEQ ID NO: 13592 - DNA, 672 bp, Artificial Sequence
  Description of Artificial Sequence: Synthetic coding sequence
atggcttcaaggattggcctcagaatgcagttaatgcgggaacaggcccaacaggaggagcagcgggaacgaatgcagcaacaggccgtgatgcactatatgcagcagcagcagcagcagcagcagcaacagctgggggggccacccacacccgctattaatacccccgtgcatttccagtcaccaccgcccgtccctggagaagtactcaaggtgcagagctatttggagaatcctacgagttaccacttgcagcaatcccagcaccagaaggtaagagagtacttgtcagaaacgtatggcaacaagttcgctgcgcacataagtccagctcaaggctcgcccaagcctccccccgccgccagccccggcgtgcgcgctggccatgtgctgagttcaagtgctggaaattccgctcctaactcacccatggctatgctgcatatcggttcaaatcccgagagagagctagatgacgtcatcgacaacatcatgagactggacgacgttctggggtacattaaccccgaaatgcagatgcctaacactctgccattatcgagtagtcacctgaacgtgtattcgtcagacccccaggtgactgcctctctagttggggtgacgagcagctcttgccccgcagacctaacccagaagcgggaactaacttag

SEQ ID NO: 13593 - DNA, 216 bp, Artificial Sequence
  Description of Artificial Sequence: Synthetic coding sequence
atggcctcccggatcgggcttcggatgcagctgatgcgagagcaggcccaacaggaggagcaaagagaaaggatgcaacagcaagccgttatgcactatatgcagcagcaacagcaacagcaacagcagcagcttggaggaccacccaccccagctatcaacacacctgtccatttccagtcccctcctcccgtaccaggagaggtgctgaagtag

SEQ ID NO: 13594 - DNA, 1176 bp, Artificial Sequence
  Description of Artificial Sequence: Synthetic coding sequence
atggccagcagaatcggcttacgcatgcagctaatgcgcgaacaggcacagcaggaagagcagcgtgagaggatgcagcaacaggcagtgatgcattacatgcaacagcaacagcagcaacagcagcaacagctgggaggcccccccacgcccgccattaacactcccgtccatttccagagccctccccccgtgcccggcgaggtattaaaactggacgacgtaatcgataatattatgaggctggacgacgtgttgggttatataaacccagaaatgcagatgcccaataccttacctctgtccagctctcatttgaatgtttatagctctgatcctcaggtgacagcctcgttagtgggggttacttcctcctcttgtcccgcggatttgacccagaaaagggaactcaccgacgccgaatcgcgagccctggccaaggaacggcaaaagaaggacaatcataatctgattgaaaggcggagacggtttaatattaatgatcgcatcaaggagctcggcatgctcatccccaaagctaacgacctggacgtgaggtggaacaagggaactatcctaaaagccagcgtggactacattaggcggatgcaaaaggatctgcagaaaagccgagagctcgagaatcactcacgtcggctggaaatgacaaataagcagctttggctacggatccaggagctggagatgcaggctcgggtccacgggttgccgacgaccagcccctccggcatgaatatggctgaattggctcagcaggtggtgaaacaggaattacctagcgaagagggtcctggtgaagccctgatgctcggtgccgaggtaccggaccctgaaccgctaccagccctgccaccgcaagcccccctgcctcttccaacacagcccccttcacccttccaccatttggatttctctcattcactcagctttgggggaagagaagacgagggcccgcccggttatcccgaacccctggcacccggacacggcagcccatttccttctctcagcaagaaagacttggatctcatgctactcgatgattcactgctacctcttgctagtgaccctttgctgtcaacaatgtctccagaggcctctaaagcatcgagtagaagatcctcattcagcatggaagaaggagacgtgttgtag

SEQ ID NO: 13595 - DNA, 240 bp, Artificial Sequence
  Description of Artificial Sequence: Synthetic coding sequence
atggcctccagaatcggcctcagaatgcagcttatgcgagagcaagcacaacaagaggagcagcgggagcgtatgcagcagcaggctgttatgcattacatgcagcagcagcagcagcagcagcagcaacagttaggaggccctcccacaccagctattaataccccagtgcacttccagtcacctccgccagtgccaggggaagtcctgaaggtgcaatcctacttggagaacccttag

SEQ ID NO: 13596 - DNA, 99 bp, Artificial Sequence
  Description of Artificial Sequence: Synthetic coding sequence
atggcaagccgaattggacttcgaatgcagcttatgcgggaacaggcccagcaggaggaacagagggaacggatgcagcaacaggcagtgatgcactag

SEQ ID NO: 13597 - DNA, 39 bp, Artificial Sequence
  Description of Artificial Sequence: Synthetic coding sequence
atggccagccgtatcggattgcggatgcaacttatgtag

SEQ ID NO: 13598 - DNA, 216 bp, Artificial Sequence
  Description of Artificial Sequence: Synthetic coding sequence
atggcttcccggatcggcctgcgcatgcaactgatgcgggaacaagctcaacaggaagaacagcgggaaaggatgcaacagcaggcggtaatgcactacatgcaacaacaacaacaacaacaacagcagcagctaggagggccccccacaccagccatcaacaccccagtgcactttcagtcccctcctccagtccccggcgaggtgctgaagtag

SEQ ID NO: 13599 - DNA, 39 bp, Artificial Sequence
  Description of Artificial Sequence: Synthetic coding sequence
atggcatccagaatcggtctgcgaatgcagcttatgtag

SEQ ID NO: 13600 - DNA, 1044 bp, Artificial Sequence
  Description of Artificial Sequence: Synthetic coding sequence
atgaccctggaccaccagatcataaaccccacactcaaatggtctcaacctgcggttcccagcggcgggcccctggttcaacacgctcatacaaccttagacagtgatgcgggtttaaccgaaaaccctctgacgaagctgctggccatcggaaaggaggatgacaacgcccagtggcacatggaagatgttattgaggacattatcggtatggagtcttccttcaaggaggaaggtgctgactctccactgctcatgcagcggacactgagcggatcaatactggatgtgtattctggggaacagggtatatcacctatcaatatgggtctcacttcagcctcatgtccctcttccctcccaatgaaacgagagatcacagagacagatacaagagctctggccaaggagcgccaaaaaaaggataatcacaacctgatcgaacgccgtcggcgatacaatatcaattatcggattaaagagcttggaactttaataccgaagagtaatgacccagatatgcggtggaacaaagggactatactgaaggcaagcgtggagtacatcaagtggcttcaaaaagagcagcagcgagccagagagctggaacaccggcagaagaagctggagcaagcaaatcgcagactcttgcttcgtatacaggaactcgagatccaggctcgcactcatggattacccacactggccagccttgggaccgtagatctgggcgcacacgtgaccaagcagcaatctcaccctgaacaaaactcagtggactattgtcagcagcttacagtgtcccaaggtcctagtccggagttatgcgatcaggctatcgcgttttctgaccccctcagttatttcactgatttatcattcagtgctgccttaaaagaagagcagagattggatgggatgttgctcgacgacaccatcagtcctttcggcactgatcccctcctgtccgcaacatcaccggctgtctcaaaagagagttctcggcgttcttcgttcagcagcgatgatggcgacgaattgtag

SEQ ID NO: 13601 - DNA, 957 bp, Artificial Sequence
  Description of Artificial Sequence: Synthetic coding sequence
atgactctagatcatcaaattatcaatcccacgctgaagtggtctcagcccgcagtgccctccggcgggccacttgttcagcacgcccataccacgctcgatagtgatgctgggttgactgagaaccccctaaccaagttactggcaatcggtaaggaagacgataacgcgcaatggcacctttcaggaagtattctcgacgtgtattcaggcgaacaggggatttctcccataaacatgggactgacctcggcatcctgtccttcctccctgccgatgaaaagagagatcaccgagaccgatacccgtgcactggccaaagaacgccaaaagaaggacaatcacaacctgatcgaaaggagaaggcgatataatattaactacaggatcaaggagttgggcactcttatccctaagtcaaatgatcccgatatgcggtggaataaagggactatcctgaaagcgtccgtagagtacattaagtggcttcagaaggagcagcagagagccagggagctcgagcaccggcagaaaaaactggagcaggccaataggcggctgctgctcagaatccaagagctcgaaatacaagctcgaacacacggcctgccaacactggcctcactgggcacagtcgacctgggggctcatgtcaccaaacagcaaagtcaccccgagcagaatagtgtcgattactgtcagcaattgaccgtatctcagggcccctcgcccgaattgtgcgaccaggcaattgcattcagtgaccccctctcttacttcaccgacctgtctttttctgccgcactaaaggaggagcagaggttggatggtatgctcctcgacgataccatatccccttttggtaccgaccccctcctatccgctacatctcctgccgtgagcaaggagtcatcccggcgcagctcattttcttcagatgatggcgacgagttgtag

SEQ ID NO: 13602 - DNA, 594 bp, Artificial Sequence
  Description of Artificial Sequence: Synthetic coding sequence
atgacgctggaccaccagatcatcaatccgacattgaaatggagtcagccagccgtcccctcaggcggcccattggtacaacatgcacatactacactggatagtgacgcaggactaacggagaatccattaactaagctgctagccataggcaaggaggacgacaacgcacagtggcatctaagcggatcaatcctggacgtatattccggagagcaaggaatatctcccataaacatgggactgaccagtgcttcatgccccagctcccttccaatgaaacgcgagataactgaaactgacacacgggcattggcgaaagagcggcagaagaaggataaccataacttgatcgagcgccgcaggcgctacaatataaattataggattaaggagctcgggacactgataccaaagagtaatgatcctgatatgcgctggaataaaggcaccatcctgaaggcatcagtggagtatatcaagtggttacagaaggaacagcagcgggcccgggaacttgagcataggcaaaaaaagctggaacaagcaaatcgtcgactgctgttacgtatacaggtgtttattcggatgtag

SEQ ID NO: 13603 - DNA, 843 bp, Artificial Sequence
  Description of Artificial Sequence: Synthetic coding sequence
atgatgaaggagaaggaaaagaccatcgcaatcgtcaaagttatcgatactagcaaacttaaactcctgtccggcagtattctcgatgtgtattcaggcgagcagggcatatcccccatcaatatgggcctgacctctgcgtcttgcccgtcgagcctaccaatgaagcgagaaataacggagacggacacacgggcacttgctaaggagaggcagaaaaaagacaatcataatctcattgagaggcgtagacgttataacatcaactatcgaatcaaagaattaggcactctgattccaaaatccaacgaccccgacatgaggtggaataagggtacgatcttgaaggcctctgttgagtatattaagtggctgcagaaggaacaacagagagcacgtgagcttgagcatcgccagaaaaagctagagcaagctaatcgccgactactgctgcgcattcaagaacttgaaatccaggccaggacccatggtctccctacacttgcttcactgggcacggtcgatctgggcgcccatgtcactaaacagcagtctcaccccgagcaaaacagtgttgattattgccaacagttgacggtcagccagggcccatctcctgagctctgtgaccaagcaatagcgttctcggacccactgtcatatttcacagacctgtcgttttctgctgcattaaaagaggagcagcggctcgacgggatgctcctagacgacactatctccccctttgggactgaccccctgctcagcgccacctccccagctgtgagcaaggagtcttctaggaggtcctcatttagttcagacgatggagacgaactgtag

SEQ ID NO: 13604 - DNA, 951 bp, Artificial Sequence
  Description of Artificial Sequence: Synthetic coding sequence
atgctgcaggctctaactggcctgcagttccagttaaaggagcagctaggcgaaaaagaacgtaggctgcaaatcagtcaagagatcagcgcgcacagaaccgagttccatatgcagttttcctataagcctgtccttcacaggcttgtccccgcccggccccagatctacagcagtcagttgccgtcttttacgagagtgccagcgcatctggagtctagcgctcgcccccagctgcagaaggcacagagacaaaaagtgaattctttcatgacgttagatcaccagatcattaatccaaccttgaaatggtctcaacctgccgttccttcgggagggcctctggttcagcacgcacacacgacactcgacagcgacgccggccttacggaaaatccactaaccaagctgctggccatagggaaagaggacgataatgcacagtggcacatggaagacgtaatcgaggatatcatcggcatggaaagctcatttaaagaggaaggcgcagattcccctcttctcatgcagcgaactctctccggcagtatccttgacgtgtacagcggagagcagggtatctccccaattaatatgggcctcacaagcgccagctgcccatccagcctgccgatgaagagagaaatcaccgagactgataccagggccctcgccaaagagaggcaaaagaaggacaatcacaacttgatcgagagacgacgccggtataacatcaactatagaattaaggaactaggcaccctcattcctaagagtaatgacccagacatgaggtggaataagggaactatactgaaagccagcgtggaatacattaagtggttgcagaaagagcaacagcgggcacgggagcttgagcaccgtcagaagaaactcgagcaagccaatcgacggctacttctcagaatccaggtgttcataagaatgtag

SEQ ID NO: 13605 - DNA, 2169 bp, Artificial Sequence
  Description of Artificial Sequence: Synthetic coding sequence
atgccgttacaccaactaggcgacaagcctcttaccttccctagcccaaatagcgcaatggagaacggactagatcacacccctccctccaggagggcgtcccccggcactcccctttcacccggtagtcttaggtccgcagcacattctcccctggacactagcaagcagcctttatgtcagctctgggctgagaagcatggtgccaggggtactcatgaggttcgctacgtgagcgccggacagtctgttgcttgtggctggtgggcctttgccccaccttgcctgcaggtgctcaatactcctaagggcatcttgttctttctctgcgctgcagcctttctgcaaggcatgacagttaatggctttattaacacagtgataacatccctggaacgcaggtatgatctgcattcctaccagtctggacttatagcctcctcctacgacatcgctgcatgcctgtgtttgaccttcgtgtcatatttcggggggtctggccataagccaaggtggcttgggtggggcgtcctgctcatgggcacgggatctcttgtctttgccttaccccactttactgccggcagatacgaagtggagctcgacgctggggtgaggacgtgccccgcaaatccaggcgctgtttgtgccgactctactagtggcctatcaagatatcagctcgtcttcatgctcgggcagttcttacacggcgtgggcgctacacctttatacacgctcggggtgacatatctggatgagaacgtaaagtcctcgtgctcgccggtgtatattgctattttttataccgctgcgattttaggacccgccgctgggtatctgatcgggggcgcacttcttaacatctacacagagatgggcagacgtaccgaactgacgacagagagtcccttgtgggtgggcgcttggtgggttgggttcctcggctctggtgccgccgcgttcttcaccgctgtcccaattcttggttaccctcggcagctgccaggaagtcagcgttacgcagttatgcgggcagccgagatgcaccagctcaaggatagtagtcgtggggaggcgtctaaccctgatttcggaaagaccatcagggatctgccactttctatttggttgttgctgaagaatcctacgttcatcctgctgtgcctagccggtgctacggaggccactctcatcacggggatgagcacattttctccaaaatttttagagagccagtttagcctttccgctagtgaagctgcaactctttttgggtacctcgtggtgcccgccggtggcggaggcacgtttctgggggggtttttcgtgaataagctaagactgcggggatccgcggtcatcaagttttgtctgttttgcactgtggttagcctgttaggaattctggtcttcagccttcactgcccatctgtgccgatggccggtgtcactgcaagctacggagggtctctgctgccggaaggacatctgaacctgactgccccctgcaatgctgcatgtagttgccaacctgaacactattcccccgtctgcggatctgacggtctgatgtatttttccctttgtcatgctggctgccctgccgcaaccgagacaaatgtagatggccagaaggtttatcgagattgcagctgcattcctcagaacctgtcatccggctttggacatgcaaccgccggaaaatgtacaagcacctgtcagcgcaaacccctgctcctggtgtttatcttcgtcgtgatctttttcacattcttgagctctatcccagccctcaccgccacactgcgctgtgtgagagacccccagcggtcttttgccctcggcattcagtggatagtggtaaggatacttggcggtattcctgggccgatcgcattcggatgggttatcgataaggcttgcctcctctggcaggaccagtgtgggcaacagggatcttgcttagtgtaccaaaacagtgccatgtcacggtacatcttgattatgggcctgttatacaaagttctgggcgtgctgttctttgctatcgcgtgctttctttacaagcccctcagtgaatccagcgacgggctcgagacctgcctgccttctcagagctcagcccccgacagcgctaccgattctcaattacagtccagcgtgtag

SEQ ID NO: 13606 - DNA, 1503 bp, Artificial Sequence
  Description of Artificial Sequence: Synthetic coding sequence
atgtctggccctggccccagagaacccccacctgaagcaggggctgcgggaggcgaggccgctgtcgagggtgcgggaggtggagacgccgccctcggtgagcctggcttgtcttttactacaacggacttatcactggttgagatgacagaggtcgagtacacccaactacagcacattctgtgtagccatatggaggctgctgctgacggggaactggagacacgcctgaatagcgcactgctggctgcagcgggaccaggggcaggggcaggtgggtttgcagctggaggacaggggggggcagcgccagtgtatccagtactatgcccatccgcattggctgccgacgcaccctgtcttggtcatatcgactttcaggaactccgtatgatgctcctgtccgaggctggtgccgctgaaaagacaagcggaggaggtgacggagctcgcgctcgtgctgatggtgctgcgaaggagggtgctggcgctgccgccgccgccgccgggcccgacggtgcacccgaggcaagagctaaacccgccgtacgtgttcgactggaggatagattcaacagcatcccggccgagccccctcccgccccaagagggccagagcctccagagcctggcggggcattgaacaacctggtaacattgatccgtcatccgagtgagctgatgaatgtgccactccaacagcagaataagtgcacagccctggtgaagaacaagactgctgccactacaacagccctgcagtttacgtatcccctattcacgactaatgcctgcagcacttcaggaaacagtaatctctcccaaacacagtcttcatccaattcatgttctgtgctggaggcagctaagcaccaggacatcggcttgccacgagcttttagcttctgttaccaacaggagattgaatctactaagcagacccttggctcccgcaacaaggtgctgcctgaacaggtgtggataaaagtgggcgaagccgcactgtgtaaacaagcccttaaaaggaaccgcagtaggatgcgccagttggataccaacgtcgagcgcagagccttgggagaaatccaaaacgttggggagggcgccacagcaacacaaggcgcttggcagagttcagagtccagtcaagctaacctgggcgagcaggcccagtctggcccccagggaggccgctcccagagacgagagcggcacaatcgaatggaacgcgaccgaagacggagaattagaatttgttgcgacgagctgaatttgctggtcccgttctgtaatgcagaaaccgacaaagcaactactctgcagtggacaaccgccttcctcaagtacatacaagagagacacggagatagcctcaaaaaggagtttgagtctgtattttgcggaaaaacgggcaggagactaaagctgacgcgccccgacagtttagtgacgtgtcctgcccagggaagcctgcagagcagcccctccatggagataaaatag

SEQ ID NO: 13607 - DNA, 1008 bp, Artificial Sequence
  Description of Artificial Sequence: Synthetic coding sequence
atggccacatttgtctccgagctggaagccgctaaaaagaacctctccgaagcgcttggggataacgttaaacaatactgggccaacctgaaattatggtttaagcagaagataagcaaggaagaattcgacctggaagcgcataggctcttaacacaggataatgtccatagccataatgacttcctgctcgccatacttacacgatgtcaaatcttagtgtccactccggatggggctggctccctcccttggcctggcgggagtgcagctaaaccggggaagccaaagggcaagaagaagttgtcctccgtccggcagaaattcgatcatagatttcagccacagaatccactgagcggggcccagcagtttgtggcgaaagaccctcaggatgacgacgacctgaaactgtgtagtcatactatgatgctccccactagagggcagctcgaggggcgaatgattgtgaccgcatatgagcatggactagataacgtcaccgaagaagccgtttcggccgtagtctacgccgtggagaatcatctcaaggacatactcacaagcgtcgtttcacgtagaaaagcctatcgcctgcgagacggacattttaagtatgcctttggctcgaacgtgacccctcagccttacctcaagaatagcgtggtggcctacaacaaccttatagagtctccgccagcgtttactgctccctgcgcaggccagaacccagcctctcaccctccacccgatgacgcggagcagcaggccgcacttctgctggcttgctccggagatacactgccagctagcctcccacccgtcaacatgtacgatctgtttgaagccctacaggtgcaccgggaggtaatccccactcacaccgtttacgcccttaacatcgaaagaattataacaaagctctggcatcccaatcatgaggagttacaacaagataaagtgcatagacaacggttagcagccaaggaagggcttcttctctgctag

SEQ ID NO: 13608 - DNA, 2286 bp, Artificial Sequence
  Description of Artificial Sequence: Synthetic coding sequence
atgtctcggaaaggaccaagggctgaggtgtgcgcagattgcagcgcccctgatcccggatgggcctccattagccggggcgtcttggtttgcgacgaatgctgcagcgtccaccggtcactcggaaggcacataagcatcgttaaacacctacggcatagcgcatggccgcctactctactgcagatggtccatacactggcatctaatggagctaattctatatgggagcacagcttgctggaccccgcgcaggtacagagcggtaggcggaaagccaatcctcaggacaaggtgcaccccatcaagtctgagtttatcagggcaaaataccagatgctggctttcgttcacaagttgccatgtagagacgatgatggcgtgacagctaaggatctcagtaaacaacttcatagtagcgtacgcacaggcaatctcgaaacctgtttgagactgctttctctcggagcacaagctaacttctttcatcctgaaaagggaaccaccccgctccacgtggctgctaaggccggccagaccttgcaggcggagctgctggtggtttacggggcggatcccggctcaccggatgtcaatggaaggacacctattgattacgcgagacaggccggtcatcacgaactggccgaaagactagtggaatgccagtacgagctgactgaccgtctcgcgttctacctttgtggcaggaagccagatcacaagaacggacactacattatacctcaaatggctgacagtcttgatttgagtgagctggcaaaggccgccaagaagaagctgcaggctctgagcaaccgactgttcgaggaactggctatggatgtctacgatgaagtggatagaagagagaatgatgctgtatggctggctacccagaatcacagtaccttggtcacagagcgtagtgcagttccctttctgcctgtcaaccctgagtactccgctacaagaaaccagggacgccagaaactcgctagattcaatgcacgagagttcgctacattgattatagatatccttagcgaggcaaaaaggcgccagcaggggaaaagtctgagttcacccactgataacttggaactgtcattgcgttctcagtccgacctagatgaccagcatgactatgattctgtcgcctccgacgaagacactgaccaagagccgctgagatcgaccggcgcaacccgctcgaatagagcgcgttcaatggactcctctgacctctctgatggcgctgtgactcttcaggagtacctagagctgaagaaagccctcgcaacatctgaggccaaggtgcagcagcttatgaaagtcaacagcagtctgtcagatgagttaagacgcttgcagcgcgaaatacataagctgcaagctgaaaatctccagcttcgtcagccaccgggtcccgtacccacacctcctctcccgtccgagcgcgctgagcacactcctatggcccctgggggcagcacacaccgacgggaccgccaggctttcagcatgtatgagcccggttctgcgctcaagccctttggtggacctccgggtgatgaactcacaactcgcctccagccgtttcacagcacagaattagaggacgatgctatctacagcgtgcatgtgcctgcaggcctgtataggattcgcaagggggtttccgcatctgccgtgcctttcacgccatcttcacccctcctgagctgctcacaagagggcagtcgacataccagtaagttgtccagacacggctcaggggcggatagcgactacgaaaatacccaatccggcgatcccttactcggtctggagggaaagcggtttctcgagttgggtaaagaggaggatttccacccagagcttgagagccttgatggagatctcgaccctggtctcccctctacggaggatgtgatattaaagacggagcaggtaactaagaacatccaagagctccttcgtgccgctcaagagtttaaacatgatagcttcgttccatgcagcgagaagattcacctagcagtgaccgaaatggcatcccttttccccaagcggcccgccctggaacctgtccgaagttctctgcgcctgttaaatgcctccgcgtaccgcctgcagagcgagtgccgcaagacagttccacctgaacctggggcgcctgtggatttccaactcctcacccagcaggtcatccagtgcgcctatgacatcgcaaaggccgctaagcaattggtgaccatcacaacacgtgaaaaaaaacagtag

SEQ ID NO: 13609 - DNA, 1332 bp, Artificial Sequence
  Description of Artificial Sequence: Synthetic coding sequence
atggaccggctgggtccatttagcaacgatccatccgacaagcctccatgtagagggtgctcatcttatttgatggagccatatataaaatgtgctgaatgcggtcccccaccgttcttcctttgcttgcagtgcttcactagaggattcgaatataaaaaacatcagagtgatcatacttacgagatcatgacaagcgacttcccggtgctagacccctcctggactgcacaggaggagatggctctactggaggccgttatggattgcgggttcggtaattggcaggatgtcgccaaccagatgtgcaccaagactaaggaggaatgcgagaagcattacatgaaacattttatcaataatccactttttgccagcacactgcttaatctcaaacaggctgaggaagccaagaccgctgatactgctatccctttccatagtacagacgaccccccacgcccaacattcgatagcctcttgagtagggacatggccggctacatgccagctcgtgccgatttcatcgaggaatttgacaactatgcagagtgggatctccgcgatatagacttcgtggaggacgattcagacattcttcatgccttgaaaatggccgtggtcgacatttatcactcgcggctcaaggagcgccaacgccggaaaaaaataattcgggatcacggccttatcaatttacgcaaatttcagctgatggagagacgctatcccaaggaggttcaagacctgtacgagacaatgcgccgatttgcacggattgtgggacctgtggagcatgataaattcatcgaatcgcatgccctggagtttgagctcaggcgcgagataaagcggctgcaggaataccgtaccgccggaatcaccaacttctgttccgcacgcacttatgaccatcttaagaaaacccgcgaggaggagaggctcaaacggacaatgctttcagaagtgctccagtatatacaagacagttccgcgtgccagcagtggctccgtagacaagccgacatcgattcaggactttccccgagcatacccatggcatcaaatagcgggagacgaagtgcaccccccttgaacttgacaggtctgcccgggacagagaaactgaacgagaaagaaaaggagttatgtcaaatggtgaggctggtgccaggtgcttatctggagtataaatccgcattgctgaatgagtgcaataagcagggcggtctccgactggctcaggcccgggcccttataaagatcgacgtcaacaagactcggaagatctatgacttccttattcgcgaagggtacattaccaagggatag

SEQ ID NO: 13610 - DNA, 918 bp, Artificial Sequence
  Description of Artificial Sequence: Synthetic coding sequence
atggatcggctggggccgttctcaaacgatccatcagacaagccgccctgccgaggatgtagtagctacctgatggaaccctacatcaagtgtgctgagtgtgggcctcccccttttttcttatgcctccagtgctttacacgggggtttgagtataaaaagcaccagtccgaccatacctatgaaataatgaccagtgattttcctgtgctggacccctcatggactgcacaggaggaaatggccctcttagaggccgtgatggattgcggttttggcaattggcaggatgtggcaaatcaaatgtgcacaaagacaaaggaggagtgtgagaaacactacatgaagcattttatcaataaccccctattcgccagcacactacttaatctaaagcaggcggaggaggcgaaaactgcagacacggctattccgtttcactccactgatgatcccccacgacccacatttgatagcctgctcagtagggatatggctggttatatgccagctcgtgccgatttcattgaagagtttgacaattatgccgagtgggacttgagagacattgattttgttgaagatgacagcgatatccttcacgccctgaaaatggccgtcgtggacatttatcattctaggcttaaggagcgccagcggaggaagaaaataatccgagatcacggtctaatcaatcttagaaagtttcaactgatggagcgtcgctaccccaaggaagttcaagacctttacgagactatgcgacgcttcgcacggatagttggtccagtggagcacgacaagtttatcgagagccacgcttgccgctggttcctctcactggagcaatacctctgtgtgtacatctatatcaatcgtcgtgacaatggcgtattctacgttaaattttataaatag

SEQ ID NO: 13611 - DNA, 1029 bp, Artificial Sequence
  Description of Artificial Sequence: Synthetic coding sequence
atgtgcaccaagaccaaagaggaatgtgagaagcactacatgaagcattttattaataatccgctttttgccagcacattgctcaatctcaagcaagctgaagaggcgaagaccgctgatacagctataccgtttcatagcactgacgatcctcccaggcctacattcgattctcttctttcacgagatatggccggctatatgcccgcccgggctgacttcatcgaagagtttgacaactacgcagaatgggatctcagagacatcgattttgtggaggatgactccgatattctgcacgccctgaagatggccgtggttgatatctatcactcaaggctcaaggaacgccagcggagaaaaaagatcatccgggatcatggactaataaacctacggaaattccagctgatggaaaggagatatcccaaagaagtccaggatctctacgagaccatgaggaggttcgccagaatcgtcgggccagttgaacatgacaaatttattgagagccatgctcttgaattcgagctccggagggaaattaaacgactgcaggaatatagaacagctggaatcaccaacttctgctccgctaggacctacgaccacttgaagaagactcgggaggaggaacgcctgaagaggactatgcttagtgaagtgctgcagtatattcaggattcctctgcatgtcagcaatggctacgccggcaagcggatattgactccggactgagcccatccatccccatggcttcaaacagcgggcggcgtagtgctccaccgctcaacctgaccggcctgcctggcacagagaagttgaatgagaaagagaaggagctgtgtcagatggttcgattggttcctggcgcatacctcgagtataagtcagcacttctgaatgaatgcaataaacaaggggggctgaggctggctcaagcccgtgccctgattaaaatcgacgtaaataaaacacggaaaatatatgattttcttatcagagaggggtacataacaaaaggctag

SEQ ID NO: 13612 - DNA, 1332 bp, Artificial Sequence
  Description of Artificial Sequence: Synthetic coding sequence
atggaccggctgggtcccttctccaacgatccctcggacaagcccccatgccgcggatgctcctcctatctgatggagccctatataaagtgcgcggagtgcggtcctccccccttctttctgtgtctccagtgcttcaccagggggttcgagtataaaaagcatcagagcgatcacacgtatgagataatgacttcggattttcctgtgctcgatccttcatggacggcacaggaggagatggccctgttagaggccgtaatggattgcgggttcgggaactggcaggacgtcgcgaatcagatgtgcaccaaaaccaaggaagagtgcgaaaaacactatatgaagcatttcatcaataatcctttattcgcttccacactgctcaatcttaaacaggccgaagaggcgaaaaccgccgacaccgcaatcccgttccattccactgatgaccctccccggcccacattcgactcactgctatcaagggatatggccggctacatgcccgcccgggcagactttattgaagaatttgacaactacgccgaatgggacctccgggacatagacttcgtcgaagacgattccgacatcctgcatgctcttaagatggctgtcgtcgatatataccacagccgcctgaaggagaggcaacggagaaagaagatcattagagatcatgggctcataaaccttcgaaaattccagctaatggagaggcgctaccctaaggaagtgcaggatttgtatgagactatgagacggttcgcacggatcgttggccctgtggagcatgataaatttatcgagagccacgctcttgagtttgagctgcgtcgcgaaatcaaacgcttgcaagagtataggaccgccggaataacaaatttttgttccgccaggacctatgaccacctcaaaaaaactagggaggaagaaaggctgaagcgcacgatgctcagcgaagtccttcagtatatccaagactcgagtgcttgccagcagtggctcaggcgccaggctgatatcgattcaggcctgtctccttcaatcccaatggcctccaatagtggccgtaggtctgcgccaccacttaacctgaccggtctgcccggaaccgagaaacttaatgaaaaggagaaagaactttgtcagatggtgagactagtgcccggcgcttacctcgagtataagagtgccctcctcaatgagtgtaacaaacagggaggactccgactggcccaggctcgggctcttataaaaattgatgtgaacaagacacggaagatctacgactttttgattcgcgaagggtacattacaaagggatag

SEQ ID NO: 13613 - DNA, 3390 bp, Artificial Sequence
  Description of Artificial Sequence: Synthetic coding sequence
atgggggatcaacagctgtataagaccaaccatgtggcccacggcagcgaaaaccttttctaccagcaaccacccctgggggtccactctgggctgaatcacaactacgggaatgccgttaccggggggggtatggacgcgccacaggcttctccaataagccctcatttcccccaggacacacgcgacgggttaggactccctgtgggaagtaaaaacctgggacagatggacacaagtcggcagggcggatggggttcacacgcagggccgggtaatcatgtccagttgcgagggaatctcgccaattccaacatgatgtggggggcccctgcccaggctgaacccacggatggatatcagtatacgtactcccaagccagcgaaatcaggacccagaagctgacgagcggggttttacataaactcgactcctttacgcaggtgttcgctaaccagaaccttcggatccaggtgaataacatggcacaggtgctgcacacacaatctgctgtgatggacggggcacctgattctgccctgcgccagctcctgtctcagaagccgatggaacccccagcgccagcgattcctagccgttaccagcaggtgccccaacagccccatccaggctttacaggcgggctctcaaaacctgcactacaggtgggccaacaccctactcaaggacacctctattacgactatcagcagccacttgcacaagtgcccgtacaaggtggccaaccccttcaggcccctcagatgctgagccagcacatgcagcaaatgcagcagcaccagtattacccccctcagcaacagcagcaggctggccaacaacggatcagcatgcaagaaatccagacccaaccccagcagattcggcccagtcagccacagccgcccccacagcagcagcagccccagcaactgcaattacagcagcgtcagggcagtatgcaaattccacagtattatcagcctcagcctatgatgcagcatctgcaagagcagcaacagcagcagatgcacctacaacccccatcttaccatcgcgaccctcaccaatatacacctgaacaggcacataccgtgcagctgattcctctgggctccatgtcccaatactattaccaagagccgcagcagccttattcacaccccctgtatcagcagagccatctgagtcagcaccagcagagagaggacagtcagttgaagacatactcttctgatcggcaagcgcaagctatgcttagttcacatggtgatcttggtccccccgatactggtatgggggaccccgctagctccgatctaacccgcgtgtcaagtactctcccccaccgaccactattatctccgagcggcattcacctgaataacatgggaccccagcaccagcaactgtccccttctgcgatgtggccacagatgcaccttcctgacgggcgggcgcagccaggaagccctgaaagcagcggccagccaaaaggagcctttggtgagcaatttgacgccaaaaataaactgacctgctctatatgcctgaaagaattcaagaatctgcctgctctgaatggtcatatgcgctcacatggcggaatgagggctagcccaaacttaaaacaagagataccacggaagcatcagcccagcgtgcctaaggccgaagaacccctcaagaccgtgcaggaaaaaaaaaagttcagacatcgcccagagcccttgttcatccctccccccccatcatacaaccccaaccccgctgcgtcgtacagcggggctacattataccagtcccagttgcgttcccctagagtattgggcgaccacctgcttctcgaccccacacacgagttgcctccttatactcccccccccatgctttctccagtgcgacagggaagtggcctgttcagcaatgtcctaatctctgggcatgggcccggggcccacccacagcttccccttacccccctgactccaactcctagagtactgctgtgcagatccaacagtatagacggctctaatgttacggttacaccggggcctggcgagcagacagtagatgtagaacctaggatcaatatcggactgagatttcaagccgaaatccccgaactgcaggacatctcagccctggctcaggacacccacaaggccacacttgtgtggaagccgtggcctgagttggagaaccacgatttacagcagagagttgaaaatctcctgaatctttgctgtagtagtgcccttccaggcggaggaacaaatagcgaatttgctctacactccctcttcgaggccaagggcgacgttatggtcgccctcgaaatgctgcttctacgtaaacccgttaggctgaagtgccatcctcttgctaactatcattatgccggcagcgataagtggactagcctcgagagaaaactgtttaataaggcgctggccacttattctaaggattttatctttgttcagaaaatggtgaagagtaagaccgtcgcacagtgtgtggaatactactacacttggaagaaaatcatgaggctcggccggaagcaccgcactcggctggcagagatcatagatgactgcgtgacctcagaagaggaggaggaattagaggaagaagaagaggaggaccccgaggaagaccggaaatccactaaggaggaggaaagtgaagttccgaagagtccggagccaccgcccgttccggtgctcgcccccacagaagggcctccactgcaagctcttggacaacctagtggatcattcatttgcgagatgcccaactgtggtgctgactgcaggtgccacgtgacacccttcctgcctcaggtgtttagtagtcgacaagctctgaatggccatgcaaggattcatggtggaacaaaccaagtaactaaagctcgtggtgctattccctcaggtaagcagaagcccggcggcacacaaagtggttattgcagcgtcaaatcgtcacccagtcactctacaaccagcggggaaactgaccctacaaccattttcccctgcaaagaatgcggaaaagtgttctttaagattaagagtcggaacgcccacatgaagacacacagacagcaagaagagcagcagagacagaaagcacaaaaggccgcattcgcagccgaaatggcggccaccatcgaacgcacgactggacctgtaggcgcaccaggtcttttacccttggaccagctgtccctcatcaagcctatcaaggacgtcgacattttggacgacgacgtggtgcagcaattggggggagtgatggaggaggccgaggtggtggacactgatctgcttctagacgatcaggactccgtcctgctgcaaggggacgcagagttgtag

SEQ ID NO: 13614 - DNA, 3603 bp, Artificial Sequence
  Description of Artificial Sequence: Synthetic coding sequence
atgggagaccaacagttgtacaagaccaatcacgttgctcatgggagcgagaacttgttttaccagcaaccacccttgggtgtacactccggtctgaaccataactatggaaatgctgtcacaggcggaggtatggatgccccacaagccagccctatctcaccgcatttcccacaagatactagggacggcctcggcctacccgtgggaagtaagaaccttggacaaatggacacctctcggcagggggggtggggctcacatgccggcccgggcaaccacgtgcagctgcgtggcaatctggcgaactcaaatatgatgtggggcgcccctgcccaggccgagcctacggacggttaccagtatacatactcacaggcctcagagatccggacccagaaactcacctccggtgtcctgcacaagttggattcctttacgcaggtgtttgcaaaccaaaacttgcgtatccaggtcaacaacatggctcaggtgttgcatacccagtccgcggttatggatggggcaccggactccgcccttagacagctactctcacaaaagcccatggaacctcctgcacctgccattccgagccggtatcagcaggttccccagcaaccccaccccggatttactgggggtctctccaagccggcgctgcaggtgggccagcaccctactcagggtcacctatattacgattatcagcagcctctggctcaggtgcctgttcaaggaggccagcctcttcaggctcctcagatgctcagccagcatatgcaacagatgcagcagcaccagtactaccccccccagcaacagcagcaggccggccagcagaggatcagcatgcaggagattcagactcagcctcagcagattcggccttctcagccccaacctccgcctcagcagcagcagcctcagcaactccaacttcaacagcggcagggcagcatgcagattccacagtactatcagcctcagcctatgatgcaacatctgcaagagcagcagcagcagcaaatgcatctgcagcccccatcctatcatcgagacccacaccaatacacccctgagcaggcacacaccgtgcaattgattccgctgggatcgatgtctcagtattattaccaagagccccagcagccctattcacacccactataccagcagagccacttgtcacagcaccaacaacgggaggactcccagctcaaaacatactcttccgataggcaggcccaggctatgctgtcatctcacggagatctaggaccacccgataccgggatgggagaccccgcatcaagcgaccttactcgtgtcagttcaactcttcctcacagacctctcctctcccccagcggtatccacttaaataacatgggtcctcagcaccagcagttatccccaagcgcaatgtggccccagatgcaccttccggacggtagagcacagcctggctctccagagagctctggccagccaaaaggagctttcggcgagcagttcgatgctaagaacaagcttacatgttctatttgcctgaaagagttcaaaaatctgcctgcattaaacggccatatgcgctctcatggcgggatgcgggcaagcccaaacctcaagcaggaagaaggagaaaaggtgctgcccccccagccacagccacctctgccccccccgccgccaccaccaccccctccccaacttccacccgaagccgagtcgcttacacccatggtcatgcccgtgagtgtgcccgtgaaactcttgccaccaaagccttctagccagggatttactaattctacagtagccgcacccagtgcgcgggacaaacccgcctcctcaatgtcagatgacgagatgccagtcctggaaatccccaggaagcaccagcccagcgtaccgaaagccgaggagccactcaagaccgtccaagagaaaaaaaaatttaggcatagaccggagcctctgttcattcctccgcctccctcttacaaccccaatcccgcggctagttacagtggtgcaaccctctatcagagtcaactgagaagccccagagtgctcggcgaccatctgttactggacccaactcacgagttgcccccctacactccccccccgatgctcagcccggtgagacaggggagtgggttgttcagtaacgtactcatttccgggcacggccccggtgctcacccccaattgccactgactccccttacacccacaccaagggtgttgctttgtcgatctaatagtatcgacggcagcaacgtcaccgtcaccccaggccccggggaacagacagttgacgtggagcccaggattaacatcggcttgaggtttcaggccgagattccagaactccaggacatctccgctctagcgcaggatacacacaaagctactctggtctggaaaccttggccagagctggagaaccatgacctccagcaacgcgtggagaatctcctcaatttatgttgctcatcagctttgcctgggggaggtacaaactctgagtttgccctgcactcccttttcgaagcaaaaggtgacgtgatggtggctcttgagatgctactgcttcgaaagcctgttcgacttaagtgccaccctcttgcgaactatcattatgccgggagtgacaagtggaccagtctcgagcgcaaactgtttaataaggcgttggctacctattcaaaagacttcattttcgtgcagaaaatggtaaaaagtaagactgtggcacagtgcgttgaatattattacacctggaagaaaattatgagactcggccgaaaacacagaacacggctggcagaaatcatcgatgactgtgtaacaagtgaggaagaggaggagctggaggaggaagaagaagaagacccagaagaagataggaaatctacaaaagaggaggaaagcgaagtgcccaagagcccagagccacctccagtcccggtgctggctccgacagaagggccccccctgcaggccctgggtcagccatccggctcttttatttgcgagatgcccaactgcggagcggttttctcctcgcgccaggccttaaatggccacgcccgtatccatggggggacgaatcaagtaaccaaagctcggggtgccattcccagcgggaaacaaaaacctggcggcactcaatccggctattgctctgtcaagagctcaccctcgcacagtacaacgtccggtgagacagacccaaccactatctttccgtgcaaggagtgcggcaaggtgttctttaaaatcaaaagccgcaacgcacatatgaagacccaccgtcagcaggaggaacagcaaaggcagaaagcgcaaaaagctgccttcgcagccgaaatggctgcgacaatagaacgtaccactgggcctgtgggagcgcccgggctgctgcccttagaccagctgagccttataaaaccaatcaaggacgtggacattctggacgatgacgtagtccagcagctgggtggcgtgatggaggaggcagaagtcgttgatactgacctgcttctggacgatcaggactccgtgctgttacagggcgatgcggagttgtag

SEQ ID NO: 13615 - DNA, 3663 bp, Artificial Sequence
  Description of Artificial Sequence: Synthetic coding sequence
atgggtgatcagcagctgtataagacaaatcatgttgcccacggttcggagaacctgttctatcagcaaccaccactgggagtacattcgggcttgaatcacaactacggcaacgccgtgaccggtgggggcatggatgcccctcaagcatcaccaatctcaccacactttccacaggatacccgagatggattaggtttaccagtcggcagcaaaaatctcggccagatggatacaagcagacaggggggctggggaagccacgcaggaccagggaaccatgtgcagcttcgcggaaacttagccaactcaaacatgatgtggggcgcgccggcccaggccgagcccaccgacgggtaccaatatacttacagtcaggcaagtgagattagaactcagaagctcacgtctggtgtgctgcataagttggactcatttacccaagtgttcgccaaccagaatctgcgcatccaggtcaacaacatggcccaggtactccacacgcagagtgcggtcatggacggagctcccgacagcgccttgagacaactgcttagtcagaaaccaatggaaccacccgcccctgcgattccgtctcggtaccagcaggttccacagcagccccaccctgggttcacggggggactgagcaaaccagctttacaagtcggtcagcacccaacacaaggccatctctattacgactatcagcagccgctcgcgcaggtcccagtgcaggggggacaaccacttcaagcaccacagatgctgtctcagcacatgcagcaaatgcagcaacatcaatactaccccccccaacagcaacagcaggccgggcaacagaggattagcatgcaagaaattcagacgcagccccagcagattagacctagtcagcctcagccgcccccacagcagcagcaaccgcagcagttacagcttcagcaacgccagggatctatgcagatcccacagtactaccagcctcaacccatgatgcagcatctccaagaacagcagcagcagcagatgcacctgcaaccacctagttatcatagagacccacatcagtatacgcctgaacaggctcacacagtgcagctcatccctcttggcagtatgagccaatactactaccaagagccacaacagccttactcacaccccttgtatcagcagtcgcatttgtcccagcaccaacaacgggaggacagtcagctgaagacttattccagcgaccggcaggcacaggccatgcttagctcgcatggggatctggggcctccagacaccggaatgggcgatcccgcttcatccgatttgacccgtgtatcctccaccttgccccacagacctctcctcagcccctctggcatccatctgaacaatatgggcccccaacatcagcagttaagcccgtctgctatgtggccacaaatgcatctgccagatggtcgcgcccagccaggcagcccagagtcctctgggcagcccaagggagcgttcggagaacaattcgatgctaaaaacaagctgacatgctctatatgtctgaaggagttcaaaaacctgcccgctctcaacggccatatgagatctcacggcggcatgcgagcttcccccaacctgaaacaggaagaaggggagaaggtgctgccacctcagccacaaccacctcttccaccccccccaccccctcccccaccccctcagcttccccccgaagctgaatctctgacccccatggtgatgcctgtttcagtgcctgtcaagctgctgcccccaaaaccctcatcacagggatttacaaactccacggtggctgctcccagcgctagggataagccagcatcttcaatgtccgatgacgagatgcctgtcttggtccgcatgactttgagcccccctcactccccacagggtgcagcaccccgtacacctgctgagatccctagaaagcaccagccaagcgttccaaaggctgaggagcctttgaagactgtccaggagaaaaaaaaattcagacaccggcccgaacccctttttatcccccccccaccctcttacaatcccaacccagctgctagctacagcggcgctacactgtaccagtctcaactgcgatcccctcgcgtcttaggagatcatctattgctggacccaacccacgagctgccaccttatacccccccacccatgctgagccctgtccggcaaggctccggactgttctccaatgtcctaatatccgggcacgggcccggcgcgcacccccagcttccactgaccccactgacacctacgcctagagtgctgttatgccgaagcaactccatcgatggatccaacgtcacagtcactccggggcctggcgaacaaactgtcgacgttgaaccaaggatcaatattggacttcggtttcaggccgagatccccgagctacaagatatctcagctctcgctcaagacacccacaaggccacgctggtttggaagccgtggcctgaattggagaatcacgacctgcagcaaagagtggaaaacctgctgaatctgtgttgcagcagtgcgttgcccggtggggggaccaactccgaattcgccttgcacagcttattcgaggcgaaaggtgacgtgatggttgctctggaaatgctcttgctccggaagcccgtccgcctgaagtgtcaccccttggccaactatcactacgcggggagcgataaatggacatcacttgaacggaaattatttaataaagctcttgctacctattcaaaagacttcatcttcgtgcagaagatggtcaaaagcaagactgttgcacaatgcgttgaatactactacacatggaaaaagattatgcgcttaggtagaaagcaccgcacaagactggcagagattatcgatgattgtgtcacttctgaggaggaggaagaactagaggaggaggaggaggaggaccctgaagaggaccgcaaatctacaaaagaggaggagtccgaagttcccaaaagccctgagccgccgcctgttcccgtgctggctcctacagaaggaccacccctccaagctctggggcagccctccggaagcttcatttgcgagatgcctaattgtggcgctgtgttttcttctaggcaagccctaaatggacatgcgagaatccacggcggcaccaatcaggttacaaaggctagaggcgccataccaagcgggaaacagaagcccggtggcacccagtctggttactgctcagtgaaatctagcccgagtcacagtaccacctctggcgagactgacccaacaactattttcccatgtaaagagtgcggaaaagtattttttaagatcaaatccaggaatgcacatatgaagactcaccggcagcaggaggagcaacagaggcaaaaggcgcagaaggccgcttttgctgccgagatggctgcaacaattgaacggaccacaggccccgtgggagcccccggcctgctcccgctcgatcagctcagcctgatcaaaccaattaaggatgtagatatactggatgatgatgtcgttcagcagctgggtggtgtaatggaggaggccgaagttgtggataccgacctgctgctagacgatcaggattccgtgttactgcagggcgatgccgaactgtag

SEQ ID NO: 13616 - DNA, 2247 bp, Artificial Sequence
  Description of Artificial Sequence: Synthetic coding sequence
atgatcagagacctgagtaagatgtacccccagaccaggcaccctgctcctcatcagccggcacaacctttcaaatttaccatcagtgagagctgtgatcgcattaaagaggagtttcagtttctgcaggctcagtatcattcattgaagctggaatgcgagaagctagcatctgagaagacggagatgcagcgacactacgtcatgtattatgagatgtcatacggtcttaatatcgagatgcataagcaagcggagatagtgaaaaggttaaatgccatctgcgcccaggtgatccccttcttgtcccaggagcagcagctgcaggcccagcacctttcccatggccacggtcttccagtgcccctcactccccacccgtcaggactgcagccccccgccattcctccgatcggaagcagcgccggcctgctggccctgagctctgcactgggcggccaaagccatctacccattaaggatgaaaaaaagcatcacgataatgatcaccaaagggatagagactctattaaatcctccagcgtgtccccttctgctagctttagaggagcagagaagcacagaaatagcgccgactactctagtgagagtaaaaagcagaagacagaggaaaaggagatcgctgcaaggtacgacagcgatggcgagaaatctgatgataatctggtagtagacgtctccaatgaagatccatcatctccccgaggtagtcctgctcacagcccaagggaaaacgggcttgacaagactcgtttactgaaaaaggacgcccccataagccccgctagtatagcttcaagctccagtacccctagcagtaagagcaaggagctctctcttaatgaaaagagtactactcctgtgagcaagtcaaacacaccaactccccggaccgacgctccaactcctggatctaattctactcctggtctgcggccagtgcctggcaagccccccggggtggatccactggccagctctctgcggacacccatggctgttccctgtccctatcccactcctttcggaattgtgccacacgctgggatgaacggtgaattgacctccccaggggcggcgtacgcggggcttcacaatatttccccgcagatgagcgcggccgcagctgccgccgctgcagccgctgcatatggcagaagtccagtggtcgggtttgatccacatcatcacatgcgagtaccagccatccctccaaacctcaccgggattccagggggaaagcccgcatattcttttcacgttagcgcagatggtcagatgcagccagtgccgttcccccctgacgctttgatcggaccggggattccgcgccacgcacgacagattaataccctgaaccacggcgaagtggtttgcgcagtgacaatttcgaaccccacaaggcatgtgtatacgggaggaaaaggctgcgtcaaagtctgggatatcagccatcctggcaacaagagtcccgtaagtcaactggattgcctgaatcgggacaactatatcagaagctgtcggctgttaccggatggccgtacacttattgtgggaggagaagcctcaacactgtccatctgggacctggcggcccccacgccaagaattaaagccgagttgacttcgtctgcccctgcctgttatgccttagccatctcaccagatagcaaagtgtgcttttcctgctgtagtgatgggaacattgccgtgtgggatctgcacaaccaaactctggtcaggcagttccagggccacactgatggcgcatcatgcatcgatatcagcaacgacggaaccaagctgtggacagggggtctggacaacacagtaagaagttgggacctcagagagggccggcagctccagcaacacgattttacaagtcaaattttctccctgggatactgcccaactggcgagtggcttgcagtgggcatggagaatagcaatgtggaggtgctgcacgtgacaaagcccgacaaataccagctccacctccatgagtcatgcgtcctttccctcaagttcgcccattgtgggaagtggtttgtgagcacaggtaaagataatcttctgaacgcatggcgcacaccttatggagcttcaatattccagtcgaaggagtcctcctcggtgctttcttgtgatatctctgtggacgacaagtacatagttaccgggtccggcgataaaaaagcaactgtatacgaggtcatttactag

SEQ ID NO: 13617 - DNA, 2418 bp, Artificial Sequence
  Description of Artificial Sequence: Synthetic coding sequence
atgatccgcgatctttctaaaatgtatcctcagacccgacacccggccccacatcagcccgcacagcccttcaaattcaccatcagcgagtcttgcgatagaataaaggaggagttccaatttttgcaggctcagtatcatagcttaaagctcgaatgcgagaagttagccagtgaaaagacagagatgcaacgacattacgttatgtactatgaaatgagctatgggctcaacatcgaaatgcataagcaggcagagattgtcaagcgcttgaacgctatttgtgctcaggtgattcccttcctgtcccaggaacaccagcagcaagtggtgcaggcagtggaacgggcaaagcaggtgaccatggcagagctgaacgccatcataggccagcagctgcaagctcagcacctcagtcacggacatgggctcccagtgcccttaaccccacaccccagcggcttgcagcccccagccattcccccgatagggtcatccgcggggctgctggcgctgtcctccgcccttgggggtcagagccatctgcctatcaaagacgaaaagaagcatcacgataatgatcaccaacgcgaacgcgacaagttgaatcataaaagtctttcaccatcagcctctttccggggggcggagaaacatcggaactctgccgattatagttccgaatccaaaaaacagaaaaccgaagaaaaagagatcgctgccagatatgattcagacggcgagaaatcagatgacaatcttgtggtcgacgtctccaatgaggaccccagctccccccgcggctcacccgctcactctcctagggagaatggcctggacaagacacggttgctgaagaaggacgctcctatttcacccgccagcatcgcctcttcttctagtacaccgagcagcaaatcaaaggagctgagccttaaaagagatatggggaaactgtcagaaactcgcctcagcgaggacgagcagtgcacactcggactccaacgttggttctgccgcctttggttcatgaacgagaagtctacaacacccgtcagcaagagcaacactcctacaccaaggaccgatgcccccacgccaggtagcaactccaccccaggacttcgtcccgtcccggggaagccacccggtgttgatcccttggcatcctctttgaggaccccaatggcggtgccctgtccctatcccaccccatttggtattgtccctcatgcaggtatgaacggagagctgacatcgcccggtgccgcctacgctggcctacacaacatctcaccccagatgtccgctgccgctgccgccgctgccgctgcagctgcctacggccgatctcctgttgtgggctttgatccacaccaccacatgcgcgtccccgccatcccgcccaatctgaccggaattcccggcggaaagccagcatatagcttccacgtctcagcagacggtcaaatgcagcccgtccctttcccgcccgacgccctgattggaccaggaattcctagacacgcccggcagatcaatactcttaaccacggagaggtcgtatgcgcagttactatcagcaaccctacacgtcatgtatacacaggaggcaagggctgcgtgaaagtctgggacatatcacatccaggaaataaaagcccggtaagccagttggactgcctcaaccgggacaactacattcggagttgtaggctcctacctgatgggcggactctgatcgtagggggcgaggcttctaccctgtctatctgggacctggccgcacctacccctagaataaaagccgaactgacaagctccgcacccgcttgctacgctttggccattagccccgactcaaaagtgtgtttctcgtgctgctccgatggcaacatcgctgtgtgggacctccataaccagacactagtgaggcagtttcaagggcacaccgacggggctagctgtatagatatatctaacgacggcacaaagctgtggacaggcggcctggataacacagtaagaagctgggacctacgtgagggtcggcaattgcagcaacatgacttcacttcgcaaattttcagtctcggatattgccccacaggggaatggctcgctgttggcatggagaactctaacgtcgaagtattgcatgtgactaagcctgataaataccagcttcacctacacgagtcctgcgtcctttctctcaaattcgcccattgcggaaagtggttcgtgagtacaggtaaagacaatttactgaacgcctggcggacgccttacggggcatcaatattccaatcaaaggagtcttcaagcgttctgtcctgtgacatatcggtggatgacaagtacatcgtgactgggagtggggacaaaaaagctaccgtgtatgaggttatatattag

SEQ ID NO: 13618 - DNA, 1233 bp, Artificial Sequence
  Description of Artificial Sequence: Synthetic coding sequence
atggccgtgccatgtccttacccgaccccttttggcatcgtgccacacgccggcatgaatggcgagctcacaagtcccggggccgcctacgccggcttacataatattagcccccagatgagtgcggctgccgccgcagccgccgctgctgcagcatacgggcgctcgccagtggtagggttcgatccgcaccatcatatgcgggtcccagccatccctcccaatcttacaggtatacctgggggcaaacccgcctactctttccacgtctccgcagacggtcagatgcaaccagtccccttcccccctgatgctctgattggacccggcatccccaggcatgcaagacagatcaacacactaaaccacggtgaagtggtttgtgccgtgaccatctcaaaccctacaaggcacgtctatacaggtgggaaggggtgtgtgaaagtgtgggatatcagccatcctgggaacaagagcccagtgagccagctggattgtttaaaccgagataattacatccgatcatgtcgactgctgccggacggtaggacattaattgtgggcggcgaagcaagcaccctttccatttgggatttggccgctcccaccccccgcattaaggccgagctcacctcaagtgcgcctgcctgctacgcactggcgatatctcccgacagtaaagtgtgcttcagctgctgcagtgacggaaacatcgctgtttgggatttgcataatcaaaccctggtgcgccaattccaaggacatactgatggggccagttgcattgatatcagcaatgatggcactaagctttggacagggggactggacaacaccgtgcgtagctgggacctcagagaaggtcgccagctacaacagcatgacttcacttctcagattttcagcttgggatactgtccgaccggcgaatggctggcagtggggatggagaattccaacgtggaagtgcttcatgtgactaaacctgataagtatcagctgcaccttcacgagtcctgtgtcttaagtctgaaatttgcccattgcggaaagtggtttgtgagcaccggcaaggacaatctgctcaatgcatggcggaccccttacggagcgtctatcttccagagcaaggaatccagctccgtcctgtcttgcgacatttccgtggacgacaagtacatagtgaccgggtcgggagataagaaagcgacagtctacgaggtgatttattag

SEQ ID NO: 13619 - DNA, 2418 bp, Artificial Sequence
  Description of Artificial Sequence: Synthetic coding sequence
atgattcgggatctgtctaaaatgtatccgcagacccggcatcctgcaccccaccagcccgcccagccatttaagtttaccattagtgaaagttgtgaccgcatcaaggaggagttccaattcctccaagctcagtatcattcattgaaattggagtgtgagaagctcgcctccgagaaaacagagatgcagagacattacgtcatgtattacgaaatgtcttatgggcttaacattgagatgcataaacaggctgagatagttaagcgcttaaacgctatctgtgcccaagtcatcccatttctgtcccaggaacatcagcagcaggtcgtacaagctgtagaaagagcgaagcaggttaccatggcagaactcaatgctattatcgggcagcagctccaagcgcagcacctgagccacggacacggactgccagtgcctctcacaccccatccgtcaggcctccagccccccgcgattccccctatcggtagcagtgccggcttattggcgctgagtagtgccctgggtggccagagtcatctaccgattaaggacgagaaaaagcaccacgacaatgatcatcagcgcgaccgcgatagcataaaatcaagctcagtgtccccatccgcatcgtttaggggggccgagaaacataggaatagtgcggactattcatcagagtctaaaaagcagaagactgaggaaaaagagatagctgctaggtacgattcagacggggagaaaagtgatgacaatcttgtcgtggatgtgtccaacgaggatcctagcagcccgcgcggttcaccggcccattccccccgcgaaaatgggcttgataagactcgactgctgaagaaagacgcacccattagtcctgcctcgatcgcttcttcatctagcaccccatcctccaagtcaaaagagctgagcttgaagagagacatgggtaagctgagcgagactcgcctgagtgaggacgagcagtgcaccctcggcttacagcggtggttttgtcgcctctggttcatgaatgagaaatcaacgacccctgtgtcgaagagtaatactccgaccccccgaactgacgcccccactcctgggtccaactcaactcctggcctacggccagtccctggcaaaccacctggtgtcgacccattagcttcttctctcaggacacccatggccgttccttgtccataccctacgccctttgggattgtgccacacgccggcatgaacggcgaacttacttctccaggtgccgcctatgccggcttgcacaacatcagtccccagatgtcagccgcagcggcagccgcggcagccgccgccgcttacgggaggagcccggtggtagggttcgacccacaccatcacatgagagtcccagcaatcccaccgaacctgacggggatacctgggggaaaaccggcatactcattccacgtgtccgctgatggtcagatgcagccggtgccttttcccccagacgctctgatcggaccagggatcccccgccacgccaggcagattaatacactgaatcatggtgaggtggtgtgtgccgtcaccatttccaatccaacgaggcatgtgtacaccggcggcaaggggtgtgtcaaggtgtgggacatctcgcatcctggaaacaagagccctgtgtcccagttggattgtctgaacagagacaactatattcgtagctgtcgcctcctgcctgacgggagaacacttatcgtcggcggtgaagcaagcaccctgagtatctgggacctggccgccccgacgccccgcatcaaggctgaactgacaagttcagctccagcctgttatgccctggctatctctccagactccaaggtgtgtttttcttgttgctctgacggcaacatcgcggtttgggacctgcacaaccagacgctggtcagacagtttcaaggccacacggacggagcttcctgtatagatatttccaacgacggaaccaaactgtggaccggcggcctggacaacacggtccgcagctgggacctgagagaaggtcgccagctgcagcagcatgatttcacctcacagatcttcagtctcggctactgcccaacaggcgagtggctggcagttggtatggagaactctaacgtggaggtgttgcacgtgaccaaacctgacaagtatcagttgcatctgcacgagtcttgtgtgctgtctctgaagttcgcccactgtggcaaatggtttgtctcaactggaaaagataatctccttaacgcatggagaaccccctacggcgcaagtatttttcagagcaaagaaagttcctccgtgctgtcctgcgacatttccgtggatgataaatatatcgtgaccgggtctggcgacaaaaaggctaccgtgtacgaggtgatctactag

SEQ ID NO: 13620 - DNA, 2115 bp, Artificial Sequence
  Description of Artificial Sequence: Synthetic coding sequence
atgatccgggatctctctaaaatgtaccctcagaccagacatccagccccccaccagcctgcccagccgtttaaatttacaattagcgaaagctgcgacaggatcaaagaggaatttcagttccttcaggcacaatatcactcgctgaagctcgagtgcgagaagctggcatcagaaaaaactgagatgcagcggcattacgtgatgtactacgagatgtcttatggcctgaacatagagatgcacaagcaggccgaaattgtgaaacggctgaacgcaatctgcgcacaggttattccctttctgagccaggaacatcagcagcaggtggtccaagcagtggagagagccaaacaggtcacaatggctgagctcaatgccattatcggtcagcagctgcaggcccaacatctgtctcacggccacggtctccccgtaccattaacgcctcacccctctggtctgcagccaccggccattcccccaatcggctcttccgcaggcttgctcgcccttagcagtgcactgggcgggcagagtcaccttccaattaaagatgaaaaaaagcaccacgataacgatcaccagcgagaacgcgataagctgaaccataagtcattgtcaccatcagcctccttccgaggtgccgagaagcatcggaattcagccgactattcgagcgagtccaaaaaacagaaaaccgaagagaaagaaatcgctgcccgctacaacgaaaaaagtaccacaccggtctcgaagtcaaatactccgacaccccggaccgatgctcctacacccgggagtaacagtacacctggtttacggcctgtgccaggaaagcctcctggtgtggaccccctcgcaagttcgctacggactccgatggccgtaccgtgtccatatcctaccccatttggcatagtcccccacgctggaatgaatggcgaactgacatcacccggcgccgcctacgccggcctgcataatatttcaccgcaaatgtctgctgcggcagcggccgccgccgcagccgcagcttatggacggtcccccgtggtgggctttgacccccaccaccatatgcgcgtgccagccatacctcctaatctgacaggtatccctggagggaagccagcctactccttccacgtaagcgctgacggacaaatgcagcccgtgccctttccaccagacgctttaattggacctggcattcctcggcacgcaagacagatcaacacgttgaaccacggagaagttgtgtgtgctgttactatttccaatcccacaaggcacgtgtatacaggcgggaagggctgtgtcaaggtttgggacatatcgcacccagggaataagtcgcctgtgagccagctcgattgtctgaacagagacaactatattcggtcatgcaggttgcttccagatgggagaacactaattgtaggcggagaggccagcacactgtcgatctgggatctggcggcaccaaccccccgaatcaaggctgagttgacctcatctgcccccgcttgttacgcgttagctatctcgcctgatagtaaagtatgttttagttgctgctctgacggaaacatcgccgtatgggatctccataatcaaacactcgtgcggcagtttcaaggacataccgacggggccagctgcatagacatttctaatgatggcaccaaactgtggacaggaggattagacaacaccgttagatcctgggacttaagggagggcaggcaacttcagcagcacgatttcaccagccagatttttagtctgggttactgccctaccggggagtggttggcggtgggcatggaaaacagcaacgtagaagtgctgcacgtaacaaagcccgataagtatcaattgcacctccacgaatcctgcgttttgtctctcaagtttgcccactgtggcaagtggttcgtcagcactgggaaagacaatttattgaatgcctggcggacaccttacggcgcaagcatttttcagtctaaagagagctcttcagtactttcctgcgatatcagcgtggatgataagtacattgtgacagggagcggcgacaaaaaggctacagtttacgaggttatttactag

SEQ ID NO: 13621 - DNA, 2322 bp, Artificial Sequence
  Description of Artificial Sequence: Synthetic coding sequence
atgatacgcgacttgagcaagatgtatccccagactcgacatcccgcccctcaccagcctgcacagccctttaagttcactatttcggagagctgcgaccgaatcaaagaggagtttcagtttctccaagcgcagtaccactccttgaaattggaatgcgaaaaattagccagcgagaaaaccgaaatgcagagacattatgtgatgtattacgagatgtcctacggtctgaacatcgaaatgcacaagcaagctgagatcgttaagaggctcaatgccatctgcgcacaggtgatccccttcctgtcccaggagcaccaacagcaggtggtacaggccgtggaaagggcaaaacaagtgacaatggcggaattgaatgctattataggtcagcagctgcaggcccagcacctgtcacatggacacgggctcccagttccccttaccccccatccctcagggcttcagcctccagcaatcccaccaattggctcctctgctggcttactggctctgtcatctgcgctgggagggcaaagtcatctcccaataaaagacgaaaagaagcaccacgacaacgaccaccagcgggaccgtgacagtattaaatcaagttcggtgagtccatctgcttctttcaggggagcagaaaagcatagaaactctgccgactacagctccgagagcaagaagcagaagaccgaggagaaggaaatcgccgccagatacgattcggacggggagaagagcgacgacaacctggtggtagacgttagtaatgaggatccctcctctcctcgggggagcccagcccacagcccccgagagaatggcctggacaagactcgactccttaagaaagatgctcccatttcccccgctagcattgccagtagtagctctactccatccagtaaatccaaagagctgtcccttaacgagaagagcactactcctgtgtccaagtccaatacacctacacctcgaaccgatgccccaacccctggctctaatagcacccccggactccggcctgtgccaggaaagccaccgggggttgatcccctggctagcagtctgagaacgccgatggccgttccttgtccctatccaacacctttcgggatcgtgcctcacgctgggatgaacggcgaactcacaagtccaggggcggcatacgccgggctgcacaacatttccccccagatgtccgccgcggccgctgcagcagccgcagccgcagcctatggtagatcccccgtggtgggattcgatccacaccatcacatgcgtgtgccagcgatcccacccaacttgaccggaatccccggcggaaagccggcctatagttttcacgtgagtgctgatggccagatgcagcctgttccatttcctcctgacgcccttatcggccccggcatccccagacatgcccggcagataaatacactcaatcacggcgaggtggtttgtgccgtgacgatctcgaatcccacacggcatgtgtatacaggaggaaagggatgcgtgaaggtgtgggacattagccatcccggaaataagtcaccagtgagccagttggattgcttaaatcgcgataactacatccggtcatgtcggctgctgcctgatggaaggacgcttatagtgggcggtgaggccagtactttgtccatctgggacctggccgcccccaccccccgaatcaaggctgaactcacgtccagtgccccggcctgctatgctcttgccatctctcctgacagtaaagtatgtttctcttgttgtagtgatggcaatatcgctgtatgggatctgcacaaccagaccctggtgcgacagttccaggggcatacagacggcgctagctgtatcgatatatccaacgacggcacaaagctttggaccgggggtcttgacaataccgtgagaagctgggatctccgagagggtaggcagttacagcaacatgatttcacctcccagatcttttcccttggatactgcccaacaggggaatggttggcagtcggaatggaaaacagtaacgtggaagtgctgcacgttactaagccggacaaataccagctgcatctccatgagagctgtgttctcagcctcaaattcgcccactgtggaaaatggttcgtcagtacaggtaaggataatcttctgaacgcctggcgcaccccatacggcgccagcatttttcaaagtaaagagagcagctccgttctgagttgcgacatttctgtggacgacaagtatatcgtgaccggtagtggggataagaaagccacagtgtacgaagtaatctattag

SEQ ID NO: 13622 - DNA, 642 bp, Artificial Sequence
  Description of Artificial Sequence: Synthetic coding sequence
atgatccgcgacttgtctaagatgtacccccagacaaggcatccggccccccaccagcctgcccagccgttcaaatttaccatctctgagagctgcgatcgcatcaaggaggagttccaatttctacaggctcagtaccactccctcaaactggaatgtgagaagctcgccagcgagaaaacggagatgcagagacactatgtgatgtattatgaaatgtcatatggattaaacatagagatgcataagcaggcggagatcgtaaagagacttaatgctatctgtgcccaggttattccttttctgtcccaggaacatcaacagcaggtggtccaggcagtcgagagggctaaacaagtaacaatggctgaacttaatgcaataattggtgagaaaaaaaacaagagcgacacacccggtagcttgaaacagcagcagctgcaggcacagcatctgagtcatggacatggtttacccgtgcctctgactcctcatcctagcgggcttcagcccccagcaatcccacccattggttcctctgctgggttactcgccctctcttcagccctggggggtcaaagtcacctgcccattaaggacgaaaaaaagcaccatgataatgatcaccaaagaggtgaatag

SEQ ID NO: 13623 - DNA, 849 bp, Artificial Sequence
  Description of Artificial Sequence: Synthetic coding sequence
atgagcgatgtggaggaaaacaactttgaggggagggagtcaagatcccaatctaaatctccaacagggacccccgcaagagtcaaatctgagagccgttccggatctcgttctccgtctagggtcagcaagcactcagagtcacactcaaggagccgatccaagtcacgcagtcgcagccgccggcattcccataggaggtacacccgcagtcgctctcactcccattcccacagacgtcggtccagaagccgatcatatactcccgagtacaggcggagacggagcaggagccattctcctatgagcaaccggagaaggcacaccggcagccgagctaatcctgatcctaacacatgcctgggagtcttcggcctgtctctgtatactacagaacgggacctgagagaggtattttcccgatacggtcctctgagcggggtgaacgttgtctacgaccagcggaccggacggagccgcggctttgcctttgtttactttgagcggatcgacgatagtaaggaggctatggagagggccaacggcatggagctggacggaaggcggattcgcgtagattatagtatcaccaagcgagcacacacgccgactcctggtatttatatgggaaggcctacccactccgggggaggcggcggaggcggggggggggggggtggaggtgggggaggaagacgacgcgatagttactacgaccgcggctatgaccgggggtatgacagatacgaagactacgattaccgatatcgccgcagaagtccctcgccttactattcccggtataggagcaggagccgatcccgttcctattccccaaggagatactag

SEQ ID NO: 13624 - DNA, 543 bp, Artificial Sequence
  Description of Artificial Sequence: Synthetic coding sequence
atgtccaataggagacgccacaccgggtcaagagcaaatcccgatcccaacacatgtctgggggtgtttggcctttctctgtatactactgagcgtgatctgcgcgaagtgttttcccggtacggcccactctcaggcgttaatgtcgtgtacgatcagaggactggccgcagtcgagggttcgctttcgtgtactttgagcggattgatgacagtaaggaggccatggagcgcgcgaatggaatggaactagatggtagaaggattagggttgattactctatcacgaaaagagcacacacccctactcctggaatctacatgggccgacccacccattccgggggtggaggcggaggaggtggtggaggtggcggagggggcggcggtcgccgaagggactcatactacgaccggggatatgacagaggatacgaccgttatgaggactacgactaccggtaccggaggtcgccaagcccgtattacagccgctatcgatctcgttcacgcagcagatcctacagcccaagaaggtactag

SEQ ID NO: 13625 - DNA, 546 bp, Artificial Sequence
  Description of Artificial Sequence: Synthetic coding sequence
atgagcaacaggcgtagacacaccggttcccgtgccaatccagatccaaatacctgtctcggcgttttcggcctgtctctctacacgaccgagagggatctccgtgaagtcttcagtcggtacggcccactgtccggtgtgaatgtggtgtacgatcagcgaacaggcaggtcacgggggtttgctttcgtatacttcgaacggatcgatgattccaaagaggctatggaacgggccaacggcatggagcttgacggacggcgcatccgcgtggattacagcatcacaaagagggcacacaccccaacaccggggatatacatgggcagacccacgcactccggcggcggaggcggaggaggtggaggcggcggcggcggcggcggaggtaggcgccgcgacagctactacgatcgcgggtacgatcgagggtacgacaggtacgaagactatgattacaggtaccggcggcggtcaccatctccatattatagtcgatacaggagtcgctctcgctctcggtcctacagtccaagaaggtattag

SEQ ID NO: 13626 - DNA, 2508 bp, Artificial Sequence
  Description of Artificial Sequence: Synthetic coding sequence
atggctgcttctgcggcggcagcatctgccgcggcagcgtcggccgcgagcggaagcccagggcccggggaggggtccgcggggggagagaaaagatcgacagctccatctgcagccgccagcgcaagtgcatcagccgccgcatccagcccagctggcgggggcgccgaagccctggaactcttggagcactgcggggtgtgtagagagcgtctcaggccagagcgcgagcctaggctcctaccatgcttgcactccgcctgctccgcatgccttgggccagccgccccggctgccgccaacagctcaggagacggtggcgcagccggcgacggaactgtggtcgattgtcctgtctgcaaacagcaatgtttctccaaggatatagtggagaactattttatgagggatagtggctctaaggctgccaccgacgcacaggatgctaaccagtgctgcacctcctgtgaggacaatgcccccgctaccagctattgtgtggaatgcagtgaacccctttgtgagacttgtgttgaggcccatcaaagagtgaaatatacaaaggaccacacagtccggagcacagggcccgccaagagtcgagatggagaacgcacagtgtattgcaatgtgcacaagcacgagcccttggtcctcttctgtgaatcctgcgacactctgacatgcagggattgtcagctgaatgcccacaaggaccatcagtaccagttccttgaagacgcagtgcgaaaccagcgaaaactgctggcatccctcgtgaagagattaggcgacaaacacgctacactgcagaaaagtaccaaagaagtgagaagcagcattcggcaagtatcagatgttcaaaagagagtccaagtggatgtcaagatggcaattctccagattatgaaggagctgaataaacgaggcagagtgctcgtgaatgatgcccagaaggtcaccgaggggcagcaagaaagactggagcggcagcactggaccatgacaaagatccaaaagcaccaggagcacattctccgcttcgccagctgggctctggaaagcgacaacaacacagcattactgctaagcaagaagctgatttatttccaactgcatcgcgcactgaagatgatcgtggaccctgtggagccccacggagagatgaagttccaatgggatctaaacgcatggaccaagagcgccgaagcgtttgggaagatcgttgccgagcgcccaggaactaatagtacagggccagcacctatggcgcctccacgtgcccccggtcctctgagcaaacagggatcagggtccagccagcccatggaagtccaggaggggtacggcttcggaagtggcgatgatccgtattcaagcgcagaaccacacgtcagtggcgttaagcgaagtagaagcggcgaaggagaggtctccggactgatgaggaaggtgccacgcgtgtccttggagcgcctggatcttgatcttacagctgattcacagcctcccgtgttcaaggtgtttcccggcagcaccaccgaggactacaatctgatagtcattgagcggggagcggctgccgccgctacaggccagcccgggacagcccctgccggtaccccgggcgccccccccctggctggcatggcaattgtgaaggaggaagaaaccgaagctgcgattggcgcacccccaacagccacggaggggcctgagaccaagcctgttctgatggcgctggcagagggacctggcgctgaagggccccggcttgcatctccttctggctctacatcctccgggctggaagtggtcgctcccgaaggaactagcgcaccagggggtggccctggcactctggacgactccgccaccatctgcagagtatgtcagaagcccggggacctggttatgtgcaaccagtgcgaattttgttttcacctggactgtcacttacctgcactgcaagatgttccgggcgaagagtggtcctgctcactctgtcatgtgctgcctgacctaaaggaggaggatggatccctgagcctggacggagccgattcaaccggcgttgtcgccaagttgtctcctgccaaccagaggaagtgcgaaagagtccttctggcactgttctgccatgagccctgccgacccctgcatcagctggccacggactccactttctcgctagatcaaccgggcggcaccttagacctgaccttgatacgagcccggctccaggagaagctttcaccaccttacagctccccccaagaatttgcccaggatgttgggaggatgtttaaacaattcaataaactcaccgaagacaaagctgatgtgcagtcgatcattgggcttcagagatttttcgaaaccagaatgaacgaagcctttggcgacaccaaatttagcgctgtgctggtcgaaccccccccaatgagccttcccggggccgggctgtctagccaagagctgtcgggaggtccgggcgacggcccttag

SEQ ID NO: 13627 - DNA, 2262 bp, Artificial Sequence
  Description of Artificial Sequence: Synthetic coding sequence
atggccgcctctgccgctgccgcctccgccgcggccgccagcgctgcctccggcagcccaggccccggcgagggtagtgcgggcggagagaagcggtcaacagccccaagcgcggctgccagcgcttccgcctcagcagcagcctcttcccccgcgggcggtggggccgaggccctcgagttgctcgagcattgcggtgtatgcagagaacggctgagaccggagcgcgaacctcggctcctgccctgtctgcactccgcctgtagcgcttgtctgggccccgccgcacctgcagcagctaattccagtggcgatggaggtgcggctggtgacgggactggacctgcgaaatcccgcgatggtgagcggactgtgtactgcaatgtgcataaacatgagcctcttgtccttttctgtgagagttgtgacacactgacttgccgagattgccagctgaacgcccacaaagaccaccagtaccagttcctcgaagatgcagtgagaaatcagaggaagttgctggccagcttggtcaaaagactgggcgacaagcacgccactctgcagaagagtacgaaggaggtgcgttcttcgatccgccaagtttccgacgtccagaagcgggttcaggttgacgtgaagatggcaatcctccaaatcatgaaggaactcaacaagcgagggagagtactggtaaacgacgcacagaaggtgacggagggacaacaggagcgactggaacggcaacattggacgatgactaagattcaaaaacaccaggagcacatcctgagattcgcttcctgggccctagagtcagataacaacacggctctcctgctctccaagaagttaatttacttccaactgcaccgcgctctaaaaatgatcgtcgatcccgttgagccccatggcgagatgaaattccagtgggacctaaatgcttggactaaatctgcggaggcctttgggaagatcgtagctgagaggcctggcaccaattcaactggacctgcccccatggcccctccaagggcacccggcccattgtctaaacagggatccggctcctcgcaacccatggaagtgcaggaggggtacgggttcggttcgggggacgatccttacagctctgccgagccccacgtgagtggagtcaagagatctagatcaggcgagggggaggtttccggcctcatgagaaaggtccctcgcgtgtcattagaacggctggacttggacctcaccgctgacagccagccccccgtgttcaaggtattcccggggtctaccacagaagactataacttgatcgtgatcgaaagaggtgctgccgcagcagcaaccggccagcctgggactgcaccggccggcacccccggggcgcctccactggctggcatggcaattgtcaaggaggaggagactgaagccgctattggagcaccccctactgcaacagaaggtccagagaccaaacccgtcttgatggcgctcgctgagggccccggagcggaaggacctaggcttgcctctccatctggcagtacctctagcggtctcgaagtggtcgcccctgaggggacttctgccccaggaggcggacctggcacactggatgacagtgcaactatttgtcgcgtgtgccaaaagcccggggacctggttatgtgtaaccaatgcgaattttgcttccacctcgattgtcacctccccgctctgcaggacgtgcctggtgaagagtggagctgctccttatgccacgttctgcctgacctaaaggaggaggacgggtctctgtccttggacggggccgatagcaccggcgtggtagccaaactctctcctgccaaccaacgcaagtgtgagagagttttgctggctctattctgtcatgaaccatgcagacctcttcatcagttagcgactgactccacattctctctggaccagcccggtggaaccttggatctcaccttgatccgggcccgtctgcaggagaaactctctcctccctacagctccccacaggaatttgcgcaggatgtgggccgaatgttcaaacaattcaataaacttactgaagataaggctgatgtacaaagtatcatcggcctccagaggttttttgagactagaatgaacgaagctttcggcgatacaaagttttctgccgtcctggtcgagccgcccccaatgagcctgccaggcgcaggcctcagtagccaagagttatccggtgggccaggcgatggcccctag

SEQ ID NO: 13628 - DNA, 1503 bp, Artificial Sequence
  Description of Artificial Sequence: Synthetic coding sequence
atggaggtgtccactaatccctcatccaacatcgaccctggtgattatgtggaaatgaacgattcaattacgcatctcccgtccaaggtagtcattcaggacataactatggaactccattgtccgctgtgtaacgactggtttagggaccctctcatgctcagctgcggacacaatttctgtgaagcctgcattcaggatttctggcgtttacaggcaaaagaaaccttctgccctgaatgcaagatgttatgtcaatataacaattgtacctttaatcccgtcctcgataagctggtggaaaaaattaagaaactgcctctgcttaagggccatccacagtgccccgagcatggtgaaaatctcaagcttttttccaagccagatggaaagctgatctgtttccagtgcaaggatgcccgactgagcgtggggcagtccaaagaattcttacagatctcagatgccgtgcacttctttactgaggaactcgcaattcagcagggtcagttggaaacgacgcttaaagaattgcagacattgagaaacatgcaaaaggaagctatcgccgcacataaggagaacaagctccatttgcagcagcacgtgtccatggagttcctgaagcttcatcagtttctacactccaaggagaaggacatattgaccgagttgagggaggagggaaaggccctgaacgaggaaatggagctgaatcttagtcagctgcaggagcaatgcttactcgcaaaagacatgctggtttccatccaggcaaagaccgaacagcaaaatagcttcgactttctcaaggatatcaccaccctgttacactccctggaacaaggaatgaaagtcctcgcgacgagggaactgatttctcggaaacttaacctcggccagtacaagggtcccattcagtacatggtctggcgagaaatgcaggacactctctgtcctggcctttcccctctcactcttgacccgaagactgcccatcccaatctcgtgctgagcaaaagccaaacttctgtgtggcacggagacataaagaagattatgccagatgatcccgagaggttcgatagctctgttgcagtgctgggttcaagaggctttaccagcggcaagtggtactgggaggtggaagtcgccaagaagactaagtggactgtgggcgtcgtacgggagtcgataatccggaagggcagttgtcctctgaccccggagcagggcttctggctgctccggcttaggaaccagactgacctcaaggcactggatctgccttccttttccctgactctgacaaataacctggataaagtcgggatctacttggactacgaaggaggccagctaagtttttacaacgctaagactatgactcacatttacaccttctcaaacacttttatggaaaaactgtatccttacttttgcccttgtcttaatgacgggggcgaaaataaagagccgctccacattttacaccctcaatag

SEQ ID NO: 13629 - DNA, 1026 bp, Artificial Sequence
  Description of Artificial Sequence: Synthetic coding sequence
atggaagaagagttggctattcagcagggccagctggagactaccttgaaagagttacaaaccttgcgtaacatgcagaaagaggccatcgccgcacacaaggagaacaaactccacctccaacagcacgtaagcatggagttcttaaagctccaccaattcctgcattccaaagagaaggatatcttgactgaactccgggaggaagggaaagcgctaaatgaagaaatggagctgaacctgagccagttgcaggaacaatgcctgctggccaaagacatgctggtctccatacaggctaaaaccgaacagcagaattctttcgacttcttaaaagatatcaccacacttctgcactccctggaacagggtatgaaagtgcttgctactagagagctaatctctcggaagttgaacctgggccagtacaaagggccaattcagtacatggtgtggagggagatgcaagacacattatgtccaggcttgtcaccactgactcttgatcccaaaacagcacacccgaatctcgtgctaagtaaatcccagacttctgtttggcacggagatataaaaaagataatgcctgacgatcccgagcgattcgatagcagcgtcgctgtcctgggctcaaggggctttacgtctgggaaatggtactgggaggtggaagtggctaagaagaccaagtggaccgtgggtgtggtgagggagagtatcatacggaaaggaagttgccctctaacccccgaacagggcttttggcttctgagactgcgaaatcaaaccgatctgaaagcactggacctgcctagctttagccttaccctcacgaataatctggacaaggtcggcatttatctcgactatgaaggaggacagctgtccttctataacgccaagactatgacccacatatatacattctccaacacattcatggaaaaactctacccctacttttgcccatgtctgaacgacggcggtgaaaataaagagccgctccacattctgcatccacaatag

SEQ ID NO: 13630 - DNA, 891 bp, Artificial Sequence
  Description of Artificial Sequence: Synthetic coding sequence
atggagtttctgaagctccatcagttcttgcattcaaaggaaaaggacatcttgacagagctcagggaagagggcaaagcactgaacgaggaaatggaactgaatctgtctcaactgcaagagcaatgtctgctcgccaaagatatgcttgtctccattcaggcaaaaactgagcagcaaaattccttcgatttccttaaggacatcaccacacttttacactccctcgagcaagggatgaaggtgctggcaacccgagagctgatctcacggaagttaaatttggggcagtataaggggcccatccagtatatggtatggagggagatgcaggataccctctgtccaggcctgtcacccctcactctagatccaaaaaccgctcaccccaatctggttctttcaaaatctcagaccagcgtgtggcatggcgacattaagaagattatgccggatgatcctgagaggttcgactcttcagtggccgtcttgggatctcggggattcacaagcggaaagtggtattgggaagtcgaggtggccaaaaaaactaagtggacagttggggtagttcgggaatctattatcaggaagggcagctgcccactgacccccgaacagggattctggttgctccgtttaagaaaccagactgatctcaaggcgcttgatctgccttcattctccttaactcttaccaataacctggacaaagtcggtatctacctggactatgagggcgggcagctctccttctacaacgctaaaacgatgacacacatttataccttttctaatacgttcatggagaagctgtacccttacttttgcccctgtctgaacgatgggggcgaaaacaaagagcctttgcatatcctgcatccgcagtag

SEQ ID NO: 13631 - DNA, 840 bp, Artificial Sequence
  Description of Artificial Sequence: Synthetic coding sequence
atggaattcctgaagttacaccagtttttacactccaaggagaaagacatcctgactgaactccgggaggagggaaaagcactcaatgaggaaatggagctcaatttgtctcagctgcaggagcagtgcctcctcgccaaagacatgctggatatcacgaccttgttgcactcactcgagcagggcatgaaagtgctggccacgcgagaactgatttccagaaaactgaacctggggcagtacaagggcccaattcagtacatggtgtggagggagatgcaggataccttatgtcccggtctgtctccgctgacgctagacccaaaaactgctcatccaaatctcgtcctgagtaaatcccagacttcggtctggcacggtgacatcaaaaagattatgccggatgatcccgaaagattcgatagtagcgtcgccgttctcggcagtcggggattcacttctggcaagtggtactgggaagttgaggtcgccaaaaaaactaagtggacagtgggggtggttagggagtcaattattcgcaaggggagctgccctctaacccctgagcaaggtttctggttactccggttgcgcaaccagaccgatttgaaagcactagatctgccctccttctcattgacactcaccaacaatcttgacaaagtgggaatttatctggactatgaggggggccagctgagcttctataatgctaagactatgacgcacatctatacatttagcaataccttcatggagaagttgtatccttatttctgcccctgtctgaatgacggcggcgaaaacaaggaacctctccatatcctccacccacagtag

SEQ ID NO: 13632 - DNA, 1503 bp, Artificial Sequence
  Description of Artificial Sequence: Synthetic coding sequence
atggaggttagtaccaatccatcttcaaacatcgacccaggtgattacgtggagatgaatgattctattactcacctgccaagtaaagtggtaattcaggatatcacgatggagttgcattgcccattgtgtaatgattggttccgcgacccactgatgctttcctgtgggcacaacttttgtgaagcgtgtatacaagatttctggcggctgcaggccaaagagacattttgtcctgagtgcaagatgctgtgtcaatacaataactgcacgtttaacccagtactagataagcttgtagagaagattaaaaaattgcccctgctgaaaggccatccccagtgccctgagcacggcgagaaccttaagctgttctcaaagccagacggtaaactcatttgttttcagtgtaaggatgccaggctttctgttggacagagcaaggaattcctgcagatcagcgatgccgtgcacttctttaccgaggagctcgcaattcagcaaggccagctggagaccaccttaaaagagcttcaaacactacgaaacatgcagaaagaggctatcgcagcacataaggaaaacaagctgcaccttcagcagcacgtttcaatggaattcctgaagctccatcagttcctccattcaaaggaaaaagacatacttaccgaactgcgcgaagaggggaaagcacttaacgaagagatggagctgaatctcagccaacttcaagagcagtgcctcctcgcgaaggacatgctcgtgtcaattcaagctaagacagagcagcagaactcattcgatttccttaaggatatcaccacgctgctgcacagtctcgagcagggaatgaaagttctggcgactcgcgagttaatttcccgtaagctcaacttgggccagtataaaggccctatccagtacatggtgtggagggagatgcaggacaccctctgccctgggctgagtccactgaccctggacccgaagaccgcccatccaaacttagtcttgtctaagtctcagacctccgtttggcatggcgatataaagaaaatcatgccggacgatcccgagcggtttgactcaagcgttgccgtcctgggcagccggggttttaccagcggaaagtggtattgggaggttgaagttgctaaaaagacaaagtggactgtgggcgtggtccgggagagcattattagaaagggatcatgcccgctcaccccggaacagggcttttggctcctgaggctaaggaaccagacagatctaaaggcactggacttgcccagtttcagcctgaccctgaccaacaacctcgataaggtcggcatctacctagattacgaaggtggccagttgagcttttacaatgccaaaacaatgactcacatctacactttttctaacacctttatggagaaactttatccttatttctgtccctgtctcaacgacggcggtgaaaacaaggagccgctgcacattctgcacccgcagtag

SEQ ID NO: 13633 - DNA, 891 bp, Artificial Sequence
  Description of Artificial Sequence: Synthetic coding sequence
atggagtttctgaagttgcaccagtttcttcacagcaaggaaaaggacattctgacagagttgagggaggagggtaaggcactgaacgaagaaatggagctgaacctgtcccagctccaagagcagtgccttctggcaaaggacatgttagtgtccattcaggctaagacagagcagcagaactcatttgatttcttgaaggacatcactacacttcttcacagcctggagcagggaatgaaggttttagcaacacgggaacttatttcgcgcaagcttaacttaggacagtataaaggccccatacagtacatggtgtggcgcgaaatgcaggataccttatgccctggtttgagtccgttgactctggaccctaagactgcgcatcccaacttggtactgtctaagtcccaaaccagtgtgtggcatggagacattaagaagattatgcctgatgacccagagagattcgattcctccgtggccgtccttggtagccgaggcttcactagtgggaagtggtactgggaagtcgaggtagcaaaaaaaacgaagtggacagtgggggtcgtacgggaaagtataattcggaagggttcctgtcctctgactcccgaacagggattctggctccttagactgcgaaatcagaccgacctgaaggcactggatcttccgtccttctctctgaccttgacaaacaatctggataaggtcgggatctatttagattatgaaggagggcaactgtctttttacaacgctaaaactatgactcatatatacaccttcagcaatacattcatggagaaactgtacccttatttctgtccttgtttgaatgatgggggagagaacaaggaacctctgcatattcttcatccacagtag

SEQ ID NO: 13634 - DNA, 1494 bp, Artificial Sequence
  Description of Artificial Sequence: Synthetic coding sequence
atggagggttctggagaacagcctggccctcagccccagcatccaggcgaccatcggatcagagacggggacttcgttgttctaaagcgcgaggacgtgttcaaggcagtgcaggtgcagcgacgaaagaaggtgacttttgagaaacagtggttttatttagataatgtgatcggccactcatacggcacagcattcgaggtcacatctggcggatcactccagcccaaaaagaagcgggaagaacctacggctgagactaaagaggcaggtactgacaacaggaatattgtagacgatgggaaatcccaaaagctcactcaggacgacattaaggcccttaaagataagggaatcaaaggggaagaaatagtccagcagctgatcgagaactctaccacgttccgagataagacagagttcgcccaagataagtacattaagaaaaaaaaaaaaaaatatgaagctattataactgtcgtgaaaccgtccacacggatcctgtccataatgtattacgccagggaacctgggaagatcaaccacatgcgatatgacactctggcccagatgctgaccctcggaaatattcgcgccggtaacaaaatgatagtaatggagacatgtgctggcctagtgcttggagccatgatggaacggatggggggattcggcagcattatacagttataccccggtggcggccccgtaagggccgctacagcctgttttggattccctaagtcttttctgtcagggctctacgagttcccactgaataaggttgatagtttactgcatggcaccttctctgccaaaatgttatctagcgaaccaaaggactccgctctggtggaggagtccaacgggaccctggaagaaaagcaggcctctgaacaggagaatgaagattctatggcagaagccccagaaagcaatcaccctgaggaccaagagacaatggaaactatctcacaggatccagagcataaaggtcccaaggagaggggttccaaaaaagactacatacaggagaaacagcgaagacaggaagaacaaaggaaacggcacctcgaggccgcagcactgttgtcagagcggaacgcggacggccttattgtggctagtcggttccaccccacccctttgctcctctctttgctggattttgtagccccatcacgaccctttgtcgtttattgccagtacaaagagcccctgctcgaatgttatacaaagcttagggaacgcggcggggttataaaccttcggctttccgagacttggttgcgcaattaccaggttttacctgatagatcccacccgaagctgttaatgtctggtgggggcggctacctgcttagcggcttcaccgtggccatggataaccttaaagccgatacctccctgaaaagcaacgcttctacgctcgagtctcacgagaccgaggagcccgcagctaaaaagcgcaagtgcccggaatcggacagttag

SEQ ID NO: 13635 - DNA, 984 bp, Artificial Sequence
  Description of Artificial Sequence: Synthetic coding sequence
atgtattacgcgcgagaacccgggaagatcaatcatatgaggtatgacacactggcccagatgctgacgctcggtaacatcagggcagggaacaagatgatcgttatggaaacctgcgccggactggtacttggcgcaatgatggaacgaatgggcggcttcggctccattattcaactgtatcctggtgggggccccgtgagggctgctacagcgtgctttggctttcctaagtcattcctgtcagggctgtacgagttcccactgaacaaggttgattccctcttgcacggaacatttagcgcaaagatgctgtcctctgagcccaaggattctgccctggtcgaggaatctaacgggacattggaggaaaagcaagcaagtgaacaggagaacgaggattccatggccgaagccccagaatcgaaccacccagaggatcaggaaactatggagacaatttcccaagaccccgagcacaaaggaccaaaggagaggggctccaaaaaggattacatccaggaaaaacagcgtaggcaggaggaacagcgaaagagacatctagaggctgccgctttgctatccgagcgtaacgctgatggattgatcgtggcgtcccggtttcacccaacaccactcctattgtccctgctcgattttgttgccccctctaggcctttcgtcgtctattgtcagtacaaagagccactgctggagtgctacactaagctgcgcgagcgcggcggtgtgatcaacctgcggctgtcagagacatggctacggaactaccaggttttgcccgaccgctcccacccaaagctcctcatgagtggcgggggcgggtatctcctgtccggatttacagtagcaatggataacctgaaggcggatacgtcgctaaagtctaatgcctccactttggagtcacacgaaaccgaggaacctgctgcgaagaaaagaaagtgtcccgagagtgactcttag

SEQ ID NO: 13636 - DNA, 963 bp, Artificial Sequence
  Description of Artificial Sequence: Synthetic coding sequence
atgtctttcgtggcctatgaggagttgatcaaagaaggcgacaccgccattctgtccctgggacatggcgctatggtggcagttagggtgcagcgaggtgcacagacccagacacggcatggcgtcttgcgccactctgtggatttaataggccggccctttggctctaaggtgacctgcggcagaggtggctgggtctatgttctgcaccctaccccggaactatggactcttaatcttcctcaccggacccagatcttatactcaacagatatagccttgataacaatgatgctggagctccgtcctggttcagttgtgtgtgaatcggggaccgggagtgggagcgtgtcccatgccatcattcgaacaatcgcacctactggacacctgcacaccgttgagtttcaccaacaacgggctgagaaagcacgggaggagtttcaggagcacagggttggtagatgggtgacagttcgaactcaagacgtgtgtcggtcggggtttggagtttcacacgtggcggatgcagtgttcctggacataccaagcccttgggaagcagttggacacgcctgggatgcgctcaaggtggaaggaggccggttctgttcattctccccatgtatagagcaagtgcagaggacctgccaggctctggccgcacgcggattctcagaactgtctacactggaggtgcttccccaggtgtacaatgtcaggacagtaagtctgccgccacccgatctggggaccggaactgatgggcccgctggatctgatacctcaccctttcgatctggaacccctatgaaagaagcggtgggccacacggggtacttaacacttgcgaggtcatggggcgagctcacccaaaatccttgccctgcactgccctccgcacgaagacccggccagcctcgtaatcagggcggagatcccgcgctgtggccgcccgggtag

SEQ ID NO: 13637 - DNA, 870 bp, Artificial Sequence
  Description of Artificial Sequence: Synthetic coding sequence
atgtcttttgtggcctacgaggaactcatcaaggaaggcgacaccgctatcctgtctttaggtcatggcgctatggtcgccgtccgggtccagcggggcgctcagacccagacaagacacggagttctacgacactctgttgaccttatcggaaggccttttggctcgaaggtaacctgtggaagggggggatgggtgtacgttctgcaccccaccccagagctttggacattgaacctgcctcatagaactcagatactttattctactgatattgctcttatcacaatgatgcttgaactccggccgggttcagtggtctgcgaaagtgggaccggatctggcagcgtcagccatgccatcatccgtacaattgccccaaccgggcacctgcacacagtcgaatttcaccagcagagagccgagaaggctagggaggagttccaggaacatagagtaggtagatgggtcaccgtcagaacacaggatgtgtgtaggtctggcttcggggtctcccacgtcgcagacgctgtgtttctggacattccttccccatgggaggccgtaggacatgcttgggatgccttaaaggtcgagggcggacggttctgtagtttcagcccttgcattgagcaggtgcagaggacttgtcaagccttggctgccaggggtttctcggagctgagcactctggaggtgttacctcaggtgtacaacgtgcggacagtttctctgccccctcctgatctgggaactgggactgatggaccggcgggctccgacacctcacctttccggtcagggactccaatgaaagaagccgtgggtcatacgggctacttaacgttcgccaccaagaccccaggttag

SEQ ID NO: 13638 - DNA, 1245 bp, Artificial Sequence
  Description of Artificial Sequence: Synthetic coding sequence
atgagtgggttggatggaggaaacaaactcccattagcccagaccggtggcctagccgcaccggatcacgcctccggggaccccgatagggatcagtgtcagggcctgagagaggagacagaagccacccaggtcatggccaatacaggcggaggtagcctggaaacagtggctgaagggggcgcctcccaggatcctgtggattgcggccccgcactgcgtgtacccgtggctggaagtagggggggcgctgccactaaagccggacaggaagacgcgcccccatctacgaaaggcctggaagccgcctccgctgctgaggctgcagactcctcccagaaaaacggttgtcagttgggtgaaccccgaggtcccgctggccagaaggctcttgaagcatgtggggcggggggcctcggatctcagatgatacctggcaagaaggccaaggaagtgacgaccaaaaaaagagccatcagcgcggcggtggagaaggagggagaggccggcgccgcgatggaggagaaaaaggttgtccagaaggagaagaaagttgcaggtggtgtgaaggaagagaccagaccaagagctcctaagattaacaattgtatggattctctcgaagctattgaccaggagctgagcaatgtcaatgcccaagccgatagggcattcctccagcttgaacggaagttcggccggatgcgcagattgcatatgcagaggagaagttttatcatacagaacattcccggattttgggtaacagcctttcgcaaccacccccagttgagccctatgataagtggacaagacgaagatatgctccgttacatgattaatctggaggtggaagagctaaagcacccacgagccggatgcaagtttaaattcatcttccagggaaatccatacttccgaaatgaaggcctagttaaagaatatgagcgaaggtccagcggccgcgtggtctccttgtccacccctatccgatggcataggggccaggatcctcaagcccatatccaccggaatcgcgagggcaatacaattccaagcttcttcaactggttcagcgaccatagtctattggaatttgatcggatcgctgagatcataaagggagaactttggccaaatcccctgcagtactacctgatgggcgagggtccacggcgtggcatcagaggcccacctaggcaacctgttgaaagtgctagatcattccggttccagtcaggatag

SEQ ID NO: 13639 - DNA, 1254 bp, Artificial Sequence
  Description of Artificial Sequence: Synthetic coding sequence
atgtctggcagatcccgcggacggaaaagtagtcgagcgaagaatcgcgggaagggtcgcgccaaggccagagtccgtccagccccagacgatgcacccagagaccctgatccatcacagtaccagtccctcggagaagatacacaggcggctcaggtgcaggcaggggccggttggggtgggctggaggccgccgcctccgcacagctgttgcgcctaggcgaggaggccgcatgcagactgcctctcgattgcgggttggcactgcgggcgcgagctgccggcgaccatgggcaggcagctgcccggcctggccccggtaaagcagccagtctgtccgaacgtctggccgctgacacggtgttcgttggaactgccggtacagtggggagaccaaagaacgcacctcgcgttggtaatcgccgggggcccgccggcaaaaaggcccccgagacgtgcagtacagccgggcgtggcccccaggtgatcgccggagggcgccagaagaagggcgcagccggagaaaacacctccgtatccgccggcgaagaaaaaaaagaggagcgcgatgccggatcgggtccaccagcgactgaaggatctatggataccctggaaaacgtccagcttaagctggagaatatgaatgctcaagcagaccgggcttatctgagactgagcaggaagtttggtcagcttcggttgcagcacctcgagcgtagaaatcatcttattcaaaatatcccaggattttggggtcaagcatttcagaatcatccacagttggcctcattcctgaacagccaggagaaagaggtgttgagctacctgaattccctagaggttgaggagctcggcctcgccagactgggctataaaatcaagttttattttgacagaaatccttactttcagaataaagtactaataaaagagtatggatgcggtccttctggccaggtggtaagccggtccactcccatccagtggctgcccggccatgacctccaatctttatcgcaaggaaacccggagaacaaccgatcctttttcgggtggttctccaatcactcttcaatagaaagcgacaagatagttgaaattataaacgaagaactgtggcccaacccattgcagttttacctgctttctgaaggggcccgcgtagagaaggggaaagagaaagagggcaggcagggacccgggaagcagcccatggaaactacccagcctggagtgtctcagagcaattag

SEQ ID NO: 13640 - DNA, 1233 bp, Artificial Sequence
  Description of Artificial Sequence: Synthetic coding sequence
atgtccctccccgagtccccacattcacccgccactctggactacgctctcgaggacccgcatcaggggcagagatcaagagagaagtccaaggctacggaagtaatggcggatatgttcgacggaaggttggaaccaatcgtgtttcctccgcctcgtttgcctgaggaaggagtggcccctcaggatcccgcagatggcggacatacattccacatcctggtcgatgcagggaggagtcatggcgcgataaaggccgggcaggaagttacacctcccccagccgagggccttgaggccgcgtctgcctccctgactacagatggctcgctaaagaatggatttccaggcgaggagacgcacggactgggcggtgagaaagcactagagacctgtggcgctgggagaagtgagagcgaggtgatcgctgaggggaaagctgaagacgtgaaaccggaagagtgcgccatgttttctgccccagtcgatgagaaaccagggggggaggagatggacgtggctgaggaaaatcgggctatcgatgaggtcaatagagaggccggaccgggcccgggaccaggccctctgaacgtgggactccatctgaaccccctggagagtatccaactcgaactggacagtgtcaatgcagaagctgatagagcgttactgcaagtggagcgaaggttcgggcaaatccatgaatactatctcgaacagaggaacgatattattcgcaatattcccggcttctgggtgaccgcctttcgccatcacccccagctgtccgccatgattagagggcaagacgcggagatgctgagttacctgaccaacctcgaagtcaaggaactcaggcaccctcgcaccggttgtaagttcaagttcttcttccagcgaaatccatacttcaggaacaagctgattgtaaaggtgtatgaagtgagatctttcggtcaggtggtatcattcagcactttgatcatgtggagaagaggccacgggccccagtcatttatccataggaatcgacacgtgatttgttcattcttcacctggttctccgaccacagccttcctgaatccgataggatcgcacagattatcaaagaggacctgtggtccaaccccctgcagtactacctcttaggcgaagacgctcatcgggcccgccgaaggctggtgcgggagcctgttgagatccccaggccatttggcttccagtgcgggtag

SEQ ID NO: 13641 - DNA, 2415 bp, Artificial Sequence
  Description of Artificial Sequence: Synthetic coding sequence
atggccgctcatcgccccgggcccctcaagcagcagaataaggcccacaaaggaggtcggcatagggggcgggggagtgcacagcgggatggcaagggaagattagccctgaaaacgttgtccaagaaagttagaaaagaattgagcagagtggaccagcggcatagggctagccagttaagaaagcagaagaaagaggccgtcttggcggagaagcgccagctcgggggaaaagacggtccacctcaccaggtcctggtcgtgccactccattctaggatctccctgcccgaagctatgcaactactgcaggaccgggacaccgggaccgtccatctcaacgaactcggtaatacccaaaatttcatgttactgtgcccacgtttaaagcacaggtggtttttcacgtccgccaggcccggcgatctccacgttgtcttggatatggcaaaggttgcggacaccatcctgttcctcctggaccctctcgagggttgggattcaactggcgactactgtctctcttgtctcttcgctcaggggctgcctacgtacacactagctgtgcaggggatttcgggcctgcctctgaagaaacagatcgatacccgcaagaagctgagtaaagccgtggagaagagatttccgcacgataaactgctgctgctagatacacagcaggaagcagggatgttgttgcgacagctcgccaaccaaaaacagcaacatttggccttcagagaccgacgggcatacctctttgcccacgcggtcgattttgtgcctagtgaagagaacaacctagtgggcacgctgaagatcagtggttacgtacgtggtcagactctgaacgttaatcgactgttgcacatcgttggttatggcgatttccagatgaaacagattgatgctccaggtgatccattcccactgaacccccgggggattaaacctcaaaaggatcctgatatggccatggagatctgtgccaccgatgcagtggatgacatggaagaggggctgaaagttcttatgaaggccgatccaggccggcaagagtccctgcaggctgaagtaatcccggacccaatggagggagagcagacatggcccaccgaagaggaactcagtgaagctaaggattttctgaaggagagctccaaggtggtcaagaaggtcccgaaggggacgtcctcataccaagctgaatggatactggacggtgggagtcaatctggcggagagggtgatgagtacgaatacgatgacatggaacacgaagactttatggaggaagagtcccaggatgagtcaagcgaagaggaagaggaatacgaaaccatgaccataggagagtcggttcacgatgatctttatgacaagaaagtggacgaagaggctgaggcaaaaatgcttgagaaatataaacaggaacggttggaggagatgtttcccgacgaggtggatactccgcgcgacgtggctgcgaggatccggttccagaaatacagaggtctcaaaagtttccggacaagcccctgggacccaaaggaaaacctcccacaggattacgcaagaatatttcaattccagaattttactaatacgcgaaagtcaatttttaaggaggtggaggagaaggaggtggaaggtgcagaagtcgggtggtatgttacactgcacgtgtccgaagtgcccgtgagtgtggtggagtgttttagacaggggaccccactcatcgcattcagtttgctccctcatgagcagaaaatgtccgtgctcaacatggtggtgcggagggaccccggtaacacggagccagtcaaagctaaagaagagctcatctttcactgtggattcagaaggttccgcgcaagccctctgttttcccagcacacagcggccgataaacataagctccagcgtttcctcaccgccgacatggctctggtcgcaactgtgtacgccccaataacattccccccagctagcgtgttgctcttcaagcaaaagagcaacgggatgcactccttgattgcgaccggacacctcatgtcagtggaccctgatcgaatggttatcaagagagtggtgttgagcggacatccctttaagatcttcacgaagatggccgtggtccgctatatgttttttaacagggaggatgtcctctggttcaaacctgtggagctccgaacaaagtggggaaggcgtgggcatattaaggagcctttagggacccacggacatatgaaatgtagtttcgatggcaagctgaagtcccaggacactgtcttgatgaacctttataaaagggtctttccaaagtggacgtacgatccatacgtgcccgaaccagtgccgtggctcaaatcagaaatatcaagcacggtccctcagggcggtatggaatag

SEQ ID NO: 13642 - DNA, 57 bp, Artificial Sequence
  Description of Artificial Sequence: Synthetic coding sequence
tgtaagcaatcgtgcgtctccatcgctagctgcgaggctgctgaactgaatctctag

SEQ ID NO: 13643 - DNA, 2319 bp, Artificial Sequence
  Description of Artificial Sequence: Synthetic coding sequence
atgaaccgcctgcgcaatgccaaaatctacgtcgagcgggccgtaaaacagaagaaaatttttacaattcagggctgctatcctgtgatcaggtgtctcctccggagacgcggttgggtggagaagaaaatggtgcaccgatcagggcccactctcctaccgccacaaaaagatttagattctagcgcaatgggggatagcgacactaccgaggatgaagatgaggacgaggacgaagagttccagccttctcaactcttcgattttgacgacctcctgaagtttgacgatttagacggcactcacgccctcatggtgggcttgtgtctgaacctcagaaacttaccatggtttgacgaggtggatgctaattccttttttccgcgttgctattgtctgggcgccgaggatgataagaaagccttcatagaagacttttggctgactgccgcccgcaatgttctcaaactggtggtgaaaagcgagtggaagagctatccgatccaagccgtagaggaggaagcttccggagacaagcaaccaaaaaagcaggagaaaaacccagtgttggttagccccgaatttgtggacgaagccctctgtgcctgtgaggagtacctgtctaatctggcacacatggacattgacaaggacttggaggcaccattatacctgaccccagagggttggtcactgttcttgcagagatattaccaggtcgtgcacgagggggcagaactacggcacctggatacccaggtgcagcggtgtgaggatattttgcaacagttgcaggcagtcgtgccccagattgacatggaaggggatcgaaacatttggatagtaaaacccggagctaagagcagaggccgcggtatcatgtgcatggaccatctggaggaaatgttaaaactcgttaatggaaacccagttgtgatgaaggatggaaagtgggtggttcaaaaatacatcgagaggcctctgttgatcttcgggacaaagtttgacctcaggcaatggttcttggtgactgactggaatccattgaccgtttggttctacagagactcctacattaggttttccactcagccgttcagcctgaaaaacctcgataattctgtgcacttgtgtaataattcgatacagaaacacctggagaactcttgtcatcgccaccccctcctcccccccgataatatgtggtcttcccagcggttccaggctcacttacaagagatgggtgctcccaacgcctggtccaccatcatcgtgcccggaatgaaagacgccgtgatccatgcactccaaacttcgcaagatactgtccaatgtaggaaagcaagctttgagctgtacggtgctgattttgtctttggggaagacttccagccatggctcatcgagatcaatgccagtcccactatggccccctcgaccgcggtcaccgcacgcttatgtgctggggtgcaagcggatactctgcgtgtggttatcgaccgcatgctggacaggaattgtgataccggcgccttcgagctgatttataaacaacctgccgtggaggtaccccagtatgtgggcatcaggctgctcgtggagggcttcacgattaagaagcccatggcgatgtgccataggcgtatgggcgtcaggccggcagttcccttgttgacccaaagaggttcaggcgaggcccgacaccatttccccagtctacataccaaagctcagctgccttccccccacgtgctacgacatcaagggcaggttctgaggcgacagcattccaaactggtcgggacaaaggcccttagcacaaccgggaaagcgcttaggacgctgcctactgctaaagtgtttatctccctcccgccaaatctggatttcaaggtggcgccctccatcctcaagccacggaaggctcccgcccttttatgtctgcgcgggccccagctggaggttccttgttgcctctgcccacttaagagcgagcagttccttgcacccgttggtcgcagtcggcccaaagctaactccagacccgactgcgacaaacctcgggctgaggcttgcccaatgaagcgtctctcaccactgaagccactgcccttggttgggacatttcagagacggcggggacttggggacatgaaactgggaaagcctctcctcagattccccaccgccttagtgctcgaccccaccccaaataagaaaaagcaggttaaatatctcgggctggattcaatagcagtggggggctcacgcgtggatggtgcaaggccgtgtactcccgggagcaccgcccgagcctag

SEQ ID NO: 13644 - DNA, 723 bp, Artificial Sequence
  Description of Artificial Sequence: Synthetic coding sequence
atgttccagagacttaataagatgtttgttggagaagttagttcctcaagtaaccaagaacctgaattcaatgaaaaggaagatgacgaatggatccttgtggacttcattgatacatgtaccggctttagcgcagaggaggaagaggaagaggaggacatctctgaggaatcccccacagagcacccatccgtattctcctgcctgccagcttctctggagtgcttggccgacacaagcgatagttgtttcctgcaatttgagtcatgtcctatggaggagtcttggttcatcaccccacctccgtgctttaccgctggtgggctgacaacaatcaaagtggaaacaagcccgatggagaatctcctgatcgaacatccaagcatgtccgtctacgccgtgcacaattcttgccctgggctgtcagaagcgacacgcgggactgatgagttgcattccccctcctctccacgagttgaggctcagaatgagatgggacaacacatacattgttatgtcgcggccttagcggctcatacaacatttttagagcagcctaagtctttccgcccttcacagtggataaaggaacactcagaacggcagccccttaatagaaattccctccgccggcagaatctcacccgcgattgccacccgcggcaggtgaagcataatgggtgggtggtccaccagccttgtcctagacagtacaactattag

SEQ ID NO: 13645 - DNA, 558 bp, Artificial Sequence
  Description of Artificial Sequence: Synthetic coding sequence
atgttccaacgtctgaacaagatgttcgtcggcgaggtgagcagctccagcaatcaagaacctgaattcaatgagaaggaggacgacgaatggattctggtggatttcatcgatacctgcaccggctttagcgccgaggaagaggaagaggaggaagacattagcgaggagtctcctaccgagcatcccagcgtgtttagttgtctccccgccagtttagagtgcctggccgatacatcagactcatgtttcctccagtttgagtcttgccccatggaggaatcctggtttataacaccgccaccatgcttcaccgcagggggcctgacaactatcaaagtcgaaacctcccccatggagaatctgcttattgagcaccccagcatgagtgtctacgccgtacacaacagctgccccggactgtctgaggcgactcggggaaccgatgagctccattcaccgtccagccccagatattcacaagactgtcaccctaggcaagtgaagcacaatgggtgggtcgttcaccagccctgccctcgccaatacaactactag

SEQ ID NO: 13646 - DNA, 495 bp, Artificial Sequence
  Description of Artificial Sequence: Synthetic coding sequence
atgttccagcgcctgaacaaaatgtttgtcggagaggtctcgagctcaagcaaccaagaacctgagtttaacgagaaagaagatgatgagtggattctggtcgactttatcgacacatgtactggattctccgccgaagaggaggaagaggaggaagatatctccgaggaatccccaacagagcacccttctgtgttctcttgcctgccagcatctctagagtgtcttgcagatacatccgatagctgtttccttcagttcgaatcctgcccaatggaggagtcttggttcatcacgccacctccttgtttcaccgcggggggattgactacaataaaggtcgagacctctcctatggaaaacctacttatagaacatcctagcatgtccgtctacgccgtgcataatagctgcccagggctctccgaggctactagagggaccgacgaactgcactcccccagctcaccaagagctcgcaaatcgtgcctttag

SEQ ID NO: 13647 - DNA, 663 bp, Artificial Sequence
  Description of Artificial Sequence: Synthetic coding sequence
atgttccagaggctctccagcctgtttttttcaaccccctcccctccagaggatcccgattgcccgcgcgccttcgtgtctgaggaagacgaggtggacggctggctgattatagacctccccgacagttatgccgcccccccaagcccaggggccgctcccgcacctgccgggcggcctccaccggctccttctcttatggacgagtcatggtttgttaccccccccgcttgtttcacagctgagggccctgggctgggacctgccagactacagtccagcccattagaagatcttctcatagagcacccatctatgagcgtgtacgttacaggatcaacaattgtcctggagcccgggagcccatcgcctctgccagacgcggccctaccagacggcgacctgtctgagggagaactgacaccggctaggcgtgaacccagggcggcacggcacgccgctcctctgcctgccagggccgcgctgcttgaaaaagccggtcaggtgagacggttgcagagagcgcggcagcgcgctgaaaggcatgcattgagcgcaaaggcagtgcagcgtcagaatcgggcacgggaatctagacctcgcaggtctaaaaatcagtcgagctttatttaccagccctgccagcggcagtttaactactag

SEQ ID NO: 13648 - DNA, 663 bp, Artificial Sequence
  Description of Artificial Sequence: Synthetic coding sequence
atgttccagcggctgtctagcctgtttttcagcacaccgagccccccggaagaccccgattgtccccgcgcatttgtgagcgaagaggatgaggtggatggctggctgattattgaccttccagatagctatgccgccccaccttcacctggagccgctccagcacccgccgggaggccccctcccgccccatctctgatggacgagtcctggttcgttactccacctgcctgttttacagctgaggggcctgggttggggcctgctagactccagtcctctccattggaggatctgctaatcgagcatccctcaatgtccgtgtacgtcacagggagtactattgtattagagccaggatcacctagcccccttcccgatgccgcactgcccgacggagacttaagcgagggggagctgaccccagcccgccgcgagccacgggccgcccgtcatgcagctcctctgcccgctagggccgctttgcttgaaaaagctgggcaggttcgtcggctccagagggcacgtcaaagagccgaaaggcatgctctgtctgccaaggccgttcaacgacagaatagagcccgagagtcccggccccggcggtcaaagaaccagtcaagtttcatttaccagccctgccagcgccagttcaattattag

SEQ ID NO: 13649 - DNA, 234 bp, Artificial Sequence
  Description of Artificial Sequence: Synthetic coding sequence
atgttccagaggctgagtagcctctttttcagcacaccaagtcctcccgaggaccctgattgtcctcgcgcatttgtgtcggaggaggacgaggttgatgggtggctaatcatagatttgcccgacagctatgccgctcctccctcccccggagcggcacctgcgcctgccggtcgacctccaccagctcctagtctgatggacgaatcatggtttgttacccccccagcctag

SEQ ID NO: 13650 - DNA, 267 bp, Artificial Sequence
  Description of Artificial Sequence: Synthetic coding sequence
atgttccagaggctgagcagcctcttcttctccactccatctcctcccgaagaccccgattgtccgagagcctttgtgagtgaagaagacgaagtcgatggttggcttatcatcgatctccctgaaggtccggggttgggacctgcccggttacagagttcccctctggaagacctgttaattgagcatccaagtatgtccgtgtacgtgactggttcaactatcgtcttagaaccgggaagcccgtcccccttacctgacgcctag

SEQ ID NO: 13651 - DNA, 915 bp, Artificial Sequence
  Description of Artificial Sequence: Synthetic coding sequence
atggcaacctggaaatcaccatgttttttgtactgcctgtttatcctgggcccacggctgactggccagaataactccgtggatctgaccaatgaggagaccacagactctactacgtccaagattagcccatccgaggatacacaacaggaaaacggatctatgttcagcttgatcacctggaatatagacgggctcgatctcaataatctgtccgagagggcccggggtgtatgcagttacctcgcactttattctccggacgtaatcttcctccaggaagtgatccccccatattatagctatctgaaaaagcggagctctaattacgagataataacaggacatgaagaagggtacttcacagccattatgctaaaaaagtcccgtgtgaagctgaagtctcaggaaatcatcccgttccctagtacaaagatgatgcgcaatctgctgtgtgtgcacgtgaatgtgagcgggaacgagttatgccttatgacgtcacacctcgaaagtacccgcggccatgccgctgaaagaatgaaccagctgaaaatggtgctgaagaaaatgcaggaggcgcccgagagtgcaaccgtgatctttgctggggacacaaacctcagagaccgagaagtcacaagatgcgggggattgccaaacaacattgtggacgtgtgggagttcctggggaagccaaaacactgccagtacacgtgggacacacagatgaatagcaacctgggaatcacagccgcatgcaagctccggtttgatagaattttctttagagctgccgcagaagagggccatattatccctcggtcactcgacctcctagggctcgagaagctcgattgcgggagatttccttctgatcattggggtctgctgtgcaacctggacatcatactctag

SEQ ID NO: 13652 - DNA, 1089 bp, Artificial Sequence
  Description of Artificial Sequence: Synthetic coding sequence
atggaattgggatcatgcttggagggcggcagagaggctgctgaggaggaaggggaaccggaagtgaagaagcgacgtttgctgtgtgtcgagtttgcatccgtagctagctgcgatgccgccgtggctcagtgttttctggccgagaacgattgggaaatggaaagggccctcaatagctatttcgagcctcccgtagaggaaagtgccctggagcgtcggccagaaaccatatcagagcccaagacctatgttgatttgacgaacgaggaaacgaccgattccactacatccaaaattagcccgagcgaggacacccaacaagagaacgggtctatgtttagtctcataacttggaatatcgacggcctcgacttgaataatttatccgagcgggccaggggcgtatgctcttatctggctctctacagtcctgacgtgatcttcctgcaggaggtaattcccccttattactcatatctgaagaagcgctcttccaactacgaaattataactggacacgaggagggctacttcactgcaataatgctcaagaagtctcgggtgaaactgaaaagtcaggagatcattccctttccaagtaccaagatgatgagaaatctattatgcgtccatgtcaatgtgagcggaaacgaattgtgcttgatgactagtcatctggaaagcacacgcgggcacgcagccgaacggatgaatcagctgaagatggttttgaaaaagatgcaggaggcccccgagagcgctacagtcattttcgctggagataccaacctaagggacagggaggttactcgctgtggagggctccccaacaatattgttgatgtgtgggaatttctgggaaagccaaaacactgccaatacacctgggatacccagatgaattccaacttagggataacagctgcttgtaagttaagatttgacaggattttcttcagggcggcggccgaagaaggccacatcatcccccggagtctggacctgttgggactcgagaagctggactgtggaagatttcccagcgaccactggggactgctgtgtaacctggacatcattctgtag

SEQ ID NO: 13653 - DNA, 855 bp, Artificial Sequence
  Description of Artificial Sequence: Synthetic coding sequence
atggaactggggtcttgtctcgaaggagggagagaggccgccgaggaggaaggggagccagaagtgaagaagaggaggttactctgtgtcgagttcgcaagcgtggcctcatgtgacgccgccgtcgctcagtgctttctggcagaaaacgactgggaaatggaacgagctctaaatagttacttcgagccgtacagtccagatgtgatcttcttacaggaggtgatccctccatattattcgtaccttaagaaacggtcctctaattatgagattattaccggacatgaagaagggtacttcaccgccattatgcttaagaaaagtcgggtgaaactgaaaagtcaggagatcatcccgtttccatcgactaagatgatgcgaaatcttttgtgcgttcacgtaaatgtcagcggcaatgagctgtgtctaatgaccagtcaccttgaatcaactagaggtcatgcggcagagaggatgaaccaactgaagatggtattaaagaaaatgcaagaagcacccgaatcagccaccgtcatcttcgctggggatactaacctccgcgatagagaggtgacgcgctgtggcgggttgccgaacaatatcgttgatgtttgggagttcctgggcaaaccaaaacactgccagtatacttgggacactcagatgaacagcaatctgggcattacagcagcctgtaagttgcggtttgaccggatcttctttagggccgctgcagaagaaggccatattatcccacgtagcctagacctcctgggtctggaaaaacttgattgcggaaggttcccctccgaccactgggggctcttgtgcaacctcgacattattctctag

SEQ ID NO: 13654 - DNA, 1179 bp, Artificial Sequence
  Description of Artificial Sequence: Synthetic coding sequence
atgcgcgagcgccatgacactggggcctgcgccgaacccagggtgggcctcctgtttaggctgaaggggagatgcaggggtggacgcaagatggagcttggctcatgtctggaaggtgggagggaagccgccgaagaggaaggcgagcctgaggtgaaaaaaaggcgcctcctgtgcgtggagtttgcttctgtcgcttcctgtgacgctgccgtggctcaatgctttttagcggaaaatgattgggagatggagagggccctgaattcttacttcgagccgcccgtagaagagtccgcgttagaacgccgccccgaaacaatctccgagcccaagacctacgtggatctgactaacgaggaaacaacagatagtacgacttcaaaaatttccccatctgaagatactcagcaagagaatggctcaatgttttcgttgatcacgtggaacattgatggtctggacttgaataatttgtctgagcgtgctcgcggggtttgtagctatctcgccctctactcaccggatgtgatcttcctccaggaagtgataccaccctactactcttacctcaagaagaggtcatccaactatgagattatcaccggacatgaagagggctattttacggccatcatgctgaaaaagagccgagtgaaactcaagtcacaggaaatcatcccgtttccaagtacaaagatgatgcgaaacctgctctgcgtgcatgtgaacgttagcgggaatgagctttgcctcatgaccagccacctcgagagcactcgagggcacgctgcagaacgcatgaaccaattgaagatggtgctcaaaaaaatgcaggaggcacctgagagtgcaactgtcatttttgcgggcgatacaaatttgagggaccgcgaggtcacaagatgtggcgggctgccaaacaatattgtggacgtttgggagttcttgggtaagcccaagcattgccagtatacctgggatacccaaatgaatagcaacttaggcatcacggcagcgtgtaaactgcgcttcgaccgaatattcttcagagctgcagctgaagagggccacataatcccccggtctcttgatcttctgggcctggagaaattggattgcgggcgatttcccagtgaccactggggcctgttatgcaatcttgacatcattttgtag

SEQ ID NO: 13655 - DNA, 1428 bp, Artificial Sequence
  Description of Artificial Sequence: Synthetic coding sequence
atgagtgactttgatgagtttgagaggcagctgaacgaaaacaagcaagaacgcgataaggagaacagacatcgaaagaggagccatagtcgctccaggtctcgtgataggaaacgcagatctcgtagccgcgaccggaggaatcgggatcaaaggagcgcatctcgagatcgccgtcgaaggtctaagccactgacgcggggggctaaggaggaacacggcggattgattaggtcaccaagacacgagaagaaaaagaaggttcgtaaatattgggatgtaccaccaccagggttcgaacatataacccccatgcaatacaaggcaatgcaggccgccggccagattcctgccacagcgcttctgcccacgatgactcctgacggacttgcagtcacaccaaccccagtcccggtggttggatctcagatgacccgacaggcaaggcgtctgtacgtcggaaatatcccgtttggtataacagaagaagccatgatggactttttcaacgcacaaatgaggctcggagggctgacccaggccccgggcaaccccgtactggccgttcagataaaccaggacaaaaatttcgcctttctggagtttcggtcggtggacgaaaccacccaggcaatggcattcgatggcatcatatttcaaggacagtcattgaagatccgtcgtcctcacgactatcaaccgctgcctggaatgtcggagaatcccagcgtgtatgtgcccggagtggtgtcgaccgtggtgcccgactccgcgcataagctcttcattggcggcctcccaaactaccttaatgatgaccaggttaaggagctgctgacttccttcggacctctgaaggcctttaacctcgttaaggatagcgcgacaggtctgagcaagggttatgccttttgcgaatacgtggacattaacgtgacagatcaggccatcgcagggctaaacggcatgcagctgggggacaagaagctgcttgtgcagcgagcatctgtcggggccaagaatgcaactctggtttctcctcccagcacgatcaaccagacccccgtgacattgcaagtgccgggcttgatgagtagccaggtgcagatgggcggacatcctaccgaggttctttgcctcatgaatatggtcctgcctgaagagctactggatgacgaagaatatgaagaaattgtcgaggatgtgcgcgatgagtgcagcaagtacggactcgtcaaatccatcgaaatccctcgaccagtggacggtgtagaggttcctggatgcgggaaaatcttcgtcgaattcacatccgtttttgactgccagaaagctatgcaggggctgactggacgtaagttcgcaaaccgcgtggtcgtcacaaaatactgcgaccccgacagctaccaccggagagacttctggtag

SEQ ID NO: 13656 - DNA, 3090 bp, Artificial Sequence
  Description of Artificial Sequence: Synthetic coding sequence
atggccgacaaaacccctggtgggtcgcagaaggcatcatccaagacccgcagctcagacgttcactccagtgggagctcagacgcccatatggatgctagtggcccatctgattccgacatgccttcccggactaggccgaagagcccccgcaaacataactaccggaacgaaagcgcacgcgaatctctttgtgattcaccacaccagaatttgagccgacctcttctcgagaataagttgaaggccttttccatcggaaagatgagtaccgcgaaacgaaccctgtctaaaaaggagcaggaggagctgaaaaagaaggaagatgaaaaggccgccgcggaaatctacgaggaatttttggctgccttcgaaggctctgacggcaataaagtgaagaccttcgtacggggcggggtggtgaatgccgccaaagaagaacatgagacggacgagaagcgaggcaaaatttacaaaccctcctcacgattcgccgaccagaagaatcctcctaaccaaagttcaaacgaacgtccgcccagcctcttagttatagaaacgaagaagccccccctgaagaaaggggaaaaggagaaaaagaaatctaatctcgagctctttaaagaagaattgaaacagattcaagaggagagagatgagcgtcacaaaactaaaggacgactgagcaggttcgaaccccctcagagcgactctgacggacagagacgatccatggacgccccttcccggcgaaatcgctcttctggggtcctggacgattacgcacctggctcgcacgacgtgggcgatccctcgactactaatttgtatctgggaaacattaatccacagatgaacgaagagatgctgtgtcaggagttcggccgctttgggcctcttgcatctgtaaaaattatgtggccccgcactgatgaggaaagagcacgagagcggaattgtgggtttgttgctttcatgaataggcgagatgccgaacgtgcactgaaaaacctgaacgggaagatgatcatgtccttcgaaatgaaactggggtggggaaaggctgtgcccatcccacctcatccaatttacatacctccttctatgatggagcatacactgcctcctccccctagcgggctgccttttaacgcccaaccccgagagaggctgaaaaatccgaatgctccgatgttaccgccccccaagaacaaggaggacttcgagaaaaccctcagtcaggcaattgtgaaggtggtcatccccacggagcggaacctgctcgccctgatacacaggatgattgagtttgtggtgagggagggccctatgttcgaggctatgatcatgaatagagaaatcaacaaccccatgtttcggtttctttttgagaaccaaacacctgctcacgtctattacaggtggaagctttacagcattctgcagggggacagccccaccaaatggagaacggaggattttcgaatgtttaaaaatggcagcttctggcgcccgccgcctctcaacccatatctacatggcatgagcgaagaacaggagaccgaagccttcgtcgaggaaccatccaagaagggcgccctcaaggaagagcaacgggataagcttgaagagattctgcgagggctcaccccacggaaaaatgacatcggagatgccatggtgttttgtctgaacaacgcagaggccgccgaggaaattgtagattgcattaccgaatcgttgtcgattctgaaaacccccctcccaaagaagatagcacgcctgtaccttgtgagcgatgtgctgtacaattcatccgccaaggtcgccaatgccagttactacagaaaatttttcgagaccaaactttgccagatcttttcagatcttaacgctacctacaggacgattcagggtcaccttcaaagcgaaaatttcaagcagcgggtaatgacctgcttcagggcatgggaagactgggccatctaccctgagccttttctgataaaactgcaaaatatctttctgggtctggtgaatattatagaggaaaaggaaactgaggatgtccccgatgatctggatggcgcccccatcgaggaggagcttgatggcgccccactagaggatgtagatgggattccgatagacgcaactcccattgatgatctcgacggtgtacccattaagagcctcgacgatgatctggatggtgtgccactggacgcgacagaagattcaaaaaaaaatgaacccatctttaaggtagcaccctctaagtgggaagccgtggacgaatcagagctcgaagcccaagccgtcaccaccagcaagtgggagctgtttgaccagcacgaagagagcgaggaggaggaaaaccaaaatcaggaggaagagagcgaggatgaggaggacactcagtcttccaagagcgaggagcatcatctttatagtaatcccatcaaggaagaaatgaccgagtcaaagtttagcaagtattctgaaatgtcagaagagaagagggccaaacttagggagatagagttaaaggtaatgaagttccaggacgagttagaatccggaaagcggcccaagaagccgggtcaatcctttcaagagcaagttgaacattatagagataaactgctgcagagagagaaggaaaaagagctggagagagagcgcgagcgcgacaagaaagataaagaaaaactggagagtcgttccaaggacaagaaggaaaaagatgagtgcacccccacacggaaggagagaaagaggaggcacagtaccagcccgagcccatcccggagtagtagtgggaggagggtgaaaagtccaagccctaaatcagagcggtctgagcgatctgagaggagccacaaggagtcctctagatcgagatcttcccacaaggattcccccagggacgtgtctaagaaggccaaacgcagcccctccggaagcagaacgccgaaacgttcacgccgctcccgttcccggtccccaaagaagtctgggaagaagtctcggtcccaaagcaggagtcctcaccggagccacaaaaagtcaaagaagaataaacactag

SEQ ID NO: 13657 - DNA, 1863 bp, Artificial Sequence
  Description of Artificial Sequence: Synthetic coding sequence
atgttgttgtgctacaggcaccttaaaactaagcggattctgagacgaaatctcctcgcgctgatccatcgcatgatcgaatttgttgtgcgagaggggccaatgttcgaagccatgattatgaatcgcgaaattaataaccccatgttccggtttctgtttgaaaaccagactccagctcacgtctattatagatggaagttatattcgatccttcagggcgacagtccaaccaagtggcgcactgaagacttccgaatgtttaagaacgggtctttctggcggcctccaccattgaatccgtacttgcatgggatgagtgaggagcaggagactgaagccttcgtcgaggaacccagtaagaaaggcgcactaaaggaagagcagcgggacaaactggaagagattcttcgcggtctgactccccgcaagaacgacatcggcgatgcaatggttttctgtctcaacaatgccgaagccgccgaagaaattgttgattgtattacggaatcactcagtatcctgaagacacccttgccgaaaaaaatcgctaggttgtacctagtgagcgatgtgctgtacaattcctccgcaaaggtggcaaacgcatcttattatcgcaagttttttgaaaccaaactttgtcaaatcttttcagatttgaatgccacctacaggaccatacagggacatcttcagtcagaaaacttcaagcagcgcgtgatgacatgtttcagggcctgggaggattgggctatctaccctgagccttttctgataaaattgcagaatatcttccttggcctcgtgaacattattgaggaaaaagaaaccgaagacgtgccagatgatttggatggcgctcctatcgaggaagagcttgatggcgcccctctcgaggatgtggatggcatccccattgacgcaacccccatcgatgatctcgatggcgtaccgattaaaagcctggacgacgatctcgacggagtcccactcgacgccactgaggactctaagaagaacgaaccaatatttaaagtagcacctagcaaatgggaggccgtcgatgaaagtgaactggaagcccaggccgttactacatctaagtgggaactattcgaccagcatgaagagtccgaggaagaagaaaatcagaatcaggaggaagaaagcgaggatgaggaggacactcagtcaagcaagtctgaggaacatcacctgtattcaaatccaatcaaggaagaaatgaccgaatcaaagttttccaagtattccgagatgtccgaggagaagagggccaagctgagagaaatcgagctgaaggtcatgaagttccaggatgaattggagtccggcaagcgtcctaagaaacctggacagtcttttcaggagcaggtcgaacactaccgcgacaagttactccagcgggaaaaagaaaaagagttggagcgagaaagggaacgagataagaaagataaggagaaactggagtctcgaagtaaggataaaaaggaaaaagacgagtgtaccccaacccggaaagaacggaagcgacgtcacagcacctctccaagccccagccgttctagcagcggacggcgggttaagtccccctctcccaaatccgaacgcagcgagcggagcgagcgctctcacaaagagagctcaaggagtaggtctagccataaggacagtcccagagatgtgtccaagaaggcaaagcggagtccttctgggtctcgcactcccaagcgctcccggcgcagtaggtcccgtagcccgaagaagagtgggaagaaaagtcgctctcaaagcaggagccctcaccgatcccataagaagagcaagaagaataagcactag

SEQ ID NO: 13658 - DNA, 3090 bp, Artificial Sequence
  Description of Artificial Sequence: Synthetic coding sequence
atggcagacaaaacccctggcggatctcagaaggcatcgtctaaaactaggtcttcagatgtacattcctcaggctcctctgacgcccacatggacgcttccgggccctcggacagtgatatgccctcaaggacgcgaccgaagtcgcctaggaaacataattatcggaacgagagtgcacgcgaatctctgtgcgactctccccaccaaaacctgtcacggccgctcctcgaaaacaaactgaaagcattctctattggcaagatgtcgaccgctaagcgtactctgtccaagaaggagcaggaagagctgaagaagaaagaggacgaaaaagcagccgccgaaatctatgaggaatttttagctgccttcgaaggctccgacggaaacaaggtgaagactttcgtccggggaggcgtggtgaatgccgcaaaagaggagcacgaaaccgacgagaagagaggaaaaatctataagcccagtagcaggtttgccgaccaaaagaaccctcccaaccaaagtagtaacgagcgccccccatctctgttggtgatcgaaacaaaaaaaccccccctgaagaaaggagagaaagaaaaaaagaagtcgaacctcgagctgtttaaggaagagcttaagcagattcaagaggagcgtgatgagcgtcacaaaaccaagggccgcctcagccgattcgagccacctcaatcagactcagatggccagaggaggtccatggatgctccttccagacggaataggagttcaggcgttcttgatgactatgctccaggaagccatgacgtcggcgatccatcaactacgaatttgtacttgggcaatatcaacccccagatgaacgaggagatgctgtgccaggagtttggacggttcggcccactcgcctctgtgaaaattatgtggcccaggaccgacgaggaaagggcaagggaaagaaattgcggcttcgtagcgttcatgaacaggcgcgacgcggaaagagccctgaagaatctgaacggtaagatgattatgagttttgaaatgaagctgggttgggggaaggcagttcccatcccgccacaccctatttatataccacccagtatgatggagcacacccttcctccaccaccctccggtctcccttttaatgcccaacctagggagaggctgaagaaccccaatgctcctatgttgcctccccccaaaaataaggaagacttcgaaaagacactgtctcaggcaattgttaaagtggtcatacctactgaacggaacttgctggcactgatccacaggatgatcgaattcgtggtccgtgagggtcccatgtttgaagcaatgataatgaatcgggagattaacaatcccatgttcaggtttctctttgaaaatcagacacccgcccatgtgtactatcgctggaagctatactctattctgcagggcgactcccccaccaagtggagaaccgaggactttaggatgtttaaaaacggtagcttctggagacccccgcctcttaacccttacctgcatggcatgtccgaggagcaggaaacggaggcattcgtagaggaaccttccaaaaagggtgcactgaaagaagagcaacgtgataaactagaggagattctgcggggtctaacacctcggaagaacgatatcggcgacgcaatggtgttctgcctgaataacgcggaagccgctgaagagatcgttgactgtatcacagaatctctctctattctgaagactcctctgccaaagaagatcgccaggctgtacctcgtgtcagatgtgctctacaactcatcagctaaagtggcaaacgcctcatactaccgaaaattttttgaaaccaagttgtgtcagatctttagcgacctgaacgccacctacagaactatacagggccacttgcagtcagagaatttcaagcagagggtcatgacttgcttccgagcatgggaagactgggccatctatcctgagccgttcctgatcaagctgcagaacatattcttggggctcgtgaatatcatcgaggagaaggagacagaggacgtgcccgacgatctagatggagccccaatcgaggaagagctggacggagccccactagaggatgtggatggaatacctattgacgccacccccattgatgacctggacggagtgccaattaaaagccttgatgatgaccttgacggagtgcccctggacgctactgaagactctaagaaaaacgaacctatatttaaagtggctccttccaaatgggaggcagtggatgagtccgaacttgaggctcaggccgttactaccagcaaatgggaacttttcgaccagcatgaggaatctgaagaagaggagaatcagaaccaggaagaggagtccgaagatgaagaggatacccaatctagcaagtcagaggagcaccacctatactccaaccctattaaggaggagatgactgaatcaaagttctcaaagtatagcgaaatgtctgaagaaaagcgggctaaacttagagaaatcgaacttaaagtgatgaagtttcaagatgagctggagtcaggcaaacgtcctaagaaacctggccagtccttccaagaacaggtggagcactacagggataaattgctacagcgggagaaggagaaggagctcgagcgggagagagaaagagacaagaaggacaaggagaaactggagtccagatccaaggataaaaaggagaaagatgaatgtactcccactcgcaaggagagaaaaagaagacacagtacgtcaccatcaccttctcgatcttcaagcggcagacgggtgaaatctccgtcccccaagagtgagcggtctgaaagatctgaacggagtcacaaagagagctctcgcagccgctcctcccataaagatagcccacgtgatgtatcaaaaaaagcaaaacggtctccgtcgggctctcgaacaccaaagcgctccaggagatctaggtctaggtctcccaaaaaaagcggcaagaaatcccggtcccagtctaggtccccccaccgcagccataaaaaatccaagaaaaacaagcattag

SEQ ID NO: 13659 - DNA, 3087 bp, Artificial Sequence
  Description of Artificial Sequence: Synthetic coding sequence
atggccgacaagactcccgggggttcacaaaaagcctcctccaaaacgaggtcaagtgatgtgcactctagtggcagctcagacgcacacatggacgcttccggaccctctgactcagacatgccaagccggacccgtcccaagtcgccgcgaaagcacaattatcggaatgaatctgcacgcgaatccctatgcgactccccacatcagaacctgagccggcctctgctggagaacaaactcaaagctttctccatcgggaagatgtcaaccgctaagaggacactgtcaaagaaggagcaggaagagctaaagaagaaggaggatgagaaggctgctgctgagatctatgaagagtttcttgcagcctttgagggctccgacggcaacaaggtcaagactttcgtcagggggggagtcgtgaatgcagcaaaggaggagcatgagacagacgagaagagagggaaaatttacaagccaagtagcagatttgctgatcagaaaaatccacctaatcaatcctctaacgaacggcctccttcactcttggtgatagagaccaaaaagccacctctgaagaaaggagaaaaagaaaagaaaaagtcaaatctggagttgttcaaggaggagcttaagcagattcaggaagagagagatgaacgacataaaacaaaaggaagactgagtcggttcgagcccccccagtccgattcagacggccagaggagaagtatggacgcccccagccgccggaaccgaagcagtgtgcttgatgactacgcccccggatcacacgacgtcggtgacccatcgacaaccaatctgtaccttggtaacatcaatcctcagatgaatgaagaaatgctttgccaggaatttggccgattcggaccactcgcgtctgttaaaattatgtggcctcgcaccgacgaggagcgcgctagagagagaaactgcgggtttgtcgccttcatgaataggcgggacgccgaacgggccctgaagaatctgaacggaaaaatgatcatgtcgttcgagatgaagttgggctggggcaaagctgttcccattccaccccaccccatttacattccacccagcatgatggagcacacccttcccccaccacccagtgggctccccttcaacgcccagcctagggagcgtctcaagaacccaaacgcgcctatgctgccaccccccaagaacaaggaagattttgagaagacactgtcacaggccatcgtcaaggtggtgattcctactgagagaaacctcctcgcactgatccacaggatgattgaattcgtggttcgcgaaggaccaatgttcgaggcaatgatcatgaatcgggagatcaacaaccccatgtttaggttccttttcgagaatcaaacacccgcacacgtctattaccgctggaagttgtacagcatactccaggcaaacagccccactaaatggcgcaccgaggacttcaggatgttcaaaaatggcagcttttggcgaccccctcccctgaacccgtatttgcatggcatgtctgaggaacaggagactgaggctttcgtggaggagccgagcaagaaaggagccttgaaggaggagcagcgagacaagctcgaagagattctcaggggcctgacccctaggaagaatgacattggtgatgccatggtcttctgcctcaataacgccgaggcggctgaagagatagttgactgtataacagagagtttgagcattttgaaaacaccgctgcctaagaaaatagctagactgtaccttgtatcagatgtattatataatagcagcgctaaagtggctaacgcctcctattaccggaaattctttgagaccaagctgtgtcaaatctttagtgacctgaatgcgacatatcgtacaattcagggacatctgcagtctgaaaactttaaacagagagttatgacttgttttagagcctgggaagattgggctatatatccagaacctttcctgataaagctccaaaatatcttcttgggcctcgtgaacatcatagaagaaaaagaaacagaagatgtgcccgatgacctagacggtgctcctattgaagaggagctggacggagccccgctggaagacgtcgacggcattcctatcgacgcaacccccatcgacgatctcgatggagtgccaattaaaagtctggatgatgacttggacggcgtccctctcgacgcaacagaggactccaaaaagaatgaacccatctttaaggtggcgcccagtaagtgggaagccgtcgacgaatctgagctggaggcacaggccgtgacaaccagtaaatgggaactgtttgatcagcacgaagagtcggaggaggaggagaatcagaatcaggaggaggaatccgaagatgaagaggatacccaaagctctaagagtgaggaacatcatctgtactctaaccctatcaaggaggagatgactgaaagtaaattctcgaagtacagtgaaatgagcgaagaaaagagagccaaactcagagaaatagagctcaaagttatgaaatttcaggacgagctggagtcagggaagaggcctaagaagcccggacagagttttcaagaacaggttgagcactaccgggataagctgctccaacgcgagaaggagaaagaattggaacgagaacgggaacgcgacaaaaaggacaaggagaagcttgagtcgcggagtaaggacaagaaggagaaggacgagtgtacaccaacccgcaaagaaagaaaacggcgccacagcacttctccctcaccgtcccgcagtagttctggccgacgggtcaagagcccttcaccaaaatctgagcggtcggagcgctctgaacgatctcacaaagagtcatcacgtagtagaagtagccataaggatagccctcgggatgtctcaaagaaggctaaacggtctccatccggcagtcggacacctaagcgcagtagacgaagtaggtcccggtctccgaaaaaatcagggaaaaaatcaaggtcccaatcacgatctccccacaggagccacaaaaagtccaagaaaaacaagcactag

SEQ ID NO: 13660 - DNA, 486 bp, Artificial Sequence
  Description of Artificial Sequence: Synthetic coding sequence
atggccgacaaaacacccggcggcagccagaaggcttcgagcaaaacccgatcttccgatgtccattcttccggcagctccgacgcccacatggacgcatccggcccctcagactccgacatgccaagtaggacacgccccaagtctccccggaagcacaactaccgcaatgagtctgcccgggagtctctgtgtgattctcctcaccagaatttgtctagaccactgctggaaaataagctgaaggccttctctatcggaaagatgtcaacagctaaacgaacactgtcgaaaaaggaacaagaggagctgaagaagaaggaagacgaaaaggctgccgcggagatttacgaagaattcctggctgcttttgaggggtccgatggaaataaagttaaaaccttcgtgagggggggtgtcgtcaacgctgctaaagaggagcatgagacggatgagaaaaggggcaaaatttataaacctagctag

SEQ ID NO: 13661 - DNA, 3237 bp, Artificial Sequence
  Description of Artificial Sequence: Synthetic coding sequence
atgatgacttctgtgggcacgaaccgggctcgcgggaactgggagcagccgcaaaaccagaatcagacccagcacaagcaacgtccacaggccactgccgaacagatccggctcgcccaaatgattagcgaccataatgacgcagactttgaggaaaaggtgaaacaattgattgacatcacaggcaaaaatcaggatgaatgcgtgatagcgcttcatgattgcaatggcgacgtcaaccgggcaattaacgtgttactcgaggggaacccagacacacacagttgggagatggtgggaaagaagaaaggtgtgtctggccagaaggatggcggccaaactgaatcgaacgaggagggtaaagagaaccgcgatagagacagggattatagtcgacggcggggaggccctccccgaagaggaagaggggcatccagggggagggagtgcatgcacggggctttgtccaagccagcagtcgtgcggggacaggaaaacggacttgatggtaccaaatcaggcggaccatccgggagagggactgagaggggccggcggggacggggaagaggaagggggggcagcggccgtcggggaggacgattttccgcacagggcatgggtacctttaatcctgctgattatgccgaacctgcaaacacagatgataattacggcaactcctctggtaatacctggaacaacaccgggcatttcgagcctgacgatgggacatcagcctggaggacagccacagaggagtggggtaccgaggattggaacgaagacttgagcgagacaaaaatcttcaccgcatcgaacgtctcatctgttcccctgcccgctgaaaacgtcaccattaccgccgggcagagaatagacctggccgtgctgttaggaaagacccccagcacaatggaaaacgatagctctaatttggatcccagccaggctccgagcctggctcagccgctcgtatttagcaacagcaaacaaactgctatctctcaacctgcttccggtaacacattttcacaccacagtatggtatcgatgctggggaaagggttcggcgatgttggggaagcgaaaggcggttcaacaactggttcacagtttttggaacaattcaaaaccgcacaggctctggcccaactggctgcccagcacagtcaatcgggaagtacgaccacgtcatcatgggacatgggctccactactcagtcaccatcgctggtccagtatgatcttaaaaatccaagtgattctgccgtccactccccattcacgaagagacaagcttttacgcctagctccacgatgatggaggtatttctgcaggaaaagtctcccgccgtggctacttcgacagcggcgccacccccaccatcatctcctttacccagcaaatcaacatccgcacctcagatgtctccagggtccagtgacaaccagagtagcagcccccagcccgcccagcagaaattgaaacagcaaaaaaagaaggctagcttaacaagcaaaattccggctctcgccgtggaaatgccaggcagtgcagacatcagcggcctcaacttgcagtttggggccctccagtttggatccgagccagtgctcagcgattacgagagtactccaacaacttctgctagcagttcccaggccccatcctctctgtatacctctaccgctagtgaatcatcctcaacaatttcttcaaaccagtcccaggagtcaggctaccagtctggtcctatccagtccaccacctatacctcacagaataatgcccagggacctttatacgagcagaggtccacccaaaccagacggtatccatcttctatttcgtccagtccacagaaggacctgactcaggccaaaaacgggttctcaagcgtccaagccacacaacttcagacgacgcagagcgtagagggggcaacagggtctgccgttaaatctgatagtccttccactagttctattccgccacttaacgaaaccgtgtctgccgcttcattattgactacaactaatcagcacagctctagccttggaggcctatcccattccgaggagattcctaacaccaccaccacacagcactcctccaccctgagcactcagcaaaacacgttaagctctagtacatcctcagggcgtacatcgacttcgaccctcttacataccagcgtcgagagcgaggccaatcttcacagttcttctagcacctttagtacaaccagcagcaccgtcagcgcaccgccgccagttgtttcagtgagttcttccctgaactcgggaagcagcctgggactgtcactcggctccaattccacagtgacagcatccacaagatctagcgtggccactacaagtggcaaggccccaccaaacctccctcctggcgttcctcctcttctgcccaacccatacatcatggctccagggctgctccatgcatatccccctcaagtgtacgggtacgatgacttacagatgctgcagactcggttccctctcgactactattccatcccatttccgacccctacaacgcctctgacaggacgggacggtagcctggcatccaatccctattccggggatttaacgaagtttggtagaggagatgcaagttcccctgcacctgccaccacattggcgcaaccacagcagaatcaaacccagactcatcacactacgcagcagacattcctgaaccctgctctgccccctgggtatagctatacgtccttaccctactacactggggtacctgggctgccttccaccttccagtacggcccggcggtctttcccgtggcaccaaccagtagcaagcagcatggcgtaaacgtcagcgtgaacgcctcggcaactccattccagcagccatctggatacgggtctcatggatacaataccggagtcagcgtcacttcaagtaacaccggagtgcccgatatcagcgggagcgtgtatagcaagacgcagtcttttgagaaacagggtttccatagcggcacccccgcagcctcatttaaccttccgagcgcactgggttcaggaggtcccatcaaccctgccacagcagcagcctatccacccgcaccattcatgcatattctgaccccgcatcagcaaccccactcccaaattctccaccatcatctccagcaggatgggcaggacatattgaacttcgtagatgatcagctgggagagtag

SEQ ID NO: 13662 - DNA, 2952 bp, Artificial Sequence
  Description of Artificial Sequence: Synthetic coding sequence
atgatgacgtccgtgggcacaaatagggccaggggtaattgggagcagccccagaatcagaaccagacgcagcacaaacagcgaccccaggccaccgctgaacagataaggctcgcacagatgatcagcgatcataacgacgctgactttgaagaaaaggttaagcagctgatcgacattacaggtaaaaaccaagacgaatgcgtgatcgctcttcatgactgcaacggagatgtgaaccgcgcaataaatgttcttctggaagggaaccccgacacccactcttgggaaatggtgggaaaaaaaaaaggggtgtctggccagaaggatggcgggcaaaccgagagcaacgaagaagggaaggagaaccgggatagagatagagactacagcaggagacgcggtggaccccccagaagagggaggggagcctcacgtggtcgtgaatttcgcgggcaagagaacggactggacgggacaaagtctggaggcccttccggcagggggacagagcgcggccgccgcggcagggggcggggcaggggcggtagcggcagaaggggagggagattcagtgctcaggggatgggaacttttaatccggctgattacgctgaacctgcaaacactgacgacaattatggaaactcgagtgggaacacctggaacaacacagggcacttcgagccggacgacggtactagcgcatggcgcaccgctactgaagagtgggggacagaggattggaacgaggatctgtccgagactaagatcttcacagcgtcaaatgtgagtagtgtgcctctgcctgccgagaatgtgactatcaccgcaggccagaggattgacctggcagttcttcttggaaagaccccctctacaatggaaaacgacagctcaaacctggatccttcccaggctccatctctggctcagcccttggtgttcagtaacagtaagcagacggccatttctcaacctgcatctggaaatacttttagtcaccattcgatggtgtccatgctgggtaaaggtttcggggacgtcggagaggccaagggagggtcaacaaccgggagccaatttctcgagcagtttaagactgcgcaagccttagcacaacttgctgcccagcatagccagagtgggtctactacgacttccagttgggacatgggaagcactacccagtcaccttcgttagtgcaatatgacctgaaaaacccctctgattctgcagtacactcacccttcacaaaacgccaggcctttacaccttccagcactatgatggaggtatttctacaggagaagtcccccgccgtggccacttcaacagcagctcccccgcccccatccagcccccttccgagtaagagtaccagcgcaccccagatgtctcctgggtcatctgacaatcagtcatctagcccccagcccgctcagcagaagctgaagcagcaaaagaagaaggcaagccttacctctaaaatcccagcattagctgtcgaaatgcctggcagcgccgacatttctgggctgaacctgcagttcggggctctgcagtttggaagtgaacctgttttgagtgactatgagagtacccccaccacctcagcgtcgtcttcccaggccccctcctccttgtacacttccacagcttcggagagttccagtacaatatccagcaatcagtcccaggagtccggataccaatcaggcccaatacaatctacgacctatacgagccaaaacaacgcccagggacccctgtatgagcagaggagcacgcagaccagaaggtacccatccagcattagcagctcacctcagaaggatcttactcaggcaaagaatggtttttcgtccgttcaggcaacccagctacagaccacccagtccgtggagggtgccaccgggagcgcagtgaagagcgattcacccagcaccagcagtatccctccacttaacgaaaccgtgtcagcggccagtctgctcactaccactaatcagcacagctcctctttaggcggccttagtcattccgaggagattcccaatactaccaccacccagcacagtagcactctttccactcagcagaacacactttcatcttccacctctagcgggcgcacatccacctcaacactgctacacacttctgttgaatccgaggcaaacctccactccagctctagtacattctctactacctcctctactgtgtcagcgccaccgcctgtggtttctgtttccagttctctgaatagtggcagttctcttggcctgtcgctgggtagtaactctacagtaactgcaagcacgagatctagcgtggcaacaacttccggtaaagctccgccaaatttgcccccaggcgttcctccgctcttgcccaacccatacatcatggcacctggcttgctccatgcatacccaccccaggtttacggctacgacgacctgcaaatgctccaaacccgttttccgctagactattatagcattcccttccccacacccaccacccccctgaccggcagggatggcagccttgcttcaaacccctatagtggcgatttaacgaaatttggccgtggcgacgcatcctccccagcacctgctacgacacttgcccaaccccaacaaaaccaaacccaaacacaccacaccactcagcaaacattcctaaacccagctctcccccccggatattcatatacatccttgccatattacaccggtgtcccgggactaccatcaaccttccaatatggccctgccgtgtttcccgtcgcacccactagcagtaaacagcacggagtgaacgtaagcgtgaatgccagcgctactccattccagcagcctagcgggtatggctctcacgggtataacaccgggagaaagtatcctccaccttacaagcatttttggacagccgagagctag

SEQ ID NO: 13663 - DNA, 3264 bp, Artificial Sequence
  Description of Artificial Sequence: Synthetic coding sequence
atgatgacaagcgtgggcaccaacagggctcgcgggaactgggagcagccacagaaccaaaatcaaacccagcacaagcagcgcccccaggccactgccgaacaaatccgcctagcacaaatgatatccgaccacaatgacgccgatttcgaagagaaggttaaacagctgatcgatatcaccggtaaaaaccaggatgagtgcgtaatagcacttcatgactgcaacggtgacgtgaatagagccatcaatgtcctgctggagggaaatcctgatacccattcctgggaaatggtcggcaagaaaaaaggggttagtggtcaaaaagacggcggtcaaacagagtctaacgaagagggaaaggagaatagagatcgcgaccgcgactattcaagaaggcgtgggggacctcccaggcgaggtcgaggggccagtcgcggtagagaattcagaggacaggaaaacggcctggatggaaccaagtctggggggccttcaggccgcgggactgaacggggccggcgaggtcgcggccgaggtaggggggggtcaggcagaaggggaggtcgcttttccgcccaaggtatgggcacttttaatcccgccgactatgcagagccagccaataccgacgacaactatgggaacagctccggaaacacttggaacaacactgggcacttcgaacctgatgacggcacaagtgcctggcgtacagccacagaagaatggggcacagaagattggaacgaagatctgtccgagacaaagatatttacagcgagtaatgtatctagtgtgcccctgcccgccgagaacgtgaccattacagcgggccaacgcatcgaccttgccgtgcttttaggtaaaacaccctccacgatggaaaatgattcctcaaatctcgatccttcacaggctcctagtcttgctcagcccttagttttcagcaactccaaacagacagccatatcccagcctgcttccggcaacactttttcccaccactcaatggtgagcatgctgggcaaggggtttggagacgtgggtgaagcaaaaggcggtagtaccacaggcagccagtttctcgaacaatttaaaacggcacaggccctcgcccagcttgccgctcaacatagccaatcaggatccactacaacctcttcctgggacatgggaagtaccacacagtcacctagccttgtgcagtacgacctgaaaaatccttctgacagcgcagttcacagcccatttacaaagagacaggcattcacaccctcctcgaccatgatggaagtgttcctccaagagaaatctcccgcggttgccacaagcacagccgcacctccacctccgagcagccccctcccaagtaagagtacttccgctcctcagatgtctcctggctcctcagacaaccagagttcgtctccacagcccgcccagcagaagctgaagcagcagaagaaaaaagcctctctgacttccaagattcccgccctcgctgtggagatgcctggaagtgcggatatctctggcttaaacctgcagttcggggctctgcagtttgggagcgaacctgtgctcagcgactatgagtcaacccccactacttcagctagctcctctcaggcacccagctcgctatacacatcgaccgcatccgaatctagcagcacgatttcatccaaccagtcacaagaaagcgggtaccagtctggtcctatccagtctactacttacaccagccagaacaatgcacagggtccattatacgagcagaggagcacacagacaagaagatacccctcgtctatatctagcagtcctcagaaggacctgacccaggcaaaaaacgggttttcttcagttcaggctactcagcttcagactacccaaagcgtagaaggtgcaaccgggtcggctgtaaagagtgactctcctagtacatcttcgataccacctcttaatgagacagtttcagctgcttctctacttacgacaacaaaccagcacagctcgtccctcggcggcttaagtcattcggaagaaatccctaacaccaccactacccaacactcttccactctctcaacccaacagaataccctgtcaagctccactagtagtggcagaacaagcacttctactctgctgcacacctcagtagagtcagaagctaacctacattcttccagttcaactttcagcacaacgtcctccaccgtgtctgccccacctcccgtcgtgagcgtttcatcatccctgaatagcgggtcttccctgggcctcagccttggcagcaattcaaccgtcactgcttcaacgagatcaagcgtggccactacatctggtaaggcacctccaaatctccctccaggggtaccgcctctcctccccaatccatacatcatggcaccagggctgctacacgcatatcctccgcaggtctatgggtacgatgacctccagatgctccagacgcggtttccgctggactactattccatcccgtttcccactcctaccacacccctgactggtcgggacgggagtctggcctccaacccatacagtggggatctgaccaagttcggaagaggggacgcatccagcccagcccccgctactacactggcccagcctcagcagaaccaaacacagacccatcacaccacccagcagacctttctcaatccagctctcccacctgggtatagttacacctccttgccctactacacaggggtcccaggcctgcccagcacgttccagtatgggccagcggtcttccctgtcgcaccaacttcgtcgaagcaacacggcgtcaacgtctcagtcaatgcctctgcgacaccttttcagcagccgagcgggtacggaagccatggttacaataccggcgtttccgtgacgagcagtaacacaggggtacctgatatctcaggcagcgtgtactcgaagacccaacagagcttcgaaaagcagggcttccattccggtacacctgcagcaagctttaacctccctagcgccttaggaagtgggggcccaatcaacccagccactgcagccgcataccctcccgctcctttcatgcatatcctcactccccatcaacaacctcactcacagatattgcaccaccatctccagcaagatggtcagaccggtagtggccagaggtcccagacgagcagcataccacagaagccacaaacaaataagagcgcctacaattcgtacagctggggagctaattag

SEQ ID NO: 13664 - DNA, 1053 bp, Artificial Sequence
  Description of Artificial Sequence: Synthetic coding sequence
atgatgacatcagtcgggaccaatagagctcgagggaattgggaacagccacagaatcagaatcagacacagcataagcagagaccacaggccacggctgaacagattaggctggctcagatgattagtgatcacaatgatgcagactttgaagagaaggtcaaacagctcatcgacatcaccggcaagaatcaagatgaatgtgtgatcgccctccacgattgcaatggcgacgtcaacagggcgattaacgtccttctagaagggaatccggatacgcatagttgggaaatggtcggtaagaaaaaaggagtcagcgggcagaaggatggtggacaaactgaatccaacgaggagggtaaggagaacagagacagggatcgcgattactcccgtagacgcggaggccctcctcggcgcgggcgcggcgcctccaggggtagagaatgcatgcatggcgcattgtccaagccggctgtcgtgagagggcaagaaaatgggctggatggaactaaatcggggggaccttcaggacgaggtaccgagagagggcgccgaggtagggggagagggcgaggggggagcggaaggcgtggtggaaggttctcggctcagggaatgggcacctttaacccggcagactacgcggagcccgccaacaccgatgacaattatgggaattccagcgggaacacctggaataataccggtcatttcgaacccgatgacggcactagcgcatggcggacagcaaccgaagaatgggggactgaagattggaatgaagatctatccgaaaccaagatcttcaccgctagcaacgtgtctagtgtaccgctccctgccgagaatgtcaccatcacagcaggccagcgaattgatctggcagtgcttctaggaaaaactcccagcaccatggaaaacgattccagcaacctggacccctctcaagccccatccttggctcagccccttgtgttctctaacagcaaacaaacagcgatttcacagcccgcaagcgggaataccttcagtcaccacagcatggtttag

SEQ ID NO: 13665 - DNA, 843 bp, Artificial Sequence
  Description of Artificial Sequence: Synthetic coding sequence
atgatgaccagcgtgggcactaatcgagccaggggaaattgggagcagccgcagaatcaaaaccaaacacaacacaagcagcgacctcaggctacagctgagcagattcggctggcgcagatgattagtgatcacaacgacgccgatttcgaggagaaagtaaaacagctcatagacataaccgggaagaaccaagacgagtgcgtcatcgcactgcacgattgcaatggggatgtgaatcgcgcaattaatgttctcctggagggcaatcccgatactcatagctgggagatggttggtaaaaagaagggcgtttccgggcagaaggatggggggcagactgaaagcaacgaagaagggaaagagaacagggacagggatcgtgattactcaagacgtcgaggtggacccccccgccggggccgtggcgcgtctagaggcagggaattccgtggccaggagaatggattagatggaacgaagtccggggggccgagtggacgggggacagagcggggccggcggggaagaggccggggtcgagggggaagcggccgaaggggaggccggttcagtgcacagggaatggggacctttaatcctgctgattatgcggagcccgctaatacagacgataactacgggaacagctcgggaaacacctggaacaacacaggccactttgagcccgacgacggtacatctgcctggcggactgccacagaagaatggggaactgaggattggaacgaagacctatcagagacgaagatcttcaccgcttcaaacgtgagctcagttcccctgcctgccgagaatgtcacaatcacagccggccagtag

SEQ ID NO: 13666 - DNA, 1152 bp, Artificial Sequence
  Description of Artificial Sequence: Synthetic coding sequence
taagttgagtctgaggccaatctgcactcatctagtagtactttttctacaacctctagcacagtctctgcccccccacctgttgttagcgtttcaagcagcctgaactctggtagcagtctgggattaagtctgggatctaatagtacggtgaccgcatctacacgttctagtgtggcaactacttccgggaaggcccccccaaacctacctccgggcgtgcctccactgctaccaaatccctacataatggcaccgggtctgctccatgcctatccacctcaggtatatggttatgacgacctccaaatgctgcaaacgcgttttcccctggactattactcaatcccattccccacacctaccactcctttaactggtagagacggatcgctcgcctctaacccctacagcggtgatcttaccaagtttggaagaggagacgcaagcagccccgccccggccactaccttggctcaaccccagcagaatcaaacccagactcatcacaccacccagcagacattcctcaacccagccttacctccagggtacagctacactagtttgccatactatacaggggtccctgggctaccaagtacgtttcagtatggcccggccgtgttcccagtagctcctacatcctcaaaacagcacggcgttaacgtgagtgtcaacgcaagcgcgactcccttccaacagccctctgggtacggctcgcatggatacaacacaggtgtgagtgtcaccagttctaataccggtgtcccagacatttcagggagcgtatattctaagacccagcaatctttcgagaagcaaggcttccatagtgggacaccggcggcgagtttcaacctgccaagcgccctgggaagcggcgggcccattaaccccgctaccgcagctgcgtacccacccgcaccttttatgcatatcctgaccccacaccagcaacctcactctcagatccttcatcaccatctgcagcaggatggacagctcccttacctgcagatgattctgtgttgtcagcgacagcaggaggagcagaccggttccggccagaggagccaaaccagttccattcctcagaagccgcagacaaataagtctgcctataattcctacagctggggcgcaaactag

SEQ ID NO: 13667 - DNA, 3264 bp, Artificial Sequence
  Description of Artificial Sequence: Synthetic coding sequence
atgatgaccagcgtgggaactaacagggcaagaggcaactgggaacagccacagaatcagaaccaaacacagcacaagcagagacctcaggccactgcggaacagattcgcctggcacagatgatctcagatcataatgatgctgatttcgaggagaaggtgaaacagctcatagacattactggaaagaaccaggacgagtgtgtgatcgccctgcatgattgcaatggcgatgtgaatagagccattaatgttttgctcgagggaaaccccgacacacacagctgggaaatggtaggcaagaagaagggcgtcagcgggcagaaggacggggggcagacggagagcaatgaagagggaaaagagaacagggaccgggaccgggactactccaggagaaggggagggcctccacggcggggccgtggagcctctcgtggtcgcgagttccgagggcaggaaaacggtctcgacggcaccaaatcgggtggcccctctgggagaggtaccgagcgcggtcggaggggcaggggtagagggcgcggcgggtcgggacggagaggaggtaggttctctgcccagggaatggggacctttaatcccgctgactatgctgagcccgcgaacaccgatgacaactacggaaactcctccgggaacacttggaacaatactggacatttcgagcctgatgatgggacgtccgcctggaggactgccactgaggaatggggcaccgaagattggaacgaagatctttctgagacgaaaatctttaccgcatcaaatgttagctctgtgcccctgcctgctgagaacgtaaccatcaccgctggacaaaggattgatctcgcagtgctcttgggtaagacaccctcaacaatggagaacgactccagcaatctggatccatcccaggccccaagcctggcacagcccctggtgttctccaactccaaacaaacagccatttcccagccagccagtggcaatacgttctcgcaccattcaatggtgtccatgctgggtaaggggtttggcgacgtgggcgaggccaaaggcggttctacgaccggttcacaattcctagaacagttcaaaacggcgcaggcgctcgcccagcttgccgctcagcacagtcagtcaggatcaactacaacttcatcctgggatatgggtagcactactcagagccccagtctggtgcagtatgatctcaagaatccctctgattctgccgttcactcccccttcacgaaaagacaagccttcacaccatcatccacaatgatggaagtgtttctccaggagaagtcgcccgctgttgctaccagcacagcagccccccctcctccctcaagcccactgccttccaagtctacctccgccccacagatgagtcctggctcttctgacaaccaatcctcaagtccacaaccagcccagcaaaaattaaaacagcaaaagaaaaaggcatccctcaccagtaagattcctgctctagctgtggaaatgcccggatccgcagacatatccggcctgaatttgcagtttggtgcactgcagttcggcagcgagcctgttctcagcgactatgagtctacaccaactaccagtgccagcagttctcaagccccttcctccctgtacacttccactgcatccgagtccagcagtaccatttccagtaatcagagccaggaatcaggttatcagtctggacctatccaatctacaacatacacaagtcaaaacaacgctcagggaccactgtacgaacagcggtctactcaaacacgaagatacccgagcagcatctcgagtagtccacagaaagacctgactcaagccaaaaatgggttttcatccgtgcaggccactcagctgcagaccacgcagagcgttgaaggtgcaaccggttcagccgtgaagtcagactcccccagcaccagctccatccccccgctgaacgaaacagtgtcagcagccagtctacttacgacaacaaaccagcactctagctccctcggcgggctctcacatagcgaggagattcccaataccacaacgactcagcactcatccacccttagtacacagcagaatactcttagtagctccacttcctccggacgcacctctacttcaacactacttcacacatctgttgagagcgaggctaatctccactctagttcctccacattcagcacaacttcttccactgtatctgccccgccacccgtggtttcagttagttccagcctgaactctggtagctccctggggctgagcctgggcagcaactccacggtgaccgcttcaacacgtagctccgttgctaccacttccggaaaggcccctcccaaccttccccctggggtcccacccctgctcccgaacccttatattatggcgcccggactgctccacgcataccccccccaggtttatgggtatgatgatctccagatgctgcagacccgatttccactggactattattccattccatttccaacaccaacaaccccactgactggccgtgacggatcactagcgtctaacccatacagtggagacctaaccaaattcggccggggggatgcctcaagcccggcaccagcaactactcttgcacagccgcaacagaaccaaacacagacacatcacacaacgcagcagacttttctcaatccagctcttcctccaggatactcatacacttcgttgccatattacaccggcgtgccgggtttgccctcgacattccagtatgggccagcagtcttccctgtggctccgacatcgtctaagcagcatggtgtgaatgtgagtgtgaacgcatccgctacaccatttcagcagccaagcggatacgggtcccatgggtataataccggcgtgtctgttacctcttcaaacaccggcgtccccgacatcagcggtagcgtatactccaagacacaacaatcctttgagaaacagggcttccatagcgggacgcccgccgcatcattcaacctcccttcggccctaggctccggtggacccatcaatccagctaccgctgcagcctatccacccgctccgtttatgcacatcctcacgccccatcagcagccacacagccaaatccttcaccatcacctccagcaggatggacaaacgggaagtggccagcgcagccaaacgagctctatcccacagaaaccgcagacaaataaaagcgcttataatagctacagttggggagctaactag

SEQ ID NO: 13668 - DNA, 1803 bp, Artificial Sequence
  Description of Artificial Sequence: Synthetic coding sequence
atgcctgggtccgcagacattagcgggctcaacttacagttcggcgctctgcaatttggtagcgagccggtgctctcggactacgaaagtactcctacgacctctgcctctagctcacaggcgccttccagcctttacacgagcaccgcaagcgagtcttcgtcaacgatctcatcaaaccaatctcaggagtcggggtaccagtcagggcctatccagtcgacaacatatactagtcagaataacgctcagggccctctgtacgagcagcgctcaacccagacacggcgctacccatcctccatctcaagctctccgcagaaagacctgacacaagcaaagaacggcttctctagtgttcaggcgacacagctccagactacccaatccgtggagggcgcaaccgggagcgctgtgaaatctgacagcccctcgactagttcaatccctcctctgaacgaaaccgtgtccgctgcctcgttgctgacaacaaccaatcagcactctagctctttgggagggttgtcacacagtgaggagatccctaataccactaccacgcagcattcctcaactctgagcacccaacaaaacactctgtcttcaagcaccagcagcggccgcaccagcacctctaccctcttacatacatcagtggaaagcgaagccaacctccattcctccagctcgacctttagcacgaccagtagtacagtctccgcccccccccccgttgtgagcgtatcctcttcgctcaattccggttcttctctgggcctgagtctcggcagtaacagcacggtgaccgcaagcacccgctcctctgtggcaactacttctgggaaagctcctcccaatctgcctcccggcgtgccccccctgcttcccaacccatatataatggcccccggcctactccatgcctatcctccccaggtgtatggctatgacgacttgcagatgctccagactcgttttcctctggactattactcaataccctttccaacaccaactacgcctctgacaggcagggacggatcactcgcaagcaatccttattcgggcgacctgaccaaatttggccggggggatgcctcttctccagcccccgcaacaacactggctcaaccccagcagaaccaaacccagactcaccacactacgcagcaaacgttcttgaatccagctctgcctccgggctactcctatacgtctttgccctactataccggtgtacccggccttccttctacctttcagtacggacccgccgtcttccctgttgcccctaccagctcaaaacagcatggcgtgaatgtgtccgtgaatgcatcagccacacctttccagcaacctagtggctatggctcccacggctacaacactggggtgtcagttacttctagtaacaccggtgttccagatattagtgggtcagtgtattccaagacacaacagtcattcgaaaagcaaggctttcattctggcacgcccgccgccagctttaatctgccctctgccttagggtccggcggccccatcaacccggctaccgctgccgcttatcctccagcccctttcatgcacatccttaccccacatcaacaaccccactcccagatcttacaccaccacttgcaacaagatggccagctgccttatttgcagatgatcctgtgctgccagcggcagcaggaggagcagactggcagtggtcagagaagccaaacaagcagcatccctcaaaaaccacagactaataaaagtgcctataattcatactcctggggcgccaattag

SEQ ID NO: 13669 - DNA, 1200 bp, Artificial Sequence
  Description of Artificial Sequence: Synthetic coding sequence
tgacagcacagctcttccctgggtggactgagccactcagaagagattcctaacactacaaccacacagcattcaagcacactgagtactcagcagaatacccttagcagcagcactagctccggtagaacatctacgagtaccctgctgcatacatcagtagagtcagaagcgaacctccacagttcgtcctctaccttctccacaaccagctccaccgtgtccgcgcccccccctgtagtgagtgtttcatcctccctgaattccggctcttcgctgggcttaagcctgggcagtaactctacagttaccgcctctacaagatcgtctgttgccacaacaagcggcaaggcaccacccaatctacctccgggagtacccccactgctgccgaacccttatatcatggcccccggccttctgcacgcatatccaccccaagtgtacgggtatgacgatctccaaatgttacagactaggtttcctctggattattatagcatcccgttcccaactccgacaacgccccttactggaagagatggcagtttggccagcaatccctacagtggcgaccttactaagttcgggcgtggcgatgcctcttcccccgccccagcgaccactttagcccagccgcagcaaaaccaaactcagactcatcacactacacagcagacttttctcaaccccgcactgcccccagggtacagttacacaagtttaccatattacaccggagtccccggcctgcccagtacattccaatacggccctgcggtattccctgttgctcccacgtcatctaaacagcatggagtgaatgtgtccgttaatgcatcagccacaccattccagcagccttcaggatacgggtctcatggttataacacaggggtctctgtaaccagttcaaataccggggttccagatatctccggatctgtgtactccaaaacacaacagagtttcgagaaacagggtttccatagcggcacccccgccgcctcatttaatctcccctcagctctcgggtccgggggacccatcaatcccgccactgccgccgcttacccccctgccccttttatgcacattcttaccccccaccagcagccacactcacagatcttgcaccaccatttgcagcaggacgggcaagatattctaaactttgtggatgaccagctgggggaatag

SEQ ID NO: 13670 - DNA, 798 bp, Artificial Sequence
  Description of Artificial Sequence: Synthetic coding sequence
atgatgacatccgtcgggacgaaccgggcccgagggaattgggagcaaccccagaatcaaaatcaaacacagcataagcagcgcccccaggcaacagccgagcaaatccggctagcccagatgatcagcgaccataacgatgctgattttgaggagaaggtaaaacagttgatcgatataaccggtaagaaccaggatgaatgcgtgattgcactccacgattgcaatggcgatgtgaaccgggccattaatgttctcctcgagggaaatcccgatacacattcctgggagatggtagggaagaagaagggtgtatccggacagaaagacggaggacaaactgaatctaatgaggagggaaaagagaatcgggacagagatcgggattactctagacggcggggtggaccccctagaagagggagagttcgcggccaggagaacggcctggatggcactaagtcagggggcccaagtggccggggaacagaacggggtcgacgcggcagaggcagggggcgtggagggtctggcagacgagggggcaggttctcggcccagggtatgggtacgtttaacccggcagattatgccgaacctgctaatacagacgataactacggaaattcaagcggcaacacctggaataatacaggccacttcgagccggatgacggcacgtctgcctggcgaaccgcaacggaagaatggggcaccgaggactggaatgaggacctctcagaaacaaagatcttcacagctagcaacgtgtctagtgtccctttgcccgcagaatag

SEQ ID NO: 13671 - DNA, 549 bp, Artificial Sequence
  Description of Artificial Sequence: Synthetic coding sequence
atgatgacatcagtggggactaacagagctagaggaaactgggaacaaccccagaatcagaatcagacccaacacaaacagcgaccccaggcgaccgccgaacagatcaggctggcccaaatgatctctgatcataatgacgccgatttcgaagaaaaggtgaaacagctcattgacataacagggaagaatcaggacgagtgcgtgatcgctcttcatgactgcaacggggacgttaacagggctatcaatgtcctcctagaaggaaacccggacactcacagttgggagatggttgggaaaaagaagggggtttcagggcagaaagatggaggtcaaaccgagagcaacgaagaaggcaaagaaaaccgcgatagagacagagattatagtcgacgccggggaggacccccccgaaggggtcgcggagcttccagagggagggagtttagaggccaggagaacggcctcgatggtacgaagtcaggtggtccttctggacgcgggaccgaaagaggtcgacgtggacggggcagaggacgtggatag

SEQ ID NO: 13672 - DNA, 705 bp, Artificial Sequence
  Description of Artificial Sequence: Synthetic coding sequence
atgatgacatctgtaggcaccaatcgagctagggggaactgggagcaaccacagaaccagaatcagacgcagcataagcaacgtcctcaagccactgctgagcagatccgactggcccaaatgataagcgatcataacgacgcagacttcgaagaaaaagtcaagcaacttatcgacatcacagggaagaaccaagacgaatgcgtgatcgccctgcacgattgtaatggtgatgtgaacagagctatcaacgtactgctcgagggaaaccctgatacacactcctgggagatggtcggcaagaagaaaggagtctccggccagaaagacgggggccagacagaatcgaacgaggaagggaaggagaatagagatcgggaccgggattactctcgcaggcgcggtggccccccaagacgtggaagaggcgcttcaagaggccgggagtttcgcggccaggagaacggattggacggcacgaaatccggagggccttccgggcgcggcacggaacgtgggcgtcggggacgaggcaggggcagaggtggctcaggaaggagagggggtcggttcagtgcccagggtatgggcacatttaacccggcagattatgcagaacctgcaaacaccgatgataactacgggaattcctctgggaacacttggaacaacactgggcatttcgagcccgacgatggaacatag

SEQ ID NO: 13673 - DNA, 1989 bp, Artificial Sequence
  Description of Artificial Sequence: Synthetic coding sequence
atgcccgggagcgcggatatttcgggcctgaacctgcaattcggtgccctgcaattcgggtccgaacccgttctcagtgactacgaatcaactcccaccacaagcgcttcgtcctctcaggcaccgtcctccctgtacactagtacagcctcagaatcttcatctaccatctcgagcaaccagagccaggagagcggctatcagtccggacctatccaaagtaccacttatacttctcagaataatgctcagggacctctttacgagcagagaagcacacaaacccggcggtacccttcatctatctcctcctccccgcagaaagacctgactcaggccaagaatgggttctcctcggtgcaggccacccagcttcagaccacacagtccgttgagggggccacaggatctgcagtgaaatcagattcacctagcacatcatctattccccctttgaatgagactgtgagtgcagccagcctgttgactactaccaatcaacattctagtagcctaggtggcttgagccatagcgaagagatccccaatacaacaacgacccagcatagctcaacgctgtctactcagcaaaatacactgtcaagcagtacctccagtgggcggacctctacttcgaccctgctacacacctctgttgaaagtgaagcaaatttacactcctccagctccacattttccactacatcgtccaccgtttccgcacctcctccagtggtcagcgtttccagctcattgaatagtggaagtagccttgggctaagtctgggctcgaacagcactgtcaccgctagcactcgcagctccgttgccacaaccagcggcaaagcacctcctaatctgccaccaggggtgcctccactcctaccaaacccttacattatggcccccggcttgctccatgcctatcccccacaggtctacggatatgatgatcttcagatgctgcaaacacggttccctctggattactatagcatcccatttccaacacccaccacaccactgacaggaagggacgggtcactcgccagcaacccttattccggcgacttgactaagttcgggcggggagacgcttcttctcccgcaccagcaactaccctggcgcagccacaacagaatcagacccaaacccaccacaccactcagcagaccttccttaatccagcccttccccccgggtattcctacacatcgcttccctactataccggggtgcccgggctcccctctaccttccagtatggcccagccgttttccctgtggctccaacctcgagtaagcagcacggagtgaacgtatctgtgaacgcaagcgcgacacctttccagcagcctagcggctacggctcacacggttacaatactggggtgagtgtgacctcttctaacaccggtgtgcccgatatctccgggagcgtgtactcaaagactcaacagtcctttgagaagcagggctttcacagcgggacacctgccgccagttttaatctcccaagcgccctcggcagcggaggccccatcaaccctgctacagcagcagcttatccacccgcccctttcatgcatattctcaccccccaccagcaaccccatagccagatactgcaccatcacctgcagcaggatggccaactgccttatcttcagatgattctttgctgccagcgtcagcaggaagagcagacagggagtggacagaggtcgcagaccagctctatcccccagaagcctcagacaaacaagagcgcctataattcatactcctggcctactgaggcgctgacactgttctcgcggtctcacttgctccgagggttgctttctctggaaacaatggaaacagcttccaagcgaaaggagtgtggcgggtttcccctgccaccaacccccagtggtcctccccacgccagcgcatcttgtttgagtcattcctatactatccctactttgctgtacgttctctag

SEQ ID NO: 13674 - DNA, 1593 bp, Artificial Sequence
  Description of Artificial Sequence: Synthetic coding sequence
atggaggatgattccttgtatctcagaggagagtggcagtttaaccacttttctaagctgacatcaagccggcctgatgctgcgtttgcagaaattcaacggacgagtctgcctgagaagtcccctctgtcgtgcgagactcgtgttgacctctgtgatgatctggcccccgtcgcgcgccagctggctcccagagaaaaactgccgctgagctcacggagaccagccgcagtaggagcaggtcttcagaatatgggtaatacctgctatgttaatgccagtctccagtgcctaacttacacccccccgctcgccaactatatgctctcccgcgagcatagtcagacctgccaccgccacaaaggctgcatgctttgtaccatgcaggctcacatcacaagagccttgcataatcccggccacgttattcagccaagtcaggcattagccgcagggtttcatcgtgggaagcaggaagacgcccatgaatttctgatgtttaccgtcgacgctatgaaaaaggcctgcttacccgggcataagcaggtggaccatcattctaaggataccaccctcattcaccagatcttcggcggctattggcgttcccagattaaatgtttgcattgtcatgggatatctgacaccttcgacccttatcttgatattgcccttgacatacaggcagcacagagcgttcagcaggctctcgagcaactcgtgaaacctgaggagctcaatggcgagaacgcctatcactgcggcgtgtgtctgcaaagggctcctgccagcaagaccctcaccctacatacaagcgccaaagtgctcatcctcgtcctgaaacgattctccgacgtcacaggtaacaaaattgctaagaatgtgcaataccccgaatgtcttgatatgcagccctatatgtcacagccaaataccggacctttggtatacgtgctttacgccgtgctggtgcacgccggctggagctgccacaatggacactatttcagctacgttaaggctcaagagggtcagtggtataaaatggacgacgccgaggtgacagcctcaagtatcacttcagttttgagtcaacaagcatatgtcttattctacatacaaaaaagcgagtgggagcgtcactctgagagcgtgagccgtggcagggagccccgggctctgggagccgaagatacggacagacgcgctactcagggcgaacttaagagagatcatccttgtcttcaggcccctgaacttgacgagcatctggtcgaacgggctacccaggaaagtacgctggaccattggaagttcctccaggagcagaacaagacaaagcctgagttcaacgtaaggaaggtcgagggaacccttccaccagatgtgctggtcatccaccagtcaaagtataagtgcgggatgaaaaaccatcaccccgagcagcagtcctcccttttaaacctgtcctcatctacacctacgcaccaggaatctatgaataccggtactcttgccagcttacgaggaagagcgagacgaagcaaaggtaagaataagcattccaagcgcgctctcctggtgtgccagtag

SEQ ID NO: 13675 - DNA, 1593 bp, Artificial Sequence
  Description of Artificial Sequence: Synthetic coding sequence
atggaagatgacagcctgtatttgaggggagagtggcagttcaaccacttttccaaattgacctcgtctcgccccgacgccgccttcgccgagattcagaggactagcctccccgagaagtctccgctgagctgcgaaactcgggttgatctctgcgacgacctagcccccgttgccaggcagctggctccaagagagaagcttcccctgtccagcaggcgccccgcagccgtcggcgctggtctgcagaatatgggaaatacttgttacgttaatgcctccctacaatgcctgacctatacccctccactggccaactatatgctctcacgggagcactcacagacctgccataggcataaaggctgtatgctgtgtactatgcaagcccacatcacgcgcgctctgcataatcccgggcatgtgatccagccatcacaagctcttgccgctgggtttcaccgaggaaaacaggaagatgcccacgaattccttatgttcactgtagatgcaatgaaaaaggcctgtctccccgggcacaaacaggttgaccaccatagcaaagatacgaccctcatccaccagatatttggcgggtactggcgaagccaaattaagtgccttcactgtcacggcatttcagacacgttcgacccgtacctggacattgccctggatatccaggccgctcagtctgttcagcaggcactcgagcaattagtgaagccagaagagttaaacggcgaaaatgcgtaccactgcggggtgtgcctgcaaagagcgccggcctctaagacgctcactctccatacaagtgccaaagtgctgatcctggtgctgaaacggttttccgacgtgaccggtaataagatcgccaagaatgtacaatacccggaatgtctcgatatgcagccttatatgagccagcccaataccggcccgctggtgtatgttctgtatgctgttttggttcatgctggatggtcgtgccacaatgggcactacttttcatacgtgaaggctcaggaggggcagtggtacaaaatggacgacgcagaagtgacggcctctagtatcacctccgtgctgagccaacaggcttacgtcctgttttacattcagaaaagcgagtgggaaagacacagcgagtccgtcagtcgcggccgagagccaagggccctgggagcggaagacacagacagaagggccactcagggagaactcaagagggaccatccttgcctgcaggccccagagctcgatgagcatctcgtcgaaagagcaactcaggagtcgacactggaccattggaagtttttgcaagagcaaaacaaaactaagccagagttcaacgtcagaaaggtggagggaactttacctcctgatgtcctcgtgatccatcaatcgaaatacaagtgcggcatgaagaaccaccatcccgagcagcaatcctccctcctgaatctgtcgtcttccacgcccacacaccaggagagtatgaataccggcacccttgcctcgctgcgtggccgtgcccgccgttctaaggggaagaataagcactcaaagagggcacttctggtctgtcagtag

SEQ ID NO: 13676 - DNA, 1593 bp, Artificial Sequence
  Description of Artificial Sequence: Synthetic coding sequence
atggaagatgatagcttgtacctgaggggggagtggcagtttaaccacttttctaaacttacaagtagccgcccagatgctgccttcgctgaaattcagaggacttcactcccagaaaaatcccctctcagctgcgagacgcgtgtagatttatgcgatgatcttgcacctgttgctcggcagctagcaccccgggagaagctcccgctctcctctaggagacccgcagcagtcggagccggtctgcagaatatgggcaacacatgttacgtgaacgcctcattacaatgcctgacatacaccccgccactggctaactacatgctgtctcgcgaacatagccagacatgtcacagacacaagggctgcatgctgtgtaccatgcaagctcacatcacacgtgctcttcataacccagggcacgtgatccagcctagtcaagctctggcagcaggattccatcgagggaagcaggaagacgcacacgagttccttatgtttacagtggacgccatgaaaaaggcttgcctaccaggtcacaagcaagttgatcatcactctaaggacacaaccctgatacatcagatattcggtggatactggcggagtcagataaagtgcctccactgccacggtatctcagacactttcgatccctatcttgacattgccctggacatacaggccgctcagagtgtccagcaggccttggagcagctggttaaacccgaggaactaaacggagaaaatgcttaccactgcggagtctgtttgcagagagctccagctagcaagactcttacccttcacacatcagcaaaggtattgatcttagttctcaagagattctcggacgtcactggaaataagatcgccaagaacgtgcagtatcccgagtgtctagacatgcagccctacatgtcgcagcccaacacaggccccctggtgtacgttctctatgcagtcctggtacatgctggttggtcctgtcacaacgggcattactttagttacgttaaggctcaggaggggcagtggtacaagatggacgatgctgaagttactgccagtagcatcacctcagtattgtcacagcaagcttatgtgctattctacattcagaagagcgagtgggagaggcatagtgagtccgtgtctagaggacgagagcccagggcgctaggcgcagaagatacggatcgccgcgctacacagggcgagttgaagcgcgaccatccttgtctgcaggctcccgagttggatgaacacttagtggagagggctacgcaggagagtactcttgaccattggaagtttctccaggagcaaaataagaccaagccagaattcaacgttagaaaggttgaggggactctcccaccggacgttctggtgatccatcagtcaaagtacaaatgcggcatgaagaatcatcatccagaacagcagagctccctgctgaacctgagcagttccacaccaacgcaccaggagagtatgaacaccgggacccttgccagccttcggggacgagccagaaggtcaaaagggaaaaacaaacacagtaagcgagcactccttgtctgccagtag

SEQ ID NO: 13677 - DNA, 1593 bp, Artificial Sequence
  Description of Artificial Sequence: Synthetic coding sequence
atggaagacgattccctttatcttaggggcgagtggcagtttaatcattttagtaagctgactagtagtagacccgatgctgccttcgcagaaattcagcggactagtctgcccgaaaaatcccctctttcctgcgagactcgagtagacctgtgcgacgatctggctccagtagcacgccagttagccccgcgcgaaaaactgcccctcagtagccgccgacctgcggctgttggggctgggctccagaatatgggcaatacttgctatgttaatgccagtctccagtgtctgacctatacccctcccctggctaattatatgctgagccgagagcatagtcagacctgccaccgtcacaaggggtgtatgctgtgcacgatgcaggcccacatcacgcgcgccctacataatccaggccacgtgattcagcctagccaggctctggctgcagggttccacagagggaaacaggaggatgctcacgagtttttaatgtttaccgtcgatgctatgaaaaaagcatgcctgccagggcacaagcaggttgatcatcatagcaaagacactacactcatccaccagatcttcggcgggtactggcggtctcagattaagtgtcttcactgccatggtatatcagacaccttcgatccttacctggatattgctttggacatacaagctgcccagtccgtccagcaggctttggaacagcttgtcaagccagaggaactgaatggagaaaacgcctaccactgcggggtttgcctccagagggcacctgcttctaagactctgactctgcataccagcgcgaaagtactgatcctggtcctcaagagattctccgacgttaccggcaataagatcgcgaaaaatgttcagtacccggaatgtcttgacatgcagccttatatgagccagccgaacaccggtcctttagtgtacgtactgtatgcagtattagtgcatgcaggatggagctgccataacggccactattttagctatgtaaaggctcaggaaggtcagtggtataaaatggatgacgcagaggtgaccgcttcttccatcaccagtgtcctgagtcagcaggcttacgtgttgttttacatccagaagtccgaatgggagagacactcagagtctgtttcaagaggtagagagcccagggccctaggcgctgaggacaccgacagaagggcaactcaaggggaactgaagcgcgatcacccttgccttcaggctccagagctcgacgagcatcttgtggagcgggcaactcaagagtcaacactggaccactggaaatttctgcaggagcagaacaaaactaagcctgaattcaacgttaggaaagttgaaggcacactgcctcccgatgtgctggtgatccaccagagtaagtacaagtgcggaatgaagaatcaccatccagagcagcaaagctccctgctcaacttgagtagctctactccaacgcaccaagagtctatgaacacgggcaccctcgcctctttgcgcggccgtgctcggcggtctaaaggcaagaataaacattccaagagagctctgctggtgtgccaatag

SEQ ID NO: 13678 - DNA, 1593 bp, Artificial Sequence
  Description of Artificial Sequence: Synthetic coding sequence
atggaagacgatagcttgtatttgagaggagagtggcaattcaaccacttctccaagcttacgagctcacgtcccgatgccgcattcgccgagatccagaggacatctctgccggagaaatccccactgtcctgcgagacaagggtggatctttgcgatgacctggcacctgtcgctagacagctcgcgcctcgggagaaactacctttgtctagtaggagacctgctgccgtgggcgctggtctgcagaacatgggaaatacctgctacgtaaacgcgagcttacagtgtctcacttacaccccaccacttgctaattacatgctgtcacgggagcatagccagacatgtcaccgtcacaagggttgtatgctgtgcactatgcaagcacacataaccagagctctgcataaccccgggcacgtcatccagccaagtcaagcgctggccgctggattccacaggggcaagcaagaagatgcccacgaattcctaatgtttacggtagacgcaatgaagaaagcctgtctgcccgggcacaaacaggttgatcatcatagtaaagatactacgctcattcaccagatctttggtggatactggcgctcgcaaattaaatgcctgcattgtcatggaattagtgatacattcgacccttacctggacattgccttggatattcaggccgcccaatcagttcagcaggctctggagcaactggttaaacctgaagagctcaacggcgagaacgcatatcattgtggggtatgcctccagcgcgctccggcttctaagacattgacactgcatacatctgcgaaggtcctaattctggtgctgaagcgttttagtgatgtcaccggcaacaagatcgctaaaaacgtccagtaccccgagtgcctcgacatgcagccatatatgtctcaacctaacacaggccctctggtgtacgtgttgtacgccgtgctcgtgcacgccgggtggtcttgccacaatggccactacttttcttatgtcaaagctcaggaggggcagtggtacaagatggacgatgctgaagtgacggcttcctctatcactagtgttcttagccaacaggcatatgtgctcttctacatccagaagtccgagtgggagcgacattctgagtccgtaagtcgtggtagagagccacgcgcccttggcgccgaagatacagatcggcgagcaacacaaggggagttgaagcgcgatcatccatgcctgcaagcacctgagctcgacgaacacctcgtcgaaagagccacccaggaaagcactctcgatcattggaagtttctgcaggaacagaataagactaagcctgagtttaacgtgagaaaggtcgagggaacactgccaccggatgttctggtgatccaccaatccaaatataagtgcggcatgaagaatcaccaccccgagcaacagtctagtctcttgaacctgtccagctcaactcccacgcatcaggaaagcatgaacacaggtaccctggccagcctcaggggacgtgcacggaggagcaaaggcaaaaacaaacacagtaaacgcgccctactggtctgccagtag

SEQ ID NO: 13679 - DNA, 1593 bp, Artificial Sequence
  Description of Artificial Sequence: Synthetic coding sequence
atggaagatgacagtctgtatctccggggggagtggcaattcaatcacttttccaaattgacttccagcaggccagatgccgcattcgccgagatacaaagaacctccctccccgaaaagtctccactgtcctgtgaaacaagggtcgatttgtgtgatgatctagcacccgtggcacgacagctggcacccagggaaaaactccctcttagctcccgtagacccgctgccgtcggcgccgggctgcagaacatgggcaacacatgctacgtgaacgcatcactgcagtgtttaacgtacacacctcccctggcaaactatatgctgtcccgcgaacactcccagacctgccacaggcacaaggggtgcatgctgtgcactatgcaagcccacattacaagggcactccataatccagggcacgtcatacagccttcccaggccctggctgctggtttccaccggggcaaacaagaagacgctcacgagtttttgatgtttactgtggacgctatgaagaaagcgtgcctgccaggacacaagcaggtagatcaccattcgaaagatactacactcatccatcagatatttggcggatattggcgttctcagatcaagtgcctccactgccatggaataagcgacacattcgacccttatctggatatcgctctggacatccaggccgcccagagtgtccaacaagccctggagcagctggtaaagcccgaagagctgaatggggagaatgcttaccattgcggcgtgtgcctccaaagagcacctgcgagtaaaaccttaaccctgcacacctcagccaaagtgctgatcctggtgcttaaacggttcagcgacgtgaccggaaataaaatcgcgaagaatgtgcagtatcccgagtgtctcgatatgcagccgtatatgtcccagccaaatacaggtccccttgtctacgtgctgtacgccgttctggtacacgcgggctggtcctgtcacaacggtcactatttcagctacgttaaagcccaggaggggcagtggtataagatggatgacgccgaggtgactgcctcttcaattaccagcgtgctgagccaacaggcctacgtgctgttctacatacaaaagtccgagtgggagagacatagcgaatcagtgtcccggggtagagaaccacgagcactgggagccgaggataccgacaggagagccacacagggagaactgaagcgggatcatccatgtctgcaggcacctgagctggacgagcatctagtggagcgggccacccaagagtctaccctcgaccattggaagttcctccaggaacagaataagaccaagccagagttcaacgtgcggaaggtcgagggtacactcccacctgacgtcctcgtcatccatcaatctaagtacaaatgtggcatgaaaaaccaccaccccgagcagcagtcgtcgctgctaaatctgtcttcatcaacaccaacccaccaggagtccatgaacaccgggaccctggcatccttgaggggccgggcaagaaggagtaagggcaagaacaaacactccaaaagggcacttctggtatgccaatag

SEQ ID NO: 13680 - DNA, 1593 bp, Artificial Sequence
  Description of Artificial Sequence: Synthetic coding sequence
atggaggatgactccttatatttgaggggagagtggcagtttaaccatttcagcaagctaacttcatccagacccgacgccgcatttgcggagattcagcgtacaagcttgcccgagaagtctcctctaagctgcgagactcgcgtcgacctttgtgacgaccttgcacccgtggctcggcagcttgcccctagggagaagctccccctgagtagccgcagaccagcagccgtgggcgctggactgcagaacatgggaaacacttgctacgtgaatgcgagtttacagtgcctaacttataccccccccctggctaactatatgttgagtagagagcacagccagacgtgccacaggcataaaggatgtatgctgtgcaccatgcaggcacacataactcgtgcattgcataatcctggacacgttatccagccaagccaggcactggccgctggcttccacaggggaaaacaagaggatgctcatgagtttttaatgttcacggtggacgctatgaagaaggcatgcctgccaggccacaagcaggtggaccatcatagtaaggatacaactctcattcaccaaatctttggggggtactggagatctcaaatcaagtgtctgcattgccacggcatcagtgacacctttgacccgtatctcgatatcgcactggatatccaggcagcccagagcgtccaacaggctttggaacagcttgtgaagccagaggagctgaacggggagaatgcctatcattgtggtgtttgcctgcagagagcgcctgcctctaagactctgactctgcatacctctgccaaggttttgatattggttctcaaacgtttctcagacgtgaccgggaacaaaatagccaagaatgttcagtacccagaatgcctcgacatgcagccatacatgtctcaacctaataccggccccctggtctatgtgctctacgcagtcctggtgcatgcaggctggagctgtcataatggccactacttctcttatgtgaaggcacaggaggggcaatggtataaaatggacgacgctgaagtgactgcaagctccattacatcagtgttaagtcaacaggcttatgtgctgttctacatccagaagtccgaatgggagcggcactctgagtccgtcagcaggggccgggagccccgggccttgggagcggaagatactgatcgccgtgcaacccagggggagttgaagcgggatcacccgtgtttacaggcgcctgagcttgacgagcaccttgtagagagagctacccaggagagtacgttggatcactggaaattcttgcaggagcagaacaagacaaagccggaatttaacgtgcgaaaagttgagggcacccttccccctgacgtcctggtgatccaccaaagcaagtacaaatgcggtatgaaaaatcatcatccagagcaacagtcttccctgctgaacttatcatcgtccactccaacgcatcaggaaagcatgaacaccggcaccctcgcgtcactccggggaagggcgaggcggtcaaaagggaaaaataagcactcaaagcgggccctgctcgtttgtcagtag

SEQ ID NO: 13681 - DNA, 477 bp, Artificial Sequence
  Description of Artificial Sequence: Synthetic coding sequence
atgctgctatttgccctccttctcgcaatggagctgcctctggtggccgctagcgccacaatgcgagcccagtggacatatagccttagatgtcacgattgtgctgtcatcaatgactttaactgccctaacatccgtgtgtgcccgtaccacattaggaggtgtatgactatttctattcggatcaattcccgagaacttctggtgtataaaaattgcactaacaactgcacctttgtgtacgcagcagaacaacccccagaggcccctgggaagattttcaaaaccaacagtttctattgggtgtgctgctgcaacagtatggtctgtaacgccggcggcccaacaaacctcgaacgagacatgctgcctgatgaggtgaccgaggaggaattgcctgagggcaccgtgagactgggcgtttccaagctgcttctctccttcgcaagcattattgtgagcaacatcctgccatag

SEQ ID NO: 13682 - DNA, 1584 bp, Artificial Sequence
  Description of Artificial Sequence: Synthetic coding sequence
atggccgtacaccgcgtcaaggtgacattcaaagacgagcccggagagggttctggcgtcgcaagatcgttttatactgcaatagcccaggcctttctgtccaatgaaaagctgcccaacctcgaatgcattcagaacgccaataaaggcactcacacatctctgatgcagcggttacggaaccgcggcgaacgcgaccgggaacgcgagcgtgagagggagatgcgccggagctccggcctgcgggccggaagccgccgcgacagagaccgggattttcgccgccagctctccatagacactagaccctttagaccagcctccgaaggaaaccccagcgatgaccccgaacctctgcccgctcaccggcaagccctgggcgaacgcttgtatcccagagttcaggctatgcagcctgcattcgccagcaaaatcacaggaatgttgctcgaactgtctcccgcgcaacttttgctgctcctcgcctctgaggatagccttcgggcccgtgtcgatgaagctatggagcttatcatcgcacatggccgagagaacggcgctgactccattttggacttagggcttgtagattcttccgaaaaggtccaagagaatcggaagcgccatggttctagcaggtcagttgttgacatggacctggacgacaccgacgacggcgatgacaacgccccactgttctaccagccgggaaaacgcggattctacacccccaggcccggaaaaaatactgaggcccgcttaaattgtttcagaaatatcggacggatcctcggcttgtgtttgctgcaaaacgaattgtgcccgattaccttgaataggcacgtgatcaaagttctcttaggacggaaagttaactggcacgatttcgctttcttcgacccagttatgtatgagagcctgcggcagctcatcctagcctcacagtcctctgatgctgacgccgtgttctcagctatggacctggcgttcgccatcgatctatgtaaggaagagggcggggggcaggtggaactcatacccaacggcgtgaacattccggtgacacctcagaacgtttatgaatacgtgagaaaatatgctgagcataggatgctggtcgtggccgaacagccgctccatgccatgcggaagggcctcctggatgtgctgcccaagaacagcctggaggatctgaccgcagaggacttccgactgctggtcaacggttgtggtgaggttaacgtgcaaatgctgattagctttacaagctttaacgatgagtcaggggagaacgcagagaagctgctccagttcaagagatggttctggtcaatcgtcgagaagatgtccatgaccgaacgccaagacctggtttacttttggactagttctccctccttgcccgcctcagaagagggttttcagcctatgccatctatcacaatccggcctcctgacgatcagcacctccccacggcaaatacatgtatctcccggctatatgtgcctctttactcatccaaacagatcttgaagcagaagttgttgctcgccataaagacaaaaaacttcgggtttgtatag

SEQ ID NO: 13683 - DNA, 8400 bp, Artificial Sequence
  Description of Artificial Sequence: Synthetic coding sequence
atgacaagcatccactttgtggttcacccgctacccggaactgaggatcaactcaatgatcgtctgcgcgaagtgtccgagaagttaaacaaatataatctgaattcccacccccccctgaacgtactggaacaggccacaataaaacagtgtgtggttggaccaaaccacgccgccttcctcctcgaagatgggcgcgtgtgtagaatcgggttttcagtgcagcccgatcggctcgagctggggaagcccgataacaatgatggctccaaacttaactccaatagtggtgcaggtcggactagtcgacccgggcggacatctgatagcccttggtttctgtcaggatcagagactttaggacgtctggccggtaatactcttggtagtcgctggtcctccggcgtcggtggatccggaggggggagttctggtaggtccagcgcaggggctagagatagcaggcgccagacaagggtcattaggacagggcgagaccgaggctccggactcctgggtagtcagcctcaacccgttatcccggcctcagttattccagaagagcttatcagtcaggctcaggtggtgttgcagggcaaaagcaggagcgttatcatccgggagttgcagcgaacaaatctagacgttaacctcgccgttaacaacctgctgtccagagacgatgaagatggagatgacggcgacgacaccgcctcagaatcttatctgccaggcgaagatcttatgtccctactcgacgctgacatccatagcgctcacccatcggtgatcatcgatgccgacgcgatgttcagcgaggacattagttacttcggctacccttccttccgcagaagcagtttatcccggctcggtagttcccgggttctgctcctgcccctggaacgcgactccgaactgttacgcgagagggagtccgtcctacgactgagagagcgccggtggttagacggcgcctcgttcgataacgaacgagggtcaacatccaaagagggagagccaaacctggataagaagaatacccccgttcagtcacccgtttcactcggggaggatttacaatggtggcccgacaaggacggcacaaaattcatttgtatcggtgccctgtactcagaactgctagccgtgagctccaagggcgagttgtatcagtggaaatggtctgagtccgagccctatcggaatgcgcagaacccgtctctccaccacccccgcgccacatttctgggcttgacaaatgaaaagattgtgctgctctctgcgaactcgattagagctacggttgctacagagaacaacaaggttgcgacgtgggtggacgaaacactgtccagtgtggcctctaaactcgagcataccgcccagacctacagcgaactgcaaggagagcggatcgtgtcgctgcattgctgcgccctgtatacttgcgctcagctggaaaactccttgtattggtggggcgtggttccattcagtcagcgtaagaaaatgcttgagaaggccagagctaaaaacaaaaagcctaagtcttccgccggaatatcgagcatgccaaatatcaccgtggggactcaggtttgcctgagaaacaatcccctctaccatgcaggtgctgtggccttctctatctccgccggtatccctaaagtgggcgtcttgatggagagcgtctggaacatgaacgattcctgcaggtttcagctgcggagccccgagagtttaaagaacatggaaaaggcatctaaaacaaccgaagctaaaccagagtccaaacaggagcccgtgaaaacagagatgggaccaccacctagcccagcttctacttgttcagatgcatcaagtatagccagttccgcatccatgccctataagaggcggagatctacgcccgcccccaaggaagaggagaaagtgaatgaagagcagtggtctcttagagaggtagtctttgttgaggatgtcaagaatgtgccagttgggaaggttctcaaagtggacggagcctatgttgccgttaagtttcctggtactagcagtaacactaattgccagaactcttctggtccagatgcagacccttcctctctgctacaggactgtaggctcctcaggatcgatgagctgcaggtagtgaagactggcggtacccccaaagtgccagactgcttccaacgaactcccaagaagttgtgcatccccgagaagactgagatcctggctgtaaacgttgactcaaagggcgtccacgcagtgctgaagaccggcaactgggtgcgctattgcatcttcgatctcgcgaccggtaaagcagagcaggaaaacaatttccccaccagctctattgcctttctgggacagaatgagcgaaatgtagcaatcttcaccgccggccaggaatctcccatcatcctgagggacggtaatggtacgatctaccccatggctaaagattgcatgggaggcatcagagatccagattggctggacctccctcccatttcatcccttgggatgggtgtgcacagcctgattaacctccccgcaaatagcaccattaagaagaaggcggccgtgattattatggcagtggaaaagcagacccttatgcagcacatcctccggtgtgactacgaggcgtgccggcagtacttgatgaatctcgagcaggccgttgtgcttgagcagaatctccagatgttgcaaacctttataagccatcggtgcgatggtaataggaatatcttgcacgcctgcgtgtcagtctgttttcctacaagcaacaaagagactaaggaagaggaggaggccgaacgttccgagagaaatacattcgccgaaaggctgtctgccgttgaggcgattgctaatgcgatatcggtggtctcgtcaaacggaccgggtaaccgggcaggctcttctagctccagaagtttgcgactgcgcgagatgatgaggcgaagcttgcgggccgcaggccttggccggcatgaggcaggagcctcctccagtgatcatcaggatccagtgtctccgcctattgctccccctagttgggtgcctgacccacccgcaatggacccggacggcgacattgattttatcctggctcccgccgtgggctcactcacaaccgcagctacaggtacaggccaaggcccaagcacgtcaacaatacccgggccttctacagagccttcagtggtggagagtaaagataggaaggcgaacgctcactttatccttaagctgctgtgcgacagcgtggttctccaaccatacctgagggagctccttagcgcgaaagacgctcggggcatgactccatttatgtctgccgtgtccggccgagcatatccggctgctatcaccattttggagacagcccaaaagatcgccaaggctgagatcagcagctccgagaaggaggaggacgttttcatggggatggtctgtccgtcaggaactaatccagatgactctcctttgtacgttctgtgttgcaacgatacatgtagttttacctggactggagccgagcacattaatcaggatatctttgaatgccgcacctgcgggctgctcgaatccttgtgctgttgcacggagtgtgccagagtgtgtcataagggccatgactgcaagttgaaaaggacttcccctacggcctactgcgactgttgggagaagtgtaagtgcaagactctcattgcaggccagaagagtgcacgattagatctgctgtacaggttgctcaccgccaccaaccttgttacactccctaacagtcgcggggaacacttgctcctgtttttggtacagaccgtggcccggcaaaccgtggagcactgtcagtaccggccaccgagaatccgggaagaccgcaatcggaagactgcctccccggaagactccgacatgccagaccatgatcttgagcctcctagatttgcgcagctcgctctggagagggtgctccaggactggaatgcccttaaatcaatgatcatgttcggatcccaggaaaacaaggacccactgtctgcaagcagtagaattggccatcttttaccagaggagcaggtgtatctgaaccaacagtctggcaccatccgcctggattgcttcacacattgcttaatagtgaaatgcacagcagacatcctcctgttggatacactgctggggactctcgttaaggagcttcaaaacaagtatacccccggccgtagggaagaagccatcgcagtgactatgagattcctcaggtctgtggcacgagtttttgtgatccttagtgtcgagatggctagctccaagaagaagaacaatttcatcccccagcctatcgggaaatgcaagagggtgtttcaggctctgctgccttacgctgtggaggagttatgcaacgtcgccgagagcctaatcgtgcccgtaagaatggggatcgctcgcccaacagctccattcacactggcatcaacttccattgatgctatgcaagggtctgaggaactgttttcggtggaaccgctgcctccccgcccctctagtgaccagtcctcctcttccagccagtctcagtccagttatataattcgaaatccacaacagagacgaatcagccagtcccagccagtcagagggagagacgaagagcaggacgacatcgttagcgccgacgtcgaagaagtcgaagtcgttgagggcgttgccggcgaagaggaccaccacgacgagcaggaggaacacggcgaggagaatgcagaggcggaaggtcagcacgacgaacatgatgaagacgggagcgacatggagctggatctgctggctgccgcggagacagaatctgattctgagtctaatcatagcaaccaggacaacgcctcagggaggcgctccgtggttaccgccgcgactgcaggctccgaagcgggggccagttccgtgccagccttcttctccgaagatgactcccagtccaacgattcatcagactcagatagctcctcatcccaatctgacgatatagaacaggagacattcatgcttgatgaacctctggagcgcactacaaattcgtctcacgcgaatggagctgctcaggcaccgcgaagcatgcaatgggctgtgcgaaatacgcagcaccagagggcagcatccactgcgccgtcttccacaagtacccccgccgcatcctcagcggggcttatatacatagatccatctaaccttagaaggtctggaactatttctacttcagctgctgctgccgcagcggccttggaggcaagtaatgccagtagctacctgacaagtgcctcgtctctggcgagggcctactcaattgtgattaggcagatcagcgacctgatgggccttattccgaaatataaccacctggtgtattcccaaataccagccgctgtaaagctcacctatcaggacgcagtcaacctgcaaaattacgtcgaagagaaactaattccgacgtggaattggatggtttccatcatggatagcaccgaagcccagcttagatacggcagcgccctggctagcgccggggaccctgggcaccctaaccatccgcttcacgcctcccaaaattccgcacgtagagaaaggatgacagctagagaggaggcaagtctacggacactggagggaaggcggagggcaactctcctttccgccagacagggcatgatgtctgccagaggagactttctcaactacgccttgtccctgatgcggtcacacaatgacgaacacagcgatgtcctccccgtgttggacgtgtgctccctcaaacatgtggcatatgtcttccaggctctgatctattggattaaggccatgaaccaacagactacactggatactccccagttggaaagaaagcgtactagggagctgttggagctgggcatcgataatgaggatagtgagcacgaaaacgacgacgacaccaaccaatcagccactctcaacgataaagatgacgacagcctccccgccgaaacaggacaaaatcatcccttcttcaggcgcagcgactcgatgacgttcctcgggtgtatccccccgaacccattcgaagtgcctctggctgaagccattcccctcgctgaccagccacatctgctgcaaccaaatgcgcgcaaggaggacctgttcggacgtccaagtcagggactgtatagcagttctgcatcatccgggaaatgtctcatggaagtaacagtggacaggaattgtttggaggtcctgccaaccaagatgtcctatgcagctaacctaaagaatgtgatgaatatgcaaaaccggcagaaaaaggagggggaggagcagcctgtgctgccagaggagaccgagtccagcaaacccggacccagtgcccatgatcttgcggcccagctaaaatcatccctgctggcggagatcggcctcactgagtctgaagggccgccattgacttcattcagaccccagtgttcctttatgggtatggtcatctcacacgatatgctgctggggaggtggcgcctgagcttagaactcttcggtcgcgtgttcatggaggacgtgggggccgagcctggatccatcctgacagaactgggcggctttgaagtgaaggagtccaaattccgcagggagatggagaagctcaggaaccagcagagccgcgacttatccctagaagtagaccgggaccgggaccttttgattcaacagactatgcgccagttgaacaatcatttcggcaggcggtgcgcgaccacccctatggccgtccacagagtaaaggttacattcaaggatgagcccggcgagggctctggagtagcccgaagtttttacaccgccattgcccaggctttcctgtccaacgaaaagttgcctaacttggaatgcattcagaatgctaacaagggaacccacactagcctgatgcagaggctgaggaatcgcggcgagcgtgacagggaaagagaaagagagcgggagatgcgaaggagctctggactgagagcaggcagtcgcagggacagagatcgtgatttccggcgccaactgtccatcgacacaaggcccttcaggccagcttcagaaggcaatcccagcgatgaccctgaaccgctacccgcccataggcaagccctgggcgaacggctgtacccgagagtccaggctatgcagccggcgttcgccagtaaaattacaggtatgctcttagaactctcacccgcacagctgctcctcctcctggcaagcgaggactctctgagggcccgggttgacgaggcaatggagcttattatcgcacacggcagagaaaatggtgcagactctatccttgacctggggctggtggactcatccgagaaagtacaacaggaaaaccgtaaaagacacggcagcagccgctcagtggtggacatggatctggacgatactgacgatggcgatgataacgccccgctgttctatcaaccagggaagaggggtttctacactccccgaccgggcaagaacaccgaagctaggctaaattgctttcgcaacattgggcggattctgggactgtgtctgctgcagaacgagctgtgccccatcacattgaatagacatgtgatcaaagtcttgctgggtagaaaagtaaattggcatgacttcgcgtttttcgatcccgtgatgtatgaatctctgaggcagctcatcctggcgtctcaaagcagtgacgcggacgctgtgttctcagccatggatcttgccttcgcaatcgacctgtgcaaagaggagggtgggggccaggttgaattgattcccaacggcgtgaacatacctgtcactcctcaaaatgtctatgaatatgtccgcaagtatgccgaacaccggatgttggtggtggctgagcagccgctccacgctatgaggaaaggcctccttgatgttttgcccaagaactccctggaggacctgaccgcagaagatttcaggttacttgtcaatggctgcggagaagtaaacgtgcaaatgcttatctcattcacttccttcaatgacgaatctggcgaaaatgcagaaaaactcctgcaatttaaaaggtggttttggagcatcgttgagaagatgtctatgaccgaaaggcaagaccttgtgtacttctggacctcttcaccctccctacccgcctccgaagagggcttccaacctatgccaagtataacaatcagaccccccgacgaccagcaccttcctacagccaatacgtgtatttcaagactgtacgtccccttgtacagcagcaaacaaattctgaagcagaaactgctgttagcgatcaagaccaagaactttgggttcgtttag

SEQ ID NO: 13684 - DNA, 8379 bp, Artificial Sequence
  Description of Artificial Sequence: Synthetic coding sequence
atgacaagtatccacttcgtcgtccatcctctgccaggaactgaggaccagctgaacgacagactgcgtgaggtcagtgaaaagctcaacaaatataatctgaactcacatccacctctgaacgtgctggaacaagcaacgatcaaacagtgtgtcgtggggcccaatcatgcagcatttctgctagaagacggtagagtgtgccgaataggctttagtgtgcaaccggacagactcgagttgggcaagccagacaataatgacggcagcaaactcaactcaaatagtggcgcagggcgaactagtcgcccagggcggacctccgattccccttggttcctgtccggcagcgaaaccctgggaagactggccgggaacactttaggtagcagatggagtagtggcgtgggggggagcggggggggtagcagtggacgctcatcggctggtgcccgcgactcaaggcgtcagacgagagtgatccggactggaagggatagggggagcggactgttaggtagccaaccacagccggtcatcccggcctcagtgatccccgaagagctaatatcacaagctcaggtcgtgcttcaaggcaagtccagatccgttatcatccgtgagctgcagcgcaccaacttagatgttaacctcgcagtcaataaccttctctccagagatgatgaagacggagatgacggcgacgacactgcaagtgagtcctatttgcccggtgaggatttgatgtcactcctggacgcagatatccattccgcacacccaagcgtcattatagatgcagacgcaatgttcagcgaggatatatcatacttcggttacccgtcttttaggagaagttcactctccaggctcggatcaagtagagagcgcgattctgagcttctgagagaaagggaaagtgtgttgagattgagggaaaggcgatggctcgatggcgcttcctttgacaatgaacgcggaagcacgagcaaggagggcgaaccaaacctggataagaagaatacaccagtgcagtcacccgtgagtctgggcgaggatcttcaatggtggccagacaaagacggtaccaaattcatctgcattggcgccctgtactccgaactcttagctgtttccagtaagggggagttgtatcagtggaagtggtcggagtccgagccttaccgaaacgcccagaacccctcactgcatcatccccgcgctaccttcctgggtctaaccaacgagaaaattgtgctactatccgccaactcaattcgagcaaccgtggccactgagaataacaaagttgccacctgggtggacgaaacgctctcctcggtggcttctaaactcgagcataccgcccagacatactctgagctccaaggcgaacggattgtctccctgcattgctgtgcgctgtatacgtgcgctcagctggagaatagcctgtactggtggggggtggtaccattctcccagcggaaaaagatgctggagaaggctagggccaagaacaaaaagcccaagagctccgccggcatcagctccatgccaaatataacagtcggtacccaggtgtgcctccgtaataaccctctttaccatgctggggccgtggcatttagtatttccgccggaattccaaaggttggcgttctgatggaatctgtgtggaacatgaacgatagttgccggttccagcttaggagtccggagagcctgaagaacatggaaaaagccagcaagacaaccgaggctaagccagaatccaaacaggaaccggtgaaaacagagatggggccccctccatcccccgcctccacctgtagcgacgcttcctccatcgcatcctctgccagtatgccatacaagagaagacgtagcacccctgcgcccaaggaagaggagaaagttaatgaggaacagtggtccctgcgtgaggtcgtctttgtggaagacgtcaagaacgtccctgtgggtaaggtgctcaaggtggacggcgcctacgtcgcagtgaagtttccggggacctcatccaacacaaactgccaaaactcatctggcccagatgccgatccctcatccctgctgcaagactgcaggctgctgagaatcgacgagttacaggtggtgaaaacgggaggaacacccaaggttccggactgtttccagagaacccccaagaaactgtgcatccctgaaaaaaccgaaattctcgctgtcaacgtcgacagcaaaggcgtacatgccgtgctgaagactggtaattgggtaagatattgcatcttcgatctggccacggggaaggcagagcaagaaaataactttcctacgtcgtctattgcattcctcggacagaacgaacgcaatgtcgcaatcttcacagctggacaggagtcaccaattattttgcgggatggcaatggaactatctacccgatggccaaggactgcatgggtgggatcagggatcccgactggctggacctgcccccgatctccagtctgggcatgggggtccactctctgatcaatctgcccgccaactccacaatcaagaagaaggcagccgttattataatggccgtcgagaaacagaccttgatgcagcatattctgaggtgcgactatgaagcatgccgccagtatcttatgaaccttgaacaagcagtcgttctggagcagaacctacaaatgttgcaaacgtttattagtcatagatgtgacggcaaccgcaatattctgcacgcctgtgtcagcgtctgttttccaaccagcaataaagagaccaaggaagaggaagaagccgagaggtcagagcggaacacctttgctgaaagactatcagccgtcgaagcaatagccaatgccatatctgtggtttccagtaatggccctgggaaccgcgcgggaagttccagtagtagatcactccgtctacgcgagatgatgaggcgatccttgagagctgccgggctggggcgacatgaggcaggcgctagctcctccgaccaccaggacccagtaagcccgcccatcgctcccccaagttgggtacctgatcccccagcgatggaccctgacggagatattgatttcatactggcgcctgcagttggttcgctgacaaccgcggctaccgggacaggccagggtccgagtacgtcaacaatacctggtccttctactgaacccagtgtggtggagtcaaaagatcgcaaggctaacgcacatttcattcttaaactgctatgcgattccgtggtactacagccttatttacgcgaactcctaagtgctaaagacgcaagagggatgacacccttcatgtccgcggtgtctggcagggcttaccccgccgcaatcaccatccttgaaacagcgcagaagatcgcaaaggccgaaatatctagctcagaaaaagaagaagacgtgttcatgggaatggtctgcccaagcggcactaaccccgatgattctccactttacgtgctctgctgtaatgatacttgctcattcacctggacaggcgctgagcacattaatcaggatatattcgaatgtaggacctgcggcctgctggagagcttatgctgctgcaccgagtgtgcccgtgtgtgccacaaggggcacgactgcaaactgaaaagaacaagccctaccgcgtactgcgactgttgggaaaaatgcaaatgtaagacactgattgcaggacagaagagcgcaaggttagacttactttacagacttctgacagcaacaaacctcgtgaccctacccaacagtaggggggagcaccttctgctgtttttggtccagactgtcgccaggcagactgtggaacactgccaataccgtcctcctcgaatccgcgaagaccgaaatcggaagaccgcctctcccgaggattccgacatgcccgaccacgatctagagcccccccgtttcgcccagctggcgctcgaaagggttctgcaggactggaatgcattgaagagtatgatcatgttcggttcgcaggagaacaaagatccactctctgcttcgagcagaatcggccatttactgccagaagagcaggtttacttgaatcaacagagcggcaccatccggcttgattgtttcacccactgcctaatcgtgaagtgcactgccgatatattgttactggacacactcctggggaccctggtcaaagagcttcagaataagtacactcctggccgcagggaggaggcgatagctgtgacgatgcggttcttacgcagtgtcgcgcgagtgtttgtgattctctctgtggagatggcaagctccaaaaagaagaataactttatcccacagcctatcggcaagtgtaagcgggtgtttcaggctctgctgccctatgcagtagaggaactttgtaacgtggctgagagtctcatagtacccgtgcgcatgggcatcgccagacctaccgctccctttacactggcgtccacctcgatagacgcaatgcagggaagcgaagagctcttcagtgtcgagcctctgcctccacgaccaagttctgatcagagctcctcttcatcccagtcccaaagctcctatataatcagaaatccacagcaacgtcgtatctcccagtcgcagccagtgcgggggcgcgacgaggaacaggacgacatcgtcagcgccgatgttgaggaagtcgaagtcgttgagggcgttgctggagaggaagaccaccacgacgagcaggaggagcatggggaggagaacgccgaggcagaggggcagcatgacgagcatgacgaggatggaagcgacatggaattagacttgctggctgccgcagaaactgaatcagacagcgagagcaatcacagtaaccaagacaatgcctcggggcggcgaagcgttgtcacagccgctacagccgggagcgaagcaggggctagctcggtacccgccttcttctccgaggatgattctcaatccaacgatagcagtgattcagatagcagcagctcccaaagcgacgacatagaacaagaaacctttatgctggacgaacccctagaaaggaccacaaactcaagtcatgctaacggcgcagcccaggcacccaggagcatgcagtgggcagtgagaaatacccagcatcaacgtgctgcatccaccgctcccagttcaacatcaactcccgccgcctccagcgcaggccttatttacattgacccttccaatctgcggcgaagtggcacaatcagcacctctgccgccgccgcagcagctgccttggaagcgtctaacgcgagctcttacctcacctctgcctcctctctggccagggcatacagtatcgtaataagacaaatcagcgacttgatgggtctcatccccaagtataaccatttggtctattcacaaattccagctgcggtcaaactgacctatcaggatgccgtgaacctccagaattatgtggaggagaaactgatacccacatggaactggatggtgagcattatggattccactgaagcgcagctgcggtacggttccgctctggcgtccgccggagaccctggccaccccaatcatcccctgcacgcttcccagaactcggctaggcgagagagaatgactgctcgagaagaggcgtctctaagaacactggagggtcggcggagagcaactctgctatctgcaagacagggaatgatgagtgcaaggggtgacttcctgaattacgcgctctctctcatgcggtcccataacgatgagcattcagatgtgctccccgtgctcgatgtgtgctccttgaagcacgttgcttatgtttttcaggcactaatctactggatcaaggctatgaatcaacagacaaccctcgacactccacagcttgagcgcaagagaacccgagagctgctcgaactgggcattgacaacgaggactcagaacatgagaatgacgatgatactaatcaatctgccacgctgaacgacaaggatgacgatagtttaccagcagagactgggcagaaccacccatttttcagacgctccgatagcatgacattcctgggttgcatcccaccaaaccccttcgaggtgcccctcgccgaagcaattcctctggctgatcaacctcatctgctacagccaaatgccagaaaagaggatctatttggccggccctctcagggcttgtactccagttctgcgtctagcgggaagtgcctgatggaagtaacagtggaccgcaactgtctagaggtgcttccaactaagatgagctacgctgctaatctgaagaatgtgatgaatatgcagaaccggcaaaaaaaagagggagaggagcaacccgtgctgccagaggagaccgaatcctctaagcctgggccctccgctcatgacctggcggcgcagctgaagagtagtttgctagccgaaattggactgacagagtcggaagggccacccctgacatcgtttcggccccagtgctccttcatgggcatggtgattagtcatgatatgctgctagggcgctggaggctatcactggagctgttcggcagggtcttcatggaggatgtgggagcggaaccgggtagcatattgacagagctaggaggctttgaggtgaaagaaagcaaatttcgccgcgaaatggagaagctgcgcaatcagcagtcccgggatctctccttagaggtggatagggatcgcgacctcttgatccagcagacaatgcgtcagctcaacaatcattttgggagaagatgcgccaccacacccatggccgttcatcgcgtgaaagtcaccttcaaggatgagcccggggaaggatcaggcgtagctcgcagcttttataccgctatcgcccaggcttttttgagtaacgagaagcttcccaatctggaatgcatccagaatgcgaacaaaggcactcatacctctctcatgcagcggttgcgaaataggggggagcgggatcgagaaagggaaagagaaagggagatgagaagatctagcggcctacgcgctggctcacgcagagatcgcgatcgagacttccggcgccagctgagcatagacacgagaccatttcgccctgcatctgagggaaacccttccgacgaccctgaaccgctgcctgcgcatcggcaggccctgggggagcgcctgtacccccgggttcaagcaatgcaacccgcctttgcctctaagatcaccggcatgctgctggagctgtcccccgctcagctgctcttgctgctggcttctgaggacagtttgcgcgcgcgcgtcgatgaggccatggaactcattattgctcatgggagagaaaatggggccgatagtattctggaccttgggcttgtcgactcttccgagaaagtgcaggaaaacagaaaaaggcacggctcctcccggtctgtcgtggacatggatttggacgacacggacgatggcgatgacaacgccccattattctatcagcctggaaagcgcggattctacacaccacggcccggcaagaacacagaagctagactgaattgcttccgtaatatagggagaatactgggcctatgcctgctgcagaacgaactgtgcccgatcactctgaaccgacatgtcataaaggtacttctcgggaggaaagtaaactggcacgatttcgccttctttgatccggtgatgtacgaatcactccggcaactgatcctggcttctcagagtagcgacgcagatgcagtgtttagtgcaatggacctcgcttttgctattgatctctgcaaggaggaagggggtggccaggttgagctcattcccaacggggtgaatattccagtgactccacagaacgtttacgaatatgtacgtaagtatgccgagcatcgaatgttggtggttgctgagcagccgctgcatgccatgcgtaaaggtctcctggacgtcctccctaaaaatagcctggaagacctgaccgcagaggactttaggcttttggtgaatggttgcggggaagtgaacgtccagatgctcattagcttcacaagctttaacgacgagagcggggagaatgctgaaaagctgctgcaatttaaaagatggttctggtccattgtcgagaagatgagcatgacggaacgccaagatctggtgtacttctggacttcaagcccaagtctgcccgcctccgaggaaggatttcagcctatgccctccatcacgatccgaccaccagatgatcagcacttgcccaccgctaatacctgcatcagcagactgtatgtccccctgtactctagtaagcagatcctgaagcagaagctgctcctggctataaaaacaaaaaactttgggttcgtctag

SEQ ID NO: 13685 - DNA, 1593 bp, Artificial Sequence
  Description of Artificial Sequence: Synthetic coding sequence
atggaggacgattccctctacctgggcggcgagtggcagttcaatcactttagcaaactgacctccagcagacccgatgccgccttcgctgagattcagcgcacctctctacctgaaaagtcgccgttaagctcggaggcacgcgtggacctgtgtgatgatctagcacccgttgccagacagctggcaccccgcaaaaagctgcctctctcaagcagaagacccgcggctgtcggtgcgggacttcagaatatggggaatacatgttatgaaaacgcatcgctgcagtgtttaacgtatacccctcctctagcgaactacatgttgtcacgagaacattctcagacatgtcagcgccctaagtgctgtatgctgtgtaccatgcaggcacatattacgtgggcattgcactctcctgggcatgttattcaacctagccaggctctcgcagccgggttccatagggggaagcaagaggacgctcatgagttcctcatgtttacggtcgacgctatgaaaaaggcctgtctccccggacacaaacaggtcgaccaccacagtaaggatactaccctgatacatcagatatttgggggctgctggcggtcccagattaaatgcttacactgtcacggcatctccgacacgttcgacccatacctggacatagcccttgatattcaggctgctcagtctgtcaagcaggccctggagcaactggtgaagccagaagaactgaatggcgagaatgcttatcactgtggcctgtgtctgcagagggctccagcgagcaaaacactgaccttgcatacgtctgccaaagttctcatcctggttttgaaacgattctcagacgtcactggaaataaattagccaagaacgtgcaataccccgagtgcctggatatgcagccgtacatgtcccaacagaacaccggcccgctcgtgtacgtcctgtacgcagtcctagtgcacgccgggtggtcctgccacgacgggcactacttctcttatgtgaaagcccaggaaggacaatggtataagatggatgacgctaaggtcaccgcctgcagcatcaccagtgtgctctcccagcaagcctatgtactcttttatatccagaaatcagagtgggagcgccattccgagtcagtcagcagggggcgagagccacgggcccttggagctgaggatacagaccgccgcgccacgcagggggaactgaagcgggatcacccttgcctgcaggctcccgaactggatgagagactcgttgaacgagcgactcaggaatctacattggaccattggaaattcccccaggaacaaaataagacaaaacccgaattcaatgtgcgcaaggtagagggaacattgcctccaaatgtcttagttattcaccagtcaaaatataagtgcggtatgaagaaccaccaccctgaacagcagtctagcctcctgaacctttctagcaccacaaggacagaccaagaatcagttaacaccggaaccttggcgtctctccaaggtcgaacaagacgctccaaaggtaaaaataagcactccaaacgcgctctgctagtttgccagtag

SEQ ID NO: 13686 - DNA, 2940 bp, Artificial Sequence
  Description of Artificial Sequence: Synthetic coding sequence
atgagcccattgaaaatccacgggcccatccgcatccgtagcatgcagaccggtattacaaaatggaaggaggggtctttcgagattgtagaaaaagagaacaaggtgagcctcgttgtccactacaacaccggcgggattcctaggattttccaactgagccataatatcaaaaacgttgtgctaaggccatccggggccaagcagagtaggctcatgctcacactgcaagataattcttttctcagcatcgataaggtgccaagcaaagacgccgaagagatgcgactattcctggatgcagtacaccagaatagactgccagctgccatgaagccctcccaaggatctgggagtttcggggccatcttaggatctcgcacaagccagaaagaaacttcccgccagctttcctactcagacaatcaggcttctgcaaagagaggttcacttgagaccaaagacgatattccttttaggaaggtgctgggtaatcccgggcgcgggagtatcaagaccgtggccggcagcggaatcgcccgcacaattccaagtctgacgagcactagcacaccgcttcgtagtggcttgcttgagaacagaaccgagaagcgaaagaggatgatttctactgggagtgagttgaacgaagactacccaaaagagaatgattcatcatctaataacaaggcaatgacagatccttccaggaagtatctgacaagctcccgggagaagcagctctccctgaagcagagcgaagagaatagaacaagcggactgctgccattacaatcgtcatccttttatggctctcgtgctggatctaaagaacactcatctggtggtacaaatctcgacagaacaaatgtcagcagtcagaccccatccgctaagaggagtctcgggttcctgcctcagccagtacccttgagtgtcaagaagctgcggtgcaaccaggattacacaggctggaataagcccagagtcccactctcatcacatcagcaacaacagttacaggggttttccaacctgggtaacacatgctacatgaacgcaattctgcaaagcctgttctccctccagtccttcgccaatgacctgctcaaacaaggtatcccttggaaaaagatacctctcaacgccctcatccggcggtttgctcatctgttagttaagaaagacatatgtaattcagagaccaaaaaagatcttttgaagaaggtcaagaatgccatctctgccaccgcggagagatttagcggctacatgcagaacgatgcccatgagttcctctcccaatgtcttgaccagctgaaagaagatatggagaagttaaacaagacttggaaaacagaacccgtatctggcgaagaaaactctcccgacatcagtgccacccgtgcgtacacttgtccagtaatcaccaatttagaattcgaagttcagcactcaattatatgcaaagcctgtggcgagatcatcccaaagcgggagcagtttaatgacctcagcatcgatctccctcgaagaaaaaagcctctgcctcctcgatctattcaggactccctggatcttttttttagagctgaggaactcgaatactcctgcgaaaaatgcggagggaaatgcgcactggtgcgtcacaaattcaatcgactgcccagagtgctgatactgcacttgaaaaggtattcttttaatgtcgcactctctctcaataacaagattggacagcaggtcatcataccccgatacctcaccctctcctcccattgcacagaaaacacaaagcccccatttaccctgggatggtctgctcacatggccatctctcgccctctgaaggccagccaaatggtcaatagttgtatcacctcccctagcacaccatctaaaaagtttacgttcaagagcaaaagctcgctggccctatgcttagatagcgactcagaggatgagctgaaaaggtcagtggctctatcccagagactttgtgaaatgctgggaaatgaacagcagcaggaggatctggagaaggattccaaactgtgtcccatagaacctgacaagagcgagttagagaactcaggcttcgaccgcatgtccgaggaagagctgctcgctgctgtactggagatcagcaaacgagacgcatctccaagcttgagtcacgaggacgatgacaaacctacttccagcccagacacaggtttcgcagaggacgacatccaggagatgcctgaaaatccagatacaatggaaacggaaaaaccaaaaaccattactgagttggaccccgcaagtttcaccgaaatcaccaaagattgtgatgaaaataaagagaacaaaacaccagagggttctcaaggggaggtagattggctccagcagtatgacatggaacgtgagcgggaagaacaggaactgcagcaggccctggcacagagtttgcaagagcaagaagcctgggagcagaaagaggatgacgacttaaaacgcgcaacagagctgagcttgcaggagtttaataattcctttgtcgacgctctgggatccgatgaagacagcggaaatgaggatgtgttcgatatggaatacactgaggctgaggccgaggaactcaagcggaatgccgagaccggaaatctaccacattcataccgtctgatcagtgtcgtctcacacatagggtccacctcttccagcggtcattacattagcgatgtttacgacataaagaaacaggcctggttcacatataacgacctcgaagtttcaaaaattcaggaagcggccgtccagagcgatcgcgatagatcaggttacatctttttttatatgcacaaagagatttttgatgaattattagaaaccgagaagaattctcagtccctgagcactgaagttgggaagactaccaggcaggccctctag

SEQ ID NO: 13687 - DNA, 2940 bp, Artificial Sequence
  Description of Artificial Sequence: Synthetic coding sequence
atgagtcctctgaagatccatggcccgatacgaattcggtcaatgcagactggtattaccaagtggaaggaagggagtttcgaaattgtcgaaaaagagaacaaagttagtctggtcgttcactataacactggaggaattccgaggattttccaactcagccacaacattaagaacgtagtgctccggccctcaggagccaaacagagcagacttatgctgactctgcaggacaattcatttctttccattgacaaggtccccagcaaagatgccgaggaaatgcgcctgtttctagacgcagtccaccagaaccggctcccagctgcgatgaagccctctcagggctctgggtcgtttggcgcgatccttggctcgcgcacttcacagaaagagacgtctagacagttgagttatagcgacaatcaggcatctgctaagcggggttccctggagaccaaggatgatatccctttcagaaaggtcttaggaaatccaggaaggggcagcattaagacagtcgccgggtcaggcatcgcgaggactattccttccctaacttccacatccacccctctgcgttctggccttcttgaaaatagaacagagaagaggaagaggatgatttccactggatctgagcttaatgaggattatcccaaggagaacgacagttcaagcaacaacaaagccatgacggatccgtctcggaagtaccttacaagctctcgggagaagcagttgagtctaaaacagagtgaggaaaaccgcacatcggggctcctgcctctgcaaagctcttccttctatggcagtagagcaggttccaaggagcattccagcggtggtacaaatctggacagaactaatgtatcgtcccagacaccatccgccaagcgtagcttgggtttcctgcctcagccggtccccctgtccgtgaagaagcttcgctgtaaccaggactataccggttggaacaaacctagggtcccgctgtccagccaccaacagcagcagctgcagggattctcgaacttgggcaatacttgctacatgaacgctatcctgcagtccttgttctctctgcagtcttttgcgaacgatctgctgaagcagggcattccctggaaaaaaatcccactcaacgctctaatccggcggttcgcgcacttgctggtgaagaaggacatttgcaatagtgaaaccaagaaggatctgctgaaaaaagttaaaaatgcgattagtgcaaccgcagagcgattcagtggatacatgcagaatgacgcacatgaattcctaagccaatgtctcgatcagttgaaggaggacatggaaaagctgaataaaacgtggaagaccgagcccgtctccggggaggaaaatagcccggatattagcgccacgcgtgcatatacttgtcccgttatcactaacttagagttcgaagtacaacacagcattatctgcaaggcatgcggggagatcatccctaaaagggaacagttcaacgatctgtctattgacttaccgcggcgaaagaaacccttaccccctcgaagcatccaggatagccttgatctctttttcagagctgaggagctggaatactcttgtgaaaaatgtggggggaaatgcgcactagtccggcacaagttcaaccgcctgccgagggtgttgatactccatcttaagaggtattcttttaacgttgctctgtcactgaacaacaaaatcggtcaacaggtcatcatccctcgctaccttactcttagctctcactgcaccgagaacacaaaacctccgtttactctagggtggagcgcccatatggcaatttcccgccctttgaaggcatcgcagatggttaacagctgtattacctcgccctctaccccttcaaagaaatttacctttaagagcaaatcctccctagctctgtgtttagactccgattccgaggatgaactaaaacgctctgtcgctctgtcacagcgcctctgtgaaatgctgggaaatgagcagcagcaggaggacctggaaaaggattctaaactatgcccgattgaaccggataagagtgaactggagaacagcggatttgaccgcatgagcgaagaagaactgttggcagccgtgctggagatatccaagagagacgcctcaccctccttaagccatgaagacgacgacaagcctacctccagtcctgatacaggctttgccgaagacgacatccaggagatgcccgagaatccagatacaatggaaacagaaaagcctaaaactatcacagagctggatccagcctccttcaccgaaataaccaaagactgcgacgaaaataaggagaataaaacccccgaagggtcacagggggaagttgactggctacagcagtacgacatggaaagagaaagagaagaacaggaactgcagcaagcactcgctcagtcgcttcaggaacaggaggcctgggaacagaaagaggacgacgacctgaaacgcgccaccgagctgagcctccaggagtttaataattccttcgtggatgcccttgggagcgacgaggactcaggaaatgaggatgtatttgacatggagtacacggaggctgaagccgaagagctgaagcggaacgctgagaccggaaatcttcctcatagttacaggttgatcagtgttgtgtcacatatcggctccacttcctcttctggtcattacatctctgacgtgtacgacattaagaaacaggcatggtttacctataatgacttggaagtgtccaagatacaggaggcagccgtgcaatctgacagggatagatctgggtacattttcttctatatgcataaggagatctttgatgagctgcttgagacagagaagaatagccaaagcttgtccaccgaagtgggtaaaacaacccgacaggccttgtag

SEQ ID NO: 13688 - DNA, 2940 bp, Artificial Sequence
  Description of Artificial Sequence: Synthetic coding sequence
atgagccctctgaagattcacggccccattcgaattcgatctatgcagacaggaataactaagtggaaggagggaagcttcgagattgttgagaaggagaacaaagtgagcctcgtggtgcactacaatacaggaggtatccccagaatcttccagctgtcccataatatcaaaaacgtggtgctgcgcccgtccggagctaaacagagccgccttatgcttactttgcaagacaatagctttctatcgatcgataaggtacccagcaaggatgctgaagaaatgagattgttccttgatgctgttcatcaaaaccggcttccggccgcaatgaagccgtcacagggatctggctcctttggggcaatcttggggtcccgtacgagccagaaagagacctcacgccagctgagctacagtgataaccaagccagtgcgaaaagaggatcattagagaccaaggacgatatcccattcaggaaggtgctgggtaacccggggcgtggatctatcaagactgtcgcaggctctggtattgcgagaaccataccaagtctgacatctacaagcacaccattgagatcaggtcttttggagaacagaaccgagaagcgcaaaagaatgattagcaccgggtcagagctaaacgaagattaccccaaggaaaacgactctagctccaacaacaaggccatgacagacccctccagaaagtatttaacaagttcaagggaaaagcagctgtccctcaaacaaagtgaggagaacagaaccagcggcctcctgccacttcagtcgtccagcttctacgggagccgggcaggcagcaaggaacattcatccgggggtaccaatcttgatcggacaaatgtatcatctcagacacccagtgctaaacgctcgttgggatttctcccgcagcccgtgcctttgagcgtgaaaaagctgcgctgcaaccaggattataccgggtggaataaaccacgcgtcccattgtcttcacatcaacagcaacaacttcagggctttagcaacctaggcaatacctgttatatgaacgccattttgcaaagcctgttttctctgcaatcctttgcgaacgatctgctcaagcagggcattccttggaaaaagatccccctgaatgccctgattaggcgatttgcccacctgctcgttaagaaggatatttgcaattctgaaaccaaaaaagacctgctaaaaaaggtcaagaacgccatctctgccacagcagagagattctcaggctacatgcaaaacgacgctcacgagtttttatcacagtgtctggatcagcttaaggaagatatggaaaagttgaacaagacatggaagacagagccagtgtctggcgaggagaattcacccgatatttctgccaccagagcctatacgtgcccggtgataactaacctggagttcgaggtgcagcacagcatcatatgcaaggcctgtggggagattatcccaaaaagggagcaattcaatgatctgtccattgacctgccacgaaggaaaaaacccctccccccccgaagtatacaggatagcctcgatctttttttccgggctgaagagctggagtactcctgtgagaagtgcggcggcaagtgcgcactcgtgagacacaaatttaatagacttcccagggtgctcattctgcatctcaaaagatatagctttaatgttgccctgagccttaacaacaagattggccagcaagtgatcattcctagatatctaacactgagttcccattgcacagaaaacacaaaaccgccgttcactctgggatggtccgctcacatggctattagtagacccctgaaggccagccagatggtgaattcctgtattacctcacccagcacacctagtaagaaattcacgtttaagtccaaatcatcactggcactttgcctggactctgattcggaagatgagctgaagaggtctgtcgccctgtctcagaggttatgcgagatgctgggaaatgaacaacaacaggaggacctcgaaaaagactcgaagctgtgtcccatagaaccagacaagagtgagctcgagaattcaggattcgaccgcatgtcagaagaagagctgttggctgcagtccttgagattagtaaaagagatgcgagtccaagcttgagccacgaggatgacgacaaacccacatccagcccggacactggctttgctgaggatgatattcaggagatgccggagaaccccgacaccatggaaacggagaagcccaaaactattaccgagttagatccagcctccttcactgaaatcacgaaagattgtgacgaaaataaggaaaacaaaacacccgaaggaagccagggagaagtggactggctgcagcagtatgatatggagagagagcgcgaagagcaagaactgcagcaggcgctggcacagtcgctgcaggaacaagaggcatgggaacaaaaggaggacgacgatttaaagcgcgcgaccgaattgagcttgcaggaattcaataactcatttgtggacgccctgggaagcgacgaggatagcggcaatgaggacgttttcgatatggagtacacggaagctgaagcggaagagctgaaacgcaatgcagaaacgggaaatctgccccacagttatagactgatttccgtggtgtcccatataggcagcacttcaagttccgggcactacatttcggatgtatacgacatcaaaaagcaagcctggtttacgtataatgacctagaggtatcaaaaatacaagaggcggccgtgcagtcagatcgggatcgtagcggatacatctttttctacatgcacaaggaaatattcgacgagctactcgagaccgaaaagaattcacagtctctctccacagaggtggggaagacaactagacaggctctctag

SEQ ID NO: 13689 - DNA, 462 bp, Artificial Sequence
  Description of Artificial Sequence: Synthetic coding sequence
atggcagaactgccccaccgcataattaaagaaacacaacggttgttagccgaacccgtgcccgggatcaaggcggagcccgacgaatctaacgccagatatttccatgtcgttatagctggcgagagcaaggacagtccgttcgaggggggcactttcaagcgtgaactgcttctggctgaggagtatccgatggcagccccaaaggtccgatttatgactaagatataccacccaaacgtggacaagctggagaggattagcctggacatcttgaaggacaaatggtcacctgctctccagatccgaaccgtgctcctgtccatacaggctctgctaaatgcccctaatcctgacgacccccttgctaacgatgtcgtggaacagtggaaaacaaatgaggcccaggctatcgagacagccagagcttggacccgactgtacgccatgaattccatttag

SEQ ID NO: 13690 - DNA, 1350 bp, Artificial Sequence
  Description of Artificial Sequence: Synthetic coding sequence
atggctgatggagaagagcctatggccgttgatgggggatgtggcgacacgggggactgggagggcaggtggaaccacgtgaagaaatttctggagcgctccggtccctttacacatcctgacttcgaacccagtacggaaagcttgcagttcttattggatacttgcaaggtgttggttatcggggcaggcgggcttggctgcgaattgctgaagaacttggccctctctggctttcgccagatccacgtgattgacatggataccatcgacgtgagcaacctgaaccgacaatttctctttcggcctaaggatatcggcagacccaaagctgaggtggccgccgaattcctgaacgatcgggtccccaattgcaatgtggtccctcatttcaacaaaattcaggactttaatgacactttctacagacaattccacattatcgtctgcgggctggattccataatcgcacgtcgatggatcaatggtatgttgattagcttacttaactacgaagacggggtgctcgaccctagctcaatcgtaccccttattgatgggggcaccgagggctttaagggtaatgcccgcgttatattacctggtatgaccgcatgtatcgagtgcactctggagttatacccgccacaagtgaactttcctatgtgtactatcgcctccatgccaaggctgccagagcattgtattgaatacgtgcggatgctgcagtggccgaaagaacagccctttggggaaggggtccctctcgacggcgacgaccctgagcacatacagtggatttttcaaaagagcttagaaagggcctcccagtacaatataaggggcgtgacataccggcttactcagggcgtggtgaaaaggattatccctgccgtggctagcaccaatgctgtcattgcagccgtgtgtgcaacggaagtgtttaagattgctacttcagcatacatccctcttaataactacctcgtgtttaatgacgtcgacggactgtatacctatacttttgaagcggagcggaaggaaaactgtccggcctgttctcaactcccacagaatatccagttttcgccttcagccaagctccaggaggtgctggattacttgactaactcagccagcctccaaatgaagtcccccgctatcaccgctaccctagagggcaagaacaggacgttgtatctgcagtcggtcacttcaattgaagagaggacaaggcccaatctgtccaagacattgaaggaactgggcctggtggacggacaggaactcgctgtcgctgatgtgacgaccccccagacagtgcttttcaagctgcacttcacctcctag

SEQ ID NO: 13691 - DNA, 1392 bp, Artificial Sequence
  Description of Artificial Sequence: Synthetic coding sequence
atggctgatggtgaggagcctgaaaaaaagaggcgcagaatcgaggaactgctggcagagaaaatggccgtggacgggggatgtggggatactggggattgggaagggcggtggaaccacgtcaagaaatttctagagcgctctggaccctttacacacccggatttcgaacctagtactgaatcattacagttcctgctggacacttgcaaggtgttggtgataggcgctggcggcctgggttgtgaactcctgaaaaatttggccttgtctggtttccgccagatccacgtaatcgacatggacacaattgatgtaagcaatttgaatcggcaatttttgtttaggccaaaggacatcgggaggccgaaagcagaggttgcagccgagttcctgaacgacagggtgcccaattgtaatgttgtccctcactttaataagatccaggatttcaacgacactttctacaggcagttccatatcattgtgtgtgggctggatagcattatcgcacggaggtggatcaacggtatgcttatcagtctcctgaactacgaagatggcgtgctcgatccatcctctattgtgcctctgatcgatggtggcaccgaagggttcaaggggaacgcccgtgttatactcccgggtatgaccgcttgtatcgaatgtacactggagttgtatcctccacaagtcaatttccccatgtgtactatcgcctccatgcctcggctgcctgagcactgcattgagtatgtgcgcatgctgcagtggcccaaggagcagcccttcggggaaggggtgccattagatggggatgaccctgagcacatccagtggatcttccagaagtccctcgaaagagcctcccagtacaatattagaggagtcacatacaggctaactcagggcgtggtcaagaggattataccagctgttgcctccactaatgcagtcatcgcagcagtgtgtgccacagaggtgtttaagattgctacctctgcctacatccctttgaataattacctcgtattcaatgatgtggacggcttgtatacctatacttttgaggctgagagaaaggagaactgtcccgcatgctcacagctacctcagaacatacagttcagtcctagcgcaaaactgcaagaggtgctcgactacctcaccaactcagcctcacttcagatgaaatccccggcaatcacagccacgctagagggcaagaacagaaccttatatctgcagagtgtgacatctatcgaggagcggacacgcccaaacttgagcaagacattgaaggagttgggcctggtggatggccaggaactcgctgttgctgacgttacaacacctcagacagtactgttcaaactgcacttcacctcatag

SEQ ID NO: 13692 - DNA, 861 bp, Artificial Sequence
  Description of Artificial Sequence: Synthetic coding sequence
atgctcatttcactcctgaattatgaagatggcgtcctagatccaagctctatcgtgcctctcatcgacggcggtaccgaaggtttcaaaggtaacgcccgtgtcatcctcccaggaatgacagcttgcatcgaatgcactttagaattataccctccccaggtgaactttccaatgtgcactatagccagcatgccccgactgccagaacattgcattgagtacgtccggatgctccagtggccaaaagaacagccttttggggaaggggtgcccttggatggagatgatcctgagcacatccagtggatcttccagaagtcccttgagcgggcatcacagtacaatatccgaggggtgacctaccgtctcacacaaggcgttgtgaaaaggattattcccgctgttgcttcaacaaacgcagtcattgcggctgtgtgcgccactgaagtctttaagatcgccactagtgcctacataccgttgaataactacctcgtgtttaacgacgtcgatggcttatatacctacacctttgaagctgagcgtaaggagaactgccccgcttgtagccagctgccacagaacattcagttctcaccatccgccaagctgcaggaggtgctggattacctgaccaactcagcttcactccaaatgaaatcacctgccattaccgccaccctggaggggaaaaacaggacactgtatctgcagtcagtcacctccattgaagaacggacgcgaccgaacctgagtaaaaccctcaaggagctcggtctggtggacggccaggagctggccgtggccgatgtgaccaccccgcagaccgtgctttttaagttgcactttacttcttag

SEQ ID NO: 13693 - DNA, 2409 bp, Artificial Sequence
  Description of Artificial Sequence: Synthetic coding sequence
atgtggatacaggtgcgcacgatagacgggtcaaaaacctgcactatcgaagatgtgtcccgcaaagccaccatcgaggagctcagggaaagagtgtgggctctcttcgacgttaggcctgaatgtcagaggcttttttaccggggcaaacagctggaaaatgggtataccctctttgattacgacgtgggattgaacgatatcatccagctcctggtgcgaccagaccctgaccaccttccagggaccagtacacagattgaagcaaaaccctgtagcaatagtccccccaaggtgaagaaagcgccgagagtggggcccagtaatcagccgtcaacaagcgcccgggcacgccttatcgatcccgggttcggcatctataaagttaatgagctcgttgatgcccgtgacgtcggccttggcgcgtggttcgaagctcatattcactcagtgaccagagcctccgatggacaaagtcgaggcaagactccactgaagaacgggagttcttgcaaaaggacaaacgggaacatcaagcataagagtaaagagaataccaataaattggacagtgtgccaagcacatcaaattccgactgcgttgccgctgatgaggatgtcatctaccacatccagtacgacgagtacccagaatctgggacgctcgaaatgaatgtcaaggacctgcgacctagggcacggaccatccttaagtggaatgaacttaatgtcggcgacgtggtgatggtcaactacaacgtcgaaagtccaggacagaggggcttctggtttgatgctgagatcaccacacttaaaaccatctcgcggactaagaaggagctacgcgttaagatcttcctcgggggtagcgaagggacgttaaacgattgtaaaatcatcagtgtggatgagattttcaagatcgagagacctggggctcatccactgtcgttcgccgatggtaaattcctacgcagaaatgatccagagtgcgacctctgcggaggcgaccccgaaaagaaatgccattcctgttcatgccgagtgtgtggtggcaagcacgagccaaatatgcagcttctatgcgacgagtgtaatgtggcttaccatatctactgcctgaatccgcctctggataaggttcccgaggaagaatattggtactgcccgtcatgcaagaccgattccagcgaggtcgtcaaagccggagaaaggcttaagatgtcaaagaaaaaggctaaaatgccaagcgcttccacagagagcagaagagattggggtaggggcatggcctgcgttggccggacacgtgagtgcacaattgtaccttctaaccactacggtcccataccaggaatccctgtcggtagcacttggcggtttcgtgtacaggtcagcgaggctggcgtacacagacctcatgtgggcggtattcacgggcgatctaacgacggagcctatagcctagtgttggctggaggattcgccgacgaggtggaccggggagacgagttcacttacacagggagtggcggtaagaacttagctggcaacaaaagaattggagctccaagcgccgaccagaccctgactaatatgaatagagccttggctctgaactgtgacgcccccctggacgataagattggcgccgagagcagaaactggagagccggaaagcctgtgagggtgattcgctcttttaagggcaggaagattagtaagtacgccccggaagaaggaaatcgttacgacggaatttacaaggtcgtaaagtactggcctgaaatttctagttcccacgggtttctcgtgtggagatacctcttaagacgagatgatgttgaaccggccccttggacatctgaaggaattgagagatccagaaggctctgccttagactgcagtaccctgctgggtatccctctgacaaggaggggaaaaagcccaaaggccagtcaaaaaagcagccgtcggggaccacaaagaggccaatatctgacgatgactgcccctccgcgtccaaagtgtacaaagccagtgactccgctgaagccatcgaggctttccagctgactccccagcagcaacatcttatccgcgaggattgtcaaaatcagaaactatgggatgaggtgctgtcacatctggtggagggacccaacttcctcaagaagctagagcaatccttcatgtgtgtgtgctgtcaagaactagtgtatcagccggtgaccaccgaatgtttccataatgtgtgtaaagactgtctgcagcgctcttttaaggctcaggtcttttcttgccctgcctgtcgtcacgaccttggccagaattatatcatgattccaaacgagattcttcagactctcttggacctgttctttcctggttactccaaggggcggtag

SEQ ID NO: 13694 - DNA, 411 bp, Artificial Sequence
  Description of Artificial Sequence: Synthetic coding sequence
atgtggatccaggtgagaaccattgatggatctaaaacctgtacaatagaggatgtctctagaaaagccacgattgaagaactgcgtgagcgtgtttgggctctcttcgacgttcgacccgagtgtcagcgactgttctatagaggtaagcaactggagaacggatatacactattcgactatgacgtgggcctgaacgacattatacagctcctcgtcaggccagacccggaccaccttccaggcactagcacgcagattgaagctaagccgtgtagtaactctcctcctaaggttaagaaggccccccgagtggggccatcaaaccagccttccaccagcgcccgtgcgcgattaatcgaccctggctttggcatctataagggactggctttaagccccagactctag

SEQ ID NO: 13695 - DNA, 339 bp, Artificial Sequence
  Description of Artificial Sequence: Synthetic coding sequence
atgaacgtgaaagacttaagaccccgggcgaggacaatcctcaagtggaatgaacttaatgtgggcgacgtagtgatggtgaactataacgtcgagtctccaggccagagggggttttggtttgatgccgagatcacaaccctgaagacgatctctcgcacgaagaaggaactccgcgttaaaatcttcctgggggggtcagagggtacactgaatgactgcaagattatttctgtcgatgagattttcaagatcgagaggccaggagcccacccgctttcgttcgcagacgggaagtttcttcggaggaacgatcctgaatgcgatctgtgcggctag

SEQ ID NO: 13696 - DNA, 897 bp, Artificial Sequence
  Description of Artificial Sequence: Synthetic coding sequence
atgggtcctaaagacagtgccaagtgtctgcacagggggcctcaaccaagtcattgggctgccggcgatgggccaactcaagaacgatgcggtccgaggagcctaggatcccctgtcttgggattagacacctgtcgtgcctgggaccatgtggatggtcaaatcctgggccagctgcgccccctcacggaggaggaagaagaggagggagctggcgcaaccctatccagaggacccgcatttccggggatgggcagcgaggagctgcgactggcctcgttttacgactggccgctgacagccgaagtccctccagagctgctggccgccgctggattttttcatacggggcaccaagacaaggtaagatgctttttctgttatggcggcctgcagtcgtggaaacggggcgatgacccttggacagaacacgccaaatggtttccctcctgccaattcctcctgcgctcaaagggtagagatttcgtccactccgtgcaggagacacactctcagctcttgggctcctgggatccatgggaagaacccgaagacgcagccccagttgcaccaagcgtccccgcatccgggtatccggagctgcccacccccaggagagaagtgcagtccgagtccgcacaggagcccggcggtgtcagtccagctgaggcccagcgtgcctggtgggtgctggagccaccaggtgcaagagatgtcgaagcgcaattgcgccgtttgcaagaagagcggacatgtaaggtgtgcctggaccgcgcagtctctatcgtcttcgtgccttgcgggcacctcgtgtgcgcagagtgcgcccctgggctccagctttgcccaatttgcagggctccagtgaggagccgcgtgagaacctttctatcttag

SEQ ID NO: 13697 - DNA, 1464 bp, Artificial Sequence
  Description of Artificial Sequence: Synthetic coding sequence
atggttatcaacttgtgccttccacaattccggcctagaatccattgcaataagatcagcgctgatggctatgaagtcgagaacctaatttccgaggacctgactaaaaggtcccacggcttccgcactgagtattttatcaaacccccggtctatgttactgtatcttttcctttcaatgttgaaatctgtaggattaacatagatctgaccgcaggcggcgggcagaacgttactggactggaaatgtatactagcgcctcaagcagcagagtgtcatggaatactccacagtgcagaaccctgggcccggctgagccttcagttccggacaaggaggcattcaccctggttggtaaagtgctcctgaagaatcagtcacaagtcgtgttcagccacagggggtttaaagcccgccccccattcggcgcaatggaggccaccttgccttcccctgctgtggtcgcacaggaattatggaacaagggggccctcagcctttcacacgtggcacatctgaggatttgtatcactcacgtaactgggggaggcatcccctgcataaagagactggaagtttggggccagccggcaaaaacctgtagccaggaggtgattgattcaatccttttagttacctcagaaaacctgcctcaggacgtggccttgcaggctcctgcactgccaatggagtcggactgtgatcccggtgatcagcctgagagtcaacaggcaccatcatcgctgcagaaactggccgagataatccaggacgttccagaagagttcctggaccctatcaccctggagatcatgccttgtccaatgctgcttccctccggaaaagtgattgaccagtccaccctcgagaaatgcaatcgctcagaggcaacatggggtcgtgtcccaagtgatccatttactggtgtggcattcacaccacattcccaacctcttccacacccgtccctgaaagcgcggatagaccactttctgctgcaacacagtatccccggctgtcacctgctcggccgggctcagactgcactggcggtgattccgtccagcattgtcctgccgtctcagaaaaggaagattgagcaggctgaacacgtgcctgactcgaatttcggcgtcaatgctagttgcttttctgcgacctctccactagtgctccctaccacatccgaacacacagcgaagaaaatgaaagcaacaaacgagccatcactgacacacatggattgcagtaccgaacaacccggcagcatcctcggacccgagtgtgcaagttgtaaaagggtgtttagcccttatttcaagaaagagcccgtataccagctcccatgcggccacctcttgtgtcgtccctgcctgggtgaaaagcagcgtagcctgcctatgacctgtaccgcatgccaacggcccgtggcgagccaggacgtgctgagagtccatttctag

SEQ ID NO: 13698 - DNA, 267 bp, Artificial Sequence
  Description of Artificial Sequence: Synthetic coding sequence
atggtaattaacctctgcttgccccagttccggcctcggatccattgtaacaagatttcagcagacgggtacgaagtggaaaacctgatttcagaagatttaacgaagcgttcacacgggttccgcacagagtactttatcaagcctcctgtctatgtaaccgtctcctttcctttcaacgtcgagatttgccggatcaatattgatctgactgctggcgggggccaaaacgtgaccggactagaaatgtacacaagcgcctcctag

SEQ ID NO: 13699 - DNA, 1605 bp, Artificial Sequence
  Description of Artificial Sequence: Synthetic coding sequence
atggccagaggtctgcaagtgcccctcccgcgactggccactggccttctactccttttgtctgtgcagccctgggctgagtctgggaaggtgctggtcgttcctacagacggctctccttggctgtccatgcgagaggctctgcgggaactgcatgccaggggtcaccaggctgtggtacttactcccgaagtaaacatgcatattaaggaggagaagtttttcacgttgacagcgtacgcggtgccatggactcaaaaggaatttgatagagtcaccctgggatacactcagggattcttcgaaaccgagcacctgctgaaacgttactccagatccatggccattatgaacaatgtgagcctggccctgcacagatgctgtgtagagttgcttcataacgaggccctgatcaggcatctcaacgctacttcttttgacgttgtgctaaccgaccccgtcaacttatgcggggcagtgttggccaagtatctatcgattcccgcagttttcttctggcggtatattccctgcgacttagacttcaaaggaactcaatgccccaatccctcttcttatattcctaaattgctgactacgaattctgaccacatgacctttctgcaacgagtgaaaaacatgctgtacccactcgccctctcttatatctgccacacattcagtgctccttatgccagtctcgcgagcgaactgttccagagggaagtcagtgtagtggatctggtttcttacgcgagcgtgtggctctttcggggagatttcgttatggattatccacgcccaatcatgccaaacatggtttttatcgggggcattaactgcgcaaacggcaaacctctcagccaggaattcgaagcttacataaacgctagtggcgaacacggtatagtagtgttctccctggggtccatggtttctgaaatcccggaaaagaaagcgatggctatcgccgacgccctggggaagatccctcagactgttctgtggcgttacacaggtactcggccttcaaatttggccaataataccatcttagtcaaatggctgccacagaacgacctactgggccacccaatgacaagagcattcatcacccacgctggctcccatggggtttacgagtcgatttgcaatggagttcctatggtcatgatgccactcttcggagaccagatggacaacgccaaacggatggaaacgaaaggggccggcgtaacattgaatgtcctggagatgacttcagaagacttggaaaacgcgctcaaggccgtcattaacgacaaaagctataaagaaaacattatgagactctcctctttacataaagacagaccggtggagccgctggatctcgcggttttttgggtcgagttcgttatgaggcacaaaggtgctccacatctgcgtccggcagcccacgacctcacctggtatcagtaccatagcctcgacgtgatcggcttcttacttgcagtcgttctcactgttgccttcatcactttcaaatgttgtgcctatggctacagaaagtgtctcggtaagaaagggcgagtgaaaaaagcccacaagagtaagacgcattag

SEQ ID NO: 13700 - DNA, 1596 bp, Artificial Sequence
  Description of Artificial Sequence: Synthetic coding sequence
atgatggacggccggctcttggagcaccctcacgcacagttcgggggcagtttgggcggcgtggtgggatttccgtatcccctgggtcatcaccacgtgtatgagctggccggtcaccaattacagagcgcagcagcagccgcttcagtgccattctccatagatggccttctgggagggtcctgtgcagccgctgcctcggtagttaatcctacccctctgctacccgccgcttgcggtgttggcggagacgggcagccctttaagctgtccgattccggggatcctgataaagagagtcccggctgcaagcgccgaagaacacgaacaaatttcacagggtggcaactggaagagttggagaaggccttcaatgagtctcactatcccgacgtgtttatgagagaggccctggccctgaggctagatctggtggaatcccgggtgcaggtgtggtttcaaaatcgaagagccaaatggagaaagaaggagaatacaaagaaaggtcctggccgccccgcacacaacagccatccgacaacatgcagtggggaacccatggatcccgaggagattgcgagaaaggaattggaaaaaatggaaaagaaaaaaaggaaacatgagaaaaagctgcttaagagtcagggccgccacttacacagtccgggggggttgtcattgcattcagccccatcatccgattcggactccgggggaggaggtctcagccccgaacccccggagccgccccctcccgcagcaaaggggcccggtgcccatgccagtggcgccgccggaacggctcccgcacccccaggggagccacctgctcctggcacttgtgatcctgctttctacccatcacaacgttccggtgcgggcccacagccacggccaggcagaccagccgacaaagacgcagccagctgcggccctggggcagcagtggctgctgttgaacggggagccgctggcctcccaaaggcatcacccttctctgtggaatctttgttgtccgatagcccccctcggaggaaggcagcatcaaacgccgctgcagccgctgctgccggtctggacttcgcccctggccttccttgcgctccaagaaccctaatcggaaagggccacttcttgctgtaccctatcacccagccactgggctttttggtcccccaggcggcgctgaaaggcggcgctggacttgagcccgctcccaaagacgcccctccggcaccggcagtgccacccgctcccccagctcaggcttcttttggagctttctctggccccggaggcgctcctgactccgcttttgcccggcgctctcctgatgctgttgcaagccctggagcaccagccccggctcccgccccctttcgagacttggcctccgccgccgccacagagggcggcggcggcgactgcgcggacgctggaactgctggacctgccccgcccccacccgcaccatcaccccggccgggtccgagacccccgagtcccgccgaagagcccgccacctgtggagtccccgagcctggtgcagctgccggtcccagtccacccgagggcgaggaactggatatggactag

SEQ ID NO: 13701 - DNA, 255 bp, Artificial Sequence
  Description of Artificial Sequence: Synthetic coding sequence
atggccctctccagccagatctgggccgcctgcctcctgcttttgctgctactggcctcgctgacctctggtagtgtgtttccacagcaaactggacagctcgccgagttgcaacctcaggatcgagccggggctcgggcctcctggatgcctatgttccaaaggagacgccgccgagatacccatttcccaatatgcatcttttgttgtggctgttgtcataggagtaagtgcggcatgtgttgcaagacatag

SEQ ID NO: 13702 - DNA, 840 bp, Artificial Sequence
  Description of Artificial Sequence: Synthetic coding sequence
atggacatgctggacccggggctggaccctgctgcctctgctacagcagcagcagcggcttcgcacgataaagggcctgaagcagaggagggggttgagctgcaggaaggcggggacggccctggggctgaagagcagactgccgtggcaataacttccgtgcagcaggccgcctttggagaccacaatatccagtaccagttccgaacggaaactaatggcggccaggccgttatacagaaccctttctccaatggaggtagccctgccgccgaggcagtgtcaggagaggcacgctttgcttactttccagcttccagcgtcggcgacacaactgcagtgagtgtgcagaccacggatcaaagcctccaggcgggaggacagttctacgtaatgatgacccctcaggacgtgttgcaaacgggcacccagagaaccattgcgcctcggacacacccctattcacccaaaatagacggcacccgcacccctcgggacgaaaggagaagagcccagcataatgaggtggagcgccgtcggagagacaaaatcaataactggatcgtccagctgtctaagatcatcccagattgtaacgcagataacagcaaaaccggcgcgtccaaaggtggtattctctcaaaggcatgcgactatatccgcgaattacgacagacaaatcagagaatgcaagagacatttaaagaagccgagcgcctgcaaatggataacgaactgctccggcaacaaattgaggagttgaaaaatgaaaacgcactgctcagggcacaactccagcaacacaacttggaaatggtgggagaaggcacccgacaatag

SEQ ID NO: 13703 - DNA, 648 bp, Artificial Sequence
  Description of Artificial Sequence: Synthetic coding sequence
atggatatgctggatccggggctggacccagcggcgtccgcaaccgcagcagcagccgcctcacacgataaaggcccagaggccgaggaaggagtcgagctccaggaaggcggcgacggaccaggggccgaggaacaaactgcggtagccataactagcgtgcaacaagctgctttcggcgaccacaacatccagtaccagtttaggactgaaaccaatggaggacagactggtacacaaagaacaatcgctcctagaacccatccatatagtccaaaaattgacggcactaggactcctagggacgaacgcaggagggcccagcacaacgaagtggaaagaagacgacgggataagatcaataattggattgtccagctcagtaagatcattcccgattgcaacgcggataactccaaaaccggggcttctaagggaggcatactttcaaaagcctgtgactacattcgggagctcagacagactaatcagcgaatgcaagaaacattcaaggaagcagagcggctgcaaatggataatgaactcttgcggcagcagatagaggagttgaagaatgagaacgcccttctacgtgcccaactgcagcagcataatctggaaatggtcggtgaaggaactagacagtag

SEQ ID NO: 13704 - DNA, 6816 bp, Artificial Sequence
  Description of Artificial Sequence: Synthetic coding sequence
atgggcgtgccaaagcgcaaggcatccggcggccaggatggagctgctagcagtgccggcgccgcgaaacgcgctaggaaggaagagctcactggggtcaggtttaaggcacagcttaaggacccccagggccctgggcctggactcgaagcatttgtgagcgctgccaagaagctccctagagaagatgtctacgatgtagttgaggggtatataaagatttcagtggagtgtgtggaaatattccaactgttgagtggcgaaaagagaccagagtccgagaccatgctcatattccaggtattcgaagccatccttctccggaccgcaagcgatttaagccacttccacgtggtcggcacgaacattgttaagaaactgatgaacaatcatatgaaacttatctgcgagagcctttacgcgtccggatatagactagccagggcatgcctgtccctgatgaccgcgatggtaacccagggacctgaggccgctcgggatgtctgttcccacttcgacctgaacaagaagaccctctacacactggtgaccaagcgtgatagcaagggagtgtacgacgttcggcaagcttacgtgcagttcgctctctcgttccttatcgcaggggatgattctactattgtgcaggtattggaggtgaaggagtttattccctgcattttctcctccgggattaaggaagacaggatttccaccatcaatattcttttatccaccctaaaaaccaaggtcgtgcataataagaacatcacaaaaacccaaaaggtgagattcttcacagggcaactgctcaatcatattgcttctctttataattggaacggaataaccgacgtgaatcccgaaaacgtaaaggtgagtgctgaggaagcggggaagacgatggttagggagctagtccacaatttcctaatggatttgtgttgttccctgaaacacggcataaatttctacgacgcatccctgggcacattcgggcgaggcggaaatctaactctgctgcactttctgctgggcttgaaaaccgccgccgacgatgacctcgtggccgacttggttgtgaacattctgaaagtatgcccagatctgctaaacaaatactttaaagaagtcactttctctttcatcccacgggccaagagcacctggcttaacaatattaagctgctgaataagatctatgaggcacaaccggaaattagcagggcctttcaaactagagaatttattccgctacccaggcttctggccatggtgatggtcaccaccgtgcccctcgtgtgtaataagtctatgttcactcaggctttgaacctcgactctacctccgtgcggcacactgccttgtcccttatctccgtaatcctaaagagggcccttaaaaccgtagaccattgtcttaacaaagaggtctggcaggaaagtggcgtgtatactgccgttatgatggaagagtttgtacagttgttcagagaagctctatccaaaatcctgcccgatcttaacaccgtagtttgggtgtggcagagtctcaagaaacaggagacaaaacaggacgataaaaaaggacagaaaagatcagacgggcctcccgcagcttgtgatgctcaccagtgcgatgatgcagagacgattctactgaaagcagtgctgcttcaagtcatctgtctgtatcaaaaggttgtgccacatgttgtaatgcagtacaatttcgacttctctaaactgttgaaaggagtcatttctgaacagggactgagagaagaggttcctcccatcctccagcatcacatgcttaaggtagccctggagctccctgcctccaagtttctgtggctgaaagctcaagaaggaccggacgcggagatcattggtggggaaaggagcgtgttttacctcctcatgaagatgtttgtgacctcatctcacctccagctaaagagtctcaccaagctcctgattatgaagatactgcgcgacacgggggtgttcgaacatacttggaaggagttggagttgtggcttgagcacctggagaacacaatggaggaggacaaggagacagtgatccagtttcttgagcggattttgctgacccttgtggccaatccatacagctatacagataaggcctccgacttcgtgcaggaagcttctatgttgcaggctactatgaccaagcaggaggctgatgacatgtctataccaatcagtcacatagacgatgtacttgatatggtggacgtgcttgttgaaggctccgagggcctggacgaggaaattgggttcacactttctgaagatatgattctactgactttcccgtttagcgctgtggtccccgctgcactagaagcaagaaacaagctgcttttagggacaggtaatgaggccgccgagaatgtggtaacctacctgactgcagttctcacagacctgctccacacacagagagacccacttgctctctgcttattgctacaggcctacgacaaactagagccaccctgtctcgtcccatgctgtcagcagctgtctaggttcaatagatactactccctctggattcccgaacaggctcgcgaggcttggctcctgcaggcccaagggagcccctcccctcctgccctgccgcttgcgagctcttttaccgcactgctccaggccgcatacgagtcccaagccctccgcgacgagcatatccaggtgcaactgcaagcaaccatgcctcacctcagcatgcagcaggtacttctagcagcgaagcaggtgttgttgtatctgcggtcgacagtcgagaactttggccagctcggacggtctgtcggccctcctttgctgcagttattcctggatttactgaggaggctggtggtgcactgtgaacagttggatgcccagaatcagcaacgatgcgaggccgctcgggccgaagccgacctgttcctggacatggaaagcgtcgccagcttagaacttgcgaatgaccagaccttagaagaggtgctagtcgctatcctgagacaccctactttagagggatggtttctagcgctcgaacagcaagctcttcccccccacaccctgagtccagttctcgtcaagctgctggcaacccacttctcagccggcgttttacagcttctggctgcttctgcacccatcctccagaatattggacaattgggccttctggcccggtatagtgaggccattactcaaagtgttctcaaggaattacagaatcgccgtgcagggccggcaacatccccgcctaagacacccccccagttggaggcactccaggaactgcatccttatatggagggcgcacagttgagagaggttactttagctctgctttcactacccgagactcatcttgtgacgcaacagccaaccaaatctccgggcaaggaacgccacctgaacgcactcggaaaaaccttggtgcagttacttacgtgctcaccacaggaccagctccagagtggagaacttttgtggagctccgagtacgtcagagggctgggcgcactgttgccgaccctcgccgtcgatgagctggataccgtgctgctccatactcttcagcgggatccagtgctggctcccgccgtgggcgcggacctcctagattactgtttagcccgccggactcaggctgcactgagtattgccgcgctcctattacaggagtcctgtacccacctcctgtggttcgagcagtggtgcctgcaagccgggccaggtctaggcctgcagggagacctggatgattttctcccccttatccacgtctacctgcagtgccggacgcggtctcacttcacccgccccgcaggtgtgagtagcgcagtaatccccgtgctgcgcaagacgttgtggaggcagctccagagccgcctgttgagtacagattctcccccagccagtgggttgtatcaggagatactggcccagctggtgcctttcgccagagcgaaagatctgtcagtcctcatggatcggcttcctagtctgctgcatacccctagtagtcacaaacgatggatcgtggctgattccatctccgcagcactagaaggatctgccgaagagctttgcgcctggcggcgaactctgctggaaagctgcgtgaagtggctgattgtcagcttttccggcgggcagcaggacgatgacaacactcaaaatcaggagaaagaaatgttgctgcgtctcaatgcactattacatgctttgaacgaggttgatcctggagattggcagaagttcgtgaagaaagggctaaaatttaggtaccaggaccacaccttcctgaagatgctcctcaccgccgttcaacttttgtactcacccgagtcatctgttagaaccaagctgatccaactgccagtggtctacgtaatgttaatgcagcactcacttttccttcccacgcttctgactagtgacggtgaagaatcccccgattcccaggtgaaagaggctctggtggacctgatgttaactgtcgtggagatgtgcccgtccgtatgtgaatcctcacatttcgccgtcttgctgggtgcctacggagccactctgagtgtgctcgaccaaaaaattcttttactactcagggcctacgaacagaacaaactgtctcttatcaactttagggtgttgttgtggggcccagctgctgtcgagcatcataaaacatgccggtccttgggccgatctctgtggcagcagcctagtgtgggcgatattctgcgactgctggatcgcgaccggatgatgcagacaatcctacactttcctcagaatcggcgcctgctgccaccggaagacacacaggagctaatcttcaaagacaagagcagagtagacctggacggcctgtacgatccatgtttcctccttcagttattctcagagttgacaagacccgagtttgtcgtcgattgccgcaaattcctggatagcaacgctttaggccttaccgtcacagccctgtccagttacgatccccagatgcgggcaatagcgtatcatgtgctcgctgcctactattcacatcttgagggcgcgcgatttcaggaacagtcccagctgttatatctgcttgacgtggtgcgaaacggtatcaggacacaggacatgaggctgaccttcacgttggctctcttcattgcaaaggccgctctgcagatcctcaaacctgaagagcatatgtacttgaaggtctccaatttccttcttagccacgaataccttaacatggacaaggttcctgggttttaccaattcttttatagcagtgacttcgagcagaagaccgaacagaaatgggtgttcggtgttctcaggcagggcataagggataaacaatgttacgagctgtgcgcgagacgaggcatctttcatatcatactgagcttctttcatagtcctctgtgtgacgaagccgcacagaactggatcctggagatcttacagaacgccgctcaggttgctcgctccgcgtacgagataatacgagattactccttgctgacctggatcctacatatcctggaaagcaagtttctggagacgccattattgtcaaatgtaataagtttgctgcacaccctgtgggtcacaaatttgggggataaagccgtggaatgggagtctcaaagattatgccagcccagttcccaagaaccggccaaacggcttgccctacatctggtgaacgagtttctgtacgtactcatagttcttatgaaacacttgaggcctacgcttgcccccgtgcagctgacaaacttcttcggaaccctggatagcgtgctccggtatagagctactgtaatccaggcattcagagacatgaacagatttaccgtaaatgagacagtgctaagcaccaaggatgtcctagtgctactgcataaatggagtctgatagagcgagacttgaaactccaggaagaccttcgggccgccatcgagaaagcacaggcgcgagagttgatgaaaatgctgaaggataagaataagcccgttatgcctgccagggcgaaaggacctcggggccggaagaggcgccctggcgaggctgaagagatggcggaccctgaattgatggcctccactcttgaaacttgtaaggggttgctccggtccattctgacgtactggcgcccagttattcccggccccgatcccacacaagagcctgtggactccgcgtctccagaaagcgacgctcccggacctgtgtatgctgccgcctcacttgcggtgagttgggttctcaggagcgtagcggaacatccgctatccagggctgaggccgccggcctgatcggatggcttaaatcccacatcttaccacacccagtagtagtggccgatctgcttaaagattcagccgtccgaagttctatctttcgcctatatagtcggttatgtggagctgagggactcgccgggccagtgcaggaagtggcctgcctcttcaacactgtgatgttacagttagttgctgcacaaggccgagccggctctccttttcatcccgcaatggaagccctttccctcagcagcttgtctgagaaggacgaggccacacaggcgtccgctgcattccttgtgagtttgtacatcaaagacatctggctaggtgctcagcgacctgacacacttctaacgcacgtacgcatggtttgtgaagctgccgatgatgccccttcctcggaggaggaggccatcgtggtcctgtgtaaagatgcagcgagtgcagctagtgacgcatag

SEQ ID NO: 13705 - DNA, 4575 bp, Artificial Sequence
  Description of Artificial Sequence: Synthetic coding sequence
atggcagctgtttattctggcatttcattgaagctgaaatctaaaaccacatcatgggaggacaaattaaagctggcccattttgcctggattagccatcagtgcttccttccgaataaggagcaggtactattggattgggctcgtcagtccctggtcgcattttacaaaaagaagctagagctcaaggaggacatcgtcgagaggttgtggatatatatagataacattttgcacagtcgaaaattgcagaacctgctcaaaaacgggaagacaatcaacctccagatctccctggtcaaaatcattaatgagagggtcgccgaattctcattgagcggttcacaacgaaatatttgcgcagtgctgcgatgctgtcagggcatactttctacaccagccttggcagtaatctacactgccaagcaggagcttatggtggctctgctaagtcaactatgttggtccgcctgcaggcaacctgaaggcgccgtcgtggctcagctgttcgaggtaattcacctggcattgggtcactacttgctcatcttgcagcagcaggtgaacccacggcgcgccttcggtgatgtcaccgcccatctgttacagccctgtctcgtgttgagacatttactgagtgggggtacgtggacacaggcaggacaaggccagcttagacaggtactgagcagggacataaggtcccaaatcgaagccatgtttcggggtgggatttttcagccggagctgctgtcatcttacaaggagggcctactggaccagcagcagggcgacgtcaaaacaggcgccatgaagaatctactggctccgatggataccgtcttaaacaggctggtagatgccggttattgtgccgcctcccttcacacctccgtggtggccaactctgtcgctctcctgtacaagctctttctcgattcatattttaaagaagggaatcagctgttatgtttccaggttctacccaggttatttggctgcctaaagatctcccacttgcaggaggagcaaagtaaagccctttctacttcagactggaccactgaactgctagtggtcgaacagctgctcaattcggtggcaaacaataatatttacaacattgctgctgacagaatcaggcacgaagaggcccaattcaggttttaccgtcatgtcgcagagctgttaattaaccatgcacaggcgcccataccagcctggtttcggtgtctaaagaccttgatcagtctgaatcaccttatccttgaacccgacctcgatgatcttctggctagcgcatggattgatgctgaggtgaccgagtttcgaacgaaaaaggcccaggaagcattgatccggaccgtgtttcagacttatgccaaacttcgccaggttccaaggcttttcgaggaggtcctgggggtcatttgtcgaccagccgccgaagcgttacgacagcccgtgttagccagcgggcccagcaccgtattgagcgcctgtctattagagttgcctccttcgcaaatccttgatacgtggtccctggtgcttgagaagttccagagcttagtgttaccataccttcagtccgacgccgacatggccctcaagtctctgtccttgagtctactgctacactgtattatgttcaacatgagatcactggactcttctacccccttacccatagtaagaaggactcagtgtatgatggagagaatgatgagggaactggtgcagccattgctggccctgctgcccgacacacccggtccggaacctgagctctggctgcagaaagtttctgattccgtcctcttgcttagctatacatgggcccaggtagacgctatgttctcccttaactgctcccaataccattctatgtccgggcccttgataggcgtggcactggagatttccaatttgccctcccttttgcccggggtcaagacccagcactggaaaaaaattgagaagttcacagcccaattttcttccctcggaacctactgtctggagcaactctatctgcagaaaatgaagcgcaccttaatgcagacatccttccgatctgagggcgccatccagtctctgcgatgtgatgccgcttttattatagggtccgggcgcaaatcgctgaaccagcggacaactgcttcttgggatggacaggtggggatggtatccggcctcacttatcccgtcgcacattggcaccttattgttagtaatttaacgattctgataagctacctgtgcccagatgacgtaggttacttagcctcagtgctccttcgaacactgcctatgggaaaagctcaggaggtttctatcgacgaggaagcctatatcactctggagaaaatctcaaaagctttcctccatagccctctgtttcccgaaatgcagtcactccatagcgcctttctgacgtgcgtgactacatcttgcagctctatcctgtgtagcggcgcccagagagattccggcttagtgtcccagcaattgccctggcttttcgagaaggaccacatggtggtgggacactgggaaaacaggtttgcgaaagcgggaccagaaggaattgagccgcgtggcgagattgcccagaacttgttgagcctggtgaagtctgattttcccatccagttggagggcgaacagctggaaagcatactggggttacttgaggtgatctccgccctccagctggacagccttctgcccccgtaccatgtccactactttctcgtccttctgtccatggccgtcaccaagctgggctgttcttgtagctcatcactagcactgaaattcctcactacctgttatcaactactgggctacctccagaagggtaagtccgcccgttctgtttttaagatcatgtatggatcagacattttcgaggtcgtgctcacatcccttttccgcgcctcaagccggtttctgattgaaatggacgaccccgcctggctggaattcctgcaggtgatcggtacttttctggaggagctgatgcaaatgctgatacagatgaaactctcgctggtgctgaatttccgtaaaatcactgcattcctatctagtagcaaaccttacacagaggctgcttcctctaagcaactagagaatcagaatccacaagggcggcagctgctgctggtgtcccttacaaggctgtgccacgtgttgggtccttttttaaaggagcagaagctcggacaggaagcccctgccgcactgtcagaactgctgcagcaggtggtacttcagacaggcgccgtgctgcagctctgttcggttccaggcgccagggggtggcggctgcctagcgtcctcatttcctccgtcagcacactgctcgaagctgacctaggtcagcactgtagagatggcggcgccgacatctcccagggtagcgatcgcactctgctctcgcatgtcgcattgtaccagggtgtgtattcccagatcttacttgagctgcctgccttagctggtcatgatcagtcattccaggctgcgctgcagttcctaacattgttctttctagcccctgaactgcacccaaagaaggatagcgttttcactagtatgttccattccgtgagacgggtcctggctgaccccgagattccagtgcaggtaacccaggacatagagccccacctgggtgcactctttacgcagatgttagaagtggggaccaccgaggacttgcgtctagtcatgcagtgtattctgcagggccttgatgtgtcgaatatgtggaaggccgatgtccaagccgtcgtgtcagctgtcactctccttcggttgctccttaactgccccctgtctggagagaaagcctcgctcctgtggagggcctgcccacagatcgtcacagctctcacgctgctgaacagggaggctagtcaggaacaaccagtatccctgaccgtcgtgggtcctgttttagatgtgttggccgcgctgctgcggcaaggggaagaggcaatcgggaatccacatcacgtgagcttagccttcagtattctgctaaccgtcccgttagatcacctcaaaccgctggagtacggctctgtgttccccagattacacaatgtgttgttcagcattctgcaatgccacccgaaggttatgctgaaggccatcccaagctttttgaattcatttaatcgccttgtatttagcgtcatgcgcgaggggcggcaaaaggacaaagggagtatcgacgacttgccaacggtcttgaagtgtgcgcgcctggtggagcgcatgtattcccacatcgctgctcgcgcagaggagttcgcagttttcagtccatttatggtcgcccagtatgtgctggaggtgcagaaggtcaccttatacccagccgtgaagagcctactgcaagaaggaatctacctcattctcgacctgtgcatagaacctgacgtgcagtttctgcgggctagtttgcagcctggaatgagagatatcttcaaagagctttataacgactacttgaaataccacaaagccaagcatgaaggggaaaaacgctacaccgcctag

SEQ ID NO: 13706 - DNA, 255 bp, Artificial Sequence
  Description of Artificial Sequence: Synthetic coding sequence
atgctgaaggcaatcccgtcgtttttaaattcctttaaccgattagtgttctctgtgatgagagaaggccgtcagaaggacaaagggtccattgatgatttgccaacggtcctgaaatgtgcccgcttagtagaacggatgtactcgcacattgccgcaagggccgaggagttcgcggtcttctccccgtttatggtagcccagtatgtgctggaagtgcaaaaagtgacactgtaccccgcggtcaagtcatag

SEQ ID NO: 13707 - DNA, 1812 bp, Artificial Sequence
  Description of Artificial Sequence: Synthetic coding sequence
atgaagggggactttagaaaaaagaaatcagaagcacggacaccactcgagcaggagatctttaacctgctgcacaagaacaaacagcccgtgacagaccctctcctaacccctgtggagaaggccagcttgagagcaatgtcactggaagaggctaagatgagacgggctgaacttcaaagagctcgagccctccagtcttattacgaagcgaaggcccggcgtgagaagaagatcaaatcaaagaagtatcataaggtcgtcaagaagggtaaggcgaagaaggccttaaaggaattcgagcagctcagaaaagtgaatcctgcggccgccctggaggaactagagaagatcgaaaaggctagaatgatggaaagaatgtcgttgaagcatcaaaatagtgggaaatgggccaagtccaaagccattatggccaagtacgatcttgaagcccgccaggctatgcaagagcagctatcgaagaacaaagaactgactcagaaactccaggtagctagcgaatccgaagaggaagagggcggcaccgaagatgtggaggagcttttagttccagacgtggtgaatgaggtgcagatgaacgccgacggaccaaacccctggatgctgagaagctgcaccagcgacaccaaagaggcagcgacacaggaagacccggaacaactccctgagttggaagcccatggtgtgagtgagagtgaaggcgaggagaggccagtagccgaggaggagatcctgctgcgcgaatttgaggaacgacgttctctgagaaagcgatccgagctgagtcaggatgcagagcccgcggggagccaggaaaccaaagattcaggctcccaagaagtactgagtgagctgcgtgtgctaagccaaaagctgaaagaaaatcatcagtcacgtaagcaaaaagcaagttcagaagggaccattcctcaggtacagcgagaggaaccagctcctgaagaggaggagcccctgttattgcagcgacctgaacgcgttcaaacccttgaagaattggaagagctggggaaggaagagtgttttcagaataaggagctgccacgcccggtcctggaggggcagcagtccgaaaggacgcccaataatagacccgatgctcccaaagagaagaaaaagaaagaacagatgattgacctgcagaatttactcactacacaatccccgagcgttaagtctctggcggtgccaactatcgaagagctcgaggatgaagaggagcgcaatcacaggcagatgattaaagaggccttcgcaggagatgatgtgatccgtgattttcttaaagaaaaacgagaggctgtagaagcatcaaagccgaaggacgttgaccttacactgcctgggtggggagagtggggcggcgtgggcctcaagccctctgccaaaaagaggaggcgcttcctgatcaaagcaccagaggggcctccacgtaaggataaaaatctgccaaatgttattattaatgaaaagaggaacattcatgctgccgcccaccaggtacgagttctgccgtatcctttcacccaccactggcagtttgagaggactattcagactcccatcggcagtacatggaatacacaaagagcttttcaaaaactgactactccaaaggtggtgacaaaaccaggacacatcatcaacccaattaaggcggaggatgtcggctaccgtagcagcagcagatccgacctttccgtgatacagcgaaatcccaaaagaattaccacccgccacaagaagcaactcaaaaagtgttctgtggattag

SEQ ID NO: 13708 - DNA, 2154 bp, Artificial Sequence
  Description of Artificial Sequence: Synthetic coding sequence
atgagaggcactatgatggaacgcgaatccatcaagagtttctggaaacaaagcgtgcctctaatggaacgtattggatcgggcgagaagcttgtgctcgcagacttgttggagcccgtgaaaacctcatcatccctcgcaaccgtcaaaaagcaactgtcaagggtgaaatcaaagaaaacggtggaactgcctttaaacaaggaagagatagagcgtatacatagagaggtggcgtttaacaagacagcgcaggtgctgtccaagtgggaccccgtggttctgaagaatcggcaagcggagcagcttgtcttcccactagagaaagaggaacctgcaatcgcccctatcgagcatgtgctaagcgggtggaaggccaggacacccctggagcaggaaatcttcaaccttctgcataagaacaaacaacccgtcactgaccccctgctgacccccgttgaaaaagcttcattgagagccatgagcctggaggaagccaagatgcgacgagctgaacttcagcgcgcccgggcactccagagttattacgaggccaaagctaggcgagagaaaaaaattaaatccaagaagtatcacaaagtcgtgaagaaagggaaggccaagaaggccttaaaagagtttgaacagttacgcaaagttaacccagccgcggccctagaggagttggagaaaattgagaaggcccgaatgatggagagaatgtctttaaagcaccaaaatagtggtaaatgggctaagtcaaaggccatcatggcaaaatacgatttggaggctcgacaagcaatgcaggagcagctttctaaaaataaggagttgacgcaaaaactccaggtggcgagtgagtcagaggaggaggagggaggcacagaagatgtggaagagctgcttgtgcccgacgtggtgaacgaggtccaaatgaacgctgacggaccaaatccttggatgctgcgctcctgtacctcggatactaaggaggccgcaacccaggaagatcctgagcaactgcccgaactggaggcccacggggtaagcgaatctgagggcgaagaaaggccagtggccgaagaggaaatactgctacgggaattcgaagagcgcaggtctttgagaaagcgctctgaactttcacaggacgctgagccagctggcagtcaggaaacaaaagactctggcagtcaggaggtgctctccgaacttcgggtcctgagccagaaactaaaagaaaaccatcaatcgcgcaagcaaaaggccagtagtgagggtacgatcccacaagtgcagcgggaggaaccagcccctgaggaagaggagccactgctgttgcagagaccggaaagagtacagacactggaagagttggaggagctggggaaggaagagtgtttccagaacaaagagctcccaagacccgttttggaaggtcagcaatcggagcgaacacctaataatcgtccagatgccccaaaagagaagaaaaagaaggagcagatgatcgatctgcagaacctgctcactactcaaagtccctccgtgaagagcttggccgtgccaaccatcgaagaactggaggatgaggaggaaagaaaccatagacagatgattaaagaagctttcgccggcgatgacgtgatacgggactttctgaaagagaagagagaggccgttgaggcaagtaaacctaaggacgtggacttgacacttcccggttggggagaatgggggggcgttggattgaagccgtccgccaagaagcggcgccggtttctgatcaaggctcctgaagggcccccgcgcaaggataagaaccttcctaacgtgataataaatgagaaaagaaacatccatgcagctgctcaccaggtcagagtgttgccctacccatttacacaccattggcagtttgagcgcacgatccagacgccaattggctccacgtggaacacccagagagcctttcagaagctgaccactcccaaagtggtaactaaacctggtcacatcataaacccaatcaaagctgaggatgtggggtatcggagctctagtaggtctgacctgtctgtgatccagcgcaatcctaagcgaattaccactcggcacaagaagcagctgaagaagtgttctgtggactag

SEQ ID NO: 13709 - DNA, 2316 bp, Artificial Sequence
  Description of Artificial Sequence: Synthetic coding sequence
atgaccgccaaccgcctggccgaatcactgctcgcattgtctcagcaggaggagctcgctgatctacccaaagattatttactgagcgagagtgaggacgagggcgacaatgacggggagcggaagcaccagaagctactggaagcgatctcttcattagatgggaaaaatagaaggaagctcgctgaaaggtccgaagcctccctgaaagtctccgaatttaatgtgtcttcggagggatcaggagaaaagcttgtgttggcggatctgctcgagcccgttaagacttcgagttccttggcaacagtcaaaaagcaactgagcagggtgaaatccaagaagaccgttgagctgcccctgaacaaagaggagatcgagaggatacatcgggaagtagcctttaacaagacggcacaggtcctgagcaagtgggaccctgtggtgctaaaaaatcgccaagccgagcagcttgtcttccccctggaaaaagaagagccagcaatcgcccccattgagcatgtacttagcgggtggaaagccaggaccccacttgagcaggagatcttcaatcttcttcataaaaacaagcagccagtgacagatcccttattgacacctgtggagaaggcatccctgcgggccatgagcctggaggaggccaagatgaggcgcgcggagctgcaacgagcacgtgcattacaatcatattatgaagcaaaggctcggcgtgaaaagaagatcaagagcaaaaagtaccacaaagtggtaaagaaaggcaaagcaaagaaagccctaaaggagtttgagcagttgcggaaagtgaaccctgctgctgccctggaggagctggagaaaatcgaaaaagcacgcatgatggagcggatgtctttaaagcatcaaaacagcggcaagtgggcaaaatcgaaggctatcatggccaagtacgacctggaggcccgccaagccatgcaggaacagctctcaaagaataaagagcttacccagaagctgcaggtcgcctctgagtcagaggaggaggaaggcggcaccgaggacgtcgaggaacttcttgtgcccgatgtcgtgaacgaggtgcaaatgaacgcggacggacctaatccttggatgctgaggtcctgcaccagcgacacaaaagaggcggctacccaggaggacccagaacagttgccggagctcgaggcccacggtgtttccgaatccgagggagaggaacgcccagtggccgaagaggaaattctattgcgggagttcgaggagcgacggtctcttagaaaaaggtccgaactcagccaggatgcagagccagccgggagccaagaaacaaaagacagtgggtcccaggaagtgctttctgagctccgggtcctgtcgcagaagcttaaagagaatcatcagtcccgaaaacaaaaggcatcctcagagggcacgatcccacaggtacaaagggaggagcctgcaccggaggaggaggagcctctgctgctacaacggcctgagcgtgtgcaaactctggaagagctagaagagctgggcaaagaggagtgctttcagaataaagagttgccgcgcccagtgcttgagggacagcagtccgagaggacacccaacaacagacccgacgcgcctaaggagaagaaaaagaaggagcagatgattgacctccagaatttactcaccacccagtctccatctgttaaatctttagctgtgccgacgatagaagaactcgaggacgaagaggagaggaatcatcgccagatgattaaggaggcgttcgccggagacgacgtcattcgcgactttctgaaagaaaagcgagaggcagttgaagcctctaagcccaaggacgtagaccttacccttcccggctggggggaatgggggggcgtcggcctcaagccaagtgccaagaagagacgaaggtttcttatcaaggcgcctgaaggtccccccagaaaggacaagaaccttcctaatgttattattaacgaaaagaggaatatccacgctgcagcccaccaggtcagagtgctgccttaccccttcactcatcattggcaatttgaacgtaccatccagacccctatcggtagtacttggaatacccagcgggcctttcagaagctgacaacccctaaggttgtcacgaagcctggccatatcattaacccaattaaggctgaggatgtggggtacaggtcaagtagcaggagcgatctgtctgttatccagagaaatccaaagagaatcaccaccagacacaagaagcagctgaagaagtgtagtgtggattag

SEQ ID NO: 13710 - DNA, 2160 bp, Artificial Sequence
  Description of Artificial Sequence: Synthetic coding sequence
atgactgcgaatcgtttggcagaatcgctgctggctttgtctcaacaggaagagctggctgacctcccgaaagattatctgctttctgagtccgaggacgagggggataacgacggggagaggaagcaccagaagttactggaagctataagttcactggatgggaagaaccgaaggaaactggccgaaagaagcgaagcatctctgaaggtcagtgaatttaatgtcagtagtgagggcagcggtgagaaattggtgctggcggatctattggagcctgtgaagacttcgtcttcattggccaccgtcaaaaagcaactgtcacgggtcaagtcaaaaaaaactgtagagctgcccctgaacaaagaagaaattgagcgtgcgagaactccactcgaacaggaaatcttcaacttattgcataaaaataaacagcccgtcacggaccccctgctgactccagttgagaaagcctcacttcgcgccatgagtctggaggaggccaagatgcgccgagccgagttacagcgtgctcgcgctctgcaatcttactacgaggcaaaagcccggagggagaagaagattaagtctaagaagtatcataaagtggttaagaagggtaaagccaagaaagccctcaaagagttcgaacagttaaggaaagttaaccccgctgccgccctggaggagctagaaaagattgaaaaagctcgcatgatggaacggatgtccctgaaacatcaaaacagcggtaagtgggccaaatccaaagccataatggccaagtatgatctcgaggcaagacaggctatgcaggagcagctctctaagaataaggaactcacacagaaactgcaggtggcatccgagtcggaagaggaagaagggggtactgaagacgttgaggagcttctcgtgccagatgtcgtgaacgaagtgcagatgaatgcagacggcccaaatccctggatgctgaggtcctgtacttccgatacgaaggaagctgccacgcaagaagacccggagcagctccctgagctggaagcgcacggcgttagcgagtccgagggggaagagaggcctgtggctgaggaagagatcctactgcgggagttcgaggaacggcggagcctgaggaagaggagtgaactgtcccaggacgccgaacccgcagggtcacaggaaactaaggatagtggatcccaggaggtgctgtcggagctgcgggtactatcacagaagttgaaagaaaaccaccaatcaagaaaacagaaagcaagcagcgaaggaacgattccacaggtgcagcgagaggaacctgcgccagaggaggaggaacccctgttgctgcagcggcctgaacgggtccaaaccctcgaggaactggaggagctgggaaaagaagagtgcttccagaataaagaacttccccgaccggtgcttgaaggccagcagagcgaacgtacacctaataatcggcccgacgctcccaaggagaaaaagaagaaggaacaaatgattgaccttcaaaacttgttaactacccagtctccctccgtgaagagccttgccgtgcctacaatagaggagctggaggacgaagaggagaggaaccacaggcagatgattaaggaggcatttgccggcgacgacgtcataagggactttctcaaagagaagagggaagccgtggaagcttcaaagcccaaggacgtggacctcaccctgcccggctggggcgaatggggaggcgtcggtctgaaacccagtgccaagaagaggcggcgcttcctgattaaggcaccggaaggtccacctaggaaggacaagaatctacccaatgtgattatcaatgagaagaggaacatccacgcagctgcgcaccaggtccgcgtgcttccttaccctttcacacatcactggcagttcgagcgcactatccaaactcctatcggatcgacttggaacacgcagagggctttccagaagctgacaacgccgaaggttgtcaccaaacccgggcatataataaaccccataaaggccgaggatgttgggtaccgcagcagcagccgcagcgatctgtccgtgatccagcgcaatcccaagcggattacaacacgccataaaaaacaattaaagaaatgctccgtagactag

SEQ ID NO: 13711 - DNA, 963 bp, Artificial Sequence
  Description of Artificial Sequence: Synthetic coding sequence
atgaaaggcgattttaggaagaagaaaagcgaggctcggacaccactggagcaggaaatttttaatctactgcacaagaacaagcagcccgtgactgacccattgctgaccccggtcgagaaggcttccctgagggcaatgtcactggaggaagctaagatgcgcagggctgagctccagcgcgcgcgagcattgcagtcttactacgaggctaaagctcgccgggagaagaaaatcaagtcaaagaaataccataaggtcgttaaaaaggggaaagcgaagaaggcccttaaagagttcgaacagctgagaaaggtgaaccctgcggctgccctggaggagctggagaagatcgaaaaggcaaggatgatggaaaggatgagcttgaaacatcagaatagtggaaaatgggccaaaagtaaggccatcatggccaagtacgacctagaggcacgtcaggctatgcaggagcagttgagtaaaaacaaggagctcacacagaaactgcaggttgctagcgagtcagaagaagaagagggtggaaccgaggatgttgaagagctgctggtgccagatgtcgtgaatgaggtacagatgaacgcagacggaccgaatccatggatgcttaggagttgtacatccgatactaaagaagcagcgactcaggaggaccctgaacagctgcctgagctcgaggctcacggagtcagcgagagcgaaggggaagaacgccccgtggccgaagaagagatcctactgagggagttcgaagagaggagatctcttaggaagaggtctgagcttagtcaagatgccgaacccgcaggtagtcaggaaacaaaagactcaggttcacaagaggtgctaagcgaactgcgtgtcctttctcagaagttgaaggaaaaccatcagtcgcgtaagcagaaagcatccagcgaaggcacgataccacaggtccagtag

SEQ ID NO: 13712 - DNA, 2301 bp, Artificial Sequence
  Description of Artificial Sequence: Synthetic coding sequence
atgaatgtcaaccaggtcgccgaaaacctcgccttaagccaccaagaagaattggtggacctccctaaaaattaccctttgagcgaaaatgaggatgaaggtgatagtgacggtgaacgcaaacaccaaaaactccttgaggcgatcatcagcctggacggcaaaaacagaagaaaactggccgaacgaagcgaggcatcactgaaagtgagtgagtttagcgtgtcctccgaagggagtggagaaaagctaggcttggccgatttgctagagccagtgaagaccagcagcagcctggcgactgtgaagaaacagctgaatcgtgtgaagtcaaaaaaggtggtagagctaccccttaataaggaaaagatcgagcagattcatcgagaggttgccttctcaaaaacatcccaggttttatccaagtgggacccaatcatactgaaaaatcagcaggctgagcagctggtgttccctcttgggaaggaacaacccgccattgctcccattgaacatgcccttagtggctggaaggccagaactccactggagcaggaaatttttaacttgctgcataagaataagcagccagtcactgatccattattgacgcctatggaaaaagcttctcttcaggccatgtccctcgaggaagccaagatgcaccgcgcagagctgcagcgtgcacgcgcgctccagtcctattacgaagccaaggcccgcaaagagaaaaagatcaaatccaagaagtaccataaggtggttaagaagggtaaagccaaaaaggccctgaaggagttcgagcagttgcagaaagtgaatccgaccgtcgccctcgaagagatggaaaaaatcgaaaatgctcgtatgatggagaggatgtccttaaaacatcaaaactcaggtaagtgggcgaagtcaaaagccattatggcgaagtacgacctggaggcacggcaggctatgcaggaacagctcgcaaagaacaaggaactcacacagaaactgcaggttgcctctgagtcagaggaagaggagggaggcacggaggtggaagagctgcttgttcctcacgtcgcaaatgaggtgcagatgaacgtcgatggacctaatccctggatgtttagatcttgcacctctgatacgaaggaagcggcgacgcaggaggatcctgaacaggtgcctgaacttgccgctcatgaggtcagtgcttctgaagcggaagaacggcccgttgccgaggaggagatccttctgcgagagtttgaagagaggcaaagcttgcgaaaaagatcagaactcaaccaggatgctgagcccgcctcctcacaggagacgaaagatagcagttcacaagaggtcctatcagaactgagggccctgagtcagaagcttaaggaaaagcaccagtccagaaagcagaaagccagttctgaaggcacggtgccccaggttcaacgcgaagaacccgcacctgaggaggcggagccactcttgctccaaagatctgaacgcgtacagacccttgaagagctcgaggaactcggaaaagaggattgtttccagaataaggagctacccaggcccgtgcttgaagggcagcagagtgagagaacgcctaacaaccgtcctgacgcacctaaagagaagaaagagaaggagcagctaattaatcttcagaacttcctcaccacacagtcaccttctgtgcgatcacttgcggtgcccacaattattgaggagctggaggatgaggaggagcgcgaccagagacagatgataaaagaggctttcgcgggggatgatgtaattcgagattttttgaaagaaaagcgtgaagccgtggaagcatctaagccaaaagatgtggatttaactctgcccgggtggggagagtggggcggcgtgggtctcaaaccatccgcaaaaaagaggcgccagtttctcatcaaagcgccggaaggcccacctcgcaaggacaagaatctgccaaacgtgatcatttcggaaaagcggaacatacatgccgccgcacatcaggtgcaagtgcttccctacccttttacacatcatagacaatttgagaggactatccaaacccccataggtagtacttggaacactcaaagggcgttccaaaaactgaccactcccaaagtcgtgaccaaacccgggcatattatcaagcccataaaagcggaggacgttggctatcagtcttccagtaggagtgacctccctgtgattcaaagaaatcccaagaggatcacaacacgtcacaacaaagaagaaaaattgtag

SEQ ID NO: 13713 - DNA, 1557 bp, Artificial Sequence
  Description of Artificial Sequence: Synthetic coding sequence
atggccggatacaagccagtggccatccaaacgtatccaattctgggggaaaaaatcacccaggacactctctattggaacaattataagacgcctgtgcagatcaaagaattcggagctgtttcaaaggtggacttcagtccccagcccccttataactacgccgtgacagcttcatcaaggatccacatctacgggcgctacagccaagagcctataaagacattctcccgctttaaggataccgcatattgcgccacctttaggcaggacggcagactcctagtggcaggctcagaggatgggggtgtgcagctctttgacatttctggaagagctcccttaagacagtttgaaggtcatactaaggctgtgcatacagtcgacttcacagcagacaagtatcacgtggtcagcggcgcggacgactatacagtcaaactgtgggacatacctaatagtaaagagattctgactttcaaggaacacagtgactatgtgcgatgtgggtgtgcctctaagctgaatcccgatttgtttatcaccggctcgtatgatcatacggtcaagatgtttgatgcaaggacatctgagtcggtgctgtccgtcgagcacgggcagccggtggaaagcgtgctcctattccctagcggtggtcttcttgtatccgcaggcggcaggtacgtcaaagtatgggatatgctcaagggaggacagctgctggtgtcccttaagaatcaccataaaaccgtcacatgtctctgcctgtcttctagtggacagagacttctcagtggttccctggaccgaaaggttaaggtgtatagtactacctcatacaaggtggtgcattcatttgattacgcagcttctatcctgagcctggcccttgcccacgaagatgaaacgatagtggtggggatgactaatgggatcctatcagtgaaacatcgaaagagtgaggccaagaaggaaagtttgccgcgacgtcgacgtccggcatacagaacgtttatcaaaggaaagaattatatgaaacaacgcgatgacatcctgatcaacaggcctgctaagaaacatttggagctgtatgatcgcgacttgaagcactttcggatttcaaaggccctcgatcgggttctggacccaacatgcacaattaagacacctgaaatcacagtttccatcattaaggaactcaatcggcgaggcgtcctggctaatgccctagccggccgggacgagaaggagatatcccacgttttgaactttttgatcaggaacctgagtcaaccccgatttgcgccagtgcttatcaacgcggcggagataattatagacatttatcttccagtcatagggcaatcccccgtggtcgacaaaaagttcctccttctgcagggactggtggaaaaagaaatagactatcagagagagctgttggaaaccctcggcatgatggacatgttgtttgcgacaatgcggcggaaggaagggacctcagtgctggagcatactagcgatggttttcctgagaacaaaaagattgagagttag

SEQ ID NO: 13714 - DNA, 1500 bp, Artificial Sequence
  Description of Artificial Sequence: Synthetic coding sequence
atggcaggctataaacccgtggccatacagacctaccccatcctcggggagaagataactcaggataccctgtattggaacaactataaacccccctacaattacgccgtgaccgcctcgagcagaattcatatctacggccgctacagccaagaacccattaaaacgttctctcggttcaaggatacagcttactgcgccacattcagacaggacgggagattattagttgccggcagcgaggatggtggggtgcaattgttcgacatttcaggcagggcccccctccgccagtttgagggacacaccaaagcagttcacacagtggactttactgccgataaatatcacgtcgttagtggagcagatgactatacagtgaaactttgggacattcccaatagtaaagagattttgacgtttaaagaacacagcgattatgttagatgcggatgtgcttccaaactgaatcccgatctgtttatcactggatcttatgaccacaccgtgaaaatgttcgacgcccggacatctgagtccgttctgtcagtggaacatggccaacctgtggaaagcgtgctgctgttcccatccggaggactgcttgtatctgctggaggtcgttacgtgaaggtttgggacatgctaaagggaggacaattgctcgtgtccctgaagaaccatcacaaaacagtaacatgcctgtgcttgtcttcttcgggtcagcgcttgctgagcgggtcactggatcgaaaggtgaaagtgtacagcactacgagctacaaggtggtgcattcgtttgattatgctgcctctatactgagcctcgctctggcacatgaggatgagacaattgtggtcggaatgaccaacggtatcttatccgtaaagcacaggaagagcgaagccaagaaggaatcgttgcctcggcggcggcggcctgcgtatcgaactttcattaaaggcaagaactacatgaaacagcgtgacgacattctgataaacaggcctgccaaaaagcatctggagctctacgaccgagatctgaaacattttagaatctcaaaagcactcgatcgcgtactggatcctacctgtacaattaagacgcccgaaatcaccgtgagtatcattaaggagttgaaccgacggggcgtgctggcaaacgcactggcaggccgggatgaaaaggagatcagtcatgtgcttaacttcctcattcgtaatctatcccaaccccgatttgctcccgttctcatcaacgcagctgaaataattatcgacatctatttgcccgtaattgggcagtcccccgtcgttgacaaaaagtttctgcttcttcaaggcttggtggagaaagaaatagattatcagcgggagctgctggagaccctgggcatgatggatatgctgtttgcgaccatgcggcgcaaagaaggtacatctgtacttgagcacaccagcgacgggtttcccgagaataaaaagatcgaatcctag

SEQ ID NO: 13715 - DNA, 24 bp, Artificial Sequence
  Description of Artificial Sequence: Synthetic coding sequence
atggccggctataagcctgtgtag

SEQ ID NO: 13716 - DNA, 1638 bp, Artificial Sequence
  Description of Artificial Sequence: Synthetic coding sequence
taagtgattttcgcgcgtcgctccgtccgttgcgtctgcaggaggttgctggagggaccctgcgatttttacgctagtgccgcagaactgtgccgtgtgggctcctggcacagtcccatcaactgcccctgggtggaggtgtctaggcgcaccttgtggggctccgtcgagacccctgttcaaattaaagagtttggagctgtaagtaaagtcgacttcagtccccagccaccgtacaactacgccgtaaccgcgtccagccgcattcatatctacgggcgctactcgcaggagccgattaagacctttagtaggtttaaggacactgcatactgcgctacatttaggcaagatggccgcttgctcgtggctggttccgaggacggtggcgttcagctatttgacatatcaggacgcgcgcctctgcggcagttcgagggacacacaaaagcagtgcacaccgttgacttcaccgccgacaaataccatgtggtatccggagcagacgattatactgtcaagctctgggacattcctaactccaaagaaatcctgacctttaaagaacacagtgattatgtaagatgcggctgcgcttcgaagctcaatcctgacctgttcatcaccggatcctacgatcataccgtgaaaatgttcgacgcaaggacctctgagtctgtgctgtccgtcgaacatggccagcccgtcgagtctgtgcttctgttccccagcgggggtttgctcgtttccgccggcggtcgatacgtaaaagtgtgggacatgcttaagggtggccagctgctggtctccctcaaaaatcaccacaagactgttacctgcctgtgcctcagtagttctggccagcggctgttgtcagggtccctcgacagaaaggtgaaggtgtacagtacaacttcctacaaagtcgtgcactcattcgactacgctgcttcgattctctcgctcgctttggcacatgaggatgaaaccatcgtcgtcggaatgaccaatggcatcctgtctgtcaaacataggaagtccgaagccaaaaaagagtcactgcctaggagacgaagaccggcctaccgcaccttcataaaggggaaaaattatatgaaacaaagggacgatattctgatcaaccgtcccgccaaaaagcacttggagctctacgatcgtgatttgaagcactttcgaatcagcaaggccttggacagagtccttgatccaacctgcacaatcaagacccccgaaattacggttagcattattaaagaactcaatagacgcggagttctggccaatgcccttgccggcagagatgaaaaggagatttcccatgttctgaacttcttgattcgaaatctgagccaaccaaggttcgcccctgtcctcattaatgcagccgaaattataatcgacatctacctccccgtgatcgggcagagccctgtggtcgataaaaaatttctgctccttcaaggcttggtggagaaggagatcgattatcagagggagctgctcgagaccctgggaatgatggatatgctatttgccaccatgcgcagaaaggagggcacaagcgttctagagcacacctccgatggcttcccagaaaataaaaagattgagtcgtag

SEQ ID NO: 13717 - DNA, 198 bp, Artificial Sequence
  Description of Artificial Sequence: Synthetic coding sequence
atggcaggatataagccagtggccatacagacctatccaatcctcggagagaaaattacacaggatactttgtattggaacaattataagacccctgtacaaataaaggagtttggcgccgtgagcaaagttgatttttcaccgcaaccaccctataactacgccgttactgcctcctcccgcatccacatctactag

SEQ ID NO: 13718 - DNA, 987 bp, Artificial Sequence
  Description of Artificial Sequence: Synthetic coding sequence
atgtttgatgctagaacgtctgaatccgtgctgtcggtcgagcacggccagcccgtggaatccgtgctcctgtttcctagtggtggactccttgttagcgccggggggagatatgtgaaagtttgggatatgcttaagggcggccagctgctagtgagcttgaagaaccaccataaaactgtgacctgtctttgtctgagtagttccggccagagattgctttctggcagcctggacaggaaggttaaagtttattccaccacctcttataaggtggtacacagcttcgattatgcagcgagtatcctgtcacttgccctggctcatgaggatgagacaattgtcgtggggatgactaatggtatcctgtctgtaaagcaccgaaaatctgaagcaaagaaagagtcactgcctcgacgcagaagaccagcatatcgcacttttattaaggggaagaattacatgaaacagcgcgatgatatattgattaaccggccagctaagaaacaccttgaactgtacgatagggatctgaagcacttcagaatttccaaggccttggacagggtgcttgaccccacctgtaccataaagacgcccgagatcactgtgagcatcatcaaagagctgaatcggcgcggcgtcctcgctaatgccctcgcaggcagggatgaaaaagagatttcccacgtacttaactttctgattcggaacctgtcccaacctagattcgctcccgtgctcatcaatgccgccgaaattatcattgatatatatctgccagtgattggccagtccccggtggtcgataagaagttcctcttgctgcagggactggtagagaaagagatcgactaccagagggagctgctggagacactgggcatgatggatatgctatttgcaacaatgcggcgcaaagagggcacatctgtgcttgagcacacaagtgatgggttcccagagaacaaaaagatagaatcctag

SEQ ID NO: 13719 - DNA, 750 bp, Artificial Sequence
  Description of Artificial Sequence: Synthetic coding sequence
atgaagattacacggcagaagcatgcaaaaaaacacctgggcttttttaggaacaattttggagtgcgtgaaccctatcagattttgctggacggcacattttgccaggccgccctccgcggccgtatacagctgagagaacagttgccccggtacctgatgggcgagactcagctgtgcacaacccgttgtgtgctgaaagagcttgagacactcggaaaagacctgtacggcgccaagcttattgcccagaagtgccaggtgcgtaattgtccccacttcaagaatgcagtctcaggcagtgagtgcctgcttagcatggtggaggagggcaaccctcatcattatttcgtggcaacccaagaccaaaacctgagtgttaaggtaaagaaaaagcccggcgtgcctctgatgtttatcattcagaataccatggtactcgacaagccctcgcccaagaccatagctttcgtcaaggcggttgagtctggtcagttagtctccgttcatgaaaaggaaagcatcaagcatctgaaagaggagcaaggcctcgtgaagaatactgaacagtcccggcgaaaaaaacgaaagaagattagtggacccaaccccctgtcgtgcctgaagaagaaaaagaaggcgcccgacacccagagcagtgccagtgaaaagaaacggaaacgaaaacggatcagaaatcgctctaacccaaaggtcttgagcgaaaagcaaaatgctgagggagaatag

SEQ ID NO: 13720 - DNA, 438 bp, Artificial Sequence
  Description of Artificial Sequence: Synthetic coding sequence
atgaagattaccagacagaaacatgccaagaagcacctgggatttttcaggaacaattttggcgttcgcgaaccataccaaatccttctggatgggaccttttgccaagctgctctccgcgggagaatccagctgagagagcagctacctcggtatctgatgggtgagactcaactctgtactacccgctgcgtgctcaaggagctggaaaccctgggcaaagatctctatggggcaaaacttattgcccaaaagtgtcaagtccgcaattgtccgcactttaagaacgccgtctctggcagcgagtgtctgctgagtatggtggaagaaggcaatccgcaccactactttgtagcaacccaatatatacctcggatgtacactttttgtacgaactacggtggtcagcagtatgtcatcgacgcgctgatcgggtag

SEQ ID NO: 13721 - DNA, 1794 bp, Artificial Sequence
  Description of Artificial Sequence: Synthetic coding sequence
atggcagaaatcatccaagagcgcatcgaagaccggttaccagaactcgaacaactggaaaggatcggtctattttctcatgcagaaattaaggccatcattaagaaggcttctgacttggaatacaagattcaaaggcgcacactgttcaaggaagacttcatcaactatgtccaatatgagattaacttgttagagctaatacaacgacgaagaactcgaattgggtactcctttaaaaaggacgagatcgagaattctattgtgcatcgggttcaaggcgtttttcagagggcctcagctaaatggaaagacgatgtgcaactttggctttcttatgtggccttctgtaaaaagtgggccacgaaaacccgactcagcaaagtcttttcagccatgctggccatccacagtaacaagccggctctctggattatggccgctaagtgggaaatggaggatcgcctgagctccgaatccgctcggcaattattcttaagagctctgaggttccacccggaatgtcctaagctttacaaagagtatttcaggatggagttaatgcacgctgagaaactaaggaaggagaaagaagagttcgaaaaagcaagcatggatgtagagaatcccgactactccgaagaaatcctgaagggtgagctggcttggattatctataagaacagtgtatccattatcaagggcgcagagttccacgtgtctcttctgtctatcgcccaactgttcgacttcgccaaagatctccagaaggaaatctatgacgacctgcaggcacttcataccgatgatcctttaacctgggactatgtggctaggcgggagctcgagattgaatcccaaactgaggaacagcctactacaaagcaggcaaaggctgtggaagtggggagaaaggaggaaaggtgctgcgcagtgtacgaagaagcagttaagaccttgcccactgaagcgatgtggaagtgctacatcacattttgtctcgagaggttcacaaaaaagtcaaacagcggttttctgcgaggaaaacgattggagagaacaatgacagtttttaggaaggctcacgaattgaagcttctgtccgagtgtcaatacaaacagctctccgtctcattgttatgttacaacttcctgagagaagctcttgaagtggccgtggccgggacggagctcttccgggatagtggaaccatgtggcagctgaagttgcaggtcttgatagagtccaagtcacccgatatcgccatgttatttgaagaagccttcgtgcatctgaagccacaggtctgtcttcctctatggatctcctgggcggagtggagtgagggagcgaagtcccaggaggacactgaagcggtgttcaagaaagcactgctggccgtcattggagcagattcagtaactctcaagaataagtacctggattgggcgtacaggtcgggcggctacaagaaagcgagagccgtctttaagagtctgcaggagagcaggcctttctccgtggatttttttcggaaaatgatccagttcgaaaaggagcaggagagttgtaatatggcaaatatcagagaatattacgagcgggcccttagagagttcggcagcgccgacagcgatctgtggatggactacatgaaggaggaactgaaccaccccctcggcaggcccgagaactgcggccaaatctactggagagctatgaagatgctgcagggggagagcgccgaggccttcgtcgctaaacacgctatgcaccagactgggcatctgtag

SEQ ID NO: 13722 - DNA, 1425 bp, Artificial Sequence
  Description of Artificial Sequence: Synthetic coding sequence
atgatcagtttttgtcccgactgcggtaagagcatccaggctgctttcaagttctgtccttactgcgggaacagtctaccagtggaagaacacgtcggtagccagacctttgtaaatccgcacgtttcaagttttcaagggtccaagcgggggttgaattccagttttgaaaccagcccaaaaaaggtcaagtggtcaagtactgtgacaagcccacggctaagtttattctcagatggggacagctcagaatcagaggacacactcagctctagtgaacgctcaaaaggatcgggaagcaggcctcctacacctaaatcatctccccagaagacgcgaaagtctccacaggtgacacggggatcgccccagaaaacctcatgctcaccgcaaaaaacccggcaatcaccgcagactctcaaacggtctcgagtgactacatctctagaggccctgcctacagggaccgtcctgacggataagtctggcaggcagtggaagctgaagagcttccagaccagggataaccaggggattctgtacgaagctgcgccgacctcaactttgacatgtgatagcgggcctcagaaacaaaagtttagtcttaagctggatgccaaggacggtagacttttcaacgagcaaaatttctttcagagggctgcgaagcccctgcaggtgaataaatggaagaaactgtattctaccccccttcttgccatcccaacatgtatgggtttcggggttcaccaggacaagtatcgctttctggtattaccgtctctgggccggtcactccagagtgccctggacgttagcccgaaacacgtgctaagcgaaagatccgtgctgcaagtggcttgccggttattggacgctctcgaattcctccacgagaacgaatatgtccacggcaatgtcaccgcggaaaacatcttcgtggaccccgaggaccagtcacaggtgactctggccggttatggttttgccttccgctattgccctagtggaaagcatgtagcctatgttgagggaagccggtctccgcacgagggggacctggagttcatctcaatggacttgcataagggctgcggcccttccagacgcagcgacttacaatccctcggctattgcatgctgaaatggttgtacgggtttttgccctggacaaactgcctgccaaacacagaggatattatgaagcagaaacagaaatttgttgacaaacccggcccttttgtcggaccatgcggccactggatcaggccgagtgagacgctgcaaaaatatctgaaggtggtcatggccctcacttacgaagagaaacccccttacgcaatgctgcgcaataatctcgaggcccttctacaagatctcagggtctcaccctacgaccctatcggtctgccaatggtaccctag

SEQ ID NO: 13723 - DNA, 1275 bp, Artificial Sequence
  Description of Artificial Sequence: Synthetic coding sequence
atgatctctttctgcccagactgcgggaagtccatccaggctgccttcaaattctgcccgtattgtggcaattctctaccagtcgaggaacacgtcggcagtcaaacctttgtcaacccacatgtgtcctccttccagggctctggcagccgccctccaactcccaagtcttcgccacagaaaacccggaaaagcccacaagttacaaggggaagcccccagaagacctcctgcagtccgcaaaaaacccggcaatcccctcagaccctgaaacgcagcagagtgaccacatctttggaagcactgccaacaggtacagtgctgaccgacaaatcagggcggcaatggaaactcaagtctttccagactcgggacaatcaaggcatcctttatgaggccgcacccacttctacacttacttgtgactcgggcccacagaaacagaaatttagtttgaaacttgatgctaaagatgggcggttgttcaacgaacagaacttttttcagcgggccgctaaaccgctgcaggtcaacaagtggaagaagctgtactctacgcccttgctggcaatccctacatgtatgggcttcggcgtacatcaagacaaatacagatttctggtgctgcctagcctgggccgtagcctgcagagtgccctggacgtgtctcccaaacacgttctgtccgagagatcagttcttcaggtcgcttgtaggctgctggatgcactggaattcctccatgaaaacgagtatgtgcacggaaatgtaacggccgagaacattttcgttgacccagaagatcagtcacaggttacactagcggggtacggcttcgctttccgctattgtccttccggcaagcacgttgcctatgtagaaggaagtagatcgccacacgaaggagacctggaatttatttccatggacctgcacaaggggtgtggcccctcgcggcgttcagatctccagtctttggggtactgtatgctgaaatggctgtatggctttctcccctggactaactgcttgcccaacaccgaggacataatgaagcaaaagcagaaattcgtcgacaagccaggtccctttgtgggcccttgtggccattggataaggccctccgaaaccctgcagaagtacctgaaggtagtgatggcattgacctacgaagagaaaccaccctacgcaatgcttaggaataaccttgaggccctccttcaggatctccgagtcagcccctatgatcccatcggacttcccatggtgccttag

SEQ ID NO: 13724 - DNA, 855 bp, Artificial Sequence
  Description of Artificial Sequence: Synthetic coding sequence
atgataagtttttgtccagattgcggaaagagcatccaagccgcattcaagttttgtccctattgtggaaactcactcccagtggaggagcacgttggaagccagacttttgtgaacccacacgtgtcctcattccagggttccaaaagaggcctgaacagttcttttgaaacctcaccaaaaaaggtgaagtggtcttccacggtaacatcccccagattaagcctgttctcggatggcgattccagtgagtctgaagacaccctgagtagctccgagcgctccaaaggctctggcagtaggccaccgactcccaaaagctcgccccagaagaccagaaaaagccctcaggtaaccagaggatctccccagaagacctcctgctctccccagaagacacgtcagagtccccagaccttgaagagaagcagagtaactacgagtctggaagcactgcccactggcaccgttttaaccgacaaatcaggccgccagtggaagctcaaatcctttcagacaagagacaaccagggcatcctgtatgaggctgctccaacctcaacgctgacttgcgactcagggccccagaagcaaaagttttccctgaagctgagcacatctggacggtcttgtacacgccctcactgctggccctctctgccagcctgggtaagcgttttcaccagaaccaacacagggtcatggtgctacccggcttggggcggggcctttagccgaccttggatgtccgcgcagtccatgtgctgtcagagagggctgtgctgtcgctggcccgctggatgttggatgccttggtcttccagcatgcgtatgtctatgtttatggaaatgtag

SEQ ID NO: 13725 - DNA, 732 bp, Artificial Sequence
  Description of Artificial Sequence: Synthetic coding sequence
atgaaacttcacccacctcctccttcccctgtaacacaagatcatagatccaagtcctcacacagtaattggtttctggttctcccaagccttggccggtctctccaaagtgctctcgacgtttcccccaagcacgtgctgtccgaacgcagcgtgctccaggttgcctgcagactactcgacgcgttggagttcctgcatgagaatgaatacgtgcacggaaacgtgaccgctgagaacatatttgtcgatcctgaagatcaatcgcaagtgacacttgccgggtatggattcgcttttaggtactgccctagcggcaaacacgtcgcctatgtggaaggctcccgttccccccacgaaggcgatctggaatttattagcatggacctgcacaagggctgtggacccagccggaggtcagacttacaaagcctggggtattgtatgcttaaatggctgtacggctttctgccatggacaaactgtcttcccaatacagaagacatcatgaaacagaagcagaaatttgtggataagccaggcccgttcgtaggcccttgtggacactggatccgcccttctgaaaccttgcagaaatacctaaaagtcgtaatggctctgacatatgaagagaaacctccatacgctatgctcaggaataacctggaggctctccttcaggacctcagagtttccccatacgaccccatcgggcttcctatggtcccctag

SEQ ID NO: 13726 - DNA, 645 bp, Artificial Sequence
  Description of Artificial Sequence: Synthetic coding sequence
atgtcccctaagcccagggccagcggaccacccgcaaaggccaaggaggccggtaagagaaagtcgagcagccagcctagtcctagcgaccctaaaaagaaaacgactaaggtagccaaaaaaggtaaggctgtgcgtagaggacgcaggggcaagaagggcgcagcaaccaaaatggccgcggtaactgcccctgaggcagagagtggccccgctgctcctggaccatccgaccaaccatctcaggagctcccacaacacgaacttcctcctgaggagccagtgagtgaggtggaggagcccctttcacaggagagccaagtagaagaaccactgtcacaggaaagcgaggttgaggaaccattaagccaggaaagccaggtcgaggaacctctatctcaggagtcggaagtcgaagaacccctaagccaggaaagccaggtggaggaaccgctgtctcaggagagtgaagttgaagagcccctttcgcaggaaagtcaggttgaagagcctctgagtcaagagagcgagatggaggaacccctgagccaggagtcgcaagtcgaggagccgctttcgcaggagtcggagatggaggagccactgagccaggagtccgagatggaagagttgccttccgtgtag

SEQ ID NO: 13727 - DNA, 561 bp, Artificial Sequence
  Description of Artificial Sequence: Synthetic coding sequence
atgagcccgaagccacgagctagtggtcctcccgccaaggccaaggaagcaggtaaacggaagagttccagtcagccttcaccgtctgatccaaagaagaaaaccaccaaggtggctaagaagggtaaggccgtaagaagggggaggcgcggaaagaaaggtgccgccactaaaatggccgcagttacagcccccgaagctgaatctggtccagctgccccaggcccctctgaccagccatcgcaggaactaccgcagcacgaactccctcccgaagagcccgtgtctgaagggacccagcacgaccccctcagtcaggaatctgaactggaggagcctcttagccaggagtccgaagtggaagagccactgagccaagaaagtcaagtggaggaacctctatctcaagagagcgaagtcgaagagccactgagtcaggaatcccaagttgaagaacctttaagccaagaatccgaaatggaggagccactgtcgcaggaatctcaggttgaagaacctctgtcccaggagtctgaaatggaggaacttccatcagtttag

SEQ ID NO: 13728 - DNA, 651 bp, Artificial Sequence
  Description of Artificial Sequence: Synthetic coding sequence
atgtcaccaaagcccagggcctcggggcccccggctaaagcaaaggaggcaggtaagcggaagtcatcctctcagccctctccatctgaccccaaaaagaaaactacaaaggtagctaagaagggaaaggcagtgaggagggggcgccgcggtaaaaaaggcgccgccaccaaaatggccgcagtgaccgcccctgaggccgagtcaggccctgcagcaccggggccgagcgatcaaccctctcaggaactgcctcaacacgagctgccacctgaagagcccgtctccgaggggacacagcatgatcctctgtcgcaggagagtgagctagaggagccacttagccaagagtccgaggtggaggaaccgctgtcccaggagtcgcaggtggaggagccactgagccaagaaagcgaggtcgaggagccattgtcccaggagagccaggtggaggaaccactgagccaggaaagcgaggtggaggagccactgtcacaagagtcacaagtggaagagccgctgtcccaagagtccgagatggaagagccactcagtcaggaatcccaagtggaggagccgctgtctcaggaaagcgagatggaggagccactgagccaggagagcgaaatggaagagctgcctagcgtctag

SEQ ID NO: 13729 - DNA, 561 bp, Artificial Sequence
  Description of Artificial Sequence: Synthetic coding sequence
atgtcacccaagccccgggctagcggacctccagccaaggcaaaagaggccggaaagaggaaatctagttcccagccttctccatctgatcccaaaaaaaagacaactaaggtagctaaaaagggcaaggcagtgagaaggggccgcaggggaaaaaaaggtgcggctaccaaaatggccgcagtaactgcaccagaagctgagtctgggcctgccgcccctggtccctccgatcagccgtcgcaggagttaccgcagcatgaactgccacccgaagagcccgtctcagaagggacgcagcacgacccacttagccaggaaagtgagctcgaagagcccctgtctcaggaatcagaggtggaggagccactttcacaggagagccaggtggaagaacctctgagccaggagagcgaggtggaggagcccctctcccaggagagccaggttgaggagccattaagtcaggagtctgaagtcgaagagcctctttctcaggagtcagaggttgaagaacctctctctcaggagagtgaaatggaagaattgccgagcgtttag

SEQ ID NO: 13730 - DNA, 777 bp, Artificial Sequence
  Description of Artificial Sequence: Synthetic coding sequence
atgcggctgtcttcttcaccgcctagaggtccacaacagctgagcagcttcggatctgtggattggctgtctcagtcatcttgcagcggccctacacacactcctaggcccgccgattttagtctggggtcactccctggaccaggccagaccagcggtgctagggaaccgcctcaagcagtttctataaaggaggccgccggcagcagcaatcttcccgcgcccgagagaacaatggctggtctctcaaaagaacccaacactctgagggctcctagggttcgcacggccttcacaatggaacaagtgcggacactagaaggagtgttccaacaccaccagtacctgtctccccttgagaggaaacgactggcccgcgagatgcagctctcggaggtgcaaattaagacatggtttcaaaacagacggatgaagcacaaaagacagatgcaggatccgcagcttcacagcccgttctctgggtccctccatgctccacccgctttctatagcactagtagcggcctagccaacggcctgcaactactctgtccttgggcgccactgagtggcccccaggcgcttatgctgccccccgggagtttctgggggctttgccaggtggctcaggaggccctggcctctgcgggagcttcctgctgtggtcaaccattagccagtcaccccccaacaccaggtcgaccttccctcggtcccgccctgtcaaccgggcctcggggtttatgtgcgatgcctcagacaggggatgccttttag

SEQ ID NO: 13731 - DNA, 561 bp, Artificial Sequence
  Description of Artificial Sequence: Synthetic coding sequence
atgtttggcaagccggacaagatggatgtgagatgtcacagcgacgccgaggcagcaagagtttctaaaaacgctcacaaagagtccagggaatctaagggtgctgagggcaacctcccggcagctttcctgaaggagcctcagggcgctttctcagctagcggcgccgctgaggattgcaacaaatccaaatccaacagcgctgcagatccggactattgccggcggattctggtgagagatgcgaagggaagcatcagggagataatcctgccgaaaggcctcgatctagataggcctaagcgaacaagaacatcttttactgcagagcagttgtaccgattggagatggagtttcaacgctgccaatatgtagttggtagagaacgaactgaactcgctagacagctaaatctgagcgaaacccaggccaattccgaggagaataatgagaggttcaagcggggcatcaaaaagcagaaaaaaaaacgtaagaaagaacccgctaatgatgagtcccggaggggcgattccggagggcggggatggcagcccctttag

SEQ ID NO: 13732 - DNA, 1005 bp, Artificial Sequence
  Description of Artificial Sequence: Synthetic coding sequence
atgttcgggaagccggataaaatggacgtgaggtgccactcagatgccgaggcagctcgggtgtcaaaaaacgctcacaaggaatccagggaaagtaaaggagcggaggggaatctgccggcggcatttctcaaagagccccaaggggctttctctgcatcaggggcagccgaggattgcaacaaaagcaagtctaactctgccgctgatccagactactgccggcgcatcctcgtgcgtgatgccaagggaagtatcagagagatcatcctccccaaaggtttggacctggaccgccccaaaagaactcggacttcttttaccgctgagcagctgtaccggctagagatggagtttcagcgatgccagtatgtggtgggaagagagaggactgagctggcacgccagctaaatctgagtgaaactcaggttaaggtttggttccagaatcgcaggaccaaacagaagaaagatcaaggcaaggactctgagcttagatctgttgtgtccgagaccgccgctacttgttccgtgctgaggctgttggagcaggggcgactgctgtcacctcctgggttaccagctttgttaccaccgtgtgctaccggtgcccttggcagtgccttgcgtggaccatccctgcccgcgctcggtgctggcgctgccgctgggtctgccgcagccgcagccgctgccgcccccggccccgccggcgctgcttctccccatccccccgccgttgggggcgcccccggccctggtccagccgggccgggcggtctgcatgccggggcgccagctgcgggacacagtctctttagtcttcctgtgccatccctgctcggatccgtcgctagccgcctgtccagtgcaccactgaccatggccgggtctctagcaggcaatctgcaggagcttagcgcacgttacctgagctcatcagcatttgaaccctactcccggacgaacaacaaagagggtgccgagaagaaggcactggactag

SEQ ID NO: 13733 - DNA, 711 bp, Artificial Sequence
  Description of Artificial Sequence: Synthetic coding sequence
atgacagcagagttcctgagcttgctgtgtctggggctgtgtctcggatacgaggatgagaaaaaaaatgaaaagcctcccaaaccttcactgcatgcatggccctctagcgtcgtggaggccgagtccaacgtgaccctcaagtgtcaggctcactctcagaacgttacatttgtgctccggaaggtgaacgactctggctacaagcaggagcagtcctccgccgagaacgaggcagagtttcctttcacagatctgaaacccaaagacgcaggacggtacttctgcgcatataagaccacagcctcacacgaatggtccgagtctagcgagcacctccagttggtggtcaccgacaaacacgatgagttggaggcaccgagcatgaagactgatacacggacgatattcgttgctatcttttcttgcatttccatccttctgctgttcctgagtgtgttcattatctatcgctgtagtcagcacagctcgtcctccgaagagagcacaaaaaggacctcccatagcaaattgcccgaacaagaggctgcagaagcggatctgagcaatatggaacgcgtgtcacttagcacggccgacccccagggcgtaacctatgccgaactgagtacttccgccctgtcagaagccgcctccgacacaacacaagagcccccagggagccacgaatacgcagcacttaaggtatag

SEQ ID NO: 13734 - DNA, 447 bp, Artificial Sequence
  Description of Artificial Sequence: Synthetic coding sequence
atgagaaagcgcatgggcccgacgcgactgcccaggctggagtgttctggcgctattactgctcactgcagtctcgacctgcccgggccggataagcacgacgaattagaagccccttccatgaaaacggacacacgcaccatatttgttgctatcttcagctgcatctccatattactgctgttcttatctgttttcatcatctacaggtgttcacagcattcgagcagtagtgaggaatccacaaagcgaacatctcacagcaagttaccagagcaagaagcagccgaggctgatctttctaacatggagcgggtgtctcttagtaccgctgaccctcagggcgtgacttatgctgagctaagtacctcggctctgtcagaggccgcctccgataccacccaggagccacctggatcacacgagtacgcagccctgaaagtgtag

SEQ ID NO: 13735 - DNA, 618 bp, Artificial Sequence
  Description of Artificial Sequence: Synthetic coding sequence
atgaccgcagagtttttgtcactgctgtgtctgggcctttgtctgggttatgaggacgagaagaaaaacgagaagccacccaaaccgagtctgcacgcctggccctccagtgtggttgaggcagagtcgaacgtgactctgaagtgccaagctcattcccagaacgtaaccttcgtgttacggaaggtaaatgacagcggctacaagcaagagcagtctagtgccgaaaatgaagccgaatttccttttactgaccttaaacccaaagatgctggacggtacttttgcgcttacaagaccacagcaagtcatgagtggtccgagagctctgagcacttgcagctcgtggtgaccgacaagcatgatgaactcgaggccccctcaatgaagaccggatccagttcagaggaaagcacaaagcggacctctcactccaaattacctgagcaggaggcggctgaagccgatttgagcaatatggaaagggtgagtctgtccactgctgaccctcagggcgtaacttacgccgagctctctacgagtgccttaagcgaagccgcttccgatacaactcaggagccacctggcagccatgagtatgctgccttaaaggtgtag

SEQ ID NO: 13736 - DNA, 432 bp, Artificial Sequence
  Description of Artificial Sequence: Synthetic coding sequence
atgacagccgagtttctcagccttctgtgtctaggactgtgtctgggttacgaggatgagaaaaagaacgagaaacccccaaaaccaagtctgcatgcctggccttcttcagtggttgaggctgagagcaacgtaactttaaagtgccaggcgcacagccagaacgtgactttcgtccttcggaaggtgaatgactctggatacaaacaggagcagagctcagccgaaaatgaagccgaattcccattcacagacctgaaacccaaggacgcgggaaggtacttttgcgcgtataagaccactgccagccacgagtggagtgaatcctctgaacacctacagctcgtggtgaccgacaagcacgatgaactggaagcaccctcaatgaagacggtggcgcatgtgtgcaatactcggacgctgggcaggtag

SEQ ID NO: 13737 - DNA, 1272 bp, Artificial Sequence
  Description of Artificial Sequence: Synthetic coding sequence
atggctcagcttcagacaagattctatacagataataagaaatatgccgtcgacgatgtgccctttagcatccctgctgcctctgaaattgctgatctgagtaatatcatcaataagctgcttaaggataaaaacgaattccacaagcacgtggaattcgacttcttgatcaagggacagttcttaagaatgcccctggacaaacacatggagatggagaacataagctctgaagaggtggtggagattgaatacgtcgagaagtatactgcaccccaacctgagcagtgtatgttccacgacgactggatttcaagcattaaaggagccgaagagtggattctcactgggagctatgataaaacatccaggatctggtctttggaaggcaagtccattatgaccatagttgggcataccgacgtagtgaaggacgtggcatgggttaaaaaggactccctgtcctgcctcttgttgtcagccagtatggatcagacaatactcctgtgggaatggaacgtcgaacgtaataaagtaaaggccctgcactgttgtcgagggcatgccggctctgtcgatagcatagcagtggatggctccggtaccaagttctgctcaggaagctgggataagatgctcaagatctggagtactgtacctaccgatgaggaggatgaaatggaggagtccacgaacaggcctagaaaaaagcagaagaccgagcaactaggtcttacccggacgccaattgtgactttgagtggccatatggaagcagtgtctagtgtactgtggtcagatgccgaggagatttgtagcgctagttgggaccatacgatccgagtgtgggacgtagaatccggatcattgaagagtacactgaccgggaacaaggtgttcaactgtatttcttatagcccactgtgtaagaggctagccagcggtagcaccgacagacatataaggctgtgggatccacgcactaaggacggcagcttggtgtcactgagcctcacgtcacacacgggctgggtgacctccgtcaaatggagcccaacacacgagcagcaactcatcagcggcagcctcgacaatattgtgaaactgtgggacaccaggtcttgcaaggcgccactatatgacctggcagcccacgaggacaaggtcttgtccgttgactggaccgacacaggactgctgttgtccggaggcgccgacaataaattgtactcctacagatactcccctactaccagccatgtgggagcctag

SEQ ID NO: 13738 - DNA, 2034 bp, Artificial Sequence
  Description of Artificial Sequence: Synthetic coding sequence
atggccgccgggggcggggggtcttgcgatcccttggcacctgccggggtcccctgcgcattctcacctcattcgcaggcctacttcgcactcgcttcgactgatggtcatttaagagtttgggagactgcgaacaaccgccttcaccaggaatatgttcccagtgcgcatctttctggcacatgcacctgtctcgcttgggcgcctgcacgcctgcaggccaaagaatccccccagcgcaaaaaacggaagagtgaggctgttggaatgagtaatcagactgacctcttggccttaggtactgccgtgggatccatccttttgtactcaactgtgaagggggagttacatagcaagctgatttcaggcggtcacgataatcgggtgaactgcattcagtggcaccaggattcaggctgcctgtacagttgttctgacgataagcacattgtagagtggaacgtccaaacctgcaaggttaaatgcaaatggaagggcgacaatagttccgtgtcttcattgtgtatctcccctgacggaaagatgttactgtcagcgggccggaccattaagctttgggtgctggaaaccaaagaggtttatagacactttaccggacacgccacgccagtttccagcttgatgtttacaaccatccgcccgccaaatgagtcgcagcccttcgatggaattaccggcctgtacttcctaagcggcgctgtgcacgatcgcttgcttaacgtgtggcaggttaggtctgagaacaaggagaaaagcgctgtcatgtcctttacagtgaccgacgaacccgtctatattgacctcacattgtctgaaaacaaggaggagcccgtcaagcttgctgtggtatgccgcgatggtcaagtacatcttttcgagcatatcctcaacgggtactgtaaaaaacctctcacttccaactgcacgatacagatcgcaacccctgggaagggcaagaaatcgacaccaaaacccatcccgattctagctgccggcttctgctcggataagatgtctctgcttttggtgtatggtagttggtttcagccaacaatcgagcgagtcgctctgaacagtcgggagcctcacatgtgtctggttagggacattagcaattgctgggcacccaaggttgaaacagccataacaaaagttcggacccctgtgatgaattcagaggccaaggtgctagtgccaggcatccctgggcaccacgcagctatcaaacctgcccccccccagaccgagcaggtggagtccaagaggaagtcaggtggtaatgaggtgtctatcgaggaaagacttggcgccatggacatcgatacacataagaaaggcaaggaagacctgcaaaccaacagttttcctgtgttgctgacacagggccttgagtcaaacgacttcgaaatgctcaacaaggttttacagacacggaacgtgaatctcatcaaaaagaccgtactgaggatgcctcttcatactatcattcctcttcttcaggagctgacaaagcgactgcaggggcacccaaactccgccgtcttaatggtgcagtggctcaagtgcgtgctcaccgtgcacgcaagttatctcagcacactgcccgacctggtcccacagttaggaacactctatcagctgatggagtctcgggttaagactttccagaagctctcccacctccacggtaaactgatactcttgattacacaagtgacggcctctgagaagaccaaaggcgccacatcacctgggcagaaggcaaagctcgtgtacgaggaagaatcctcagaggaggaatccgatgatgagatcgcagacaaggacagtgaagacaattgggatgaggacgaggaggaatcagagtccgagaaagacgaggatgtggaagaagaagatgaggacgcggagggcaaagacgaagaaaacggcgaagaccgcgacacggcttcagaaaaagaacttaatggagactcagacctggatcccgagaacgagtcagaggaagagtag

SEQ ID NO: 13739 - DNA, 1005 bp, Artificial Sequence
  Description of Artificial Sequence: Synthetic coding sequence
atggccactgaagaaaaaaagcccgagacagaagccgcgcgggcccagcccactccttccagtagcgctacccagagcaaacccactcccgtgaaacccaactacgccctcaagtttaccctcgctggtcataccaaggccgtaagtagcgtaaaattttcccccaatggcgaatggctggccagctcaagtgcggataaactgataaagatctggggagcctatgacggtaaattcgagaagacaatcagcggccataagctgggtatctctgacgtggcctggtcctcagattcaaacttgctagtgtcagctagcgacgataagaccctgaagatttgggacgtttcatccgggaagtgtctgaaaacactcaagggccatagcaattacgtcttctgctgtaacttcaatccccagtccaatctgattgtgtcggggtcgttcgacgagtccgtccggatatgggacgtcaaaacggggaagtgtctgaagacactgccagcccatagcgaccccgtttcagctgtccacttcaatcgggacgggtcactgatcgtatcaagcagctacgacggtttgtgtaggatctgggacaccgcatctggccagtgcctgaagactctcatcgacgatgataacccacccgtgtcattcgtgaaattctcacccaatggtaagtatatactggcagcaacactggataacaccctgaaactctgggactacagtaaggggaaatgcctcaagacctacacaggccataaaaatgagaaatattgcatatttgctaacttttccgttacagggggaaagtggatagttagcggatccgaggacaacctcgtatacatctggaatctccaaaccaaggaaatcgtccaaaagctgcaaggtcataccgatgtcgtcatctccactgcctgccaccctaccgagaacatcatcgcaagtgctgctctggaaaacgataagaccataaagttgtggaagtcagactgctag

SEQ ID NO: 13740 - DNA, 1005 bp, Artificial Sequence
  Description of Artificial Sequence: Synthetic coding sequence
atggccactgaagaaaagaagcctgagacagaggctgcccgggcacagccaaccccctccagcagtgcaacacaatctaagccaactccagttaagccaaattacgccttgaagtttaccttggccggccacacaaaagcagttagttctgtcaagttttccccaaatggcgagtggttagcctcttcttccgcagacaaattgatcaaaatttggggagcttacgacgggaagttcgagaaaacgatcagtgggcacaaattgggcatcagtgatgtcgcttggagctccgatagcaatctgctggtttctgcttcagacgacaaaacgctgaagatctgggacgtgtctagcggcaaatgcctcaaaactctcaagggacattcaaattatgtgttctgttgcaatttcaacccccagagtaacttgattgtatctgggtcatttgacgagagcgttaggatttgggatgtcaagaccgggaaatgtctcaaaaccctgccggcgcatagtgatcctgtgtcagctgtccatttcaacagagacgggtccctaattgtatcaagttcatacgacgggctgtgcagaatatgggacactgcttccgggcaatgcttgaagacacttatcgatgacgacaatcctcctgtctctttcgtgaagttttcaccgaacgggaaatatattttagccgcaaccctcgataacacgctaaagctttgggattacagcaaggggaagtgcctgaagacttatactgggcataagaatgaaaaatattgtatctttgccaacttctctgtaaccggggggaagtggatcgtgtcgggctcagaagataacctcgtatacatctggaatctgcagacgaaggagatcgtccagaaacttcagggacatacggacgtcgtcatatcaaccgcatgccatccaactgaaaatatcatcgcttccgctgcattggagaacgacaaaacgatcaagctgtggaagtcagactgttag

SEQ ID NO: 13741 - DNA, 1158 bp, Artificial Sequence
  Description of Artificial Sequence: Synthetic coding sequence
atggcagccgctgctgcccggtggaatcacgtatgggtgggcacagagacgggtattctaaagggcgtgaatctgcagcggaaacaagccgctaatttcaccgcgggcgggcagccacggagggaagaagccgtgtcagcgctctgttggggtacaggcggcgaaacacagatgctggtgggttgtgccgacaggactgtgaaacatttttccactgaggacggtatcttccagggacagaggcactgccctggtggcgagggaatgtttcggggtttagctcaggctgacgggacactaatcacatgcgtggatagtggaattctccgggtctggcacgataaggacaaggacacaagcagcgaccctctgcttgaactgagagttgggccaggagtctgccgcatgcgccaggatcccgctcaccctcacgtggttgccacgggcgggaaggaaaacgctctgaaaatatgggatctgcagggctctgaagagcccgtattcagggcaaagaatgtccgcaacgattggctagacctgcgcgtcccaatttgggatcaggacatccagttcttaccaggctcccagaagttggtgacctgcaccgggtaccaccaggtcagagtgtacgatccagcttctccacaacggcgtccggtgctggaaactacttacggagagtacccattgaccgcaatgacactaactccaggcggtaatagtgtgattgtcggcaacactcacggacagttagccgagatagacctgagacaaggaaggctactgggctgtctgaaaggattagcaggctcagtgcggggtctgcaatgccatccttctaaaccactgttagcttcgtgtggactggacagagtgctcagaatacacaggatccagaatccgaggggactggagcataaagtctacctgaaatcacagctgaattgcctgctcctctcaggcagggataattgggaggacgagccacaggaaccacaggaacctaacaaagtgccgctcgaggacacggaaactgacgaactgtgggccagtcttgaagccgccgcaaagcgtaagttgtctggtctggaacaaccacagggggcacttcagactaggcgccgcaagaagaagcggcctgggtccacatccccctag

SEQ ID NO: 13742 - DNA, 1101 bp, Artificial Sequence
  Description of Artificial Sequence: Synthetic coding sequence
atggccgccgctgctgcacggtggaaccacgtgtgggtgggcactgaaaccggtattttgaagggggtaaatctgcagagaaagcaggctgccaattttaccgctggggggcagccccggagggaggaagcagtctccgcactgtgttggggaactggcggtgagactcagatgctggttggatgcgccgatcgtacagtgaaacatttctcgacggaagatgggatcttccagggacagagacactgtcctggaggcgaaggaatgttccgcggcttggcccaggctgacggtactttgattacctgcgttgattccggcattttacgcgtttggcacgacaaagataaggacacttctagcgaccccctcctagagctccgcgttggccctggagtctgtaggatgaggcaggaccctgcacaccctcacgtggtggccaccggcggaaaagaaaatgctcttaaaatatgggatctgcaggggagcgaggagcccgtgtttcgcgccaagaatgtgcgcaacgactggctggacctgcgggtccccatttgggatcaggacattcagtttctacctggtagtcaaaaactagtcacctgcacaggctatcatcaggtgcgcgtttacgaccctgcaagcccacagcggcgtcccgtcttggaaaccacatacggcgaataccctctcactgctatgaccctcacccccggggggaatagcgtaatagtgggcaacacgcacggtcaattagcagaaatcgacctgcggcagggcaggctactcgggtgcctcaagggtcttgctgggagcgtcaggggactccagtgtcacccctcgaagccactgctggcaagttgtggacttgacagggttctccgtattcacagaatccagaacccccggggcctggaacataaagacgagcctcaggagccacaggaaccaaataaggtaccacttgaggacaccgagactgatgaattgtgggcgtccctggaggcagcagctaagaggaaactgagcggcctcgagcagcctcagggcgctctccaaacacgacgccggaagaagaaacggcctggttccacgtctccatag

SEQ ID NO: 13743 - DNA, 1158 bp, Artificial Sequence
  Description of Artificial Sequence: Synthetic coding sequence
atggccgccgccgccgctcggtggaaccatgtgtgggtcggcacagaaacaggcatcttaaagggggtaaaccttcagcgtaagcaggcagcgaattttacggctggcggacagccccggcgagaagaggccgtttctgccctctgctggggtactgggggagaaacccaaatgcttgttggatgcgcagacaggacagtcaagcattttagcaccgaagatggcatcttccaggggcagaggcactgtcccggaggggaaggtatgtttcgcggtctggcccaggccgacggaacccttattacctgcgtggacagcggtattctacgggtgtggcacgacaaagacaaagatacatctagcgatcctttgttggagctgcgcgtaggcccaggcgtttgccggatgagacaggaccccgctcaccctcatgtcgtcgcaacaggtggcaaggagaacgcactgaaaatttgggatctgcagggcagcgaagagccagtctttagggcgaaaaacgtgcgcaacgattggctggatttgcgcgttcctatctgggatcaggatatccagttcctaccaggcagtcagaagctggtcacctgcacaggctatcaccaggtacgagtctatgaccccgcctcacctcaacgcaggcctgtgctggagactacctatggcgaatatcctctgactgcaatgacacttaccccaggcgggaacagcgtgatcgtggggaacactcatggtcagctcgctgagattgatctcagacagggacgccttttaggatgcctaaaagggctggcgggaagcgttagaggactgcagtgtcacccctccaaacctctgcttgcctcttgtggtctcgacagggtgctgcgcattcaccggatacagaatcccagaggcttagagcacaaagtgtacctaaaaagccagctcaattgtttactgctgtccggccgggataattgggaggacgagcctcaagagccccaggagcccaataaggtgcctctggaagatacagagactgacgaactctgggcctccctcgaagccgccgctaagaggaagctgtctggcctagagcagcctcagggcgctctgcaaaccaggagacgcaagaaaaaacggcctggttcgaccagtccatag

SEQ ID NO: 13744 - DNA, 1158 bp, Artificial Sequence
  Description of Artificial Sequence: Synthetic coding sequence
atggctgcagctgccgccaggtggaaccatgtgtgggttgggacagagaccgggattctcaagggagtcaacctgcagcgtaaacaagcagccaacttcacggccggaggccagccccgtagggaagaggctgtttccgctctttgctggggcactgggggagaaacacagatgcttgtcggctgcgcagaccgtacggtaaagcattttagtaccgaagatggcattttccagggccagaggcactgtcccggaggtgaaggcatgttcaggggtctggcccaagcggatgggacgctgatcacgtgcgtcgacagtggaattctgcgggtgtggcacgacaaagacaaagacacaagttcggatcctctgttggagctacgggtcggccccggagtgtgcagaatgcgccaggacccggcccaccctcatgtggtggccactggaggcaaagagaacgccctgaagatctgggacctccagggatccgaggagcctgtattcagagcgaaaaacgtgcggaacgactggcttgacctgagagtccctatctgggaccaggacatccagttcctcccaggaagccaaaagctcgtgacatgtacgggataccaccaggtgcgcgtgtacgaccccgcttctccccaacggcgacctgttctcgaaaccacctacggtgaatacccactcacggctatgaccctgacccctgggggcaatagtgttattgtgggtaacactcacgggcaactggccgaaatcgacttgcgccaaggccggcttcttggatgtttaaaaggtcttgcgggatccgtgcggggactgcagtgccacccgagtaagccacttctggcaagctgcggcttggacagagtgctgcggatccacagaattcagaatcccagaggactggagcacaaagtgtatttaaagtcacagcttaattgcctgctgctgtcaggacgggataactgggaagacgaaccgcaagaaccccaagagccaaataaagtgcctttagaggacactgagacagacgagctttgggcctccctggaagccgcagcaaagcggaagctgtccggcctcgagcagccacagggcgcgttgcaaacacgaagacgaaagaaaaagcgtcccggctccacaagtccctag

SEQ ID NO: 13745 - DNA, 117 bp, Artificial Sequence
  Description of Artificial Sequence: Synthetic coding sequence
taatgggcatccttggaggcagctgcaaaacggaagctgagtggcttggagcagccccaaggtgcgctccagactaggcgtaggaagaagaaacgacctggttctacatctccctag

SEQ ID NO: 13746 - DNA, 174 bp, Artificial Sequence
  Description of Artificial Sequence: Synthetic coding sequence
atggccgctgcagcagcccggtggaatcacgtgtgggtggggactgagacaggtatcctgaaaggcgtgaacctgcaacggaagcaggcagctaatttcaccgccggcgggcaacccaggcgtgaagaggctgtgagcgcactttgctgggggacagggggagagactcagtag

SEQ ID NO: 13747 - DNA, 2493 bp, Artificial Sequence
  Description of Artificial Sequence: Synthetic coding sequence
atggtcgaagaggagaatattagggtagtacgctgcggcggctccgagctgaacttccgacgggccgtcttctcggccgacagcaaatatattttttgcgtctcgggggacttcgtgaaggtctattcaaccgtgacagaagagtgcgtgcacatcctccacggtcaccgcaatctggtaactgggatccaactgaacccgaataatcacctccagctctattcatgctcactggacggtaccattaaactctgggattatatcgatgggatcttaattaagacctttattgtgggatgcaagttgcacgccttattcacgctcgcccaggcagaagactctgtgttcgtgattgtgaataaagaaaagcctgatatcttccagctggtatctgtaaaactccctaaaagcagcagccaagaagttgaggctaaagagctctctttcgtgttggattacatcaaccagtctcctaaatgcattgcctttgggaacgagggcgtgtacgtcgctgcagtgcgagaattttacttatctgtgtatttttttaaaaagaagacgacatcaagattcactttgtctagctcaagaaataaaaagcacgccaagaacaactttacttgtgtggcctgccaccccaccgaagattgtattgcctcaggacacatggacggcaagattcgcctgtggaggaacttctatgacgataaaaaatacacatatacatgcctgcactggcaccacgatatggtgatggacctggccttcagtgtaacaggcacaagccttctttccggggggcgggaatctgtccttgtggagtggagggatgcgactgaaaagaataaagagttcctccctcgcctcggagccaccatcgagcacatatcggtcagtcccgcaggcgacctgttctgtacaagccactctgacaataaaatcatcatcatccaccggaacttggaagcgtctgccgtgatccagggtctcgtcaaagacaggtccatcttcaccggactgatgattgacccacgcactaaagctctcgtcctgaatggaaaacccgggcatctgcaattctactctctgcagagtgataagcagctgtacaacctcgatatcatccaacaggagtatatcaacgactacggcttaattcagattgagctgacaaaggccgcctttggatgcttcgggaattggctggccaccgtggagcagcggcaggaaaaggagacagagctcgaactgcaaatgaagctctggatgtacaataagaagactcagggatttatcttgaatactaagatcaatatgccccatgaagattgcatcacagctctgtgcttctgcaacgcagaaaagtccgagcagcctaccctggtgactgcatccaaagacggttactttaaggtgtggatccttaccgatgattcggacatatacaagaaggccgtagggtggacgtgtgacttcgtgggttcctatcacaaataccaagctaccaactgctgtttcagtgaagatgggtccctcctcgccgttagcttcgaagagatcgtcaccatctgggacagcgtcacatgggagctcaaatgcacattttgccaaagggctgggaagatccgacatctgtgtttcggaagattaacctgttctaagtacctgctgggcgctaccgaaaacggaattctgtgctgttggaatttgctgtcatgcgcactggaatggaatgctaagctgaatgtcagagtaatggaacctgatcctaatagcgaaaacatagctgccatcagccagagttcagtgggctcagatctgttcgtgttcaagccctccgaaccccggcctttgtatatccagaaaggtattagtcgggaaaaggtacagtggggggtcttcgtgccacgtgacgtaccggagtcattcacctctgaggcataccagtggctgaataggtctcagttttacttcctgacaaagtcccagtctctcctcacttttagtaccaaaagccctgaggaaaagctcacacctactagcaaacagctgttggcagaagagagtctgcctactacccctttctactttatactgggaaagcaccgccagcagcaagacgagaaactgaatgagacactggaaaatgagctggtgcagctgcccctgaccgagaacatccccgccatcagcgagctcttgcatacacccgcccacgtcctccctagtgccgctttcctgtgtagtatgtttgtcaactccctgctccttagcaaagaaacgaaatccgctaaagagatcccggaggatgtagacatggaggaagagaaagaatcagaggacagtgatgaagagaatgactttaccgagaaagtccaagataccagtaacacagggcttggggaagatattatccaccaattgagtaagagcgaagagaaggaacttcggaagtttaggaaaatcgattattcttggatagcggccctatag

SEQ ID NO: 13748 - DNA, 1155 bp, Artificial Sequence
  Description of Artificial Sequence: Synthetic coding sequence
atggtcaaactcattcacacgctggcagaccacggggatgatgtgaactgctgcgctttctccttttcacttttggctacatgtagtcttgataaaaccataagactgtattcgcttcgagatttcaccgaactccctcacagcccactcaaatttcacacctatgccgtacattgttgctgtttctcacctagcggacacattctggcttcttgcagtacggatgggaccaccgtcctctggaacaccgaaaacggtcaaatgttagccgtgatggaacagccaagtggatctcctgtgcgcgtgtgtcagttttcacccgacagcacatgcctggctagcggagcggccgacggcacggtagtcctttggaacgcacagtcatataagctttatcgctgtggctctgtgaaggacgggtccttggccgcgtgcgcgttcagtccaaatggatcgtttttcgttaccgggtcctcatgcggcgatctgacagtctgggatgacaagatgcgctgccctcactcggagaaggcccatgatctggggatcacctgctgtgatttctcatcacaacccgtcagcgacggggaacagggcttgcaattttttaggcttgcatcatgcggccaggattgccaggtgaaaatctggatcgtaagctttactcacatcctagcacgccggacagagcatcagctgaagcagtttaccgaggattggagcgaggaagatgtgtccacctggctttgcgcacaggatctgaaagacctcgtggggatcttcaaaatgaataatatagatgggaaagagcttctcaacctaactaaagagtccctcgcggatgatctgaagatcgagagcttaggcttaaggagcaaggtgctgaggaagatcgaggagctgcggactaaagttaaatctcttagttctggaatcccggatgagtttatctgcccgattactagagagctcatgaaagatccagtcatcgcatcagacggttatagctatgaaaaagaggccatggagaattggatcagcaagaagaagaggacctccccaatgaccaaccttgtcctcccatcagctgtcctcacccccaaccgcacactaaaaatggcaatcaatcggtggctagaaacgcaccagaaatag

SEQ ID NO: 13749 - DNA, 1431 bp, Artificial Sequence
  Description of Artificial Sequence: Synthetic coding sequence
atggtcaagctgattcacactttggcagaccacggtgacgacgttaattgctgcgcgttctctttctccctgcttgccacttgttccctggataaaacaattcgcttgtattcgctgagagactttacagagctgccccactcccctcttaaattccatacgtacgccgtccactgctgctgctttagcccatcaggccacattttggcttcctgttcgaccgatggaactactgtgctctggaataccgagaatgggcagatgctggctgtgatggagcagcccagcggctcacccgtaagggtatgtcaattcagcccagatagtacgtgcttagctagcggcgctgcggacggcaccgttgtactgtggaatgctcagtcatacaagttgtatcggtgcggatccgtgaaggatggcagtctagcagcatgcgccttctcacccaatggttcgttctttgtcactggcagcagttgcggggatctgacggtttgggatgataagatgcgatgccctcacagtgaaaaggctcatgatttaggcataacatgctgcgacttctcctcccaacccgtgagtgacggagaacagggattacagttttttcgtctggcgagctgtggacaggactgtcaagtgaaaatctggatcgtgagctttacccacatcctcgggtttgagttaaagtacaaatctacactgtcaggacactgcgctccagtcctggcctgcgctttctctcatgatggccaaatgctggtcagtggcagtgttgacaaatctgtgatcgtctacgacactaataccgaaaatattctgcacacattgactcagcacaccagatatgtcaccacttgcgcgtttgctcctaatacgcttctacttgctacgggttccatggataagacagttaatatctggcagttcgatctcgaaaccctgtgtcaggccagaaggactgagcatcagctcaagcagttcactgaggactggtccgaggaagacgtctctacatggctctgcgcccaggatttaaaggatctggtgggaatattcaagatgaacaatatagatggcaaggagctgctaaacctcactaaagagagcctcgccgatgaccttaagatcgagagtctgggtctgcgaagtaaggtgctccggaaaattgaagaactgaggaccaaggtaaaatccctatcatccggcattcccgacgagtttatctgtcctatcactcgggaactaatgaaagatccagttatcgcatccgatggctactcctatgaaaaggaagctatggaaaactggataagtaaaaagaagagaacaagtcctatgactaacctggtgttgccctctgcagtcctgacaccgaacaggactctgaagatggccataaaccggtggctcgaaactcaccagaagtag

SEQ ID NO: 13750 - DNA, 1431 bp, Artificial Sequence
  Description of Artificial Sequence: Synthetic coding sequence
atggtaaagctgattcatacactcgccgatcacggtgacgatgtgaactgttgtgcctttagtttctccctcctcgcgacatgttctctcgacaaaaccattcgtctctactcacttcgggattttactgagcttccccactctccccttaagtttcacacctatgcggttcattgttgctgtttttctccttcgggacatattctcgcttcatgctctactgacggcaccacagtgctgtggaacacagaaaatggtcagatgctggccgtgatggagcagcccagtggcagtcctgttcgagtatgtcagttttctcccgactcgacttgtctggcctccggcgccgcagatggcactgtggtgctctggaacgcccagtcatataaactctacagatgcggctcagttaaggatggatccctggctgcgtgtgcatttagtcccaacggctctttcttcgtaacaggtagttcatgcggagacctgaccgtctgggacgacaagatgagatgtcctcacagtgagaaggcacatgacttgggaatcacttgctgcgattttagttcccagccagtgtcagacggggaacaggggctgcagttttttcgacttgcgagctgtggtcaggattgtcaagtgaagatttggattgtctcctttacccacattctgggctttgagctgaagtacaagtccacacttagcgggcattgcgcccccgtcctcgcgtgcgccttctctcacgacggccagatgttggtcagtgggtcagtggataagtctgtcatcgtttacgacacaaacaccgagaatatcctgcatactctgacccagcatacccgctacgttacaacttgcgcctttgctcccaacacgctcctcctggccaccggttctatggataagaccgtgaatatctggcaattcgacctcgagacactctgccaagctcgccggactgagcaccagttgaagcagttcaccgaagattggtccgaggaggatgtgtcgacatggctctgcgcccaggacttaaaggacctggtcgggattttcaaaatgaacaatatcgacggaaaagagctcctgaatctgacaaaggagtctctggctgacgatttaaagattgaaagcctcggccttcggtccaaggtgctgcggaagatcgaagaactacgcaccaaggtgaaaagcctctccagtggaatccctgacgaattcatctgtcccattaccagggagctgatgaaagatccagttattgccagtgatggttacagttacgagaaggaggccatggagaattggatatctaaaaagaagcgcacctccccaatgaccaacctcgtgctgccatccgctgttttgacacccaatcggaccctgaagatggccataaatcgatggctggagacccaccagaagtag

SEQ ID NO: 13751 - DNA, 1431 bp, Artificial Sequence
  Description of Artificial Sequence: Synthetic coding sequence
atggtgaaattgatacacacccttgcggaccatggagacgatgtcaattgctgtgcattctcattttccctgctcgccacctgttctctggacaaaacgataaggttgtactccctgagggattttacagaactgccacacagcccgctgaaatttcacacatacgctgtccattgctgctgctttagccccagcggacatatcctggcttcatgctctacagacggtactacagtcttatggaacacagagaatgggcagatgctggccgtgatggaacagccaagcggttccccagttcgggtttgccagttttctccggatagcacctgtctggcaagcggagctgcagatggtacagtggtgctgtggaacgctcagtcctataaactctatagatgtggcagcgttaaggacggcagtctggcggcgtgtgcgttctcgcccaatgggtccttcttcgtaacaggaagtagctgcggggacctgacagtgtgggacgataagatgcgctgtcctcactccgaaaaggcccatgaccttgggattacgtgctgcgatttctctagccagcctgtttcggatggcgagcaaggtctgcaattctttcggctcgcatcttgtgggcaggactgtcaggtgaaaatctggatagtgagcttcactcacattctgggatttgagctgaaatacaagagtacactgagcggacattgtgcacctgtgctggcatgtgctttcagtcatgatggccagatgctggtgtccggcagcgtggacaaatccgtaattgtttacgataccaataccgagaatatcttacatacattaacccagcacaccaggtacgtgaccacctgtgcattcgcaccgaatacgctcctgcttgctacagggtcgatggataaaaccgtcaatatatggcagttcgacttagaaaccctctgccaggcccgtaggactgagcaccagctcaaacagtttaccgaggactggtctgaggaggacgtatccacctggctgtgcgcccaggacctcaaggatcttgttggaatttttaagatgaataacattgatgggaaagagctcctgaacttgacgaaagagagcctggcagatgaccttaaaatcgaatcattggggttgcgctccaaggtcctacgcaagattgaggaactgcggactaaggtcaagtctctgagtagcggaattcccgatgagttcatttgcccaataacacgcgagctaatgaaagatcccgtcatcgcttctgatggttactcgtatgaaaaagaagccatggagaattggattagcaagaagaaaaggacgagcccgatgacaaacctggttttgccaagcgcggtcctcacccccaataggaccctcaaaatggccatcaaccggtggttagagacccatcagaagtag

SEQ ID NO: 13752 - DNA, 2385 bp, Artificial Sequence
  Description of Artificial Sequence: Synthetic coding sequence
atggaaggctcgcttgcgggcagcttggccgccccggaccgtccccagggtcccgagaggttgcccggtccagcccctagagaaaacatcgagggaggggctgaggcagcagagggcgagggtggaattttcagatccacacgctacctaccagttacaaaggagggaccgcgggatatattggacgggcggggggggatttcagttgccaacttcgatccgggcaccttctcgctgatgcgatgtgacttctgcggggccggatttgacactcgagctgggctcagcagccacgccagagcccatttgcgagatttcggaattaccaactgggagctgaccgtctctcccatcaacatattgcaagagctgctcgcgacaagtgctgcagaacagccacctagcccgttaggacgggaacctggtggaccccccggtagttttctgacatctagacgtccaaggctgcccctgaccgttccgtttcctccaacctgggctgaggaccccggcccggcgtatggagacgcaagcgggcctgaacccgctcgcgatattcgttgcgaattctgcggcgagttttttgagaaccggaaaggtctttcgtcccatgcaagaagccacttgagacagatgggggtgactgagtggtacgtcaacggctcaccaattgacacactgcgagagatcttgaagcggaggacacagtctcgacccggggggccaccaaatccccccggaccttccccaaaggcattggcgaagatgatgggaggcgcaggccccgggagcagtttagaagcccggagtcccagcgacctgcacattagcccattggctaaaaaactccctccccctcctgggagtccactaggccatagcccaactgcatcaccacccccaaccgctaggaaaatgtttcctgggctggcagcaccttctttgccaaagaagctgaagcccgaacagattcgcgtcgagattaaacgggagatgttgccaggcgcactacacggcgagcttcatccatctgagggaccgtggggggccccacgcgaagacatgacacctctgaacctgtcctcccgagccgaacccgtcagggatattcgatgcgaattctgcggtgagtttttcgagaaccgcaagggcctgagcagccatgcgcgaagccatttacggcagatgggcgtcaccgagtggtctgttaacggatctcccatcgacacgctgagggagattttgaagaagaagagcaaaccgtgcctcattaaaaaagagccaccggcaggagacctcgcaccagcactggctgaggacgggccgcccactgtagcccccggcccagttcagagcccactgccccttagtcccctcgccgggcggcctggaaaacccggtgccggcccagcacaggtgccacgggaattatctttgacacccataaccggagcaaaaccctcagccaccggttacctgggctcagtggccgcaaaacggccgctccaggaggacaggttattgccagctgaggtgaaagccaagacctacattcagacggaactacccttcaaggcaaaaactcttcatgaaaaaacttctcacagtagcactgaagcatgctgcgaactttgtgggctgtactttgagaacaggaaagccctggcatcgcacgctcgcgcccatctgcgccagtttggggtcactgagtggtgtgtcaacggctctcctatagaaacgctgagcgaatggatcaaacacagacctcagaaggtgggcgcctatcgttcatacatacaaggcggacgccccttcaccaaaaaattccggagcgcgggccacgggagagactccgataaacgtccctccctgggactggcccccggaggcctcgccgtggtcgggagatctgccggcggggaacctggcccggaagcgggccgggctgccgacgggggtgagagacctctggccgcttccccaccaggcacggtgaaagcagaggaacaccagcgacagaatatcaataagttcgaacggcggcaggctcgacctccggacgcttcagccgcgaggggtggggaagacactaacgacctacaacagaagctggaagaggtgcggcagcctccccctcgtgtgagacccgtcccaagtcttgtacccaggccacctcagacaagccttgtcaaattcgtaggtaacatctacactctcaaatgcagattctgtgaggttgaattccagggaccgctgtcaatccaggaagagtgggtgagacaccttcagcgacacattctcgaaatgaacttctctaaagctgatccaccccctgaggaatctcaggctccacaggcacagactgccgctgctgaggccccctag

SEQ ID NO: 13753 - DNA, 4956 bp, Artificial Sequence
  Description of Artificial Sequence: Synthetic coding sequence
atggaggggtcgttggcagggtcactggctgccccggatagaccccagggccctgaacggcttcctggacctgcccctcgcgagaacatagagggcggagctgaggccgccgagggcgagggaggtatcttccggtccacccgctacctcccagtcacaaaggaaggtcccagggatattttggacggcagaggcggcatcagcggaacacctgacggaagggggccttgggagcacccgctggtgcaggaggcaggagaagggatcctctccgagagaagatttgaggattcggttatcgtaagaacgatgaagcctcacgctgagcttgaaggctctcggcgttttttgcaccacagaggcgagccccgactgctggaaaagcatgcccagggccgccccagatttgattggctgcaggatgaggatgaacagggttctccacaagatgcaggtttacacctggatttgcctgctcagccgccacccctggccccattccggcgggtgtttgtaccagtagaggatactcccaaaaccttggacatggccgtggttggcgggagggaagacctggaggatctcgagggactggcccagccctccgagtggggtctgccgacctctgcttctgaagtggccacccagacttggactgtcaacagcgaagctagcgtggaaagattacagcctctcttgccaccgattaggaccggtccttatctatgcgaactgctggaggaggtcgcagaaggcgttgcttcccctgacgaggacgaggatgaagaaccggccgtcttcccttgcatcgaatgttcgatctattttaagcagaaagaacacctcttggaacacatgtcgcaacatcggcgtgccccaggccaagagcctcccgccgacctagcccccctcgcgtgtggggagtgcggctgggcattcgccgaccccactgcactggaacagcatagacaactgcaccaggcttcaagagaaaagataattgaggaaattcaaaaattaaaacaagtccccggggacgaaggtcgagaagcccgtctgcaatgtccgaagtgtgtttttggtacaaactcttccagagcctacgtacagcatgcaaaactgcatatgcgagagccaccaggtcagacaaccaaagagccgtttggaggcagcagtggggctggatcacctagccccgaggcttccgccctgctataccagccgtatggcgccgctgtagggctttctgcttgtgtcttctgcgggttccctgcgcctagcgagagtctgctccgggaacatgttcggctggttcacgctcatccccattgggaggaagatggtgaagcatatgaggaggaccccgcctctcagccaggaacctctcaggacgctcatgcttgttttcctgatactgccgtcgattattttggaaaggccgaaccaagcctcgccccgatgtggcgagaaaaccccgcaggatacgacccttctctggcctttggtccgggctgtcagcagctctccatcagagacttcccactctccaagcccttgctccacgggaccgggcagcgtcccttgggccgcctcgcatttccctcaacgctcgcctctaccccatattccttgcagctcggtcgaaataagtctacagtccacccccagggccttggcgagaggaggagaccgtggtccgaggaggaggaagaggaagaggaggaagaagacgtggtcctcacctctgaaatggatttcagccctgagaatggagttttttcgccgctggcaacccccagtctcatcccacaggcagctctcgagctcaaacaggcctttagggaagctttgcaggcagttgaggccactcaaggacagcagcagcagctccgtggcatggtgcccattgttctagtggctaagctcggcccccaggtcatggccgccgccagggttccaccacgactccagccagaggaattggggctcgccggcgcccaccctctggattttttactcctagacgcccctctaggcgggccgttggggctggatacactattagatggcgaccctgccatggccctcaaacacgaggagagaaagtgcccatattgtccagaccgcttccacaatgggatcggtttagcaaaccatgtccgggggcatctgaatagggtgggtgtatcttacaacgtccgtcacttcatcagcgccgaggaggtaaaggccatcgaacggcgtttcagctttcagaaaaagaaaaaaaaggtggccaactttgatcccggtaccttcagcctcatgaggtgtgatttttgcggcgcagggttcgatacccgggccggccttagtagccatgcgcgcgctcacctccgtgattttgggattacgaactgggagctgaccgtgagtcccattaatatcctgcaggagttgctcgcaacttctgcagctgaacaacccccctcgcccctgggaagagagcccgggggacccccgggctccttcctgacttctcgccgcccccggctcccactcaccgtgcctttcccacctacgtgggctgaggatccaggtccagcctacggcgatgctcagtctttaactacgtgtgaggtgtgtggcgcctgctttgaaacccggaaaggactgagttctcatgcgagatctcacttgcgacaactcggagtcgctgagtctgagagtagcggagccccgatcgaccttctgtacgaactggttaagcagaagggtctgcctgacgcccacctgggccttccgccgggccttgcgaagaagagctcaagcctgaaggaggtcgtcgccggcgccccacgaccagggctgctgtctctagccaaacctctggacgctcccgcagtcaacaaggccatcaaaagccctcctggcttttcagcgaagggactcggacatccacccagttcccctctgctcaagaagacacccctggccctggctgggtccccaacccctaagaatccagaggataaatccccacagctgtccctgtccccacgaccagcaagcccaaaggctcagtggcctcagtccgaagacgagggcccattgaacttgacatccggcccagagccagctcgggacattcgctgtgaattctgcggcgaattctttgaaaacaggaaaggcctttcttcccacgcccgtagtcacttgagacagatgggcgtcactgagtggtacgtcaacggctcacccatcgacacattacgggaaatcctcaaaaggagaacccaatctcgaccgggaggaccgccaaatcccccgggcccttcccctaaggccctcgcgaaaatgatggggggcgccggccccgggagttcactcgaagctcgtagccccagcgacctgcacatctctcctctggcgaagaaactgccccccccccccggcagccccttaggacattcaccaactgccagcccacccccgactgccaggaaaatgtttcctggtctcgcagcaccgagtctgcccaaaaaactaaaacctgaacagatcagagtggagatcaagcgggagatgcttcccggcgccctgcacggggagctacaccccagcgaggggccttggggagcacccagggaagatatgacaccactcaatctttctagccgggccgagcccgtgagggacataaggtgtgagttctgtggagagtttttcgaaaatcgaaaggggctgtcttcgcacgcaagaagccacctgcgacagatgggcgtgaccgagtggagtgtaaacgggagtccaattgatacactccgcgaaattcttaaaaaaaaatctaagccctgtctgattaagaaagaaccacctgccggagacctggctcccgcactggcggaagatgggccacccactgtagcacctggccccgttcagtccccactgcccttgtcaccactggccggcagaccagggaagcccggagcaggtcctgctcaggtacccagggaactgtccctcactccaatcaccggagcgaagccctcagctactggctatctcgggagcgtcgctgccaagaggccactccaggaagatagattgctgcctgccgaggttaaagccaagacctatattcagacagagctgccctttaaggccaaaactcttcacgaaaagactagtcattcttctaccgaagcctgctgtgaattatgtggactttacttcgagaaccggaaggcacttgcgtcacatgcgcgagcccacttaaggcagttcggagtgacagagtggtgtgttaatgggtcccccattgaaaccctgagtgagtggattaaacatagaccccagaaggttggcgcatacaggtcatatatccaaggcggtagaccatttactaaaaaatttagatctgccggccatggacgggatagcgacaaacgcccttcacttggtctggcgcccgggggactggcggtggtgggacggagcgctggcggcgaacctgggcccgaggccggaagagcggctgacgggggcgagcgtcctctcgcagcttcacctccggggaccgttaaagctgaggaacaccagaggcagaacatcaacaagttcgagaggcggcaagctaggcccccagacgcctcagcggctagaggtggcgaggacacaaacgatctccagcaaaaattggaggaagtgagacagcccccacccagggtcaggcccgtcccatctttagtgccccggccacctcagacctccttggtcaaattcgtgggaaacatttacacgctgaagtgtagattttgtgaagtagaattccagggccccttgagtattcaggaggagtgggtgagacacctccagagacacattctggagatgaacttttccaaagctgacccccctcccgaggaatctcaggccccccaggcacagacagcagcggctgaagccccgtag

SEQ ID NO: 13754 - DNA, 2508 bp, Artificial Sequence
  Description of Artificial Sequence: Synthetic coding sequence
atggtggccatggatcttggctcgccctcgttacctaaaaagtccctgcccgtgccaggcgccttggagcaggtggcctcgcggctgagcagtaaggtcgccgctgaggtccctcatggtagcaaacaagaactgcaggacctgaaggcacagtcattaacaacatgcgaagtttgtggtgcctgctttgaaacccggaaaggattgagcagccatgctcgctctcatctgcgccagctgggagtggcggagagtgagagctccggagcacccatcgaccttctgtacgagcttgtcaagcagaagggactgccagacgcccacctgggcctcccgccaggcctagcaaaaaaaagcagcagtcttaaggaagtggtcgccggagcacctaggccaggcctcctctcgttggctaagccgttagacgccccggctgtcaataaagctatcaagtccccacctggcttcagcgccaagggcttgggccacccaccgagctctcctctgcttaaaaaaacacctcttgctttggctggctcgccaacccccaagaaccctgaagataaatctccgcagttgtctctgtctccgagacccgctagccctaaagcacagtggccacagagcgaggatgaaggaccactgaacctcacttccggtcccgagccagccagggatattcgctgcgagttctgtggtgagttcttcgaaaatcggaagggtctttcttcccatgcgaggtcacatctccgtcaaatgggggtgactgaatggtacgtaaatggttctcccatcgacacactgcgcgagattctcaagaggaggacccagtcccggccaggcggaccccccaatccaccgggcccatcaccgaaagccctcgccaaaatgatgggtggagcgggccccggcagtagcctcgaggctagaagcccttccgatctgcatatttcgcccctcgcgaagaagctacccccacccccgggctctcccctgggacacagccccacagcctccccccccccgactgccaggaagatgtttccaggactcgctgcccccagtcttccaaaaaagctgaagccggaacagatcagggttgagatcaagcgcgaaatgcttcctggggccctccatggagagctgcatccgtctgaggggccatggggagcacctcgggaggatatgactcctctgaacctgtcgtcacgggcagaacccgtgcgtgatattcggtgcgagttctgcggcgagttctttgagaatcgaaagggcctttcctctcatgcgcgttcgcatctgaggcagatgggagttacggagtggagcgtgaacggtagccctattgataccctgcgcgaaattctcaaaaagaagtcaaagccttgtctgatcaaaaaggagcctccagcgggcgacctggcccccgcgctcgccgaagacggtccaccgaccgtggcacccggacccgtgcaaagtccccttccgctgtccccactggccgggagaccgggaaagcctggggctggccctgcacaagttcctagagagctcagcctaacacccataactggtgcgaagccctcagctaccggatatctgggaagtgtggctgctaagaggccgctgcaagaggacagactgctgcctgccgaggtgaaggccaaaacatatatccagacagagcttccattcaaagcgaaaacactgcacgaaaagactagccatagtagtaccgaagcatgttgtgaactgtgcggactgtacttcgaaaatagaaaagcactggcaagccacgcccgagcacacctgagacagtttggtgtcactgaatggtgcgtgaacggctcaccgatcgaaaccctcagcgagtggatcaagcaccggccgcagaaagtcggagcctacaggagctacatccaaggcggccgacccttcacaaagaaatttcgctctgccggccacggccgagattctgacaaaagaccctcgctcggcctggcaccagggggcttagcagtcgttggcagatctgccgggggagagcccggccctgaggcagggcgcgcagcagatggaggggagaggccgctcgcagccagtcctcctggcaccgttaaggccgaggagcaccagcggcagaatatcaacaaatttgaacgtcggcaggccaggccccctgatgctagtgctgcccgaggcggggaggacactaatgacctccagcagaagttggaggaggtgcggcagccaccgcctcgtgtcaggcctgtgccatcccttgtgccaagacccccacagaccagcctggtcaagttcgtcgggaatatttataccttgaaatgtaggttctgtgaagtggaatttcaggggccgttatcaattcaggaagaatgggtccggcacctacaacgccacatcctagagatgaattttagtaaagccgatccaccacccgaggaatcccaagcaccacaggcgcagaccgccgccgctgaggcgccgtag

SEQ ID NO: 13755 - DNA, 2898 bp, Artificial Sequence
  Description of Artificial Sequence: Synthetic coding sequence
atggacctcggctctcccagtctgccgaaaaaaagcctgcctgttcccggcgccctggagcaagttgcatcacgcctttcctctaaagtggcagccgaggtcccacatgggtcaaagcaggaattacaagatcttaaagcacagagcctgaccacatgtgaagtgtgcggagcctgctttgaaacgagaaagggattgagctcacatgctcggtcacatctgagacagttgggggtcgcagagtccgagagttccggggcgcccatcgatctgctgtatgaattggtgaagcagaaaggactgcccgatgctcacctcgggctgcctcctggtttggccaaaaagagctcctctctcaaagaggtggtggccggggcaccgagacctgggctgttaagcttagctaagccgctcgatgcacctgctgtcaacaaagccattaagtccccgcctggcttcagtgctaagggcctgggccacccccccagttcgcctttactgaagaagacaccactcgctctcgcaggctccccaaccccaaaaaatccggaagacaaatccccacagctctctctcagcccaagacctgccagtcctaaggcgcagtggccacaatcagaagatgaaggcccccttaatttgaccctggactcagacgggggtagagagctggactgtcagctatgcggagcttggttcgaaaccaggaaaggtttatcaagccatgcgagggcccaccttaggcacctcggtgtgtcagatcccgacgctaaggggagtcccatcgatgtcctgcatggattgatccggcgggacggcgtgcagatcaggctgccacctcgtagaggcgccctggctcatccagggaggcctccccctacatccgctgccttgagcctacttcctccacctccaccagctaagaaggcaaaacttaaagcagccgggatggccagcccatgggggaagcaagatctgagcgcagctgctgcagctggaatattctgggccagtgatgtggagcctagtccgctcaatctgagctccggccctgagcccgcaagggacatcagatgtgagttttgtggtgagtttttcgaaaatagaaagggactgtcctctcacgcccgttctcatctcaggcaaatgggcgtcactgagtggtacgtgaacgggagtcccatcgacactttaagggagattctgaaacgtcgcacgcagtctcggcccggcggaccgccgaacccaccaggcccatcaccaaaggccctcgccaagatgatggggggggccggtccgggtagttccctggaggcgcggtcccctagtgaccttcacatatccccattggcgaagaaactccccccgcctcctgggagtcctctgggccattcccctactgccagcccacctcctacagctaggaaaatgttccccggcctcgcagctccttccctcccgaagaaactcaagcctgaacagatccgggttgaaatcaagcgggagatgctcccaggagctctgcatggagagttgcatcccagcgagggcccatggggcgcacctcgcgaagacatgaccccattgaacctctcaagtcgcgctgagcccgttagagacattaggtgcgaattttgtggtgaatttttcgagaatcggaaagggctttcatctcacgccagaagccacctgaggcagatgggtgtgacagaatggtcggtgaacggctcgcccatcgatactctgagagagatcctcaaaaagaagtcaaagccttgtttaatcaaaaaggagcctccggccggcgacttagccccggcacttgccgaagacggcccccccaccgtagcgcctggaccagtccagagcccccttccactctcacctttggccggacgaccggggaaacccggggccggcccagcacaggtgccgcgggaactgtccctgacgcccatcacaggggctaaaccctccgccacaggatacctcggatcagtggccgctaagagacccctgcaggaggaccgtctacttccagccgaagtaaaggccaagacttacatccagactgagcttcctttcaaagctaaaaccctccatgagaagacctcccactcgagcacagaagcatgttgtgagctgtgcggcttgtactttgaaaataggaaagctcttgcttcacatgccagggctcacctgcggcaattcggagtgacagagtggtgtgtgaatggcagccccattgagactttatcagaatggatcaagcatagaccacagaaggtcggggcctaccgtagctacatacaggggggtaggccattcaccaagaagttccgaagcgccggccacgggcgcgattcagataaacgcccctccctggggctggctccaggtggactggcggtcgtgggccgttcggccggaggagagcccgggccagaagctggtagagcagcagacggaggcgagagaccactggctgcttcaccgcccggcacagtaaaagccgaagagcatcagcgccagaacattaataaattcgaacggcggcaagctcggccccccgatgcaagtgcagctcggggtggcgaggataccaatgatctacagcagaaactagaagaggtgagacagccccccccaagagtgcgccccgttccaagcctggttccacggccccctcagacctcactggtaaaatttgtcgggaatatatacaccctgaagtgccggttttgtgaggtggaatttcaaggcccactgagcatccaagaggaatgggtgcggcatcttcagcgacacatactcgaaatgaactttagcaaggccgaccctcctccagaggagtcccaggccccccaggcccagaccgccgccgccgaagctccatag

SEQ ID NO: 13756 - DNA, 846 bp, Artificial Sequence
  Description of Artificial Sequence: Synthetic coding sequence
atggcaagccgtgggcgccggcctgaacacggcggcccacccgagctgttctacgacgagactgaggcacggaaatacgtgagaaattcgaggatgatcgacatccagactaggatggcagggcgggctcttgagctgctctacttgccagagaataagccctgttatctacttgacatcggctgtggtaccggcctgtcagggagctacctgtcagacgagggtcattattgggtcgggctggatattagcccagccatgcttgacgaggccgtcgatagggagatagaaggggatctattgttaggcgatatgggccaaggtatccccttcaagccgggcactttcgatggatgtatctccatttcagctgtccagtggctctgcaacgcaaacaagaaatccgaaaatcccgctaaacggctgtactgctttttcgcgtctctgttcagcgtcctcgtgaggggcagtcgcgctgtgctccagctctacccggaaaactccgaacaactggagttgatcactactcaggctacaaaggccggctttagcggcggtatggtggtcgactacccaaactcagcgaaagctaaaaaattctacctctgcctgttctcagggccatctaccttcattccagaggggttatctgaaaatcaggacgaggtcgagccccgggagagcgtgtttaccaacgagcggttccccctgaggatgtcccgcaggggcatggtgaggaaaagtagagcctgggtattagagaagaaggaacgtcaccgtagacaggggcgcgaggttcggccggatacacaatacacgggcaggaagcgaaagccccgattttag

SEQ ID NO: 13757 - DNA, 372 bp, Artificial Sequence
  Description of Artificial Sequence: Synthetic coding sequence
atggcagaccctcaaagctgctttatgactcgtcaaaagcctggtaatacctttgccagcgaagggtccttgaacacagctggtaggcccggggtgggcaaaaggcaggtggcacctgtggcaggtgttgctcgcaagggacggcgcatttggggatcacggatgatagacattcagacacggatggccggtcgggctcttgaacttttatatctccctgagaataaaccttgttatctgttagatatcggatgtggtaccggtctgtctggatcctacctctcagatgaggggcattactgggtgggcctagatatctcaccagctatgctaggacccggtattccaagctgtccagccgctgtgccatag

SEQ ID NO: 13758 - DNA, 897 bp, Artificial Sequence
  Description of Artificial Sequence: Synthetic coding sequence
atggccagccgcggacgccgacccgagcacggtgggcccccagagttgttctacgacgagaccgaagcgagaaagtacgtgcgcaatagtaggatgattgacattcaaacaagaatggctggtagagccttagagctgctgtatctgcccgagaacaagccctgttacctgttagacattggatgtggcaccggcctgtctggttcatatctgtctgatgaaggccactactgggtcggcctcgacatttcgccagccatgttggacgaggcggtggatcgggagattgaaggagacctgctactgggcgacatgggacaagggatccctttcaagcccggtacattcgacggttgcatcagtattagcgccgtccaatggctgtgtaacgccaacaagaagagtgaaaacccagccaaaagattgtactgctttttcgccagtctgttttccgtgctcgttcgcggaagtcgagctgtgctccagttatatccggagaactccgaacagctggaactgattacgacacaggccacaaaggctggtttcagcggtggcatggtcgtggattatcctaattctgccaaagctaagaagttctatctgtgtttattcagcggccctagcacttttattccggaaggcttgagtgagaatcaagacgaagtggagcctagggagtcagtgtttaccaatgagcgggaggggggcgccttcgaacgacgtggcattagaggccatcagactcggcgatttccccttcggatgagtaggagaggtatggtgaggaaatcccgcgcgtgggtgcttgagaaaaaggagaggcacaggcgccaaggtcgcgaagtgcggcctgacactcaatatactggtcggaaacgcaagccacggttttag

SEQ ID NO: 13759 - DNA, 1131 bp, Artificial Sequence
  Description of Artificial Sequence: Synthetic coding sequence
atggcagactattggaaaagccagcctaagaaattttgcgactattgtaagtgctggatcgcagataaccggccttctgtcgagttccatgaaagggggaaaaatcacaaggagaacgtggcaaaaagaatttcagagatcaagcaaaaatccctcgataaagccaaggaggaggagaaagcttctaaggagttcgcagccatggaggctgccgcattaaaggcttaccaggaggacctgaagagacttgggctagaatccgagattctagagccgagcataaccccagtaacctccacaattccacccacctccacatctaaccagcaaaaggagaaaaaagagaagaaaaaaaggaagaaagatccaagtaagggaagatgggtggaaggtatcactagcgagggctaccattactactacgaccttatcagcggcgcctcgcagtgggagaagccagaaggatttcagggagatctgaagaaaactgcagtcaagacagtttgggtggaaggcctctccgaggatggctttacatactattataataccgaaacgggagaaagccggtgggaaaaacccgatgacttcatcccgcataccagcgacctcccctcaagcaaggtgaacgaaaattctctgggcaccctcgatgagtcaaagtcctctgacagccactcggatagtgatggggagcaagaagccgaggaagggggagtgagcactgagaccgagaagcccaaaatcaagtttaaggagaagaacaaaaatagcgatggtggctccgacccggaaacgcagaaggagaaatcaatccagaaacagaacagcctcggaagcaacgaagagaaatcgaaaacactgaagaaatcaaacccctacggtgaatggcaagagattaagcaggaagtggagtcacacgaggaagtagatctcgagctccctagtacagagaacgaatacgtgtccacctcagaggccgatggcggcggcgagcccaaggtcgttttcaaagagaagacagtgacctcactcggcgtgatggccgatggtgtggcacccgtcttcaaaaagaggcgcacagaaaacggtaagtccagaaaccttagacagaggggcgacgatcagtag

SEQ ID NO: 13760 - DNA, 1068 bp, Artificial Sequence
  Description of Artificial Sequence: Synthetic coding sequence
atggcagattactggaagtctcaacctaagaaattctgcgactactgtaagtgttggatagccgataatcggccaatcaaacagaagtcattagacaaggcaaaggaagaagagaaggctagtaaggaattcgcggccatggaagcggccgccttaaaggcctatcaggaagacctcaagcgtctgggtctggagagtgagattcttgagccatctatcactcctgtcacatcaaccattcctcccacatccacaagcaaccagcagaaagaaaaaaaggaaaaaaagaaacgtaagaaggacccctcgaagggccggtgggtggagggcatcactagcgaggggtaccattactactatgatcttatttccggggcatcccagtgggagaagcccgaggggtttcagggcgatctcaaaaaaactgcagttaagacagtttgggtagaggggctgagcgaggacgggtttacgtattactacaacaccgagactggcgagtctagatgggaaaagcctgacgactttatcccccacacctctgacctgccttctagtaaagtgaacgagaattcacttggtacgctggatgagagtaaatcaagcgactctcacagtgattccgacggcgaacaagaggcagaggaaggtggcgtgagtacagagaccgaaaaacccaaaattaaatttaaggaaaagaacaaaaactcggacggaggctctgaccccgaaacacagaaggagaagtccatacagaagcagaattcccttggttctaatgaggagaagagtaagactctcaagaagtcaaatccatacggagagtggcaagagatcaagcaggaggtggaatcccatgaagaagtcgatttagagctgccttcaaccgagaacgaatatgtaagcacaagtgaggccgacggaggtggcgagcctaaggttgtatttaaagagaagacagtaacatccctgggtgtgatggcggatggagtagcgccagttttcaaaaagcgcagaactgaaaatggaaaatccagaaacctccggcagagaggagatgatcagtag

SEQ ID NO: 13761 - DNA, 354 bp, Artificial Sequence
  Description of Artificial Sequence: Synthetic coding sequence
atgtccttgacctccgatgcctcctcgcctcgcagttacgtaagccctcgtatctccacccctcagaccaatacagtgccaattaaaccgctgatctccacacctcctgttagtagccagcccaaagttagcacccccgttgttaagcagggacctgtcagtcagagcgccacccagcagcctgttaccgccgacaaatccaaagtgatgaatctctcccttctcgaggtgttctctgcccaggtggcacgggaagtgcatcaccttgtgccaatcatactgctgatcgtggtgatgcaccagatgcagcagctttatcaccgtatcttactgcccgatccccgggttcattag

SEQ ID NO: 13762 - DNA, 1635 bp, Artificial Sequence
  Description of Artificial Sequence: Synthetic coding sequence
atggtgatgtacgctaggaagcagcagagattaagtgatgggtgtcatgacagacgtggagacagtcaaccctaccaggccctgaaatactccagtaagtcgcatccttcatccggcgaccacaggcatgagaagatgagggatgccggagaccccagccctccgaacaagatgctgcgacgtagtgacagcccagaaaacaaatactccgattccactggccactccaaggcaaaaaatgtgcacacacacagggtgagagagagggatggaggtacctcttattctcctcaagagaactcacataatcactcagccctccactcctccaattctcatagctccaaccccagcaacaatccatcgaaaacaagcgatgcgccatatgattctgcggatgactggtccgagcacatttcttcctccggcaagaagtactattataattgtaggactgaggtgtcgcaatgggaaaagcctaaagaatggttagaaagggaacaaagacagaaagaagccaacaagatggctgtcaacagctttccaaaggacagggactaccgccgtgaggtgatgcaggctaccgcaaccagcggctttgcctctggtaagagtacatccggcgataagcccgtgtctcactcctgtaccacaccaagtacctccagcgcatccggactcaaccccactagcgcccctccaacctcagccagcgctgtgcctgtgagtcccgtgccgcagtctccaatcccgcctctgttacaggatcctaacctgctgaggcagctgctacccgcgctgcaggcgacattacagctcaataactcgaacgtcgacatctcaaagataaacgaagttttgaccgccgctgttactcaagcatctctgcagagtatcattcataagttcctgacagcagggccctcagcttttaatataacgtctctgatcagtcaggccgcccagctatctacacaggctcagccgtctaatcagtcgcctatgtcactgacttcggatgcctcctcccctaggagctatgtgtctcctcggatcagtaccccccagactaatactgttcccattaagccactcatcagtaccccaccagtgtccagtcaacccaaggtgtcaaccccagttgtcaagcaaggccctgtgtctcagtccgctacccagcagcctgtgactgccgataagcaacaagggcacgaacctgtttcgccccgatccctgcagaggagttcatctcagcgctcccccagccccgggccaaatcatacctcaaactcatcaaacgcctccaacgctaccgtagttccacagaatagctctgcccggtcaacctgctccctcacccccgcgcttgctgcccacttttcagaaaaccttatcaagcacgtgcaaggctggcccgccgatcacgctgagaagcaggcctcccggttgcgtgaggaggctcacaatatgggaactatacatatgagtgagatctgcacggagcttaagaatctgcgctctttagttagggtctgtgaaattcaggccacgctccgggagcagcggatcctgttcctgaggcagcaaattaaagagttagaaaagctgaaaaatcagaattccttcatggtgtag

SEQ ID NO: 13763 - DNA, 1944 bp, Artificial Sequence
  Description of Artificial Sequence: Synthetic coding sequence
atggtgatgtatgctcgcaagcagcaaagactctcagatggctgccatgaccgacgaggggatagccagccataccaggccctcaaatacagctcaaagagtcaccccagttccggcgaccatcggcatgagaagatgcgggacgcgggcgacccgagcccacccaacaagatgctgagacggtccgatagccctgagaataagtattctgatagcacaggtcactcaaaagctaaaaacgttcatactcatcgggtgcgcgagagggatggcgggacatcctactccccccaggaaaattcgcataaccactcggccctccatagcagcaactctcacagttccaacccatctaacaacccttctaagacctctgacgcaccttatgactctgcggacgattggtcagagcacatatcatcttcaggcaagaaatactactacaattgccgcaccgaagtcagccaatgggaaaagcctaaggagtggttggagcgggagcagaggcagaaggaggccaataagatggcagtcaacagctttcccaaggatcgcgactaccgtagagaggtgatgcaggccactgctaccagtggatttgcaagtgggatggaagacaaacactccagcgacgctagctcgctcttacctcaaaacatcctgtcccagacctccagacataatgacagggactaccgcctgccccgcgccgagacccactcgtcttctacgccagttcagcatcctatcaaaccagttgtccatcccaccgccacaccgagcacagtacctagttctccttttacactccagtccgatcatcagcccaagaaaagcttcgatgcgaacggtgcctcaaccctcagtaagttgcctacacccaccagcagtgttcccgcccagaagactgagagaaaagagtccacaagcggagacaagcctgtcagccacagttgtacgaccccctccacctcatcagcctccggcctgaatcccactagcgcaccacctacaagcgccagcgctgtgccagtaagccccgtcccccagtcccctattccgcctcttctccaggaccccaatctattgagacagttgctaccagctttgcaagctaccctgcagttgaacaacagcaacgtcgacatcagcaagatcaacgaggttctgacagctgccgtgacacaggccagcttgcagtctataatacataagtttctaacagctggcccttctgcgtttaatatcacttctcttatctcccaggctgcccagctttcaactcaagctcagccgagcaaccaatctcctatgagtctgacaagtgatgcaagttctcctcggagctatgtctcgccgagaatctctaccccgcagaccaacactgtgcccatcaaacctctgatttctactccccctgtgagctcacagccaaaagtttcaactcccgttgtgaagcaaggccccgtttcgcagtcagcaacccaacaaccagtcacagcagacaaacagcaggggcacgaacccgtctctccacggtcacttcaaagatccagctcgcaacgcagcccttcccctgggccaaaccatacgagcaactccagtaacgccagtaatgctaccgtggtgccccagaactctagcgccagaagtacttgcagcttgaccccagcactggccgctcacttcagcgagaacctcattaagcatgtgcaaggttggcctgcagaccacgctgaaaagcaggcaagtcgtctccgggaggaagcgcacaatatgggtactattcacatgtctgaaatttgcaccgaattgaagaatctgaggtccctggtcagggtgtgtgaaatccaagcgactctgcgcgagcaacgaatcttgttcctcagacagcaaatcaaagaactagaaaagttaaaaaatcaaaacagttttatggtgtag

SEQ ID NO: 13764 - DNA, 1809 bp, Artificial Sequence
  Description of Artificial Sequence: Synthetic coding sequence
atgagggacgctggtgacccatcacctccgaacaagatgcttcgtcgaagcgacagcccggagaataaatactctgacagcactggccactctaaagctaagaatgtgcatactcatcgtgtccgggagagagacggaggcacatcctatagcccacaggagaacagccataaccactcggcactgcattctagcaattctcactcctcaaacccaagcaataatccctcgaagacatcagatgccccctacgattctgctgacgattggagcgagcatattagcagcagtggcaagaaatattactataactgtcggacagaggtgtcgcagtgggagaaaccgaaggagtggctggagcgtgagcagcgccagaaggaggcgaataaaatggcagttaattcatttccgaaagatcgcgattacaggagggaggtgatgcaggcaacagcaacttccggcttcgctagcgggatggaagacaagcactcatcagacgccagctctctgctgcctcagaacatattgtcccaaaccagtcggcataatgaccgggattacagactccctcgcgcagagacacactcttcttcgacccccgtccagcacccaataaaacccgttgtgcaccctaccgcaacaccctcaacggtgccttcaagtccatttaccctccaatctgatcaccagcctaagaagagctttgatgctaatggggccagtacactatccaaacttcccacaccaacgtcctctgtgcctgcacaaaagactgagcgcaaggagagtacctccggcgataagccagtgtcccacagctgcactaccccttccacatcttctgctagtgggcttaatcctacctccgcaccaccaacttctgcttcagcggtgcctgtctctccggtaccacaatctccgatcccgcctctcttacaagacccaaacctattacgccaactgctgccagctctgcaggccaccctccagctcaataattcaaacgtggatattagcaagattaacgaagtcctcactgcggccgtcacgcaggccagcctgcagtctatcatccataagtttctcacagccggcccgtctgccttcaacattacctctcttatctcacaggctgcccagctttccacccaagcccagccctcaaatcagagcccaatgtctctgacttcagacgcgagctccccacgatcctatgtaagccctcggatcagtacaccacaaacaaacacagtaccgatcaaacctcttatctccacacccccagtgagcagccagcccaaggtttccactcccgtggtgaaacaaggtcccgtaagccagtctgctactcagcagcccgtcaccgcagataagcaacagggccacgaacctgtctccccgagaagcttgcaaaggtccagttctcagagaagtccaagcccagggcccaaccacacatccaacagtagtaatgcttctaatgccacagtggtgcctcagaacagttccgcgaggtccacatgctctttgacccctgccttagctgcccattttagcgagaatctgatcaaacatgtccagggctggccagccgatcatgccgagaaacaggcctcacgacttcgggaagaagcccacaacatgggaacaatccacatgagcgagatttgtactgagttgaaaaacctgaggagcctggttagggtatgtgagattcaagcaactctcagagaacagaggatcctctttttacgccagcagattaaggaacttgaaaagttgaagaatcagaatagctttatggtgtag

SEQ ID NO: 13765 - DNA, 702 bp, Artificial Sequence
  Description of Artificial Sequence: Synthetic coding sequence
atgagggacgctggggatccctcaccacccaataagatgttgcggagatccgactcaccagagaataagtactctgatagtaccgggcactctaaagccaagaacgtgcacactcatcgggtgcgcgagcgagacggagggacctcatatagtccgcaggagaactcccataaccactctgcacttcactcgtctaattctcacagttcaaacccgagcaataacccatccaaaacatccgatgcaccctacgattctgcagatgactggtccgagcacatcagctcctccggaaagaagtactactataattgtcgaaccgaggtgagtcaatgggagaaaccgaaggaatggttggagcgtgagcagagacagaaggaggccaacaaaatggccgtgaactcattccctaaagatcgggactacaggagagaggtgatgcaggccactgccacaagcggtttcgccagtggcatggaggacaaacacagctctgatgctagcagtctgctgcctcagaacatcttgtctcaaacatcacgacacaatgacagggactatcggctcccccgagccgagactcactcctcctccacgccggtccagcacccaatcaagccagtagttcacccgaccgctacaccatctacagtcccatctagtcccttcacactacagtctgatcaccagccaaaaaaatag

SEQ ID NO: 13766 - DNA, 615 bp, Artificial Sequence
  Description of Artificial Sequence: Synthetic coding sequence
atgcgcgacgccggcgacccatcgccaccgaataagatgctgcggcgctctgacagtcctgagaataaatatagtgacagtacaggccacagtaaagcaaaaaacgtccacacccacagggtccgggagcgagacggtggcacatcatacagcccgcaggagaacagccacaatcacagtgccctgcactctagcaattctcattcttctaatccgtctaacaatccaagtaaaaccagtgacgcaccgtatgacagcgcggatgattggagcgagcatatttcatcctcaggcaagaaatactattacaattgtcggaccgaggtgtcccagtgggagaagcctaaagagtggttggagcgggaacagcggcaaaaagaggccaataaaatggccgtgaattcatttccgaaggatcgggattatagaagggaggttatgcaagctacagccactagcgggtttgcctccgggatggaggataagcattcctcagatgcttcgagcctgttgcctcagaacatcctgtcccagaccagccgccacaacgacagggactatcgcctccctagagcggagacccacagctcctcaactcctgtgcagcacccttag

SEQ ID NO: 13767 - DNA, 1044 bp, Artificial Sequence
  Description of Artificial Sequence: Synthetic coding sequence
atgcgcgatgcaggcgatcccagccctccaaacaagatgcttcgcagaagcgattcaccagagaacaaatactcagacagcacaggacactccaaagccaaaaatgtgcatacacatagagtaagggagagagacggcggcacttcctattccccccaggaaaatagccacaatcacagcgcactccactcaagcaattctcactcctctaacccatcaaacaacccctccaagacttcggacgccccttatgattccgctgatgactggtccgagcacatttcaagttctggcaaaaagtattattacaattgccggactgaagtgtcacagtgggaaaagccaaaagagtggctggagagggagcagcgccagaaagaggcaaacaagatggccgtgaattcatttccaaaagaccgggactacaggcgagaggtgatgcaggcaacagccacatccgggtttgcttccgggatggaagacaagcattcatccgacgcttcctccctgctcccccaaaacattctcagccagacgagtcggcacaacgaccgggactacaggctgcctagagccgagacacactctagcagcactcctgtgcagcatcccattaaacccgtcgtgcaccccacagcaactccctcaactgtcccctcaagccccttcacgctacagagcgaccaccagccgaagaagagctttgatgccaacggcgcgtctaccctgtccaagctcccaacaccaacttccagcgtgcctgcccaaaaaactgagcgcaaggagagcacgagtggagacaagccggtctcccactcttgcaccaccccctccactagttctgcatccgggttaaatcccacgagtgctccacccacctccgcatcagccgttcccgtatccccagtgccgcagtcccctatccctccgctgctccaggaccctaatttactaaggcagctgttacctgctctgcaggcgacgctgcagctgaataatagtaacgtagatatctctaaaatcaatgaggtcctcacggcctag

SEQ ID NO: 13768 - DNA, 1311 bp, Artificial Sequence
  Description of Artificial Sequence: Synthetic coding sequence
atgagagatgctggagacccaagccctccaaacaagatgcttcgtcgctcggactcaccggagaacaaatatagtgactctaccggtcactcaaaggccaagaacgtgcatacacatcgagtgagggagcgcgatggcggtacttcctattcgccacaggagaatagccataatcatagtgcgctgcacagctctaactctcactccagtaaccctagtaacaaccctagtaaaacaagcgatgcaccgtacgattctgcggatgattggtctgagcacatctcttctagtggcaaaaagtattactacaactgccggacagaggtgtcacagtgggaaaagcccaaggaatggctggagagggaacaaaggcagaaggaggcaaataaaatggccgtgaatagctttcctaaggaccgggactaccgacgggaggtgatgcaggctaccgcaacttcagggttcgcaagtggaatggaagataagcatagtagcgatgcgagtagcctgttaccacaaaacatcctttcacaaacgagccggcataatgaccgggactatcgactcccaagagctgagactcatagtagcagcactcccgttcagcatcccatcaagccagtggtgcaccctaccgctacaccaagtaccgttcctagttccccttttaccttgcaatcagaccatcagcctaagaagtccttcgacgctaatggcgcttccacactgagtaaactgccgacgcccacttcgtccgttccagcccagaaaacggagcgcaaggagtccacttctggcgataaaccagtgtctcattcctgtaccacaccaagcacttcctcggcctccgggctgaacccgacaagcgccccacctacctctgccagcgccgtacccgttagccctgtaccccagtcaccaatcccccctctgcttcaggaccctaatctgctgcgtcaactcctccccgctctgcaagccaccttgcagctgaacaatagcaacgtggatataagcaagataaatgaagtgcttacagctgccgtgacccaagccagcctgcaatctattatacacaagtttctgactgcaggccccagcgcgtttaatattacaagtctgatctcccaagctgcccaactgagtacacaggacattcccctgcacgaaggaattcagatggaacgagatacacaccgatcaaaatgggaggtgaaaggctcgctctgccagaaggccgataagcagcaggagtgtctcgtgtggaacggctcaataatggtgcagcgcctcctgcagcctagtggctag

SEQ ID NO: 13769 - DNA, 522 bp, Artificial Sequence
  Description of Artificial Sequence: Synthetic coding sequence
atgagggacgctggggacccatctccacctaataagatgctgaggcgctcggacagcccggaaaacaaatactcagactccaccggacatagcaaggcaaagaatgtgcacacccatcgagtgagggagagggatggcgggacctcttactctcctcaggagaactcccacaaccactcagctctccatagttccaatagccatagtagcaatcccagtaataacccctcaaagacctcagacgcgccctacgattctgcagatgattggtctgaacacatcagtagctccggtaaaaaatattactacaactgccggaccgaagtctctcagtgggagaaacctaaagagtggctggaacgcgagcagcggcagaaagaggccaataagatggccgtgaatagctttccgaaagaccgcgactaccgccgggaggtaatgcaagctacagctacctctggatttgcttctgggatggaggataaacacagtagtgacgcatcttccctactcccgcagtag

SEQ ID NO: 13770 - DNA, 180 bp, Artificial Sequence
  Description of Artificial Sequence: Synthetic coding sequence
atgcgagatgctggtgacccatcaccaccaaataagatgcttcgacgcagtgattctccggaaaacaagtacagcgactccactggccactctaaggctaaaaatgtgcacactcacagagttcgtgagcgtgatggcggcacatcctattctccgcaagaaaatagccataatcactag

SEQ ID NO: 13771 - DNA, 111 bp, Artificial Sequence
  Description of Artificial Sequence: Synthetic coding sequence
atgcgggacgcaggggaccctagcccacctaacaaaatgctccgacgcagcgattctcccgagaacaaatactccgactcgacaggccactccaaggccaaaaatgtgtag

SEQ ID NO: 13772 - DNA, 906 bp, Artificial Sequence
  Description of Artificial Sequence: Synthetic coding sequence
atgcgtgacgcgggcgatcccagtcctcctaataagatgctccgaaggagcgattcgcctgagaataaatactctgatagcacaggacacagcaaagctaaaaacgtgcacacccacagggtccgggaaagggatggaggtaccagctattctccacaggaaaacagccataaccacagtgccctccactcgtccaacagtcacagctctaatccaagcaacaatccaagcaagacatcagatgccccttatgactctgcagatgactggagcgaacatataagcagttctggaaagaaatattattataactgtaggacggaggtgtctcagtgggaaaaacctaaagagtggctcgagcgggaacagcggcaaaaggaggccaacaagatggcagtaaactcctttccaaaggatagggactataggagagaggtaatgcaggccacagctaccagtgggtttgcatctggcatggaagacaaacactcctcagacgccagtagcctgttgccacagaatatactatcacagacgagccggcacaatgatagagattacagactaccccgggctgagacccactctagttccacccccgtccagcatcccatcaagcccgttgttcaccctaccgcaacaccatcgaccgttccttcatcaccattcactctgcaatcagatcatcagcccaagaagagctttgacgccaatggtgcctccacgctcagcaaactccctactccaacttcctctgtccccgctcaaaagacagagcgaaaggagagcacctctggagacaagccggtcagccatagttgcacaaccccaagtacctcctcagcctccggccttaacccaacatccgcccctccaacatcagcctctgggccaaagtccagctag

SEQ ID NO: 13773 - DNA, 5469 bp, Artificial Sequence
  Description of Artificial Sequence: Synthetic coding sequence
atgtaccctaactggggtcgatacgggggttctagccattaccctccaccgcctgtgcccccacccccaccggttgcactgcccgaggcctcaccaggtcctggttacagcagcagtaccacccccgccgccccctcctcatccggtttcatgagcttccgtgagcagcacctggctcagttgcaacagcttcagcagatgcatcaaaagcagatgcagtgcgtgcttcagccccatcacctgccccctcctcctctgccgccccctcctgtcatgcccggaggcggttacggcgattggcaaccaccacctcctccaatgccacctccaccaggccctgccctgagctaccaaaagcaacagcaatataagcatcagatgctgcaccatcaacgggatggaccacccggtttagtgcccatggagcttgagagccctccggaatcccctccagtgcccccaggatcttacatgccacctagccaatcctacatgccgccgcctcagccgccacctagctattaccctcccacatcttcccagccttatctaccgcctgctcaaccttctccatctcaatcccctcctagccagagttatctggcaccaacaccctcatattctagctcttcatccagctcccagtcttatctgtcacactcccagtcttatctgcctagcagccaagcttccccatcccggccatctcagggccattctaagtcccagctgctcgccccaccacctccatcagccccccccggcaacaagacgactgtccagcaagaacccttggagagcggagctaagaacaagagcacggaacagcagcaagcagctcctgagcctgacccaagcacaatgacacctcaagagcagcagcagtactggtatcgccagcatttactgagtctacaacagcgcacgaaggttcatctcccgggacataagaaagggcctgtagttgctaaagacacccctgagcccgtcaaagaggaagtgacagttccggccaccagtcaggtaccggagagcccctccagcgaagaacctccactcccacctccaaatgaggaggtacctcctcccctgcctccagaggaaccgcagtccgaggaccctgaggaagacgcacgactgaagcagttgcaagctgcagctgcacactggcagcaacaccaacagcatcgggtgggatttcagtatcagggcatcatgcagaaacatactcagctgcaacagattctgcagcagtatcagcaaataatccaaccgccgccgcacattcaagccaccacaccccctcctgggattccgcctcccggcgtgcctcaagggatccctccccaactaacagccgccccggttcctcccgcttcgagtagccagtcgtctcaggttcccgagaaaccaagacctgccctgctacctacacctgtgtcattcggttccgcgccccctacaacgtaccatccccctctgcagagcgccggtccttcagaacaggtaaattccaaagcacctctgagtaagtcggctctgccgtactccagtttctcatcggatcaagggctcggggagtcttccgccgctccctcccagccaattactgcagtgaaggatatgccagtcagatcgggcggacttctgccagatcctccacgctccagctatctcgagtcaccgcgtggacctcggttcgatggtccacggcgcttcgaggacctgggaagccgatgcgaggggccgcgaccaaaaggacctcgtttcgaagggaacagacctgacggtccacgcccacgttacgagggtcaccccgctgagggaactaaaagcaaatgggggatgatccctaggggacctgccagtcagttttacattaccccctctacgtctctgagccctagacaaagtgggccacagtggaaaggacccaaacctgcattcggccagcaacaccagcaacaacctaaatcacaggctgagcctttaagtgggaataaggagcctctcgctgacacttcatctaatcagcaaaaaaacttcaaaatgcagtctgccgccttctccatcgccgcggatgttaaggacgtgaaggccgcacagagcaacgagaacctctcagactcacaacaggagcctcccaagtcggaggtctccgaaggacctgtagaaccttccaactgggatcagaacgtgcagagcatggagacacagatcgataaggcacaggcggtgacccagccagtccccctcgccaacaagcccgtgcctgctcagtctaccttcccaagcaaaaccggcggcatggagggcggcactgctgttgcaacgagcagtctgacggccgataacgactttaaaccagtaggaatcgggctcccgcacagcgaaaacaaccaagacaaggggttgcctcggccggacaatcgagacaatagactggaaggaaataggggaaactcctccagttatcgcggcccaggacaatctaggatggaggacacccgtgataagggactggttaaccgaggtagagggcaggccatcagcagagggcctggtttagtgaaacaggaagacttcagggataagatgatgggaaggcgggaggacagtcgcgagaagatgaatcgcggagaaggctcacgagacagggggctggtacgccctggatccagccgagagaaagtccctggcggcttacagggaagtcaagaccgcggcgcagccggctccagagagagaggtcctccaaggcgagccgggtctcaggagcgcgggcccctaagaagggccgggagccgggaaagaatccctcccaggcgagctggctcacgcgaacgtggacctcccaggggtccagggtcaagggaacgggggctgggcaggtccgattttgggagggacagaggcccctttcgccctgaaccaggagatggtggggaaaagatgtacccataccacagagatgagcctccccgggccccatggaatcacggggaggagagggggcatgaggaatttcctctcgacggtagaaacgcccccatggaacgggagaggctggatgattgggatagagagaggtattggagagaatgtgaacgagattaccaggatgatactttggaattgtacaaccgcgaggacagattctccgccccgccatcaagaagtcatgacggcgatcgccgaggcccctggtgggatgactgggagcgcgaccaggacatggacgaggactacaaccgggagatggagcgcgatatggatcgcgatgtagaccggattagtaggcccatggatatgtacgaccgaagtctcgacaatgagtgggaccgggattacggccgccccttggatgagcaggagagccagtttcgcgagcgagacatcccctcactacccccgctgccccccctgccccccctcccccccctggaccgttacagagacgacaggtggagagaggaacggaacagggagcacggctacgatagagacttccgcgacaggggcgagttgcggatccgagagtacccagaacgcggcgatacatggagggagaagcgcgattatgtgcccgatcgtatggattgggaacgtgagcggttgagtgacagatggtatcccagtgacgtagatagacattcacccatggctgaacacatgcccagttcccatcactcaagcgaaatgatgggaagtgatgcttcccttgatagtgatcagggtttggggggcgtgatggttttatcacagcgccagcacgagataatcctgaaggccgcccaggaactgaaaatgttgcgtgagcagaaagagcagctgcagaagatgaaggattttgggtcagagccccagatggctgaccacctacctccgcaagagtcaaggcttcaaaacacctctagcaggcccggtatgtaccctccaccgggatcctaccgacctcccccccctatggggaagcctccaggatcaattgtgcgcccctccgcgccacccgctagatcctccgtgcccgttaccaggccacccgtgcccatcccaccgccacctcccccaccccccctgccacctcctccccccgtcattaaacctcagaccagcgcagttgaacaggagagatgggacgaagattctttctacgggctgtgggacactaatgacgagcaaggtttgaacagtgagttcaaaagtgagacagccgcgattcccagtgcgccagtcctgcctccaccgcctgtgcactcctccataccccctcccggacctgtccctatgggaatgcctccaatgtccaaacctccccccgtccagcaaacagtggattatggccatggacgtgatatcagcaccaataaggttgaacagattccatacggtgaacgtatcacactccgccctgatcctctgcccgaacgctccaccttcgagaccgaacatgctgggcagagagatcgctacgacagagaacgggatagggagccttattttgaccgccagtctaacgtgatcgctgaccatagagattttaagcgcgatagagaaacacacagagacagggaccgcgacagaggagtcatcgactatgaccgggaccgattcgacagagaaagaaggccccgggacgaccgtgctcaatcctaccgggataaaaaggatcatagctcaagtagacggggtgggtttgaccggccgagctatgatagaaagtcagatagacctgtgtatgagggaccctctatgtttgggggagaaagacgcacataccccgaggagaggatgcctctccctgccccttcactctctcaccagccccccccagcccctagagtggaaaagaagccagagagcaaaaacgtcgacgacatcctcaagcctcctgggcgggagtcccggccagagagaatagtggtcataatgcgcggactcccaggatccgggaagacccacgtggccaagctcattagggtaatggaatatgagtacgaggcagagatggaggaaacatatcgaacatcgatgttcaagacgtttaagaagaccctggatgatgggttctttcccttcattattctcgacgctataaacgatcgggtacgacacttcgatcaattctggtcggccgccaagaccaagggttttgaagtctacctggcggaaatgagtgccgacaaccagacgtgcggtaaacggaacattcatggtcggaagttgaaggagataaacaagatggctgatcactgggagaccgccccaagacacatgatgcgcctggacatacgcagccttctgcaggacgcagccatcgaggaggtggaaatggaggactttgacgccaatatcgaggagcagaaggaagaaaagaaggacgcagaagaggaggagagcgaactggtgggcgatcgaccgacgactctcaattctgtgagcctgctgaagttccttaaaaaagtctag

SEQ ID NO: 13774 - DNA, 6441 bp, Artificial Sequence
  Description of Artificial Sequence: Synthetic coding sequence
atgtaccccaactggggacggtacggcgggagcagtcattatccaccaccccctgtcccccctcctcctcccgttgcgctgcccgaggcctcgcctggccccggatactcgtctagcaccacaccagccgcaccatcttccagtggctttatgtcgttccgcgaacagcacctggcccagctgcagcagctgcagcagatgcatcagaaacaaatgcagtgtgtcctgcaacctcatcacctaccaccaccacccctgcccccacctcccgttatgcccggcggaggctatggggattggcagcctccaccacctccaatgcctcctccgccaggacccgctctgagctatcagaagcagcagcagtataagcaccaaatgttacaccaccagagggacggccctcccggactcgttccaatggagcttgaaagccccccagagtctcctcctgttcctcccggtagctacatgccaccatcccagagttacatgcctccaccccagccaccaccttcttattatccacccacctcgagccagccataccttccacctgcgcagccatctccatcacagtcccccccgagtcaaagctacctggctcctactccgtcctattcatcctcatcctccagtagccagagttatttgtcccactcccagagctaccttccaagtagtcaggcatccccatccaggccctctcagggccattcgaagagtcagttattggccccaccccctccatccgcccctcccggcaataagactactgttcagcaagaacctctggaatctggggccaaaaacaagtcaacagagcagcaacaggcggcccccgagcccgacccatcaactatgacaccgcaggagcagcaacagtattggtatcggcaacatttgctcagcctccagcagcgaactaaagtgcacctccctgggcacaagaaagggcctgtggtcgcaaaggataccccagagcccgttaaagaggaagttactgtcccagcgacgtcccaggtgcctgaatcccccagcagcgaggagcctcccctccctcccccgaatgaagaggtgccacctcccctgccacccgaggaacctcagtcagaggaccccgaggaggatgcccgcctcaagcaactgcaagccgctgctgcccactggcaacagcaccaacagcaccgagttggcttccaataccaaggaatcatgcagaagcacacacagctccaacaaatcctgcaacagtaccagcaaatcatccagccaccaccacatatccagaccatgagcgtagacatgcagctgcggcactacgaaatgcagcagcagcaattccagcacctgtaccaagaatgggaaagggaattccaactctgggaggaacagctgcattcctatcctcataaggatcaactccaggaatatgagaaacaatggaaaacatggcaggggcatatgaaagccacacagtcctatctgcaggaaaaggttaattctttccagaatatgaagaatcaatacatggggaatatgtctatgccccctccatttgttccatactcgcaaatgccaccacccctgcccaccatgcccccgccagtacttccccctagcctgccccccccagtaatgccccccgccctgcccgctactgtgccacctcccggaatgcccccaccagtgatgcctcctagtctgccaacctcggtcccccccccaggaatgccacctagcttgtccagcgccgggcctcctcccgttctaccaccgcccagcctgtcttcggcagggcctccacctgtgctcccacccccatccctgtcgtcaaccgcacctcctccagtgatgccattacctcctctgagcagcgccacccctccacctggcattccgccccccggcgtgccacagggaattccacctcaactgactgccgcccccgtgcccccagcttcctccagccagtcaagtcaggtaccggagaagccacggcccgctcttctcccaacccctgtttccttcggctccgcacctcccaccacataccaccccccactgcagtcggccggccccagtgagcaggttaatagcaaggcccccttgtccaagtccgcgctcccgtactcatccttctcaagcgaccagggtctgggcgaatctagtgctgctcctagccagcctatcaccgccgtgaaagacatgcccgttaggagtggcggtcttctgcccgacccccctcgttcctcctacctggagtctccacgtgggccccggttcgacggcccaagaagatttgaggatctggggagtcggtgcgaggggccgagacccaaaggcccaagattcgagggaaatcgaccagacggccctaggcctagatacgaaggccaccctgccgaggggacgaaatccaagtggggtatgatccctcggggccctgcatcccaattctatattacacccagcacatcactgagcccaagacagtctgggccccagtggaagggcccaaaacccgcattcggccagcagcatcagcaacagcctaaatcccaggccgagcccctctcaggcaataaggagcccctggcagatacgtcgagtaaccagcagaaaaactttaaaatgcaatcagcagccttctctattgccgctgatgtgaaagacgttaaggcagcccagtctaatgaaaatctctctgattcacaacaggagccccctaagtctgaggttagcgagggcccagtcgagccttcgaattgggatcaaaacgtccagtccatggagactcagatcgataaagcacaggccgttacccaacctgtcccactggctaacaagcccgtacccgcacaaagtaccttcccgtctaaaactggcggaatggaaggaggcacggcggttgctacgtcgtctctgacggccgacaatgactttaagccagtgggcattggcttgcctcattccgaaaataaccaggacaaaggactgccgaggccggacaaccgggacaataggttggagggcaatcgtggtaattcctctagttatcgtggccccggacagagcagaatggaagacactcgcgacaaaggcctcgtgaatcgcggccggggtcaggctatctccagaggccccggcttagttaagcaagaggacttccgcgacaaaatgatggggagacgggaggacagccgggagaagatgaaccggggcgaggggtctcgtgatagaggactcgtccgcccaggaagcagtagagagaaagtcccagggggcctgcagggatctcaagaccgcggagctgcgggaagccgggaacgtggcccacctaggcgcgcgggcagtcaggaacgtggaccactgcggcgggctggttcaagagagagaatcccacccaggcgagccggctcccgagagagaggcccaccgagaggccctggctcgcgagaacggggcctcgggagatctgattttggcagagataggggcccattccgacccgaacccggagatggtggagagaagatgtacccatatcaccgggatgaacctccacgggcaccgtggaatcacggagaagaacgtgggcacgaagaattccctctcgatggcagaaacgctccaatggagagagagagattggatgactgggacagagaacgatactggagggagtgtgaaagagactaccaagatgatacactcgagttatataatagagaagatcggttcagtgcccccccctcccggtcacatgatggagaccggcgtggtccttggtgggatgattgggagcgcgaccaagatatggacgaagattacaatcgtgagatggagagggacatggaccgggatgtcgaccggatcagcagacccatggacatgtatgatagaagcttagataacgaatgggaccgtgactacgggagacccctcgacgaacaggagagccagtttcgggagagagatatcccatccttgcctccactgccacccctcccccctttacctccgctcgatcgctacagggatgatcgatggcgggaggagcgaaaccgcgagcacggctatgacagggactttcgcgaccggggggagctgcggattagggaatatcccgagcgcggagacacctggagagagaaacgagactacgtccctgatagaatggactgggagcgggagagactgtctgaccgatggtatccatcggacgtcgacaggcatagtccaatggcagagcacatgcccagcagtcatcacagttcagaaatgatggggagcgacgcgagtctggattctgatcaaggactgggtggagtgatggtactaagtcagcgacagcatgaaattatcttgaaagcagctcaggagctgaagatgcttcgcgagcaaaaggaacagttgcagaagatgaaggacttcggatcggagccacagatggcagatcacttaccacctcaggaatctcggctgcaaaatacctcgtctcgtccgggtatgtatcctcctcccggatcctaccgtcctccccccccaatgggaaagccccctggatctatcgtacgcccatcggctcctcctgctaggagttccgtccccgttactagaccccctgtgcccatccctccaccgccaccgcctcccccactaccacccccaccacccgtgatcaagcctcagacctctgccgtggagcaggaaagatgggatgaggacagtttttatggcctgtgggataccaatgacgagcagggcctcaattcagaatttaaatctgagaccgcagcaatcccgagtgccccagtgctgcctccaccccccgtgcatagcagcattcccccacccgggcccgttcccatgggtatgcctccaatgtctaaacctccgccagtgcaacagaccgtcgactacgggcatgggagagatatctccacgaacaaagtcgagcagattccttatggagaacggataaccctcaggcccgatccactccccgagcgttctacctttgagactgaacatgcaggtcagcgcgatagatatgacagggaaagggaccgagagccttacttcgacagacagtcaaacgtgatcgctgatcaccgggattttaaacgggacagggagacacaccgggaccgcgacagggacagaggagttatagactatgaccgcgatcggtttgaccgcgagcggcggccccgtgatgatcgggcccaatcatacagagacaaaaaagaccattccagcagtcggcgcggtggttttgatcgtccatcatacgatcggaagtccgaccgtccagtttacgagggacctagcatgtttgggggggagagacgtacataccctgaagaaaggatgccccttccagcacctagtctctctcaccaaccacctccagctccccgtgtcgaaaagaaaccggaatcaaagaatgttgatgacattttaaagcctccgggacgggaatctaggccggagcggattgtggtaatcatgcgcgggctgccgggcagtggaaagactcatgtcgcgaaactgatcagagacaaggaggtggaattcggcggccccgcacctcgcgtactgtctctcgatgactacttcatcacagaggttgagaaggaggagaaggacccagattccggcaagaaggtgaagaagaaagtgatggagtacgagtatgaggccgagatggaagagacctaccgcacctctatgtttaaaactttcaagaagacgctggacgacggatttttccccttcattatcctggatgcgattaacgaccgtgtacggcactttgatcaattctggagtgccgccaagaccaagggctttgaagtctacctcgctgagatgagcgctgataaccaaacatgcggaaagcggaacattcacgggaggaaactgaaggaaattaataagatggcagatcattgggaaacagctccgcgccacatgatgcgtctcgacattagaagtctgctgcaagacgccgccatcgaagaggtcgaaatggaggactttgacgcaaatatcgaggagcagaaagaagagaagaaagatgccgaggaggaagaatcagagttagggtacatccctaagtctaagtgggagatggacacaagcgaggccaagctggataagttagatgggctgcggaccggaacgaagcgaaagagggactgggaggcaattgcatctcgcatggaggattacctgcagctgccagacgattacgacactcgcgcatctgaaccaggcaagaagcgggtcagatgggctgatctggaggaaaagaaggacgccgatagaaagagggcaattgggttcgtggtcggtcagaccgactgggaaaagattaccgacgaatctgggcacttggcagagaaggcgctcaaccgtaccaagtacatatag

SEQ ID NO: 13775 - DNA, 5565 bp, Artificial Sequence
  Description of Artificial Sequence: Synthetic coding sequence
atgacaccacaagagcagcagcagtactggtaccgccagcatttactttccctgcaacagcgtacaaaggttcacctgcccggccacaaaaaggggcccgtggtcgcaaaagacaccccggagcctgtcaaagaggaagtgacggtacctgcgacttcccaggtacccgaaagcccgtccagcgaagagcctccgctccctccccctaatgaagaggtgccacctcctttaccacccgaagaacctcaatcagaagatcctgaagaggacgctcgactgaaacagcttcaggccgcggcagcacattggcagcaacatcagcagcacagagtaggtttccaataccaggggattatgcaaaaacacacgcagctgcagcagattttgcagcagtaccaacaaattatccagccccccccccatatacagacaatgagcgtagatatgcagctaagacattatgaaatgcaacagcagcagtttcagcacttatatcaggaatgggagcgtgagtttcaattgtgggaagagcaactacactcttatccccacaaggaccagctacaggagtacgagaagcaatggaagacttggcaggggcacatgaaggctacccaatcatatctgcaggagaaagtaaacagcttccaaaacatgaaaaaccaatacatgggcaacatgagtatgccaccccccttcgtcccttactctcaaatgccacctccactccccactatgcctcctccagtcttacccccatctctgcccccacctgtgatgcccccagccctgcccgccaccgtaccgcctcctggcatgccccctcccgtgatgcccccaagcctccctacatcagtgccccctcctgggatgccaccttccctgtcaagtgcgggacctcctcctgtgttgccgccgccctcattgagttctgccggccctccaccagtgttgccacctccgtcactgtccagtactgcccccccccctgtaatgcccttaccgcctctctccagtgctacgcctccccccggaatccctcccccgggagtgccccaaggtatcccgccgcagctaaccgccgctccagtgccgccagcctcttccagtcagtcttcccaggtgcccgaaaagccacgcccggcattgctgcccacacccgtctcatttgggtcagcgcccccaactacatatcatcctcccctccaatcagcaggaccgtccgagcaggtcaattcgaaggccccgctctcaaagtctgctttaccttattcttctttttcaagtgatcagggcctcggggaaagttctgccgctccttctcagcctatcacagccgtaaaagatatgcctgtccggtccggtggcctgttacccgatcctcctcgctcatcatacttggagtccccacggggcccacggtttgatggacccaggaggtttgaagatctcggaagtcgatgcgaggggcctaggcctaagggccccagatttgagggtaaccgcccagatggacctagacctcgctacgagggacatcctgctgaaggaactaagtctaaatgggggatgataccacgcggcccggcctcccaattctacatcaccccgagtacctccctgtcaccaagacagtcaggaccgcaatggaagggcccgaagccagcctttggccagcagcaccagcagcaacctaaatcccaggcagagcctcttagcggcaataaagaacctctggctgatactagttcaaatcagcagaaaaacttcaagatgcagagcgccgcgttttccatcgccgctgatgtgaaagacgtgaaggccgcgcagtccaatgagaacctgagcgacagccagcaagagccaccaaaaagcgaggtttccgagggacccgtggagccttcaaattgggatcaaaacgtgcagtctatggagacccagattgataaagcccaggcagtcacacagcccgtgcccctcgctaataaacctgtgcccgcgcagtcaactttccctagcaaaactggcggtatggaggggggaactgccgtggccacgagctcattgaccgccgacaatgatttcaagcccgtagggattggcttgccgcattctgaaaataatcaggataaagggctgccacggcccgacaatagagacaatcgcctggagggcaatcgcggaaatagctctagctatcgcggccccgggcagtccaggatggaagacactagggacaagggactggtgaaccgcggtcgaggacaggctattagtcgcggcccaggcttagtgaagcaggaagatttccgtgacaagatgatgggaagacgggaggattccagagagaagatgaaccgcggagaaggatccagagacaggggtcttgttcgccctggatcttccagggaaaaggtaccaggtggcctccagggctcgcaggaccggggggcagctggcagcagagagcgggggccccccagaagggcagggagccaggagagaggaccacttcgcagggccggatctcgagagagaatccctccaagaagagccggttccagggagcgcggcccccccaggggtccgggatcacgcgaaaggggattggggcggtccgactttggccgggatcggggccccttcagacccgaaccaggtgacggtggtgagaagatgtatccataccaccgggacgagccacctagggcaccatggaatcacggggaggagcggggacacgaggagttcccattggacggcaggaatgcccctatggaacgtgagcgcctggacgattgggaccgggagagatactggcgcgagtgcgagagggattatcaggatgatacattggaactgtacaacagggaagacaggttttcggcgcccccttcacggagccatgacggtgatcgccgagggccatggtgggacgattgggagcgtgaccaggatatggatgaagattacaacagggagatggaaagggatatggacagagacgtggaccggatttcccgtccaatggatatgtacgatcggagcctggataacgaatgggatcgcgattatgggagaccgctggacgaacaggaaagtcagtttcgggagcgagatattccctcactgccgccgctgccacccctaccacctttgccaccactggatcgctatagggacgaccgttggagggaggagaggaacagggaacatggatacgaccgtgattttagggataggggcgagttacgaataagagaatacccagagagaggagatacctggcgggaaaaaagagattatgtccctgataggatggactgggaacgagaaagactgtcagataggtggtaccctagtgatgtggaccggcactcccccatggccgagcacatgccctcgtcgcaccattcatctgaaatgatgggatcagacgccagcctcgactcagaccagggactcggcggagttatggtgctgtcccaacggcagcacgagatcatcctaaaagctgctcaagagttgaagatgttgcgcgaacagaaggagcagctgcagaagatgaaggattttggctctgagccacagatggccgaccacctccctccccaagaaagtcggctccagaacacgtcttccagacctggcatgtaccccccaccagggtcctatagacccccacctccaatgggaaagccgcctggatcgatcgtaaggccatcagctccccctgctcgtagtagcgtacccgtgactcgtccgcccgtcccaatccccccccctccacctcctccccctctacctcctccacccccagtgatcaagcctcagactagcgcagtggaacaagagaggtgggacgaggattcattttacgggctgtgggacactaacgatgagcaagggcttaatagcgaatttaaaagtgaaacagccgccatccccagtgctccagtgctgcctccccccccagtccacagctctatccccccaccaggtccagtgcccatgggcatgccccctatgtcaaaaccaccccccgtgcagcagactgtggattatggacacggtagggatatttccacgaacaaagttgaacaaatcccatacggggaacgcatcacactgcggcccgatccattacctgaacgaagcacctttgaaaccgagcatgcaggtcagcgggatcgatacgatcgagaacgggaccgagaaccgtactttgatcggcaaagcaacgttattgccgatcatcgggactttaagcgcgaccgcgaaacccaccgcgacagggaccgcgaccggggtgtcatcgactacgatcgcgaccgctttgaccgtgagaggcggcccagagacgacagggcgcagtcctatagagataaaaaagatcacagtagtagccgccgcggaggtttcgataggccatcttatgatcggaagtctgatcgacctgtctacgagggcccaagtatgttcggcggcgaaaggagaacttatccagaagaacgcatgcctctgccagctccttccctgagtcaccaacccccccccgcaccaagggtggagaagaagcccgaatctaaaaatgtggacgatatcctcaaaccccctggcagggaaagcagacctgagcgcatcgttgtcattatgagaggactgccaggctccggtaagacccacgtggccaaactgataagggataaggaagtagagttcggcgggccagccccccgcgttctctcgttggacgattattttattacagaagttgagaaggaagaaaaagaccccgatagcggaaagaaggtcaagaaaaaggtgatggagtatgagtatgaggccgaaatggaagagacataccggacttcaatgtttaagacttttaagaaaactctagatgatggtttcttccccttcataattctggatgctattaacgaccgggtccggcattttgatcagttttggtcagcagctaagactaagggcttcgaagtttacttggctgaaatgtcagctgataaccaaacgtgcgggaagcgcaatatccatgggcgaaagctgaaggaaattaacaagatggcagatcactgggagacagcaccaagacacatgatgagactggacattcgctctctgcttcaggatgcagcaattgaagaggtggaaatggaggattttgatgctaacattgaggagcagaaggaggagaagaaggacgctgaagaagaggaatcggaattagggtacataccaaagtctaagtgggaaatggacacctctgaggcaaaattggacaagttagatggtcttcgcaccggtacaaagagaaagagggactgggaggcgatcgcctccagaatggaagactacttacagcttcccgacgattatgatacacgcgcctcagagccacctcgccctcggggcgcttccttgtgcgtgacgctcctgcccaggttctcctcttgctttgtgagcaccgccctcgtattcttcaaggtgctgcagtgtccccaggaggttctggagtcatgttgcacccaggccaggcggtag

SEQ ID NO: 13776 - DNA, 2184 bp, Artificial Sequence
  Description of Artificial Sequence: Synthetic coding sequence
atggccgcggacagtcgggaggaaaaggacggtgaactcaacgtgctcgatgatatccttacggaggtcccagagcaggacgacgagctctataacccagagagcgaacaagacaagaacgagaagaagggcagtaagaggaagtcagaccggatggaatctacagatactaaaaggcagaagccgtcagtccactctcggcaattggtatcaaaaccccttagtagttcagtgtcaaataacaagcgcatcgtctccactaaaggaaagtctgcaaccgaatacaagaatgaggaataccagaggtcagagagaaataagcggctggacgccgatcgcaaaatcaggctcagcagctctgcgtctcgggagccatacaaaaatcagcccgagaagacttgcgtccggaaacgtgatcctgagcggcgcgccaagtcacccacccccgacggctccgagcggataggactggaagtcgacagaagagcttcacggtcaagccagagcagcaaagaagaagtcaattctgaggaatatgggagcgaccacgagacaggatcctcaggttcatccgacgagcaggggaacaacaccgagaatgaagaggaaggcgtcgaggaagacgtggaagaggatgaggaggtggaggaggatgccgaagaagacgaagaagtcgacgaggacggcgaggaagaggaggaggaggaagaagaggaggaggaggaggaggaagaggaggaggaagaatacgagcaagacgaaagggatcagaaggaagagggcaacgactacgataccagaagcgaagccagcgactccggatccgagagcgtgtccttcaccgatgggagcgtgaggtcgggttccgggacagacggttctgacgagaagaagaaggaacggaaacgcgccaggggcatctcccctatagtctttgataggtccggtagctcggccagcgagtcttatgccggaagcgagaaaaagcatgagaagttgtcatcttcagtcagggccgtgcgcaaggatcagacaagtaagctgaagtacgtgctgcaggacgcgcgattcttcttgattaaatcaaacaatcatgaaaacgtgagcctagctaaggcaaagggtgtctggtccactctacccgtcaatgagaagaagctgaatttggccttccgctcagctaggagcgtgatcctgatcttctctgtccgggagagtggcaagttccagggcttcgctcgactttcttccgagtctcaccacggcggaagcccaattcactgggtcctccccgcaggaatgtccgccaagatgctggggggcgtttttaagatcgactggatttgccgcagggagctgcccttcaccaaaagcgcacatttgaccaatccctggaatgagcacaagccggttaagattggaagagatggtcaggagattgagctcgaatgcggaacccaactgtgtctgctcttcccccccgatgaatctatcgacctgtatcaggtgatacacaaaatgagacataaacggcgcatgcattctcagccccgtagtagaggccgcccaagccgtagggagccagttagggatgtggggcggcggagaccagaagattacgacatacacaactctcggaaaaaaccaaggatcgactacccgcctgaatttcatcagcggcctggatacctgaaagatccacggtatcaggaggtggatcggaggttctccggtgtgcggagagacgttttcctgaatggttcctataatgactacgtgcgggaattccataacatgggaccacctcccccctggcagggcatgcctccctaccctggaatggagcaaccaccacatcatccgtactaccaacatcacgcacctcctcctcaagctcatcctccatattcaggacaccatcccgtcccccacgaagcaaggtacagagacaagcgagtgcatgattacgacatgagagtcgatgacttcctcagaagaacacaagccgtcgtctcggggaggcggtcccgcccgagagaacgggacagagagagagagagggaccggccccgcgataatcgccgggaccgcgaaagggatcgcgggcgggaccgcgaaagagaaagggaacggctgtgtgaccgagatcgggatcgtggtgagcgcggacggtacagacgttag

SEQ ID NO: 13777 - DNA, 2130 bp, Artificial Sequence
  Description of Artificial Sequence: Synthetic coding sequence
atggccgccgactcccgcgaagagaaggacggggagcttaacgtgctggacgatatcttgacagaggtgccagagcaggacgacgagttgtacaaccccgagtccgagcaagacaagaatgaaaaaaagggtagcaagcgcaaaagcgataggatggaatccaccgacactaaaagacaaaagccgtctgtgcacagcagacagcttgtgtctaaacctctaagcagctctgtttcgaacaataagcggatagtgtccacaaagggaaagtctgcgacagagtataagaacgaggagtaccaacggagcgaacgtaataaaagactcgacgccgatcggaagattcgactgtcatcttctgcctcaagagaaccgtacaaaaaccagcctgaaaaaacatgcgtgcggaagcgtgatcccgaaagacgcgcaaagtcccctactccagacggtagcgaacggataggcctggaagtagacaggagggcgagcagaagttctcagagcagcaaagaagaagttaattctgaagaatacggcagcgaccacgaaactggatcttctgggtcctctgatgagcaggggaataacacggaaaacgaagaggagggggtggaagaggatgtcgaggaagacgaggaggtggaagaagacgccgaagaggacgaagaggttgacgaggacggagaggaggaagaagaggaggaggaggaggaggaagaagaggaagaggaggaggaggaggagtacgagcaggacgagagggaccagaaggaagaagggaacgattacgacactcgctccgaggcctcagatagtggaagcgaatcagtgtccttcactgacggaagcgtgaggtcagggtcgggcacagatggatcggacgaaaagaagaaagagagaaagagggctcgcggaatcagccctatcgtctttgacagatcgggctcaagtgcttctgagagctacgctgatcaaacatccaaacttaagtacgtcttgcaagatgcccgatttttcctaatcaaatctaataaccatgagaatgtgtctctcgccaaagctaagggcgtgtggagcacactgcccgtaaacgaaaagaagctcaatctagcatttaggagtgcccggagtgttatccttatcttttccgtgcgggaatcaggaaaattccaaggattcgcacgtctgagctccgagtcccatcacggcgggtcgccaattcactgggtgctgcccgcgggtatgtctgcaaagatgttaggtggcgttttcaaaatcgactggatatgtcgccgagagctaccattcactaaaagcgcccaccttaccaatccatggaatgaacataagccggttaagattggtagggatggccaagagatagagctggagtgcgggacacagctttgcctccttttccccccagatgagagcatcgatctgtatcaagtcatccacaagatgcgccataagcggcgcatgcattcccagcctaggtcccggggcaggcccagtcgccgcgaaccagttagagatgttggaaggaggaggcctgaagattacgacatccacaatagtagaaaaaagccccggattgactacccacctgagttccatcaacggcccggctaccttaaggaccctcggtaccaggaagtcgatagaagattcagcggagtgagaagggacgtgtttctgaatggatcctacaatgactacgtgcgtgaatttcataatatgggccccccacccccctggcaagggatgcctccatacccaggcatggaacagcctccccatcacccttactatcagcaccatgcgcccccccctcaggcccaccctccctattccggtcatcacccagtgcctcatgaagcacgctaccgcgataaaagggtgcatgactatgatatgcgggtagatgatttcctccgccggacccaggccgtagtcagcgggcgccgaagtaggcccagagagcgggacagagaacgcgaacgggacagaccccgtgacaatcggagagaccgagaacgcgatcggggcagggatcgcgagcgtgagcgggaacgtttatgcgacagagacagggatagaggcgaacgtgggcggtacaggcgatag

SEQ ID NO: 13778 - DNA, 2130 bp, Artificial Sequence
  Description of Artificial Sequence: Synthetic coding sequence
atggctgctgacagtcgggaagagaaggacggcgagttgaacgtcctggacgatattctcacagaggttccagaacaggatgatgagttgtacaatcctgagtctgaacaagacaaaaacgaaaaaaaaggatccaaacgcaaatcagatcgtatggagagcactgataccaagcgccagaaaccttccgtgcacagcagacagctggtgtccaaaccactcagctcctcagtgtccaataataagcggatcgtttctaccaagggaaagtccgcaaccgagtacaagaacgaggagtatcagaggtctgaacggaataagcgacttgatgcagatcgaaagatccgcttatctagttctgcctctcgcgagccgtacaagaaccaacctgagaaaacttgtgtccgtaaaagggatccagagagaagggcaaaatcacctacgcccgacggctctgagaggattgggctggaggttgatcggagggccagcagatctagtcaaagttccaaggaagaagtgaatagcgaggaatacggtagcgatcacgagacaggtagctctgggagttcagatgagcaaggcaacaatacagagaatgaggaggaaggagtcgaagaagacgtggaggaggatgaggaagtggaggaggacgcagaagaagatgaagaggtggatgaggacggagaagaagaagaggaagaggaagaggaagaagaagaagaagaggaggaagaggaagaagaatacgagcaagacgagagggatcaaaaggaggagggaaatgactacgacacaagatccgaggcttctgacagtggcagcgaaagtgtttccttcacggatgggagtgtccgctctggttctggaactgacggcagcgatgagaaaaagaaggagcgcaagcgggcaagaggaatctcccctatcgtctttgaccggtccgggtcctccgccagcgagtcctacgccgaccaaaccagtaagctaaaatatgttctgcaagacgcccggttctttctgatcaagtccaacaaccacgaaaatgtgtctctggctaaggccaaaggtgtgtggagcaccctgcccgttaatgagaaaaaactgaacctggcgttcagaagcgctcgatctgtgatcctcatcttctcggttcgcgagagtggaaaattccagggatttgctcgactgtcctctgagagtcaccacgggggatcaccgatccactgggtccttcccgctggcatgtcggcaaagatgcttggcggcgtgttcaagattgactggatctgtcgccgagagctgccctttacaaaatctgctcatctgaccaacccctggaacgagcacaaacctgtaaagatcgggcgcgatggacaggaaatcgagcttgaatgtggaacacagctttgcctgctatttccacctgacgagagcatcgatctataccaggtgattcacaagatgcgccataaacggagaatgcattcacaacctcgatcgagggggcgccccagcaggcgggagcccgtcagggatgttgggaggagaagacccgaagactatgacatacataactcaagaaagaaaccgcgcattgactaccccccggaattccaccagcgacccggatatctaaaggatccccggtatcaggaagtcgacagaaggtttagcggggtgcggcgggatgtcttccttaacggtagttacaatgactacgtgagagagttccacaacatgggccctccgcctccctggcagggcatgcccccatatcccggaatggaacaaccaccgcaccatccctactaccaacatcacgccccgcctcctcaggctcaccctccatactccggacatcatcctgtacctcatgaagccaggtatagggacaaacgggtacatgactacgatatgcgggtggatgactttctcaggcggacacaggctgtggtaagcggaaggagatccagacctagggaaagagaccgggaaagagagcgagatcggccgcgagacaatagaagagaccgtgaacgggacagaggcagggaccgggaacgcgaacgggagagactctgcgacagagaccgcgaccggggtgaacgaggtagataccggcgatag

SEQ ID NO: 13779 - DNA, 2184 bp, Artificial Sequence
  Description of Artificial Sequence: Synthetic coding sequence
atggccgccgattctcgagaagaaaaggacggcgaactgaacgtactggatgacatcctgacggaggtccctgagcaggacgatgaactttacaaccccgaatcagagcaggataagaacgagaaaaagggttcaaagaggaaatctgatagaatggaatcgacagatacaaagcgtcagaagccgtctgttcacagcagacagttggtgtccaaaccactctcgtcttcagtatccaataacaagcgcatcgtatccacaaaagggaagtccgccacagaatataagaatgaggagtatcagcggagtgagaggaacaaacggcttgacgcagatcggaagataaggctctcctcctccgctagccgagagccttataagaaccagccggagaagacgtgtgtgaggaagcgggaccctgagaggagagccaagtccccgacacctgatggcagcgaaagaatagggctggaagtggaccgccgtgcctccaggtcctcgcaaagctctaaggaagaagttaactccgaggagtacgggtccgaccacgaaaccggatcctcgggctcgtctgatgaacagggtaacaatacggagaacgaggaagagggcgtggaggaggacgtcgaggaagacgaggaggtagaggaggacgctgaggaggatgaggaggtggacgaggatggcgaagaagaggaggaggaagaagaagaagaggaggaggaggaagaggaagaagaggaggagtacgagcaagacgaacgcgatcagaaggaggagggaaatgactatgatacacgctccgaagcatcagatagcggttccgagtctgtaagcttcaccgacggaagcgtgaggagtggctcaggcactgatggctccgatgaaaaaaagaaagagcggaagcgagcacgaggaatcagtcctatagtatttgataggtcgggaagttcggccagtgaatcctacgcaggctctgagaagaaacatgagaaactgagcagctctgtcagggcagttcggaaggaccaaacgagcaaacttaagtatgtcctgcaggacgcacgttttttccttatcaagtcaaacaatcacgagaacgtctctctggctaaggctaagggcgtttggtcgactctgccggtgaatgaaaaaaaacttaaccttgcgtttagatcagctagaagtgtaatattgatcttctcagtgcgtgaatcagggaaattccagggattcgcccggctgtcttctgagagtcaccatggcggctcacccatccactgggtgctgccggcaggaatgtctgccaaaatgctggggggggtattcaagattgactggatctgccgcagggagttgccattcaccaagtccgctcacctcacaaacccatggaacgaacacaaacctgtgaagattggccgggacggccaagagatcgagttggagtgcgggactcagctttgcttgctctttccccctgacgaatccatcgatctgtaccaggtgatccataagatgcggcacaaaagaagaatgcattctcagccaaggtcgcgggggcggcctagtaggcgggaaccagtacgggacgttggtcgacgacgacctgaagattacgatatccacaactcaaggaaaaaaccccgtattgactatccgcctgagttccaccagcggcctggttatctgaaggatccccggtaccaggaagttgaccgccgcttcagcggagtccgccgcgatgtgtttctcaacggctcctacaatgattatgtgagggagtttcataacatgggtcccccacccccatggcaaggcatgcctccttatcctggcatggagcagcctccccaccatccttactaccagcatcatgccccaccccctcaggcacacccgccgtacagcggacaccacccggttccccacgaggccaggtaccgggataagagggtgcatgactatgacatgagggttgacgacttcctgagacgcacccaggccgtggtgtctgggcggaggtcccgcccccgggaaagggaccgtgaaagagaaagagatcggccccgagacaaccggagagacagagaaagagaccgggggcgggaccgggaaagggaaagagagagactgtgcgaccgggaccgggataggggcgagcgcggtaggtataggcggtag

SEQ ID NO: 13780 - DNA, 1992 bp, Artificial Sequence
  Description of Artificial Sequence: Synthetic coding sequence
atgttcctaaaagcagggcgcggcaacaaggtgcccccagttcgggtgtacggacccgactgcgtcgtgctcatggaaccgccactgagtaagagaaacccaccagctctgcggctggctgacctcgcaacggcacaagttcagccgctgcagaacatgaccggcttcccggccctagctggtccccctgcccacagccagctgagagctgcagtggcccatctgcgcctccgggatctgggggctgatccaggagtagccacaacaccactgggtcctgaacacatggctcaggcgtcaacgctgggattgtctcctcctagtcaagcgttcccggcacatccggaggcccccgccgcagccgcacgggccgctgcccttgtagcgcatcccggagccggcagttacccatgcggtggcggtagtagcggcgcccagcctagcgcccccccccccccagcacctcctctgccaccaaccccttcacctccgcctccccctccaccgccacctcctccagctctgagtggttacactactacaaatagtggaggtggcggatcctccgggaaaggccacagcagagattttgtgctgcggagagatctgtcagctaccgccccagcagccgcaatgcacggggcacctctcggaggcgagcagcggtccggtacgggctctcctcagcatcccgctccaccaccccactcggccggaatgttcataagcgcgagcgggacatatgcagggccggacggaagcggcggaccggctctgttccctgcgctgcatgatactcccggcgctcccggtggccatccacatcctctgaacgggcagatgcgcctcgggctggccgcagcagccgccgccgccgcagctgagctgtatggccgggctgaacccccattcgctccacgaagcggagacgcccattacggtgccgttgcagcagcggccgccgcagcgctacacggttacggagctgtgaatctgaatctgaacctggcagcggctgcggcagccgccgcagccggccccggcccccaccttcagcaccacgctcctccaccggcaccccctcctcctcctgctccagctcagcatccacaccagcaccaccctcatttgccaggtgccgctggcgctttccttcgctatatgagacaacctatcaaacaggaacttatctgcaaatggatagaccccgacgagcttgctggactgcctcctcctccgcccccacctcccccccctcctcccccacccccagccggcggtgctaagccgtgttctaagacttttggaaccatgcatgaactggtgaaccatgtgaccgtggagcatgtgggcggtccagagcagtccagtcacgtctgtttctgggaagattgtcctcgggagggcaaaccctttaaagcaaaatacaagctcattaaccacattagagtgcacacaggtgagaagccatttccttgtcccttccctgggtgcgggaaggtcttcgccagatcagaaaatttgaagatccacaaaagaacacacaccggcgagaagcccttcaaatgcgaatttgatggttgtgatcgaaagttcgctaactccagcgatcgtaagaagcactcccacgtccacacctcagacaagccttattactgtaagatccgcggatgtgacaagagctatacacatcccagcagtcttcgcaagcacatgaagatccactgtaaatcacctcctccttccccaggaccacttggctactcctccgttgggacccctgtgggtgcgccgctgagtccggtcttggaccccgcccgctcccattcatctaccctcagcccacaggtgaccaaccttaacgaatggtatgtctgtcaggcttcgggggcccccagccacctgcatacacctagctcgaacggcactaccagcgaaaccgaagacgaggaaatctatggcaaccccgaggtggtaaggaccatccactag

SEQ ID NO: 13781 - DNA, 654 bp, Artificial Sequence
  Description of Artificial Sequence: Synthetic coding sequence
gcagcggccgccctgcacggctacggagctgtgaacctcaatttaaatctggccgctgcagccgcagcggcacacccgcaccagcatcatccacacttacccggtgcagctggagcgttcctcaggtatatgaggcagccgatcaagcaggagctgatctgcaaatggattgatcccgatgagttggcgggaagagcaaaaccgtgctctaagacttttggaaccatgcatgagctggttaatcatgtaactgtggagcacgtaggtggtccggagcagagttcacatgtatgcttttgggaagactgcccccgcgaggggaaacctttcaaggcgaaatataagctcataaaccatatcagggtacacactggcgagaaacccttcccttgtccctttcccgggtgcggaaaggtcttcgcccgatcggagaatcttaaaatccacaagcgcacccacaccggggagaagccttttaagtgcgaatttgatggctgcgacaggaaatttgctaactcaagtgacagaaaaaagcacagtcatgtccacacgtccgacaagccatactactgtaagattcgaggatgcgataagtcttatacccacccatcctcactgagaaagcatatgaaaatccactgtaagagtccgtag

SEQ ID NO: 13782 - DNA, 3696 bp, Artificial Sequence
  Description of Artificial Sequence: Synthetic coding sequence
atgtgtaaatgctgcaacttattttcacctaatcaatccgaactgcttagtcatgtttcagaaaagcacatggaggaaggagtcaatgtggatgagatcattattccactgagacccctctccactccagagcctcccaactcttccaaaaccggggacgagttcttggtgatgaagcggaaacgcggtcgcccaaaaggctctacaaaaaagtcttccacagaggaagaactggcagagaacatagttagtcctacggaggactcacctcttgctcctgaagaaggaaatagcttaccgccaagttctctcgagtgctctaaatgttgtagaaaattcagtaatactcggcagctacgtaaacatatttgcattatagtactgaaccttggcgaggaggaaggcgaagccggaaacgagtccgacttagagctcgagaagaaatgcaaagaggatgatcgcgaaaaagcgagcaagaggccgcgttctcagaagactgagaaagtgcagaaaattagtgggaaggaagccagacaactgagcggtgccaagaagcccatcataagtgtcgtcctgaccgcccacgaggccatccccggagctaccaagatcgtcccagtggaggctggccccccagagacgggcgccactaattctgaaaccacatccgccgacctcgtgcctcggcggggctatcaggaatatgccatccagcaaaccccttacgagcagcctatgaaaagcagtcggctgggtcctacccagcttaaaatctttacttgcgagtattgtaacaaggtctttaagtttaagcactcactgcaggcccatctcagaatccatactaacgagaagccatacaagtgccctcagtgtagttacgcctcagctatcaaagcaaatctgaatgtacacctccgaaaacacaccggggagaaatttgcctgtgattactgtagctttacctgtctcagtaaggggcacttgaaggtgcacatcgaacgtgtgcacaagaaaataaaacagcattgcaggttctgcaagaaaaagtatagtgatgtgaaaaacctgatcaagcacatccgcgacgctcatgatccacaggataagaaggtcaaggaggctcttgatgagctctgccttatgacaagggagggaaaacggcagctgctatatgattgtcacatttgcgaaaggaagttcaagaatgaactcgacagagatcgtcatatgctggtacatggtgacaaatggccatttgcatgcgaactctgcgggcacggcgcaacgaagtaccaggctctggaactgcacgttcgcaagcatccatttgtgtacgtgtgtgctgtttgtagaaagaagttcgttagcagtattcgtcttaggacccacatcaaagaagtgcacggagccgcccaagaggccctggtttttacatcttctattaaccagtccttctgtcttttggagcccgggggtgacatccagcaggaagccctcggtgaccaactgcaactcgtcgaagaggagttcgcgttacagggggtcaacgcactgaaagaggaggcctgtcccggagacacacagctggaagagggccgtaaggaaccggaagccccgggagaaatgcctgcccctgcagtgcacctcgcatccccacaagccgagtccacggcactccctccatgcgaattggaaacaactgtggtctcaagctccgatctacactcccaagaggtggtctctgacgactttctactgaagaatgacacgtcaagtgctgaagctcatgcagcccccgagaagcctcccgatatgcaacaccgcagtagtgttcagacccaaggtgaggtgattacactgcttctgtctaaagcacagtctgctggttctgaccaagaatcccatggggcgcagagccctctgggcgaaggccaaaacatggccgtactgagcgcgggagaccctgatccctcacggtgcttaagatctaaccccgccgaagcaagtgacctcctgccacccgtcgctggaggcggcgatacaattacgcaccagcctgacagctgtaaagccgcccccgagcatcgctctggtattacggcctttatgaaagtgctgaattccttgcagaaaaaacagatgaacacttctctgtgcgagaggataaggaaggtgtacggcgatttggaatgcgagtattgcggtaaactgttctggtatcaggtacattttgacatgcacgtccgtactcatactcgcgagcacctgtattactgtagtcagtgtcactactctagcatcactaagaactgtctgaagagacacgtcatccagaaacacagtaacatactgttgaaatgtccgacagacggatgtgactattctacgcctgacaagtataaactgcaggcccacctgaaggtccacactgcactcgacaaaagaagctatagctgtcccgtgtgcgagaagagcttttctgaggatcgtctgattaaaagccatattaagacaaaccatcccgaggtctcgatgtccaccattagcgaagtactgggaagaagagtccagctgaaaggtttgataggcaagagggccatgaaatgcccttactgtgacttctatttcatgaaaaatggatctgatctgcagcgccacatatgggcccatgagggtgtgaaaccttttaagtgttctttatgtgaatatgcaacacggagcaagtccaacctcaaagcgcatatgaaccggcattcgacggagaagactcacctctgtgatatgtgtggtaagaagtttaaaagcaagggcacactgaagagccacaaactcctgcatacagcggacggtaagcagttcaagtgtaccgtgtgtgactatactgctgcacaaaaaccacaactgctcagacatatggagcaacacgtgtctttcaaaccattccgatgcgcccactgtcactactcctgcaacattagcgggtccttaaagcgccactataatcggaagcatcctaatgaggagtatgctaacgtgggaacaggcgagctggccgccgaagtgttaattcagcaaggggggctcaaatgtccggtttgctcctttgtgtatggcaccaaatgggaatttaatagacacctgaaaaacaaacatggcctaaaagttgtcgagatagacggagaccccaagtgggaaacagccaccgaggccccggaggagccctctacccaatacctgcacattacagaggcggaagaggacgtccagggaactcaggccgccgtcgccgcgcttcaggacctgcgatacacatccgagtctggagataggctcgatccaaccgccgttaacatactccagcagattatcgagttaggggcagaaacgcacgatgcaactgcgctggcctcggtggtcgctatggctcctggcacagtgacagtggttaagcaggtgaccgaagaggagcccagcagcaaccatactgtcatgattcaggagaccgtgcagcaggctagcgtggagctcgccgaacagcatcacctggttgtgagttcagacgacgtggagggcatagagacggtgaccgtgtacacccaaggcggggaggcatccgaatttatcgtctatgtgcaggaagccatgcaacccgtcgaggaacaggccgtggaacaacctgcccaggagctttag

SEQ ID NO: 13783 - DNA, 1935 bp, Artificial Sequence
  Description of Artificial Sequence: Synthetic coding sequence
atggctaagccttcacacagttcgtacgtgctgcagcagctgaataaccagagagaatggggattcctgtgtgattgctgtatcgctatagatgatatttatttccaggcccataaggcggttctcgccgcctgcagctcttactttcgcatgtttttcatgaatcaccagcacagcacagctcagctgaaccttagcaacatgaagataagtgctgaatgtttcgatctcatactgcagttcatgtatctgggaaagatcatgaccgctccctcgtcttttgaacagtttaaagtggcgatgaactacttacagctgtataatgtgccggactgccttgaagatatccaggatgctgactgttcatcatcgaaatgcagctccagcgctagttcaaaacagaactcgaagatgatctttggggtgaggatgtatgaagacacagtggcacgaaatggaaacgaggccaaccgatggtgcgctgaaccatcatcaactgtcaatacgccccataacagggaggctgacgaggagagtcttcagctggggaactttccagaaccattgtttgatgtgtgtaagaagagttccgtgtccaaactttcgactcctaaagagcgggtgagcaggaggttcggccgatccttcacttgcgatagttgcggatttggcttcagctgtgaaaagctcttagatgagcacgttctgacttgtacaaataggcacctgtaccagaatacccgtagctaccaccgcattgtggacataagagacgggaaagacagcaatatcaaggctgagttcggcgagaaagactcctctaagacgttctcggctcagacagataagtaccgcggagacacttcacaggctgcagacgatagtgctagcacaaccggttcaaggaagtccagcaccgttgagtccgaaatcgcaagcgaagaaaaatcacgcgccgctgaacgcaagagaatcatcattaagatggaaccagaggatattccaaccgatgagttaaaggattttaatattatcaaggtcaccgacaaggattgcaatgaatccaccgacaatgatgagctggaagatgagcccgaggagccattttaccggtactatgtcgaagaggatgtgagcatcaaaaagtccggacggaagacactaaaaccccggatgagcgtgtccgccgatgaacggggcggtttggaaaacatgcgccctcccaacaacagctctcctgtgcaggaggacgctgaaaatgcgtcttgcgagctgtgcggtctgactattaccgaggaggacctgtcaagtcactatctcgccaagcatatcgagaacatttgcgcatgtggcaagtgtggtcagattctagttaaagggcggcaattacaagaacatgcccagcgctgcggagaaccacaggatctaacaatgaatggcctggggaataccgaggaaaaaatggacctggaggagaaccccgacgagcagagcgagatccgcgatatgtttgttgagatgctggatgactttcgcgataaccattatcagatcaatagtatccagaagaaacagctgtttaagcactccgcttgcccattcaggtgtcctaattgtggccagagattcgagacagagaacctcgtagtcgaacacatgtcctcatgcctggatcaagacatgttcaagtccgccatcatggaggaaaatgagcgcgatcaccgccgtaagcacttctgcaatctctgcggaaaagggttttatcagcgctgtcatcttagggagcattacaccgttcatacgaaagaaaaacagttcgtctgccaaacctgcgggaaacaatttttaagagagagacaattgcgtttgcacaacgatatgcacaagggcatggcttctggggagatagggccaagcaaacctgtggagaaatag

SEQ ID NO: 13784 - DNA, 2142 bp, Artificial Sequence
  Description of Artificial Sequence: Synthetic coding sequence
atggccaagccatctcactctagttatgtgctgcaacagctaaacaatcagcgcgagtggggctttctgtgtgactgttgtatcgccatagacgatatttattttcaagctcataaggccgtgcttgctgcatgctcctcctattttaggatgttctttatgaatcaccagcatagcaccgctcagcttaacttaagcaatatgaaaatctctgccgaatgctttgacttgatactgcagttcatgtaccttgggaagatcatgacagccccatcatcattcgagcaattcaaagtcgctatgaactatctccagctttacaatgtccccgactgcctagaggacattcaagacgcagattgttcttcatctaaatgctcttcctcggctagctccaaacaaaatagtaaaatgattttcggggtccgcatgtacgaagatacagtggcaaggaatggcaatgaggcaaatcggtggtgcgcagagccgagtagcacggtgaatacaccacacaatagggaagcagatgaagaatccttgcagctgggtaattttcccgagccactgtttgacgtctgtaaaaagtcaagtgtgagtaagctgagcaccccaaaggaaagggtgtctagacgcttcggacggtctttcacttgtgacagctgcggatttggattcagttgtgaaaagctgctggatgaacacgtgctaacttgcacaaatcgacacctgtatcagaatacacgttcgtaccatagaatagtcgacatcagggacggaaaggacagcaatatcaaggctgagttcggggagaaggattcatccaagacattttcggctcaaacagacaaatatcgcggtgacacctcacaggccgctgacgattccgcatccaccacaggttctagaaagagctctaccgttgagtcagaaattgcttcagaagaaaaatctcgtgcagcggagcgtaagagaattattatcaaaatggagcccgaagatatccctacggacgagctaaaggatttcaacattattaaggtgacggacaaagattgtaacgagagcactgacaacgacgaacttgaagatgaaccagaggagcctttctaccgttattatgtggaggaggacgtgtcaatcaagaaaagtggacggaaaactctgaagccacgcatgtctgtcagtgccgacgaaaggggcgggctagagaacatgagaccacctaacaatagcagtcctgtgcaggaggatgccgagaatgcatcttgtgagctgtgtggtctgacaatcacagaggaggatctatcttctcactaccttgctaagcacatcgagaatatttgcgcttgcgggaaatgcggacagatactggtcaagggccggcagctacaggaacacgcgcagcgctgtggagaaccccaagatttaacgatgaatggcctgggcaacaccgaggagaaaatggatctcgaggagaacccagacgaacagtccgagattagggacatgtttgtagagatgttggacgactttcgcgataaccactatcagattaacagtattcagaagaagcagctgttcaagcacagtgcctgtccttttagatgccccaactgtggccagcgctttgaaacagaaaatcttgtcgtggagcatatgtcatcctgcttagatcaggacatgttcaagtcagcaatcatggaagaaaacgagagagaccatcgtcgtaagcacttctgcaacttgtgcggcaaagggttctatcagcgatgccacctgagagaacactacacagtccataccaaggagaagcagtttgtatgtcagacttgtggaaaacagtttttgcgagagaggcagctgcggctccataatgatatgcacaagggtatggcacggtatgtctgttccatttgcgaccagggtaatttcaggaaacacgaccatgtccggcacatgataagccacttgtctgcaggggagaccatttgtcaggtgtgtttccagattttccctaataatgaacagctggaacagcacatggatgtgcatctttatacttgtgggatttgtggagcgaaatttaatttaagaaaagacatgagaagtcactataacgcaaagcacttgaagcggacttag

SEQ ID NO: 13785 - DNA, 468 bp, Artificial Sequence
  Description of Artificial Sequence: Synthetic coding sequence
atggccaagccttcccacagctcctacgttttgcagcagttaaataatcaacgggaatggggcttcctttgcgattgttgtatcgctattgatgatatttacttccaggcccacaaggccgtcttagcagcctgtagttcatactttaggatgtttttcatgaatcaccagcatagtaccgctcagctcaatctgtcaaatatgaaaatctccgccgagtgtttcgacctgatcttgcagtttatgtacctcggcaagatcatgactgcccccagcagcttcgagcaattcaaggtcgctatgaactatctgcagctctataacgtgcctgactgtctagaagacatccaggatgcggattgcagcagttcaaaatgtagcagttccgctagtagcaaacagaactccaagatgatttttggcgtacgcatgtatgaggacactgttgcccgtaacggaaatgagtag

SEQ ID NO: 13786 - DNA, 2142 bp, Artificial Sequence
  Description of Artificial Sequence: Synthetic coding sequence
atggctaaaccttctcatagctcctatgtattgcagcagctcaataaccagagagagtggggatttctctgcgattgctgcatcgcaatagatgacatatatttccaggctcataaagcagtactggcagcctgctccagttactttaggatgttcttcatgaatcaccagcactccacagctcaactgaatctctccaacatgaagatctcagcagagtgttttgacctaatcctccagttcatgtacctgggaaagattatgaccgcccccagtagttttgagcagtttaaagtcgccatgaactacctacaactctataatgttcctgattgtctcgaggatatccaggatgccgattgctctagctcaaagtgctcgtcatccgcaagcagcaaacagaattccaagatgatcttcggcgtcagaatgtacgaggacactgtagctcgaaatggtaacgaggcaaaccggtggtgtgccgaaccatcttcaaccgttaatacaccccataaccgcgaagcagacgaggagtcccttcagctggggaattttcccgagcctctgtttgatgtttgcaaaaaaagttcggtgtcaaagctgtctacgcccaaggaaagagtgtcccgacggttcgggaggtcttttacatgcgacagctgtggtttcggcttctcttgcgagaaactcctcgacgaacacgttctgacatgtactaaccgtcatctgtatcaaaatacacggagttaccaccgcatcgtcgatatccgggacgggaaggactcgaacatcaaggccgagtttggcgagaaggacagttccaagactttctccgctcaaacggacaaatacagaggagacacatcccaggcagcggacgattctgcctcaaccacgggatcgcgcaaaagctctacggtggagagcgagatcgctagcgaagagaagtctagagccgccgaacgcaagcgtattatcattaaaatggaaccggaagatattccgactgatgagctcaaggatttcaatatcattaaagtgactgacaaagattgtaacgagtctaccgataatgatgagctggaagatgaacctgaagaacccttctatagatattacgtggaggaagacgtgtctatcaaaaagtccggtcgaaaaacccttaagccccgcatgagtgtaagtgctgatgagcgtggcgggcttgagaacatgagacccccaaacaattcctctcctgtgcaggaggacgctgagaatgcatcctgcgagctgtgcggactcacgatcacagaagaggacctcagctcccactaccttgctaagcatatcgaaaacatctgtgcttgcggtaagtgtggtcagattttagtaaaagggagacagctgcaggagcatgcccagaggtgcggagaaccacaagaccttacaatgaacggattagggaataccgaagagaagatggacctcgaggaaaatcccgatgagcaatccgaaatccgcgacatgttcgtggagatgctggacgactttcgcgataaccactaccaaattaacagcatacaaaagaagcagctgtttaaacactctgcttgtccgtttaggtgtcccaactgcggacaacggttcgagacagaaaatctagtggtggaacatatgagtagctgtctggatcaggacatgttcaagtcagccatcatggaggagaatgagcgtgaccataggagaaagcatttttgcaacctctgtggaaaggggttttaccagcgctgtcatctgagggagcattacacagtgcatacaaaagaaaagcagttcgtctgccagacatgcggtaagcaatttctgcgggagaggcagctcaggctgcataacgacatgcacaagggtatggcccgttacgtgtgttctatctgtgaccaaggcaacttccgcaagcatgatcacgtccggcatatgatttcccatctctctgcaggagagacaatctgtcaggtgtgcttccagatatttccgaataacgagcagcttgagcagcatatggacgtacacctttatacctgcggcatatgtggcgcaaagtttaacctgcggaaggatatgcgtagccactacaatgctaagcacctaaagaggacatag

SEQ ID NO: 13787 - DNA, 105 bp, Artificial Sequence
  Description of Artificial Sequence: Synthetic coding sequence
atggccaaaccgagccactctagttatgttttgcagcagttaaacaatcaacgtgaatggggttttctatgtgattgctgtattgcgatagatgatatctactag

SEQ ID NO: 13788 - DNA, 393 bp, Artificial Sequence
  Description of Artificial Sequence: Synthetic coding sequence
atggctaagccaagtcattcatcttacgtgctccaacaactgaataaccagagagagtggggattcttgtgcgattgctgcattgcaatcgatgacatatattttcaggcccataaagctgtgttagcagcttgctcttcttattttaggatgtttttcatgaaccatcagcattctaccgcacagctgaatctctcaaatatgaagatttctgctgaatgttttgacctgatactacagtttatgtatctcggcaagattatgaccgctccgtctagctttgaacagttcaaagtagcgatgaattatctgcaactgtacaacgtacctgattgtttagaggatatccaagacgctgattgctcaagcagtaagtgtagctcatccgcctag

SEQ ID NO: 13789 - DNA, 1740 bp, Artificial Sequence
  Description of Artificial Sequence: Synthetic coding sequence
atgacccgtctggagcgaagcagccaccggactgtgatctgtaaagtgccaggcgagctggtggcgagagagggaaagtgcgcctcccgagcaagggaaagtgaaatcccctccgaggaggggtattgtgacttcaattctcgacctaatgaaaactcttattgctatcagttgctgaggcagctgaatgagcagcgtaaaaagggcatcttgtgtgatgtcagcattgttgtgtcaggaaaaattttcaaagctcataagaacattctagtagcagggagcaggtttttcaagaccctctattgtttcagcaataaggaatccccaaatcaaaacaacacgacacacctcgacatcgccgctgtccagggcttttccgtgatactcgattttctgtatagcgggaatctagtgttgacctcccagaatgctatcgaggtaatgaccgtggcatcatatttacagatgagcgaagtcgtgcaaacgtgcaggaactttatcaaggacgctttaaacatcagtatcaagtcggaagctcctgaatctgtggttgtggattataacaaccgcaaacccgtgaatagagacggcctcagtagctccagagaccaaaaaattgccagcttttgggctacacgcaacctgaccaatctcgctagcaatgtaaagattgagaacgacggatgtaacgtggacgaagggcagattgaaaattatcagatgaatgactcaagctgggtgcaggatgggtcaccagaaatggctgagaatgagagtgaaggccagacaaaagtgttcatttggaataacatggggagccagggtatccaggaaaccgggaagaccagacgcaaaaaccagaccaccaaacggttcatttataacatccctcccaataacgaaactaatcttgaggattgttcagtgatgcagccgcccgtggcctaccccgaagagaatacactattgatcaaggaggagccagatctcgatggggctctgctctctggcccagatggagaccggaacgtgaacgctaatctactagctgaggctggaacgtctcaggacggaggggatgccggcaccagtcacgattttaagtacggcttgatgccaggaccatccaatgattttaagtacgggctcatccccggcacatcaaatgacttcaagtatgggctcatcccaggagcctccaatgacttcaagtatggcctgctgcccgaaagctggccaaagcaggagacatgggagaacggtgagagcagcctgatcatgaataagctgaagtgcccacattgcagctacgtggccaaataccgacggacgcttaagagacacctactgatccataccggtgtccgctcattctcttgtgatatatgtggcaagctgtttactcggagggaacacgtgaaaagacattcgttagtgcacaaaaaagacaaaaagtacaagtgcatggtatgcaaaaaaattttcatgcttgccgcgagtgtggggatcaggcatggctctagacgatacggcgtctgcgtagactgtgccgacaagtctcagcccggcggccaagaaggggtggatcagggccaggacaccgaatttccaagagatgaggaatatgaggagaacgaagtgggtgaggcagacgaagagttggtcgacgatggcgaagatcagaacgaccctagtaggtgggatgaatcaggggaggtgtgtatgagcctcgatgattag

SEQ ID NO: 13790 - DNA, 2616 bp, Artificial Sequence
  Description of Artificial Sequence: Synthetic coding sequence
atgagctttagtgagatgaaccgacggaccttggctttcagagggggtgggttagtgactgccagcggaggaggttccacgaacaacaatgccggcggcgaggcctcagcatggcctcctcagcctcaaccacgccagccccctccccccgcgcccccagcacttcagcctcccaacggccgcggggccgatgaagaggtcgagttggaaggactcgagccccaagatctggaggccagtgccggacccgccgctggggcagcagaggaggctaaggagcttttactgcctcaagatgcaggggggcccactagcttgggaggtggagctggcgggcctctgctggccgaaaggaatcgcagaactctagcttttcgcggaggaggtgggggtgggctgggtaacaatggatcgtcaagaggacggccagaaaccagcgtgtggccattaagacattttaatggaagagggccagccaccgttgaccttgagctcgatgcattggaaggtaaagagctgatgcaggatggtgcttcgttatctgactccacagaggatgaggaagaaggtgcttccctgggagatggttcaggggccgagggaggcagctgcagctcaagcagacggtccgggggcgacggaggcgacgaagttgagggctctggcgtaggagccggcgaaggagaaacagtccagcacttccctctcgcccgacctaagtctctcatgcagaagctgcagtgttctttccagaccagctggctgaaggactttccttggctaaggtactcaaaggacacgggactgatgagctgcggctggtgtcaaaaaacccctgctgatgggggctctgtggacctgcccccagtcgggcacgacgagctctcaaggggcacgagaaactataagaaaactcttttactgcgccaccatgtgagcactgaacacaagctccacgaggctaatgcccaggagagtgagattccaagcgaggaaggttattgtgatttcaactcgcgccccaatgaaaactcttactgctatcagcttctgaggcagctcaacgagcaaagaaaaaaggggatcctatgcgatgttagcattgtcgtctctgggaagatcttcaaagcacacaagaacatcctagtggccgggtccaggttttttaagaccctgtattgtttcagtaacaaggaatctccaaaccagaataacactacccatctagacatagccgcagtccaaggctttagcgtgatcctggactttttgtacagtggtaatctggttctaactagtcagaatgccatcgaagtgatgactgtcgccagctacctccaaatgtcagaggtcgttcagacatgtaggaattttatcaaagatgccctgaatatttccattaagtccgaggccccagaaagcgtggtagtggattataataaccgtaagccagtcaatagagatggactgtcctcttcacgcgaccagaagattgcttccttttgggccactcgcaatctcaccaacctggccagcaacgtgaagatcgaaaacgacggatgcaacgtggacgagggacagattgagaactatcagatgaacgattcaagctgggttcaggatggtagtcccgagatggccgaaaacgagtccgaggggcagaccaaggttttcatatggaacaacatgggatcccaggggattcaggaaaccggcaagacccgccgaaagaatcagacaactaagagatttatctacaatatcccccctaacaacgagactaaccttgaggattgttcggttatgcaacctcccgtggcctatcctgaggaaaatactcttcttataaaagaagagccggacttagatggcgccctgctttcggggccggacggagacaggaatgttaacgccaatttgttagccgaagctgggacgagtcaggatggaggagacgctggaacatctcacgattttaagtatggtttaatgccaggacccagcaatgactttaagtatgggctaatcccagggacaagcaatgattttaagtatgggttgatacccggagcctcaaatgacttcaagtatggccttctacctgagtcatggcccaagcaggagacctgggagaatggagaatcctccttaatcatgaataagctgaaatgcccccattgctcttatgtagctaagtataggaggacgcttaaacggcatctgttgatccacacgggcgtgcgctctttctcctgtgacatttgcggaaaacttttcacccgaagggaacacgtgaagcgccactccctggttcacaagaaagacaaaaagtataagtgtatggtctgtaagaaaatctttatgctggcagcatcagtgggtatccgacatggcagccggcgttatggggtgtgcgttgactgtgcagacaagagtcagcctggcgggcaagagggcgtagatcaggggcaggacaccgaatttcctcgagatgaggagtatgaggaaaacgaagtgggcgaggccgacgaggagctcgttgacgacggggaggaccagaatgatccgtcgcggtgggacgagagcggagaggtgtgcatgagcctcgatgactag

SEQ ID NO: 13791 - DNA, 2616 bp, Artificial Sequence
  Description of Artificial Sequence: Synthetic coding sequence
atgtctttctccgagatgaatcgccgtactctggcctttcgcggtgggggtctcgttactgctagcggcggcggatcgaccaataacaatgctggcggcgaagccagcgcctggccaccacagcctcagccccggcaacctccccccccagcccccccagcactgcagccgcctaacggccggggggccgacgaggaggtcgagttagagggattggaaccacaggacctcgaagcctcagccgggcccgccgctggggcagccgaggaggccaaggagctccttttaccacaagacgctggagggccaacctcgctaggtggcggggccggcgggcccctccttgccgagaggaacaggcgcaccctggcctttcggggagggggtgggggcgggctaggcaataacggctcctcgagagggagacccgaaacatctgtgtggccgctcagacacttcaatggtcgaggccccgccaccgtcgatctggagctggatgccttggagggcaaggaattgatgcaggacggcgcttcgttgagtgatagtaccgaagatgaggaagaaggtgccagcctcggggatggcagcggtgcagaaggcggttcctgctccagcagcagacgctccggaggggatggcggggatgaggtggaaggatccggggtgggagcaggagagggggagactgtacaacacttccctctggcccgccctaaatcgctaatgcagaaactgcagtgtagtttccagaccagttggctcaaggatttcccatggctgcgctactccaaagatacaggcctcatgtcatgtggctggtgccagaagacgcccgcagacgggggttctgtcgatctgcccccagttggacacgatgagctgtctcggggtacccggaattacaaaaagactctgctcctccggcatcatgtttcaactgaacataaactgcacgaggccaatgcccaggagagcgaaattccatccgaggaaggttactgtgatttcaacagccgccccaatgaaaacagctattgttatcagctgcttcgacaattgaacgagcagagaaaaaaaggcatcctgtgtgacgtgtcaattgtagtctcagggaagattttcaaagcccacaaaaatatactggtggctggttctcgtttttttaagactttatattgtttttcgaataaggaatctccaaatcagaacaatacaacacaccttgacattgctgccgtgcagggcttctctgtcattttagacttcctgtattccggaaacctcgtcttgacctcacagaacgccatcgaggttatgaccgtcgcaagctacctgcagatgagcgaagtggttcagacctgtaggaatttcatcaaagacgctctgaatatttctatcaaaagcgaagcccccgagagtgtggtggtggactacaacaatcggaagccggtaaatagggacggcctgagttcttcaagagatcagaaaattgctagcttttgggcaaccagaaacctgacgaacctcgcaagtaatgttaagattgaaaatgatgggtgcaacgtagacgaagggcaaattgagaactatcagatgaacgactcgagttgggtgcaagatggctctcccgaaatggctgaaaatgagtcggaaggccagactaaggtcttcatctggaataatatggggagtcaaggcattcaagaaaccggtaagactagacgaaaaaatcagactaccaagaggtttatctacaatatcccccccaataacgaaaccaacctagaggactgctcggtaatgcaaccacccgtcgcttacccagaggagaataccttactcataaaggaggagcctgatttggacggagccctgttgtccggacccgacggggatagaaacgtcaacgcgaacttgcttgccgaagctggcacgagtcaggatggcggcgacgcaggtacatctcatgatttcaaatacggactaatgccaggacccagcaacgacttcaaatacggactaatccccgggactagtaatgattttaagtatggactcatccccggtgcatccaatgatttcaaatacggcctgctgcccgaatcttggccaaagcaggaaacttgggagaacggtgaatcatcgcttatcatgaacaagctgaagtgcccccactgcagctatgtcgctaagtataggcggactctgaagaggcacctcttaatccacacaggtgtacgcagcttctcttgtgacatttgtggcaagctgtttacacggcgtgagcatgtgaagaggcattcactggtgcacaaaaaggataagaagtataagtgcatggtatgcaaaaagatctttatgttggctgcctctgtcgggatccggcacggttcacggcggtatggcgtgtgcgttgactgcgccgacaagagccagcccggcggccaggaaggagtcgatcagggtcaagataccgagtttccccgggatgaggagtatgaagaaaatgaggtaggagaggccgatgaggagctagtagatgacggggaggatcaaaacgacccatccaggtgggacgagtctggtgaggtatgtatgagtctggacgattag

SEQ ID NO: 13792 - DNA, 2544 bp, Artificial Sequence
  Description of Artificial Sequence: Synthetic coding sequence
atgagtttctccgagatgaatcgacgcaccttagctttcaggggcggcggcctggttaccgctagcggcggtggcagcactaataacaatgccggtggcgaggctagtgcctggccgccacagccccagccaagacagcccccgcctcccgcgccaccagcgcttcagcctcccaacggccgcggtgcagatgaggaggtcgagcttgagggcttggaacctcaggaccttgaagcatccgccggccctgccgccggtgcagcagaggaagccaaagagctgttattgccccaggacgccgggggacccactagtctcggggggggtgctggcgggcctctcctggcggaacggaatagaaggacactggcttttagaggtggaggcggcggggggttggggaacaacggctcaagccgcgggcggcctgagacaagtgtttggccactgcgccacttcaatggaaggggccccgctacagtagacctcgagttagacgctctggagggcaaagagctgatgcaagatggagcttctctgtctgacagcacagaagatgaggaagagggcgcctcactgggggacggatcaggggctgaaggaggatcatgttcatccagtaggcgaagcggaggtgatgggggcgatgaggtggagggctctggagtgggcgccggtgaaggtgaaacagtgcagcacttccctcttgcaaggccaaagtcgctcatgcagaaattgcagtgctccttccagacatcttggctgaaggacttcccttggctccgttacagcaaagacacaggcctcatgtcctgcggatggtgtcagaagactccagctgacggggggagtgtggacctcccgcctgtcggacatgatgagctcagtcgtggcacgcggaattacaagaagaccttgctgctcaggcatcatgtttccaccgagcataagctacatgaagcaaacgcccaagaatcagagattcctagcgaagagggctattgcgactttaattcacgtcctaacgagaattcatactgctaccaactcttgcggcagctgaacgagcaaagaaaaaaaggaatcctctgcgacgtgagcatcgtggtgtctggtaagatcttcaaggcacataagaatattcttgttgcaggctcgcgtttcttcaaaacactgtactgcttctctaataaggagtctcccaatcagaacaacacgacccatctggatatcgcagctgtccaaggatttagcgttattctggactttctttactcaggaaatttggtgttgactagccagaatgccattgaggtgatgactgtggcatcctacctgcagatgtcagaagtggtccagacctgccgcaattttattaaagacgcgctgaatattagcataaagtccgaggcccctgaatctgtggtggtggactataacaaccgcaagccagtcaacagagatggcctcagttccagtagagatcagaaaatcgcttcattctgggcaacccgtaatttgacaaatctcgcttcgaatgtgaaaattgagaacgatggatgtaatgtcgatgagggacagatcgagaactatcagatgaacgacagcagctgggtgcaggacggaagtcctgagatggctgagaacgagtccgagggacagactaaagtctttatttggaacaatatgggcagtcagggaattcaggaaaccggcaaaacccggcgaaagaaccagacgacaaaacgcttcatctataatatcccacccaataacgaaactaatctagaagactgctcagtcatgcagcctcccgtcgcctaccctgaggagaataccttgttaattaaagaggaaccagatctggacggcgcgctattgtctggccctgatggagataggaatgtgaatgcgaacctgctggccgaagccgggacatcacaggacggcggggatgctggcaccagccatgattttaaatacggtctcatgcccggggccagcaacgatttcaagtacggcttgcttccggaaagctggcccaaacaggaaacgtgggaaaacggggaatcctcactcataatgaacaagctcaagtgtccacattgctcttacgtcgctaagtatagaaggacccttaagcgccatctactcatccataccggcgtgcgctcgttctcatgcgacatttgtggcaaattgtttacacgccgcgagcatgtgaagcggcattctctggtgcataaaaaagataagaagtataaatgcatggtctgcaagaagatatttatgttggctgcttccgtcggcataagacatggttcccgacgatacggggtctgcgttgactgcgctgataagagtcagcctggcggtcaggaaggggtggatcagggccaggacaccgagtttccaagggatgaggagtatgaagaaaacgaagtgggcgaagcagatgaggagcttgtggacgacggtgaggaccaaaatgacccttcgcggtgggatgaatcaggcgaagtgtgcatgtctctcgacgattag

SEQ ID NO: 13793 - DNA, 3162 bp, Artificial Sequence
  Description of Artificial Sequence: Synthetic coding sequence
atgagttccgaagagtcttatagggccatcttacggtatttaactaacgaacgggagccatacgctcccggcaccgaaggcaatgtgaagaggaaaattcggaaagctgccgcctgttatgtggtgcgtggcggtaccttgtactatcagagacggcagcggcatcgtaagaccttcgcagaattagaggttgtgcttcagcctgagaggaggcgagacctgatcgaagctgcccatctggggcctggggggacccaccatactagacaccagacatggcactatctgtcaaagacatattggtggaggggaatccttaagcaggtaaaagactacatcaaacaatgttctaaatgtcaggagaagttagatagaagtagaccgatctcggatgtaagcgagatgctggaagagctgggactggacctcgaatctggggaggagtccaatgagagcgaagatgatctatctaattttacttctagtcccaccaccgcttctaagcctgccaaaaagaaacctgtatcaaaacacgagctggtatttgtcgatacgaagggcgtggtaaaacgctcaagcccaaagcattgccaggccgtgcttaagcagctcaatgagcagcggctgagcaaccagttctgtgacgtgacgctgcttattgagggtgaggaatacaaagcccacaagtcagtcttgagtgccaattccgagtacttcagggatctgtttattgagaaaggagcggtgtcaagccacgaggccgtcgtagacctgtcgggtttttgtaaggcttctttccttcctctcctggaatttgcgtacacgagcgtactttcatttgacttttgtagtatggctgatgtggcgattctggctcgacacctcttcatgagtgaggtgctcgagatatgtgaatccgtgcacaaattaatggaggagaagcagctcacagtatacaaaaaaggagaggtccagaccgtggcctcgactcaggacctgcgggtgcaaaatggcggcacagccccccccgttgcctcatctgagggaaccacaactagcctgcccacagagctgggggactgcgaaatcgtcctcctagtaaatggcgaattaccagaggcggagcagaacggggaggttgggcgtcagcccgagccccaggtgagtagtgaggccgaatctgcacttagctcagtggggtgcatcgcagactctcatccagaaatggaaagcgtcgatcttatcacaaaaaataaccagactgaacttgaaaccagtaataatagagaaaacaataccgtctctaacattcacccaaagctgtctaaggaaaatgttatttcatcgagtcccgaggattcaggaatggggaacgacatttctgcagaggatatctgcgccgaggacattcctaaacatagacagaaagtggaccagccactgaaggatcaagaaaatttagtcgcatccacggccaaaaccgatttcggacctgatgatgatacttatcggagccgattgcggcagagaagcgtcaacgagggtgcctatataaggctgcataaaggaatggaaaagaagcttcagaagcgcaaagcagtcccaaagagcgccgtacagcaggttgctcagaaactggtccaaaggggaaaaaagatgaagcagccgaagcgcgatgcgaaggagaacaccgaggaagcctcccacaagtgtggagagtgcggcatggtatttcagcggaggtacgcccttattatgcataagctgaagcacgagagagctagggactacaagtgtccactgtgcaaaaagcagtttcaatactcagccagcctccgtgctcacctcatcagacatactcgtaaagatgccccctcatcgtcaagtagcaattccacaagtaatgaagcaagcggcacaagcagtgagaaggggcggactaagcgcgagttcatttgcagcatttgtggacggactttgcccaaattatacagtcttcggatccacatgctaaagcacacaggcgtgaaacctcatgcttgtcaggtatgcggcaagacattcatctacaaacatggacttaagctgcaccagtccctccatcaaagtcagaagcagtttcagtgcgagctgtgcgtcaagtctttcgtaacaaaacgctcgctgcaagaacatatgtctatccacacgggggagtccaagtacctgtgctccgtctgcggaaaaagcttccacaggggcagcggcttgtcgaaacattttaaaaagcaccaacctaagccagaggtacgaggttatcattgtactcaatgcgagaaatctttctttgaggctcgggacctcagacaacatatgaataagcacctgggcgtgaagcccttccagtgccagttttgcgacaaatgctacagctggaaaaaagactggtattctcatgtaaagtcccacagtgtgactgagccataccggtgtaatatttgcgggaaagaattctatgagaaggcactgttcaggcgtcacgtaaagaaagccacgcatggaaagaagggaagagccaagcaaaacctggagagggtgtgtgagaaatgtggtagaaagtttacccaactgagggagtacagaagacatatgaataaccacgagggagtgaaaccctttgagtgcttgacctgcggggtagcctgggcggatgcgcggagtcttaaacggcatgtgcggactcatactggcgagcgcccatatgtgtgtcccgtctgttcagaggcttatattgacgctaggaccctgcggaaacatatgacaaagttccatcgggactatgtcccatgtaaaattatgctcgagaaggataccctccagttccacaatcaaggtacacaggtcgcccacgctgtgagtattctgaccgccggcatgcaggagcaggagtcatccggcccacaggaactggaaaccgtcgtagttaccggtgagactatggaggcgctggaggcagttgccgccaccgaggagtacccaagcgtttctaccctcagcgatcagtcaatcatgcaagttgttaattacgtgttggctcaacaacaaggacaaaagttatctgaggtcgccgaggccatacagactgtgaaagtggaagtggcacacatcagtggtggcgaatag

SEQ ID NO: 13794 - DNA, 1380 bp, Artificial Sequence
  Description of Artificial Sequence: Synthetic coding sequence
atggcgagtggggtcgaagtgctccggttccagctgccaggccacgaggcagcgactttacgtaacatgaaccagttgagggccgaagagcggttttgcgatgttacaatagtagcggattctctaaaatttagaggccacaaggttatcctagctgcctgctccccattcctgagggaccagtttctcctgaatccatcctcagagctgcaggtctccctgatgcacagcgcccgcattgtcgccgacctcctcctcagttgttacacgggcgccttggaattcgctgttagagacattgtgaactaccttactgcagcctcctaccttcagatggagcacgtagtcgagaaatgcagaaatgcgttgagccaattcatcgagccaaagattgggctgaaagaggacggtgttagtgaggcttctttggtgtcatccatatcggccacgaagagtttgctgcctcctgctcgaacacctaaacccgctccaaaaccaccgccaccaccacccttaccccccccactccttcggccagtgaaactggaattccccctcgacgaggacctggagctgaaagctgaggaggaggacgaagacgaggacgaagatgtttctgacatctgcattgttaaagtggagtctgctttggaggtcgctcatcgccttaaacctccaggtgggttgggtggcggcctggggattggggggtccgttggcggacatctgggcgaattggcacagagtagcgtgcctcccagcaccgtggcccccccccaaggggtggtgaaggcttgctattctttgtcggaggatgcagagggtgagggcctgctgcttatccccggcggacgggcatcagtgggcgccacaagtggacttgtggaggccgccgcagtagcaatggccgcaagaggcgccggcggcagcctgggcgccggaggctcgagaggacctctcccaggtggtttttctggtggtaaccccctgaagaatatcaaatgcacaaagtgccccgaagtgtttcagggcgtcgagaaattagtgttccatatgcgtgcacaacattttatctttatgtgcccccgatgtgggaaacagtttaatcacagctcaaaccttaatagacacatgaacgtccatagaggcgtgaagagccacagttgcggtatttgtggcaagtgttttacccagaagtccactctgcacgaccaccttaaccttcactctggagcccgcccatataggtgctcctactgcgatgttcgttttgcccataagcccgctatacgaagacacctgaaggaacagcatggaaaaactacagcagagaacgtcctggaagcctcagtggcagagattaatgttctgattcgctag

SEQ ID NO: 13795 - DNA, 1380 bp, Artificial Sequence
  Description of Artificial Sequence: Synthetic coding sequence
atggccagcggcgtcgaagtactgagatttcagttacctggccacgaggctgcaactctacgaaatatgaaccagctgcgcgctgaagagaggttttgtgacgtgacaatcgtggcggactcccttaaattcagaggccataaggttatcttggcagcctgcagcccctttctgcgggatcaatttctcttgaatccatcaagtgagttacaggtaagtttgatgcactcagctagaattgtagctgacctcctcctcagctgctacacaggcgccctggaatttgccgtcagagatatcgtgaattatctcactgccgctagttatctgcagatggagcatgtagtagaaaagtgcagaaatgccttgtcccaattcatcgaacccaaaatcgggctgaaggaagacggcgtaagcgaggctagcctcgttagtagtattagcgccacgaagagcctgcttcctcctgctcgcaccccaaagcctgcaccaaaaccccccccaccccctcccttgcccccgccattgcttagaccagtgaaactggaatttcctcttgatgaagacctcgaattaaaggccgaggaggaagatgaagatgaagacgaggatgtgtcagacatttgtatagtaaaggtggaatccgctctcgaggtagctcataggctaaagccaccaggcggtcttggaggaggcttggggattggaggttcggttggtggccatcttggcgagctcgctcagagttctgttcccccctctactgtcgccccacctcagggggtggtaaaagcttgctactcactgtccgaagatgcggagggagaggggctgctcctaatccccggaggacgtgcctcagttggggcaacttccggattggtcgaagccgctgccgtcgcaatggccgcacgcggcgcagggggctctcttggggccgggggaagtaggggccctctcccgggagggtttagtggagggaatcctctcaaaaatataaagtgtaccaaatgtcccgaggtgttccaaggagttgaaaagctggtcttccacatgcgtgcacagcacttcatcttcatgtgccccagatgtggaaagcagtttaaccatagtagcaacctaaaccgtcatatgaacgtacatcgaggcgtgaagtcccactcatgcggaatttgtggcaagtgtttcacccagaagtctacccttcacgaccacctcaacctccacagtggtgcacgcccctaccggtgcagctattgcgacgttaggttcgcacataagcccgccatacgcagacacctcaaagaacagcatgggaagaccacagctgagaatgttttagaggcttcggtggcggaaatcaacgtccttatacgttag

SEQ ID NO: 13796 - DNA, 1380 bp, Artificial Sequence
  Description of Artificial Sequence: Synthetic coding sequence
atggcgtcgggtgttgaggtactccgctttcagcttcccggccacgaagcagccacactccgaaacatgaatcagctcagagccgaagagaggttttgtgacgttactatcgtagcagatagcctgaaatttagaggtcacaaggtcattctcgccgcctgttcccccttcctgagggaccaattcctgctgaatccctccagtgaactacaggtgtcgctcatgcacagcgccaggatcgtagccgacttgctgttgtcatgctatacaggcgcattagagttcgctgttcgtgacattgtgaactacctgactgccgctagttatctccagatggagcacgtcgttgaaaagtgcaggaacgccttgagtcagtttatcgagcccaaaataggccttaaggaagatggcgtttctgaggccagtctggtgtcatctatatcggccaccaagtccctcctgcctcctgcccgcacacccaagcccgctcctaagccccccccccccccaccactcccaccccctttgctccggccggtgaagctggagttcccccttgacgaggatctggagctgaaagccgaggaagaggacgaagatgaagatgaagatgtctctgatatttgcatcgtgaaagtggagagcgctttagaggtcgcacaccgcctgaagcctcctggagggctggggggtggcctaggcattggtgggtcagtcggtggccacctgggggaactcgctcaatcctctgtccccccgagtactgtggcaccccctcaaggtgtcgtcaaagcctgttatagtctgtctgaagacgctgagggagaggggcttctgttgatcccgggtggtcgtgcttccgttggagcgacgagtggacttgtcgaggcagctgcagttgcgatggccgcgcgcggagcaggcgggtctctgggtgcaggtggtagtcgtgggccactcccgggaggcttttccggcgggaatcccttaaaaaacataaagtgtaccaagtgccctgaggtctttcaaggcgttgaaaaactcgtctttcatatgcgtgcacagcacttcatctttatgtgccccagatgtgggaagcagttcaatcactcatctaatctaaatagacacatgaacgtccatcgaggcgtaaaatcgcattcatgcggcatctgtggaaaatgcttcacccagaagagcactctgcatgaccatctgaaccttcacagtggagcgaggccttaccgttgttcctattgcgacgttagatttgcccataaaccggcaatcagacggcatctcaaagaacagcacgggaagaccaccgccgaaaacgtgctggaggcaagtgtggccgagattaacgtcttgatacgatag

SEQ ID NO: 13797 - DNA, 1380 bp, Artificial Sequence
  Description of Artificial Sequence: Synthetic coding sequence
atggccagcggcgtggaggtactcaggtttcagttaccaggacacgaggcggcaactctgaggaacatgaaccagctccgtgctgaagagcggttttgcgatgtcactatcgttgcagacagcttgaagttccgagggcataaagtgattttggccgcgtgctccccttttctccgtgaccagttcctgctgaatccaagtagtgagctgcaggtgtctctcatgcattcggcccggatcgttgctgatctgttgttgagttgctacacgggcgccttggaatttgcagtgagagacatcgtcaattacttgaccgctgcttcatatctccagatggaacacgtcgtggaaaagtgccgtaacgccctttcacagttcattgagcctaaaatcgggttaaaagaggacggggtgtctgaggcgtctctcgtatcatccatttccgcaacaaagtctctgctgcctccggcacgtacgccaaaacctgccccaaaacctccaccccccccaccccttcccccgccactgctgcgtccagtgaagctggagttccctcttgacgaggatctcgaattgaaggctgaggaggaggacgaggacgaagatgaagacgtgagcgatatctgtatagtcaaagtggaatcagccctcgaggttgcccaccggctgaaaccacctggaggcctgggtgggggattaggtattggcggcagcgtgggtggccatctgggggagctcgcacagtcctctgtccccccgagcacagtggcacctccacagggggtggtgaaagcgtgttattcgctttccgaagacgctgaaggggagggcctcttattaattcctggtggcagggcaagcgttggcgccacctctggtctcgtggaggccgccgccgtggctatggctgctcgcggcgccggtggttctctgggtgccgggggctcccgaggtcctctgccggggggattttccgggggaaatcctttgaagaacattaaatgcacgaagtgtcctgaagtttttcaaggagtggaaaaactggtttttcacatgagagcacagcattttattttcatgtgtccgcgctgtgggaagcagtttaaccattccagcaacctgaatcgccacatgaacgtgcaccggggcgtgaagtcccatagctgcgggatttgtgggaagtgcttcactcagaaatccaccctgcacgatcatcttaacttgcactctggcgccaggccgtatcggtgctcttactgtgacgttcggtttgcccataaaccggccatacgccggcacctgaaggaacaacatgggaagaccacagctgaaaatgtgctcgaggcatcagtggctgaaatcaacgtactgattcgttag

SEQ ID NO: 13798 - DNA, 1380 bp, Artificial Sequence
  Description of Artificial Sequence: Synthetic coding sequence
atggcctccggagtcgaagttttaagatttcagcttccaggacacgaagccgctaccctccgtaacatgaatcagctacgcgccgaagagagattttgcgacgtcacaatcgtagccgattctttgaaattcagggggcataaggtaatcctcgccgcctgttcaccattcctgcgggaccagtttctccttaacccatcaagcgagctgcaggtgtcccttatgcattctgcacgtatcgtagctgacctcttgctgtcctgctacacaggggctctggaattcgcagttcgggatattgtgaactatctgacagccgcgagctatctgcagatggaacacgtggttgagaaatgccgaaacgccctatctcaattcatcgagcccaaaatcgggctgaaagaagatggtgtaagcgaggcgtcattggtgagttccatctcagctaccaaaagcctcctgcctccagcacgcacccctaaaccggcaccaaaaccgccaccacccccccccctcccacccccattactgcgacccgtaaagctggaatttccattggacgaggacctggagcttaaggccgaggaggaggatgaggacgaagacgaggatgtcagtgacatttgtatagttaaagtagaaagcgccctcgaggtggctcaccgcctcaagccccccgggggtttaggcggtggtctgggaatcgggggatcggtagggggtcacctgggtgagctcgctcagagctctgtgccccctagcaccgtcgcacctccccaaggagttgttaaggcttgctacagcctgtcggaggacgcagaaggggagggattgctattgatcccaggtggacgggccagcgtgggggctaccagtggcttggtagaggcagctgctgtcgccatggcagctcggggagcaggtggctctctgggagcaggtggctcgcgcggaccactcccaggcggtttttcgggaggcaaccccttgaagaacattaagtgcacaaaatgccccgaggtgttccaaggtgttgagaaactggtgttccatatgagagcccaacatttcatatttatgtgcccccgttgtggaaagcaattcaaccactcttcaaacttgaaccggcatatgaacgttcatcggggcgtgaaaagccatagctgtggaatctgtggtaagtgttttactcagaaaagtaccttgcacgatcatctaaacttgcacagcggggcccggccctacaggtgttcctactgcgatgtccgatttgcacacaagcccgccatcaggcgccacctcaaggagcagcacggcaagaccacagctgagaatgtactggaggctagcgttgctgagatcaatgttctgatcagatag

SEQ ID NO: 13799 - DNA, 1545 bp, Artificial Sequence
  Description of Artificial Sequence: Synthetic coding sequence
atggatctggcgaatcatggccttatcctgctgcaacagctgaatgcacagcgcgaatttggctttctctgcgactgtaccgtggccatcggagatgtttacttcaaagctcacaaatcagtactagcctctttttcgaattactttaaaatgctcttcgtgcaccagacgtccgagtgtgtgaggctgaaaccaactgatatccaaccggatatcttctcctacttgcttcatctgatgtatactggcaaaatggcaccccagttgatcgacccagtgcgtctggagcagggaatcaagttcctgcacgcctaccctctgatccaggaagcttcactagcaagccagggagcattttcgcatcccgaccaagtgtttcctcttgccagcagtctgtatggaatccagattgccgatcaccagctccggcaggccacaaaaatcgctagtgctccagagaaactgggtcgggaccctcgccctcagacgagtcgtatctcccaggagcaggttcccgaggcatcacagcttagtcagttgacttccaatttggcccaggttaacagaaccaatatgaccccaagtgacccactccaaactagcctgtccccggaattggtgagcacacccgtgcctccacccccccctggggaagaaacaaatttggaggcatcaagtagcgatgagcagccagccagccttaccatcgctcacgtcaagccaagcattatgaaacgcaatgggtctttccccaagtactatgcctgtcacctgtgtggacggaggttcacacttaggagtagtcttagagaacatttacagatacatacaggcgttccctttacctcttcacagcagggtgagtcacgcgtgccactgaccctatgttctaatgctgcggatctgggaaaagacgcaatggaagtacctgaagccgggatgatctctgactctgagctgcagcacatctcagatagtcccattatagacggccagcaacagagtgagaccccgccgccatctgatatcgcagacattgataatctggagcaagcagaccaggaacgggaagtgaagcggcgcaagtatgaatgtactatttgtggacggaagttcattcaaaagtcacactggcgcgagcacatgtacatacataccggcaaaccatttaaatgctcgacatgcgataagtcattttgtcgggcaaatcaagcagcccggcacgtgtgcctaaatcaatccattgacacatatactatggtggataaacagacgctcgagctctgcactttcgaggaaggctctcaaatggataatatgttggtccagaccaacaagccgtataagtgcaacctgtgcgacaaaactttctccacccctaatgaagtggtgaaacacagctgccaaaatcagaactctgacgtgttcgctctcgatgagggacgaagcatcctcctgggaagtggagactccgaggtgaccgagccagatcatcccgtactcgccagcattaagaaagaacaggaaaccgtgctgctggattag

SEQ ID NO: 13800 - DNA, 1905 bp, Artificial Sequence
  Description of Artificial Sequence: Synthetic coding sequence
atggagccctcccccctgagccccagcggagcggctttgcctctgccattgtcactggcaccgcctcccctgcccctgccggctgccgccgtggtgcacgtgtcctttccagaggttacatctgccctgcttgaatctctcaaccagcagagacttcaggggcagttgtgcgatgtgagcataagggtacagggccgtgaatttagggcacaccgcgctgtgttagcagcctcctcgccatactttcatgatcaggttctgctgaaggggatgacctctatcagcctgccttcagtgatggatccgggtgctttcgagactgtcctagcgtccgcttatactggccgactcagcatggcagcagcggatatcgttaacttcctgactgttggatctgtgctgcagatgtggcacatcgtcgacaagtgtacagagctcctgagggagggccgtgcaagcgctaccaccactattaccactgctgccgctacctccgtcactgtcccaggagcaggcgtaccatccggctccggcggaaccgtagcacccgcaactatgggaagcgcccgctctcacgctagctcaagagcatcagaaaatcagtccccatcttccagcaactatttttcccccagagaatcgactgactttagtagcagcagtcaggaggcattcgcagcgagtgccgtcggatcgggcgagcgaagggggggaggtccggtgttcccggcaccagtggtgggaagcggtggagccacatcaggcaagttactcttagaagcagacgagctttgtgacgacggaggggacggccgaggcgcggtagttccgggtgctgggctacgacgtcctacatacacccccccaagcatcatgccacaaaagcactgggtatatgtgaagcgaggcggtaattgcccggctcctacacccctagttccacaggaccctgatctggaagaagaggaggaagaagaggatctggtcctgacttgtgaggacgacgaggatgaggagctggggggttccagccgggtacctgtcgggggaggccctgaggcaactctctctatctctgacgtgagaaccctgtctgaacctcctgataaaggcgaggaacaagtgaatttttgtgaatctagcaatgatttcggcccttacgagggcggaggccctgtggctggactcgatgatagtgggggccctacaccctcaagctacgcccctagtcatccccctcggcccttgctgcccctggacatgcagggcaaccagatcctggtctttccgtcctccagttcttcctcttcctctcaagcccccggtcagccaccaggaaaccaagcagaacacggagccgtcaccgtgggaggaacatcagtgggctcactcggtgtgccagggtctgtaggtggagtgcccggaggtacggggtcgggagacgggaacaaaatcttcctttgtcattgtggaaaggccttcagccacaaaagcatgagggatcgacacgtgaacatgcaccttaacttgaggcctttcgactgtccagtctgtaataagaagtttaagatgaaacatcatctgaccgagcatatgaagactcacacaggcttgaagccatacgaatgcggggtctgcgccaaaaagttcatgtggcgcgatagctttatgaggcaccggggacattgcgagcggcgccatcgcttgggaggggttggcgccgtgcctggacctggaactcccactggaccatctctgccatcgaagcgcgagagtccaggggtcggcggcggatccggcgacgaagctagcgctgctaccccaccgagtagccgtagggtgtggtcaccccccagggtgcataaagtggagatgggttttggaggagggggaggggcaaactag

SEQ ID NO: 13801 - DNA, 1905 bp, Artificial Sequence
  Description of Artificial Sequence: Synthetic coding sequence
atggaaccctctccccttagtccctcaggggcagctctacccctcccgctgagccttgcgcctcctcctctgcccctccccgctgcagcagtagtgcatgtctcctttcctgaggtgacctctgcactactggagtcgctcaatcagcagcggttgcaaggccaattgtgcgacgtctccattagagtgcagggacgggaattcagagcgcacagagcggtattggctgcatcctctccatacttccacgaccaagttctgctcaagggtatgacaagcatttccctgccatccgtgatggaccccggtgccttcgagaccgtacttgctagcgcctacacaggccgactttcgatggccgcggcagacatcgtcaacttcctcacagttgggagcgtcctgcagatgtggcacatcgtggataaatgcaccgaactgctaagagagggcagggcatctgcaactactactatcacaaccgccgccgctaccagcgttactgtcccaggcgcgggcgttccttctgggagcggtggaaccgtggcaccagcgacaatggggtcagctaggagccacgcctcctcacgggccagcgagaaccagtccccaagctcgtcaaattatttctctcctcgtgaatccacagactttagttctagcagccaggaagcttttgcagcttccgccgtagggagcggagagcgcagggggggtgggccagtatttcccgcacccgtcgttggatccggcggggctacaagtggcaagcttcttctggaagccgacgagctttgcgatgacggtggagacgggaggggtgctgtggttccaggcgcaggcctcagaagacccacatacacacccccctctattatgcctcaaaagcactgggtgtatgttaagcgcggagggaactgtcccgcgcccactccattggtccctcaggacccggacttggaagaggaggaggaggaggaggatctggtgctaacatgcgaagatgacgaggacgaggagctagggggctcgtcccgagtccctgtcgggggcggcccagaagcaacgttatctatttcagatgttcggaccctgagcgagcccccagacaagggcgaagagcaggtgaacttttgcgagtcatcgaacgacttcggaccttatgaaggcggcgggcccgttgcaggcctggacgactctggcgggcccactccgtccagctatgccccatcgcacccacctagaccgctgttgccccttgacatgcagggtaatcagatcctggtttttccctcctctagcagttctagctccagccaagccccagggcagccgcccggcaatcaggcggaacatggcgccgtgactgtgggagggaccagtgtagggagcctcggcgtccccgggagtgtcgggggggtgcccggggggactggtagtggcgatggaaataaaatcttcctatgccactgtggtaaggccttttctcacaaatctatgcgagatcggcatgtcaatatgcacttgaatcttcgcccgttcgattgccccgtatgcaacaagaagtttaagatgaagcaccacctcaccgaacacatgaagacgcatacagggttaaaaccgtatgaatgtggcgtttgcgccaagaagttcatgtggagggactcttttatgagacatcgaggccactgtgaacgcaggcacaggcttggcggggttggagccgtacccggcccaggtacgcccaccggcccatcacttcccagtaaaagggagtcccccggcgtgggtggaggctccggggatgaggctagcgccgccacacctccaagttctagacgtgtttggagcccgcccagggttcataaagtggagatgggattcggaggtggtggaggcgcaaactag

SEQ ID NO: 13802 - DNA, 450 bp, Artificial Sequence
  Description of Artificial Sequence: Synthetic coding sequence
atggagccttccccgctttcaccctctggcgccgcattgcccttgccattgagcttggcaccgccgccccttcctctccctgcagctgccgtggtccacgtgtcatttcctgaggtgaccagtgctctcctggagagtttaaaccagcagcggcttcaggggcagctgtgtgatgtgtccatcagagtgcagggccgcgagttcagggctcatagagccgtgcttgccgccagctcaccatattttcacgatcaggtgctgctgaaagggatgacgtcgatatctttgccttcagtgatggatcctggcgccttcgaaaccgtcctggccagcgcttatacaggtaggttgagtatggccgcagccgacatcgtgaattttttgacggtaggatccgtgttgcagatgtggcacatcgtggataagtgtacagagttgcttcgggagtag

SEQ ID NO: 13803 - DNA, 450 bp, Artificial Sequence
  Description of Artificial Sequence: Synthetic coding sequence
atggagcctagccctctttctcccagtggtgctgccttgcctctgcccctctccttggctcctcccccattaccgctccccgcagcggctgtggtacatgtttcatttccagaggtcacatccgcactactcgaaagcttaaatcaacaacgactgcaaggacaactctgtgacgtttctatccgcgtgcagggacgcgaattccgagcacaccgggcagtcttggctgctagctctccctattttcatgaccaggttctgttgaaggggatgacttccattagcctgccttcagtcatggatccgggcgctttcgagaccgtcctcgcctccgcctatactggcagactgtcaatggctgccgccgacatagtgaatttcctcaccgtcggaagcgtcttacaaatgtggcacatagtggacaaatgcaccgagctgcttcgcgagtag

SEQ ID NO: 13804 - DNA, 1905 bp, Artificial Sequence
  Description of Artificial Sequence: Synthetic coding sequence
atggagccttctcctctgagtccatctggtgcagccctgcctctcccccttagtctggcccccccacccctcccactgcccgctgccgcagtcgttcatgtgtccttccctgaggttacctcagccttgctcgagtctttaaatcagcagagactccagggccagttatgcgacgtttccattcgcgtccagggacgtgagttcagagcacaccgggctgtcttggccgctagttcgccgtactttcatgaccaagtcctgctgaagggcatgacatcaattagcctgccatccgtgatggaccctggcgccttcgaaacagtactggccagcgcctataccgggaggttaagtatggcagcagcagatatcgtaaactttttaactgtcggttctgttctacagatgtggcacatcgtagataaatgcaccgagctgctgcgcgaaggaagggcctccgctaccacaaccatcacgaccgccgctgccacgtccgtgactgtgccaggcgccggtgtgcccagcggttcaggcggcaccgttgctccggcgacaatgggttccgcccgcagtcacgcctcatcgagagccagtgagaaccaaagcccctcatcctcgaattactttagtcctcgggagtccacagatttttcatccagctcccaggaggcttttgccgcctccgcagtgggatctggcgaaagaaggggtggcggtcctgtattccccgcaccagtggtgggaagcgggggagccacatctggtaagcttttgctggaggctgacgagctctgtgatgatggcggggatggccggggcgcagtggtacctggcgccggtctccgccgcccgacttacacaccaccgagcattatgcctcagaagcactgggtgtatgtgaagaggggggggaattgtccagccccaacacccctcgtgccccaggaccctgacctcgaggaagaagaagaggaggaggatttggtgctgacatgcgaggatgacgaagatgaggaactaggaggaagctcccgggtgccagtgggcggaggacccgaggccactttgagtatatcggacgtccggacgttgtctgagccacctgataagggggaggaacaggtcaacttttgtgaaagcagcaacgattttggtccatacgaaggcggtggccccgttgcgggactggatgattcagggggacctacacccagctcctacgcaccttcacacccccctaggccactgctgcctctggatatgcaagggaaccaaatactcgtgttcccctcctctagttcttcctctagcagccaggcaccaggacagcctcccggaaatcaggccgaacatggcgcagtcaccgtcggggggacaagtgtgggcagcttgggtgtgcctggatcagtgggtggcgttccaggaggcactgggagcggggatggcaacaagatttttctgtgccattgcggcaaggcctttagccacaaaagcatgagggatcggcacgtcaatatgcatctgaatctgcgtccatttgattgtccggtatgtaataaaaagttcaaaatgaagcatcacctaacagagcacatgaagacacataccgggctcaaaccctacgagtgtggtgtttgcgctaagaaattcatgtggagagacagcttcatgaggcacagagggcactgcgaacggcggcacagactgggtggagtcggtgccgtgcccgggccggggacccccactgggccctctctccctagtaagagagaaagccccggagtcggcgggggctctggggacgaagcgtctgcagcgacaccaccctcatctcgaagagtttggagtccccctagggtgcacaaagtggagatgggatttggtggtggcgggggagccaactag

SEQ ID NO: 13805 - DNA, 1905 bp, Artificial Sequence
  Description of Artificial Sequence: Synthetic coding sequence
atggagccttcccctctaagtccctcaggggccgccctgcccctacctctgagtttggccccacctccgcttcctctgcctgccgctgccgtggtgcacgtttcttttcccgaggtcacaagcgccctgttggagagcctgaaccagcagcggctccaggggcagttgtgcgacgtaagtattcgtgttcaggggagggagtttcgagcacacagagctgtgttggctgctagttctccttatttccacgaccaggtgctgctgaagggcatgacgtccatcagtctcccctctgttatggatccaggggccttcgagacggtgctggcttctgcttatacaggtaggttgagcatggccgccgccgacatagtgaatttcctgacagttggctccgttctacagatgtggcacatagtggacaaatgcacagaactgttgagagaaggacgtgcgtccgcaacgacaactatcacgaccgctgctgcaacgagtgttacagtacccggtgccggagtgcccagcggctctggcgggactgtggcccctgccacaatgggctcagcgcgcagccatgcctcaagtagagcctcagagaaccagtcaccatcctcctccaactacttctctcctcgcgaatccacggacttttcttcctcttctcaagaagccttcgctgccagtgcagtggggagcggcgagcgcagggggggcggacctgtgttcccagctcccgtggtcggatccggaggggcaaccagcggtaaactgctgctggaagccgatgagctctgcgacgacggaggcgacggcaggggggccgtcgtaccaggagcaggcctcaggcggcccacatacactcctcccagcattatgccacagaaacattgggtgtatgttaagcggggtggaaattgtccagcaccaacacccctggtgcctcaggatcctgacctggaggaagaggaggaggaggaggacctggtgctgacctgcgaggacgacgaagacgaggaactcggaggctcatcccgcgtacccgtaggggggggtccagaggcgaccttaagcattagtgatgtcagaaccctgtccgaaccccctgataagggggaagaacaggtgaacttctgcgagtcaagtaacgattttggcccctatgagggaggaggccctgtcgctggattagacgactcagggggcccaacaccctcctcttacgcaccttctcaccccccccgaccacttctgccactcgatatgcagggaaatcagatattggtcttcccctcttcgtcttcttctagcagttcgcaggcaccaggccagccccctggaaatcaagccgagcatggggccgttaccgtcgggggtacgtctgtcggttctctgggggtaccaggtagcgtcggaggcgttcctggggggactggatcgggtgacggcaataaaatcttcctttgccattgcggtaaggcatttagccacaaatcaatgagggatcggcacgtgaatatgcacctgaaccttcggccgttcgattgtcccgtctgcaacaagaaatttaagatgaagcaccaccttaccgaacatatgaagacccacacaggactgaagccttatgagtgcggtgtctgcgccaagaagtttatgtggcgggattcctttatgcgccacagaggccattgcgaaaggcggcaccggctcggcggcgtgggggcggtccctggaccagggacccccacagggccatcactgccttccaagcgtgaatcacctggagttggtggaggttcaggcgatgaggcttcggccgccacccctccaagctccagacgggtgtggagtcctccgagggtgcacaaagtagagatgggctttggaggaggcgggggagcaaattag

SEQ ID NO: 13806 - DNA, 1326 bp, Artificial Sequence
  Description of Artificial Sequence: Synthetic coding sequence
atgtccgagcggtcggacctgctgcacttcaagttcgaaaactacggtgactccatgttgcaaaagatgaacaaactgagagaagaaaacaagttttgtgatgtcaccgtgctcatcgatgacatcgaggtgcaggggcataaaattgtgtttgcagcgggtagtccatttctaagagaccagtttctgctgaatgactcacgggaggtgaagattagtatcctgcagagctcagaggtgggtcgacagctcctgttgtcttgctactcaggcgttcttgaattccctgagatggaactggtaaattatttgaccgcagcttcttttctacagatgtcacacattgttgaacgctgcacacaggccctttggaaattcatcaagcctaagcagcctatggattcaaaagagggctgtgagccccaatcagcgtccccacagtctaaagagcagcagggcgacgcacgggggagtcctaaacaggactctccgtgtatccaccctagtgaagattccatggatatggaggactcagacatccagattgtgaaggtagaaagtatcggcgatgtgtctgaggtacggagtaagaaggatcaaaaccaattcatctcaagcgaaccaactgcactgcacagtagtgagcctcagcactcactcataaactctactgtggaaaaccgggtgtcggagatcgagcagaatcatttacacaattatgccttgagctacaccggttccgacaacattatcatggcttccaaagacgttttcgggccaaatatccgtggcgtagacaagggcctgcagtggcatcaccagtgtccaaaatgcactcgcgtgtttcggcatctggaaaactacgcaaaccatctcaagatgcataagttatttatgtgcctgctgtgcggtaaaacattcactcagaaagggaatctgcatcgccacatgagagtgcatgctggaatcaagcccttccaatgcaagatttgtggaaaaacattttctcagaagtgttccttgcaggaccaccttaaccttcattcgggggacaagccacacaagtgtaactattgcgatatggtcttcgctcacaagccagtgctgagaaagcatcttaaacagctgcatggaaagaactcttttgacaatgcgaatgaacggaatgtgcaggacctcacagtcgatttcgatagtttcgcctgtactacagtgaccgactctaaaggatgccaaccacagcccgacgccacgcaagtgcttgacgccggaaagctggctcaggccgtgctgaatctgaggaacgattctacctgtgtaaactag

SEQ ID NO: 13807 - DNA, 1326 bp, Artificial Sequence
  Description of Artificial Sequence: Synthetic coding sequence
atgtctgagcggtctgatctcctgcacttcaagtttgagaattatggggactcaatgctgcaaaagatgaacaagttaagagaggaaaacaaattttgcgatgtcaccgtgctgattgacgacatagaggttcagggccataagattgtgttcgccgccggctcccccttcctcagagaccagttcctgttgaatgatagccgagaggtgaaaatctctattctccagtccagcgaagttggaaggcagctcttactgtcctgttattcgggcgtgctcgagttcccagaaatggagctggtgaattatcttaccgcagcctcattcttgcagatgtcccatatcgttgagagatgcactcaggctttatggaagttcattaaaccaaagcagccaatggactccaaggagggctgtgagccacagtcggcttctccacagtccaaggaacagcaaggggatgcgcgaggaagtcccaagcaggactccccctgcatacacccgtctgaagactcaatggacatggaagactcagatattcagattgtgaaagtggagagtatcggcgacgtgagtgaggtgaggagtaaaaaagaccagaaccagtttattagcagtgagcccacggctcttcatagctcagagcctcagcattcgttaattaattccaccgtcgaaaaccgtgtgagtgagatcgaacagaaccatttgcacaattatgccctctcttacaccggctctgacaacatcataatggcatccaaagacgtgttcggcccaaatataagaggggtcgacaaaggattgcagtggcatcaccaatgtcccaagtgtacacgggtgtttcgccacttagagaactacgcaaaccacctgaaaatgcataagttatttatgtgcctgctgtgcggaaagacttttactcagaaaggcaatttacacaggcatatgcgcgtccacgcaggtatcaagccattccaatgcaaaatatgtgggaagacgttttcacagaagtgttcgctgcaggatcatctgaaccttcacagcggcgacaaacctcacaagtgtaattattgtgatatggttttcgcgcacaagcctgtattgaggaagcacttgaaacagttgcacggtaaaaattcatttgacaatgccaatgagagaaacgtgcaggacctcaccgttgattttgattccttcgcttgtaccacagtcaccgatagcaaaggttgccagcctcagcctgatgctacacaggtcctagacgctgggaaattagcccaggccgtcctgaacctcaggaatgattcaacctgcgtcaattag

SEQ ID NO: 13808 - DNA, 1725 bp, Artificial Sequence
  Description of Artificial Sequence: Synthetic coding sequence
atgctcagagagttctcaaagtggggcgtagaagccagtcctggcaaggcctgggagaggaagcgcagcttgctgcgcggcgccgtcggccgctaccggggagccaccgggggagatttgttctgggccccattccccagctggggcacaatggagttccctgagcattcacagcagcttcttcagagcttgagggaacaacgaagccaaggcttcttatgtgattgcaccgtaatggtgggttctacccaattcctagcacaccgggctgtcttggctagctgcagtccattcttccaactgttttacaaagagagagagctggataaacgcgatctcgtgtgtattcataacgaaattgtgaccgctccagcattcggacttctcctggacttcatgtatgctgggcagctcactctgagaggcgatactccagtggaagacgtgctggctgccgcgtcctatctgcacatgaatgacatagtgaaggtctgcaagcggcgcctgcaagcacgagccctagcggaggccgattcaactaagaaggaagaggagacaaacagccagctgccaagtttggagttcctatcctctacctcccgggggacccagcccagtctggcaagcgcggaaacaagcggccactggggtaaaggcgagtggaaaggttctgccgctcccagtcccacagtccgaccgcccgacgaaccccctatgtccagtggggctgacaccacacagcccggcatggaagtggacgcccctcacctgcgagcgccacatccccccgttgccgacgttagtttggcctcccctagctccagtacggagaccattcctaccaattatttcagctccggcatctccgccgtttcattggaacccctgccttccttagacgtgggccctgaaagccttcgggttgtcgagcctaaagatcccgggggtcccttacaggggttctatccacccgcgtctgccccaacaagcgcccccgccccggtcagcgcacccgtgcccagccaggcaccagcacctgctgaggctgaattggtacaggtaaaggtggaagcgatcgtcatctcggatgaggagactgacgtgtcagacgagcagccccaggggccggagcgtgcgttcccctccgggggggccgtgtatggagcccaaccgtcacaaccagaggccttcgaggacccgggcgctgctgggctggaagaggtcggtccttccgaccacttcctgcccacggacccacacctcccttaccacctgctgccaggcgctggccaatatcatagagggctggttaccagcccacttcccgcgcccgcttcccttcacgagcccctgtacctctcctctgaatacgaggctgctccaggtagctttggcgtgtttaccgaggacgtccccacctgcaagacttgcggcaaaaccttttcctgcagttacacgcttagaagacacgctaccgtgcatacccgggagcggccttatgagtgccgctattgtctccggagctacacccagtctggcgatctctacaggcacatcaggaaagcccacaacgaagatcttgcaaagagatccaagccagatcccgaggtgggacctttactgggagtccagcctcttccaggctcccccactgcagatagacagagctcctccggtggcggaccacctaaagactttgtcttggctcccaagaccaacatttag

SEQ ID NO: 13809 - DNA, 1512 bp, Artificial Sequence
  Description of Artificial Sequence: Synthetic coding sequence
atggagaagggcggaaacatccaacttgagatccctgacttttctaactccgtgttgagtcatctgaatcagctaaggatgcagggccgactctgcgatatagtggtcaatgttcaggggcaggcattcagagcccacaaggtggtgttagccgcttcgagtccttactttagagatcatatgagcctaaacgagatgagcactgtcagtatttccgtgatcaagaatccaacagttttcgaacagcttttatcgttttgctacacaggccgcatctgcctccagctagccgacattataagttatctgacggctgcctccttcctccagatgcagcacataatcgataaatgcacccaaatacttgagggtatccactttaagattaatgtcgctgaagtggaagccgagctgagtcagacacgtaccaaacaccaggaacgaccccctgagagccaccgggtgacgccaaatctgaatcgatctctgtcccctaggcataacaccccaaaaggcaatcgacggggtcaggtgtccgcagtgctggacatccgggaattgtccccccccgaagaatctaccagcccacaaatcatcgagccatccagcgatgttgagagtagagagcccatcctgcggataaacagagcaggacaatggtatgtggagacaggagtggccgaccggggcggccgatccgacgacgaggtacgggtgttgggtgcggtgcatataaaaaccgagaaccttgaagagtggctggggcccgagaaccaaccatccggcgaggacgggtcctcagccgaggaggtgaccgcgatggttatcgatactactgggcatggatccgtgggccaggaaaattacactctgggatcctccggtgcaaaggtggccagacctacttcatctgaggtggacagattttctcccagcggatcagttgtccccttgaccgagaggcacagggccaggagcgagagcccgggcaggatggacgagcctaagcagccgagctcccaggttgaggagagcgccatgatgggcgtgagcgggtacgttgagtatctgagagaacaggaggtgagcgagcgctggttcaggtataacccccgcctcacttgcatctattgtgctaagagttttaaccagaagggctctctggataggcatatgcggctccacatgggcattactcctttcgtttgccgaatgtgtggtaagaaatatacccggaaggatcagttagaatatcatatccgaaagcacaccggcaacaaaccgttccactgccacgtatgtgggaaatccttcccctttcaagccattcttaatcagcacttccggaaaaatcatcccgggtgtatccctctggaaggaccacacagtatctccccagagactaccgtgacttctagggggcaggctgaagaagaaagcccttcccaggaggagacggtggcccccggcgaagcagtgcaagggtccgtgtctactaccgggcccgactag

SEQ ID NO: 13810 - DNA, 1236 bp, Artificial Sequence
  Description of Artificial Sequence: Synthetic coding sequence
atgccagctacaggacggtatcatcagctgcccaattcttgccagttcagtgccaatgccgcatactaccggcaaatgtatacggacccaggcggccattcattcaagattaacgtcgctgaggtcgaagccgaactttctcagacgagaaccaaacaccaggagcgtccgcctgagagtcaccgggtaacccccaacctcaacaggtcactatcgccacgacataataccccaaagggaaataggaggggacaggtgagcgccgtcctcgatatccgcgagctaagcccacctgaggagtctacctctccccagattattgaacccagtagtgatgtggagtctagggaacctatattaaggataaatcgggctggccaatggtacgtcgaaactggggtggcagacagaggaggtcggtccgacgatgaggtgagagtgctgggagctgtacacatcaagaccgagaatctggaagaatggctgggccccgagaatcagccaagcggcgaggatggtagctcagcagaagaagttaccgccatggtgatcgatactactgggcatggtagtgtgggacaagagaattacacgttggggagcagtggggccaaagtggctcgtcccacaagttctgaggtggacaggttcagcccaagcggctcggttgtgccgctcacagaacgccaccgagcgcgatctgaatctccaggtagaatggatgagcctaagcagccctcatctcaggttgaagagtctgcgatgatgggggtgagtggctacgtagagtaccttagagagcaagaagtctccgagcgttggttccggtacaatcctcggctaacctgcatatactgcgccaaaagttttaaccaaaaggggagcctcgacagacacatgaggttgcacatggggatcactcccttcgtgtgtcgcatgtgtggcaaaaagtacacaagaaaagaccagttagagtatcacatccggaagcataccgggaataagcccttccactgccatgtctgtgggaagagcttcccatttcaggccatactgaatcagcatttcaggaaaaaccaccccggctgcatccccctcgagggcccacatagtataagcccagagaccaccgtgactagcagagggcaggcagaggaagaatctccatctcaagaagaaactgtcgcccccggagaggcggtgcaaggctcagtcagtacaacaggccctgactag

SEQ ID NO: 13811 - DNA, 927 bp, Artificial Sequence
  Description of Artificial Sequence: Synthetic coding sequence
atggagaagggcgggaatattcagttagaaatccccgacttttcaaatagcgtgctaagccacctcaaccagctgcggatgcaaggccgcttatgcgacattgtggtgaacgtgcaagggcaggcattcagagcccacaaagtcgttttggccgcttccagcccgtacttccgcgaccatatgtccttgaatgaaatgagcactgtgagcatctcagttatcaagaacccaacagtgtttgaacagctgctctcattttgttacactgggcgtatctgcctgcaactggccgatatcatctcttatttgacagcggcgtcttttctgcagatgcagcacattatcgataagtgtacacagattcttgaagggatacattttaaaataaatgtcgctgaggttgaagcagagctttcccagacgcgcaccaagcatcaggaaaggcccccagagagtcatcgagtgacgccaaatttgaatcggtccttatctcccaggcacaacacacccaagggaaacagacgtggacaggtctcagccgtactggatattcgtgaattaagtccacccgaggagtccactagccctcagataatcgagccttcctcagacgtcgagtctagagaaccgattcttagaattaatagggccgggcagtggtacgttgagaccggcgtggccgaccggggaggtagaagcgatgatgaagtacgcgtgcttggcgctgttcatatcaaaacagaaaatctggaggagtggttgggacccgaaaatcagccaagcggtgaagacggatcgtctgccgaagaggtgaccgccatggtgattgatacaactggccacggatccgtaggccaggaaaactacactctggggtcctcgggtgcaaaggtggctagaccaacctcatccgaggtggaccgttag

SEQ ID NO: 13812 - DNA, 1512 bp, Artificial Sequence
  Description of Artificial Sequence: Synthetic coding sequence
atggaaaaaggaggaaacatacagctcgaaattccggactttagtaactcggtgctctcccatctgaatcaactgcggatgcaggggaggctgtgtgatattgtggtgaacgtgcaaggacaggcctttcgggcccacaaggtggtgctggccgccagcagcccctatttcagagatcatatgtccttgaacgaaatgagtaccgtgtcaattagtgttattaaaaaccccaccgtctttgagcagctgctgtccttttgttatacaggccgaatttgcctgcagttagccgacataatttcctatctgaccgctgcaagttttctgcaaatgcagcatataatcgacaagtgcacccagatactcgagggcattcatttcaagattaacgttgctgaggtcgaggctgagctgagtcaaacacgaaccaagcatcaggaaagacctcccgaatcccacagagttacacccaacctaaaccgcagcctatcaccgcgccataatactccgaagggtaaccgtagaggccaggtttctgccgtgctggacattagagaactgagcccaccagaagaaagtacctcacctcagattatcgagccaagttccgacgtcgagagccgtgagccaatcttgaggatcaatcgcgcggggcagtggtatgtggagacgggcgtcgccgaccggggggggcgcagtgatgacgaggtaagagtgctcggcgcggtgcatattaaaaccgagaacttggaagaatggctgggtcctgagaatcaacccagcggagaagacggttcaagcgcagaagaggtcaccgccatggtcatcgacactacaggccatggttcagtcggccaggagaactacaccttgggatcttccggggcaaaagtggcacggcccacctctagcgaggtggaccgcttttccccctccggtagcgtggtgcctctaactgaacgtcaccgcgctcgtagcgagtctcctgggcggatggatgagcctaaacagccaagttcccaggtagaagagtctgctatgatgggtgttagcggctacgtggaatacctgagagagcaggaagtatccgagcggtggttcagatataatccaaggctgacatgtatttactgtgccaagagctttaaccaaaagggcagcttggatcgccatatgagattgcacatgggaatcacgccttttgtttgcagaatgtgcggaaagaagtacacacgaaaggaccaattggagtatcatatcagaaagcacacgggtaataagccgttccattgtcacgtgtgcggaaagtcattccccttccaggctatactgaaccaacactttcggaagaaccatcccggatgtatcccccttgaggggccacatagtatttctccagaaacgacagtgacgagtcgaggccaagccgaggaagagagtccatctcaggaagaaaccgtcgccccaggagaagcagtgcaaggctcggtgtctaccaccggaccagactag

SEQ ID NO: 13813 - DNA, 1086 bp, Artificial Sequence
  Description of Artificial Sequence: Synthetic coding sequence
atggagaagggtgggaatatccagctcgagatcccagatttcagcaactccgtcctctcacaccttaatcaattaagaatgcagggtcggttgtgcgacattgtggttaatgtccaggggcaagccttccgggctcataaggtcgtcctggcggcaagcagcccatacttccgggatcatatgtcccttaacgaaatgtcgacagtttcaatatctgtgataaaaaaccctacagtgtttgagcaattgctcagtttctgttacacagggcggatctgccttcagctcgccgatattataagttacttaactgcggcatccttcctgcagatgcagcatatcattgacaagtgcactcagatcctcgagggtatccattttaaaattaacgtcgccgaggtggaagcagaactgtctcaaacccgcaccaagcaccaggagagaccccccgagagccatcgggtgacacctaacctgaataggtccctaagtccccgtcataacacaccaaaaggaaaccgccgcggccaagtgagtgccgtgctagacattagggaactgagtccgcctgaagagtccacctctccacagatcatagaaccttcttccgatgtggagagtcgcgagcccattcttagaatcaaccgcgcaggccaatggtacgtggagaccggcgtggctgatagaggaggcaggtccgatgatgaagtgagagtgctcggggctgtgcacatcaagacggaaaatctcgaggaatggctggggcctgaaaaccaaccatctggcgaagacggatccagcgccgaggaggtcacagcgatggtgatcgatactaccgggcatgggtccgttgggcaagaaaattacaccttgggctcctctggggctaaagtggcgcgacccacatcgtccgaagtggacaggttcagcccatccggttcagtggtaccgcttaccgaaaggcatagggccaggagcgagtccccaggccggatggatgagcctaaacagccaagctctcaagtgtggtcatgcggctttcgtactgctctggtggttggtggtatcgcaaccgtgtacgagtag

SEQ ID NO: 13814 - DNA, 1512 bp, Artificial Sequence
  Description of Artificial Sequence: Synthetic coding sequence
atggagaagggagggaacatccaattggagatccccgacttcagcaatagtgtattatcacacctgaatcagcttagaatgcagggtagactgtgcgacatagttgttaacgtgcaaggtcaagctttcagagcccacaaggttgtcctggctgcctcctccccttatttccgtgaccacatgtcgcttaatgagatgagcaccgtcagcatcagcgtcattaaaaacccgacagtgttcgagcaattgctaagcttctgttacacaggacgtatctgcctccagttggctgacattatctcctacctaactgctgcctccttcttgcagatgcagcatatcatcgacaagtgtacacagatcttggaggggatccacttcaaaatcaatgtggccgaagtcgaagccgaactgtcccagactaggactaagcaccaggaacgccctccagagtcccaccgcgtcacccccaacttaaaccgcagtctctcacctaggcacaacacccctaagggcaatcgacgcggtcaagtcagtgcagtgttggacatccgtgaactctctcctcccgaggagtcgacctctccacaaatcatagaaccaagcagcgacgttgagagccgggaaccaatcttaaggataaaccgggcaggccagtggtatgtggaaactggcgtcgccgaccgcggaggtcgcagtgacgacgaggtgagggttcttggcgcggtgcatatcaaaacggagaatctggaggaatggctcggacccgagaaccagccaagcggcgaagacggaagctccgccgaggaagtaaccgctatggtcattgatactacagggcacggtagcgtgggccaagagaattacacccttggtagtagtggtgctaaagttgccagaccaacttcaagcgaagtggatcgcttttcgccatccgggtcagtagttcctcttaccgagaggcatcgcgcgaggagcgagagtcccggacgaatggatgagcccaagcagccctcgagccaggtggaggagtctgccatgatgggagtgagtggctatgtggagtatcttcgagaacaggaggtgagtgaacgatggttcaggtataaccctagactcacttgcatctactgcgccaaatccttcaaccaaaaaggatccctcgaccgccacatgaggcttcacatggggataaccccctttgtttgccgaatgtgtggcaaaaagtatacaagaaaagaccagttggagtatcatataagaaaacacacagggaacaaaccttttcactgccatgtgtgtggcaaaagttttccatttcaggcaatcctgaaccagcattttagaaaaaatcacccagggtgtataccattagaggggccacactcaattagccctgagaccactgtcacatcgcgggggcaagccgaggaagagtcacccagccaagaagagaccgtggcaccaggagaagccgtgcaagggtccgtaagtaccacgggaccagattag

SEQ ID NO: 13815 - DNA, 2139 bp, Artificial Sequence
  Description of Artificial Sequence: Synthetic coding sequence
atgggaatgaggattaagttgcagagcacaaaccacccaaacaatcttctgaaggagctgaataagtgtcggctttctgaaacgatgtgtgatgtgacaatagtggtgggtagccgcagtttccctgcccacaaagccgtgctggcttgcgctgctggatactttcagaatctgttcctgaatacgggcctggacgcggctagaacttacgtggttgatttcattacacccgctaacttcgaaaaggtgctgtcttttgtgtatacatccgagctgttcacagatttgatcaacgtgggagtcatctacgaggtggcggagaggctggggatggaggacctgcttcaggcctgccacagcaccttccctgacttagaaagcaccgcgcgcgccaagccgcttacgtcaacatctgaatctcatagtgggacattgtcttgccccagtgctgagccagctcaccccctgggggaactacggggcgggggcgattatctcggcgcagatagaaattacgttctccccagcgacgccggaggcagctacaaggaagaggagaagaacgtggccagcgacgccaatcactcactccacctgccacagcctccccctcccccgccaaagactgaagatcacgacactccagctccattcacctcaattccatctatgatgacacagccactgctcggcacggtaagcacagggatccagacctctacttcctcttgtcagccttacaaagtccaatctaacggagatttctccaaaaacagcttccttaccccagataacgccgtagatataactaccggcaccaattcttgcctttccaattctgagcacagcaaggatcctggatttggccagatggatgagctgcagctggaggatctgggcgatgatgacctgcagttcgaggacccagccgaggatatcgggaccacagaggaggtcatcgaattgagcgacgactccgaggacgagctggccttcggtgagaacgacaatagagaaaacaaggccatgccctgtcaggtgtgcaagaaagtgctggaacccaacatccagctgatccggcagcatgcccgggaccatgttgatctcctgacgggaaattgtaaagtttgcgagacgcactttcaggacaggaacagccgggtgacgcacgtgttaagccacattggtatcttcctgttctcgtgtgatatgtgcgaaactaaattcttcacacaatggcaattgacattgcatcgaagggatgggatcttcgagaacaacatcatcgtgcaccctaacgatcctctgcccggaaaactgggcctttttagcggcgccgccagccctgaattaaagtgcgctgcctgtggtaaagttctggccaaagacttccacgttgttcgagggcatatcctagatcacctgaatctgaaagggcaggcctgttccgtctgcgaccagcgccacctgaacctatgctccctgatgtggcacaccctaagtcatctggggatcagcgtattttcctgttctgtgtgcgccaatagctttgtggattggcatctgctggaaaagcacatggccgtacatcagtccctggaagacgccctattccactgtcgtctttgtagtcagagcttcaagagtgaagctgcttacaggtatcacgtcagccaacacaaatgtaactccggcctggacgcaaggccaggctttggactgcagcacccagctctgcagaaacggaagctgccagctgaagaattcctcggagaggaactggccctgcagggccagccaggaaacagtaagtacagttgcaaggtgtgcgggaaaaggttcgcgcacaccagcgagtttaattaccataggagaatccataccggtgaaaagccatatcagtgtaaagtctgccacaagttttttagaggccggtctacaattaaatgccacctgaagacccattccggcgcactcatgtaccgttgtacagtctgtggccactactctagcacactgaaccttatgtcaaagcacgtgggagtccataaaggatctctgcctcccgatttcacaattgagcaaaccttcatgtatatcattcacagcaaagaagcagacaagaaccccgattcttag

SEQ ID NO: 13816 - DNA, 2730 bp, Artificial Sequence
  Description of Artificial Sequence: Synthetic coding sequence
atgaaaaagaggagaaaggttacctctaacttggagaaaattcatttgggctaccataaggactcctccgaaggcaatgtggcagtcgagtgcgatcaggttacttatacgcattccgccggaagacctacaccagaagctcttcattgttaccaggagctgcccccctcccctgaccagcgcaagctcctgagttcgctgcagtataacaaaaacctattgaagtatctcaatgatgatcgacaaaaacagccgagtttctgcgacctgctgatcattgtcgagggaaaggaatttagcgctcacaaggtggtggtggcagtcgggagcagttactttcatgcttgcctaagcaagaatccaagcactgatgtcgtgacactggaccacgttacacacagcgttttccagcaccttcttgagttcctgtacacatcagagttctttgtgtataaatacgagattcccctagtgctggaggccgcaaaattcctggacatcattgatgcagttaagttattaaataacgagaacgttgcgccatttcactcggaactcactgagaagagctccccagaagagaccctgaatgagttgacgggccgcttgagtaataaccatcagtgtaaattctgctctaggcatttttgctacaaaaaatcgctcgaaaatcatctggctaagactcacagatcccttctgctgggaaaaaagcacgggctcaagatgctggagcgctctttctctgccagaaggagcaaacgtaatcgaaaatgtccagtcaaattcgatgatacgtcggatgacgagcaggaatctggtgatggttctgataatctcaaccaagaaaactttgacaaagaaaagagcgaccgtaatgattcagaagatcctggaagtgaatataacgcggaggaagacgagctggaggaagagatgagcgacgagtacagtgatattgaggagcaatcagagaaggatcacaacgatgccgaggaagagccagaggccggcgattctgtgggtaatgtgcatgaaggccttaccccagttgttatacagaactccaataagaagatcctgcagtgtcctaagtgcgacaaaacttttgaccggataggaaaatatgaaagtcatacacgggtgcacacgggagagaagcccttcgaatgcgacatttgccaccagaggtacagcaccaaatctaatttgacggtgcaccgaaaaaagcacagtaacgaaacagaatttcacaagaaggaacataaatgcccatactgcaacaagttacacgcatccaagaagaccctcgctaaacatgtgaaaaggttccacccagagaacgcccaggaatttatctctattaagaagacgaagtctgagtcctggaaatgtgatatttgcaaaaagtcattcacccggcgacctcaccttgaagaacacatgattctgcactcacaggataagccctttaagtgtacctactgcgaggaacactttaaatctaggtttgcacgcctgaagcatcaggagaagttccacctgggaccatttccttgcgacatttgtggaaggcagttcaacgacactggcaatctgaaaaggcatattgagtgcactcacggaggcaagagaaagtggacttgctttatatgcggtaagtcagttcgcgagcgcacaaccttaaaggaacatctgcggattcactccggcgagaagccgcatttgtgtagtatttgtggacaaagctttcgtcatggcagctcctacaggttacacctgcgtgtgcaccatgacgataagcggtacgagtgcgacgagtgtggaaagacatttataaggcatgatcaccttacaaagcataagaagatccattctggagaaaaggcccatcaatgtgaggaatgcggaaagtgtttcgggcgccgagaccaccttacagtgcattacaaaagtgtacatttgggtgagaaggtctggcagaagtacaaggctactttccatcagtgtgacgtgtgtaagaaaatatttaaaggcaagtcctcactagagatgcacttcaggacacattctggagagaaaccatacaagtgccagatatgcaatcagtctttccgtatcaaaaaaacgctcacgaaacacctcgtgatccactccgacgcacggccttttaattgtcagcactgcaacgcgacattcaaaaggaaggacaaactgaagtatcacatcgatcacgtgcacgaaattaaaagcccagacgatccactgagtacttccgaagaaaaactcgtttcgcttcccgttgagtactcctcagacgacaagatttttcagacagaaacgaagcagtacatggaccagcccaaggtgtaccagtcagaagccaaaacaatgctgcagaatgtctctgccgaggtctgtgtgcctgtgacactcgttccggtccagatgccagacacgccatcagatctggtacgacacactaccacactccccccctccagtcacgaaatactgtccccccaaccacagtctactgattatcccagagccgccgatctagcctttctcgaaaaatacactctaaccccacagcccgcgaacatcgtccaccctgtgagacccgaacaaatgctagatcccagagagcagagctatctcggcacactcctgggcctcgactcaaccactggcgtacagaacatcagcactaatgagcatcacagctag

SEQ ID NO: 13817 - DNA, 1404 bp, Artificial Sequence
  Description of Artificial Sequence: Synthetic coding sequence
atggaaccgggcacaaacagtttccgggtcgaatttcccgacttttcctccaccattttacaaaaactcaatcagcagcgccagcaggggcagctttgtgacgtttctattgtcgtgcagggtcacatctttagggcgcacaaagccgttctggctgctagcagcccttatttctgcgaccaggttcttctcaagaattcccggaggatcgtccttccagacgtgatgaacccacgcgtcttcgaaaatattctgctctcgagttacaccggcagattggttatgccggcacctgaaattgtgtcttacttgaccgccgcttcattcttgcagatgtggcacgtcgtcgataagtgtacagaggtccttgaggggaaccctacggtgttatgtcagaagcttaaccatggctctgaccatcagagccctagtagctcatcctacaatgggctcgttgaaagcttcgagctcggatccggtggccacacagatttccctaaggcacaggagctgagggacggtgagaacgaggaggaatccaccaaggacgaattaagtagccagttgaccgagcatgaataccttccatctaacagctctaccgagcatgacaggctcagcaccgaaatggcctctcaggacggagaagaaggggccagcgactctgccgaatttcactacactagaccaatgtactcaaagccaagcataatggcgcataaacgatggatccacgtgaagcctgaacgcttagagcaggcctgtgaaggtatggacgtgcacgccacttatgatgagcatcaagttacagagagcattaacaccgtgcaaaccgagcacacggtgcaaccttctggcgttgaggaggactttcacatcggcgagaaaaaggtagaggctgaattcgacgaacaggcagatgaatccaactatgacgagcaagtggatttctatggatcatcaatggaggaatttagcggtgagaggtctgacgggaacctcatcggccataggcaggaagccgcactggcggccggatatagcgagaatattgagatggtgaccggaatcaaagaagaagcttcccacttgggttttagcgctacagacaaactctatccatgccaatgtggaaagagctttacacacaagagccaacgtgacaggcacatgagcatgcatctggggctgcgtccatatggatgcggagtttgtgggaagaaattcaagatgaaacaccacttggtcggtcacatgaagattcacacgggcattaaaccctacgagtgtaacatctgcgcgaagcgattcatgtggcgcgacagtttccacagacacgtgacttcgtgcacaaagtcatatgaagcggcgaaggctgagcagaacaccactgaagctaattag

SEQ ID NO: 13818 - DNA, 1404 bp, Artificial Sequence
  Description of Artificial Sequence: Synthetic coding sequence
atggagcccggaaccaacagctttcgtgtggagtttcctgatttcagctcaacaatactccaaaaactcaatcagcagagacaacaggggcagctgtgcgacgtaagtattgttgtccagggccatatcttccgagcgcacaaggcagtactagcagcaagctctccatacttttgcgatcaggttctcctaaagaattctaggaggatcgtgctcccagatgttatgaatccgcgcgtctttgagaatatcctcctgtccagctacacaggccggctggtgatgccagcgccggaaattgtgtcttacctcaccgccgccagcttcctacagatgtggcatgttgtcgataagtgtactgaggtgctggaaggaaaccctacagttctttgtcagaaactgaatcacggcagtgatcaccaaagcccatcctcatctagctacaatggcctggtggagtccttcgaactggggtcaggtgggcataccgatttccccaaggctcaggagctcagggacggagaaaatgaagaagagtccaccaaggatgagctcagttcccagctcacagagcatgaatacctgccatcaaattcctcgactgagcacgatagactcagcactgagatggccagccaagacggagaggaaggggcttcagactcagccgaatttcattatactcgccctatgtattcaaaaccttcgataatggcccacaaacggtggattcacgtgaagcccgagagactagaacaggcctgcgagggcatggatgtccatgccacatatgacgagcatcaggtgaccgaatctatcaacactgttcaaacagaacataccgtacagccctctggtgttgaagaagattttcacattggagaaaaaaaggtcgaggccgagttcgatgagcaagcggatgagagcaactacgacgagcaggtggacttctatggctctagcatggaggagttttccggtgagaggtctgatggtaatttgattggccacagacaggaagcagcgttggctgccgggtacagtgagaatatcgaaatggtgactggaatcaaggaggaggcatcccatttgggattcagtgccacggacaagctgtatccctgtcagtgtgggaaatcatttacccacaagtcccagcgtgaccggcatatgtctatgcacctaggtttacggccatatggatgtggcgtgtgcggcaaaaagtttaaaatgaagcaccatctggtgggtcatatgaagatacacacaggcatcaaaccttacgaatgtaacatctgtgctaagcgctttatgtggcgggactcgttccatcggcatgtgacatcatgcacgaaaagttatgaggccgctaaagcagagcagaacactacggaagctaactag

SEQ ID NO: 13819 - DNA, 1404 bp, Artificial Sequence
  Description of Artificial Sequence: Synthetic coding sequence
atggagccaggcaccaactcattccgcgtggaattcccagactttagttccactattttgcaaaagctcaaccagcagcggcaacagggtcaactgtgtgacgtgagcatcgtggtccagggtcacattttccgagcccataaggcggtgttggccgcctcctctccctacttctgtgatcaggtgctcctcaaaaatagccgacgaatcgtgctccctgacgttatgaatcccagggtctttgaaaacatcctgctctcatcttacaccggcagactggtgatgccagcccccgaaattgtgagctacctgaccgcggccagctttctgcagatgtggcacgttgtggacaagtgtaccgaagtcctcgagggcaatcccacagtgctgtgccagaagttaaatcatggttcagatcaccagtccccgtctagctcaagttacaacgggttagtggaatcctttgagctcggaagcggtggacacaccgatttccccaaggctcaagagctccgggatggtgaaaatgaagaagagagcacaaaagatgagctttcttcgcaattaactgaacacgaatatctccccagcaacagttcaactgaacatgaccgcctctccaccgaaatggcatctcaggatggtgaggaaggagcctcagatagcgccgagttccactatactcgcccaatgtattcaaagccgagtatcatggcacacaaaaggtggattcacgtgaagcccgagaggttggagcaggcctgcgaaggcatggatgtgcatgctacctatgatgaacatcaggtcactgaatcaattaataccgttcagacggaacatacagtccagcctagtggcgtcgaagaagactttcacataggcgagaagaaggtggaggcggagttcgatgaacaggcagacgagtcaaactatgacgaacaggtcgacttctacgggagtagcatggaagagttttccggagagcgctccgacggcaatctgatcggacaccgacaggaggcagccttggccgccgggtactccgagaatatcgagatggtcaccggtatcaaggaagaggcatctcatcttggtttcagcgccaccgacaaactgtatccttgccaatgtggcaagtctttcactcataagtcccagcgggatagacacatgagtatgcatctggggctgcgcccttatggctgtggggtgtgtgggaagaaattcaaaatgaagcaccatctggtcggccatatgaaaattcatacaggaattaaaccatatgaatgcaacatttgcgctaagcgatttatgtggcgtgatagtttccaccgccatgtgacaagctgcacgaaaagttacgaagcagccaaggctgaacaaaacacaaccgaagctaattag

SEQ ID NO: 13820 - DNA, 591 bp, Artificial Sequence
  Description of Artificial Sequence: Synthetic coding sequence
atggagcccggaactaattctttcagggtggagttcccagatttcagctccacaatcttgcagaaactgaaccaacaacggcagcaggggcagctgtgtgacgtgagcattgtggtgcaaggacacatatttcgcgcacataaggctgtcctggccgcctcttctccctacttttgtgatcaggtcttgcttaaaaactccagaaggatagtgctgccggacgtaatgaacccccgcgtttttgagaacatcttattaagcagttacacaggcaggctagtaatgcctgcgcccgagattgtgtcttatctgacggcggcctctttcttgcagatgtggcatgtcgtggacaagtgtaccgaagttctggagggcaatcctactgttctgtgccagaaactcaatcacgggtccgaccaccaatcaccctccagtagttcatacaatgggttagtggaaagctttgagcttggcagtggaggccacactgacttccctaaagcacaagagctgcgcgatggcgaaaacgaagaagagagcacaaaagatgagttgagctcccaactcaccgaacacgagtatctgccatag

SEQ ID NO: 13821 - DNA, 1536 bp, Artificial Sequence
  Description of Artificial Sequence: Synthetic coding sequence
atggctgccgccgaggccgtccaccacatccacctgcagaatttctccagatctctactggaaacccttaatggacagcggctgggcggtcatttctgtgacgtgaccgtgagaatcagggaagcttcactgcgagctcaccgctgcgtcttggccgccgggtcacctttctttcaagacaagctcctactaggccattcagagatcagggtgcctcctgtggttccagcacagacagtcaggcagctggtggagttcctgtattcaggatcattggtagtggcccagggagaggcattgcaggtgctgaccgcggcatcggttctacgcattcagaccgtgatcgatgaatgcacccagattattgctagggccagagctcctggtacttcggcaccaacacccctccccacccccgttcccccccctctcgcccccgcccagttgagacaccgtctgcgccatctactcgcagcacggcctccgggtcaccccggcgccgcacattcacggaagcagcggcaacctgcaagattacagctccccgcacctcctacaccagcaaaggcggaagggcccgatgcggacccatccttaagcgctgctcccgatgatcgaggggacgaagatgacgaggaaagtgacgacgaaacagacggggaggatggcgagggcggcgggcccggagaaggacaggcacctcctagctttccggattgtgccgccggatttctcacagcagccgccgacagtgcctgcgaggaacctccagcaccaacaggcctggctgactacagcggcgcaggcagagatttcctcaggggagctggttctgctgaggacgtgtttccagacagctacgtttccacctggcatgacgaggatggggctgtgcctgaaggttgccccacagagacacctgtgcagcccgactgtatcttgtcaggctcaagaccaccgggagtaaagactcctggcccccccgtcgcactttttccatttcaccttggagcacccggacctcccgcaccgcccccgtccgcaccctctgggccagcaccggctccacctcccgccttctatcctactttgcagccggaagccgctccaagcactcagttaggcgaagttccagccccctccgctgctccaactacagcgcctagcggaaccccagctcgtactccgggcgcagagccccctacttacgagtgttcccattgtcgcaagactttctctagtaggaagaactatacaaaacacatgttcattcattcaggcgaaaagcctcatcaatgcgcggtctgctggcgatctttttccttacgggattaccttttaaaacatatggtgacccacacaggtgtgagagcgttccagtgtgcagtgtgcgctaaaagattcactcaaaagagctccctcaatgttcacatgagaacacataggccagaacgggcaccatgcccggcatgtggcaaagttttttctcaccgcgcgctccttgagcgacatttagcggctcatccggccccttag

SEQ ID NO: 13822 - DNA, 1770 bp, Artificial Sequence
  Description of Artificial Sequence: Synthetic coding sequence
atgaacaacaggaaagaggacatggagatcaccagtcactatagacacctgcttagagagctgaatgagcagcgacagcacggcgtgctctgcgacgtatgcgtggtggttgaggggaaggtgtttaaagctcacaagaatgtccttctcgggagttcgaggtacttcaagaccttgtattgtcaggttcagaaaacttccgagcaagcaacagtcacgcaccttgacatcgtgaccgcccagggattcaaagccattatcgattttatgtactccgctcatctggccctgacaagcaggaacgtgatcgaggtgatgtcagccgctagtttcttgcagatgaccgacatcgttcaagcatgccatgacttcatcaaggctgctctggacatttctattaagtcagacgcctccgacgagctggcagaatttgaaataggcgccagtagtagctcctccaccgaggccctcattagtgctgtgatggcagggcgttcaatctctccttggctcgcacgcagaacgagtccagcaaattcttcaggcgactcagcgatcgcctcatgccatgatgggggaagctcctacggcaaggaggatcaagagccaaaagcagatggtcccgacgacgtttcatcccaacccctatggcctggagatgttggatatgggcctctccgtatcaaggaggaacaggtttccccgagccagtacggcggctccgagctgcccagtgccaaggacggcgcagtgcagaactccttcagcgagcagtctgccggcgacgcttggcagccaaccgggcggaggaaaaaccggaagaataaagaaactgtccggcatatcacacagcaggtggaggacgattcgcgcgcatcttccccggtgccgtctttcctccctacctcaggctggccattctcaagccgggacagcaacgccgatctgtccgtaaccgaggcctcttctagcgatagcaggggcgaacgggcggagctttacgcccaggttgaggagggactgctgggtggagaggctagctacctaggcccacccctcactccagagaaagacgacgcactgcatcaggctactgccgtcgcgaatctgcgcgcagctctcatgtcaaagaacagcctgctcagtcttaaggctgatgtgctgggggacgatggatctcttctcttcgagtacttacccaggggagctcacagtctgtccttaaacgagtttacagtcatccggaagaagtttaaatgcccatactgttcttttagcgctatgcaccaatgtatcctaaagagacacatgaggtcacacactggtgagcgaccttacccatgcgaaatatgtggtaagaagttcactcgcagagaacatatgaaacggcatactctggtccactctaaggataaaaagtatgtgtgcaaagtgtgttctcgtgtgttcatgtctgctgcaagcgtaggaatcaggcatggttcgcggcggcacggagtgtgtacagattgcgctggtagaggcatggccggcccactggaccacggcggggggggaggtgagggttcaccagaagccctcttccctggggacggcccttatctagaggatcccgaagatcctagaggtgaggccgaagaacttggagaagacgacgaagggctggcaccggaggacgcgctcctggcagacgacaaggatgaggaagatagccccagaccccgttcgccgccaggaggcccagacaaggactttgcatggcttagttag

SEQ ID NO: 13823 - DNA, 1770 bp, Artificial Sequence
  Description of Artificial Sequence: Synthetic coding sequence
atgaacaaccggaaagaagacatggagatcacttctcattacaggcacctgctgagggagctgaatgaacagcgtcagcatggcgttctgtgcgatgtgtgtgtggtagtcgagggtaaggttttcaaagctcacaaaaacgtcctcctcggctctagccgttactttaaaaccctctactgtcaggtccagaaaactagtgagcaggcaaccgtcactcaccttgacattgtgaccgctcaggggtttaaggccatcatcgactttatgtactcagcccacctggccctgacctcgcgtaatgtgatcgaagtaatgtctgctgcttccttcctccaaatgaccgatattgttcaggcttgtcatgactttattaaagctgcactcgacatctcaatcaaatcggacgcctctgacgaattagccgagtttgaaatcggggccagttctagctcaagtaccgaggccctgatctccgcagtgatggccggcaggtctatttctccctggctcgcacggcgtacttcccccgctaacagctccggcgattctgccatcgcctcttgccatgacgggggctcttcatacggaaaggaggaccaggagccaaaggctgacgggccggatgacgtgtctagccagcccctctggcccggtgacgtcggatatgggcctctgaggatcaaggaggaacaagtgagtccttctcagtatggcggtagcgaactgccaagcgcaaaggatggcgctgtccaaaattcgttctcagaacagagtgccggtgatgcctggcagccaacaggccggagaaagaacagaaaaaataaggaaacagttcgccatatcacacagcaggtggaggatgacagtcgggcctcatcgcctgtgccttcatttttaccgacctctggctggcctttttcttcaagggatagcaacgcagatctgtcggttacagaagcctcatccagtgattccagaggcgagcgggcagagctatacgctcaagtggaagaaggtctgctgggaggcgaggcgtcctacttaggtcccccccttactccagagaaagatgatgccttacaccaggccaccgctgtcgctaacctgagggcagcgcttatgagcaaaaattccctacttagcttgaaagcagacgtgctgggagacgacgggagcttgctcttcgaatacctgcctcgaggtgctcattcactgagcctcaatgaattcacagtgatccggaaaaagtttaaatgtccatattgctcatttagcgccatgcaccagtgtatactgaagcggcacatgcgtagccataccggggagagaccctacccatgtgaaatctgtggaaaaaagttcacaaggcgggagcatatgaaacgacacaccctcgtgcattccaaagacaaaaagtatgtctgcaaggtctgcagtagggtgttcatgtctgcggcctcagttggtattagacacggctctaggaggcacggcgtttgtacggactgtgccggaagaggaatggcgggaccgctggaccacggggggggaggtggcgaggggtctcccgaggctctgttccccggagacggaccctatctggaagatccggaggaccccaggggcgaggctgaggaactcggtgaggatgatgagggcttagcacccgaagacgcgctgcttgcagacgataaggatgaggaggatagcccaagaccccgatctccacccggggggcccgacaaggattttgcatggctgagttag

SEQ ID NO: 13824 - DNA, 1770 bp, Artificial Sequence
  Description of Artificial Sequence: Synthetic coding sequence
atgaacaaccggaaagaggacatggagatcacgtcgcactacaggcatctcttacgggaactaaacgaacagagacaacacggcgttctgtgtgacgtttgtgttgtcgtagaggggaaggtgttcaaagcacacaagaacgtgctccttggtagttcccgatactttaaaacactgtactgtcaggtgcaaaagacctcagaacaggctactgttacacatcttgacattgttacggctcagggcttcaaagctatcatcgatttcatgtactctgcccatttggcccttaccagcagaaatgtaatcgaggtgatgagcgccgcatcattcctacagatgaccgacattgtccaggcgtgtcatgatttcataaaggccgccctcgacattagtatcaagagcgacgcatccgacgagctggctgaattcgaaataggagcatcctcctcctcatcgaccgaggccttaatttcagccgtcatggcaggcaggtccattagtccttggttagcccgacgaacctctcctgctaactcctctggagacagtgctatcgcttcatgtcacgacggtggttcgtcatatggtaaggaggatcaggaacccaaagccgatgggccagatgacgtgagtagccaacccctttggccgggcgacgtgggttacggccccctgcgcattaaggaagagcaggtgtctccgtcacaatacggaggctctgaactgccatcggcaaaggacggagcagtgcagaacagttttagcgagcagtcggcgggggatgcgtggcagcctacaggccgaagaaaaaacagaaaaaacaaggaaaccgtccggcacatcactcagcaggtcgaagacgacagcagggcctccagtcccgttcccagcttcttacctaccagtggttggcctttcagctctcgagatagtaatgctgacctgagtgtgacagaggccagcagctctgacagccgcggcgaacgcgccgagctctacgctcaggtggaggagggcctcctgggaggcgaagctagctacttgggaccccctctgactcctgaaaaagatgatgccctccaccaggctacggcagtggccaacctgcgggctgcgctcatgtctaagaattccctgctgtcccttaaagctgacgttctcggcgacgacggtagcctgcttttcgagtatctgcccagaggtgcccacagtctgtcgctgaacgaatttacagtcattcgcaaaaagttcaaatgtccctactgctcttttagtgctatgcaccagtgtatcttgaagcggcatatgaggtcacacacaggagagaggccctatccctgcgaaatttgcgggaaaaaatttactcggcgagagcacatgaaaaggcataccctcgtacactctaaggataaaaaatacgtttgtaaagtgtgtagccgtgtttttatgtccgcagcatcggtggggatccgccacggttcaagacgtcacggtgtctgtaccgactgtgctgggagaggcatggctggacccctggaccacgggggaggcggcggggaagggagccccgaagccctcttcccaggagacggaccatatctcgaggaccccgaggacccacgaggagaggccgaggagcttggcgaagatgatgaggggctcgccccagaggatgcgctgctggcagatgacaaggacgaggaggattcccctcggcccagatcgccacctggaggccccgataaagacttcgcttggctgagctag

SEQ ID NO: 13825 - DNA, 342 bp, Artificial Sequence
  Description of Artificial Sequence: Synthetic coding sequence
atgagcactatacagaatcttcagtccttcgatccatttgccgatgctactaagggcgatgacttgcttcctgccggcactgaggactacatccacatacgcatccagcagcgaaacggcagaaagaccttgactaccgttcaaggaattgccgacgactacgataaaaaaaaactggtaaaggcctttaaaaagaaattcgcctgtaacggcaccgtgatcgagcatccggagtatggcgaagtgattcaactccagggtgaccagagaaagaatatttgtcagtttctcctggaagtggggatagtgaaagaggaacagctaaaggtccacggcttttag

SEQ ID NO: 13826 - DNA, 1116 bp, Artificial Sequence
  Description of Artificial Sequence: Synthetic coding sequence
atggccacacgttctcgggagaacgctcggcggaggggtacgcccgaacccgaagaagccggcagaaggggaggaaagcgccccaaaccacctccgggagtcgcttctgcctcagcaaggggacctcctgccaccgacggcttgggagcaaaagtcaaactcgaggaaaaacagcaccacccatgccagaagtgtccgagggtgttcaataatcgatggtacttggaaaagcacatgaacgtcacacacagccgtatgcagatttgcgatcaatgtggcaagagatttctgctggagagcgagttgctactccaccgccagaccgactgcgaaaggaatatccagtgcgtgacatgtggtaaggcattcaagaagctgtggtccttacacgaacataacaaaatcgtgcatggttatgctgagaaaaaattcagctgcgaaatttgtgagaaaaaattctataccatggcccacgtgcgcaagcacatggtggcccatacaaaagacatgcctttcacgtgcgagacctgcggtaagagcttcaagaggtcgatgtcactcaaggtccattcgctgcagcacagcggtgagaagccctttcggtgtgaaaattgcaatgaacgattccaatataagtatcagcttcggagccatatgtccatccatattggacacaaacaattcatgtgccagtggtgtggaaaggatttcaatatgaagcagtactttgatgaacacatgaaaacccacaccggggaaaaaccctacatctgtgaaatctgtggaaaatcgttcacttcacggccaaatatgaagcggcacagacggactcacacaggcgaaaagccatacccctgcgatgtttgcggtcaaaggtttaggtttagcaatatgctaaaggctcacaaggagaagtgttttagggtctcccacactctcgccggggacggggtgccggctgctccaggactccccccgacccagccgcaagcacacgccctgccactcctgccaggtctcccgcagacccttcctcccccgccccatcttccaccaccccccccactgttcccaactaccgcttctcctggtggacggatgaacgcaaacaattag

SEQ ID NO: 13827 - DNA, 1941 bp, Artificial Sequence
  Description of Artificial Sequence: Synthetic coding sequence
atgggccgcctgaatgagcagagacttttccagcctgatctctgcgatgttgatttagttctggtgccccagaggtcagtgtttccagcccataagggagtgctcgccgcatattctcagtttttccacagcctctttacacagaacaaacagctgcaacgggtggaattgagtctggaggctctcgctccgggtggcctgcagcagatcctgaacttcatctatacctccaagttacttgttaacgccgccaacgtccacgaggtcctcagcgccgcttctctgctccaaatggccgacattgcagcatcctgtcaggagctgcttgacgcgcggtctttgggcccaccaggcccaggaaccgttgcacttgctcaacccgctgcaagctgtacacccgctgcgccaccttactattgcgatatcaagcaggaggcagataccccgggccttccgaaaatttacgctagagaaggacccgatccatattctgtgagggtggaagatggggctggtacggcaggtgggaccgtccccgctacaataggaccagcccagcccttttttaaggaggagaaagagggtggggtagaagaagccggtggtccccccgcatccctatgtaaactggagggaggtgaagaacttgaggaggagttgggaggtagtggaacctatagtcgacgggagcagtcccagatcattgtggaggttaacctgaacaatcagaccttgcatgtgagtacaggcccagagggaaaacccggggctgggccatctccagccacggtagtgttgggccgcgaagatggactacagcggcactcggatgaggaagaagaagacgatgaagaagaggaggaggaagaggaagaagaggagggcggcggttcgggcagagaggaggaagaggaggaagaaggtgggagccaaggcgaggaggaggaggaggaggaggacggccactccgaacaagaggaagaggaagaggagaagcagcaccatccttgccagaagtgtccgagggtctttaataaccgatggtacctggagaaacacatgaatgttacccactcccggatgcaaatatgtgatcagtgtggcaagcgttttctcctggagtcagagctcttattgcaccggcagactgattgtgaaaggaatattcagtgcgtcacctgtggcaaggcatttaagaaattatggtctctgcatgagcacaataaaattgtgcacgggtacgcagaaaagaagttctcttgtgagatctgtgagaagaaattctacaccatggcacacgtccggaagcatatggtggcccacactaaggacatgccctttacttgtgagacctgcgggaagtcttttaagaggtctatgtctctgaaggtccacagcctccagcactctggtgagaaaccattccgctgcgaaaactgtaatgagagattccagtacaaataccaacttagatctcacatgagcatccatataggacataagcagtttatgtgccagtggtgcggcaaggacttcaatatgaagcagtattttgatgaacatatgaaaactcacaccggcgagaaaccatatatatgcgaaatctgcggcaaatcatttactagccggcccaatatgaagaggcaccggagaacccacacaggagaaaaaccctacccttgtgacgtgtgtggccagagatttaggtttagcaacatgttaaaagcgcacaaagaaaaatgtttcagggtatcacatacactcgcaggagacggcgtccccgctgctcctggcctaccaccaacacagccgcaggcacatgcgctacccctgctgcccgggctgccccagaccctgccgcctcccccccatctgcctccccctccacccctgttccccacaacggcctctcctggcgggagaatgaacgcaaacaattag

SEQ ID NO: 13828 - DNA, 2298 bp, Artificial Sequence
  Description of Artificial Sequence: Synthetic coding sequence
atggatcctgtggctacccactcgtgccacttgctacagcagcttcatgaacaaaggatccagggacttctgtgcgactgtatgctcgtggtcaagggtgtgtgcttcaaggcacataaaaatgtattggctgcattttctcagtactttcggagtctcttccagaactcctcctctcaaaaaaacgacgtttttcatctggatgtgaagaatgtgagcgggattggccagatcctggattttatgtacactagccatctggatttaaatcaagacaacatccaggtgatgcttgatactgctcagtgcttgcaggtgcagaatgtgctgtcgctctgtcatactttcttgaagtctgcaacagtcgtgcagcccccggggatgccctgcaactctaccctcagtttgcagtctactctcacaccagatgcaacctgcgtaattagcgaaaattatcccccccatcttctgcaagaatgctctgcagatgctcaacagaataaaacattggatgaaagccaccctcacgcgagccccagcgtgaatcgccaccatagtgccggcgaaatcagtaagcaggcacctgacacatccgacgggagctgcacggaactcccgtttaagcagcctaactattactacaagcttcgcaatttctacagcaaacagtatcacaaacatgcagccggtccatcccaggaacgggttgtggaacagccattcgccttctccacgtcgactgacctaactacagtggaaagtcagccttgtgcagttagtcactcagagtgcattctggaatcgcccgaacatctccctagtaactttctggctcaaccggttaatgacagcgcacctcaccctgagtcagatgccacatgtcaacaacccgtcaagcagatgaggcttaagaaagcaattcacttaaagaagctgaattttctaaaaagtcagaaatatgctgaacaggtttccgagccaaagtctgacgatgggctgactaaaaggctcgagtccgcgagtaaaaataccctggagaaagcatcatcccagtccgcggaagagaaagagagtgaggaggttgtttcctgtgagaactttaactgtatctccgagactgagcgcccggaagatcctgctgcgctggaggaccagtctcaaacattgcagagtcagcgccagtatgcgtgcgagctatgcgggaagccgtttaaacatccctcaaatcttgaacttcacaaaagatcacacaccggagagaagccgtttgaatgcaacatttgcggcaagcattttagtcaggccggcaacctgcagacgcaccttaggcgacactccggcgagaaaccttatatctgtgagatctgcggcaagcgctttgccgcaagtggggacgtccagcgacacattatcatccatagtggcgagaaaccacatctgtgcgacatctgtggaagggggttcagcaatttctcgaatctgaaggagcacaagaagacccatacagcagacaaggtgttcacctgcgacgagtgcggcaaatcctttaatatgcagcggaagctggtaaaacatagaataaggcataccggggaacgtccgtattcatgttccgcatgtggcaagtgcttcggcggctcaggtgacctgcgtaggcatgtccggacacataccggcgaaaaaccttacacttgcgaaatctgcaataagtgttttaccaggagcgccgttcttcgccgacacaaaaagatgcactgcaaagccggcgacgagtcacccgacgtccttgaggaactgagccaagcaatagaaacctcagacttggagaagtcacagagttcagatagcttctcccaggatacatcggtgacactgatgcccgtgagtgtgaagctcccggtgcatcctgtggagaactcagtggccgagttcgattcacattccggcggatcatactgcaaactacgcagcatgatacagcctcacggggtgtccgatcaggagaaactgagcctggacccaggcaaactcgcgaagccccagatgcagcaaacacaaccccaagcctatgcttattcagatgtcgacaccccagccggtggtgaacccctccaggccgacgggatggcgatgatccgatcctcactggccgcactcgataaccatggcggtgatcctttgggctccagagcttcatcaaccacttacaggaactctgaaggccagtttttctcgagcatgactttgtggggactggctatgaagacgctgcaaaacgagaacgagttagatcagtag

SEQ ID NO: 13829 - DNA, 1932 bp, Artificial Sequence
  Description of Artificial Sequence: Synthetic coding sequence
atggatcccgttgcaactcattcttgccacttgctgcagcagctgcatgaacaacgaatacaaggattgctgtgcgactgcatgcttgttgtcaagggtgtttgttttaaagcacacaagaacgtgctggctgccttctctcagtatttcagaagcctcttccaaaactctagctcccagaagaatgatgtgtttcacctagatgtgaagaatgtctctgggatcggccagatcctcgattttatgtatacctctcatctggacctaaaccaagataacattcaggtgatgctggataccgcccaatgcctgcaagtacaaaacgtgctgtctttgtgtcacacattccttaagagcgccacagttgtccaaccccctggtatgccgtgtaactccacattgtctctgcagtccaccctaacccctgacgctacatgtgttataagtgaaaactatcctcctcatctattgcaagaatgctctgcagatgcccaacagaacaagacactcgacgagagccacccccacgcttccccaagcgtgaatagacaccactcagcaggtgaaatctccaaacaggctccagatacgtccgacggttcatgcactgaactgccatttaagcagccgaattattattacaaactgagaaatttttactcgaaacagtatcataagcacgccgctggcccaagtcaggagagggtggtggagcaaccatttgcatttagtacctccactgacttgacaaccgttgagtcacaaccgtgcgccgtttcacactccgagtgcattctggagtcccctgagcatctgccctccaactttctcgcacagccagtgaacgattcagccccacacccagaatcagatgcaacctgtcagcagccggtcaaacagatgagactgaaaaaagccattcatctgaagaaacttaactttttgaagagccaaaagtacgctgagcaggtgtccgagcctaagtccgacgatggccttaccaagaggttggagagtgcttctaaaaacaccctggagaaggccagcagtcagagcgccgaagagaaagagtccgaagaagtcgtatcctgcgagaattttaattgtataagcgagaccgagcgacccgaagatccagccgccctagaagatcagagccaaactttgcagtctcagcggcagtacgcttgcgaactttgcgggaagcccttcaagcacccctctaacctagagttgcacaaacgctctcacactggcaagtgctttgggggctcaggtgatcttagacgccatgttcgtacccacaccggtgaaaagccatacacatgcgaaatctgtaataagtgctttacacgcagtgccgtcttgagaaggcacaaaaaaatgcattgtaaggccggcgacgagtcccctgatgtgctagaagaactgtcccaagccattgagacctccgacttagagaaatcacagtctagcgattcttttagtcaggacacgagcgtgaccttgatgcccgtaagtgtcaaactcccagtccatcctgtggagaactcagttgcagagtttgattctcactcaggtggcagctattgtaagctccgttctatgattcagccccatggcgtgtccgatcaggagaagctgtccctggatcccggaaaactcgcaaaacctcagatgcagcaaacccagccgcaggcttacgcttatagtgacgtcgacacacccgcgggtggagagccgctgcaggcagatggcatggctatgatcaggtccagtctggctgcactggataaccatggcggggacccattgggatccagggcctcctcaactacatacagaaactccgagggacagttcttttctagcatgaccctgtggggactggctatgaaaactctgcagaacgagaacgagctagatcagtag

SEQ ID NO: 13830 - DNA, 441 bp, Artificial Sequence
  Description of Artificial Sequence: Synthetic coding sequence
atggatcctgtcgccacacacagttgtcacctcttacagcagctgcacgaacagcgcatacaaggcttgttatgtgattgtatgttggttgtgaagggcgtttgctttaaggcccacaagaatgtgctggccgccttttcacagtattttcggagcttgttccaaaactcctcgtcccagaagaacgacgtgtttcatttggacgtcaagaacgtctctggcatcggacagatcctcgattttatgtataccagccacttagatctgaatcaggataatatccaagtgatgctagatacagcacagtgtctgcaggttcaaaacgtgttatcattgtgccacacattcttgaagtccgccaccgtggttcagccaccgggcatgccatgtaattcaaccctgagtcttcagtccacacttactcccgatgcgacgtgttag

SEQ ID NO: 13831 - DNA, 747 bp, Artificial Sequence
  Description of Artificial Sequence: Synthetic coding sequence
atgcaaagaaaactggtgaagcaccgcattcggcacactggggaaagaccctactcctgctcagcctgtggcaagtgcttcggtggctcaggggacctgcggagacacgttaggactcacacaggcgaaaaaccgtatacttgtgaaatctgcaacaaatgcttcacacgcagcgctgttctgcgccggcacaagaagatgcactgcaaagcaggcgatgaatccccggatgtgcttgaggagctgtcacaggccatcgagacatccgacctggagaagagtcagtccagtgactctttctcacaggatacttctgtaacactgatgccagtcagcgtgaagctcccggtccaccctgtagagaactccgtggccgaatttgactcccatagtggcggcagctactgcaaactgcgatctatgatacagccacacggcgtaagcgaccaggaaaaactcagccttgatcctggcaagctggcgaaacctcagatgcagcagacccagcctcaagcatacgcctacagcgacgttgacacaccagccggaggtgaaccgttgcaggctgacgggatggcaatgattaggtcaagcctggcggccctggataatcatggcggcgacccacttggcagccgcgcgtcatcaaccacatacagaaatagtgaggggcaatttttctctagcatgaccctctgggggctagcaatgaagaccctacaaaatgagaacgaattagatcaatag

SEQ ID NO: 13832 - DNA, 2034 bp, Artificial Sequence
  Description of Artificial Sequence: Synthetic coding sequence
atggattttccaggacacttcgagcagatatttcagcagctcaattaccaaaggcttcacggacagctgtgcgactgtgtgattgtcgtgggaaatcgccattttaaggcccaccgctccgtcctagcagcctgctccacccactttcgggccctcttctcagttgctgaaggagatcagactatgaacatgattcagttggattctgaggtagttacagctgaggccttcgctgccctcatcgacatgatgtacacttccacgcttatgcttggggaatccaacgtgatggacgtcttactggctgcctcccatctccacctgaacagcgttgtgaaggcatgcaagcactatcttaccacccggaccctgcccatgtccccacctagcgaacgcgtgcaggagcagtctgcccggatgcaaaggtccttcatgttgcagcagctcggtctctccatcgtatcctccgcccttaacagttcacaaaacggagaagagcagcccgcccccatgtcttcttctatgagaagcaacctggaccaaaggaccccatttcctatgcggagactgcataaaagaaagcagtctgcagaggagcgagcccgacaacgcctgaggcccagcatagatgagtccgccatcagtgacgtcaccccagaaaatggaccttcaggagtccatagcagagaagaattcttttcccctgatagcctgaaaatcgtcgataatccgaaggcagacggaatgactgataaccaggaggactctgctatcatgttcgatcaatcctttggaacccaagaagatgcgcaagtgccctcccagtcagataacagcgccgggaatatggcccagctctccatggcctcaagggcaacccaggtcgagacctcattcgaccaagaggctgcgccggagaaaagtagctttcagtgtgagaaccctgaggttggtctgggggagaaagagcatatgagggtcgtcgtcaagagtgagcccctttcctctccagaaccgcaggacgaagtttccgacgtgacttcgcaagccgaaggtagcgagagcgtcgaagttgagggcgtcgtcgtatccgcagagaagattgacctctcccccgaatcatcagaccggagcttctccgacccacagtcttctactgatcgcgtgggtgatatccatatcttggaggttactaacaacctcgagcacaagagcacattctccattagcaactttttaaataagtcccgcgggaacaatttcaccgcgaaccagaacaacgatgacaacattccaaacaccaccagtgattgtaggctggaatctgaggcgccgtacctcctatctccagaggctggaccggcaggggggcctagtagcgcacccggctcccacgtggagaacccctttagcgaaccagcagactcacattttgtacgccccatgcaggaagtgatggggctgccatgtgtacagactagtgggtatcagggcggcgaacagttcggtatggatttcagcagatctgggctcggccttcactcttctttttcaagagtcatgattggatcgcctagaggtggggcgtctaacttcccttactaccgccgcatcgctcccaagatgcccgtcgtcacttctgtgcgatcttcgcaaattccggagaactccacttcgtcccagctcatgatgaatggagccacctcgagttttgagaatggccacccttcccagccaggacctcctcagctgacccgggcctccgctgatgttctgagcaagtgcaaaaaagcactgtcagagcataacgtgctcgtagtggaaggagccagaaaatacgcatgtaaaatctgctgcaaaacatttctaacgctcaccgactgtaaaaaacacatccgagtccacactggcgaaaaaccatatgcctgtctgaagtgcggaaaacgttttagccaatcttcccatctctacaagcacagtaagacaacatgccttaggtggcagtcttctaatcttccatccaccctcttgtag

SEQ ID NO: 13833 - DNA, 1275 bp, Artificial Sequence
  Description of Artificial Sequence: Synthetic coding sequence
atggcagctgagtctgatgtgctgcacttccagttcgagcagcagggagatgtggtgttacaaaaaatgaatctcctgcgtcagcagaatttattctgcgacgttagtatttatatcaacgataccgaattccaaggacacaaagtgatccttgcagcctgcagcactttcatgagggaccagttcctattaacacagagcaagcacgttcggatcactattctgcaatccgccgaggtagggaggaaactgctattgagttgctatactggcgctctggaagtcaagagaaaggaacttctcaaatacctaactgctgctagttatcttcagatggtccacattgttgagaagtgcaccgaggccctctcaaaatacctggaaatcgacctcagcatgaaaaacaacaatcagcacacagacttgtgtcagtcatctgacccagatgtgaagaatgaagacgagaactcggacaaggattgcgaaattatcgaaatttccgaggattcccctgtcaacatcgattttcatgtgaaagaagaggaaagcaatgccctccagtccaccgtggagagcttgacatctgagcggaaggagatgaagagtccagaactcagtactgtggacattggctttaaggacaacgaaatatgcattttgcatgtggagagcatctctacagccggcgttgagaatgggcagttttcccagccatgtacctcgagcaaagcaagcatgtatttctcggagacacaacacagcctgataaacagcactgttgaaagtcgtgtggccgaggtgccgggtaatcaggatcagggtctattttgtgagaacacggagggctcgtacggcaccgtatctgagatccagaatctagaggagggctacagtctgcgccaccagtgcccgagatgcccacgcggttttctgcacgtcgaaaattacctgagacacctgaaaatgcataagctctttctgtgcctgcaatgtgggaagacttttacccaaaaaaagaatcttaatagacacataagaggccatatgggcataagaccctttcagtgcacagtatgtctgaaaacattcaccgcaaaatctacactccaggatcacctcaacatacactctggcgaccgtccttataagtgccattgttgtgacatggacttcaagcataaatcagccctcaagaagcatctcacctctgtccacggaagatcatcgggtgaaaaactttcccggcccgatttaaagaggcagtctctgctttag

SEQ ID NO: 13834 - DNA, 1755 bp, Artificial Sequence
  Description of Artificial Sequence: Synthetic coding sequence
atggcgggaggagtagacggacctattggcatcccattccccgaccacagcagcgacattctgagtgggttgaacgagcagcggacccaaggattgctttgcgatgtggtgattctggtggaaggccgagaatttccgactcatcggagcgtcctggcagcttgttcccagtacttcaaaaaactgttcacttctggagctgttgtcgatcagcaaaatgtgtacgagattgatttcgttagcgcggaagcccttactgccctgatggattttgcctataccgcaacgctgactgtgtctacggctaatgtcggggacatcctgagtgcagctagactgctggaaattcctgccgtgagtcacgtgtgtgccgatctactggatcgccaaattttagccgccgatgctggggccgatgctggtcagttggatttagtggatcagatagaccagagaaacctgctacgagccaaagagtacttggagtttttccagagcaaccccatgaattccttgcccccagcggctgcagcagccgcggcgtcattcccatggagcgcattcggcgccagcgacgacgacttggatgccacgaaggaggctgtcgccgcagccgtggccgcggtcgcagctggagactgcaacggcctggacttttacggtcctggccccccggcagagcgcccccccactggagacggggatgagggggatagtaaccccggattatggcccgagcgcgacgaagatgcaccaactggcggccttttcccgcccccagtagcccccccggccgcaacacagaatgggcattacggacggggcggggaggaggaggcagcgtccttgtcagaagcggctccagagccaggtgacagcccggggtttctctctggggctgctgagggtgaagacggagatgggcccgacgtcgacggcctggccgcatcaactctacttcaacaaatgatgtcaagcgtcggccgcgctggagcagcggctggagatagcgacgaggagtctagagccgacgacaagggagttatggactattatctgaagtacttttctggagcccatgacggggatgtataccccgcctggtctcagaaagtggagaaaaagatacgggctaaggctttccagaaatgccccatctgcgaaaaggtaatccagggagcagggaagcttcctcggcatatacggactcacacaggcgaaaagccatacgagtgtaacatctgtaaagtgaggttcactcggcaggacaaactcaaagtgcatatgcggaaacatacaggagaaaagccctatctgtgccagcagtgcggcgcggcatttgcccataactatgatctgaaaaaccatatgcgagttcacactggcctgagaccctatcagtgtgatagctgctgtaagacattcgtgcgaagcgatcacctgcacagacacctaaaaaaagacggttgtaacggggttccttcccggagaggaaggaaacccagagttcgtggaggcgccccggatccctcccctggggcaacggcgacacctggagcacctgctcagccctcatctcctgacgctcggcgcaacgggcaggagaaacactttaaggacgaagacgaagacgaggacgtagcgagcccagatggtctgggtcgtctgaatgtggctggagccgggggcggaggcgacagcggggggggccccggagctgccaccgatgggaatttcaccgcaggcctcgcctag

SEQ ID NO: 13835 - DNA, 1620 bp, Artificial Sequence
  Description of Artificial Sequence: Synthetic coding sequence
atggggtcccccgaggacgacctgatagggatcccctttcccgatcattcatccgaactgctcagttgtctgaatgagcagaggcagctaggtcatttatgtgacctgacaatcagaacacaaggtctggaatatcgaactcacagagcagtcctggcggcatgtagtcactactttaaaaagttgttcacggaaggcgggggtggggcggtgatgggcgcaggcggttccgggacagccacgggaggagctggggctggggtgtgcgagctggactttgttggaccagaagcacttggtgccttgctcgaattcgcttataccgcaactttgacgacatccagtgccaatatgcctgcagttttgcaggctgcccgactgctcgagattccctgtgtcattgccgcatgtatggagatactccaaggcagtggcctggaggccccgtctcctgacgaagatgattgtgagagggcaagacagtacttggaggcgtttgccacggctaccgcctccggtgtccccaatggcgaggattccccccctcaggtaccactaccaccccctccaccccccccccccaggcccgtggcacggcgaagtcgtaaacctcggaaggcttttctgcagaccaagggggcgcgggccaaccacttggtgcctgaagtcccaactgttcctgcacatcctctgacctacgaagaggaagaggtggccggaagggtcggaagctctggtggaagtggccccggcgatagctactctcctccaaccggaaccgctagtccaccagagggcccacaatcttacgagccatacgaaggggaggaagaagaggaagaattggtctatccacctgcatacggcctggcccagggcggaggacctcccctaagcccagaggagctgggttccgatgaagatgccatcgaccctgatctcatggcatacttatctagcctccaccaggataatttggcacctggcctcgactcgcaggataaactggtgcgtaagcggcggtcacagatgccccaggaatgccctgtctgtcataagatcattcatggggctggtaagctcccacgccacatgcgcacgcataccggtgagaaaccatttgcctgcgaggtgtgtggggtgcgattcacgcgcaacgacaagctgaaaatccacatgaggaagcacaccggcgaacggccgtattcctgcccccattgcccagctagatttcttcattcatacgatttaaagaatcacatgcacctccacaccggcgatagaccttacgagtgccacttgtgtcataaggcctttgcaaaagaggaccatctccagagacaccttaagggccagaactgtctggaggtgagaactagacgacggcggaaagatgatgcccccccacactacccccccccttctaccgctgccgcttctccagctggccttgacctttccaatggccatctggacacttttcgcttgtcccttgccagattctgggagcagagcgcgcccaccgggccccccgtaagcaccccagggccacctgacgacgacgaagaggaaggcgctcccaccacccctcaagcggagggggcaatggagtcaagctag

SEQ ID NO: 13836 - DNA, 1620 bp, Artificial Sequence
  Description of Artificial Sequence: Synthetic coding sequence
atggggtccccggaggatgacctgataggaatcccctttcccgaccactcttccgaattattatcctgcctgaatgagcagcggcagctgggccatctatgcgacctcacaatcagaactcaggggcttgaatatcggacccaccgggctgtgttagcagcttgcagtcattatttcaaaaaactgttcactgaaggtggcgggggtgctgttatgggggctggcggatcaggtactgctaccggcggggccggagcaggggtgtgcgagctggacttcgtgggtcccgaagccctgggcgccctgctggagtttgcctacactgcaacactgaccactagctctgctaatatgcccgccgtgctgcaagccgctaggcttctcgagattccctgtgttatcgcagcctgtatggaaattttgcaggggagtggtctggaggcaccctctcccgatgaagacgattgtgagagggctagacaatatttggaagcatttgccaccgctaccgcttctggggtgcccaatggagaagacagccccccccaggtgcctttgccaccaccacctcctcctcccccccggcctgtcgcacgacggtccagaaagccaaggaaggctttcctccagacaaaaggcgcccgcgcaaatcacctcgtgccagaggtgccaaccgttccagcacaccccctaacatacgaggaagaagaggtcgccgggcgagtaggttcttccggcggtagtggccctggagatagctattcccctcctacaggtaccgcaagcccgccagaaggaccccaatcctacgaaccctatgagggcgaggaggaggaggaagaactcgtgtatccgcccgcgtacgggctcgcacagggtgggggacctcccctgtctccagaggagctgggcagcgacgaggacgccattgatccagacctgatggcctatctcagcagtctgcaccaggacaacctggcccctgggctcgattcccaggacaagttggtaagaaaacgaaggtcacaaatgccgcaggagtgccccgtgtgtcacaaaattatccacggggctgggaaactgccccgccatatgcgcacacacactggggagaaacccttcgcctgtgaggtgtgtggcgtgcggtttactcgcaacgataagcttaaaatccacatgcggaagcacacaggggaaaggccatattcttgtcctcactgtccagcgaggttcctccacagttacgatctgaagaatcacatgcatttgcacacaggcgaccggccttacgaatgccatctttgtcataaggccttcgcaaaagaagatcatctccaacgacacctcaaggggcagaattgcctggaggtcaggacgcggcgacgcagaaaagacgatgcccctccgcattacccaccgccttccacagccgcggctagccccgccggcctggatctgtcaaatgggcacctggacactttcaggctgtctctggcaaggttttgggaacagtcagcacctacaggccctcctgtgtccacccccggccctcccgacgacgacgaggaagagggtgcccctaccactccacaggcagaaggagccatggagtcaagctag

SEQ ID NO: 13837 - DNA, 1722 bp, Artificial Sequence
  Description of Artificial Sequence: Synthetic coding sequence
atgctccaacccggccctcatcccccatccccgcaggccgctgcccctggcgaggcctggccagggccgtcacaggcaccgtggcagtctctggaggagaagatggggtcgcctgaagacgacctcatcgggattcctttcccagaccactcatcagaacttctcagttgtttaaacgaacagaggcaactggggcacctctgtgatttaacaatccgcactcagggtttagaataccgaacgcatagggcggtcctcgcagcctgcagccactacttcaagaagctcttcaccgagggcggcggtggggcagtcatgggcgccggcgggtctggaaccgctactggaggggcaggcgctggggtgtgtgaactcgattttgtcggccctgaggccctcggcgctctcctggaattcgcatacactgcgactttaacgacttcctcagctaatatgcccgctgtactgcaagccgcccgactgctggaaatcccctgcgtcattgcagcctgtatggagattctgcaggggtcagggctggaggctccaagccctgacgaggacgattgcgaacgcgcacggcagtacctcgaggcttttgcgaccgcaaccgcaagtggggttcccaatggcgaggacagtcctccacaggtaccattaccgcctcctccaccaccgccacctcgtccagtcgcccgcaggtctcgtaaaccacgcaaggcattcttgcaaaccaagggcgccagggcaaaccaccttgtccccgaggtccctaccgtgcctgcacatcctctcacgtacgaggaggaggaagttgccggaagagtgggttcaagtggaggctctggccccggcgactcctattctcctcctaccggcacagcttctccaccagagggacctcaaagctacgagccttatgaaggggaagaagaggaggaggaattagtatatccccccgcatacgggttagcccagggtgggggacctcccttgtcccccgaagaattggggtctgacgaggacgctattgacccagatctaatggcatacctgtcctcgctacatcaggataatcttgctcccggactcgacagccaggataaattagttcggaagaggcgatcacagatgccacaggaatgtcccgtgtgccataagattatccacggagccggaaagttaccaagacacatgaggacccacaccggtgagaaaccattcgcttgtgaagtgtgcggtgtacgctttacgagaaatgacaagctgaaaatacatatgagaaaacatactggtgaacggccttacagctgccctcactgcccggcgcgttttctgcacagctacgacttgaagaatcacatgcatctgcataccggggacaggccctacgaatgtcacctctgtcataaggcctttgccaaggaggatcacttgcagaggcatctgaagggacaaaactgtctggaagtgcggacacggcggcggcggaaagacgacgcccctccccattatccccccccaagcacagcggccgcttcgcccgccgggcttgacctctctaatggtcacctggacacatttcgactgagcctcgcgcgattttgggaacagagtgctccaaccggtcccccagtgagcacgcctggacctcctgatgacgatgaagaagaaggcgcaccgacgaccccacaggcagagggcgccatggaatcctcctag

SEQ ID NO: 13838 - DNA, 1620 bp, Artificial Sequence
  Description of Artificial Sequence: Synthetic coding sequence
atggggtcacctgaggacgaccttatcggtattccattcccagaccacagctcagaactgttgtcttgtttaaacgaacagaggcagctggggcacttatgcgacttgaccatacgaactcagggattggaatacagaacccatcgcgccgtcctggctgcttgtagccactacttcaagaagctcttcaccgaaggcggcggaggagctgttatgggagcggggggcagtggcactgccaccggaggcgctggagcaggcgtgtgtgagcttgattttgtggggcctgaagccttgggggccctccttgagtttgcttataccgccacactgacgacatcctctgccaatatgccggcggtgttgcaggccgctcgacttttggagatcccgtgtgttatagccgcctgtatggaaatccttcaggggagcgggctcgaagctccatcccccgatgaggacgactgcgaaagggcacggcagtatctcgaagcttttgctaccgccaccgcatcaggcgtgcctaatggggaagacagtcctccacaggtaccactcccacccccacctccacccccgcccaggcctgttgcccgccggtccaggaaacctcgaaaagcgttcttacagactaagggtgcccgcgctaaccacctcgttccagaagtgccgacagtgcctgcccatcccctcacctatgaagaggaggaggtggctgggagggtgggatcttcaggaggcagtgggccaggagattcttatagcccaccaacagggactgcaagtccgcctgaaggcccacaaagttacgaaccctacgaaggcgaagaggaggaagaggagctcgtctatcccccagcatatggccttgcgcaaggggggggacctccactgtctcccgaggagcttggttcagacgaggatgctattgaccctgacctcatggcgtatttgtctagcctgcaccaagataatcttgctccaggcctcgatagtcaggacaagctggtgcggaagcgccgcagccagatgccacaagaatgtcccgtatgccataaaatcatccacggagctggtaagttgcccagacacatgcgaacacacacaggcgagaaacctttcgcctgcgaagtgtgcggagtgaggttcacacggaatgacaaactcaagatccacatgcggaagcacactggtgagaggccttattcctgcccacattgcccggctcggttcctccactcctatgacctgaaaaaccatatgcatctgcatacgggagatagaccttacgagtgccatctttgccataaggcattcgccaaagaagaccacctgcagaggcacctcaaggggcaaaactgcctggaagtccggactcggcggcgccggaaggacgacgcccccccacactatccccccccgagcactgcagccgcgagccctgccggcttggatttgtccaatggccaccttgacacattcaggttgagcctagcccggttctgggagcagtccgctccaaccggacctcccgtcagtactcctggcccaccagatgatgatgaggaagaaggtgcccccacaacaccacaggccgagggggctatggagtctagctag

SEQ ID NO: 13839 - DNA, 1023 bp, Artificial Sequence
  Description of Artificial Sequence: Synthetic coding sequence
atggagatcagctcccaccagagtcacctccttcagcaactcaatgagcagcggcgccaggacgtgttttgtgactgctctattctggttgaggggaaggtctttaaagcacatcgaaatgtcctcttcgcaagttctggatacttcaagatgctactgtctcagaattctaaggaaacttctcagcccacgaccgccacgtttcaggccttctcaccggatacatttacggtcattttggactttgtgtactccggaaagctatctctgactggccaaaacgttatcgaggtcatgtctgctgcctctttcctacagatgaccgatgtaatcagcgtctgcaaaacattcattaaaagcagcctcgacatttctgagaaggaaaaggatcgctacttctctctgtccgacaaggatgctaactctaatggcgtggaacgaagcagtttctatagcggcggatggcaggagggtagtagctcccccaggtcacacctctctccagaacaagggactggaatcatcagcggcaagagctggaataaatacaactatcatccagcctcccagaaaaacacccagcagcccctggctaaacacgaaccccggaaggaaagcatcaagaagaccaaacatctacgcttatctcagcctagtgaggtgacgcactacaagtcttctaagagggaggtgcgaacctctgacagttcatcgcacgtgtcacagtctgaggaacaagcacagatcgatgcagagatggatagcacccctgtcggataccagtacgggcaagggtccgatgtcacctcaaagtcattccccgacgatcttcccagaatgcgctttaagtgcccctactgcacccatgtcgtcaagcggaaagcagatctgaagagacacttgagatgccacaccggcgaacgaccatacccttgccaggcctgtggaaagagattttcacgcctggatcacctgagtagtcattttcgaactatggaaatccggattcccgatggtacatag

SEQ ID NO: 13840 - DNA, 1326 bp, Artificial Sequence
  Description of Artificial Sequence: Synthetic coding sequence
atggaaatatccagtcaccagagccatctcctacagcaactgaacgagcaaagacgccaggatgtattctgcgattgctctattttggttgaaggtaaagtcttcaaagcccatagaaacgtgttatttgctagtagcggatactttaagatgctgttgtctcagaattctaaagaaacctcccagcccaccaccgcaacatttcaggccttctccccagatacctttacagtgatcttggacttcgtgtactcaggaaaacttagcttgaccggtcagaacgtcatcgaggtcatgtcagctgcaagttttctacaaatgactgatgtgatatctgtgtgcaaaacttttatcaagtccagtctggatatttccgaaaaggaaaaagaccgctatttttccctttcagacaaagacgcaaactctaacggggtcgaaagaagttccttctactcaggggggtggcaggaagggagttcctctcccaggagtcaccttagccctgaacaaggcaccggaattatatctgggaagagctggaacaagtacaattaccatcctgcaagccagaagaatacacaacagcccctggccaaacacgaacctagaaaggagagtattaagaagacaaagcatctgcgcttatcccaaccgtctgaggtgacccactataaaagttcaaagagggaggtccgcacctcagactcgtctagtcacgtgtctcagtccgaagagcaagcccagatagacgcagagatggatagcaccccagtgggctatcagtacgggcaaggttcggatgtcactagtaaatcctttcccgatgatctcccccggatgcggtttaaatgtccctattgtacacacgtggtgaaaagaaaggcagatcttaaacggcatctgcgatgtcacaccggcgagaggccatacccctgccaggcgtgcgggaagcgcttctccaggctagaccatctgtcctcgcacttccgcaccatacatcaagcctgcaagctgatttgccgaaaatgcaagcgtcacgtgaccgacctcacgggccaggttgtccaagaagggacaaggcgttatcgcttgtgtaacgaatgtctggcagagttcgggattgactcgctgcccatcgacctggaagccgagcagcacctgatgagccctagcgacggtgataaggatagcagatggcacctcagtgaagacgaaaatagatcatacgtcgagatcgtcgaagatgggtctggagacctggtaatccagcaggtggatgattccgaggaagaagaagaaaaagagattaagcccaatatcagatag

SEQ ID NO: 13841 - DNA, 1488 bp, Artificial Sequence
  Description of Artificial Sequence: Synthetic coding sequence
atggagatgcagtcgtattatgcaaaactgttgggtgagctaaatgaacagaggaagcgcgattttttctgtgactgcagcattatcgttgagggcaggatttttaaggcccacagaaatattttatttgccaactctggatatttccgcgccctcttaatccattacatccaggacagtggtcgacactctaccgcatccctcgacattgtcacttccgacgcttttagcattatcctggacttcctgtattccgggaaactggatttgtgcggtgagaatgttattgaggtgatgtctgccgcgagctacctccaaatgaatgacgtcgtgaacttctgcaagacctacattagatcttccttggatatctgtcggaaaatggagaaagaggctgcggtggccgcagccgtggccgcggcggccgctgccgccgctgctgctgcggctgcagcagcccatcaggtggacagtgagagcccatcgtcagggcgggaaggcacatcgtgcgggacgaagagcttggtctcctcacccgctgaaggtgaaaagtcggttgaatgcctgcgcgagtctccctgcggagactgcggcgactgccaccctctggagctcgtggtgcgagacagcctaggcggcgggagcgctgactccaatttatcaacaccacccaaacggatagagcctaaggttgaattcgacgctgatgaagttgaagtcgacgttggagagcagctccagcagtatgccgcacctctgaatctggcccacgttgaggaggcactgcctagcggacaggccgtggatctggcttatagcaattaccatgtaaagcagttcctggaagcactgcttaggaatagtgcagcccctagtaaagacgatgctgatcatcacttttcacgatctctggaggggcgcccggagggcgccggggtggctatgtcttcaatgatggacgtgcaggcagattggtatggcgaagactctggagatgtgcttgtggttcccattaaactccacaaatgccccttctgtccatacacagcaaaacagaagggcatcctcaagcgtcacatccgcagtcacactggcgagaggccatacccttgtgaaacctgcgggaaacgatttacacgccaggagcacctgagaagccatgccttaagtgtccatcgctctaatagaccaatcatctgcaagggttgcagacgcacctttaccagtcacttgtcacagggtctacgacggttcgggctgtgtgattcttgcacctgcgttacggacactcccgatgatgacgacgacctgatgcctataaacttgagtctcgtggaggcctctagcgaaagccaagaaaagagcgacactgataatgactggccaatctacgtcgaatctggggaggaaaacgacccagctggcgatgactccgatgataagccacagattcaaccaaacttgagcgaccgggagacactgacctag

SEQ ID NO: 13842 - DNA, 1422 bp, Artificial Sequence
  Description of Artificial Sequence: Synthetic coding sequence
atggagactcccacacccctgccccccgtaccagcttctccaacatgtaatcccgctccccgcaccatccagatagaattccctcagcactcttcctcgctcctggagtccctgaatcgtcatcggctggaaggaaagttttgcgacgtgtcactgctcgttcagggcagagagttgcgagctcataaggccgtgttagcagcagcctcaccatattttcacgacaagttgctgctgggtgatgctccccgcctgactctgccttcggtgatcgaagctgacgcattcgagggcctcctccagctgatttatagcggacggctccgattgcctctggatgccttgcctgcccacctcctcgtagcaagcgggctacagatgtggcaggtcgttgaccagtgttctgaaatcttgagggaattagagactagcggtggcgggatctcagcacgaggcgggaactcttaccacgctctcctgagcacaacaagctcaacagggggctggtgtatcagatcctccccattccagaccccagtccagagtagcgcatctacagaaagcccggcttccacagagagtcccgtcggaggcgaggggtcagagctgggtgaagtgctgcaaatacaggtagaggaggaggaagaggaggaggaggatgatgatgacgaggaccaaggctccgcgactctgagtcagactcctcaaccccaacgagtctccggagtcttcccacgacctcatggccctcacccgctgccgatgaccgccacccctagaaaactacccgagggtgagtctgcacccctagagctaccagccccccctgcacttccccccaagattttttatatcaagcaggaacctttcgagcctaaggaagaaattagtggttccggcacccaaccaggaggggccaaggaagagacgaaggtgtttagtggaggagacacagagggcaatggggagctgggctttttgctcccgtccggacctggaccgacatctggcggcggcggaccttcctggaagccagtcgatcttcatggcaatgaaatactctctggaggaggaggtcctggcggggcaggacaagccgtccacgggcccgttaaactcgggggaacaccaccggcggacggcaaacgctttggctgcctttgtggcaaacgcttcgctgtgaagcccaagcgcgatagacacattatgctaacattctctttgaggcctttcggctgcggaatctgtaacaagaggttcaaactgaagcaccacttaaccgaacacatgaagacgcacgcaggagcgttgcatgcgtgccctcactgcgggcgccgatttcgggtccacgcctgctttctacgtcatcgggatctctgtaaaggacagggatgggccactgcccactggacatataaatag

SEQ ID NO: 13843 - DNA, 1422 bp, Artificial Sequence
  Description of Artificial Sequence: Synthetic coding sequence
atggagaccccaaccccattaccgccagtgcccgccagtccaacgtgcaaccccgcacctagaaccatccagatagagttccctcaacattccagctctctgctggaaagccttaatagacataggctagagggcaagttctgtgatgtttccctcttggtacaaggacgtgagctcagggcacacaaggcggtgttggccgccgccagcccatacttccatgacaagttgctcctgggtgatgcaccaaggctgacacttccttctgtgatagaggcagacgcctttgaggggctcttgcagctgatatatagcggccggctgagactgcccttggacgcactgccagcacatctgctggttgcatccggtttgcagatgtggcaggtggtagatcagtgttccgaaatcctcagggagttagaaacttccggcggtggcattagcgctaggggcggcaacagttatcatgcgttgcttagcactacctctagtactggcggttggtgcatcagatcatcgccctttcagactccagtccaaagttccgcctccacagaaagcccggctagcacagagtctcccgtgggtggggagggaagcgaactcggcgaagtgcttcagatacaggtcgaggaggaggaagaagaagaggaggacgatgacgatgaagaccaaggttccgcgacactgtcacagaccccacagccgcagagggtaagcggcgtcttccctcggccacatgggccgcacccccttcccatgacagctactccgagaaaactgccagagggcgaatccgctcccctcgagttgcccgcccctcctgctctcccccccaaaatcttctacatcaagcaggaaccatttgagcccaaggaagagattagcggttccgggactcagcctggtggcgccaaggaagagaccaaggtgttctcaggcggcgacacggagggaaacggggagctcggcttcttattgccatccggcccaggacccacctctggcggggggggaccctcctggaaacccgtggatctccatgggaacgagattctcagtgggggcggaggtccagggggtgccgggcaggccgttcacgggccagtgaagctgggagggacaccacccgccgatggaaaacgtttcggatgcttgtgcggtaagcgatttgctgtgaaacccaaaagggacagacacattatgttaactttcagcctgcgtccttttggctgtggaatatgcaataaacggttcaaactgaaacatcatctcaccgagcacatgaaaacccatgcgggggcactgcatgcatgtccccactgcggccgaagatttcgggttcatgcgtgctttctgcggcacagggatctctgtaagggtcagggttgggccactgcacattggacctacaagtag

SEQ ID NO: 13844 - DNA, 1227 bp, Artificial Sequence
  Description of Artificial Sequence: Synthetic coding sequence
atgctccctcgtcctaaagcccctgcctcccctcgacgtccacaaacccccacgcccagtgaacaggacgccgacccgggacccgcttctccccgggatacagaagcccagcggctccgatttcgccagttccagtaccacgtggcgagcgggccgcaccttgccctggggcagctatggactctgtgtcggcaatggctgagacctgaggcccgatccaaggagcaaatgcttgaactcttagtgctggagcaatttctgggagcacttccaagcaagatgagaacctgggtccagtcacagggcccaaggagttgccgcgaagccgcttcactcgtggaagatttaacccagatgtgtcagcaggaagtcttggttagtttggattccgtggagccacaggattggtcctttggcgaagaagaagacggcaaaagtcctcggtcccagaaagagcccagccaagcatccgaactgatcctggatgcggtggccgctgcgcccgccctgcctgaggaaagcgaatggctggaaacaacacagctgcagcagtcacttcacacacgggcagaagccgaggccccacgggcgcccggtctgctgggctcgagagccagactgccacttaagccttcaatatgggatgaacctgaagaccttttagctggccctagttcggacctgcgggcggaggggaccgtgatcagctcccctaaagggccatcagcacagaggatctcccctagacgacgcaatagaaatactgaccagtctgggagacaccagcccagtctgaagcacaccaaaggaggtacccaagaagctgtcgcaggcatcagtgtcgtacctcgagggccacgaggcggaaggccattccagtgtgctgattgtggcatggtatttacctgggtgacacacttcatcgaacaccagaagactcaccgagaggagggcccgttcccctgcccagagtgcgggaaagtcttcttgcataattccgtcctgaccgaacacggcaagatccatctgctcgagccgcccagaaagaaggcccctcgttccaagggacctagggaatccgtgccacctagagatggggctcagggacccgtcgcgcctcgctcccccaagcggccttttcagtgttctgtctgcgggaaggctttcccctggatggttcatttgattgaccatcagaaactgcacacagcccatgggcacatgtag

SEQ ID NO: 13845 - DNA, 537 bp, Artificial Sequence
  Description of Artificial Sequence: Synthetic coding sequence
atgctccctcggcccaaggctcctgcatcacctcgaaggcctcagactcccaccccctccgaacaggatgccgaccctggcccggcttcgcccagagatactgaagcccagcggcttcgcttccgtcagttccagtaccatgtagcttctgggcctcatctggccctgggccagctgtggacgctttgccgccagtggctgcgtccagaggcccgatctaaagaacaaatgttggagctcctcgtcctggagcagtttctgggggccctcccttccaagatgagaacctgggttcagtctcaaggtcctcggtcttgtagggaggcagcttcgttagttgaggatctcacccaaatgtgccaacaggaaggtgagaggcggcggctgcccgcgccagggcgtgcccgaggccctgatgtgagcgaagatcggactgcattgctgcctgcacatattgcccctacgccagctcgccccttgcccacctccaagcccctactacccaggggttgcgtgtttaattatttctatatctag

SEQ ID NO: 13846 - DNA, 2178 bp, Artificial Sequence
  Description of Artificial Sequence: Synthetic coding sequence
atgggtcctagagcatccttgagtagactgcgtgagctctgcgggcactggctgcgaccagccctgcacaccaaaaaacaaatcctggagttgctggtactcgaacagtttctttccgtgctgcctccgcatctactgggcagactgcagggacagccacttcgcgacggagaggaggtggtgttgctactcgagggcatccatcgagaaccgtcacacgcaggaccacttgatttttcatgcaatgctggaaaaagctgcccacgggccgacgtcactcttgaggagaaaggctgcgcctcccaagttccctctcatagtccaaaaaaggaactgcccgccgaagaaccttctgtgctggggcctagcgatgagccccccagaccacaacctcgcgctgcgcaacccgccgagccagggcagtggcggctgcctccctcttcaaaacaacctctgagccccgggccacaaaagacctttcaggccttacaggaaagttcacctcagggccctagcccttggcctgaagagagctctagggatcaggagttggccgcggtgctggagtgtctgacattcgaggatgtcccagagaacaaagcatggcccgcccaccctctcggcttcggatccagaacaccagacaaggaagaattcaagcaggaagaacctaaaggagccgcctggcccacaccgattctcgccgaaagccaggcagacagtcctggcgtgcccggggagccatgtgctcagtccctcggtcggggggccgccgccagcggccctggagaggacggttcactgctgggttccagcgaaatcttggaagttaaagttgccgagggcgtgccagagcccaaccccgagctccagttcatctgcgccgattgtggagtgtcattcccccagctctcaagactcaaagcacatcagctgagatcacatcccgctggccggagttttctctgtctctgttgcggcaaatccttcggcagaagttccatcctgaagttgcatatgaggactcatacagatgagagacctcatgcttgtcatttgtgcggacaccgtttcagacagagcagccatctctcaaaacacctgctgacacattcttccgagcctgcatttctctgcgccgaatgcggacgaggatttcagaggagggcttcgctggttcaacacctgttggcccatgcgcaggaccagaagcccccctgcgcaccggagtccaaagctgaagcgcccccccttactgacgtcctgtgctcccactgcgggcagtcattccagagaaggagttccttgaagcggcacctcaggattcacgctcgggataaagatcgtcgcagcagcgaggggtctggaagcaggcggcgggattctgaccgtcggccttttgtatgctctgactgcggaaaggcgtttaggagatctgaacacctggtggcccataggagggtgcacaccggagaacgacctttttcctgtcaggcgtgcgggcgcagctttacccagagctcccagcttgtgtcccaccagcgagtacacactggcgagaagccgtacgcgtgcccgcagtgtgggaaaagattcgttaggcgggcctccctggcccgccacctgctaacacatgggggaccacggcctcaccattgcacccagtgtgggaaaagcttcggtcagactcaggacctcgcaaggcaccagagatctcataccggagagaaaccgtgtaggtgttcagaatgtggagagggcttctctcaaagcgcccacctcgcgcgccaccaaaggatccatacaggtgaaaaacctcacgcttgcgatacctgcggtcatagattcagaaattcctcaaatctggccaggcacagacggagtcacaccggggagcgaccttattcatgccagacatgtggaagatcatttcggaggaacgctcatctcaggagacacctggccactcacgccgaaccaggacaagagcaggccgaaccccctcaagaatgtgtggaatgtgggaaatctttctctcgaagctgtaacctgttgaggcacctcctcgtgcataccggtgcgagaccctacagctgtacgcagtgcggtaggagtttctctcgcaattcacatctgttgcgacacctccgcactcacgccagggagactctgtactag

SEQ ID NO: 13847 - DNA, 1977 bp, Artificial Sequence
  Description of Artificial Sequence: Synthetic coding sequence
acacgcgtccaggcagaagcaaggggcgggagtcctgccgtgcagatgttgcctgtgtctggcggccacggcgcgaccggtgttccggagcccgcccccggtgcactgcgtcctcttgccgcagcgggatcagcacatcaagaaacagaccccggggccgcgggtgccggagccgttccggagtgtgccgcatctgctcctccaggacctcctgccggcgccgcggctcagggatggggcggcggcggagccgccgcgcgaggccacccacccggcgcacaaccacgcggtgcagcaggcccccaggggccatctccctggccggaggagtcatcccgcgatcaggaactggctgctgtgctggaatgtttgaccttcgaggacgtcccagagaacaaagcgtggcccgctcatcccctcggctttggcagtaggacgccggataaggaggaatttaagcaagaggagcctaagggcgcagcgtggcccacccccatcctcgctgaatcccaagccgacagtcccggcgtccccggggagccgtgcgcccaatctttggggagaggtgctgccgcaagtgggccaggtgaggacggctccctgcttggtagctccgagatactggaagtgaaagtcgccgaaggtgttcctgagccaaacccagagctccagttcatttgcgccgattgtggggtgagcttccctcaactatcccgcctgaaggcccaccagcttagatcccatccagccggccgcagtttcctctgcctctgttgtggcaagtcattcggtagaagcagtattctaaagctccacatgcggacccatacagatgaacgtcctcacgcatgtcacttatgcggacataggttcagacaatcttcacatctttccaagcacctcttgacacattccagtgagccggcattcctctgcgctgaatgcggacgtgggtttcagcgccgcgcgagcctagtgcagcatctgctggcccatgcccaggatcaaaaacctccctgcgcgcctgagagtaaggcagaagcgccaccactcacagatgtcctttgctcccactgcggacagtcttttcaaaggagatcttctctcaaaaggcatctgagaattcacgctagggataaggatagacgttccagcgagggaagcggctcacggcgcagggattcggacaggagaccatttgtatgctccgactgtggtaaggcattcaggagatccgagcatttggttgcccaccgcagagttcacacaggcgaacggccgttctcgtgccaggcctgcgggcgatcctttacccagtcctcccagttagtgtcacaccaacgtgttcacacaggggaaaagccatatgcatgtccccagtgcgggaaacgctttgtcagacgagcttcactggcccgacacctgcttacacatggaggccccaggcctcaccattgcacccagtgcggcaagtctttcggacaaacacaagacctggccagacaccagagatctcataccggtgagaagccctgcagatgctcagagtgcggcgaggggttcagccagtccgcacatcttgctaggcatcaacgaatccacacaggcgaaaaaccacatgcctgcgatacctgcggacaccggttccggaactcatccaatcttgctcgccataggagatcgcatactggcgaacgcccatactcatgccagacctgcgggagatctttcagaaggaacgctcatttgagaagacatctcgctactcatgccgagcccggccaagaacaggctgaacccccccaggagtgcgtggaatgcggcaaaagctttagtagaagctgtaatcttctgcgtcatctgctggttcataccggggcccgcccttactcttgtacgcaatgcgggagatcgttctcccgaaatagtcatctgcttcgccatctgagaacgcacgccagagagacactttactag

SEQ ID NO: 13848 - DNA, 1047 bp, Artificial Sequence
  Description of Artificial Sequence: Synthetic coding sequence
atgaccacggccctggagcctgaggatcaaaagggacttttaatcatcaaggctgaggatcattactggggtcaggactcctcgagccaaaaatgtagcccacaccgccgtgagctatataggcagcatttccgcaagctctgctaccaggacgcaccagggccacgtgaggcgctaacccaattatgggagctgtgtcgccagtggttacgccctgagtgtcacacaaaggaacaaattctggatttgctggtgctggaacagttcctgtcaattctcccaaaggatctccaggcatgggttcgagcacaccatccagagaccggtgaggaggcagtgactgtgctcgaggatctcgagcgggagttggatgagccaggcaaacaggtcccaggtaactctgaaaggcgtgatatattaatggataaactggcccctttggggcgcccatacgaatcattgactgtgcagcttcacccgaagaaaactcagctcgaacaggaagcgggaaaaccacagcggaatggtgataaaactcggacaaagaacgaggagttatttcagaaagaagacatgcccaaagataaggagtttttgggggaaatcaacgaccggttgaacaaggacacaccccaacacccaaagtctaaagatataattgagaacgaagggcgatccgagtggcagcagcgagagcgcagaaggtacaagtgcgacgaatgtgggaaaagctttagccactccagtgacctctcaaagcatagacggactcatactggagagaagccctataagtgtgacgagtgcggcaaggctttcatccaaagatctcacctgataggtcaccatcgggttcacaccggcgtgaagccctacaagtgtaaagaatgtggaaaggacttcagcggccgcacaggtcttatccagcatcagagaatccacacaggggaaaagccatacgaatgcgacgaatgtggcagacccttccgggtgagctccgcccttataaggcaccagcgaatccacaccgctaataaactgtattag

SEQ ID NO: 13849 - DNA, 1533 bp, Artificial Sequence
  Description of Artificial Sequence: Synthetic coding sequence
atgctccctcttgagaaggcattcgcctcacccagatcctcacccgcccctccagatttgcctacaccaggatcggctgccggcgttcagcaggaagaaccagaaaccattccagagagaaccccagctgatctggagttttctaggctgcgttttagggaattcgtctaccaggaggcggccggaccccaccagacactggcgcggctgcacgagctttgcaggcagtggcttatgccagaggctcgctccaaggaacagatgttagagttgcttgttttagaacagttcctgggcatactcccagacaaggtgagaccgtgggtggtcgcacaatatcccgaatcctgtaagaaagcagcgtcgctggtcgagggcttggctgacgttcttgaggaacctggaatgctcctgggcagccccgctggtagttcatcaatcctgagtgacggtgtttatgaacgccacatggacccactgctgctcccaggggagctcgcttctccctctcaggcactgggggccggcgagattcctgccccctcagagactccctggctgtctcccgatccacttttcttggaacaacgcagagtgcgcgaagctaagactgaggaggacggacccgcgaatactgaacaaaaacttaagtctttccccgaggatcctcagcatctaggagaatggggccatctggaccctgccgaggagaacttgaagtcttaccggaagctgctgttatggggctaccagctctcccagcctgacgcggcctctaggctggatactgaagagctgaggctggtggagagggatccccaaggctctagcctgcctgagggcggacgacgtcaggagtcagctgggtgcgcctgcgaagaagccgcacccgcgggggtgttaccagagctgccaaccgaagcccccccaggggatgcgcttgctgatcctccatcaggtaccacagaagaggaggaagagcagcccggaaaagcccctgatcctcaggatcctcaggacgccgagtccgattctgctacgggaagccaacggcagtcggtgattcagcagcccgccccggacaggggcactgccaagctggggactaaacggccacaccccgaggacggggacggacagtccctagaaggtgtaagttcctccggtgacagcgctggccttgaagccggtcaggggcctggtgccgatgaaccggggctctcgcggggaaaaccttacgcctgtggagagtgtggtgaagctttcgcctggttgtcacacctcatggagcaccactcctctcatggcgggcggaagaggtacgcctgccagggctgttggaaaacgtttcacttcagcctagctttagcagaacaccagaagacccacgagaaagaaaaaagctatgccttgggtggcgctcgaggacctcagccttcgacgcgggaagctcaggcgggcgctagagctggggggccgcccgagtcagtggaaggagaggctccacctgcaccacccgaggcccagcgatag

SEQ ID NO: 13850 - DNA, 1125 bp, Artificial Sequence
  Description of Artificial Sequence: Synthetic coding sequence
atgttgctggggagcccagctggatcatcttccattttgtcagacggtgtgtatgagcgacatatggatccgctcttgcttcccggagagctggcgtctccctctcaggctctgggtgcaggagaaatacccgcgccatctgaaactccgtggctctccccagatcctctgtttctggagcagcgacgcgtccgagaggctaaaacagaggaagatgggccagccaacaccgagcagaagctcaaatcctttcctgaagatccccagcatctcggggaatggggtcacctggatccagccgaggaaaatcttaaaagttacaggaagttgctgctttggggataccaactgagccagcccgatgccgccagtcgattggataccgaagaactgcggctggtcgagcgcgaccctcaagggtcctcacttccgggtggacgcaggcaagagagtgccgggtgtgcctgcgaagaggccgcccctgcgggcgttctacctgaactcccgactgaagctcctcccggcgatgcactggcggatccgcctagcggaaccacagaggaggaagaagagcaacccggaaaggctcccgaccctcaggatccacaggatgctgaatccgattcggccactggctctcagagacagagtgtgatccagcaacctgctccagacagaggaactgcaaaattgggcacaaaacgcccacatcccgaagatggggacggccaatctctcgaaggcgtctctagttctggtgacagtgccgggctggaggcgggccaggggcctggcgctgatgagccagggttatcacgcggcaagccctacgcatgtggcgagtgtggggaggcttttgcctggctgagtcacctaatggaacaccattctagccatgggggcagaaagcgctatgcctgccagggatgctggaaaacttttcacttctctcttgccctggcagagcaccagaagactcatgaaaaggagaagagttacgctttaggcggcgcaaggggcccgcaaccgtcgactagagaggctcaagctggggctcgtgccggaggcccaccagagagcgttgaaggcgaggcaccaccagctcccccagaagcgcagcgctag

SEQ ID NO: 13851 - DNA, 1701 bp, Artificial Sequence
  Description of Artificial Sequence: Synthetic coding sequence
atgagacgagtgggaggtagggccgacgaggacgccaccgcggcagggtcactttgggtgttggctccgcctgaaccaaccggccacttagtgattcccggaacctccccactggagcctccatgcccatggctcgactcacacatcttccagtgccgcttcggtaagatgctgccacttgaaaaagcattcgcttcacccagatcttcccccgcccccccagatcttccgacccctggaagtgcagccggtgtgcagcaagaagagcccgagaccatacctgagcgaacgccagccgatctggagttctccaggttacgattcagagaattcgtgtatcaggaagctgcaggcccacatcagacactggcccggctgcacgaactctgtcgacagtggctcatgccagaggctcgaagcaaagaacagatgctggaactgctcgtcctggaacagttccttgggattctgcctgacaaggtgcgtccctgggtggtggctcagtatcctgaaagctgtaaaaaagcagcgagccttgttgaaggccttgcggatgtcctcgaggaaccgggtatgttgttgggcagcccggctggaagtagcagcatcctgtccgacggtgtgtatgagcggcatatggacccactactgctgccaggggagctagccagtccgagccaggcactaggggccggcgagatcccagctcccagtgagacgccgtggctgagccccgacccccttttcttagaacaacgacgggtcagagaagcgaagacagaggaggatggaccagccaacacggagcagaaattaaaatctttccccgaggatccccagcatctaggagagtggggccatttagaccccgcggaggaaaaccttaaaagctaccggaagctcctcctgtggggctaccaattgagtcagccagatgcagccagtcggctggacacagaggaattacgtctcgtggaacgggatcctcaaggaagcagcctgccagagggcggcagaaggcaagagtctgccgggtgtgcatgcgaagaggccgctcccgccggtgtgctccccgaactgcccactgaggccccacccggagacgccttagctgaccccccatccggcaccaccgaagaggaggaagagcaacccggcaaagcgccagacccccaggacccacaggacgcagaatctgattccgccaccgggtcccagagacagtccgttatccagcaacccgccccagatagaggaaccgccaagcttggtacaaaacgaccacaccccgaagatggtgatggtcagtcgctcgaaggggtgtcctcctcaggggacagcgctggactcgaagccggtcaaggtcctggcgccgacgagcccggcctgtcccggggaaaaccctatgcttgtggcgagtgtggggaggctttcgcctggctgtcccacttaatggaacatcatagtagtcacggcggcagaaaaaggtacgcctgccagggttgctggaagacgttccacttcagcctggcattagccgaacaccagaagacacacgagaaggaaaagtcttacgcactgggcggagcccgggggcctcagcccagtacccgagaagctcaggctggcgcacgggccggcggccctccagagtccgtggagggagaggccccccccgctcctcccgaagcacagaggtag

SEQ ID NO: 13852 - DNA, 1701 bp, Artificial Sequence
  Description of Artificial Sequence: Synthetic coding sequence
atgcgtagagtggggggccgagctgacgaagacgctactgccgctgggtctctgtgggtactagcgccacctgagcctaccggtcacttggttatacccgggacctcccccctggaacccccctgtccatggctggattcccatattttccagtgtagattcggaaagatgttgcccctggagaaagctttcgcttcccccagaagctctcctgccccccctgatctacccacccctgggagcgctgccggcgtccaacaggaagagcccgagactatacctgagcgtactccggcagacctcgagttttctaggctgcggtttagggagttcgtgtaccaggaggctgccggaccgcaccagacattagccaggttgcatgagctgtgtcgccagtggcttatgcctgaagctaggtctaaagagcagatgctggagctgctggtattagagcaatttctgggcatcttgcctgataaggttagaccatgggtggtcgctcagtaccctgagtcgtgtaagaaggctgcctccctcgtggagggtctggccgatgtgctcgaggaaccgggcatgctgctaggttctccggcgggctctagttctatactgagcgatggggtctacgagcggcacatggacccccttcttcttcccggtgaactagcgtctccaagtcaggctctgggagccggtgagattcctgcaccctcagagactccatggttatcccctgaccccctgtttttagaacagcgacgggtgcgcgaagctaagacagaggaggatggccccgcaaatactgagcagaagctcaaaagcttccccgaggatccacagcacttgggagagtgggggcacctcgaccccgccgaagaaaacctcaaatcatacagaaaactccttttgtgggggtaccaactgagccagcccgacgccgcatctagactcgatacagaagaattaagactggtcgagagggacccacaagggtccagcctgccagagggcgggcggcggcaggaaagcgcaggctgcgcctgcgaggaggctgctccggccggggtgctgcctgagttgcctacagaggccccccctggggatgcactggctgatcccccttcaggtaccaccgaagaggaggaggaacagcctgggaaggcccccgatccacaggacccacaggatgctgaatctgactcggctaccggatcacagcggcagagcgtcatccaacagccagctccggaccgcggcacggccaagttaggaaccaaacgcccccacccagaggatggggacggccagtcactcgaaggagtttctagttctggggattcagccggtctggaagccggtcagggacccggcgcggatgaaccaggcttatctcgcggcaaaccgtacgcctgtggtgagtgtggggaggcctttgcttggctgagtcacctcatggaacaccattccagccacgggggccggaagcgctacgcttgccagggatgctggaaaacttttcacttttctctggcacttgccgaacaccagaaaactcatgagaaagagaagtcatacgctctcggcggtgctagaggaccccaaccttctacacgagaggcacaagcaggcgctcgagcagggggcccaccggagtcagtggaaggagaagctccgcctgccccacctgaggcacagaggtag

SEQ ID NO: 13853 - DNA, 453 bp, Artificial Sequence
  Description of Artificial Sequence: Synthetic coding sequence
atgatggccgccgacattccccgcgtgaccaccccgctatcttcgctggtgcaggtaccacaagaggaggacaggcaggaagaggaggtgacaacgatgatcctggaagatgattcttgggtgcaggaagccgtcctgcaggaggacggcccagagagcgagccatttccccaaagcgcagggaagggtgggccacaggaggaagttactcgggggccacagggggccctcggacgtttgcgcgagctgtgccgccgctggcttcgtccagaagttcataccaaggagcaaatgctgactatgctccccaaggagatccaggcctggctccaagagcatcgtcccgagtcatctgaagaggccgctgcattggtggaggaccttacccagacacttcaggactccgctgtcgccgttgtggcaagcctccctgtggaagtgacgtcactgtag

SEQ ID NO: 13854 - DNA, 1788 bp, Artificial Sequence
  Description of Artificial Sequence: Synthetic coding sequence
atgatggccgcagacatccccagggtcaccaccccacttagtagcttagtccaggtgccccaggaagaagacagacaggaagaagaggtgaccaccatgatactagaggacgattcatgggttcaggaggctgtccttcaagaggaggttaccaggggcccccaaggagcccttggcagacttcgtgagctttgtaggcgatggcttcgaccagaagtgcatacgaaggaacagatgctgaccatgttacctaaagagattcaagcatggctgcaggagcatcggccggagtcctctgaggaggccgccgcgctggttgaggacctgacgcaaaccctacaggactcagatttcgaaatccagtcagagaacggcgagaattgtaaccaggatatgtttgagaacgagagcagaaagatcttcagcgagatgccggagggggagtcggcccagcactccgacggagaatctgattttgaacgcgacgcggggattcagaggttgcaggggcactctcccggcgaagaccacggtgaggtggtgtctcaggatagagaggtgggtcagctgattggtttacagggcacttacttgggggagaaaccctatgaatgtccacagtgcgggaagactttttcccgtaaatcacatcttattacccatgagagaactcataccggggagaagtattacaagtgtgatgagtgcggaaagtctttctcagatggttctaacttctctcgtcaccaaaccacccacacaggggagaaaccctataaatgccgggactgtggcaagagcttcagtagatcagccaacctgattactcatcaaaggatccacaccggtgagaaaccattccagtgtgcagagtgcggaaaatcgttttccaggtcgcctaatttgatcgcacatcagagaactcacacaggcgagaagccatactcctgcccagagtgcggcaagagcttcggtaaccggtcctctctgaacacgcaccaaggaattcatacaggcgagaaaccctacgagtgtaaggaatgtggtgagtcttttagttataactcgaatctgataagacatcaacgtatccacacaggtgaaaagccatataagtgtaccgattgcggtcaaaggttttcccagtcaagcgccctgatcactcatcgccgaactcatacaggcgagaaaccttaccagtgctctgagtgcggtaagtccttttcaaggtctagcaacctagctacccaccggcgcacccacatggtggagaaaccatacaagtgcggggtgtgcggaaaatcattttcacagtccagttctctcattgcgcatcagggcatgcacaccggcgaaaagccctacgaatgcctgacttgtggggaaagttttagctggtcatccaacctgctgaagcaccagcggatccacactggcgaaaaaccctacaaatgctccgagtgcggaaagtgtttttctcagagatcacagctggtagtgcatcaaagaactcacactggagaaaagccctacaagtgcctgatgtgtgggaaaagctttagcagggggtctatcctggtcatgcaccaacgagcccacctcggcgataagccttacagatgcccagaatgcggcaaaggcttctcctggaattccgtgctgatcatccatcagcgcatccacactggagagaagccatacaaatgcccggaatgtggaaaaggtttctccaactcatccaacttcattacccatcagaggacacatatgaaggaaaagctctactag

SEQ ID NO: 13855 - DNA, 441 bp, Artificial Sequence
  Description of Artificial Sequence: Synthetic coding sequence
atgatggccgccgacattcctcgagtaacaacaccccttagctcactagtgcaggtcccacaagaagaggacaggcaggaggaggaagtaacaacaatgatattggaagacgactcttgggtgcaggaagccgtgctccaggaggacggaccggagagcgaaccttttccgcagagcgccggtaaagggggcccacaggaggaggtgaccaggggaccccaaggagctcttgggaggctccgggagctgtgtcgcagatggctgaggcctgaggtccacactaaggagcagatgctgacaatgctgcctaaagaaatccaagcatggttgcaggagcatcggccggagagtagcgaggaggcagctgcgctggttgaagatttgacccagacacttcaggactctgaaacagcttcctgtgtgcacgggtgtccagtatag

SEQ ID NO: 13856 - DNA, 99 bp, Artificial Sequence
  Description of Artificial Sequence: Synthetic coding sequence
atgatggctgctgatatccctagagtcactacaccactgagttccctcgtgcaggtcccccaggaggaagacagacaggaagaggaggtcaccacctag

SEQ ID NO: 13857 - DNA, 1845 bp, Artificial Sequence
  Description of Artificial Sequence: Synthetic coding sequence
atgatggcggctgatattcccagggtgacaactcctctgagcagcctggtgcaggtgccacaggaggaagataggcaggaagaagaggtaactactatgattcttgaagacgattcgtgggtgcaggaggctgtgctccaggaggacggccccgagtcggagccgtttccccagtcagctgggaaggggggcccacaggaggaggtaacaagaggcccgcagggggcactgggtcgccttcgagagctctgtagaagatggctccgaccagaagtacacactaaggagcagatgcttacaatgctgcccaaagagatccaggcttggctacaggagcaccgcccagagagtagtgaagaggcagctgccctggtggaggacttgactcaaacactgcaagatagcgatttcgagatccaatcagagaatggcgagaactgcaatcaggatatgtttgagaacgagtcaaggaagatatttagtgaaatgcccgagggagaaagcgcccagcatagtgatggcgagtctgacttcgagcgagacgcagggatccagcggctgcaaggccatagcccaggagaggatcatggcgaagttgttagccaggaccgggaggtcgggcagctgatcggcttgcaaggcacatacttaggcgagaaaccatacgagtgtccacaatgtggcaaaacgttcagcagaaagtcccacctgatcacccatgagcgtacacatacaggagagaagtactataagtgcgatgaatgcggaaagagtttcagcgacgggagtaatttcagtaggcatcagaccacccatacgggcgaaaaaccatacaagtgtcgcgattgtggtaaaagtttcagcagatctgctaatctgataacacaccagaggatccatactggcgagaaacctttccaatgtgccgagtgtggcaagtctttttcgagatcccccaaccttatagcgcatcagcgtacccacacaggcgaaaagccatattcctgcccagaatgcgggaaaagctttggcaataggagcagcttgaatacccaccaagggattcacacgggcgagaagccatatgaatgtaaggagtgtggggagagtttcagctacaacagcaatctgatccggcaccaacgcatccatactggggaaaaaccctataaatgcaccgactgtggtcagcggttctctcagagcagtgcactaattacacaccgacggacccacactggcgaaaagccctaccaatgcagtgaatgtgggaagtcttttagccgatccagcaatctcgcaacccacaggaggactcacatggtggagaagccctacaaatgcggcgtatgcggaaagagtttctcccaaagcagctctctgatcgcgcaccagggcatgcatactggcgagaaaccttacgagtgtcttacctgtggcgagtcttttagttggagctccaacctgcttaaacaccagagaattcacaccggcgaaaaaccttacaaatgttctgagtgcggcaagtgcttcagccagcgcagccaactggtcgtacatcaacggacccacaccggtgagaaaccttataaatgtttgatgtgtggcaagtcatttagtagaggatcgattcttgtcatgcaccaacgcgcccacctaggcgacaaaccttacagatgcccagaatgtgggaagggcttctcatggaactccgtcctgatcatacaccagcgcatccacaccggtgaaaaaccttacaaatgtcctgaatgcggcaaagggtttagcaacagcagtaattttatcacccatcagcggacccacatgaaagaaaaattgtattag

SEQ ID NO: 13858 - DNA, 84 bp, Artificial Sequence
  Description of Artificial Sequence: Synthetic coding sequence
atgatggcggccgacataccgagagttacgacccccctgagtagcttggtacaggttccccaagaggaagatagacaggagtag

SEQ ID NO: 13859 - DNA, 1845 bp, Artificial Sequence
  Description of Artificial Sequence: Synthetic coding sequence
atgatggctgcagacattcccagagtgacgacccccctctcctccctggtgcaagtgcctcaggaggaggatagacaggaagaagaggtcacaaccatgattttggaggacgacagttgggtgcaggaagccgtgctgcaggaagacggacctgaaagcgaacctttcccacagagcgccgggaaaggcggcccccaggaggaagtcactcggggccctcaaggcgcccttggcagactgagggaactttgcagaaggtggctgcggccagaagtgcatacaaaggaacagatgctgaccatgctgccaaaagagatacaggcttggcttcaagaacatcgacccgaatcgtcagaggaagctgcggccttggtggaggatcttacacagacactgcaggattccgattttgaaattcagtccgagaacggcgagaactgtaaccaggatatgttcgagaatgaaagtaggaaaatcttctctgaaatgcccgaaggtgagagtgcgcagcactccgacggcgaaagtgacttcgaaagggacgctggtattcagcggctgcaggggcatagtcccggcgaggatcacggggaggttgtcagtcaggaccgagaagtcggccagctgatcgggttgcagggaacgtacctgggtgagaaaccttatgagtgtccccagtgcggcaagaccttcagccgcaagtcccatctgattacccacgagcggacacataccggggaaaaatactataagtgcgatgagtgtgggaagagcttttctgatggtagcaacttcagccgccaccaaacgacgcacactggggaaaaaccgtataagtgtcgagattgcgggaaatctttttcgcgatctgccaacttaatcacccaccagcggatccacacgggcgaaaagccctttcagtgtgccgaatgcggtaaaagcttcagccgcagtcccaatctgatcgcgcaccagaggacacacaccggcgagaagccctattcatgccccgagtgcgggaagtcgttcggcaaccgctcctccctcaacacccatcagggaatacatacaggtgagaaaccatatgaatgcaaagagtgtggtgaatccttctcctataattcgaacctgatccggcatcagcgcatacataccggagagaagccatataaatgtacagactgtggccagagattctctcagagcagcgccctgataacccaccgtagaactcacaccggcgagaaaccttaccagtgcagtgagtgtgggaagagttttagcaggtcttccaatttggctacacaccgaagaactcatatggtggaaaagccatacaaatgcggcgtgtgtggcaaatcgttcagtcaatcttcatccttaatcgcacaccaaggaatgcacaccggcgagaagccctatgagtgcctgacatgtggggagagcttcagctggagctcaaacctgctgaaacatcagcgcattcacaccggggagaaaccttacaagtgcagcgagtgtgggaagtgcttctctcaaagatcacagctcgtcgttcaccaaagaacacatacaggcgagaagccttataagtgcctcatgtgtggcaagagttttagtcgtggatccatcctagtgatgcaccagagagctcatctgggcgataagccataccgatgtccggaatgcggcaaggggttcagctggaacagtgtgctgattatccaccaacgcattcataccggggaaaagccgtacaagtgtcctgaatgcggcaagggcttctctaatagctctaatttcattacacatcaaagaacccatatgaaagaaaaactgtattag

SEQ ID NO: 13860 - DNA, 1845 bp, Artificial Sequence
  Description of Artificial Sequence: Synthetic coding sequence
atgatggccgctgacattcccagggtaaccactcccctttcatccttggtccaggtcccacaagaagaagatcgacaagaagaggaagttaccacaatgattctggaggatgattcatgggtgcaggaagcagtgctacaggaagatggaccagagagtgagccgtttcctcagtccgccggtaaagggggcccacaggaggaagtgaccagagggcctcagggagcacttggacgactgcgtgaactgtgtcgtaggtggctgcgacctgaagtgcacacaaaggagcagatgttgactatgctgcccaaagagattcaagcctggctccaagagcaccgtccggaaagttccgaggaggcagcagctctggtggaagatctgacacaaacccttcaggatagcgattttgagattcagtctgaaaatggcgagaattgtaaccaggatatgttcgaaaatgaaagtaggaagattttttccgaaatgcccgagggcgagtcagctcagcacagcgacggagaaagcgacttcgagcgcgatgccggtatccagcgcctgcaaggacattctcccggcgaagatcatggggaggttgtgagccaggacagggaggtcgggcaactgattggtctgcaggggacctatttaggagaaaaaccatatgaatgcccccagtgtggcaagactttctcccgcaagtcccaccttattactcacgagcggacacataccggcgagaagtattataagtgtgacgaatgtgggaagtccttttctgatggctccaactttagtcggcaccagacaacacatacgggggaaaaaccatacaagtgtcgcgattgcggaaaatccttttccagaagcgcaaatctgatcacgcatcagcgcatccacaccggagagaaaccattccagtgtgctgagtgtggaaagagtttctctcgcagtcctaacctgattgcccaccagagaactcacactggtgaaaaaccttattcctgtcctgaatgcggcaagtccttcgggaatcgttccagtctgaacacgcatcagggaattcacacaggggagaagccatacgagtgcaaagagtgtggtgaatccttctcctacaattcaaaccttataaggcaccagcgcatccataccggcgagaaaccatataagtgcaccgactgcggacaaaggttttctcagtcaagtgcccttatcacccaccgcagaactcatacaggcgaaaagccctatcagtgtagcgagtgtggtaagtcattcagcaggtctagcaatctggcaacgcatcggagaacacatatggtggaaaagccatataaatgcggggtgtgcggaaagtcatttagccagtctagttcattaatcgcacaccagggaatgcacacaggagagaagccgtacgagtgtcttacctgtggcgagagcttctcttggtctagcaacctgttgaaacatcagaggatccacaccggtgaaaagccctacaaatgttccgagtgtggcaaatgtttctctcaacgttcccagcttgtcgtgcatcagcgcacccacaccggagagaagccctacaaatgtttgatgtgtggaaaatcgttttctcgaggttcaattctcgtcatgcatcaacgcgcccatctgggcgataagccttacaggtgccccgagtgtgggaaggggttctcttggaattctgtactgatcatccatcagcgcattcacacaggcgagaaaccttataaatgtcccgagtgtgggaagggcttcagcaatagctccaactttataacccatcaacgaacacacatgaaagaaaagctgtattag

SEQ ID NO: 13861 - DNA, 162 bp, Artificial Sequence
  Description of Artificial Sequence: Synthetic coding sequence
atgatggctgccgatattcctagagtgaccactcctcttagtagtctggtacaggttccccaggaagaagacagacaggaggaagaggtgacaaccatgatattagaggatgacagttgggtgcaggaggcagtgctgcaggaggatgggcctgaaagctag

SEQ ID NO: 13862 - DNA, 1422 bp, Artificial Sequence
  Description of Artificial Sequence: Synthetic coding sequence
atgatgacgaaagttctgggaatggcaccagtcctgggccctaggccgcctcaagagcaggtcggacccttaatggttaaagtggaagaaaaggaagagaaaggtaaatatctgccaagcctggagatgttccgtcagcgctttcgacagttcggatatcatgacaccccgggcccaagggaagcgctctctcaactgagggtcctttgctgcgagtggctgcggccggagatccacaccaaagagcagatcctagagctgctcgtgctggagcagttcctgactattctaccacaggaactgcaggcgtgggtgcaggaacactgtcctgaaagcgcggaagaagctgtgacattgctcgaggatctcgaacgtgaactggacgaacccggtcaccaggtctctaccccccctaacgaacaaaaacctgtatgggagaaaattagttcatccggtacagccaaagagtctcctagctctatgcaacctcagcctctggagaccagccataaatatgagtcctggggtcctctgtacattcaggagagcggagaagaacaggaattcgcccaggaccccaggaaagtgcgagattgtcggctaagtactcagcatgaggagagcgccgacgaacagaagggttccgaggcggaggggctgaaaggcgacatcatctccgtaattatagctaacaagccagaagcaagtctggaaagacagtgtgtcaatctggagaacgagaagggcaccaagccacctctgcaggaggccggttcaaaaaaggggcgcgagtcagttccaactaaacctactcctggtgaacgccggtatatctgtgctgagtgtggcaaggctttcagcaattcaagcaatctcacaaaacacagaagaacgcatacaggcgaaaaaccttacgtttgcactaaatgtggcaaggcatttagtcattcttcgaatctgacgctgcactaccgaacccatctggtggatcggccatacgactgtaagtgtggcaaagcgtttgggcagagcagtgatctgctgaaacaccaaaggatgcacactgaggaggcgccataccagtgcaaagactgcggcaaagctttctctggtaagggttccctcatccgccactaccgcatacacacaggcgagaagccataccagtgtaacgaatgtgggaaaagcttttcccagcatgccggactaagctctcaccagagactgcacacaggggagaaaccctacaaatgtaaagaatgcggcaaggcgttcaatcacagcagcaacttcaataaacatcaccggatccatacgggcgagaagccttattggtgtcatcactgcggaaagaccttttgctcgaagagcaacctgtctaaacatcagagggtacataccggagaaggcgaggctccttag

SEQ ID NO: 13863 - DNA, 1347 bp, Artificial Sequence
  Description of Artificial Sequence: Synthetic coding sequence
atgatgacaaaagtgttaggcatggctcctgtcttaggccctcgacccccgcaggagcaggtgggccccctcatggtcaaggtggaggaaaaagaagaaaagggcaagtacttaccatccttggagatgtttagacagaggtttaggcagtttgggtaccatgatacacccgggccgagagaagccctttcacagctgcgtgtgctgtgctgcgagtggctgaggcctgaaattcatacgaaggagcactgcccagaatcagccgaggaagccgttactctcctggaagatctggaacgcgagctagacgagccaggccaccaggtgtctacaccacctaacgaacagaagcctgtctgggaaaagataagttctagtggaacagctaaggagagtccctctagtatgcagccgcaaccactcgagacttcacataaatacgagtcctgggggcctttgtatatccaagagagcggcgaggaacaggagtttgcccaggaccctcgcaaagttagagattgtcgacttagcacacagcacgaagaaagcgccgacgagcagaagggatcggaagccgagggcctcaaaggagatatcatatcggtcatcattgccaataagcctgaagcctccctggaaagacagtgtgtcaatctggagaacgagaagggaacgaaaccacccttgcaagaggcaggcagtaaaaagggaagagagagcgtccctaccaagccaacacccggggagaggagatacatctgcgctgagtgcggcaaagccttctcaaatagctctaatctcactaagcaccggcgaacacacacaggagaaaaaccatatgtgtgcaccaaatgtggaaaagccttctctcattcctctaacctcacactgcactacaggacacatctggttgaccgcccttatgattgtaagtgtggtaaggctttcgggcagagctctgacctcttgaagcaccagcggatgcatacagaggaggcaccgtaccaatgcaaagattgcggaaaggctttcagcgggaagggctcactaattcggcactaccgaattcacacaggcgagaaaccttatcagtgtaacgagtgcggcaagtctttctcccagcacgctggtctgtcctctcaccaacgactccatactggagagaagccatacaaatgcaaggagtgcgggaaggcgttcaatcacagcagcaactttaataaacaccatagaatacatactggcgagaagccctactggtgccaccactgcggtaaaaccttctgttctaagtcgaatctctctaagcatcagcgcgtgcatactggcgagggcgaagccccatag

SEQ ID NO: 13864 - DNA, 546 bp, Artificial Sequence
  Description of Artificial Sequence: Synthetic coding sequence
atgatgaccaaggtcctcggtatggcccccgttttaggaccccgaccacctcaggaacaggtgggcccccttatggtgaaggtggaggagaaggaggagaagggaaaatacctgcctagcctcgagatgttcagacagcgctttcgacagtttggttaccacgatacccctggtccacgagaagcattgagccaacttcgggtgctgtgttgcgagtggttgcgccctgaaatccatacaaaagaacagatattggaactgctggtgctcgaacaattccttactatccttcctcaggagctccaggcctgggtgcaggaacattgcccagagtcagccgaagaggcggtgaccctgctcgaggacctggaacgcgagctggatgaacccggccaccaggtctccacaccccccaacgaacagaagcccgtgtgggagaaaatttcttcgagcgggactgcaaaagagtctccatcatcgatgcagccccagccacttgaaactagccacaagtacgaatcttggggcccactctacattcagtag

SEQ ID NO: 13865 - DNA, 1353 bp, Artificial Sequence
  Description of Artificial Sequence: Synthetic coding sequence
atgatgacaaaagtcctaggaatggcacccgtgttagggcccaggcccccccaagaacaggtcggtcctctaatggttaaagtggaagaaaaggaggaaaaggggaaatatttgccctctctggagatgtttagacagagatttaggcagttcggctaccatgatactccgggtcctcgagaggccctgtcacagttgcgggtgctctgctgcgaatggctgagaccagagatccataccaaagagcagattctggaactgttagtactggagcagttcctgaccattctgccccaggagctgcaggcctgggtccaagagcactgcccggaaagcgccgaggaagcagtcactctcctcgaagatctcgagagggaacttgacgaacctggccatcaagtgagcacccctccaaatgaacaaaaaccagtctgggaaaaaatctcttcctcagggaccgctaaggagtctcccagctctatgcaaccccagcctctggaaacttcacataagtatgaatcctggggccctctctacattcaggagagtggagaagagcaggagtttgcacaggatccaagaaaagtccgggattgtcggcttagcactcagcacgaggagtcagccgacgaacagaaaggatctgaggccgaggggctgaagggggatataattagtgtcatcatcgcgaataagccagaagctagcctggagcgtcagtgtgttaatttggagaatgaaaagggaacaaagcccccattacaggaagctgggtctaagaaaggagagcataccctgggacgcaatctgacctgcgctccttcagtggggaagctaagcgccactgctcaaactagtcccagcaccactgagcacacctggtggaccgggcctatgaccgttagcgtggaaaagttattgggtcgcgcccaaacttttctgaacattcgggaatgtacccaaaagagacgtcacattagtgccaaaattgtggcgcggctctcagccggcaaggcggccagttttgtgactatcggttctacgctggggcgctctctgatctctgtgaccaacgttgggcgcgccagcgtaagcatgcgcgcatccgccccaactcgtgactctacaccagagaggagccacatttctgttagatctgtcggaaagcccagtactacagctcccacctccatcaacacaacagagtctacacctggaaagtctccgacaggggtgattacagttgaaaggccgagcgtggcaagcccaatcttccctaatatcagcgagtccacgctcgagagagaaaagcaccggaatttccaggccttgctgctcctgagtcttttctag

SEQ ID NO: 13866 - DNA, 1170 bp, Artificial Sequence
  Description of Artificial Sequence: Synthetic coding sequence
atggccattactttaacactgcagaccgcagagatgcaagagggtttgctcgcggtcaaggtcaaggaagaggaagaggaacattcgtgtggacccgaatccggactgtcacgaaacaatccacatacccgtgaaatttttcgccgccgatttagacaattctgctaccaggagagccccggacctcgggaagccctccaacggctgcaggagctttgccatcagtggcttagaccagagatgcacactaaagaacaaatcctcgaattactagtgctcgagcaatttctgactattttgcctgaggaattacaagcttgggtccgccaacatcgcccagtgtccggtgaggaagcggtgacagttctagaggacctagagagagaactcgatgaccccggcgagcaggtgctctcacacgcacatgagcaagaagaattcgttaaggagaaggcaactcccggggccgcacaggaaagctcgaacgaccagtttcagactctcgaagaacaacttggttacaatttacgcgaggtgtgtcctgtccaagagattgacggtaaagccggaacatggaacgttgaactagcccctaagagggagatttctcaggaggtgaaatctctgatccaagtgcttggcaagcagaacggtaatatcacccagatccctgaatatggagacacctgcgaccgggaggggcgcctcgagaaacagagagtgagcagttctgtggagagaccttacatctgcagtgaatgtggaaagtcgtttacgcagaattccatcttaattgaacaccagagaactcacactggggaaaagccctacgagtgtgatgagtgcggcagggccttcagtcagcgttctggcctttttcagcatcagcgtttgcataccggggagaagcgctaccagtgcagcgtgtgcggcaaagctttttcacaaaatgctggactatttcatcacctcaggatccataccggagagaagccttaccaatgcaaccagtgtaataagtcattttcacggagaagcgtgttaattaagcaccagcgcatccacaccggagagaggccttacgagtgtgaagagtgcggcaaaaacttcatttatcactgcaaccttatacagcaccgcaaggtgcaccctgtggccgaatctagttag

SEQ ID NO: 13867 - DNA, 1392 bp, Artificial Sequence
  Description of Artificial Sequence: Synthetic coding sequence
atgatggcaaagtcagccttgcgggagaatggcactaactccgagacatttaggcagcgattccgaagattccactaccaagaagtcgccggcccccgcgaagccttctcacagctctgggaactctgctgcagatggctgcgtcctgaggttcgaaccaaagagcagatcgtcgagctactggtgctggagcaattccttacagttctcccaggggaaattcaaaactgggtccaggaacagtgtcccgagaatggcgaagaggcagtgaccttagtggaagacttagagagagagcctggccgcccgaggagtagcgtgactgtctccgtaaaaggccaggaagttcggctggagaagatgactcctcctaaaagtagccaagagctcctgtccgtgaggcaggaatccgtggagccacagcctcgcggagtccccaagaaggagagagctaggtcccctgatctgggaccccaggaacagatgaatccaaaagaaaagttaaagccgttccagcgcagtgggttcgaagctggattcgagaacgaggataactccaagagggatatatccgaagaggttcaactgcaccgcacactcctcgctcggagcgaacgcaagatccctcgatacttacaccaagggaaaggtaacgaatctgactgccgcagtggtcgccagtgggccaaaaccagtggcgagaagcggggtaaacttaccctgccagagaaatccctcagtgaagtgctatcccagcagagaccgtgcctaggggaaagaccctacaagtatttgaagtacagcaaaagctttgggcccaattccttgctgatgcatcaagtgagccatcaagtcgagaacccatataagtgcgccgactgtggaaaatctttctctaggtccgcaaggcttattcgtcaccgacggattcatacgggggagaagccatataagtgcctggattgtggcaaatcctttagggattcctctaattttataacccaccgcagaatccacaccggggagaaaccataccagtgcggagagtgtggtaaatgcttcaatcagagctctagcctgattatccatcagaggacccacaccggcgaaaagccataccagtgcgaagaatgtggcaagtcttttaataacagctctcacttctctgcccaccgaaggattcacaccggcgaacggccgcacgtgtgccctgattgcggcaagagtttcagcaagagcagcgacctgagggctcaccatcgaactcatactggcgaaaaaccctacggctgtcacgattgcgggaagtgtttcagcaaatcttcagccttgaacaagcatggagagatccacgccagagaaaagttactgactcagtcggcacccaagtag

SEQ ID NO: 13868 - DNA, 2559 bp, Artificial Sequence
  Description of Artificial Sequence: Synthetic coding sequence
atgatggccaagagcgcgctcagagagaacggcaccaattctgaaaccttcaggcaaaggtttcggaggttccactatcaggaagttgctggtcctcgggaggccttctcacagttgtgggagctgtgttgccgttggctaagacccgaggtgcgtacaaaggaacagatcgtggagctgctcgtgttggaacagttcctgactgtgctgccaggtgaaatccagaactgggtgcaggagcagtgccctgagaatggcgaagaggcggtgaccctggtagaggacttggaacgggagcctggcaggccgcgctcatccgtgaccgtaagcgtgaagggtcaggaggttaggttggagaaaatgacacctccaaaaagttctcaggagctgctcagcgtgaggcaggagtcagtcgaaccccagccccgcggcgtgccaaagaaagaaagggcacgatctccagacttaggaccccaggagcagatgaatccgaaagaaaagctgaaaccttttcaaagaagtggtctgccttttcccaaatcaggcgttgtttccagactcgagcagggcgaaccttggatcccagaccttttaggatccaaagagaaggagctgccaagtggctcacacatcggcgatcggcgagtgcatgcagacctcctgccctccaaaaaagaccgaagatcgtgggtggagcaggaccattggtcctttgaggacgaaaaggtagcaggagttcactgggggtacgaggaaacacggactctgctggctatactgtcccagactgagttttacgaagcactcaggaactgccatcggaacagccaggtctacggggccgtcgctgagagactaagggagtacgggttcctgcgtaccctcgagcagtgccgcacaaagttcaaagggcttcaaaagtcataccggaaagtgaaaagtggacatcccccggagacctgtcctttcttcgaggagatggaggccctaatgtcagcacaagtaattgctttaccctccaacggactggaagctgcagcgagccatagcggactggtaggttcggacgcggaaacagaagaaccgggccagcgtgggtggcagcacgaggagggggcagaagaggctgtcgcccaagaatccgattccgatgacatggacttggaggccacccctcaggatccaaattcagctgcccccgttgtttttaggagccccgggggggtgcactggggctacgaagagactaagacgtacctcgccattctcagtgagactcaattttatgaagctttacgcaattgtcataggaactctcagttatacggcgcagtcgccgaaaggctgtgggaatatggctttcttaggacacccgagcagtgtagaaccaaatttaagtccctgcaaacctcatataggaaggttaagaacgggcaagctccagaaacttgcccattcttcgaggaaatggatgccctggtgtccgttagagtggcagcgccacctaatgacggacaagaggaaacagccagctgcccagtccagggtacctccgaagctgaagcccagaaacaggctgaggaggcggacgaagccaccgaggaagatagcgatgatgatgaagaggacaccgagattcccccaggtgcagtaatcactcgggcaccagttctctttcagagccctaggggattcgaggcaggatttgaaaacgaagacaactcaaagcgggacatctctgaggaggtgcagttacatcgaactctgctggcccgtagcgagaggaagatccctaggtacttacaccaagggaagggcaatgagagcgactgccgcagtggaagacagtgggccaagacctccggggaaaagcgcggcaaactcactttacctgagaaaagcctgtcagaagtgctctcccagcagaggccttgtctgggtgagcggccctataaatacctgaaatacagtaaaagcttcggccccaacagcctgttgatgcaccaagtctcccaccaagtggaaaatccttacaaatgtgctgactgtggaaagtcattctcccggtcggcccgactgatcagacaccgaagaatccacaccggagagaaaccatataagtgcctcgattgtggcaagtccttcagggacagttccaattttataactcataggcgaattcataccggagaaaagccataccagtgtggggaatgtgggaagtgttttaaccagtctagctccctcatcattcaccagagaacgcacacgggcgagaagccataccagtgcgaggaatgcgggaaatcgttcaataacagcagtcatttttcagcccacagaagaatccacactggggaaaggcctcacgtgtgccccgattgtgggaaatcattctcaaaatcctccgatctgagagcccatcacagaacacacactggcgaaaagccatacggctgccacgattgcgggaaatgcttttccaagagctctgcattgaataaacacggcgagatccatgcccgtgagaagttactgacacagtctgcccctaagtag

SEQ ID NO: 13869 - DNA, 1485 bp, Artificial Sequence
  Description of Artificial Sequence: Synthetic coding sequence
atgagcggcgaggctaccgtgttggcctaccacgcccccgaggagcaagagggcctgctggtggtgaaggtggaggaggagaactacgtgttggatcaggacttcgggctgcaggaaaatccctggtcacaggaggtgtttcgccaaaagttccgccagttttcttactccgacagcactggtcccagagaggccctgtcacgactgagagagctgtgctgccagtggctacggccagaagtgcactccaaggaacaaatcctggagctgctgatgctagaacaatttctggctatcctaccagaggagttgcaggcttggctgcgagagcaccggccagaaaacggagaagaggctgtgacaatgctggaggagctcgagaaagagctggaggagcctcggcagcaagacacaactcacggtcaagagatgttttggcaggagatgacgagtacaggtgcccttaaatcactgagtttgaactctcccgtgcagcccttggaaaaccagtgcaagacagagacccaagaatctcaggcatttcaggaaagagatggacggatggtggccgggaaagtccttatggccaaacaagagatcgtggaatgcgtcgcttctgccgctatgatcagcccaggaaaactgcccggggaaacccactcccagcgcattgccgaagaagccctgggggggctagataatagtaagaagcagaaaggcaatgccgccgggaacaaaatttctcagctgccgagccaggacaggcacttctcccttgcgacgtttaaccgaaggatccctaccgagcactccgtcctggaaagccatgagtcagaggggtctttttccatgaactctaacgatatcacgcagcagtccgttgacacacgggaaaagctgtacgagtgcttcgactgtggaaaagctttctgccagtcatcaaaattgattaggcatcagagaatacacacgggcgagcgcccctatgcttgtaaggagtgtggcaaagccttcagcctgtcttcagacttagtgagacaccagagaatacactctggcgagaagccctacgaatgctgtgagtgtggcaaagctttccgcggaagctccgagctcatccgccaccggcgcatacacactggggaaaaaccctatgagtgtggtgagtgcgggaaggcgttcagtcggtcgtcagcgctgatacagcataagaagatccatactggtgacaagtcttacgaatgcattgcgtgcggaaaggcttttggacgatccagtattctaatcgagcatcagcgtattcacacgggggagaagccctatgaatgtaatgagtgcggaaagtcttttaaccaaagctcagcactcactcagcatcagcgcatccacactggggagaagccatacgaatgcagcgagtgtcggaagacctttaggcatcgctctggattgatgcagcaccagcggacacacacacgagtatag

SEQ ID NO: 13870 - DNA, 1284 bp, Artificial Sequence
  Description of Artificial Sequence: Synthetic coding sequence
caggaggtttttagacagaagtttcgccagttctcctattccgatagtaccggcccccgcgaggctctcagtcgactccgagaactgtgctgccaatggctccggcctgaggtccacagcaaggagcaaatccttgaactgctgatgcttgaacagtttctcgccatcctccccgaggaactgcaggcctggcttcgagagcaccgccctgaaaacggcgaggaggctgtaacaatgctcgaggaattagaaaaagagctggaggagcctcgccagcaggttaggtctaaacatttcttctgtgtgcctgcaaccaccgtgtcttccgtgatggggagtaaaatacttaccctttccatacacatttttcgatggcaggacggtggatggcagtcagtggacggtaaggcgcgcaactcctccgcggccatgatatctcccgggaagctgcccggggaaacccattctcagcgtatcgcggaagaagccttgggtggcctggataattccaagaagcagaagggcaatgctgcaggaaacaagatttctcaactgccctcccaggataggcatttctcgctcgcgaccttcaacaggagaattcccaccgaacatagtgtcctggagtcccacgagagcgagggctccttctccatgaattctaacgacatcacgcagcagtcagtggacacgagggagaaactctacgagtgtttcgattgcggcaaggctttttgccagtcaagcaaacttatcaggcatcagcgtatccatactggcgaacggccttacgcatgtaaagaatgcggcaaggctttctctctgtcatctgacctcgtgagacaccagcgtatccactccggagagaagccgtacgaatgctgtgagtgtgggaaggcattccgtggaagttcagaactgatccggcatagacgcattcatactggagaaaaaccctatgagtgtggagaatgcgggaaagctttttctcgctcctccgcgctcatccagcacaagaagatccacactggcgacaagtcatatgaatgcattgcctgcggcaaagcattcggccgctcatcaattctgatcgaacatcagcgtatacatacaggggaaaagccctacgaatgtaatgagtgcggcaagtccttcaatcagtcctccgctctcactcagcaccagagaattcacacgggtgaaaaaccatacgagtgttcagaatgtagaaaaaccttccgtcatagatctggactcatgcagcatcagaggacgcatacatag

SEQ ID NO: 13871 - DNA, 666 bp, Artificial Sequence
  Description of Artificial Sequence: Synthetic coding sequence
atgagcggggaggccaccgttcttgcctaccatgcccccgaggaacaggagggtctcctggtcgtgaaagtggaggaggagaactacgtcctggatcaagacttcgggctgcaggagaacccctggtcccaagaggtcttcagacagaagttccggcaattctcctattccgactccacaggcccccgcgaggccctgagcaggctgagggaactgtgctgtcaatggctgcggccggaggtgcactccaaggaacaaatcctggagttgctgatgctcgagcagtttctcgctattcttccggaagaattacaagcttggctgcgtgaacatcggccggagaacggcgaagaggccgtgacgatgttagaagagctcgagaaagaacttgaggagccacgacagcaggacaccactcacgggcaggaaatgttttggcaagaaatgactagtactggtgctttgaagagcttgagcctgaattcacccgtgcagcccttggaaaatcagtgtaagactgaaacacaggaatcgcaggcgttccaagagagggacggggtgtccttgtatcacccgggctggtccgcagtcgtccagccccagctcacggcagcagcgttgaatccctgggttaaagtgattctgctcccccagcctcccgaatag

SEQ ID NO: 13872 - DNA, 1485 bp, Artificial Sequence
  Description of Artificial Sequence: Synthetic coding sequence
atgtctggggaggctacagtgctggcctaccacgctcctgaagaacaggagggtctgctggtcgtgaaggtcgaggaggagaattacgttctggaccaggatttcgggttgcaggagaacccatggtcccaggaggttttcaggcagaaatttcgccagttctcgtactctgattcgactggcccaagggaagcccttagcaggctgagagaactatgttgtcagtggctgaggcctgaggtacactctaaggagcagatattggagcttctcatgttagaacaatttctagcaatattgcctgaggagttgcaagcctggcttagggaacacagacctgagaatggagaggaggctgtcaccatgctggaagagctggagaaggagttggaggagcctcgccagcaggatactacccatggtcaagaaatgttttggcaggagatgacctccaccggcgcgttgaaaagtctgagcctcaattcccccgtccaacccctggaaaatcagtgcaaaacagaaacgcaggagagccaggcattccaggagagggatgggcggatggtggcgggcaaggtcctgatggccaagcaggagatcgtcgaatgcgtggcatctgccgccatgatttcaccaggcaagctgcctggcgaaacacacagccaaagaatcgccgaggaggcgcttggcgggctcgataattcgaagaagcagaagggtaacgcagccggcaataagatctcccagctgccgtcccaagaccgacacttctctctggccaccttcaatagacgaatcccaactgaacactccgttctggagtcacatgagagtgagggctccttttccatgaatagcaacgatattacgcagcagtctgtggacacccgcgagaagctttatgaatgtttcgattgtggtaaggcattctgccaaagtagtaaactcatccgacatcagagaatccataccggcgaacgcccatacgcctgcaaggaatgtgggaaggccttctctctgagctcagacttggtcaggcaccaacgaatccacagtggcgagaaaccctacgagtgctgcgaatgtggaaaagccttccgaggcagcagcgaactgatacgccacaggcgcattcacacaggagagaagccttacgagtgtggagaatgcggtaaagctttctcccgtagctctgccctgatccagcacaaaaagatccacacaggggacaaatcgtatgaatgcatcgcttgcggcaaggcctttggtcggtcatctatcctgattgagcaccagaggatacacaccggtgaaaagccctacgaatgcaatgaatgcgggaagagctttaaccaaagctccgccctcacccagcatcagcgcatccataccggtgagaagccatacgaatgttccgagtgcagaaaaactttccggcataggtctggcctcatgcaacatcagagaacccatacacgggtgtag

SEQ ID NO: 13873 - DNA, 1140 bp, Artificial Sequence
  Description of Artificial Sequence: Synthetic coding sequence
atgatagttcggccgcctcagcctagagagacatcggtcgtcactttccatgggaaggaatatatcgtgcaggactcagatattgaaatggcagaggcaccatcttccgttagagacgatctgaaggatgtgagttcacagcgggcgagctccgtgaaccagatgcgacctggcgaaggccaggcccatagagagctgcaaatactgccacgggtacccgcactgagcaggcggcagggcgaagatttcctcttgcacaaaagtatcgatgtgaccggtgaccccaaaagtctccgtcctaagcagacgttagagaaagacctaaaggaaaacagggaagagaatcccggcttaacttcacctgaaccgcaactgccgaagtcacctactgatctcgttagggcaaaggaggggaaagatccccctaagatagcttcagtggaaaatgtagacgctgacacgccatctgcttgtgtcgtcgagagagaggcatccacccatagtggaaatagaggagatgccctcaatttgtcatccccaaaacggtctaagccagatgctagcagtattagtcaagaagagcctcaaggggaggctacacctgtcggcaatagggagagccctgggcaggcggggatgaactcaatacatagccctggcccggcatctcccgtcagccaccctgatggacaggaggccaaggcattaccaccatttgcgtgtgacgtgtgcgagaaaaggttcacatgtaattcgaagctggttatccataagagatcccatacaggagagcggctatttcagtgcaacctgtgtggaaaacgttttatgcagctgatttcattacagtttcaccagagaactcataccggcgagcggccatacacttgcgatgtgtgccagaaacaattcacccaaaaatcatatttgaaatgccacaagaggtctcacacaggtgagaagccattcgagtgcaaagactgtaaaaaggtttttacttatcggggatccctcaaagaacaccagagaatccatagcggggaaaaaccatataaatgcagcaagtgtccgcgcgctttctccaggctcaaactactgaggaggcatcagaagacccaccctgaagctacatcccagtag

SEQ ID NO: 13874 - DNA, 1491 bp, Artificial Sequence
  Description of Artificial Sequence: Synthetic coding sequence
atggccgctaattgcacttcttcatggagtcttggcgagagttgcaataggcctgggctggagttgcctcgctccatggcttcaagcgagacccagttggggaaccatgatgtagaccctgagattagccacgtaaatttcaggatgttctcgtgtcccaaagagtcagatccaatccaagctctgcgcaaactcaccgaactgtgccacctgtggctccgccctgatttacacaccaaggaacagatcctggacatgctggtgatggagcagttcatgatctcgatgccacaggaactgcaggtgcttgtgatgatgaacggcgtgcagtcttgcaaggatctggaggacctgctacggaataacaggcgcccaaagaagtggagcgtggttacatttcacgggaaagagtacatagtccaagactcagatatagagatggcggaagcaccctcgtccgtgcgggatgacctgaaggacgtaagcagccagcgggccagctccgtgaatcagatgagaccgggggagggacaggctcaccgtgaattgcagattttacctagagtcccggcgctgtcaagacggcagggcgaggactttctgctccataaatcaatcgacgtgaccggagaccctaagagtctaaggccaaaacagactctggagaaggatctaaaggaaaaccgggaggagaatcctggattgacaagtcccgaaccccagctgcctaagtccccaacagacctagtccgagcaaaagagggcaaggaccctcctaagattgcgtccgtggaaaacgtggacgcagatacaccaagtgcctgcgtagttgagagagaagccagtacccacagtggcaaccggggggacgccctcaatctttcctcccctaagcgaagcaaacctgatgccagttctatctcacaggaagagcctcagggagaggccacgcccgtcggaaaccgtgagtctccagggcaggcggggatgaactccatccacagcccaggtcctgcctcacccgtaagtcacccggacggtcaggaagcgaaggctctgccgcccttcgcctgtgacgtgtgcgagaaaaggtttacatgtaactccaaacttgtaatccacaaaaggtctcacactggtgagcgtctgttccagtgtaatctctgcgggaagcgctttatgcagttgatctccctccaattccaccagcgcacacataccggcgagcgcccatatacatgcgatgtgtgccaaaagcagtttactcagaaaagttatcttaaatgtcataagcgaagtcacactggggagaagccgttcgaatgcaaggactgtaagaaggtcttcacctacaggggctcattgaaggagcatcagagaattcactcgggcgagaagccctacaagtgtagcaaatgtcctcgagccttcagcagactgaagctgctgcgacgccaccagaaaacacacccagaagccacatcacagtag

SEQ ID NO: 13875 - DNA, 2274 bp, Artificial Sequence
  Description of Artificial Sequence: Synthetic coding sequence
atggatgttgctgaaagccctgagagagatccccatagtcccgaagacgaggagcaaccgcagggcctctcagatgacgacattctcagagatagcggctcagatcaggacctggatggagcaggcgtccgtgcctccgaccttgaggacgaagagagtgccgcccggggcccgtcgcaggaggaggaagacaaccatagtgacgaagaggatagggccagtgaaccgaaaagccaggaccaggactctgaggtcaacgaactgtcacgcggtccaacatcctcaccctgtgaagaggaaggcgacgaaggagaggaagaccgcacttctgacctcagggacgaagcttctagcgtcacccgggaactcgatgagcacgagctggactatgacgaggaagtccctgaggagcccgccccggccgttcaggaagacgaagcggagaaagccggtgcagaggacgacgaggaaaagggcgagggcacacccagggaagaagggaaagccggagtgcagtccgtaggagagaaggaatcacttgaagccgccaaagagaagaagaaggaggacgacgatggtgagatagacgacggcgagatcgatgacgacgatctggaagagggcgaagttaaagatccaagtgatcggaaggtgcgccccagacccacctgccggtttttcatgaaggacgtagtcacgcctctcagcactctgttgccgccgatctccaatagtattccattcagagggcaggtgaaaggaaattgtacctggggcatgaattgtaggttcatccatcctggagtgaacgataaggggaactattccctcattacaaaggcggatccattcccacccaacggtgctcccccccttggccctcacccactgatgccagccaatccttgggggggcccagtggtcgacgaaattctcccgccccctcccccggagcctcctacagagtcagcatgggagagaggtctgagacatgctaaggaggtcctgaagaaggccacaattcggaaagagcaagagcccgacttcgaagaaaagaggttcaccgtgactatcggagaggacgagcgggaattcgataaagagaacgaggttttccgagattggaacagccggatccccagggacgttagagacacggttctggaaccctacgccgacccatattatgattacgagatcgagcgcttttggcggggaggccaatacgaaaatttccgcgtccagtacaccgagacggaaccataccacaactacagagaaagggagcgggagcgcgagcgggagagagatagggaccgtgaaaaggagagggaaaaagagaagggaaagccaaaaccgaggagcccgcagccgccgagcagacaggcagaacccccgaagaaggaagccgccactaccgggccccaagttaaacgagccgatgaatggaaagatccctggagacgctctaagagccctaaaaaaaagctcggggtttctgtgagtccctcacgggcccggcgtagacgaaaaactagtgcttccagtgcctctgcttccaattccagtcggtctagcagcaggtctagttcttacagcggaagcggcagctcgaggtcccgctctcggtcctctagttactcctcatattctagtcgctcaagcagacattcttccttcagtggctcgagaagccgctcgcggtccttctcctcgtcgccaagtccatccccaactccctcaccacatcgcccttctattaggaccaagggggagccagctccccctcccgggaaggccggagagaaatctgtgaagaagcccgctccacccccagccccgccacaggctactaagacaactgcaccagtaccagaaccgacaaagcctggggatcctcgggaagcccgccggaaggaaagaccggctaggacacccccccgccgacgtctgataaaggaagccggatcagcaatgaaccaccagacgcggaccgggagggccctcctgcagccatcaggcccaacccatccccagacagaagttttgggaacagggtcccaagttggggattgggctccacgatcccagagcgggcgagaggcacgcacccctaagccactccaacccaggctgactggctctgctagctgccatccctcaccccgcgctcccgcacgttcacgggcctgtccggcaaagccaagaatacccgcaccaccagcgccgaatcaaggaagaccggctagatgtttagggggtaggtcatgttag

SEQ ID NO: 13876 - DNA, 2862 bp, Artificial Sequence
  Description of Artificial Sequence: Synthetic coding sequence
atggatgtagccgaatcaccagagagggacccccattcacctgaagacgaggaacagccacaaggactgagcgacgatgacattctccgagacagcggttctgaccaggatttggacggcgccggagtacgcgcatcagatctggaggacgaggaatccgcggccagaggcccgtcccaggaggaagaggacaaccatagtgacgaggaagaccgggcttccgagcctaagtcgcaggaccaggattctgaggtgaacgaactctcacgagggcccacgtcctccccatgtgaagaagaaggcgatgagggcgaggaggatcgcacctcagatcttagagatgaagcctccagcgtgacccgtgagttggacgagcatgagctcgactacgacgaggaagtccccgaggagccagcacctgccgtgcaggaagacgaggccgaaaaagccggggctgaggatgacgaagagaagggcgaagggactcctcgcgaggagggcaaggccggggttcaatctgtgggagagaaagagagcttagaagcagccaaagagaagaagaaagaagacgatgatggggaaattgatgatggagaaattgatgacgacgacttagaggagggtgaggtgaaggacccaagcgacaggaaggtgaggcctagaccaacctgccgctttttcatgaagggcaactgcacatggggtatgaactgtagatttatccaccccggagtgaatgataaggggaattatagcctaattactaaagcggaccctttcccaccaaacggcgcaccgcctctcggtccccacccactcatgcccgcaaacccatgggggggtcctgttgtcgatgagatactgccaccccctccccccgaacctcccactgaatctgcctgggaacgaggactgcgccatgcgaaggaggtactgaagaaggctaccatccgtaaagagcaggagcctgactttgaggagaaaaggttcaccgtaacaattggagaggacgagagagaattcgataaggaaaacgaggttttccgcgactggaattctaggatcccacgagatgtgcgcgacactgttctagagccgtatgcagacccctactacgactatgagatcgaaaggttttggcgcggcggccagtacgagaatttcagagtgcagtacacagagaccgaaccataccataactacagggagagagaacgagagagggaacgggagaataggcagagggaacgggagcgcgaacgcgagcgagatagagagcgtgaacgcaggcaacgcgagcgcgaacgggagcgcgagcgcgagagagacaaagagcggcagaggaggaaggaagagtgggagagggagcgcgccaaacgtgacgaaaaggatcggcaacacagggaccgcgatcgcgagaaggaacgcgagaaggagaaaggcaaacctaagccccggagtccccagcctccctctaggcaggcggagccgccaaaaaaggaggcggctacgacagggcctcaggtgaagagagccgatgaatggaaggacccctggcgacggagtaagtcaccgaaaaagaagctaggcgtttccgtttcgcctagtagagctcggaggcggagaaaaacctctgcaagcagtgctagtgcctcgaactcatcccggagtagttcccgcagctcgtcctactccggctcgggaagcagcagaagtcgctcccgcagctctagctattcttcgtactcctcccgatctagtcgccactcctccttcagcggatctagaagccggtcccggtctttctcaagctcacctagtcctagcccaaccccaagtcctcatcgaccctctatccggacaaaaggagaaccagcacctccccccggaaaggcaggagagaagtccgtcaagaaaccagcccctccccctgcaccacctcaggccactaagacaacggctcccgtgccggaacccacgaagcccggggacccccgcgaggcaagacggaaggaacggcccgcaagaacgccaccccggagaaggactttgtcaggatcaggatccggatctggctcctcctacagtggttcctccagtagatcgaggtctctttctgtttccagcgtctcgtccgtctcctccgccacgagcagctcgagttcagcccattcagtggatagcgaagatatgtacgcagatctggcatcccctgtatccagcgcctcttcacggtctcctgcccctgcacaaacaagaaaggaaaagggcaaatccaaaaaggaggatggagtcaaagaggagaaacgaaagcgggattccagtacccagcctcctaaatccgctaagcctccggccggcggtaaatctagtcagcagccgtcgacccctcaacaagcccctcctggccagccacagcagggaacttttgtggcccacaaagagatcaagctgacactgctaaacaaagcagcggacaaaggctcacgaaaaagatatgaaccctccgataaggaccgacagtcccctccacctgcgaagcgaccgaacacctccccagatagaggctctcgggatcggaaatctggtggcagacttggtagtcccaaacctgagagacagcgcggccagaactccaaagctcctgccgcaccagccgataggaaacggcaactctcaccacaatccaagtcctcttccaaagttacctccgtgccagggaaggccagtgatcctggagccgcttcgacgaagtcaggtaaagcgtccaccctatcacggcgtgaggaacttctgaagcagttaaaagccgtagaagatgcgatcgctcggaaacgcgctaagattccaggcaaagcctag

SEQ ID NO: 13877 - DNA, 2934 bp, Artificial Sequence
  Description of Artificial Sequence: Synthetic coding sequence
atggatgtcgcagagagtccagagagagaccctcatagccctgaagacgaggagcaacctcaaggcctgtctgatgacgatattctgcgggatagtgggagcgaccaggacctggacggcgccggcgtccgcgcctccgatctcgaagacgaggaatcagcagctagagggccctctcaagaagaggaagacaatcacagcgacgaagaagacagagcctctgaacctaagtcacaagaccaggattctgaggttaatgagctgtcacggggccctacttctagcccctgcgaggaagaaggcgatgagggagaagaggacagaactagcgacttaagagatgaagctagctcagtgacaagagagttagatgagcatgagttggattacgacgaagaggtgcctgaagaaccggctcccgctgtacaagaggatgaagctgaaaaggctggtgctgaggatgatgaagagaagggagaaggcacgccaagagaagaggggaaggcaggggtgcaaagcgttggagagaaagagtccctagaagcagctaaggaaaagaaaaaagaggacgatgatggagagatcgacgatggggaaattgatgatgatgatctcgaggaaggcgaggtgaaggatccctctgaccgcaaagtgaggcctcgtcccacttgccggttctttatgaaggacgtggtcaccccactgagtacactgctcccaccaatttcaaactcgattccgtttcggggacaggtgaaaggtaactgcacctggggcatgaactgccggtttatccaccctggcgtgaacgataaaggaaactacagtctgattacgaaggcagatcccttcccccccaatggagcacctccacttggcccgcatccactgatgcccgccaacccctggggcggaccagtagtagatgagatacttcccccacctccccctgaaccccctacagaatcagcatgggagcgggggctgcgccacgcaaaagaagttctcaaaaaggcgaccatacgtaaggagcaagagcccgatttcgaagaaaaaagattcacagttacaattggtgaagacgagagagagtttgataaggagaacgaggtatttcgagattggaatagccgaatacccagagacgtcagagacacagtactcgagccctacgcggacccttactacgactatgaaatcgagcgcttttggcgaggcggtcagtacgaaaatttccgggttcagtacactgagacggaaccttaccacaattatcgggaacgcgagagagaacgggagcgcgaaaatagacagcgcgaacgagaacgcgagagagagcgagatagagagcgtgaaagaagacaaagagagagggagagggagcgggaacgagaaagagacaaagagcgtcagcgtaggaaggaagagtgggaacgagaaagagcgaagcgcgacgagaaggataggcagcatcgagaccgggatagagaaaaagagcgagaaaaggagaagggcaaacccaaacctagatccccacaacccccgtctcgacaggctgagcctccaaagaaggaggccgccaccaccggccctcaggtaaagagagccgacgagtggaaagatccttggaggaggagcaagtcacccaagaaaaaattgggcgtgagcgtgtcaccttcccgcgccaggcggaggcggaagacaagcgcaagtagcgcttccgcatccaacagcagcaggagttccagtagaagcagctcatattctggctcaggctcctctagaagtagatctaggtcttcaagttatagttcttacagttcccgcagctcgaggcattcatccttctccggaagcaggtctagaagccggtctttcagcagctcccccagtcctagcccaacccctagtcctcataggccatcgatcaggaccaagggagaacccgcaccacctcctggaaaagcgggagagaagtcagtaaagaaacccgcacctccgcccgctccacctcaggccactaaaacaaccgcgcctgtacctgaacccacaaaacctggagacccaagagaggccagaaggaaggagcggcccgcacggaccccaccgcgaagaagaactctctccggcagcggctcaggctctggctcttcttactccggtagctcatccaggtctcgttccctgtccgtcagcagcgtttcaagcgtttcctccgctacgagttcctcaagtagtgctcactctgtcgattccgaagatatgtatgccgacctcgcttcgcccgtgtccagcgccagcagccgatcacccgccccagcccaaactcgtaaggagaagggaaagtccaagaaggaagatggagttaaagaagaaaagcgcaagcgagactcttcaacccagccccccaagagtgctaagcctcctgccggtggtaaatcttctcagcaaccatcgacgcctcagcaggccccgcctggtcaaccgcagcaagggacatttgtggcacataaggaaattaagctgacccttctaaataaagccgcggataaagggtctcgcaaacgctacgagccgtcagacaaagacagacagagccccccccccgctaagcgacccaacacctctcctgacaggggatcgcgggacaggaagagcggggggagattggggtcgcctaaacccgagcgccagcgaggtcagaactctaaagcccccgcagcgcctgccgatcgtaaacggcagctctcccctcagagtaagagctcctcaaaggtcacaagcgttccaggcaaggcatcggatccaggcgcagcctcgactaagagcgggaaagcctctaccctgtcgagaagagaggaacttctgaaacaactgaaggctgtagaggatgcgattgcaagaaagcgcgcaaaaattccgggtaaggcctag

SEQ ID NO: 13878 - DNA, 999 bp, Artificial Sequence
  Description of Artificial Sequence: Synthetic coding sequence
atggatgtagcggaatcccccgagcgcgacccacattctccggaagatgaggagcagccacagggtctcagtgacgacgatatcctgcgtgatagcggctccgaccaggatcttgacggggctggagtgcgtgcatcagacctggaagatgaggagagtgcagcacgcggccctagtcaggaagaggaagacaatcacagcgatgaggaggatcgggctagtgagcctaagagccaggaccaggattctgaagacgacgacttggaggagggagaggtcaaggatccatcagaccgcaaggtacgcccccggccgacatgccggttttttatgaagggcaattgcacatggggcatgaattgcagattcatccatccgggcgttaatgacaaggggaattacagcctgatcaccaaagctgatccctttccccccaacggtgctccacctctgggaccccatcccctgatgccggctaacccttggggcggccccgtggtggacgaaattttaccacccccaccccccgagcccccaacagagtcagcctgggagagaggcctcagacatgccaaagaggtactcaagaaggccacaattaggaaggagcaggaacctgatttcgaagaaaaacgatttaccgtgactattggcgaggatgagcgggaattcgataaagaaaatgaggtgttcagagactggaacagccggataccacgtgatgttcgagatacggttctagaaccttatgccgacccatactatgattacgagattgaacgattctggcgaggcgggcagtacgagaacttcagggtccagtacaccgaaacagaaccttaccataattacagagagcgggagagagaaagagagagagagaacaggcaacgagagcgcgacaaagaacgccagcgcagaaaagaagagtgggagcgagagagagctgctaaattatctcaccaaaggagacggctccctcctcgcgggcggcgctag

SEQ ID NO: 13879 - DNA, 2847 bp, Artificial Sequence
  Description of Artificial Sequence: Synthetic coding sequence
atggaagagaaagagatcttgcgcagacagataaggctgttacaaggtctgatcgacgactataaaacattgcatggcaatgctcccgcccccggaactccagcagccagcggctggcagccacccacataccactctggtcgggcgttctccgctcggtacccaaggccgagccggagggggtactctagtcaccatggcccgagctggcggaagaaatacagtctggtcaatcgtccgcctggaccttctgacccacccgcggatcacgcggtcagacctctgcacggcgcaagggggggtcagccacctgtgcctcaacaacatgtgttagaacggcaggtccagctgtcacaaggccagaacgttgtgattaaggtaaaacccccaagtaaatccggctccgcttctgcttctggcgcacagagaggtagtctagaggaatttgaggaaacgccttggtcagatcagagaccacgcgaaggagagggagagccgcctcggggtcagctccaaccaagtaggcccactcgggccagaggcacatgtagcgtggaagacccactcctggtgtgtcagaaggagcccggaaagccacgtatggtgaaatccgtcgggagcgtgggcgactcaccaagggagcctcgacgcacagtgtcagaatcagtgattgcagttaaagctagcttcccgtcctcggccttgccacccagaactggcgtggcccttggcagaaagctgggctctcattctgtcgcctcatgtgccccccaactcctgggtgatagacgtgttgacgccgggcataccgatcagccagttccttcaggttctgttggcgggcctgcccgccctgcatctggcccgcggcaggcaagggaggccagcctcgtggttacctgtcgaaccaacaaatttcggaagaacaactataagtgggtggccgcctctagcaagagcccaagagtagccagaagggctctgagcccacgggtggctgcggagaatgtgtgtaaagcttctgccggcatggcgaataaggtggagaaaccccagctgatcgctgatcctgagccaaaaccgcgcaaacccgcaacatcatctaaaccaggctccgcccctagcaagtacaaatggaaagcctcgagtcctagcgcttcatcatctagctcctttagatggcagtcagaagcttcctctaaagaccacgcgtctcaactgtcacctgtgctgagcaggtccccttctggggacaggcccgcagtgggccattccggtctgaagcctttgtctggcgaaacccctctgtctgcttacaaggtgaagtcgagaactaagatcatcaggagaaggtcatctaccagcttgccaggcgacaaaaaatcaggtacttctccagccgcaacagcgaagagccacctttcactcagaaggagacaggccctgcgcggcaagagctccccagttctgaaaaagacccccaacaaagggctcgtccaagtgacaacgcatcgcctctgtagactgccaccctcccgcgctcatctgcccactaaggaagcctccagcctgcatgcggttcggaccgcccctacctctaaggtgattaaaactcgctatcggatcgttaagaagacgccagcctcccccctgtcggcaccgcctttcccgctgtctcttccatcctggagggcgcgtcggttgagtctgtctcggtccctggtgctgaatagattaaggcccgttgccagtggcggcggcaaggcccagccaggcagcccgtggtggcgaagcaagggctacagatgcatcgggggtgtgctttataaagtctccgccaataagctgtccaaaactagtggacagcctagcgatgccggaagcaggccactgttgaggaccggcagattagaccccgccggatcctgcagcagatccttagccagccgagccgtccaacggagcctggccataattaggcaagctcgccagcgccgggagaagcgcaaggaatactgtatgtactataacagatttgggaggtgtaacaggggtgagcggtgtccttatattcacgacccggaaaaggttgccgtgtgtactcggtttgtgagggggacctgcaagaagactgacggcacctgccccttctcgcaccacgtcagtaaagaaaagatgcccgtttgtagctacttcctgaaaggcatatgttcaaattccaattgcccttattcacacgtgtatgtgagcagaaaggctgaggtctgctccgacttccttaagggctattgcccactcggcgccaagtgtaaaaaaaaacacactctcttgtgtcctgatttcgcgagacggggggcctgcccccgtggtgcccagtgccaattactgcacagaacacaaaaacgacattctcgccgcgccgccacgtctcctgcgccagggccttccgacgcaaccgcccggagccgcgtcagtgctagccatggccccaggaagccgagtgcctcccagcgccccacccgtcagactccgagcagtgctgctctcaccgccgccgccgtggcagccccgccacactgtcctggcggcagcgcctcaccaagctcttccaaagcctcctcttcatctagcagctcctcctcaccaccagcttccctggaccacgaggctccctccctgcaggaggcggctctggcagcagcttgcagtaatagactgtgcaagctgccaagcttcatttctctgcagtcctcccccagtcctggcgcgcagcccagggtacgcgcaccacgggctccactgacaaaggattccggaaaacccctgcacataaaacccaggttgtag

SEQ ID NO: 13880 - DNA, 2916 bp, Artificial Sequence
  Description of Artificial Sequence: Synthetic coding sequence
atgagtaacgtctctgaagagcgtcgaaaacgccagcagaacattaaggagggcctccagttcatccagtcccctctcagctacccagggacccaggagcaatatgccgtctacttgcgagcgcttgttagaaacctgtttaacgagggtaacgacgtttaccgagaacatgactggaacaatagcatcagtcagtataccgaggctctgaatattgccgattatgctaaatcggaggagatcttgattccgaaagagatcatcgagaagttgtacattaatcgtatcgcttgctactccaacatggggtttcacgataaggtcttggaagattgcaatatcgtactgtctctcaacgcttcgaattgcaaagctctgtaccggaagtccaaagctttatcggacctgggcagatacaaaaaagcatatgatgctgtggctaagtgcagtcttgccgtgccgcaagatgaacatgtgattaaactgactcaggaactggcacagaagctcgggttcaagatcaggaaggcttacgtccgtgcagagctcagcctgaagagcgtgccgggtgacggggccaccaaggctttgaatcactcggtggaagatatcgaaccagacttactgactccgagacaagaagccgtgcccgtggtgtctttgcctgcaccaagtttttcccatgaggtggggtcagaactggcctcagtgcccgtcatgcctctgacatcaattctgcccctccaagtggaggaatcggccctcccatcagcggtgctggccaacggaggcaaaatgccgttcactatgcctgaggcattcctggatgacggcgacatggttctgggcgatgaattggatgatttgctggatagcgcccctgaaactaacgagacagtgatgccatctgctcttgttcgagggccactgcagaccgcctccgtctctccttccatgcccttcagcgcctctctgctgggcacacttcccattggggcacgttacgcacccccgccctccttctcggagttctatccacccctcacttcgtccttggaggatttctgtagttcacttaacagcttttctatgtctgagtccaagcgagaccttagtacaagcacctcccgtgaaggtacccctctgaacaattccaacagttccttgctgctaatgaacggtcccggctccctgtttgctagtgaaaactttctggggatttctagccagccccggaatgactttggaaatttttttgggtccgccgtgacgaaacctagctcaagcgtgacacccagacatcccctcgaggggacccatgaactccgtcaggcatgccagatctgttttgtgaagagcgggcctaaattgatggatttcacctaccatgccaacatcgatcataaatgtaagaaggacattcttatcggccgcattaaaaacgtggaggataaatcatggaaaaagatccgccccaggccaaccaaaaccaactacgagggcccatactacatctgtaaagacgtcgccgccgaagaggagtgccgctactccggccattgcacatttgcatactgccaggaggagatcgatgtgtggacattggagcgaaagggagctttttctagagaagcattcttcggggggaatggcaaaatcaatcttacagtgtttaagctcctgcaggagcacctcggcgagtttatcttcttgtgtgaaaaatgctttgaccacaagcctaggatgatttctaaacggaacaaagacaattctacggcctgcagccaccccgtaacaaagcacgagttcgaagacaacaagtgcttggttcacattcttagagagaccactgtcaaatacagcaagatcaggtcatttcatggacagtgccaacttgacttgtgccgccacgaagtgagatatgggtgtctccgcgaagacgaatgcttttacgcacactcactggtggagctgaaggtctggattatgcagaatgagacggggataagtcacgacgccatcgcacaggaatcgaagcgctactggcagaatcttgaggctaatgttcccggcgcgcaggtcctgggcaaccagatcatgcccgggttcctgaacatgaagattaagttcgtgtgtgctcagtgcctgaggaacggccaggtgattgagccggataagaaccggaaatattgtagcgctaaggctagacattcatggacaaaggaccgccgtgcaatgcgggtgatgtccatagagaggaagaaatggatgaacattagacctctcccaaccaagaagcagatgccgctgcagttcgacctgtgtaaccacatagcttctgggaagaagtgccagtatgtcggcaactgcagctttgcacattcccccgaggaaagggaggtgtggacatacatgaaagagaatggcattcaggatatggagcagttttatgaattgtggcttaagtcacagaaaaacgagaaatctgaagatatcgcaagccagtcaaataaggaaaacggcaagcagatccatatgccaacagactatgcagaggtgacagtagatttccactgttggatgtgcggaaagaactgtaattcagaaaaacagtggcaggggcacatttcttccgagaaacataaagagaaggtattccatacggaagacgaccaatattgctggcagcatcggtttccaactggctacttcagcatttgtgaccgctacatgaacggtacctgcccagaaggtaatagttgcaagttcgcgcatgggaatgcggagttgcatgagtgggaggagcgtcgcgatgcgctgaaaatgaagctgaataaagctagaaaagaccacctgatcggacccaacgacaatgattttggtaagtactctttcctgtttaaagatctgaattag

SEQ ID NO: 13881 - DNA, 2916 bp, Artificial Sequence
  Description of Artificial Sequence: Synthetic coding sequence
atgagcaacgtgagtgaggagcgccggaagcgtcagcagaacatcaaggaaggtttgcagtttatccagagccccctttcatatcctggcactcaggagcagtacgcagtatatttaagggccttggtgagaaacttattcaatgaggggaatgatgtctaccgtgagcatgactggaacaattctataagccagtataccgaagccttgaatattgccgactatgcaaaatccgaggagattttaatccccaaggagattatcgagaaactctatattaaccggatcgcctgttactctaacatggggtttcatgataaagttcttgaagattgcaatattgtgctgtctttaaatgcctcaaattgcaaagcactgtaccggaagagcaaggctttgagcgatctgggacgttacaagaaagcgtatgacgcagtcgctaaatgtagcctcgcagtccctcaggatgagcatgtgattaagctgacacaagaactggcacagaaactcggctttaaaataaggaaagcatatgtccgagccgagctcagtctgaaatcagtgcctggggatggggcaactaaggctcttaaccattcagtggaagacatcgaaccagatctgctgactccccggcaggaagctgtgcctgtagtgtccctcccggcaccgagtttttctcacgaggttgggtccgaactggctagcgtgcctgtcatgccactcacatccattctgcccttgcaggtagaggagagtgctctgccaagcgcagtcctggccaacggtggaaagatgccttttactatgccagaagcattcctggatgacggggatatggtgctgggcgacgagctggacgacctcctggacagcgcccccgagacaaacgaaacggtaatgccttctgctcttgttaggggtcccttgcaaactgcatccgtcagcccctctatgccattctccgccagtctgctcggtaccctgcctatcggagccaggtacgctccacctccgtcattttcagagttctacccacctctgacttcctccttggaggatttctgtagctcattaaatagttttagtatgagtgagtcaaaaagagacctctctacatccacgagtcgcgagggtacacctctgaataattccaatagttccttgctcctgatgaacggccccggatcccttttcgcaagcgagaatttcctaggaatttcctcccaacctcgaaatgatttcggcaatttctttggttccgcagtcaccaagcccagcagtagcgtcacaccccggcatccactggaggggactcatgaactacgccaagcctgtcaaatctgttttgtcaaatctggacccaagctcatggacttcacatatcacgcgaacatcgatcataagtgtaagaaagacatcctgataggccgaatcaagaatgtggaggacaagagctggaaaaagatacgccctaggccaaccaagacgaattatgagggcccgtactatatttgcaaggacgttgctgcagaagaggagtgccggtatagcggccattgtacattcgcctattgtcaggaagaaattgacgtttggacattagagcggaaaggcgctttctcccgcgaggccttcttcggtggtaacggaaagatcaatctgaccgtgttcaagcttctacaggagcacttgggtgagtttatcttcctgtgcgaaaagtgttttgaccataaacctagaatgatctctaaaaggaacaaggataattcaacagcctgtagccatcccgtcactaaacacgagttcgaggacaacaaatgcctggtccatatactaagggagacaacggtgaagtacagcaagataaggtccttccatgggcaatgtcagcttgacctgtgccgccacgaggtgcggtatggttgtctgagagaagatgagtgcttctacgcccactccctcgtggaactgaaagtgtggattatgcaaaacgagacaggaatttcccatgacgcaatcgcacaggagagcaaacggtattggcagaaccttgaagccaatgtgcctggcgctcaggtgctgggaaatcagatcatgccgggcttcctgaacatgaagatcaaattcgtctgtgcgcagtgcctgaggaacggccaggtgatagagccagataagaacaggaagtactgcagtgcgaaggccagacactcttggacaaaagacagaagggccatgcgcgttatgtcgatcgagagaaagaaatggatgaatattcggccactccctaccaagaagcagatgcccctccagttcgacctttgcaatcacatcgcctctgggaagaaatgtcaatacgttgggaactgcagctttgctcactcccctgaggaacgcgaagtctggacttacatgaaggaaaatggtatccaagacatggaacagttctacgagctatggctcaagagccaaaagaacgaaaaaagtgaggacatcgcatcacagagcaacaaggaaaacggtaagcagattcatatgccaacagactatgcagaagtgaccgtggatttccattgctggatgtgcggaaaaaactgtaacagcgaaaaacagtggcagggacacatttcatcggaaaagcacaaagaaaaggtgttccacacagaagacgaccagtactgctggcagcatcgtttcccaacggggtactttagtatttgcgacagatatatgaacggaacatgcccagagggcaactcttgcaaatttgctcacggaaatgccgagctgcatgagtgggaggagaggagggatgctttgaaaatgaaattaaataaggctcgaaaggatcatcttattggaccaaatgataatgactttggcaagtactcttttctgtttaaggatctgaactag

SEQ ID NO: 13882 - DNA, 2934 bp, Artificial Sequence
  Description of Artificial Sequence: Synthetic coding sequence
atggaacgccagaaacgtaaggccgatattgagaagggactgcagttcatccagagcaccttgccattaaaacaggaagagtacgaggcttttctgcttaagctcgtccaaaacttgtttgcggagggcaacgaccttttccgggagaaggattacaagcaggccttggtgcagtatatggagggcctgaatgtggccgattatgcagccagcgatcaggtggccctgcctcgcgaactgctatgcaagcttcacgttaatagagccgcatgctactttacaatggggctgtatgagaaggctttagaggattccgagaaggctctgggcttggactccgagtctatccgggccctgttccgcaaggcgcgggctttgaatgagttaggccgacacaaagaagcctatgagtgctcttcgagatgtagtctagcattgccccatgatgagagtgtgacccagctgggacaggaactggcacaaaagctagggctgagagtacggaaggcctataaacgcccgcaggaactcgaaactttctctctgttaagcaacggaactgctgcaggtgtggcagaccagggcacttcgaatggactggggtcaatcgacgatatcgagactgattgctatgtggacccacgaggttccccggcacttcttccatctacccccaccatgcctttgtttccccacgtactcgatctgctggcgcctctagatagcagccggacacttccctccaccgattcactagatgacttctccgacggagatgtttttggccccgaactcgatacgctgctggacagcttgtcccttgtgcagggtggactcagtgggagcggggtccctagtgaactgccccagctgattccggtttttcctgggggcaccccgttgcttcccccagtcgtcgggggcagcattcccgtttcctctcctcttccccccgcgagctttggtctcgtgatggatccttccaaaaagctggctgcgtccgttctggacgctttagatccacctggacccactctggatcctctggacctgctgccttattccgaaacacggctggacgccctagattcattcggttccacacgagggagtcttgacaagcctgacagcttcatggaagagactaattcacaggatcatagaccaccctcaggcgcgcaaaaacccgcaccgtctccagaaccttgcatgccaaacacagcattactgattaagaatcccttggccgccacccacgaattcaaacaagcctgtcaactctgctatcccaaaactggaccaagggcgggggactacacctatcgcgaaggactcgaacacaaatgcaagagggacattcttctgggtcgcctgagatcaagcgaggaccagacctggaagcggattcggccaagaccaaccaagacgagcttcgtgggatcttattacctctgcaaagatatgattaacaagcaggactgcaaatacggcgacaactgcacattcgcataccatcaagaggagatcgatgtatggaccgaggaaaggaagggcactctgaacagggacctcctgtttgatccactggggggcgtgaaacgggggtctctaactatcgcgaagctccttaaagagcatcaaggaatttttactttcctctgcgagatttgcttcgactctaagcccaggatcatctccaagggtaccaaagacagcccatcagtatgcagtaatctggctgccaaacacagtttttataataataaatgcttagtgcatatcgtcaggagtacttctcttaagtactcaaagatccgtcaatttcaggaacacttccaatttgacgtgtgcagacacgaggtgcgctatggctgcctacgggaggactcctgccatttcgctcactcttttatagaattgaaggtgtggctgctccagcaatattcaggcatgacacatgaagacatcgtgcaggagagtaagaaatattggcaacagatggaggcgcacgctggaaaggcaagcagttcaatgggggcccccagaacacacgggcctagcactttcgacctgcagatgaagttcgtgtgtggccagtgttggcggaacggccaggtcgttgagccagacaaagacctgaaatactgctcagccaaagcgcgtcactgctggacgaaagagcgccgtgttctgctggtgatgagcaaggcaaagcgcaagtgggtttccgttcggcccctgccttccatcagaaacttccctcagcaatatgatctttgtatccatgcacagaacggtaggaagtgccagtatgttggcaactgttccttcgctcactctccagaagagagagacatgtggacttttatgaaagagaacaagatcctggatatgcagcagacctacgacatgtggctgaaaaaacataatcccggtaaacccggggaaggcaccccaatttcaagtcgagaaggggagaaacagatccagatgcccaccgactatgcggatatcatgatggggtaccactgttggctgtgtggcaaaaacagcaattctaaaaagcagtggcaacagcacattcagtcggagaagcataaagaaaaagtctttacaagcgactctgacgccagtggttgggccttccgattccctatgggagaattcaggttgtgcgacagactgcagaaggggaaggcctgccccgatggggacaagtgtagatgcgcacacggccaggaggagctgaatgagtggctcgatcgacgcgaagtgctcaagcagaagctggctaaggcaaggaaagacatgctcctgtgccctagggatgatgatttcggcaagtacaacttcctcctgcaggaggatggggatcttgcaggtgctaccccagaggcgccggctgctgcggcaactgctacaacaggcgagtag

SEQ ID NO: 13883 - DNA, 2934 bp, Artificial Sequence
  Description of Artificial Sequence: Synthetic coding sequence
atggagcgccagaagcggaaggctgatatcgaaaagggattgcaattcatacagagcaccctgccccttaaacaagaggaatacgaggcctttctcctgaaactcgtgcaaaatctattcgctgaggggaatgacctgttccgcgaaaaggactacaaacaggcacttgtacagtatatggaaggacttaatgttgctgactatgccgcatccgaccaggtcgctctcccgagagagttgttatgcaaattacacgttaatcgcgcggcgtgctattttacaatggggttgtacgagaaggctctggaggattcagaaaaggcactcggcctggacagtgaatcgattcgcgcactttttcggaaagccagagcattgaacgagttgggccgacataaggaggcctacgagtgctccagtcgctgctccctcgcccttccacatgatgagagcgtgacacagcttggtcaagagttagctcaaaagctaggacttcgcgttaggaaagcttataagcgcccgcaggagctggaaacgtttagcctgttaagcaatggaactgctgctggggttgctgaccagggaacttccaatgggctggggagtattgatgatatcgagactgactgttatgtcgatcccagggggtcccccgcccttctgcccagtactcccacgatgccccttttcccccatgttttggatctactggctcctctggactcatcccgaacccttccctctaccgattcattggacgattttagcgatggcgacgttttcgggccggaactggatacgttgctggattctttgagtctggttcaaggaggtctctccggcagcggggtaccaagtgagctgccccagttgattcccgtttttccaggcggtacgccattgctacctccagttgtgggaggctccatcccagtgtccagtccactgccgcctgcctcttttggcttagtcatggatccttctaaaaaactggccgcctcggtgctcgacgccctggacccaccaggcccaacactggacccactggatctcttgccttacagtgagacaaggctggacgccctcgactctttcggcagtactcggggctccctcgacaaacctgacagtttcatggaggaaacaaattcacaggatcacaggcctccctctggagctcagaagcctgctcctagtcccgagccatgtatgcctaatacagccttactgatcaaaaaccctcttgcagcaacccacgagtttaaacaggcctgccagctgtgctaccctaagaccggacctcgggcaggagattatacatacagagagggtctcgagcataagtgcaaacgggacattcttctgggaagactgagatcctctgaagatcagacctggaagcggattcggccgaggcctacgaagacctccttcgttggcagctactatctgtgtaaggacatgattaataaacaagactgtaaatacggagacaactgtacttttgcctatcaccaggaggaaatcgacgtgtggaccgaagagaggaaaggcaccctgaaccgcgatttactgttcgatcctctcggcggggtcaagcgaggatcactaaccattgcgaaactgcttaaggagcaccagggcatttttacatttctttgcgagatctgctttgattcaaagccacgcatcattagtaaaggcaccaaagactcacccagtgtttgcagtaatttagcggcaaagcattcattctacaacaataaatgtcttgtgcacatcgtacggtctaccagtctaaagtattcaaaaattaggcagtttcaagagcatttccagttcgatgtttgcaggcacgaggtaaggtatggctgcctcagggaagactcttgccatttcgcacactccttcatcgaacttaaggtttggctactccaacagtactcgggtatgacccacgaggatatagtgcaggaaagtaaaaagtattggcaacagatggaggcacatgctggaaaagcctcctcaagtatgggagctccccggacacatggtccaagcacattcgacttacagatgaagtttgtgtgtggccagtgttggagaaatggccaagtcgttgagccagacaaagacctgaaatactgctctgctaaggccagacactgctggactaaagagagacgggttctactggtgatgtcaaaggctaaaaggaaatgggtgagtgtaagaccactcccatcgattaggaattttccccaacagtatgacctatgcatacacgcccagaatggccgaaaatgtcaatacgttgggaactgttctttcgcacactcacccgaggagcgggacatgtggacttttatgaaggagaacaaaatcttggatatgcagcagacttatgatatgtggctgaagaaacataatccgggcaagcccggagaaggaactccaattagttcaagggagggcgaaaaacagatccagatgcctaccgactacgcggacatcatgatgggctatcactgttggctctgtgggaagaactccaacagtaagaaacagtggcagcagcatatacagtcagaaaagcacaaagaaaaggtcttcacatctgactccgacgcttcagggtgggccttccgcttcccgatgggggagttcaggctgtgcgaccggctgcaaaagggaaaggcgtgccccgacggcgacaaatgtaggtgtgcacatggacaggaggagctgaacgaatggctggaccgaagagaggtgctcaagcaaaaacttgcaaaagcacgtaaagatatgctcctctgccctcgggacgatgattttggaaagtataatttcctcctacaagaagatggggatctggcaggcgccactccagaggcccccgccgccgccgccacagccacaactggggaatag

SEQ ID NO: 13884 - DNA, 876 bp, Artificial Sequence
  Description of Artificial Sequence: Synthetic coding sequence
atggattttgaaaacctcttcagcaaacctcccaatcctgcgctgggaaagaccgctaccgattccgatgaacgaatcgacgacgagatcgacaccgaggtcgaagaaacccaggaggaaaaaattaagttggaatgcgaacaaattcctaaaaaattcagacacagcgctatttctccgaagagcagcctccatcgcaaatctagaagcaaggattatgacgtttactccgacaacgatatctgctctcaggagtcagaagataacttcgctaaagaattgcagcagtatatccaagcacgagaaatggcaaatgcagcgcagccagaggaatcaaccaaaaaggaaggcgtgaaagacacaccacaggctgcaaagcagaagaacaagaacctgaaagctggacataagaacggcaaacagaagaagatgaaaaggaagtggcctggccccggaaacaaagggtcgaacgccctgttgcgcaattccggctcacaagaagaggacggcaaaccgaaggagaagcagcagcacttgtcccaggcctttattaatcagcatactgtggagcgtaaaggcaagcagatttgcaagtattttctcgaacgcaaatgtattaagggggatcagtgtaaattcgatcatgatgctgaaattgaaaaaaaaaaagagatgtgcaagttctatgtgcagggatattgtactcggggcgagaactgcttatatctgcacaatgaatatccttgtaaattttaccatactggcaccaagtgttatcagggggaatactgcaaattctcacatgccccactgaccccagaaacgcaggaactcctagccaaggttcttgatactgaaaagaaatcttgcaaatag

SEQ ID NO: 13885 - DNA, 876 bp, Artificial Sequence
  Description of Artificial Sequence: Synthetic coding sequence
atggacttcgaaaacctcttttcaaaaccccccaacccggcactgggcaagacggccactgacagcgatgagagaattgacgacgagatcgataccgaagtcgaggagacccaggaggagaagattaaactggagtgtgagcagatcccaaaaaaatttcggcatagtgcaatctcaccaaagtcttcactacatcgaaaaagtagatccaaggactatgacgtgtattcggataacgatatctgctcacaggaatctgaggataattttgcaaaagagttgcagcagtacattcaagccagggaaatggccaacgccgcacagcccgaggagtccacaaagaaagagggggtgaaggacacgccccaggccgctaaacagaagaataagaatctgaaagccggtcacaaaaacggcaaacaaaaaaagatgaagagaaagtggcctggtcccggcaacaaaggctctaacgcactgctgcgcaacagtggctcacaggaggaagacgggaagcccaaggaaaaacagcaacatctgagccaagcctttataaatcaacatacagtcgagagaaaaggaaaacagatctgtaagtacttcctggagcggaagtgtatcaagggcgaccaatgtaagttcgaccatgatgctgaaattgagaaaaagaaggaaatgtgcaagttctatgttcagggctattgcactagaggagagaactgcttatatctccataacgaatatccttgtaagttttatcataccggtaccaagtgctaccagggcgagtattgcaaattttcgcacgcgccactgacccctgagacacaggaacttttggctaaggttctagatactgagaaaaagtcatgtaagtag

SEQ ID NO: 13886 - DNA, 846 bp, Artificial Sequence
  Description of Artificial Sequence: Synthetic coding sequence
atggccgaagccgcccccgctagagacccagagacagacaagcacacagaggaccagtctccaagcactccactcccacagcctgctgcggagaagaattcctacctctactccaccgaaattacattgtggacagttgtagcggccattcaggcattagaaaagaaggttgactcctgcttgacacggctcctcactctcgagggacgtaccggaactgcagagaagaagttggctgactgtgaaaagacggcagtcgagttcggcaatcagctggagggaaaatgggctgttctgggcacactgcttcaggagtacggactcttgcagcgccgtttggagaatgttgaaaacttgctgaggaataggaacttttggatactgagactgccgcccggcagtaagggcgaggcccctaaagtcccagttaccttcgacgatgttgccgtatacttctccgagctagagtggggcaagcttgaagactggcaaaaggaactgtacaaacacgtaatgagggggaactacgaaacgctcgtcagtctggactacgccataagcaaacctgatatcctaacaagaatcgaaagaggagaggagccttgcctggataggtggggccaagaaaaggggaatgaagttgaagtcggacgacccaggatgatgggcactgggctgccaccttacccggagcatctgacgtctcctctgagtcccgcacaggaggagctcaaggagggccaggcacccaagcagcagcaggactcggaggccagagtggcacccgccgggccagaggctgggctcgcactgaggaccgatcttcaaggggaagctcagatctag

SEQ ID NO: 13887 - DNA, 540 bp, Artificial Sequence
  Description of Artificial Sequence: Synthetic coding sequence
atggccgaggccgcggcacctcccgactggcactgcggactgacatctagagaacgtccccgatctgatctgcagcgctcccccttcaggctctcctggttgctttttagatggtggcgtcgacgctggaatcctcgattgccaggctaccgagcttggagggatgcttgcgggcagccccggagatcatggctcacagcacgccgttggctttggagcagcggcacctcctggcgcgccctggtaaatggaggcgcctcacttgtgtgtgggtcccaggtgggcttggtatccagcgagtggctctgccagaaaggactagtatacgatcggaatgccggacagctggagaggccccaggccttctgcccgggttcgtcgaaaagaaagggccaagtgggtggtgcaagtagagctcatcggcgccccctgtggcatacatgtgcacaggtgagacatgccggcccatgtctcctgcgtccagtctcattgggcctgaggagacatggagtgccatggggcgcttcccaacgcctgtag

SEQ ID NO: 13888 - DNA, 1641 bp, Artificial Sequence
  Description of Artificial Sequence: Synthetic coding sequence
atggcagaggctgcccccgcaagggatcccgaaacagataagcacacggaggaccagagcccaagcactccacttccgcaaccagcggcagaaaaaaactcatacctttactcaactgagataacactctggactgttgtggcagctatccaggccctggagaaaaaggtagactcttgcttgaccagactgttgacactggaaggccggactggtacagccgagaagaagttggccgactgtgagaaaaccgccgtcgaatttggcaaccagttagagggcaagtgggctgtgctgggcacgctccttcaagagtacggattgctgcagcgtagattggagaacgtcgaaaatttactgaggaaccggaacttctggattcttcgcctgcctcctggaagcaagggggaagctcccaaagtgcccgttactttcgatgatgtggcagtgtatttttctgaactcgagtggggtaagctggaggattggcagaaggagctctacaagcacgttatgcgtgggaactatgaaaccctcgtgtccttagactacgcaatttccaaacccgatatcttgacaaggatagagaggggcgaagagccctgtctggaccgctggggtcaagagaagggcaatgaagtcgaagtcggccggccacgtatgatggggacagggttacctccatatcccgagcacctcacctcaccactttcaccagctcaggaggaactgaaagaggggcaggcacctaaacagcaacaggattcagaggcaagggtggcccctgccgggcccgaagccgggggaggtgtcgccatcaagacggaggcgcaatcagaagatgagatgacaccggaacgactttttctcggcgtgagcaggggacaaactgaatgtaggattcctcgcggcccccggaaccgacccggtggaccatcacggcaccaggcccagggaatgccaagggttagagccggagaacccagacctccgggcgcctccggggagacgccacgcgtcctgtctagacggcgtcagcgagcctttccgtgtcccgattgcggccagtcctttcggcttaagattaatctcactattcaccaaagaactcacgtggaggaaggaaggcaagaggcgcctggtaggtctccaacttcctgtggtgacagtcaggctatgctggagcctggtgaggtggttgttcccggacccgtcatcaggtggctcccagaagagccagaaggccgccgctccgttgcaggcggaagagccctggttggtcgacggcccgccgcctccaaaatgtaccattgttcagaatgccttcggttctttcagcagcgcaagtcattattgttgcaccagcgcctgcacacgggtaatgggcaggggtggcctgcatgcccctattgcggcaaagctttcagaagaccatccgacctgttcagacaccagcgcatacacaccggcgagcgaccctatcagtgtccgcaatgcgggagaacctttaaccgcaaccatcatcttgcagtccacatgcagactcatgcccggggccaagtgggcccacattttccggctgcgccagccagacacggctcgttgccattaccttggccgtctagaaaggaagagggatag

SEQ ID NO: 13889 - DNA, 846 bp, Artificial Sequence
  Description of Artificial Sequence: Synthetic coding sequence
atggccgaggccgcaccagctcgagacccagaaactgataagcacactgaagaccaatcacccagcacccctctgcctcaaccagccgctgaaaagaacagctacttatattcaactgagatcacattatggacggtagtggccgcgattcaggccctcgagaagaaggtcgactcttgtctgacacgcctgcttaccctggaaggacggactggaacagctgaaaagaagctggcagattgcgagaagaccgctgtcgagtttgggaaccagcttgaaggcaagtgggccgtcctgggcactctgttgcaagagtacggtctgctgcaaaggagactcgaaaatgtggaaaacctgctccgcaaccgaaacttttggattctccgcctgcctccaggctctaagggggaagcccctaaagtgcctgtcacattcgatgacgtggccgtctacttttccgagctagagtgggggaagctggaggactggcaaaaggagctttacaagcatgtgatgcgaggaaactatgagacgttagtgtcactggactacgccatttccaagcccgatattttgaccagaattgaaaggggcgaggaaccgtgcctcgacaggtgggggcaggaaaaaggcaatgaggtcgaagtggggaggcctagaatgatgggcactggccttcccccctatccagagcatttaacctcacctctcagccccgctcaggaggagcttaaggagggacaagcgcccaagcaacaacaggatagtgaggccagagtcgctccagccggccccgaggccggactagctctaagaactgatttgcagggagaagcccaaatttag

SEQ ID NO: 13890 - DNA, 2589 bp, Artificial Sequence
  Description of Artificial Sequence: Synthetic coding sequence
atggccaccctgaatagcgcttctacaacaggcacaacgccttcacccggccacaatgctccatccttacccagcgacaccttctcatcctctacccccagtgatcctgtgacgaaggacccgccagccgcctcatccacttcagagaatatgcggagttccgagccaggtggccagctcctggagagcgggtgcggcctggtgcccccaaaggagattggagagcctcaggagggccctgactgcggacacttccctcctaatgaccccggggttgagaaggataaagagcaggaggaggaagaggaagggctgccacctatggacctctctaaccatctcttcttcacagctggaggcgaggcgtatctggtggctaaacttagcctgcccggtgggtctgaacttctgctccctaaagggtttccctggggagaagccgggattaaggaggagccgtccctccctttccttgcgtatccaccacctagccacctgacagcccttcatattcagcacggttttgaccctatacagggcttctcttcatctgatcagatactctcccatgacacatctgctcccagccctgcagcttgtgaggagcggcacggcgccttctggtcttaccaactcgcccctaaccctccaggggacccaaaggatggccccatgggaaactcaggcgggaatcatgtcgctgtattctggttatgtttgctctgcaggctggggttctccaaaccacaggctttcatggaccacactcagtcccacggcgtcaaactgacacccgcgcaataccagggcttgtccggatctcccgcggtgctgcaggaaggggatgaaggttgtaaggctctgatcagcttcttggaacccaaattgcccgcccgcccttctagtgacattccacttgacaattcttcaaccgttaacatggaagccaacgtggctcagacagaggatggacccccagaggcagaggttcaggcactgattctcctggacgaagaggttatggccctctctcccccttcacctccaacagctacctgggacccttccccgacccaagctaaagagtccccagtggcagccggcgaagcagggccagactggttcccagaagggcaggaagaagacggtggattgtgtccccctttaaaccagtcctcaccaaccagcaaagaaggtggaacgctgcccgcccccgttggatcaccagaggatccgagcgacccaccccagccatatcgcttagcagacgattacacacctgcgccagctgcgtttcagggcctgagcctgagcagtcacatgtccttgctccactccagaaatagctgtaagactttgaaatgtcctaaatgcaactggcactataaataccaacagacgctggacgtgcatatgagggagaaacatcctgagtcgaactcacactgctcttactgctccgcaggtggagcacaccctcggctggccaggggtgaaagttacaactgtggttataaaccctataggtgtgacgtttgcaattactcaaccactactaagggtaacctttcaatccacatgcaatctgacaaacatctggccaacctgcaagggtttcaagcaggccccggtggacaagggagtcctcccgaggcgagcttgcccccaagtgccggcgacaaggaaccaaaaacgaaatccagctggcagtgcaaggtgtgcagctacgaaactaacatttcccgaaatttacgaatacatatgacatctgagaagcatatgcagaatgtgttaatgctccaccagggcctgccactggggctgccgcccggcctcatgggtcccgggcctccccctcctccaggcgccacgcctacttcccccccagaacttttccagtatttcggaccacaggccctgggccagccacagaccccactggccggacctggccttcgcccagacaaacccctggaggcccagctcttgttgaacgggtttcatcatgtgggcgcccctgcccgtaaattcccaacttcagccccagggagcctgagtccagacgcgcaccttccaccttcgcagctgttgggttcctcatccgactccttaccaacctctccaccgcccgatgattcgttgtctcttaaggtcttcaggtgcctggtgtgtcaggccttttctacggatagcctggagttgctcctgtaccactgtagtataggaaggagtctgccagaggccgaatggaaggaagtagctggagatacacaccgctgcaagctgtgttgctacggcacccagctgaaagctaactttcagctccatctgaagacagataaacacgctcagaagtaccagcttgctgctcacctccgagaaggaggcggggcaatgggcacgcctagcccggccagcctcggagacggtgcaccatacggcagtgtgtcccccttgcatctgcggtgcaatatttgtgactttgaaagcaatagcaaggaaaagatgcagttgcatgcacgcggcgccgcccacgaagagaacagccagatttacaagcgaacaggtactggactgctgataaagtag

SEQ ID NO: 13891 - DNA, 303 bp, Artificial Sequence
  Description of Artificial Sequence: Synthetic coding sequence
atggccaccctgaatagtgcgtccacgaccggcactaccccctctccaggccacaatgcccctagcctcccctccgacacattctcttctagtacaccttctgatccagtcaccaaagacccaccggcggcatcgtctacatcagagaatatgaggagcagcgagcccggaggccaactgctagagagtgggtgtggcctggtgcctcccaaggagatcggagaacctcaagaggggccagattgtggccactttcctcctaacgatccaggtgtcgaaaaggataaggagcaggaagagtag

SEQ ID NO: 13892 - DNA, 7719 bp, Artificial Sequence
  Description of Artificial Sequence: Synthetic coding sequence
atggcaactctgaattcggctagcacaaccgggacaaccccctcacccgggcataacgcgccttcactgccatctgacacgtttagctcaagcacccccagcgatccggtcaccaaggaccctcctgcagcatcaagtacatccgaaaatatgagaagcagcgaaccaggcggccagctcctggaaagcggctgcggattggtccctcctaaagagatcggcgaacctcaggaagggccagattgtggacacttccccccaaatgacccaggggtggagaaagataaggagcaggaggaggaggaggagggccttccacccatggatttgtccaatcacctgttcttcactgcggggggggaagcttacctggtggctaagctctctcttccaggcggtagcgagcttctcttaccaaagggcttcccctggggcgaggcgggcatcaaggaggaaccatccctgccattcctcgcgtatcctccccccagccacctgactgccctccacatccagcacggctttgaccccatccagggattttctagttctgatcagatcttgagtcacgacactagcgctccaagccccgcagcctgtgaagaaaggcacggcgcattctggagttaccagctagccccaaatccgcccggtgatcccaaggacggcccaatgggaaactccggaggaaatcatgtcgccgttttctggctgtgtctcctctgtcgacttggattttccaagccccaggccttcatggatcacacccagagtcacggggtcaagcttacccccgcacaataccagggtctgtctggctctccagctgtgcttcaagaaggcgacgagggctgcaaagccttaatttcatttttagagcctaagttgccagcaagaccttctagcgacattcctctggataactccagtactgtcaatatggaggcaaatgtggcacagactgaggacgggccacccgaagctgaggtgcaggcactgatactgctggacgaggaagtcatggctctcagccctccttcgccacccaccgctacttgggacccttcccccactcaagctaaagagtctcccgtggccgccggcgaagccggaccagactggtttccggaaggacaagaggaggacggcgggctctgccctcccttaaatcagtcaagtccaaccagcaaagagggtggcaccctccctgctcccgtcggcagcccagaggatcccagtgacccaccccagccttacaggctggccgacgattacacgcctgcgcccgccgcctttcaaggcctctctctcagcagtcacatgtcgctcttgcatagccgaaattcctgtaaaactctgaagtgtcctaagtgtaactggcattataagtaccagcaaaccttggacgtgcacatgagggagaagcaccctgaatccaactcccactgttcatattgttctgcaggcggcgctcaccctcgcttggctagaggggagtcctacaactgtggctataagccctacagatgcgacgtgtgcaactattccacaacgacaaagggcaatctgtcaattcacatgcaaagcgataagcatctcgcaaaccttcaaggcttccaggcagggccaggtggccagggctcccctcccgaggcctcgctcccgccatccgccggcgataaagaaccaaaaacaaaatcatcgtggcagtgtaaagtgtgttcttatgaaaccaacatcagtagaaatttaagaatccacatgactagcgagaagcacatgcagaacgtattaatgctgcaccagggtctaccgcttggcctgccgccaggcctaatgggtccaggcccgccacctccccctggtgcaaccccaaccagtcctccagagctgttccagtacttcggacctcaagcactgggtcagccgcagaccccactagccggtccaggccttaggccagacaagccacttgaggcgcagctgctgctgaacggttttcaccacgtaggagctccagctagaaagtttcctacttccgctcccggctccctatcacctgacgcccacctgcccccctctcaattgcttggaagttccagcgactccctgcccacaagccccccacctgacgactcactgtctctcaaggtgtttcgatgtctggtgtgccaagcattttcaaccgacagtctcgagcttctgctctaccattgttctatcggcaggagcctccctgaagccgagtggaaagaggtggccggagatactcacaggtgcaagctgtgctgttatggaacccagctgaaggcaaatttccagctgcacctgaaaacagataaacacgcccagaagtatcagctcgcagctcatttaagagagggagggggggccatgggaaccccttccccagcctccctcggtgacggcgccccttacggaagcgtgagcccgctgcacttgcggtgtaatatctgcgacttcgagagcaattctaaggagaaaatgcagctgcacgctcggggcgctgcgcacgaggaaaactctcagatttataaatttctactggatatggagggcgctgaggccggcgctgagctgggtctgtaccattgtctcctgtgcgcgtgggagacccccagccggttagctgtgctgcagcatctgcgaaccccagcccatcgcgacgctcaggctcaaaggcggttgcaactcctgcagaacggccccaccaccgaggagggcctggcagccttacagtccatcctctccttttcccacggtcagctgcgaactccagggaaagcacctgtcactccccttgcagagcctccaactccagagaaggatgctcaaaataagaccgagcagcttgcctcagaagagacagaaaacaaaacaggaccatccagggacagtgcgaatcagacgaccgtttattgctgcccctactgcagtttcctgagcccggaatcttcacaggtaagggcacacaccctgtcacagcacgcagtgcagcccaagtatagatgtccactgtgtcaggagcagctggtggggagaccagccctacatttccatctgtctcacctgcacaatgtagtccctgaatgcgtagagaagttgctactggttgccaccaccgttgaaatgactttcaccactaaggtgctctccgctccaaccctaagtcccctggacaatggtcaggagcctcctacacatggacctgaacctacgcctagccgggaccaggcagcagagggtccaaatctaaccccagaggcgtctcctgacccgctgccagaaccccctctggcctcagttgaggtgccggacaagccttcagggtctccggggcagccacccagccccgctccatcccccgtgcccgagccagacgcacaagccgaggatgtggctccaccacctaccatggctgaggaggaggagggaaccacgggtgagctcagatcagccgagcccgcgcctgcagattctagacacccccttacctaccggaagacaactaacttcgccctggataagtttcttgatccagctcgaccatacaaatgcacagtttgcaaagaatcttttactcagaagaatatcttgcttgtgcactataattccgtgtcccacctccacaaaatgaaaaaggcagcaattgacccctccgcccctgcaagaggagaggccggcgcccctccaaccaccacggctgcaactgataaaccatttaagtgcactgtctgcagggtttcctacaatcagagtagcactctggagatccacatgaggagtgtactccatcagactagatcccgagggactaaaacagatagtaagatcgaggggccagaaagaagccaagaagaacctaaagagggcgaaactgagggtgaggttggtactgaaaaaaagggtcccgacacttccggctttatcagtggccttcccttcctgtctccccccccaccccctctggatctacatcggtttcccgcccctttgtttacccctcctgtcctaccgccatttcctctggtgcctgagagtttattgaagctgcaacagcagcaacttttactgcctttttacttacacgatctcaaagtgggtcctaagctgactttggcaggacccgcccccgtcctgtctctgccagctgccacccctcccccaccacctcagcctcccaaggcggaattggccgaaagggagtgggagcggcctcctatggcaaaagagggcaacgaggccggcccgtcgagcccacctgatcctctaccaaatgaggccgcgcgcacggccgcgaaggctttactggagaactttggttttgagctagtgattcagtataacgagggtaagcaggctgtcccaccacctcccactccgccgcccccggaagccttaggagggggtgacaagctggcatgcggagcgtgcggaaaattgttttctaacatgctgattcttaaaacccatgaagagcacgtacaccggaggttcctcccgttcgaagcattgagtagatacgccgctcagttccgtaaatcctacgacagcctatatccccctctggctgagccaccaaaacccccagatggaagtctggattcacccgttccccacttgggccctccttttctggttccggagcccgaagccggaggtactagagctccggaggagagatctcgggcggggggccactggcctattgaagaagaggagtccagtagaggcaatctcccccccctggtgcctgccggacgcagattttccaggaccaagttcaccgagttccagacccaagccttgcaatccttcttcgaaacgtctgcgtacccgaaggatggcgaggtggagcgcttggccagcctcctcggtcttgccagccgggtggttgtggtctggttccagaatgcccgacagaaggctagaaagaacgcatgcgaagggggaagtatgcctactggcggtgggacaggtggggcctcaggatgcagacggtgccatgccacattcagctgtgtctttgaactcgtgaggcacctcaagaaatgttatgacgaccagacactggaggaggaggaggaggaggcagaacgtggcgaagaggaagaggaggttgaggaagaggaggtcgaggaggaacagggcttagaaccccccgctggtcccgaaggtcccctacctgaacctcccgacggggaagaactgagtcaggccgaagcaaccaaggcaggcggaaaggaaccagaggaaaaggccacaccttcgcccagcccagcccacacttgtgaccagtgtgcaatctccttctcctcccaagacctattgacctctcatagaaggctgcatttcctgccgtcgctgcagccatctgccccccctcaactgctagacctgcccttactggtattcggggagcgcaaccctttggtggccgcaacttccccaatgccgggcccaccactgaagcgtaagcatgaagacggaagtctcagtcccacaggatccgaagcaggcggcggcggtgaaggcgagcccccccgtgacaagaggttaagaaccacgatacttccagaacagctcgagattctgtaccgctggtatatgcaggattctaatcctacccggaagatgctggattgtatcagcgaggaggtaggtttaaaaaaacgggtggtgcaggtttggtttcagaacacccgggctagagagcgaaagggtcagtttagaagcactccaggcggggttccctcccctgccgtgaagccacctgctaccgccactccagcctctcttcctaagttcaatcttctgctgggaaaggtagatgacggtaccgggagagaagcgcccaaaagagaagccccagcctttccctacccaaccgctaccctagcatccggtcctcagccatttctgccgcccggcaaagaagccaccacccccacccccgagcctccgctccccctgctgcctccgccccctccaagtgaggaagaaggaccagaagagccccccaaagcctcccctgaatcagaggcttgtagtttgagcgccggggacctgtccgactcctccgccagctcccttgcggagcctgagagccctggcgctggcggcacttctgggggccccggggggggtaccggggttcctgatggcatggggcagaggcgctaccgcacccagatgtcgtccctccagctgaagatcatgaaagcgtgctatgaagcgtatcgaaccccaaccatgcaggaatgcgaggtcctcggagaagaaatcggcttgcccaagcgggtcatacaagtgtggttccagaatgctcgggcaaaggagaagaaggcgaaactgcaggggaccgccgccggatccacaggcggctcttcagagggcctgctagccgcacagcggacggattgtccctactgcgacgttaagtatgatttctatgttagttgtagagggcacttattctccaggcagcatctggccaagctgaaagaggctgttcgcgcccagctgaagtcagaaagcaaatgctacgatttggctccggcacccgaagcacccccagctctgaaggcaccgcctgcaacaaccccagcttcgatgccactcggggctgcccccaccctgccccggctcgcacctgtgctgctcagtggcccagctctcgcacagcctcctctgggaaacctcgcccccttcaattctggccccgcagcatccagtggacttctgggcctggccacaagcgtcctacccacgacaacggtggtgcagaccgccggacctggcaggcctttgccccaaagacctatgccagatcagaccaatacctccaccgccggaacaacagacccggtacccggacccccaacagaacccctcggagataaagttagcagcgagcggaaacctgtggctgggcccacctcttctagcaacgatgcactgaaaaacctgaaagctctcaagactaccgtccctgccctattggggggacagttcctgccatttccactccctcccgcaggtggtacagctcctcctgctgtctttggaccgcaactgcagggtgcctattttcagcagttgtatgggatgaagaaggggctctttcccatgaatcccatgatcccacagacgttgataggccttctccctaacgcactgctgcaacctccccctcagcctcctgaacctactgcgaccgcccctcccaaaccacccgagctaccagccccaggagagggagaggccggtgaagtggatgaattgctcaccggctccacaggcatctcaacagtggacgtgacacataggtacctctgcaggcaatgcaagatggctttcgacggtgaggcccccgccaccgcgcatcaaaggtcgttttgcttttttggacgaggctcaggagggagcatgccacctccattaagggtgccaatttgcacataccactgtttggcttgtgaggttctgctgagtgggagggaggccctggcctcccatcttcggtcaagcgcacatcgccgcaaagccgcccctccccaaggggggccccccatcagtattaccaatgcagccacggcagctagtgctgcagttgcattcgctaaagaagaggctcgcctccctcatactgattctaacccaaaaactaccactaccagcactcttctggcattgtag

SEQ ID NO: 13893 - DNA, 1227 bp, Artificial Sequence
  Description of Artificial Sequence: Synthetic coding sequence
atggcaactctgaattctgcctctacaacagggacaacaccctcacccggacataacgccccttccctgccgtctgatactttcagttccagtacacccagcgatcccgtgacaaaggatcctcccgctgctagtagtaccagtgaaaacatgcgtagttctgaacccggaggccagctgttggagtccggatgtggactcgttcccccaaaggaaattggagaacctcaggaaggtccagactgtggccacttcccccccaacgaccctggagtagagaaagacaaggaacaggaagaggaggaggaaggtctgcctcccatggaccttagcaaccacctattcttcactgccggaggtgaagcatatctcgttgcaaagctctcactaccaggcggaagcgaactcctgcttcccaagggcttcccatggggggaggctggcatcaaggaggaacccagcctcccatttcttgcctatcccccccccagccacttaactgcattacacatacagcacggatttgaccccatccaaggattcagctcctccgaccagatcctgagccatgacacaagcgctccgagtccagccgcatgcgaagagcgtcatggggccttctggtcctaccagttggcgcccaatccccccggggatcctaaggatggacctatgggtaatagcgggggaaaccacgtggctgtgttctggctttgtctgctgtgcaggttaggattctctaagccccaggcctttatggatcatactcagagtcatggggtaaagctaaccccagcacagtaccaagggctgtctggaagcccagccgttctgcaggagggcgacgaaggctgtaaagcattgattagttttctggagcccaaactgccggcacggccttcatctgacatacctctggataattcctctacggttaatatggaggcaaacgtcgcccaaaccgaagacggaccacccgaggctgaggtgcaggctctgatcctgttagacgaagaggtgatggcactgtctccacctagtccacccacagccacgtggggatacacgaccgcctgctgcgtcagaggccggcacccgcccgcttggttgtgttgcaatacctgcgctcacctcccaaccgccatgccccgaccccgtggtgtctgttcctgttaccgaatggcacagcctctgcgaaaagatagtcaattgttccgcgcgtcctag

SEQ ID NO: 13894 - DNA, 741 bp, Artificial Sequence
  Description of Artificial Sequence: Synthetic coding sequence
atggctaccctcaatagcgcctccacaactggcacaaccccctctccggggcacaacgctccgagcctcccaagcgacaccttcagtagtagcactccctctgaccctgtgacgaaggacccacctgccgcttcttccacctccgaaaatatgcgttccagcgagcctggcggacagctgctcgagtctggctgtggacttgtgcccccaaaagagataggcgaaccccaggagggacctgattgtggccactttccacctaatgatcccggagtggaaaaggacaaggagcaggaggaggaggaggaaggcctaccccctatggacctatcaaaccacctcttcttcactgccggtggggaggcttacctggtggcaaaattgtcactgcctggcggaagtgaactgctgcttcccaaaggtttcccgtggggtgaagccggtattaaggaggagccgagtctaccatttctcgcgtacccaccacctagtcacctgactgccttgcatatccagcacggatttgacccaatacaaggattttccagctccgatcagatcttatcccatgataccagcgcacccagcccagctgcttgcgaggagagacacggtgcattctggtcttaccagctggccccaaatcccccaggcgaccctaaggatgggccaatgggcaatagcggtggcaaccacgtcgccgtcttttggctttgcctcctgtgcagactgggtttttag

SEQ ID NO: 13895 - DNA, 1563 bp, Artificial Sequence
  Description of Artificial Sequence: Synthetic coding sequence
atgtcccagctgtctctttcttggctcggcctgtggccagtggccgccagtccatggcttctgctgctgctggtaggggccagctggctcctggcccacgttctcgcgtggacatatgcattctacgataactgccggcgcctgagatgctttccacagccccctcgtcgcaactggttttggggtcaccaaggtatggtgaatccaactgaagagggtatgcgggtcctgacccagctggtcgcgacttaccctcagggctttaaggtttggatgggtcccatctcaccactgttgagcctctgtcatcccgatatcatccgaagcgttataaatgcaagcgcagcgatagcccccaaggacaagttcttctacagtttcttggaaccatggctgggggacggactgttgctttcggctggggacaaatggagtcggcacagaagaatgttaaccccagcatttcacttcaatattctcaagccttatatgaaaattttcaatgagagcgtgaacattatgcatgccaagtggcagcttcttgctagcgagggctctgcgtgcctggacatgtttgagcatatatcactgatgacccttgactctttacagaaatgtgtgtttagttttgacagccactgtcaggagaagccttccgaatacatcgccgctattctcgagctttccgcactggttagcaagcgtcaccacgagatcctcctgcacatcgactttctatactaccttacgcctgatgggcagcgatttcgacgcgcatgccgtctggtccatgacttcacagacgccgttatccaagagagacgcagaaccttgccttcccagggagtagatgattttctgcaggctaaggctaaatccaaaacccttgatttcatcgacgtcctgttgctgtctaaagacgaagatggaaagaaattatcagacgaggatattcgggcggaggctgatacattcatgttcgaaggacacgacacaactgcctcgggtctctcatgggtcctctaccacctcgcaaagcaccccgaataccaggagcgatgccggcaagaggttcaggagctgctcaaagaccgcgaacctaaagagattgaatgggacgatctggcccacttgccttttttgactatgtgtatgaaggagtccttgagactgcacccgccagtgccagtcatctcccgacatgtaacacaggacatcgtcctcccagatgggcgggtgatcccaaaggggatcatctgtctcatttctgtgtttggaacacatcacaatcctgccgtgtggcctgatccggaggtgtatgacccttttaggttcgacccggaaaatataaaagagagaagtcctcttgcattcattcctttctctgcaggtccgcgtaattgcattggtcagacctttgctatggccgagatgaaagtcgtcctggccctcacactccttagattccgcgttctcccggaccatactgagcctcgcagaaagcccgagctcgtcctgagagctgagggtggactctggttaagggtcgaacctttgtcatag

SEQ ID NO: 13896 - DNA, 1584 bp, Artificial Sequence
  Description of Artificial Sequence: Synthetic coding sequence
atgtaccaacctgaagatgacaacaatagtgacgtgacttcagacgacgacatgactcgaaaccgcagggaatcctcccccccccacagcgttcactcattcagcggagatagagattgggacagaaggggtcgctcccgagatatggaaccccgcgacagatggagccacactcgtaaccccaggtccagaatgccaccccgcgacctgtctttaccggtcgtcgctaagacaagctttgagatggatcgcgaggacgaccgagattcccgagcttacgaatcaagatcacaggacgccgagagctatcaaaatgtagtggatcttgccgaggaccgtaaacctcacaatacaatccaagacaacatggaaaattatcggaagcttcttagtctcgggttcctggcacaagactccgtgcccgcggaaaaaagaaataccgaaatgctcgataaccttcccagcgctggtagtcagttccctgactttaaacaccttggcacattcctcgtgtttgaagaattagttaccttcgaggacgtcctggtcgatttttcacccgaggagctgagctccctcagcgctgctcaacggaacttatatcgcgaagtgatgctggagaactacaggaatctcgtgagcttggggcaccagttctccaaaccggacattatctcgcgattagaagaggaggagagctatgctatggagaccgacagtaggcatactgtaatttgccagggggaatcccatgatgatcccctggagccccatcaaggtaaccaggagaaactcctgacccccatcaccatgaacgacccgaagacgttaacgcctgagagatcttatggcagtgatgaatttgaacggagtagcaacctcagcaaacaatcaaaggatccccttgggaaggacccccaggagggcaccgcacccggcatttgtacgagcccccagtcggcctcccaggagaataaacataataggtgcgaattttgcaagcggacattctccacacaggtcgccctacgcagacacgaaagaattcataccggaaagaagccttacgaatgtaagcagtgtgctgaggccttttacctcatgccccatctaaatcgacatcagaaaacccattcgggtcgaaagacgtcaggctgcaatgaaggtcgcaagccctcagtgcagtgcgccaacctgtgtgagagagtcaggattcattcccaggaagattattttgaatgttttcaatgtggaaaggccttcctacagaatgtccatctgttacagcacctgaaagctcatgaggctgcccgggtgctgcctcccggcctgagtcacagtaaaacctatctcatcaggtaccagaggaaacatgattacgttggcgagcgcgcctgtcagtgctgtgattgtggtagagtgttctccaggaactcttacctgatccaacactaccgcactcacacacaggagcgtccctaccagtgtcaactgtgcggcaagtgtttcggccgaccttcatacctgacacaacactatcaacttcacagccaggaaaagacagtggagtgtgatcactgctag

SEQ ID NO: 13897 - DNA, 1584 bp, Artificial Sequence
  Description of Artificial Sequence: Synthetic coding sequence
atgtatcagcctgaagacgacaataattctgatgtgacttcagacgatgatatgacccggaatcgtagggaaagcagtcctccgcactctgttcacagtttctcgggggatcgcgattgggatcgcagaggacggagccgagacatggagccacgcgacaggtggtcacatacccggaaccctaggagcagaatgcccccccgggatctgtctctgcctgtcgtggccaagacctcattcgaaatggaccgggaagatgatagagacagtagggcttatgagtcgaggagccaagatgctgagtcttaccagaacgttgtggacttggccgaagaccggaaaccccacaacaccatccaggacaacatggaaaactatcgcaaactgctctccttgggctttcttgcccaggatagcgtgcccgctgagaagcggaataccgaaatgctcgacaatctaccttccgctggaagccaattccccgactttaagcatttgggcacgtttttggtgttcgaagaattggtgaccttcgaagacgttttagtcgacttttcacctgaagagctgagtagcttatccgcagcccagcgcaatctgtatcgagaggtaatgctcgaaaactatcggaacctcgtgtccctgggacatcaattctcaaaaccagacattattagccgtcttgaggaggaagaaagttatgctatggaaacagatagtcggcatacagtcatatgtcagggggagagtcatgacgatccattggagcctcaccagggaaatcaagagaagctgctgactccaatcacaatgaacgatcctaaaactctgacaccagagcgatcttatgggtctgacgaatttgagaggagcagcaacctttctaagcaaagcaaggatcccctgggcaaagacccacaggagggaactgcccctggcatctgcacatctccccaatcagcgtcacaggaaaacaaacacaaccgatgcgaattttgcaaaagaacatttagcactcaggtggccctccgccggcacgaacgcatccatactggcaagaaaccatacgagtgcaagcagtgcgccgaggccttctaccttatgccgcacctaaataggcaccagaagacacatagtggtcggaaaacttcgggatgcaacgagggtcgcaaaccttccgtgcagtgcgcaaacctctgcgaacgcgtacgcatccactcccaggaggactattttgaatgtttccaatgcggcaaagcctttctacagaatgtgcacttgctccaacacttaaaggcccacgaagctgcacgggttctgcctcccggactgagtcactcaaaaacgtacctaattaggtaccagcgtaaacatgattatgtgggtgagcgcgcgtgccagtgctgtgattgtggaagagtgttctccagaaactcttatcttatacagcactaccggacccacacccaggagcgcccatatcagtgtcagttatgtgggaagtgctttggacgcccttcatatcttacccaacattatcagctgcactcccaggagaagaccgttgaatgcgatcattgttag

SEQ ID NO: 13898 - DNA, 1584 bp, Artificial Sequence
  Description of Artificial Sequence: Synthetic coding sequence
atgtatcaacctgaagacgacaataactccgacgttacttcagacgatgacatgacacgaaatcgcagggaaagcagccccccccactctgttcatagcttctctggcgaccgggattgggaccgccgcggtcggagccgggatatggagccccgagacaggtggagtcacaccaggaaccctaggagccgcatgcctcctagagatctcagcctgccggtggtagccaagaccagcttcgaaatggatcgtgaggacgacagagatagcagggcctatgaaagtcgctcccaggacgctgaatcttaccagaacgttgtcgatttggccgaggaccggaaaccccacaatactatccaggataacatggaaaactacagaaagctgctgagtctcggctttctggcccaggattcggttcccgctgaaaaaagaaacacggaaatgcttgacaacctgccctctgccggcagccagttccccgattttaaacacctcgggacgttcctggtgttcgaggagctggtgacttttgaggatgtcctggtggatttctcacctgaggagctttcctcactgtcagccgcacagcgcaacctgtatagggaggtcatgcttgaaaactatcgaaatctggtctcacttggtcatcagttcagcaagcctgacatcataagtaggctggaagaagaggagtcttatgcgatggagaccgactcccggcacacagttatttgccaaggagagtcgcacgacgaccccctggaaccacaccagggaaatcaggagaagttgttgacccccataactatgaatgaccccaagacccttacgcctgaacgctcctacggcagcgacgaattcgagaggtcatctaacctgtctaaacagagtaaagacccactgggtaaggacccccaggaaggcaccgcccctggtatctgtacatcaccacagagtgctagccaggaaaacaagcacaaccggtgtgagttctgcaaacgtaccttctctactcaggtcgcattacgccgccacgagaggatccatacgggcaagaagccctacgaatgcaaacagtgtgccgaggcattctacctcatgcctcacctcaacagacatcaaaaaacacatagtggacgaaaaaccagtggctgcaacgaggggcggaaacctagcgtgcagtgcgctaatctgtgcgaacgtgtgcggatccattcgcaggaagactattttgagtgcttccagtgtgggaaggcattcctgcagaatgtccatttgctccaacacctgaaggcacatgaggctgctagagtccttccgccagggctctcacattccaagacatacctcatccgctaccaacggaagcacgattacgtcggagagcgggcgtgtcaatgttgcgactgtggacgagtgttttctagaaattcttacctcattcagcattaccgcacccatacccaggaacgtccctaccaatgccagctctgtggcaaatgctttggccggccctcctatctgactcagcactaccagctccactctcaggagaaaactgttgaatgcgaccactgctag

SEQ ID NO: 13899 - DNA, 1584 bp, Artificial Sequence
  Description of Artificial Sequence: Synthetic coding sequence
atgtaccagcccgaggatgacaacaactctgacgtgacttcagacgacgacatgacaagaaatcgccgcgagagctcaccccctcatagtgtgcacagcttttccggcgacagagattgggacagacgtggtcgtagtagggatatggagccaagggaccggtggagccacacaagaaatcctcggagcagaatgcctccaagggacttgagcttgcccgtggtcgccaaaacatctttcgaaatggaccgggaggacgatcgtgacagtagggcatacgagtcaaggagccaagatgctgagtcataccagaacgtggtcgacctcgccgaggatcgaaaaccccacaacaccatacaggacaatatggaaaattacagaaagctgctgagcctgggcttcttagcgcaggacagcgttcccgcagaaaaaaggaatacagaaatgctggacaatttgccaagcgcagggtcccagttccctgacttcaagcatctgggtacgtttctggtgtttgaggaattggttacttttgaggacgtgttagtagactttagcccagaagagttgtcttccctctccgctgctcagcgaaacctttaccgcgaggtgatgctcgaaaactatcggaacttagtctccctcggacaccagttttcaaaacctgatatcatcagtcgcttagaagaagaagagagttacgcgatggagactgatagccgccacaccgtaatctgccaaggcgaatcccacgacgatccactggagcctcaccagggcaaccaggagaagctcctgacgccaatcaccatgaacgaccctaagactcttaccccggagagatcttacggaagcgacgaatttgagagatcttccaacttatctaagcaatccaaagatcctttaggtaaagatccacaagagggaacggcacccggaatctgcaccagcccacagtctgccagccaggagaataagcataaccgatgcgaattctgtaagcgtaccttcagtacgcaggtggcgctcagacgccatgagcggatacataccgggaaaaaaccgtacgagtgcaaacagtgtgccgaggccttttacctgatgccacatttgaatcgccatcaaaagacccattcggggagaaagacatccgggtgcaatgaaggcaggaagccctccgtccagtgcgcaaacttgtgcgagcgcgtgaggatccacagccaggaagattattttgagtgttttcagtgcggaaaagccttcctgcagaacgtccatctgctgcagcacttgaaagcacatgaggcagctcgggtactacctcccggtctctcccattctaaaacatacctgatcagatatcagcgaaagcatgattatgtgggcgagagggcctgccagtgttgcgactgtggccgtgtgttcagccgcaatagttatctgatccagcactacagaacccatacccaagagcgtccctaccagtgccaactgtgtgggaagtgttttggaaggccaagctacttgacccagcattatcaactgcactcccaggaaaagacggtcgagtgtgatcattgctag

SEQ ID NO: 13900 - DNA, 1707 bp, Artificial Sequence
  Description of Artificial Sequence: Synthetic coding sequence
atggcccggctcactaaacgccgccaggctgatactaaagcaatacagcacttgtgggctgctatcgagattatcaggaatcaaaagcagattgccaatattgatcgtatcactaaatacatgtccagagttcacggaatgcaccccaaggaaacgacaagacagctgagcctggccgtcaaggacggtctgattgtggagacgctgaccgttggctgtaaagggtcaaaagctgggatcgaacaggagggatattggctgcccggggacgaaatcgactgggagacagaaaaccatgactggtattgtttcgagtgccaccttccaggagaggtgcttatctgtgacctgtgtttcagggtctatcactcgaagtgtttgagcgacgagtttcggcttagagacagctctagcccttggcaatgccctgtttgtcgttccatcaaaaaaaaaaatactaacaaacaggagatgggtacttacctacggttcatcgtcagccgtatgaaagaacgagctatagacctaaacaagaaaggcaaggataataaacacccaatgtatcgccgattagtgcactccgctgtggatgtccctacgatccaggaaaaggtgaacgaggggaagtataggagttacgaagaattcaaagctgatgcacagctgctgctgcataacactgtgattttctacggcgccgactcagaacaggccgatatcgccagaatgctgtacaaggatacatgccacgagctcgacgaacttcagctctgcaaaaattgtttttatctctccaatgctcggcctgacaactggttctgctacccttgcatccccaaccatgagctggtctgggccaagatgaaggggttcggattctggcccgccaaggtgatgcaaaaggaggacaaccaggttgatgttcgattcttcggacatcaccatcagagagcctggattccatccgagaatatacaggacattactgttaatattcatcggttgcacgtcaaacggtccatgggctggaagaaggcttgcgacgagttagagctgcatcaacggttcttgagagaaggacgcttttggaaaagcaaaaacgaagaccggggggaggaggaggccgagtcaagcatttcttctactagcaacgaacagctgaaagttacccaggagccacgggcgaaaaaaggaagacggaatcaatcagtcgagcctaaaaaagaagaacccgaaccagaaacggaggcagtgtcgagctcacaggagatccccacaatgccacagcccatagagaaagtctcagtgtcaactcaaacaaagaagctgtctgcttccagtcccagaatgctgcacaggagcactcaaaccaccaacgacggggtgtgccaatccatgtgccacgataaatatactaagatcttcaacgacttcaaggacagaatgaagagtgaccataagcgcgagactgagagagtagttcgcgaagcacttgagaaactgagatcagagatggaggaggaaaaacggcaggcggttaataaggcggtggcaaatatgcagggggagatggatagaaaatgcaaacaggtgaaagagaaatgtaaggaagaattcgtcgaagagatcaaaaaactggccacccagcataagcagttaataagccagactaagaagaagcaatgggtgaacacttcattgttttag

SEQ ID NO: 13901 - DNA, 1224 bp, Artificial Sequence
  Description of Artificial Sequence: Synthetic coding sequence
atgaacaaatcacaaggtagcgtgtccttcaccgacgtaaccgtggattttacccaggaagaatgggagcaacttgaccccagccagcgtatactttatatggatgtgatgctggagaattactctaacttgctttccgtggaggtctggaaggcagacgatcaaatggagagagaccacagaaaccctgacgaacaagcaagacagttcttaatcctcaaaaatcaaacacccatcgaggagcgcggggacctgttcgggaaagcactgaatctgaataccgacttcgtgagcctgcgtcaggtaccatacaagtacgacctctatgaaaagactctcaagtataattcagatctgctgaacagcaaccgctcttacgccggtaagcagactgatgaatgcaatgagttcggaaaagccttgctctatcttaaacaggagaaaactcacagcggggttgaatattcagagtataataagtccgggaaggcgctgagtcataaagccgccatcttcaagcaccagaaaatcaaaaacctggtgcaaccttttatctgcacctattgtgacaaggcattttcgttcaagtcactgctaatttcccacaagcgcattcataccggcgagaagccatatgaatgcaacgtgtgcaaaaaaactttctcccacaaggctaacctcattaaacaccagcgtatccacacgggggaaaagcccttcgaatgtcctgaatgtggcaaggcgttcacgcaccagtccaatctgattgtccaccagcgggctcatatggaaaagaaaccttatgagtgcagtgaatgcggcaagacctttgcccagaagtttgagctgactacacaccagaggattcacacgggggagagaccctatgagtgtaacgaatgcgctaaaactttttttaagaagtccaacctgatcatccatcaaaaaatccataccggggagaaaagatatgaatgcagtgaatgcggcaagtcctttatacaaaatagccaacttatcatccacatgagaacccatacgggcgaaaaaccatatgaatgcaccgagtgcggcaaaacttttagtcagcgttctaccctgcgacttcaccttcgtatccatactggggagaagccctacgaatgctctgagtgcggtaaagcctttagcagaaaaagccgactgtcagtgcaccaacgcgtgcatatcggcgaaaagccttag

SEQ ID NO: 13902 - DNA, 1224 bp, Artificial Sequence
  Description of Artificial Sequence: Synthetic coding sequence
atgaacaaatcccagggcagtgtgtctttcacggacgttacagtggatttcacacaggaggagtgggagcagctggatccatcccagaggatactgtacatggatgtcatgcttgaaaactactccaacctgctcagcgtagaggtttggaaagcggatgaccaaatggagcgggaccatcgcaacccagacgagcaggcccgacagttcctgattttaaagaatcaaaccccgatcgaggaacgcggtgatctgtttgggaaggctttaaacctcaacaccgatttcgtgtcactgaggcaggtgccctacaagtacgacctttatgaaaaaacgctgaagtacaattctgacctgctgaacagcaaccgtagctacgctggcaagcagacagatgagtgtaatgagttcggcaaggccctgctgtacctcaagcaggagaagacccatagtggggtcgaatactccgaatacaacaaatctggaaaggctctttcccacaaggctgccattttcaaacatcagaagatcaagaatctcgtgcaaccatttatttgtacatactgcgacaaggctttctcttttaaatcactgttgattagccacaaacggatacatacaggggaaaaaccatatgagtgcaatgtctgtaagaagacctttagccacaaggccaatctcataaaacatcagagaatccataccggcgaaaagcctttcgagtgtcccgaatgtggtaaggccttcacacaccagagcaatctgattgtgcaccagcgtgcgcatatggagaagaagccatatgaatgctcggaatgcggcaaaacgttcgcccaaaagtttgaactgacgacgcaccaaagaatacacactggagaaaggccttatgagtgtaacgagtgcgcgaagacattcttcaagaaaagcaatcttatcatccaccagaagatccacaccggggagaaacggtacgaatgcagcgagtgtgggaagtcctttatccagaacagtcaactaatcattcacatgcgcacgcatactggagaaaaaccttacgagtgcactgagtgtggaaaaactttctcccaaagatccaccttgcggctccacctgagaatccacacaggggagaagccttatgagtgctcagagtgcgggaaggctttttcaagaaagtccaggctctctgtgcaccagcgtgtgcacattggtgagaagccctag

SEQ ID NO: 13903 - DNA, 1602 bp, Artificial Sequence
  Description of Artificial Sequence: Synthetic coding sequence
atggcacatggttccgtgaccttccgcgacgtggcaattgactttagccaggaggagtgggaatttctggaccccgctcagcgcgatctctatagggacgttatgtgggaaaattattcaaatttcattagtctcggtccttccatctccaagcccgatgtaattaccttactggacgaggaacggaaggagcctggaatggtcgtaagggaaggtacaaggaggtactgtcctgaccttgagtcccgttataggacaaacactcttagccccgaaaaggacatctacgaaatttactccttccagtgggatatcatggagcgaatcaagtcttacagcctgcaggggagcatttttcggaacgactgggaatgcaaatctaagatcgagggcgagaaggaacagcaagagggatattttggccaagtgaagatcacctcagagaaaatgacgacatacaagagacataactttctaaccgaatatcaaattgtgcacaacggggaaaaagtctatgaatgtaaggagtgccggaagactttcatcaggagatcaactttgtcccaacacctgcgtattcacacaggcgagaaaccttacaaatgcaaggaatgtgggcaggcgtttagacagcgagcccatttgattcgtcaccataagctccatacaggcgagaaaccttacgagtgcaaagagtgcggtaaggctttcactgtgttacaggagctcacgcagcatcagcgacttcacactggggagaagccctatgagtgtaaagagtgtgggaaagccttccgcgtgcatcagcagcttgcccgacaccaacgaatccacacgggcgaaaagccgtacgagtgcaaagactgcggaaaaacatttagacagtgtacacacctgacacgacaccagcgcctccacactgctgaaaaactctacgagtgtaaagagtgcggcaaggcttttgtttgcggccctgacctgagggtgcaccaaaaaatccactttggggagaagccctatgagtgcaaagagtgcgggaaggcttttagaatttgccagcagctgacagtccaccagtcaatccacacaggggaaaagccctacgaatgcaaagaatgcggcaagaccttccgcttaaggcaacagctggtcagacatcaacgaattcatacacgcgagaaaccttacgagtgcatggaatgttggaagaccttttcgtcctactcgcaattaatttcgcatcagagcatccacatcggagagcgaccttacgagtgtgaagagtgtggcaaagccttccggttgctgtcacagctcactcagcatcaatcaatacacaccggtgaaaagccgtatgagtgtaaggagtgccggaaaccatttagattattaagccaactcacgcagcaccagagcatccataccggcgaaaaaccatacgagtgtaaagagtgcggaaaggcattcaggctctattcttttctgacccagcatcagcggattcatacaggggaaaaaccttataaatgcaaagaatgcaagaaggccttccggcagcactcgcacctgacccagcaccaaaaaatccataatggcatctag

SEQ ID NO: 13904 - DNA, 1602 bp, Artificial Sequence
  Description of Artificial Sequence: Synthetic coding sequence
gtcgcccacggctccgtgaccttcagagatgtcgctattgattttagtcaggaagagtgggagttcctggatcctgcgcaacgcgatttgtaccgggacgtgatgtgggaaaattacagtaactttatttcactgggcccatccatcagcaaacctgacgtgattacactactcgacgaggagcggaaggaacctggaatggtggtgagggaggggactcgcaggtactgcccggacttggaaagccgctatagaactaacactttatcgcctgagaaagatatttatgaaatatatagctttcagtgggacatcatggagagaatcaagagttattctctccaagggagcatttttagaaacgactgggaatgcaagtctaagatagagggcgaaaaagaacaacaggaaggctatttcgggcaagtcaaaataacctcagaaaagatgaccacgtacaaaaggcacaacttcttgaccgaatatcagattgtgcacaacggagaaaaagtgtatgagtgtaaagaatgccgtaaaacattcattcgcaggtccactttgagtcagcacctccggatacatacaggcgagaaaccatacaaatgcaaggagtgtgggcaggcatttcgccagagagcacatctcatccgccatcacaagctgcataccggggagaaaccatacgagtgtaaagagtgtggcaaggcctttactgttctacaggaactgacccagcatcaacgactgcacaccggcgaaaaaccatacgaatgcaaggagtgcggcaaggcgttccgggtacatcagcagctcgctcgtcaccagcgtatccatacaggggagaagccttatgagtgcaaggattgtggcaagacattcaggcagtgtacccacttgacccggcaccagcgcctacacaccgctgagaagctgtacgaatgcaaagagtgtgggaaggcctttgtgtgtggacctgaccttcgtgtccaccagaagatccactttggtgaaaaaccttatgagtgcaaggaatgcggcaaggcctttcggatctgccagcaactgactgtccatcagagcattcatacaggtgaaaagccgtacgagtgtaaggagtgcgggaagactttcagactaagacaacaattagtgagacatcagcgaattcatacccgggagaagccgtacgaatgcatggaatgctggaaaaccttctcttcgtacagccagctgatctctcaccagtcgatacacattggggagcgaccttacgagtgtgaggaatgcggaaaggctttcaggctgctctctcaactaacccaacaccaaagtatccacacgggggaaaagccgtacgaatgcaaagaatgccggaagccgttccgactgctgtcccaactcacccagcaccagtcaattcacacaggcgaaaagccctacgaatgcaaggagtgcgggaaggcattcaggctttattcctttctgactcaacaccaaagaatccacaccggcgagaagccttataaatgcaaggaatgtaagaaagcgtttcgccaacactctcacctcacccagcaccagaaaatccacaacggaatatag

SEQ ID NO: 13905 - DNA, 2265 bp, Artificial Sequence
  Description of Artificial Sequence: Synthetic coding sequence
atgaccacagctggccggggtaacctgggtcttatccccaggtccacagcctttcagaaacaagaaggacgccttaccgtgaagcaggagccagccaaccagacgtggggccagggctcttctcttcaaaaaaattaccctccggtgtgtgaaatatttagattgcatttcagacagttatgctaccatgagatgtctgggcctcaggaagccctttcacgcctccgtgagctgtgtcggtggtggctgatgcctgaggtgcatacaaaggagcagattctggaactgctggtgctggagcagtttctctctatcttgcctggcgaattgcgtacctgggtccaactccaccaccctgagtccggcgaggaagccgtagccgtcgtggaggacttccagaggcacctcagcgggagcgaagaggtgtctgcccctgcccagaagcaagaaatgcattttgaggaaacgactgccctgggcacgactaaggaatcgccgcctactagccctctctcagggggaagtgcacccggcgcgcatctggaacccccatatgaccctggtacgcatcacctcccctctggcgacttcgcccagtgtacctctccggtgccaaccctgccacaggtcgggaattcaggagatcaggcaggcgccacagtgttaaggatggtgagaccccaggacactgtagcctacgaggatctgtccgtggattatacccagaagaagtggaagtccctcacgttgtcacaaagggccctgcagtggaatatgatgcctgaaaaccaccattcgatggcgtccctggctggggaaaacatgatgaaaggatctgagctcacacccaagcaggagttcttcaagggttcagaatcttctaaccggacttcaggaggcctcttcggcgtcgtgcctggtgcggctgaaacaggtgacgtgtgtgaggacacattcaaagagttagaagggcaaacttctgatgaagaggggtccaggctggagaatgacttcttagagatcaccgatgaggacaagaagaaatctaccaaagatcgctatgacaagtacaaggaagtaggggaacacccaccactgagtagttcaccagttgagcacgagggcgtgttgaagggacaaaagagttatcgatgtgatgagtgtggaaaagctttcaaccgatcaagccacctcatcggacaccagcggatccatactggagaaaaaccttatgaatgtaacgagtgcggaaagaccttcaggcagacgtcacagttaatcgttcatctgcggacacatacaggtgagaaaccatatgagtgctcagaatgcgggaaagcatatcgccacagttcacatctgattcagcaccagaggctccataacggagagaagccttacaagtgcaatgagtgcgccaaggccttcacacagtcctccagactgaccgaccatcagaggacgcacacaggggagaagccctacgagtgtaacgagtgcggcgaggcatttatcagatcaaagagtctggcacgtcaccaagtgctgcacacaggcaagaagccctataaatgcaacgaatgcggacgcgccttttgttctaatcggaacttgattgatcaccagcgcattcataccggagagaagccttatgagtgttccgagtgtggaaaagcattctccaggagtaaatgcttgattcgccatcagagtctgcatactggagagaaaccatacaaatgttctgaatgtggaaaagcttttaatcagaacagtcagctgattgagcatgagaggatccacaccggtgaaaagccatttgagtgttcagagtgtggtaaggccttcggactttcaaaatgcctcatccgacatcaacgccttcatacgggcgaaaaaccttacaagtgcaacgaatgcggcaaatcttttaatcaaaactctcacctgatcatccaccaaaggatccacacaggggagaagccctacgaatgcaacgaatgcggtaaggtgttttcgtatagcagtagtttgatggtccaccagaggactcacacaggcgagaaaccttataagtgtaatgactgcggtaaagctttctctgatagtagtcagctaatcgtccaccagcgcgttcacacaggcgaaaaaccttacgagtgctccgaatgtggcaaagctttctcacagcgtagcacctttaaccaccaccagagaacacatacaggagaaaagtctagtggcctggcctggagcgtgtcttag

SEQ ID NO: 13906 - DNA, 612 bp, Artificial Sequence
  Description of Artificial Sequence: Synthetic coding sequence
tctaaatgtttaataaggcaccagtcccttcacaccggggaaaagccttacaagtgcagcgagtgtggcaaagcctttaatcagaattcacagctcattgaacacgagcgtatccatacgggcgagaaaccatttgagtgctccgaatgcggaaaggcctttggcctcagtaagtgtctgattcgacatcagcggctccatacaggagagaagccatacaagtgcaacgagtgcgggaaatcatttaatcagaacagccacctgatcatccaccaacgaattcacacaggcgaaaagccgtatgagtgcaacgagtgcggaaaagtgttcagctatagcagttcgctaatggtgcatcagcgtacacataccggcgagaagccatacaaatgtaacgattgtggcaaggccttttccgattctagtcagttgatcgtgcaccaacgcgtgcacactggcgagaaaccatatgagtgcagtgagtgcggtaaagccttttctcagagatctaccttcaatcaccaccagaggactcatactggcgaagttctgaggtccggattagtgtcctttcttcgctatgggtctgagacagaaagcaacgacctgtag

SEQ ID NO: 13907 - DNA, 831 bp, Artificial Sequence
  Description of Artificial Sequence: Synthetic coding sequence
atgaccaccgccggaagaggaaatctgggtctcattccaagatctaccgcatttcagaaacaagagggccgactgacagttaaacaggaaccagcaaatcagacctggggtcagggttcttctctacaaaagaattacccacctgtttgcgagatttttcgactacatttccgccagctctgctatcatgagatgtctggcccgcaggaggcactctcccggctacgggaactttgtcggtggtggttaatgcctgaagtacacacaaaggaacagattctggagctgttagtccttgagcagtttctgtctattctgcccggcgagttgaggacgtgggttcagctgcaccatcctgaaagcggtgaggaggctgtggctgtggtagaagactttcaacgccacctgtctggcagcgaggaagtgtcggccccagcccaaaaacaagaaatgcactttgaagaaactactgccctgggaacaaccaaggaatcccctcccaccagcccactctccgggggatcagctcctggtgctcacctggaacctccctacgaccctggtacccaccaccttccgtctggagacttcgcgcagtgtacttcacccgtccctaccctacctcaggtgggtaactctggcgatcaagctggggccactgtgctgcggatggtccgaccacaggatactgtggcatatgaggatcttagtgtggactatacccagaaaaaatggaaaagcctgaccctgtcccagagagccctccaatggaatatgatgcccgagaaccaccactccatggccagcttgggttggtccacaatggcctag

SEQ ID NO: 13908 - DNA, 2265 bp, Artificial Sequence
  Description of Artificial Sequence: Synthetic coding sequence
atgacaacagctggacgcggtaaccttggccttattccccgttccacggcgttccagaaacaggaagggagactgaccgtgaagcaagagcctgccaaccagacctgggggcagggaagctctttgcaaaaaaattacccccccgtgtgcgaaattttccgactccacttccgacagctgtgctaccacgagatgtccggtcctcaggaagccctctcgagactgcgtgaactctgtcgatggtggttgatgcctgaagtccacaccaaggaacagattttggagctgttagtgctggaacagttcctgagcatccttcccggtgagctgcgcacgtgggtccagctgcaccaccctgagtctggcgaagaggccgtggccgtggttgaagactttcagcgccacctgtctggttcagaagaggtgagcgcaccagcccagaagcaggagatgcactttgaagaaacaacagcgctgggaactacaaaagaatcacctcccacttctcccctgtccgggggaagtgcacccggtgcacacctggaaccaccctacgaccctggaactcaccatctacctagcggtgactttgcacagtgtacttcaccagtccccaccctgccccaggtaggcaattccggagatcaagccggcgctacggtcttgagaatggtgagaccacaggataccgtggcatacgaagatctttccgtcgattacactcagaagaagtggaaatcactgaccctaagccagagggccctccagtggaacatgatgcccgaaaaccaccatagcatggccagtttggctggggaaaatatgatgaaaggcagtgaattgacacccaaacaagagtttttcaaagggtctgaaagctcaaacagaacctccggaggtctgttcggagtggtgccaggtgccgcggagacaggggacgtgtgcgaggatacttttaaggagcttgaaggccagacatcggatgaagagggcagcagacttgagaatgattttctagagattaccgatgaggataaaaagaagtcaacgaaagaccgttatgacaagtacaaagaagtgggggaacatccaccactttcctcgtcccccgtagaacatgagggagtgctcaaaggtcagaagtcatataggtgcgacgagtgcggaaaggccttcaatagatcatcacatctgattggccaccagagaatccacaccggggagaagccctatgaatgtaacgaatgcggtaaaaccttccggcagacctctcagctgattgtgcacctgaggactcacacaggcgagaaaccctatgagtgtagtgagtgcggcaaggcgtaccgccattcatcacacctcatccaacatcagagactgcataacggcgagaaaccctacaagtgtaatgagtgcgccaaagccttcactcaatcgagtcggctaacagatcaccaaaggacccacacaggggagaaaccatatgagtgcaatgaatgtggagaggcctttattaggagcaagagcctggctcggcaccaggtgctgcacaccggcaagaagccctacaaatgtaacgagtgcggccgggctttctgtagcaacagaaacttgattgaccaccaaaggattcacaccggcgagaagccatatgagtgttccgagtgtggcaaggccttttccaggtcgaagtgcctcatccgccaccagtcactgcacacaggggaaaaaccttacaagtgctcggaatgtggaaaggcctttaaccagaatagccaactcattgaacatgagcgaattcacactggagagaaacccttcgaatgctcagaatgtgggaaggccttcggtctatccaagtgtctgatccggcaccaacgcttgcataccggagagaaaccttataaatgcaacgagtgcgggaagagctttaatcaaaattcccacctcattattcaccagcggattcacacaggagagaagccgtatgagtgcaatgagtgtgggaaggtattttcgtattcctcaagcctgatggtgcatcagaggacccataccggggagaaaccctacaaatgcaacgattgtggcaaagcattcagcgattccagccagctcatcgtccaccagcgagtacacacaggtgagaaaccgtatgagtgtagcgaatgtgggaaggcattttctcagcggagcaccttcaatcaccatcagcgcactcacactggcgaaaaaagctctggtttggcctggagcgtctcttag

SEQ ID NO: 13909 - DNA, 831 bp, Artificial Sequence
  Description of Artificial Sequence: Synthetic coding sequence
atgacaactgccgggagggggaacctgggtttaattcccagatctacagccttccagaaacaggaaggcagactgactgtgaagcaagagccagcaaatcaaacctggggtcagggaagctcgctgcaaaaaaattatccccccgtgtgtgaaatattccgactccatttccgccagctgtgctatcacgagatgtccggcccgcaagaagctttgtccaggctgcgagagctgtgccgttggtggctgatgcctgaggttcacactaaggagcagattttggagttgcttgtgctggaacagttcctgtccatcttacctggggagttgaggacctgggttcagctgcaccaccccgagtccggggaagaagccgttgctgtcgtggaggattttcagcgccacctgagcgggtcagaagaggtttccgctcctgcacaaaagcaggagatgcactttgaagagaccaccgcattggggactaccaaagagtctcccccgacctcaccattgagtggggggtctgcccccggtgcccacctggagccaccgtacgaccctggcactcaccacctgccctcaggggactttgcacagtgcacttcgcctgttccaactttaccacaggtaggtaattccggtgaccaggccggagcaaccgtgctcagaatggttcgtccacaggatacagtggcctatgaggacctgtctgtggactatacccagaagaaatggaagtccctcaccctgagtcagagagcccttcagtggaacatgatgcccgaaaaccatcacagcatggcaagcctcggctggtccactatggcgtag

SEQ ID NO: 13910 - DNA, 1989 bp, Artificial Sequence
  Description of Artificial Sequence: Synthetic coding sequence
atgaatctcactgaggattatatggtatttgaagacgtggcgatccatttctcccaggaagagtgggggattcttaacgacgtacagcgccatctccacagtgacgtcatgttggaaaacttcgctctgctgtctagcgtggggtgttggcacggtgccaaggacgaggaggcaccaagcaagcagtgcgttagcgtgggagtgtctcaggtcaccaccctaaagcctgccctcagcacccagaaggcacagccctgtgaaacctgcagcagcctactgaaagacatactccatctcgctgagcacgatggaacacatccgaaaaggacagccaagctctatttacaccagaaggagcacctaagggagaagctgacacgctcggacgaggggcgaccctccttcgtgaatgactctgtgcatctggcgaaaagaaatctgacctgcatgcagggcgggaaagacttcactggagactcagacctgcagcaacaagcgttgcactcaggctggaaaccccacagagatactcacggtgtggaggccttccagtccggacaaaacaactacagctgcacccagtgcggaaaagatttttgccaccagcatacattgtttgagcaccagaagattcatacagaagaaaggccctacgagtgttctgagtgcggtaaactgtttcgctacaactccgatcttatcaagcaccagcgcaaccatactggcgaacggccctacaagtgtagtgaatgtggcaaggcattcagtctgaagtacaacgtggtccagcatcagaagatccatactggggagaggccctatgagtgctctgagtgtggaaaggcgtttctacggaagagccaccttcttcaacaccagcggattcacactaggcccaggccttatgtgtgttctgagtgcggcaaggcattcctgactcaggcccacttagtggggcaccaaaagatacacaccggcgagcgcccctacgggtgtaatgagtgcggaaagtacttcatgtattcctccgccctcataagacatcagaaggtgcacacaggcgaaagacctttttactgttgtgagtgtggcaagtttttcatggatagttgcacactaatcattcatcagcgtgttcataccggcgagaagccctacgaatgcaatgagtgtggtaagttctttcggtatagatcaacgcttatcaggcaccagaaagtgcacaccggagagaagccttatgaatgcagcgagtgcggaaagttctttatggacacatctactctaatcatccatcagcgcgtgcacaccggagaaaagccctacgaatgcaataagtgtggcaagttcttccggtactgctttaccctgaacagacaccagagagttcactcaggtgaaaggccctatgagtgtagcgaatgcgggaagttctttgtcgattcatgcaccctcaaatcccaccagcgcgtgcatacgggagaaaggcccttcgagtgttccatatgcggtaaaagctttcgttgtagatcaacgctcgatactcaccagcgaatccacaccggtgagcggccttacgaatgctctgaatgtggcaaattctttagacacaatagcaatcacatccgccacaggagaaatcacttcggtgagaggagctttgaatgcaccgaatgtgggagagttttctcccaaaattcacacttgataaggcatcaaaaggtgcacacccgggaaaggacatacaaatgcagtaagtgtgggaagttttttatggacagctctacactcatcagccacgagagagtccatacaggggaaaagccctacgagtgctccgagtgtggtaaagtgtttaggtacaacagttccctgatcaagcacagaaggattcacaccggcgaacgtccttaccagtgtagcgagtgcgggcgggtgttcaatcaaaacagtcatctgattcagcaccagaaagtccatacgaggtag

SEQ ID NO: 13911 - DNA, 1989 bp, Artificial Sequence
  Description of Artificial Sequence: Synthetic coding sequence
atgaatttaaccgaggactatatggtctttgaagacgttgccattcacttctcccaggaagagtggggcattctgaacgatgtgcagcgacatctgcacagtgacgtgatgcttgagaatttcgcacttctctcaagcgtgggatgctggcacggcgccaaggacgaggaggctccttccaagcagtgtgtatccgtgggcgtgagccaggtgactactctcaaacctgccctttccactcaaaaagctcagccttgtgagacttgttctagtctattgaaagatattctgcatcttgcagagcatgatggaacacaccccaaacgcactgccaagctgtacctgcaccagaaggaacacctcagagaaaagttgacacgatctgatgagggacgcccatctttcgtgaacgatagtgtgcacctcgccaaacgcaatttgacctgtatgcagggaggcaaagactttacaggcgacagcgatctacagcagcaggctctgcattcaggctggaaacctcatcgcgatacccatggtgtggaggcctttcaaagcggacagaataactattcctgcacccaatgtggtaaagatttttgccaccagcacactctgttcgagcatcagaagattcatactgaagagcggccatatgaatgtagcgagtgtggcaaactcttccgatacaattctgacctaatcaaacatcagagaaatcacactggggagcgaccctacaagtgttcagaatgcgggaaagcttttagtcttaaatataatgtggtacagcatcagaagattcatactggggagcgaccctatgagtgctcagaatgtggcaaggccttccttcgaaaatctcacttgctacagcaccagcgcatccacacgcgccctcggccatatgtgtgttcagagtgtggaaaagccttccttactcaggctcacctggttgggcatcagaagattcataccggggaaaggccttacggttgtaacgagtgtggaaaatacttcatgtatagttcagcactaatacgacatcagaaggtgcatacaggcgaacgacctttttattgctgcgagtgcgggaaatttttcatggactcctgcacgctgattatccaccaacgcgttcacactggagagaaaccgtacgaatgcaatgagtgcggcaagttctttcgatatcggagtaccctgataagacatcaaaaggtccacactggcgagaaaccctatgaatgttccgaatgcggaaagtttttcatggacacctcgacccttattattcaccaaagagtgcataccggcgagaaaccttacgagtgtaacaagtgcggaaagttctttcgctactgttttaccctgaataggcatcagcgggtgcactcaggagagagaccgtacgaatgcagcgagtgcgggaaattctttgtcgatagttgtactctgaaatcccatcagcgggtgcataccggagaaaggccgtttgagtgctccatctgtggcaagtcatttcgttgtaggagcactcttgacactcaccagcgcattcatacgggggagcggccttacgagtgcagtgagtgcggcaaatttttccgtcataacagtaaccatattcgacacaggcgaaaccacttcggagagagatcattcgagtgtacagaatgtgggagagtgttctctcagaattcacatcttatccgccatcagaaagtgcatacccgtgaaagaacctataaatgttctaaatgtggcaagttttttatggattcctctacacttatctctcacgaaagagtgcatactggcgaaaagccttacgaatgctcggaatgtggaaaggtgtttcgatacaatagctctctgatcaaacacagaaggattcatactggggagcggccataccagtgctccgagtgcggcagggtcttcaatcagaattctcatctgatccagcatcagaaggttcatacgagatag

SEQ ID NO: 13912 - DNA, 3090 bp, Artificial Sequence
  Description of Artificial Sequence: Synthetic coding sequence
atgactcgtgagaatgttgctcataatgcactccgacaagaaggactcgtcaagggaaaagatgacacctggaagtgggggacaagttttcagggctcctccagctccgtgtgggagacctctcacttacatttccggcagctgagatatcatgaaacaagcggaccccaggaggctctcagcagactcagggaactctgccgccggtggttgcggcccgaggcccgaaccaaagcgcagatccttgagttgctggttctcgaacagtttttgtccatcttgcctggcgagattcgaacttgggtccaactccaccatcctgggtccggggaagaggcagtagccctcgtagaagaactgcagaaggacctggatggacctgcgattcaagttcccgtcttggtcaaggaccaagacacgctccagaaggtggtcagcgcgcccggtaccactttgccaccagtgcttccggggtctcacattgcagccgagatttgtcctcacccccccactgatctagtcgcatttaatctgcaggacccacagcatgatagccctgccccagaggcatctgctctaagccaggaggaaaatccacggaatcagctgatggccctgatgctgctgaccgcgcagccccaggaactggttatgttcgaggaagtttctgtttgctttactagcgaagaatgggcctgcctcggcccaattcagagagccctgtactgggacgttatgctagaaaactatgggaacgtaacctctctagagtgggagacgatgaccgaaaacgaagaagtgaccagcaaaccttcgtcttcccagagggctgacagtcataaaggcacatccaagcggctgcaaggaagcgtgccacaggtattggattttgaagaggagtgtgaatggcaggtgctggctagccaatggggaaacgagactgacgagcgtgctgatacggttaagaaagtcagcttgtgtgaaagggacaaaaagaaacgcaccccccccgagaaacaaggacagaaatggaaagagcttggagacagtctgacattcggcagcgctatctctgaatctctgatcggaactgagggcaaaaagttttacaagtgtgacatgtgctgcaaacattttaataagatctcccatctgatcaaccaccgaaggatccatactggggagaaaccacacaaatgtaaggagtgcggtaagggattcatacagcgctcctctctgctgatgcacttacggaaccactctggcgagaagccctacaagtgcaatgagtgcggcaaggcattcagtcagtccgcatacttactgaaccaccagcgaatccacactggtgagaaaccctataagtgtaaagagtgtgggaagggattttataggcattccggcttaatcattcatttgagacgacattccggcgagcgtccctacaagtgcaacgagtgtgggaaagtcttctcacagaatgcgtatctcattgaccaccaaagactccataagggagaggagccgtacaagtgcaacaagtgccagaaggcttttatcctgaagaaaagtctgattttgcaccaacgcattcattcgggggagaagccatacaaatgcgatgaatgcggtaaaaccttcgcccaaacaacgtacctcatagatcaccagagactccattcagccgagaacccatacaagtgtaaagagtgtgggaaggtattcatccgctctaagagtttgctactccatcagagagttcacactgagaagaagactttcgggtgtaagaagtgcggcaaaatattctcatctaagtcaaacttcatagaccacaaacgtatgcattctcgcgaaaagccatataaatgcaccgaatgtggaaaagccttcactcagagcgcatatttattcgaccatcaacggttgcataacggcgagaagccatacgagtgtaacgagtgtggaaaagtgttcatcctgaagaagtccctgatactgcatcaacgttttcacaccggcgagaatttatatgagtgcaaggactgcggcaaggtgttcggaagcaatcgaaacttgattgatcacgaacgcctgcacaacggcgaaaagccgtacgaatgtagggagtgcgggaagaccttcataatgagcaagtctttcatggtgcaccagaaactgcacacacaggagaaggcttataagtgtgaggactgtggcaaagcattcagttataattcctccttgctggtgcaccgccgtatacacacgggcgagaaaccttttgaatgtagcgagtgtggtagggccttctcgagcaatcgcaatctcattgagcataaacggatccacagtggagaaaaaccatacgaatgtgatgagtgtgggaaatgttttattctgaaaaagtccctcatcgggcaccagagaatacatacgcgcgagaaatcctataagtgtaatgactgcggaaaagtattttcataccgctctaaccttatagcgcatcagcgcatccacacgggagagaaaccctatgcctgctctgagtgtggtaaaggcttcacatacaatcggaaccttattgagcaccagcggattcactctggggagaaaacttatgagtgccatgtctgccgtaaggtgcttacttcatctcgtaatttgatggtgcaccagcggatccacacgggggagaagccttataaatgtaacgagtgtggcaaagatttctcgcagaataaaaatctggtggtgcaccagagaatgcacacaggcgagaagccctatgagtgtgacaagtgccgcaagtctttcacttccaaacgcaaccttgttggccaccagcgcatccacaccggtgaaaaaccttatggctgtaacgattgtagtaaggtgtttcggcagagaaagaacctgacagtccaccagaaaattcataccgatgagaaaccatgcgagtgcgacgtctcagagaaggaattctcacagacgagtaacctgcatctgcagcagaaaatccacacaatcgaagaattcagttggctgcagaacacaaatgaaagtaagattgaaatccaaaagatttag

SEQ ID NO: 13913 - DNA, 804 bp, Artificial Sequence
  Description of Artificial Sequence: Synthetic coding sequence
atgactcgggaaaacgtagctcataatgccctgagacaggagggccttgttaagggcaaagatgatacgtggaagtggggtacatcattccagggctcctccagctccgtgtgggaaacttcccacctgcactttcgccagctccgctaccacgaaactagcggaccacaggaagccttatctcgattgcgcgagctatgtcggcggtggctcaggccagaggccagaactaaagctcagatcttggagttgctggttcttgagcaattcctgtccatcctgccaggagagatacgcacttgggtgcagctgcatcatcccggaagtggcgaagaagctgtcgccctagtggaggaacttcagaaggatttggacggtcccgctattcaggtgcctgttctagtcaaagaccaggatacactccagaaggtcgtgtctgcacccggaaccacacttcccccggtgctgccgggatctcacatcgcagcggaaatttgtccacatccccctacagatctcgtggcgttcaatctccaggacccgcagcatgactcacctgcccctgaggcaagcgcattgagccaggaggaaaacccgagaaatcagctaatggcactcatgttgctgactgcacagccccaggaattggtcatgttcgaagaagtgtctgtctgttttacatctgaggagtgggcatgcttagggcccatccagagggccctgtactgggatgtcatgttggagaactatggaaacgtaacgtccctggggtatcgtaaatatagacgccaacggaacaaatag

SEQ ID NO: 13914 - DNA, 804 bp, Artificial Sequence
  Description of Artificial Sequence: Synthetic coding sequence
atgactagagagaacgtcgcccacaacgccttgcgtcaggagggactggtcaagggcaaagacgatacctggaagtggggcacatcattccagggctcatcttcctctgtttgggagacttcccatctgcatttcagacaactgagatatcatgagacttccggccctcaggaggccctaagccgattacgcgagctgtgtaggcgctggcttagaccggaagcgagaaccaaggcacaaatcctggagttactggttcttgaacaattcctgagcatccttcccggcgagattcggacctgggtgcagctgcaccacccaggctcaggagaggaggccgtcgctctcgtcgaagaactccaaaaagatcttgatgggcctgccatccaagtgcccgtcctggttaaagatcaggacaccctccaaaaagttgtctcagcacccggaacaactctccctcctgttttgcccgggagtcatatcgcggcagagatctgtcctcacccccccaccgacctcgtagcgtttaacttgcaagatccacagcatgatagcccggctcctgaggccagtgcactttctcaggaggagaatcccaggaaccaactaatggctctcatgctcctcacggcacagccacaggagcttgtaatgttcgaagaggtatctgtgtgctttaccagtgaagagtgggcttgtctgggcccaatccagcgggctctgtattgggatgtcatgctggagaattatggcaatgtcacgtcgctggggtaccgcaaatacaggcggcagcgcaataaatag

SEQ ID NO: 13915 - DNA, 3090 bp, Artificial Sequence
  Description of Artificial Sequence: Synthetic coding sequence
atgaccagagagaacgtcgcccacaatgcactgcggcaggagggcctggtaaaaggtaaggatgacacctggaaatggggaacgagctttcagggcagttcctcgagcgtttgggagacctcacatctccatttccggcagttgaggtatcacgagaccagtggccctcaggaagccttgagcagacttcgagagctgtgccgcaggtggctgcgtcccgaggcacgtacgaaagcacagatactggaactgctggtgctggagcagttcctatccatacttcccggggagataagaacctgggtgcaattacaccacccagggtctggagaggaggccgtggctctggtcgaggaactgcagaaggacctagacggccctgctattcaggtaccggtacttgtgaaggaccaagacaccctgcagaaagtggtgtctgctcccggcacaaccctacctcctgtgctgcccgggtcacatattgctgctgaaatatgtcctcatccaccgactgacctggtggcattcaatcttcaggatcctcaacacgactctccagcgccggaggccagcgccctatctcaggaggagaatccgcggaatcagttgatggcgctcatgctgctaaccgcacagcctcaagagctggtcatgttcgaagaggtcagtgtctgctttacatccgaggagtgggcttgcctgggtcccatacaacgggcactctattgggacgttatgctcgaaaactacggtaatgttaccagtttggaatgggaaacaatgacagaaaacgaggaggtaacatctaagccatcttcttcccagcgagctgactcacacaagggcacctctaagaggttgcagggaagcgtgccacaagtcctcgattttgaagaggagtgcgaatggcaggtattagcctctcaatggggtaacgaaaccgacgagcgagctgatacagtaaaaaaagtgtcattgtgtgagcgggacaagaagaagaggactccgcccgagaagcaggggcaaaaatggaaagaactcggagattctctgacatttggctccgcgatttcagaatctctcattggaaccgaagggaaaaaattctacaaatgtgacatgtgctgtaaacacttcaataaaatctcacaccttattaatcaccgccgtatccataccggagagaagccccacaagtgcaaggaatgtggaaaaggatttatccaacggagctctttattaatgcacctgagaaatcacagcggggagaagccctacaagtgcaacgagtgtggaaaagccttttcacaatcggcatacctgcttaatcatcagagaatacacaccggagaaaagccctacaagtgcaaagagtgtggaaagggattctataggcatagcggtctcattatccatcttagacgccatagcggggagcggccttataaatgtaatgagtgcggtaaggtgtttagccagaatgcctatttgatcgatcaccagagactgcataagggggaagagccatataaatgtaataaatgccaaaaagctttcatcctgaaaaagtccctgatcctccatcagcgcatccatagcggagagaagccttataagtgcgatgagtgtggcaaaacgtttgcccagactacatacctgattgatcaccagagacttcactcagccgaaaatccctataagtgtaaagagtgtgggaaggtttttattcgaagtaagagtttgctgctgcatcagcgcgtccatacggagaagaaaacattcggttgcaaaaaatgcggtaagatttttagttcgaaatccaacttcatagaccacaagaggatgcattcccgcgagaaaccctataagtgcaccgaatgcggcaaagcgttcacccagtctgcctaccttttcgaccaccaacgacttcataacggcgagaagccgtatgaatgtaacgaatgtggaaaggtcttcatactgaagaagtctctgatacttcaccagcggtttcatacgggtgagaacttgtacgagtgcaaggattgcggaaaggtattcgggagcaatcggaatcttatcgaccacgaacgtttgcacaatggcgagaaaccctacgaatgccgggagtgcggcaagaccttcatcatgtctaagtcgttcatggttcaccagaagctccatacacaagagaaggcctataaatgtgaagactgcggcaaggcattcagctataattcatcattgctggtgcataggaggatacataccggcgagaagccatttgagtgcagtgaatgtggccgagcgttctcctcgaatagaaacctgatcgagcataagcggattcatagtggagagaaaccctacgaatgtgacgaatgcggaaagtgcttcatactgaagaaatctctgatcggccaccagagaatccacactcgcgagaaatcttataagtgcaatgattgcggaaaagtgttttcttatcggagtaatctgatagcacatcaacgcattcacacaggtgaaaagccctacgcttgtagcgagtgtggcaagggctttacttacaaccgcaacttgatcgagcatcagcggatacactccggcgaaaagacgtacgaatgccacgtttgccgaaaggtgcttactagttcgaggaacctgatggtccaccagcgtattcataccggagagaagccgtacaagtgcaatgagtgtggtaaggacttctctcagaacaagaatctcgtcgtccatcagaggatgcacactggggagaagccatacgagtgtgacaaatgccggaaatcctttaccagcaaacggaatttggttggtcaccagagaatacacaccggggaaaagccatatggctgtaatgactgcagcaaggttttccgtcagaggaaaaatttgactgtgcaccaaaaaatccacaccgatgagaagccatgcgaatgcgatgtgtcagagaaagaattttctcaaacatccaatctgcatctccagcagaagatacacacgatagaagaatttagttggttacagaacaccaatgagtctaaaattgaaatacagaagatttag

SEQ ID NO: 13916 - DNA, 240 bp, Artificial Sequence
  Description of Artificial Sequence: Synthetic coding sequence
atgacaagagagaatgtcgcgcataatgccttgcggcaggaaggacttgtgaagggcaaggacgatacctggaaatgggggaccagttttcagggttcctcctcgagcgtttgggagacatcgcatttgcattttagacaactgcgataccatgaaacatctggcccgcaggaggcactgtccaggctgagggagttatgccgacgctggcttaggccagaggcacgtactaaggcatag

SEQ ID NO: 13917 - DNA, 966 bp, Artificial Sequence
  Description of Artificial Sequence: Synthetic coding sequence
atgacaagagagaacgttgctcacaatgcacttcgacaggagggattggtgaagggcaaggatgatacatggaaatggggcacctctttccagggttcaagttcttcagtgtgggaaacttctcacttgcatttccggcagcttcgctaccacgaaacctccggcccacaggaggcccttagtcggctgagagagctttgtagaagatggcttcgccccgaagcccggacgaaggcccaaattcttgaactgctggtgctggagcagtttctctcaattctgcctggtgagattagaacatgggtgcaactgcaccatccagggagcggagaagaggcagtcgcacttgttgaagagctgcaaaaggacctcgacggccccgcgattcaggtgccggtgctggtaaaggaccaggatacactccaaaaagttgttagcgctcctggtacaacactgccgcctgtcttgccgggttcccacattgctgcagagatctgcccacatcctcccaccgacctggtggcatttaatttgcaggatccccagcacgactcccccgctcccgaggccagcgcactgtcccaagaggagaatccaagaaatcagctgatggccctgatgctgctgacggctcagccccaggagctggtgatgttcgaggaggtgtctgtatgcttcacttctgaagagtgggcttgtcttggtccgatccagagggctctctactgggacgtgatgctcgaaaactacggaaacgtcacatctcttgagtgggaaactatgactgagaacgaggaggtcacttcaaaacctagcagcagtcagcgggcagacagccacaaaggtacgtctaagaggctgcagggcagcgttccccaggtactggatttcgaagaagaatgtgagtggcaggtactggccagccagtggggcaatgagacagatgagagagccgacacagtgtag

SEQ ID NO: 13918 - DNA, 1386 bp, Artificial Sequence
  Description of Artificial Sequence: Synthetic coding sequence
atggagagagaaggtatttggcactctacactcggggaaacatgggaacccaacaactggctggaggggcagcaggattcccatctgtcccaggtgggagtgacccacaaagagacctttactgaaatgcgcgtgtgcggtggaaacgaattcgagaggtgcagctcgcaggactccatccttgacactcaacagtccattcccatggtcaagcgcccccataattgcaactcacacggagaagatgccacccaaaactccgaactgattaagacccagcgcatgttcgtgggaaaaaaaatatatgagtgtaaccagtgtagcaagaccttttcacagtcgtctagcttgctcaaacaccagcggatccacacaggggagaagccgtacaaatgcaacgtatgcggaaaacattttatagaacggtcctcacttaccgtgcatcagagaatacatactggagagaaaccatacaagtgtaacgaatgcggtaaagccttcagccagagtatgaatctgaccgtgcatcagcgaacgcatactggtgagaagccttatcaatgcaaggaatgcggtaaagcctttcacaaaaatagctccttgattcagcatgagcggatccacacaggcgagaagccctacaaatgcaatgaatgcgggaaagctttcacacagagtatgaatctcactgtgcatcagaggacgcacacaggagagaagccttacgagtgcaatgagtgtgggaaggctttctctcagagcatgcacttgattgtgcatcagcgatcacacactggtgagaagccctatgagtgcagccagtgtggaaaggcgttcagcaagtcctcgacactcactctgcaccagcgtaaccacaccggggaaaaaccttataaatgtaacaagtgtgggaaatccttttctcagtccacatatctgattgagcatcagagactccatagcggcgtcaaaccctttgaatgtaatgaatgtggaaaggctttctcaaagaatagttccctcacacagcatcgccgcatacataccggcgaaaagccatacgagtgcatggtatgtggtaagcattttaccggacgatcatctctgaccgtccatcaggtgatccatactggagaaaagccctatgaatgtaatgagtgtggaaaggctttctctcagtctgcctacctcattgagcaccaacgtatccataccggcgaaaagccctatgagtgcgatcagtgcggcaaggctttcattaagaatagcagcttgaccgtgcatcaaagaacgcatacaggtgaaaaaccttaccagtgcaatgaatgtgggaaagcgttttctagaagcaccaacctgacccgacaccaacggacccacacatag

SEQ ID NO: 13919 - DNA, 1386 bp, Artificial Sequence
  Description of Artificial Sequence: Synthetic coding sequence
atggaaagggagggaatctggcacagtactcttggggagacctgggagcctaataactggctcgaggggcaacaggatagccacctcagccaggtcggtgttactcacaaggaaacattcacggagatgcgtgtatgcggaggtaacgagttcgaacgttgctcctcgcaagatagtatcctggacacgcagcagtcaataccaatggtcaaacgtccccataattgcaattctcacggcgaggatgccacacaaaattcagagcttatcaaaacccagagaatgttcgtggggaagaagatatatgagtgcaatcagtgtagcaagaccttcagccaaagcagttcccttctcaagcaccagcggatccacactggggaaaaaccctataagtgtaacgtgtgcggaaaacatttcatagagcgaagttcactgaccgttcaccagcgcatccataccggggaaaagccgtataaatgcaacgagtgtggaaaggctttttcccagtctatgaacctgacagttcaccagaggacgcataccggcgaaaagccttaccagtgcaaggaatgtggcaaggcatttcacaaaaacagttctctgattcagcatgaacgaatccacacaggagaaaagccatataaatgcaacgagtgcggaaaagcgttcacccaatcaatgaatctgaccgtgcatcaacgcacccacaccggcgaaaagccgtatgagtgcaacgagtgcggcaaagccttcagccagtctatgcacctcatcgtgcaccaaagaagccataccggtgaaaaaccatacgagtgtagccaatgcggaaaggcctttagtaagagttctactttaacactccaccaaaggaaccacacaggtgagaaaccctataagtgtaataagtgtggtaagtctttctctcagtcaacctatttgattgagcatcagcgactgcatagcggcgttaagcctttcgagtgcaacgagtgcggtaaggccttcagtaaaaactcttccttgacacaacataggcgtattcacacaggcgaaaagccttatgagtgtatggtttgcggaaagcattttacaggaaggagttcactcactgtccatcaggtcatacacacaggcgaaaaaccctacgaatgtaatgagtgtggcaaggctttcagccagtccgcgtacttgatcgaacatcaacgaattcatacaggcgagaaaccctatgagtgcgaccagtgtgggaaggcgtttattaagaattcaagtctgactgtgcaccagcggacacacaccggtgaaaaaccttaccagtgcaatgagtgtggtaaagcctttagtaggtctaccaatctgactcgccaccaaaggacccacacatag

SEQ ID NO: 13920 - DNA, 1386 bp, Artificial Sequence
  Description of Artificial Sequence: Synthetic coding sequence
atggaaagagagggtatctggcattccactctcggtgagacgtgggagccaaataattggctggagggacaacaggacagtcacctctcccaggttggcgtgacccacaaggagactttcacagagatgagggtctgtggcggcaatgagtttgagaggtgtagtagccaggacagcatactggatactcagcagagtatccccatggtgaaacggccacataattgtaactcccacggcgaggacgccacacagaatagcgaattaatcaaaactcagagaatgttcgttggaaagaaaatttacgagtgtaaccaatgttcaaagactttctcccagtcatcatccctgctgaagcatcagagaatccacaccggtgaaaaaccttataagtgtaatgtctgcggtaagcatttcatagaacggtcttcactgactgtgcatcagcgcatacacaccggggaaaaaccctataagtgcaatgagtgcgggaaagctttttcacagtctatgaacttaactgtacatcagcgcactcacactggggagaagccctaccaatgtaaagaatgcggtaaggcattccataagaacagcagtctgatacagcacgagcgaatacacactggtgaaaaaccctataaatgcaatgaatgtgggaaggcatttactcaatctatgaatctgacagtgcaccaacggacccatactggcgagaagccgtatgaatgcaacgagtgcggcaaagccttcagtcaatctatgcaccttatcgttcaccagcgctcccacactggggagaagccctatgagtgctcacagtgtggtaaggcgttttctaaaagtagcaccttgacattgcaccagcgaaatcatactggggagaagccctacaagtgtaataagtgtgggaaaagcttcagtcagtctacttacctcatagaacaccagcggttgcactctggtgttaaaccatttgagtgcaacgagtgtgggaaggccttcagcaagaattccagcctcacccagcataggcgcattcacaccggcgagaaaccgtacgagtgtatggtgtgcggaaagcactttaccggcaggtccagtttgactgtgcatcaggtgatccacactggcgagaaaccatacgagtgtaacgaatgtggaaaagcgttttcccaatcggcatacctaatcgaacaccaacggattcatactggggaaaaaccgtatgaatgtgaccagtgcggaaaggcatttatcaagaatagctcattaactgtgcaccagcgcacgcacacaggtgagaaaccttatcagtgcaatgagtgtgggaaggcctttagcaggtctacgaatctgacaagacaccagcgcacgcatacttag

SEQ ID NO: 13921 - DNA, 72 bp, Artificial Sequence
  Description of Artificial Sequence: Synthetic coding sequence
atggaacgggaaggaatctggcacagtaccctgggggagacatgggaaccaaacaactggctggaaggatag

SEQ ID NO: 13922 - DNA, 30 bp, Artificial Sequence
  Description of Artificial Sequence: Synthetic coding sequence
atggagcgtgaggggatatggcactcttag

SEQ ID NO: 13923 - DNA, 1386 bp, Artificial Sequence
  Description of Artificial Sequence: Synthetic coding sequence
atggagcgcgagggcatttggcactccacccttggcgaaacctgggagcccaataactggcttgaggggcagcaagatagtcatctttcccaggtgggagtgacacacaaagagacattcaccgagatgagagtgtgcggggggaacgaatttgaaagatgcagtagccaggattcgattctcgatacccagcagagtatccccatggttaagaggcctcataactgcaactctcatggagaagatgccacgcagaactctgaattgattaaaacccaaagaatgtttgtgggcaaaaagatttatgaatgtaaccagtgtagcaaaacgttctcgcagagttcaagcctgttgaagcaccagcggatccacaccggagaaaagccctataaatgcaatgtgtgtggtaaacattttatagagcggtctagccttacagttcaccaacgcatacatacaggggaaaagccctataagtgcaacgaatgcggtaaagcgttttcccaaagcatgaatcttaccgtgcaccagcgaacccatacaggtgagaaaccctaccagtgtaaggaatgtggaaaggctttccataaaaattccagcttaatccagcacgaaaggattcatacaggcgagaaaccgtacaaatgtaacgagtgtggtaaggcgttcacccaaagcatgaatttaacagtccatcagagaactcacacaggggagaaaccatatgagtgtaacgaatgtggcaaggcgttttcacagagtatgcacctcatcgttcaccagcgaagccataccggggagaagccatacgagtgttctcagtgcggtaaagctttctcaaaatccagcacattaacactccatcagaggaaccatacaggtgaaaaaccgtataagtgcaacaaatgcggaaagtccttttcccaatccacctacctcatcgagcaccagcgcctgcattcgggggtgaagcctttcgagtgcaacgaatgtggtaaagccttcagtaagaattccagcctgactcagcatcggcgaatccatacaggggagaaaccatacgaatgcatggtgtgtggaaagcacttcactggccggagctcactgaccgttcaccaggtcattcacactggtgagaagccttatgagtgcaatgagtgcggcaaggcattctctcaaagcgcctatcttattgagcatcagagaatccacacaggagaaaagccttacgagtgcgatcagtgcggtaaagcgtttatcaagaatagctcactcactgttcaccagcgaactcacacaggcgagaaaccgtatcagtgtaacgaatgcgggaaggccttttcgaggagcactaaccttacacgccaccaacggacacatacctag

SEQ ID NO: 13924 - DNA, 1734 bp, Artificial Sequence
  Description of Artificial Sequence: Synthetic coding sequence
atgctgggatttccaccaggccgacctcagctgccagtacagctgaggccccagacaagaatggctacggccctgcgagacccagcctccgtgccaattgccactgaagtgctgttcaagctgactcagggtagcgtaacatttgaagatgtagccgtctacttctcttgggaggaatgggacctgctcgatgaagctcagaaacatctctactttgatgtgatgctggaaaattttgcactgacatcatcgctgggctgctggtgcggcgtcgaacatgaagaaacgccttccgagcagaggatatccggggagagagttccacaatttcgtacatccaaggagggaagtagtagccagaacgccgattcctgtgagatctgttgcttggttttacgagatattcttcatctggccgaacaccaagggaccaactgcggccagaagctgcatacttgtggtaagcagttctatatctctgctaacctgcagcaacatcagagacagcatatcacggaggccccttttcgaagctatgtcgatacagcttcattcactcagagttgtatcgtacacgtgtctgagaagcctttcacatgccgggaaatccggaaagattttctggcaaatatgcggtttctgcatcaggacgccactcagacaggggaaaagcccaacaattcgaacaagtgcgctgtcgccttttatagtggaaagtcacatcacaattgggggaagtgttccaaagcattttcacacatcgataccctcgttcaggatcagaggatcctgacaagagagggactgttcgagtgttccaagtgcggaaaggcttgcacccgacgatgcaacctgatacagcaccagaaagttcactctgaggaacggccatatgaatgtaacgagtgtggtaaattcttcacctattattcaagcttcatcatccaccagagagtgcacaccggagaacggccctatgcctgccctgaatgtggaaagagcttttcacagatctactctctcaattcccaccggaaagtacacacaggcgagcggccatacgagtgcggcgaatgcggcaagtcattctctcagagaagcaacttgatgcagcaccgaagagtccacactggcgaaagaccgtacgagtgtagcgagtgtggaaagtcattcagtcagaatttttctctgatttaccaccagagagtacacacgggtgagcgaccacacgaatgcaacgaatgtggtaaaagcttttcgaggagtagtagtcttattcaccatagaagactccacacgggggagcgaccttacgagtgctcaaagtgcggcaaaagttttaagcagtcctctagcttctcctctcatagaaaagtgcacaccggggagcggccctatgtttgtggggagtgtggtaaaagtttttctcacagttctaatcttaagaaccatcagcgcgtgcacaccggcgagcgcccagttgagtgtagtgaatgttccaagtcttttagctgcaaaagcaaccttattaagcatttgcgcgtgcacaccggggaacgtccctatgagtgtagcgagtgcggtaagtctttcagtcagagtagtagtttgatccaacaccgcagggtgcatactggtaaaaggccttaccagtgcagccagtgtggaaagagctttgggtgtaagtctgttctgatccagcaccagcgagtgcacatcggggaaaaaccctag

SEQ ID NO: 13925 - DNA, 1668 bp, Artificial Sequence
  Description of Artificial Sequence: Synthetic coding sequence
atgctggaaaattttgccctcacctcatctctgggcctcatctcatcctggagtcacgtggttgcgcagcttggactgggtgaggtaccctctgtgctgcacagaatgttcatgaccccagcatccgcacgttgggaccagagaggacccggtctgcacgaatggcatcttggcaaagggatgtcctccggctgctggtgtggagtggagcacgaggagacgccgtctgagcagcgcatcagtggcgaacgggtaccccagtttcgcaccagcaaggagggctcctcttcacagaacgccgattcctgcgaaatctgctgcctggtgctccgagacattctgcacttagccgaacaccaagggacaaattgcgggcagaaactgcacacatgcgggaagcagttttatatctccgcaaatctgcagcagcatcagcgacagcatattacagaagcgcccttcaggagttatgtcgacacggcctccttcacccaatcgtgcattgtccatgtgagcgaaaagccttttacctgtcgggagatccgtaaggattttctggcgaacatgcgctttttgcaccaggatgccactcagaccggagagaagccaaataactccaataagtgtgcagtggctttttactccggaaaatcccatcacaattggggcaagtgcagtaaggccttctctcacatagatacgcttgttcaggaccagcggatactcacacgtgaagggttgtttgagtgctctaagtgcggcaaggcctgtactagacgatgcaacctcattcaacaccagaaagtgcactccgaagaaagaccttacgagtgtaacgaatgcggcaagtttttcacatattacagttcgttcataatccaccaacgtgttcatacaggggaaagaccgtatgcgtgccccgagtgcggaaagagcttttcccaaatttactccctgaacagccaccggaaagttcacaccggggagagaccctacgaatgcggcgagtgcgggaagtctttctcccagaggtctaatttgatgcagcaccgccgagtgcacaccggcgaaaggccctacgagtgcagtgagtgtggaaaatctttttctcaaaacttctcacttatctaccaccagagagtgcatactggtgaaaggccccacgagtgtaacgagtgtggtaaatcctttagccggagctcttccctgatccatcaccggagactgcacactggtgaaaggccctacgaatgctccaaatgcggcaagagttttaagcagtcctcaagcttcagctcccatagaaaggttcatacaggcgagcgcccctacgtttgtggtgagtgcggcaagagtttcagtcattcttctaacctgaagaatcaccaacgggtgcacactggcgagcggcctgtggagtgctcggaatgttccaaaagcttcagctgtaagtctaatctcattaagcacctgcgcgtgcacacaggagagcgtccttacgagtgcagtgaatgcggcaaatcattcagccagtcaagctccctaatccagcaccgccgagtccacaccggaaagcgcccatatcagtgtagccagtgtggtaagtcctttggctgtaagtctgtgttaattcagcaccaacgagtgcatatcggcgaaaaaccctag

SEQ ID NO: 13926 - DNA, 1695 bp, Artificial Sequence
  Description of Artificial Sequence: Synthetic coding sequence
atgctaggctttccaccaggccggcctcagctccccgtgcaattacgcccccagacacgaatggctacagcgcttcgcgaccccgcctcagggtcagtgaccttcgaggacgtggccgtttatttctcctgggaggaatgggacctcctggacgaggctcagaaacatttatattttgacgttatgctggagaatttcgcacttacctcttccttaggttgctggtgtggggtggagcacgaggaaaccccttctgaacagcgaatatccggagaaagggttccccagttcaggacttccaaggagggatcatcctcccagaacgcagattcatgtgagatctgttgcttggtactgcgcgatatccttcacctggctgaacatcaggggaccaactgtggacagaagctgcatacctgtggtaagcagttttacatctcagccaatctccagcagcaccaaaggcagcatattaccgaagctccttttaggagttacgtggatacagcctccttcactcaatcatgcatcgttcacgtctctgagaagccattcacctgccgcgagattcggaaagacttcctagcgaacatgcgattcctccatcaggatgcaacgcagactggggaaaaaccaaataattctaataagtgcgccgtggccttctactctggaaagtcacatcacaactgggggaagtgttctaaagccttctctcatattgatacactggtccaagatcaacgaatcttgaccagggaagggcttttcgagtgctcaaaatgcggtaaggcctgtacaaggcgctgcaacctgattcagcatcagaaggttcactctgaggaacggccgtatgaatgtaacgaatgtggcaagttcttcacatactactcctcattcatcattcaccaacgcgttcacactggtgaacgaccatacgcatgccctgagtgcgggaagtccttctcgcagatctactccctgaacagccaccgcaaagtgcatacaggggaaagaccctacgaatgtggagagtgtggaaaaagcttttctcaacggtctaacctgatgcagcaccgtcgggttcacaccggagagagaccatatgaatgcagtgaatgtggaaaatctttctcgcagaatttctccctcatttaccaccagagagtccataccggcgaacggccacacgaatgtaacgaatgtggaaagtcattttcgaggtctagctcccttattcatcacaggaggttgcacaccggagagcgtccttatgaatgttcaaagtgcggaaaatcttttaaacaatcgtcgagcttctcaagtcacaggaaagtccatacgggcgagcggccgtatgtgtgcggggagtgcggaaagtctttttcccacagcagcaatcttaagaaccatcagcgtgtgcatactggagagcgccctgtggaatgctcagagtgctccaaaagttttagttgcaagagcaacctgataaaacaccttagagtgcatacaggggaaaggccttacgaatgttcagagtgtggcaaaagtttctcccaatcttcctcactgatacagcaccgccgggttcatacaggaaagaggccctaccaatgtagtcagtgcggcaaaagttttgggtgtaaatcggtgttaatacagcatcagagggtgcatatcggagagaagccctag

SEQ ID NO: 13927 - DNA, 1512 bp, Artificial Sequence
  Description of Artificial Sequence: Synthetic coding sequence
atgctggaaaactttgctctcacatcctcactgggttgctggtgcggcgtcgaacatgaggagacacccagcgagcaacgcatcagtggggagagagtgccacaattcaggacgagcaaggagggctcctcctcccagaatgctgatagctgcgaaatctgttgtttagtgttacgcgacatactgcacttggcagagcatcaaggcaccaattgcggccagaagctgcatacctgtggcaagcaattctatatctccgccaaccttcagcaacatcagagacagcatattacagaggcgccttttcgttcatatgtggacacagctagcttcacccagagctgcatcgtgcacgtgagcgagaagcctttcacctgccgagagatcagaaaggacttcttggccaatatgcgttttcttcatcaggacgctactcaaactggtgagaagcctaacaattccaataaatgcgctgtggcattctattccggtaagtcccaccacaactggggcaagtgtagcaaggcgttcagtcacatagacacgctcgtacaagatcagcgaattctgactcgggaaggattgtttgagtgcagcaagtgcggaaaagcctgcactaggaggtgcaacctgatccagcatcagaaggtgcatagcgaggagaggccctatgagtgcaacgagtgtggaaaatttttcacctactacagtagctttatcatacaccagagggtgcacacaggcgaaaggccatacgcttgccctgaatgcggaaaatcatttagtcaaatatatagcctcaactcccacagaaaagttcataccggggagagaccctacgagtgcggtgaatgcggcaaaagtttttcccagcggagcaatctaatgcaacacaggagggtgcacacaggagagaggccgtatgaatgttctgagtgcggaaaatcattcagtcaaaatttctcgctcatttaccatcagcgcgtccacactggagaaaggccacacgaatgtaacgagtgcggtaaatctttctcccggagcagctcgcttatccaccatcggcgactgcacaccggcgaacgcccgtatgagtgttccaaatgtggaaaaagctttaagcaatctagttccttctcttctcaccgcaaggttcacacaggtgagagaccctacgtatgcggtgagtgtggaaagagcttctcacacagctctaacctgaagaaccaccagagagtgcacaccggcgagcgccctgtcgagtgttctgaatgttccaaatcattttcctgtaagtctaatcttataaaacacctccgcgtgcacaccggcgagaggccatatgagtgctctgagtgtggcaaaagcttctcccagagctcctcactgatccagcaccgtagagtgcataccggcaaacgcccctaccaatgttcccagtgcggcaaatctttcggttgtaagtctgtacttatacagcatcaacgggtgcatatcggggaaaaaccatag

SEQ ID NO: 13928 - DNA, 1707 bp, Artificial Sequence
  Description of Artificial Sequence: Synthetic coding sequence
atgatttccgcctactgtaatctccacctcctgggatcaagcgattctcccgcatccgcctctcaggttgcaggaacaacaggcatgcgccatcacgcgcaaggctccgtgacattcgaagatgtggctgtttatttctcctgggaggagtgggatcttttggatgaggctcaaaagcacctctattttgacgtgatgttagaaaatttcgccttaacaagcagcctcggatgttggtgcggggtcgagcatgaagagaccccaagcgagcagaggatcagtggcgaacgggttccacaatttaggactagcaaggagggatcctcctctcagaacgctgatagctgtgagatttgctgcttagtcctaagggacatactgcatctggcagagcatcaaggcaccaactgcggccagaagctccacacttgtggaaagcagttttacatatcagcaaacctgcagcagcaccagcggcagcatatcaccgaagccccttttcgcagttacgttgacacggcctcttttacccagtcttgtatagtccacgtgagtgaaaaacccttcacgtgtcgggaaatcagaaaagattttcttgccaacatgcggtttctgcaccaggatgccacacagacgggggagaagcccaataacagtaataagtgtgctgtggctttctactccggaaaaagccaccataactggggtaaatgtagcaaagccttcagtcatatcgacacactggtgcaagatcagagaatcttaacacgtgaagggctcttcgagtgctctaagtgcgggaaagcgtgtacgcgtagatgcaatctgatacagcatcagaaagtacacagcgaggaacgcccatatgaatgtaatgagtgcggaaaattttttacttattactcaagcttcatcatccatcagcgcgtacataccggggagcgcccttatgcctgtcccgagtgtggcaagagcttcagccagatctattctttaaacagtcataggaaagtgcacactggcgagcgtccttacgaatgcggcgaatgcggcaaaagtttctcacaacggagcaatctgatgcagcaccgacgggtccataccggagagcgcccttacgaatgctctgagtgcgggaagtctttcagtcagaatttcagtctgatatatcaccagagggttcatacaggagagcgccctcacgaatgcaacgaatgtgggaagagcttctccaggtctagttccctcatccaccacagaagacttcatacaggtgagcggccttacgagtgttcaaagtgtgggaagtccttcaagcagtcatcgtcttttagttctcaccgaaaggtccacaccggtgagcggccttacgtttgtggcgagtgcggtaaatcattttcacactcttccaatctcaaaaaccaccagagggtccatacgggcgaaagacctgtggagtgctctgagtgttcaaagagcttttcgtgtaagagcaatctgatcaagcatctgagggtccacacaggagagcgtccttatgagtgctcagagtgtggaaaatccttttcgcagtcatcgtccttgatccagcacaggcgcgtgcacaccgggaagcgcccctaccagtgctcacaatgcggaaagtctttcggctgtaaaagcgtcctcatacagcaccaacgcgtgcacatcggggaaaagccctag

SEQ ID NO: 13929 - DNA, 1668 bp, Artificial Sequence
  Description of Artificial Sequence: Synthetic coding sequence
atgttggagaattttgctctcacctcaagcctcggtctgatctctagctggtcccacgtggtggcccaactggggctgggagaggtccccagtgtcctgcaccgtatgttcatgaccccagcgtccgcacgctgggatcaaagaggaccgggactgcacgagtggcacctcgggaagggcatgagctccggatgttggtgcggggtagagcatgaggaaaccccatctgaacaacgtataagtggggaacgggtgccacaattccgcacttctaaggagggctccagcagccagaatgcagatagttgcgaaatctgctgcctcgtgctgagggatatcttgcatctagctgagcaccaaggaacaaactgcggacagaaactccacacctgcgggaaacagttttacatttctgcgaatttgcaacagcaccagcggcaacacatcactgaggcaccattccggtcatacgtggatacagcaagcttcacacaatcttgcatcgtgcacgtgtcagaaaaaccctttacctgccgagagataaggaaggatttcctggccaatatgcggtttctgcaccaggatgctacacagactggagagaaacccaataactctaacaaatgcgcagtagccttctactcgggaaagtcacatcacaattggggaaagtgctccaaggccttctcgcacatcgacacacttgtgcaggaccagagaatcctcactagggagggtctcttcgagtgcagtaagtgcgggaaggcctgcactcgcagatgcaatctgatacaacaccagaaggtccattccgaggagcgtccatacgagtgtaacgaatgcggaaaattctttacttactacagcagtttcataatccaccagagagtccacactggagagaggccatacgcctgcccagaatgcggcaaatcctttagccagatctacagtctgaatagccatagaaaagtccatactggtgagcgtccttatgaatgtggagagtgtggtaaatcttttagccagcgaagtaacctcatgcagcaccggcgtgttcacacgggagaacggccctatgagtgtagcgagtgtggtaaatcatttagccaaaacttttcactcatctatcatcagagggttcacacaggcgagagacctcatgaatgcaatgagtgtgggaaatcgttctctcggtcctccagtctgatccatcacagaaggctgcataccggggagcgaccatatgaatgtagtaaatgtggaaaatccttcaagcaatcctcttcattcagcagtcacagaaaagtccataccggggagcgaccttacgtttgcggggagtgtggcaaaagcttctcacattcctcgaacctaaagaaccatcagagggtgcataccggggagaggccagtggagtgcagcgagtgtagtaaaagcttcagttgcaaaagcaacctgatcaaacacctaagagttcatacaggggagaggccatacgagtgttccgagtgcggtaagtcctttagccagtccagctctcttattcagcaccggagagttcacactggcaaacgaccttaccagtgttctcaatgcggaaagtcttttgggtgcaaatctgtcctcatacagcatcagcgcgttcacataggtgaaaaaccgtag

SEQ ID NO: 13930 - DNA, 1731 bp, Artificial Sequence
  Description of Artificial Sequence: Synthetic coding sequence
atgcggaccctacggcaacgcgaagtggaatatttctcaaaggcgacccagctcgtccgtggatcaaccaaggatcggggagcccaggttcctatagctaccgaggtcctgttcaagctgacacagggttcagtcacatttgaagatgtagctgtatatttctcctgggaagagtgggacctgctggacgaagctcagaaacatctctacttcgatgtgatgcttgaaaacttcgccctaacatcctccctaggctgttggtgcggggtcgaacacgaggagaccccctctgaacagaggattagtggcgaacgcgtgcctcagtttcgcacctcaaaggagggctcctccagccaaaatgccgactcgtgcgaaatctgttgtctcgtgctgcgtgacatcctgcatttagcggagcatcaaggaactaactgcgggcagaagctccacacatgtgggaagcagttttacataagtgccaacctgcagcaacatcagcgccaacacatcaccgaggctccgttcagaagctatgtcgacaccgcatctttcacgcagagttgtattgtgcacgtcagtgagaagccgttcacgtgccgtgaaatccggaaagactttttggctaacatgaggtttctgcaccaggatgccactcagactggggagaaaccaaataactctaacaaatgcgccgtggccttttattctggtaaaagccatcataattggggcaaatgcagcaaagcattttcccatatagacacactagtccaggatcagcgaattctaaccagggaaggacttttcgaatgtagcaaatgtggaaaggcatgtacaaggcgatgtaatttgattcagcaccagaaagtgcattctgaggagcgcccctatgagtgcaatgaatgtggaaaattttttacatactattccagctttatcattcaccagcgcgtccatacaggtgagaggccatacgcatgccctgaatgcggaaaatccttttcccaaatttacagcctgaattctcaccggaaagtacacaccggagagcgcccatacgagtgtggagagtgcggaaagagcttcagccaacgatccaatctcatgcaacacaggcgcgtccataccggggaacgcccctacgagtgttcggaatgcgggaaaagcttctcccagaatttcagcctgatctaccaccagcgcgtacacacaggggagcgaccccatgaatgtaatgaatgcggcaaatctttcagcaggtcaagcagtcttatccatcatcgccgattacacacaggagagaggccatacgagtgttccaaatgtggtaaaagcttcaaacaaagctcctcattctcatctcatcgcaaggttcacacaggggagaggccttatgtgtgtggagagtgcgggaagtctttctctcacagtagcaatctgaagaaccatcagcgggtgcataccggcgaaagacctgtggagtgttccgaatgttcaaaatccttttcttgcaaaagtaacttaattaaacatctccgggtgcacactggcgaacgcccctatgaatgttctgagtgcgggaagagcttcagccagagcagcagcttgattcagcataggagagtgcatacggggaagcggccctaccaatgctcacagtgtggaaagtctttcggatgtaagtcagtgctcatacagcaccagagggtacatattggcgaaaaaccctag

SEQ ID NO: 13931 - DNA, 1890 bp, Artificial Sequence
  Description of Artificial Sequence: Synthetic coding sequence
atgctgggctttccccccgggcgaccgcagttgccggtccagctgcggccccaaaccaggatggctactgctcttagagatcctgcctcagtccctattgcaacggaggttcttttcaaattgacacaaggaagcgtgacgtttgaggacgtcgctgtctatttctcatgggaggagtgggatctcttggacgaggctcagaaacacttgtattttgatgtgatgcttgagaatttcgcgctgacctcaagccttggactgatctcctcatggtctcacgtggtggcccaactcggtctcggcgaagttccctccgtcctgcatcgtatgttcatgactccagccagtgccaggtgggaccagcgggggccaggcctgcatgagtggcatttgggtaaaggcatgagctctggctgttggtgcggggtggaacacgaggagacacccagcgagcaaagaatctcaggcgagagagttcctcaattcaggactagtaaggagggatcatcatctcagaatgcagattcgtgcgagatatgctgcctcgtgctgagagatatcctgcatctcgctgagcaccaggggaccaattgcggacagaaactccatacctgtggcaaacagttttatatctcggcgaatctgcaacagcatcaacgtcagcacataactgaagctcctttccgatcttatgtggataccgcttctttcacccaaagttgtatcgttcatgtgagcgaaaaaccttttacgtgtcgtgagatcaggaaagattttctggccaatatgcgcttcctgcaccaggatgctacgcagacaggagagaagcccaacaattctaataagtgcgctgtggccttctattcaggcaagtcccaccataattggggaaagtgttcaaaagcctttagccacattgacacattagtgcaggatcaaaggatactcactagggagggcttgtttgaatgctcaaagtgtggaaaagcctgcactagacgctgtaacctcatccagcatcagaaggtccactcagaagagcgtccatatgagtgtaacgagtgtggcaagttcttcacgtactactccagcttcatcatccaccagcgggtccatacgggggagcggccatacgcatgtcctgagtgtggcaagtccttttcacaaatctactctctcaactctcatcgcaaggtgcatactggggagcggccgtatgagtgcggcgagtgtggcaaatccttctcgcagcgctcaaacttgatgcagcaccggcgagtgcatacaggcgaacgcccctacgaatgctccgaatgtgggaaaagtttctcccagaactttagcttgatctatcaccagagagtccacacaggagagcggccacacgaatgtaatgagtgcggaaagtcgtttagccggtcctcaagcctcatccaccataggcgccttcataccggggaacggccttacgaatgtagcaagtgcggaaagagcttcaagcagtcctcgtcattcagttcacatagaaaggtgcacaccggagagcggccctacgtttgcggagaatgcggaaagtcattctcgcattcatccaaccttaaaaaccaccagagggtacatactggcgaacgacctgtcgaatgcagtgagtgcagcaaaagtttctcttgtaagtctaaccttattaagcaccttagggtgcatacaggcgagcgcccttatgagtgtagcgagtgtggaaagtcatttagccagagcagctcactcatacagcaccggcgggtgcacactggaaaacgcccttatcagtgtagccaatgtggtaagtcatttggatgtaaatccgtactgatccagcaccagcgagtgcacattggcgaaaagccctag

SEQ ID NO: 13932 - DNA, 117 bp, Artificial Sequence
  Description of Artificial Sequence: Synthetic coding sequence
atgcttggtttccccccaggacgtccacaattgcctgtacaattacggccacagacaagaatggccaccgcccttcgggatcccgccagtgcggttcagtggaaaaaacgtctctag

SEQ ID NO: 13933 - DNA, 1854 bp, Artificial Sequence
  Description of Artificial Sequence: Synthetic coding sequence
atgatcagtccaagcctagagttacttcacagcgggctgtgcaagttccccgaagtggaaggtaaaatgacgacttttaaggaagccgttaccttcaaggacgtcgctgtggtcttcactgaggaggaactagggttgttggatccagcccagcgcaagctgtatcgggacgtgatgttggagaatttcagaaacttgctctccgtgggcaatcagccttttcaccaggacaccttccacttcctggggaaggagaagttttggaagatgaaaaccacgtcccaacgcgaaggcaacagtggaggtaagatccagattgagatggagacagtgccagaggccggtccccatgaagaatggagctgccagcaaatttgggagcagatagcctccgatctcaccagaagtcagaattcgattcgaaatagcagccagttctttaaagagggcgatgtgccatgtcagatagaggccaggctgtccatatcccacgtgcagcagaagccataccgctgcaatgagtgcaaacagtcattttccgatgtgagcgtttttgatctccaccaacaatcccactccggcgaaaagtctcatacatgtggagagtgtggcaagtccttctgttattcccccgcactccatatccaccagagagttcacatgggcgagaagtgctataagtgcgacgtgtgcggcaaagaatttaatcagtcatcccatctccaaactcaccagcgtgtgcatactggcgagaaaccgttcaagtgcggccaatgcgggaaaggatttcactcccgaagtgcgctgaacgtgcattgtaagctccatacaggagagaagccatataattgtgaggaatgtggcaaggccttcatccacgacagtcaactgcaggagcatcaacggatccataccggtgaaaagcccttcaaatgcgacatctgtggtaagtcttttcgagtgagatctcgcctgaataggcattcaatggtgcacacgggggaaaaggcattcaggtgcgatacttgtggaaaaaattttcgtcagcggagcgcactcaattcccacagtatggttcatatcgaggagaagccgtacaaatgtgagcagtgcggcaaagggttcatctgtcgtcgggatttctgcaagcaccagatggtgcacaccggtgagaagccatacaattgtaaagagtgtggcaaaacattccgatggtcttcttgcctgttaaatcatcaacaggtacacagtggtcagaaatcattcaagtgcgaagagtgcggtaaaggcttctacacgaacagccggcggtcctcccatcagcgcagccacaatggggagaaaccttacaattgcgaggaatgcgggaaagattacaagagaagattggacctggaattccaccagagggtgcacactggcgaaagaccctacaactgtaaagagtgcgggaagagcttcggctgggccagttgccttctaaaacaccagcgcctccactctggagaaaagccatttaagtgtgaggagtgtgggaagagatttacgcagtcctctcagctgcactcccaccagacctgccacacaggcgagaagttgtacaagtgcgaacagtgtgaaaaagggtacaacagtaaattcaatctggacatgcatcagcgggttcacggaggggaacggccctacaattgcaaggagtgcggcaaatccttcggctgggcatcttgcctcctgaaacaccagcgcctgcattccggcgagaagccgttaaaatcaggtgtgtgggaagaaatctactctgagttcaccgcttccttcacttctgttagtctctgtgggcgcaaggcaatctag

SEQ ID NO: 13934 - DNA, 144 bp, Artificial Sequence
  Description of Artificial Sequence: Synthetic coding sequence
atgacaacctttaaagaggctgttacttttaaggacgtcgctgtcgtcttcacagaggaggaactgggactgctggacccagcccagcggaagctgtacagggatgtcatgttagagaactttcgcaacctccttagcgtatag

SEQ ID NO: 13935 - DNA, 1356 bp, Artificial Sequence
  Description of Artificial Sequence: Synthetic coding sequence
atggcaaagctgtacgaggctgtgacattcaaggatgtggccgtgattttcacggaggaggaactaggcctgctggatcctgctcagaggaagctctatcgcgacgtaatgctggagaatttcagaaacttgctgagcgttggcggaaagatacaaacagaaatggagaccgtcccggaagcagggacccacgaggagttttcttgcaagcagatttgggaacagatcgcctccgatttgacaagatcccaggacactactattagcaatagtcagcttttcgaacaggatgataacccgtcccagatcaaagcccggttgtccaccgtccacacgcgggagaagcccttccagggagagaattgtaaacagtttttctcggatgtctcgttcttcgacctcccacagcagctatattcaggcgaaaagtcacacacgtgcgatgaatgtggcaagagtttctgctatatctcagcactccacatccaccagcgggttcacatgggggtgaaatgctataagtgcgatgtttgcggaaaggagttctctcagtcaagtcgcctacagacgcaccagagggtgcacactggcgaaaagcccttcaagtgcgaacaatgtggtaaggggttccggtgtagatccgcattaaaagtacattgtaagctgcacatgagagagaagccttacaattgcgaaaaatgcggcaaggccttcatgcacaacttccagctccagaaacaccataggattcatacaggggagaaacccttcaaatgcgaaatatgcggcaaaagtttctgtctcagaagttcactgaatagacattgcatggtgcatacagcggagaagctctataaatcagaaaagtacggccgggggtttatcgataggctggacttgcataaacatcagatgatccacatgggtcaaaagccttacaattgtaaggagtgtggcaagagtttcaaatggagttcgtacctgttagttcaccaacgcgttcacaccggcgagaaaccttacaagtgtgaagagtgtggaaagggctatatttccaaatccggactggactttcaccatcggacgcacaccggtgagagaagttacaactgtgacaactgtggaaaatcatttcggcatgcttcttcaattctgaatcacaagaagctgcactgtcagcgcaagcctttgaaatgcgaggactgtggcaaaaggctcgtgtgtcggagctattgtaaggaccagcagagggaccacagtggagaaaaccctagtaaatgcgaggattgtggcaaacgttacaaacggagactcaatctggatataatattgagcctgttcctcaatgacatttag

SEQ ID NO: 13936 - DNA, 1194 bp, Artificial Sequence
  Description of Artificial Sequence: Synthetic coding sequence
atggagaccgtacccgaagccggcacccatgaggagttttcatgtaagcagatctgggaacaaattgcatccgacctgacccggtcacaggatacaaccatcagtaacagtcaactgttcgagcaggatgacaaccctagtcagatcaaggcaagattgagcaccgtacatacaagggaaaaacccttccagggcgaaaactgtaaacagttttttagcgacgtcagcttctttgacctaccccagcagctgtattccggggaaaaatcacacacctgcgatgaatgcggaaagtccttttgttatatttcagccctacacattcatcagcgagtgcacatgggcgtaaagtgctacaaatgcgatgtgtgcggaaaagaattcagccagtcttcccggttgcagacacatcagagagttcatactggtgagaaaccatttaagtgtgaacagtgcgggaagggcttccggtgccgttccgccctgaaagtgcactgcaagctgcatatgcgtgaaaagccctataactgcgaaaagtgcggaaaagcattcatgcataatttccagctccagaaacatcaccggattcacaccggagagaaaccgtttaagtgtgaaatatgcggaaaatctttctgcttgaggagctcgttaaacagacattgcatggtccatacggctgaaaagctatacaagtccgaaaagtacggccggggttttattgaccgcctcgacctgcacaaacaccaaatgattcacatgggacagaagccttacaactgcaaggagtgtggaaaaagctttaagtggtctagctacctgttggtgcatcagcgagtacacactggggagaaaccttacaaatgcgaggaatgcggtaagggttacataagcaaaagtgggctggatttccaccaccggactcataccggcgagaggtcgtacaactgcgacaactgcgggaagtcatttcgacatgcgtcgtccatactcaatcacaagaagttgcattgccaaaggaagccgctaaagtgtgaggattgcgggaaaaggctggtctgcaggtcctactgtaaggaccaacagcgtgatcattcgggggagaacccctctaagtgcgaagactgtggaaaaaggtataaaaggagattaaatctggacattatcctgagtctgttcctgaacgacatctag

SEQ ID NO: 13937 - DNA, 1476 bp, Artificial Sequence
  Description of Artificial Sequence: Synthetic coding sequence
atgatcgattcgggcgaaaaaaaacctgggcgccgggccgaagaggcagtgaccttcaaggacgtcgctgtgatctttaccgaggaggaactgggactgctggatcccgcccagcggaagctctaccgcgatgtaatgttggagaatttccggaacctcctatcggtcgggcatcagcctttccatggcgatacgttccactttctgcgcgaggagaagttttgggtgatgggcacaactagccagcgcgagggaaatctcgggggtaaaatccaaacagagatggagacagttcccgaggcaggaacgcacgaggaattctcatgtaaacagatatgggagcagatcgcttccgacttaacaaggtctcaggatacgactatttccaactcacagctgttcgagcaggatgacaatccgtcacagattaaagcaagactatcaactgtgcatactagagagaagcctttccagggcgaaaactgcaaacagttctttagcgatgtctctttcttcgatcttccccagcagctctactcaggcgaaaaaagtcacacgtgcgatgaatgtggcaaaagtttttgttacatcagcgcactgcacattcaccagcgtgtgcatatgggagtaaagtgttacaaatgtgatgtttgcggcaaagagtttagccagtctagccggcttcagactcatcagagagtgcacaccggggaaaagccatttaaatgtgaacagtgtggaaagggctttcgatgcagaagtgcgctgaaggtgcactgtaaactgcatatgcgggagaagccctacaattgcgagaagtgtggaaaggctttcatgcataatttccagttgcagaagcatcaccgtatacatacaggggagaagccatttaagtgtgagatctgcggcaagtcattctgcctgaggtctagcttgaaccgccattgtatggttcatactgctgaaaaactctacaaaagtgagaagtacggtcgaggattcatcgaccgacttgatctccacaagcatcagatgattcacatgggccagaagccatacaactgtaaagagtgcggtaaatcatttaaatggtctagctatctgctcgtccatcagagggttcacacaggggagaagccatataaatgcgaggagtgcggcaagggctatatatcaaaatccggacttgattttcatcataggacccataccggtgagcgatcctacaattgcgataactgtggaaaaagtttcaggcacgcatcctcgatcctgaaccacaagaagctgcactgccagcgcaagcccctgaaatgcgaggattgtgggaagagactggtgtgtaggagttattgtaaggatcagcagcgagatcacagcggggagaatccctccaagtgcgaagactgtgggaaaagatacaaacggagattgaatttggacatcatactcagcttgttcctcaacgacatttag

SEQ ID NO: 13938 - DNA, 1449 bp, Artificial Sequence
  Description of Artificial Sequence: Synthetic coding sequence
atgacaatgagtaaggaagctgtcacctttaaagacgtggccgtcgtctttacggaggaggagcttggcctgctggatctggcccagagaaaattgtatcgagatgttatgttggagaactttcgcaatctcttgtctgtggggcatcagccttttcatcgagacactttccattttcttcgggaagagaagttttggatgatggatattgcaactcagcgggaggggaatagtggaggtaaaatacaacccgagatgaagaccttccccgaggccggcccacatgagggatggtcttgtcagcagatctgggaagaaatcgccagcgacctgactcgcccacaagatagtacaatcaagtcatcgcagtttttcgagcagggggatgcacacagccaggttgaggaagggttatcgattatgcataccgggcagaagccgtccaattgcggcaagtgcaaacagtctttttccgatatgagcatcttcgatcttcctcagcagattcggagtgctgaaaagagtcattcatgcgatgagtgcggaaaatccttctgttacatatctgcgctgcatatccaccagagggtccatttaggggagaagctgttcaagtgtgacgtgtgcgggaaggagtttagtcaaagcctgcatttgcaaacacaccagagggtgcatacgggggaaaaaccgttcaagtgtgaacagtgtggacggggattccgttgtagatcagccctgaccgtccactgcaagctgcatatgggcgagaaacactacaattgcgaagcctgtggccgggcctttatacatgatttccagctgcagaagcatcagcgtatacacaccggagagaagccattcaagtgcgaaatttgctccgtgagctttcgactcaggtcgagtctgaacaggcattgtgttgtgcacaccgggaaaaagccaaattctaccggagagtatggaaaaggctttatcagaagattggacctgtgtaagcatcagaccatacacacgggggaaaagccctacaactgcaaggagtgcggtaagtcattcaggaggtcctcttatctgctgatccatcagagggtgcacacgggtgaaaagccttacaagtgtgacaagtgcgggaagtcctatattaccaaaagtggcctggacctacaccatagggcccatactggcgaacggccatataattgcgatgactgtgggaagagcttccgtcaggcatcttctatcctgaatcataagcgcttgcactgccggaagaagccatttaaatgcgaggactgtggaaaaaagcttgtgtaccgatcttacagaaaagatcagcagaagaatcacagtggagagaacccttcgaagtgcgaggattgtggcaagcggtacaaacggaggctgaacctggacataatcttaagtctcttcctgaacgacacttag

SEQ ID NO: 13939 - DNA, 2121 bp, Artificial Sequence
  Description of Artificial Sequence: Synthetic coding sequence
atgactacgctgaaagaagccgtgaccttcaaggacgtggccgttgttttcacggaggaggagctgaggctgctagatctagctcaacgaaagctgtacagggaagtaatgctagaaaacttcagaaacctgctctctgtgggccaccaaagcctgcacagggacacctttcactttttgaaggaggagaagttttggatgatggaaaccgccacccagagggaaggcaatctcgggggaaaaattcagatggaaatggagacagtctccgagtcgggaacccacgagggtctgttttcgcaccagacttgggagcagatttcctccgacctgacgagatttcaggatagcatggttaatagtttccagttttcaaaacaggatgacatgccatgccaggtcgatgcgggtctgtctataatccatgtgcggcagaagccttccgaagggagaacgtgtaaaaaatctttttccgatgtttcagttctggatttacatcagcaactccagagccgcgaaaaaagtcatacgtgcgatgagtgcggtaagtctttttgctatagctctgctctacggatacatcagcgcgttcatatgggagaaaaactttataattgcgacgtgtgtggaaaggagttcaatcagagcagccatctccagattcatcaacgcatccatacaggggaaaagccttttaaatgcgagcaatgtgggaagggttttagccgtaggtccggtctctacgtgcatcgcaagctccatacaggcgtgaagcctcatatttgtgagaaatgcggcaaggcatttatccatgattcccaactgcaggaacaccaaagaatacatacaggcgagaaaccatttaaatgcgatatatgctgcaaatctttccgatcacgggctaacctgaacaggcatagcatggtgcatatgcgcgagaagcccttcaggtgtgacacctgtgggaagtctttcggcctaaaatccgcccttaactcacaccgcatggtgcacactggcgagaaacgctacaagtgcgaggagtgtgggaagcgcttcatttataggcaagatctgtacaagcaccagattgatcatacgggagaaaagccatataactgtaaggaatgcggcaaatcattccggtgggccagcggtctcagcagacatgtaagggtgcactccggtgagactaccttcaagtgcgaggagtgcggtaagggcttctataccaacagccagaggtatagccaccagagagcccactccggtgaaaagccttaccgctgtgaagagtgtgggaaaggctataaaagaagactagatttggacttccatcagcgggtacatagaggggagaaaccctataactgcaaagagtgtgggaagagcttcggttgggcctcctgcctgctgaaccaccaaaggatccattctggtgagaaacctttcaaatgtgaggaatgcgggaagcgctttactcagaactctcagctctatacccatcgacgggtgcattccggtgaaaaaccgtttaaatgtgaggaatgtggcaagagatttactcagaattcccaactgtacagccatcggcgagtgcacactggtgtgaagccgtataagtgcgaagagtgtggcaagggctttaactccaagtttaatctggacatgcaccagcgcgtgcacaccggggaaagaccatacaattgtaaagaatgtgggaaatcattttccagggcctcatctatcctgaaccacaagagattacacggggatgagaaaccttttaaatgtgaggagtgtggcaaacgattcactgaaaattctcagctccactcacatcagcgcgtccatacaggcgaaaaaccctacaagtgtgagaaatgtgggaaatcattccggtgggccagtacccatctcacacatcagcgcctgcattcacgggaaaaactgttacagtgcgaagattgcgggaaatctattgtacattctagctgcttgaaagaccagcagcgcgatcaatccggagagaaaacaagtaagtgcgaggattgcgggaagagatacaaaagaaggttaaacctagatacattgctatctctctttctcaatgacacctag

SEQ ID NO: 13940 - DNA, 2013 bp, Artificial Sequence
  Description of Artificial Sequence: Synthetic coding sequence
atgctggagaacttccgtaatttgctgtccgtggggcaccagtccctgcatagggataccttccattttctcaaggaagagaaattttggatgatggagacagcgacacagcgcgaaggaaatctcggcggcaaaattcagatggaaatggagacggtgtctgagtccggcactcacgaaggtcttttcagccatcagacatgggaacagattagctctgatctgacacggtttcaggactcgatggtgaattcctttcagttctcaaagcaggacgacatgccatgccaggtcgacgcaggattgagcatcatccacgtgaggcagaagccctcggaggggcgaacctgcaagaagtcctttagcgatgttagtgtactggacttacaccagcagcttcagtctcgcgagaaatcccacacctgtgacgagtgtgggaagtccttctgctattctagcgcactaagaatccaccagagggtacatatgggagagaagttatacaattgcgacgtctgtggaaaggagtttaaccagtcttcacatctgcagatccaccaacgtattcacaccggcgagaaacccttcaaatgtgaacagtgcggcaagggcttctcccggaggtcgggcctttacgtccaccggaagctgcacaccggagttaaaccccacatctgtgaaaagtgtggcaaggccttcatacacgactcccagctgcaggaacatcagcgaattcacacaggcgaaaaacccttcaaatgtgacatctgctgtaaatcttttaggtcaagggccaacctcaatcggcactccatggttcatatgcgcgagaaaccattccgctgcgacacttgcggcaaaagttttgggctgaaatccgccctcaacagtcatcggatggtgcacactggagaaaaacgttacaagtgtgaggagtgcggcaaacgtttcatttaccgccaggacctgtacaagcaccagatcgaccatacaggtgagaagccttataactgtaaagaatgcggcaagagctttcggtgggcttcaggtctcagtcgccatgtgcgcgtacactctggagagacaacattcaaatgtgaggaatgtggaaagggtttctataccaactctcagcgttactcccaccagagggcgcatagcggagagaagccatacaggtgtgaagaatgtggaaagggttataagcgtcgactggacctggatttccatcagcgggtgcaccgaggggagaaaccctacaactgtaaagagtgtggaaagtcattcgggtgggcctcttgcctgctgaaccaccagagaattcactccggtgagaagccttttaaatgtgaagagtgtggcaaacgcttcacacagaactcacagttgtacacccatagaagagtacactccggtgaaaaaccgtttaagtgtgaggagtgcgggaagaggttcactcagaactctcagctgtatagtcacaggagagtacatacgggcgtcaaaccgtataagtgtgaagaatgcggtaaaggatttaattcgaagttcaacctggatatgcaccagcgcgtgcataccggggaacggccttataactgcaaggagtgtggcaagtccttttccagagcatcgtctattttgaatcacaaaagattacatggagacgaaaagccattcaaatgcgaggagtgtgggaaacgatttaccgagaacagtcagttgcatagtcaccagagggttcatacaggcgagaaaccatacaaatgcgaaaagtgtgggaaaagctttcggtgggcgagtacgcacctaactcatcagcgactccacagtcgcgagaagcttctgcagtgcgaggactgcggtaagagcattgtccacagttcttgtctgaaagatcaacagagagaccagtccggagaaaaaactagtaagtgcgaagactgcggcaagcggtacaaacgaaggttgaatctggataccctcttgagtctgttcctcaacgatacttag

SEQ ID NO: 13941 - DNA, 285 bp, Artificial Sequence
  Description of Artificial Sequence: Synthetic coding sequence
atgaatatgtttaaagaggctgttactttcaaggacgtcgcggtggccttcacggaagaggagctggggctcctggggccagcgcagcggaagttataccgagacgttatggtggaaaatttccggaacctcctgagtgttggccatccacctttcaagcaggacgtgagccccattgaacgcaacgaacagctctggatcatgaccacagctaccaggcgccagggcaacctggatacgcttctcgtcaaagcactccttctgtacgacctggcacagacctag

SEQ ID NO: 13942 - DNA, 2412 bp, Artificial Sequence
  Description of Artificial Sequence: Synthetic coding sequence
atgaatatgttcaaagaggccgttacgttcaaagatgtggctgtggcctttactgaagaagagcttggcttactgggtcccgcgcagagaaagctctatcgggatgtcatggttgaaaactttagaaacctgttatctgtgggacatcccccatttaaacaggacgtgtctccaatcgaaaggaatgaacagttgtggatcatgacaacagccacacgcaggcagggtaatttaggagagaagaatcagagcaagctgattaccgtccaggatcgggagtcagaagaagagctgtcctgttggcagatctggcagcagatcgcgaatgatctgaccaggtgccaggactccatgattaacaacagccagtgccacaagcaaggcgactttccataccaggtagggactgaactgagtatccagatctccgaagatgagaactacattgtcaataaggctgatggacctaacaacactggaaaccccgagtttcccatccttaggacacaggatagctggcgcaaaacattcctgaccgagagccagcgcctgaatcgcgaccagcagatttccattaaaaataagctttgtcagtgcaagaaaggggtcgatcctattgggtggatcagccaccatgatgggcacagagttcataagtccgaaaagtcgtacagacctaatgattacgaaaaagacaacatgaaaatactcacctttgaccacaacagtatgattcataccggccagaaaagttaccaatgtaatgagtgcaaaaagccattcagcgacctgagctcctttgacctccaccagcagcttcagtctggagaaaaatccctgacttgcgtggagcgcgggaagggattttgctactctccagttctccccgttcaccaaaaggtgcatgtaggtgagaaactgaagtgcgacgagtgtggcaaggaatttagccaaggcgctcatctccaaacacatcagaaagtccacgtgattgagaagccttataagtgcaagcagtgcggaaagggtttttccagacgcagtgcattaaatgtgcactgtaaggtgcatacagccgagaagccctacaactgcgaagagtgtggccgtgcattttcacaggcttcacatctccaggatcaccagcgccttcatactggcgagaagccttttaaatgcgatgcctgcggcaagtcctttagcagaaactctcatttgcaaagccaccagcgtgtccacacgggcgaaaaaccatataaatgtgaggagtgcggtaagggatttatttgttcaagtaatctgtacattcaccagcgggtccataccggagaaaaaccctacaaatgcgaagaatgcggaaaaggtttctctcggccatcttccttacaggcgcatcaaggcgtacacacaggagagaagagctacatctgcacggtttgcgggaaaggcttcacactgagctctaatctccaagcccaccagcgggtgcacacaggagaaaaaccatataaatgcaacgaatgtgggaagtcttttagacgcaattcacactatcaggttcacttggtggtccatacgggcgagaagccctataaatgtgagatatgtgggaaaggcttcagccagtcctcctaccttcagatccaccaaaaggctcattccatagaaaaacccttcaagtgtgaggaatgtggacagggattcaaccagtccagtcgcttacaaatacaccagctgatacacacaggagagaagccctacaaatgcgaagaatgcggaaaaggattctctagaagggccgacctgaaaatacattgtaggatccacaccggagagaaaccttacaattgcgaggagtgcggcaaggttttccgtcaagctagcaacctcttggctcatcagcgggtacacagcggggagaaacctttcaaatgtgaggaatgcggtaagtcctttggaaggtctgcacatttgcaggcgcaccagaaagtgcacactggtgataagccgtataagtgcgatgaatgcggaaagggcttcaaatggtcactcaatttggatatgcaccaaagggtgcacacaggagagaaaccctataagtgcggcgagtgcgggaagtacttttctcaggcctccagcctgcagcttcaccagtctgtgcatacaggggagaagccatataagtgtgacgtctgcggcaaagtcttctcaagaagctcccagttgcaatcacatcagcgcgttcatacaggcgagaagccatataagtgtgagatatgcgggaaatcattttcctggcggtctaacctgacggtccaccataggattcatgtgggcgacaagtcatataagagtaaccggggcggcaagaacattcgggagagtacacaggagaagaagagcatcaagtag

SEQ ID NO: 13943 - DNA, 285 bp, Artificial Sequence
  Description of Artificial Sequence: Synthetic coding sequence
atgaacatgttcaaggaggcagtgacctttaaggatgtcgccgttgcctttacggaggaagaactgggcttgctgggacccgcacaacggaagctctatagagatgtcatggtcgaaaactttcgcaacctcctttctgttggccaccctcccttcaagcaggatgtcagtcccatcgagaggaacgagcaactctggattatgactacagccacccggaggcaaggaaacctagatactttgctggtgaaagccctcctgttatatgatcttgctcaaacctag

SEQ ID NO: 13944 - DNA, 2103 bp, Artificial Sequence
  Description of Artificial Sequence: Synthetic coding sequence
atgaccacattcaaggagggcttgactttcaaggacgtcgccgtcgtttttacggaggaagagctgggtctcctggatccggtgcaacgaaacttgtaccaggatgtaatgctggaaaatttccgtaatctgctcagtgtcggacaccatcccttcaagcatgacgttttcctgctggagaaggaaaaaaagctggatatcatgaaaaccgccacccaacgcaagggaaagtctgccgacaagattcagtctgaggtggagactgtcccagaggctggcagacacgaggagctgtactggggacagatttggaagcagattgcgagtgatttgattaagtacgaggattcaatgatttccatcagcaggttccccagacagggcgacttatcctgccaagtgagggccggcctgtatacaacccataccggtcagaagttctatcaatgtgatgagtacaaaaagagcttcaccgatgtgtttaactttgatcttcatcagcagcttcactctggcgaaaaaagtcacacctgcgacgaatgcggcaagagtttttgctacatctcagctctgcatatccaccagcgtgtccatatgggggagaagtgctataagtgcgatgtgtgtgggaaagagttctctcagagcagtcacctccagacccatcagagggtccacacagttgaaaagccttttaagtgcgtggagtgcgggaaagggttctcgagacgatccactctgaccgtccactgtaaattacactcaggcgagaagccttacaattgtgaagagtgcggcagggctttcatacacgccagccacctgcaggagcaccaacgtatccacacaggggaaaagccattcaaatgtgatacgtgtggcaagaatttccgacgccggtctgcactgaacaaccactgcatggtccacacaggagagaaaccctacaaatgcgaagattgcggcaagtgcttcacatgtagcagcaacctacgtatccatcaacgggtacacaccggagaaaagccctataaatgtgaagaatgtggcaaatgcttcattcagcccagccagttccaggcgcaccggaggattcacacaggtgagaagccttatgtgtgcaaggtgtgtggtaaaggttttatttatagcagttcatttcaggcccatcagggggttcacactggagaaaaaccttacaagtgcaacgagtgtggtaagtcattccgtatgaaaatacactaccaagtgcatctcgtggtacacactggagaaaagccctataagtgcgaggtctgcggcaaagcattccgccagtcatcatacttaaaaatccatcttaaagcccacagcgtgcagaagccatttaaatgtgaggaatgtgggcagggcttcaaccagtcgagccgtcttcagatccatcagttgatacacaccggcgagaaaccatacaagtgcgaagaatgcgggaagggttttagccgcagggcagacctgaaaatccactgccgaatacacacaggcgaaaagccttataattgcgaagaatgtggcaaagtgttttcgcaggccagccatctattgacccatcagagagttcacagcggcgagaagccatttaaatgcgaggaatgcggcaaatctttctccagatccgcgcacctccaggcacatcagaaggtgcatactggcgaaaagccttataaatgcggcgagtgtggaaagggatttaaatggtccctcaacctggacatgcatcagcgcgtacacacaggggaaaagccctatacctgcggcgaatgcggaaagcacttcagccaggcttcctctttacaacttcatcagtcggtccacacaggggagaaaccatataagtgcgacgtgtgcggtaaagtatttagccgtagcagccagctgcagtatcacagaagagttcataccggggagaagccgtacaaatgcgagatttgcggaaagcgtttctcatggcgaagcaatctggtgtcgcaccacaagatccatgcagcggggacgttctatgaaaatgatgagaactctaagaacatccgcgagctgtctgaaggcggaagctctacccgatag

SEQ ID NO: 13945 - DNA, 2412 bp, Artificial Sequence
  Description of Artificial Sequence: Synthetic coding sequence
atgaatatgtttaaagaagcggtcacattcaaggatgtggcagtggcatttacggaagaagagcttggcctcctcgggcctgcccaacgtaaactctatagagacgtgatggtggaaaattttcgaaacctgctgtcagtgggacaccctccttttaagcaggatgttagcccgattgagagaaacgagcagctttggatcatgaccacagcaacacggaggcaaggtaatctcggtgagaagaaccagagcaagctgataactgtccaggatcgtgagagtgaagaggaactctcttgttggcagatttggcagcagatagccaatgacttgacacgctgccaagatagcatgatcaataacagtcagtgccataaacaaggtgacttcccttaccaggtggggacagaactgagtattcagatctccgaagatgagaactatattgtgaataaggctgacggccctaataatactgggaaccccgaattccctattctgaggacacaggactcttggcggaaaacattccttaccgagtcccaaaggttgaacagggaccagcagatctctattaaaaacaagctgtgccagtgcaagaaaggagtcgacccgatcggctggatttctcaccacgatgggcacagggtccataaaagcgaaaaaagttaccgcccaaatgactacgagaaagacaacatgaaaatcctgacgttcgaccataatagcatgattcacactggtcagaagagctaccagtgcaatgaatgcaaaaaacctttctccgatctctctagcttcgatttacatcagcagctccaaagcggggagaagtcacttacgtgtgtcgaaaggggcaaaggcttctgttacagcccagttcttcctgttcatcaaaaggtgcacgtgggtgaaaagctgaagtgcgacgagtgcggcaaagagttctcacagggggcccacctgcagacccatcagaaggtgcatgtcattgaaaaaccatacaagtgcaaacagtgtggcaaaggtttctcacgtcgctcagcgctgaacgtgcattgcaaggtgcacaccgccgaaaaaccatacaactgcgaggaatgcggaagggccttttcccaggctagccatctgcaagaccatcagcgactccataccggggaaaaaccctttaagtgtgatgcctgcgggaaatcgttcagccgaaattctcacctgcagagccaccagagggtccatacaggagagaagccgtacaaatgcgaggagtgcggcaagggcttcatctgctcttccaacctgtatatccaccagagggtgcatacaggggagaagccctacaagtgtgaggagtgtggcaaagggttcagccgcccaagctctctccaagctcaccagggcgtccatactggcgagaagtcatatatctgcacagtgtgtggtaagggattcaccttatctagcaatctgcaggcccatcagcgcgttcacacaggagaaaagccctataagtgtaatgagtgtgggaagtctttccggcgtaactctcactatcaggtgcacctggtcgtgcatacaggcgagaaaccctataaatgtgagatctgtggcaaaggtttcagtcagagcagctacttacaaatccaccagaaagcccactccatcgagaagcccttcaaatgtgaggaatgcgggcagggctttaatcaatcttccaggctacagatccatcagcttatacacaccggagagaaaccgtataaatgcgaggaatgcggtaagggattttcccggcgcgccgatttgaagattcattgtcggattcacaccggagaaaaaccctataattgtgaagaatgcggcaaagtgttccgacaggcatctaacctcttagctcatcaacgtgtccattccggagagaaacctttcaaatgtgaggagtgtgggaagtcttttggtcggtcagcccaccttcaagcacaccaaaaggttcatacgggtgacaagccctataagtgtgatgagtgcggcaagggctttaaatggagcctgaacctcgatatgcatcagcgggtgcatactggggaaaagccttacaagtgtggggaatgcggaaaatacttctcccaggcatcttcattgcagttgcaccagtcggttcatactggcgaaaagccgtacaagtgtgatgtgtgcggcaaggtcttctctcgcagctcccagctccagtcacaccaaagggttcacactggtgaaaaaccgtacaagtgcgaaatttgtggcaagagcttctcctggcggtccaacctaaccgtccaccatcgtattcacgtgggggataagagctacaagagcaacaggggaggcaagaacattagggaatctacacaagaaaagaaaagtattaaatag

SEQ ID NO: 13946 - DNA, 207 bp, Artificial Sequence
  Description of Artificial Sequence: Synthetic coding sequence
ctcaagtcaccaacttcctcggagctgcacgtcggagagaagcttaaatgtgacgaatgcggcaaggagttttctcagggcgcacatctgcagacccatcagaaagtccatgtgatcgaaaagccatacaaatgcaagcagtgcggaaaaggcttcagccgccgatctgctttgaacgttcactgcaaggttcatacagcggagtag

SEQ ID NO: 13947 - DNA, 207 bp, Artificial Sequence
  Description of Artificial Sequence: Synthetic coding sequence
catagcggcgaaaagagtcatacatgcgacgagtgtaaagcgtccgtgactagccaaccgtttatccaccagagagtacacatgggcgaaaagtgttacaaatgtgacgtatgtggcaaggagttcagtcagtcatcacatctgcagactcaccagcgggtgcataccgtggagaaacccttcaagtgtgtggaatgtggtaaatag

SEQ ID NO: 13948 - DNA, 2400 bp, Artificial Sequence
  Description of Artificial Sequence: Synthetic coding sequence
atgccaagccaaaattatgacctgcctcagaaaaagcaagaaaaaatgaccaagttccaggaagctgttacattcaaggacgtcgcagtcgtttttagccgcgaagagctcagactgctcgatttgacccagagaaaactgtacagagatgtaatggttgaaaacttcaagaatttagtggccgtagggcacctgcctttccagccagatatggtgtctcagctcgaagcggaggagaagctctggatgatggagactgaaacccagaggagcagtaaacaccaaaataagatggaaactctccaaaaattcgctttaaaatatctttctaaccaggagctgagctgctggcaaatctggaagcaagtggcttccgaactgactaggtgcttgcagggaaagagttcccaactgctgcaaggcgattcgatccaggtatctgaaaatgaaaataatattatgaacccaaagggcgatagcagcatctatatagaaaatcaggaattcccattctggcgcacacagcacagttgcggtaatacgtatctgtccgagagccagatccaatcgcgcgggaagcagatagacgtcaaaaataatctccagatccacgaggactttatgaagaagtctccatttcacgagcatataaaaacagacaccgaacctaaaccttgcaaagggaacgaatacgggaaaattatcagtgacggctccaatcaaaagctgccactaggggaaaagccgcacccctgcggagagtgcggtagaggtttctcgtatagtccgaggttgcctctacatccaaacgtgcacaccggcgagaaatgtttttcccagtcgtcccacctgaggactcatcagcgaatccatccaggagagaaactgaatcgctgccatgaatccggcgattgctttaacaagtcctcatttcacagttatcagagcaatcatactggagaaaagtcctataggtgtgatagttgtggcaagggttttagcagcagcactggcctgattatccactatagaacccacacaggagaaaagccgtacaagtgcgaagaatgcggaaagtgcttctcacaatctagcaactttcagtgccatcagcgcgtccacaccgaggagaagccctacaaatgcgaggagtgcggaaaggggtttggatggtccgtgaatctccgcgtgcatcagagagtgcacaggggagagaagccttacaagtgtgaggagtgtggcaagggattcacccaggccgcacattttcatatacaccagcgtgtgcatacgggagagaagccctacaagtgtgatgtttgtggtaagggcttctcccataattcgcctctcatctgccacagaagagtgcataccggagagaaaccatataagtgcgaagcgtgcgggaagggtttcaccagaaatactgacctacatattcatttccgggtccataccggtgaaaaaccgtacaaatgcaaggagtgcggcaaggggttcagccaagctagtaacctgcaggtccatcaaaatgttcatactggggaaaaacggttcaaatgcgagacctgcggcaagggcttctcacagtcttctaagctgcaaactcaccagcgagtgcatacaggcgaaaaaccttacagatgcgacgtgtgcgggaaagacttcagctacagctcaaatctgaagttgcatcaagtgattcacactggcgagaagccctataagtgcgaagagtgcgggaaaggctttagttggagaagtaacctccacgctcaccagagagtccactccggcgagaagccttataaatgtgaacagtgcgacaaatccttttcacaggctatagatttccgagtccaccaacgggtacatactggtgaaaagccctataaatgcggagtttgcgggaaaggcttcagccagtcatctggactccagagccaccagcgagttcacacaggagaaaagccttacaagtgcgacgtctgcggtaaaggatttcgttattcttctcaattcatctaccaccaaagaggacacaccggtgagaagccatacaaatgcgaagagtgcggaaagggcttcggaagaagcctcaatctgaggcaccatcagagggttcatacaggcgagaagccacatatctgtgaagaatgcggaaaggctttctccttgccttccaatcttcgagtacatttgggcgtgcatacacgggagaagctgtttaaatgcgaagagtgtggaaaagggttctcacagtcagccagactcgaggcccatcagcgtgtccacactggcgaaaagccttataaatgtgacatttgtgataaagactttaggcacagatcaaggctgacgtaccaccagaaggtgcatacaggcaaaaagctgtag

SEQ ID NO: 13949 - DNA, 2271 bp, Artificial Sequence
  Description of Artificial Sequence: Synthetic coding sequence
atgacgaagttccaagaagccgttacgttcaaggatgtggccgtggtcttctctcgcgaggaactccgtttattagatctgacacagcgtaagctataccgcgacgtgatggtggagaattttaagaacttggtcgctgtgggatctaaacaccagaacaaaatggagacattgcaaaagtttgcattaaaatatctgtccaatcaagagctgagttgttggcagatatggaagcaggtggccagcgagctgaccaggtgcttacagggtaagtccagccagttactgcaaggcgactccatccaagttagtgaaaatgaaaataacattatgaacccgaagggagattctagcatctacatcgaaaatcaagagtttcctttctggcggacccagcattcttgtggtaatacctacctgtcagaatcccagattcagagtcgggggaaacaaatcgacgttaaaaacaacttacagattcatgaagacttcatgaaaaagagcccatttcatgagcatatcaagactgacactgaaccaaagccttgcaaagggaatgaatatggtaaaatcatctcagacgggagcaaccaaaaattgcctctcggggagaagccacatccatgcggagagtgtgggaggggattctcttattcgccgagactccccttgcatcctaacgttcatactggagaaaagtgcttcagccagtcatcacatctgcgcactcaccagcggatccaccccggtgaaaagctgaaccggtgtcacgagtcaggtgactgctttaataaatcctcttttcacagctaccagagtaaccacaccggggaaaaaagttacaggtgtgactcatgcggaaaaggcttctcctcatctacgggcctcatcatccactatcggactcacactggcgagaaaccctacaaatgtgaagagtgtggaaagtgcttctctcagagctctaactttcagtgtcaccagcgcgttcacacagaagagaaaccatacaagtgtgaggaatgtgggaagggatttggttggtcagtgaacctgcgggtacatcaacgggtgcatagaggcgagaaaccttacaaatgtgaggagtgcgggaagggattcacccaagccgcccattttcacatccaccagcgagttcacactggggaaaagccatacaaatgtgacgtttgcggcaaagggtttagtcataacagtccactcatttgccacaggagggtgcacacaggcgagaagccttataagtgtgaggcctgtggaaagggcttcactagaaacaccgacctacacatccatttccgcgtgcatactggggagaaaccttacaaatgtaaggaatgtgggaagggattcagccaagcctctaatctacaggttcaccaaaatgtgcacaccggtgagaagaggtttaaatgtgagacgtgcggtaaggggttcagccagtcttccaagcttcaaacccatcagcgcgtccataccggcgaaaagccttaccgatgtgatgtgtgtggaaaggatttctcttattctagcaacctgaagctccatcaggttattcacaccggagaaaaaccctacaagtgcgaagagtgtgggaaaggatttagctggaggtctaaccttcacgcacaccagcgtgtgcatagtggcgaaaagccctacaagtgtgagcaatgcgataagtcattcagccaggcaattgattttagagtgcatcagcgggttcacaccggagagaagccctacaagtgcggagtctgtgggaaagggttcagccagtcttccggcctccaatctcatcaaagagtgcacacgggggagaaaccttacaagtgcgatgtttgcggcaagggatttcgctattcaagtcagtttatataccaccagaggggacacacaggagagaagccctacaaatgcgaagagtgtggcaaaggttttggacgtagcctgaatctgagacaccatcagagggtgcacaccggcgaaaaaccgcatatttgcgaggagtgcggaaaagcattcagccttccctccaatctgcgcgttcatcttggggtgcatactagggagaaactttttaagtgcgaggaatgtggtaagggattctcacagagcgcgcgcctggaggctcaccaaagggtgcacaccggcgagaaaccctacaagtgcgatatttgtgataaggatttccgccaccggtctcgcctcacgtaccaccagaaggtccacactggtaagaaactttag

SEQ ID NO: 13950 - DNA, 1317 bp, Artificial Sequence
  Description of Artificial Sequence: Synthetic coding sequence
cacgagtctggagactgcttcaacaagagttctttccattcctatcagtcaaaccatactggagaaaaatcatacaggtgcgactcatgcggtaagggattttcttccagcactggcttgataattcattatcgaacacacacaggtgaaaagccttacaagtgcgaagagtgtggcaagtgctttagccaatccagtaattttcagtgtcaccagagagtgcatacagaggaaaagccctacaagtgcgaagagtgcggaaagggatttggctggtccgtgaacctgcgcgtgcaccaacgtgtgcatcggggggaaaagccatacaagtgtgaggagtgtggcaagggatttacgcaggccgcacacttccatattcatcagagggtacacaccggggagaagccatataaatgtgacgtatgcggcaaggggttttctcataacagtcccctgatctgccatcgccgcgtccatactggagagaagccctacaaatgcgaggcatgtggaaaaggattcactcgaaataccgatctgcacatccatttcagagtgcatactggggaaaagccatataagtgcaaggaatgtggtaaggggtttagccaggccagcaacctgcaggttcaccagaatgtccacacgggtgagaagcggttcaagtgtgaaacctgcggaaaggggttcagtcaatcatctaagctccagactcgagagaaaccttacaagtgcgaacaatgtgacaagtccttttctcaagcaattgacttccgggtacaccagcgcgtacatactggggaaaaaccttacaagtgcggcgtttgcggaaagggcttttcgcagtcaagcggtcttcagtcacatcaacgggtacacactggcgagaagccttataaatgcgacgtgtgtggcaagggctttagatactccagccagtttatatatcaccaacgcggccacacaggcgagaagccatacaaatgcgaggaatgcggcaagggcttcggaagatcactgaatctacggcatcatcagcgggtgcatactggcgagaagccacatatctgcgaggagtgtgggaaggctttcagtctgccatccaatctaagggttcatctcggtgtgcatactagggaaaagttatttaagtgcgaggaatgcggtaaaggattctcccagtccgcccgcttagaggcgcatcagcgggtgcatacaggagagaagccctataagtgcgatatctgtgacaaagatttccgacacaggtcccggttaacctaccatcagaaggtgcacactggcaagaagttgtag

SEQ ID NO: 13951 - DNA, 2247 bp, Artificial Sequence
  Description of Artificial Sequence: Synthetic coding sequence
atggtggagaactttaaaaacctggtggccgtggggcacctcccattccaaccagacatggtttctcaactggaggccgaggagaagctgtggatgatggaaactgaaactcaacggtccagtaagcatcagaacaagatggagacccttcagaaattcgctctgaagtatttgtccaaccaggaactcagctgctggcaaatctggaaacaagttgcatccgagcttacaagatgtcttcaaggaaagtcttcccagcttctgcagggtgattcaatccaggtatccgaaaatgagaacaacatcatgaacccaaagggggactctagcatttacatcgaaaaccaggaatttcccttctggcggacgcagcacagttgcgggaacacttatctcagcgagtctcaaatccaatctagaggaaagcaaatcgacgtgaaaaacaacctgcaaatacatgaggactttatgaagaaaagcccttttcacgagcacattaaaaccgataccgaacccaagccatgcaagggaaacgaatacggtaaaattatatcagacggatccaatcagaaattgccactgggtgaaaagcctcacccctgcggagaatgtggccggggcttctcttacagccccaggttgccactgcaccccaatgtgcatacaggggagaagtgcttcagccaatcctctcaccttaggacgcatcaacgaatccatccaggcgaaaagctcaaccgatgtcacgaatcaggagactgttttaataagagttcatttcattcctatcagagtaaccacacaggtgagaagtcttataggtgtgactcttgcggtaaagggtttagttctagcactggtttgattattcactatcgcacccacacaggagagaagccttacaaatgcgaagagtgtgggaaatgcttctcccagagtagtaatttccagtgccatcagcgtgtgcacacagaggagaagccctacaaatgtgaggaatgtgggaaaggtttcggctggtctgtcaatttgagggtgcatcagcgggtacataggggcgagaagccatataaatgcgaagaatgtggtaaaggcttcactcaagcggcccacttccatatccatcagcgcgtccacacgggtgagaagccgtataagtgcgacgtttgcggtaaaggcttctcacataatagtcccctaatttgtcacagaagggtacataccggggagaagccatataaatgtgaggcttgcgggaagggctttactaggaacacagacctgcatattcactttagagtgcataccggagaaaagccctataagtgtaaagaatgcggcaaggggttttcccaggccagcaacttgcaggtgcatcaaaacgtgcataccggcgagaagcgttttaagtgcgagacatgtggaaaggggttttctcaatcctccaagcttcagacccaccagcgcgtacataccggagagaagccatacagatgtgatgtgtgtggcaaagacttctcttactcaagcaatctgaaactgcaccaggtgattcataccggtgagaagccatacaaatgtgaagaatgcggtaagggatttagctggaggagcaacctccatgcacaccagagagtacattcaggcgagaaaccctacaaatgtgagcagtgtgacaaaagcttttcacaggccatcgacttccgtgtacatcagcgagttcatactggtgagaagccttacaaatgcggcgtctgcggcaaaggattttcacaaagtagtggactgcagtctcaccaacgcgtgcacactggtgagaagccttacaagtgcgacgtatgtgggaaagggtttaggtactcatctcagttcatctatcaccagagaggtcacacgggcgagaagccttacaaatgcgaagaatgcggcaaggggttcgggcgtagcctcaatttgagacaccaccaaagagtgcatacaggagaaaagccacatatatgtgaggagtgcggtaaagccttcagtctgccctcgaacctgcgcgtacatctgggcgtccacacgcgagagaagctgttcaaatgtgaagagtgtggcaagggattttcccagtcggcccgactggaagctcatcagagggttcacactggggagaaaccctataagtgcgacatctgcgacaaggacttcagacacaggagtagactgacttaccaccagaaggtgcatacaggcaagaaactgtag

SEQ ID NO: 13952 - DNA, 2337 bp, Artificial Sequence
  Description of Artificial Sequence: Synthetic coding sequence
aaggtcacccagctgcaagaggccgtaacgtttaaagatgttgccgtggtcttttctagggaagagttacggttgctggatcttacccagcgcaagctgtatcgagatgttatggttgagaactttaaaaatttggtcgcggtcgatatggtgtcccagctggaagctgaagagaagctgtggatgatggaaaccgagacacagaggtcatccaaacatcagaacaagatggagacactccaaaagtttgcgctaaagtatctctcgaaccaggagctgtcctgctggcagatttggaagcaggtggcttcagagctcacgcgttgtcttcagggcaaatcctctcagctgctacaaggcgactccatccaggtcagtgagaacgagaataatatcatgaacccaaaaggagactccagtatatacattgagaaccaggagttcccattctggcggactcagcacagctgcggcaatacttacctgagtgaatctcagatccagagcagaggaaagcagatcgatgtcaagaacaaccttcagatccatgaagactttatgaaaaaatcccccttccacgagcatatcaagacggatacggagccgaagccatgtaaaggcaacgagtatggtaaaatcatatccgatgggtctaatcaaaaactacctcttggagagaagccccatccgtgtggggaatgcggtcgagggtttagctactctccccgccttcctctacaccctaacgtgcacacaggagagaaatgtttcagccagagctcccaccttcgcacccaccagagaatccaccctggagagaagctcaaccgatgtcatgagtctggagattgcttcaataagtccagcttccactcctaccagtccaaccatacaggcgaaaaatcatatcgctgcgatagctgtggcaaaggcttctcaagcagcactgggcttatcattcactacaggacccatactggtgagaagccttacaaatgtgaggaatgcgggaaatgttttagtcagtcatcaaacttccagtgccaccaaagagtccatacggaggagaagccatacaaatgtgaagagtgcggaaagggcttcggttggtctgtcaatctccgcgtgcatcagagggtccatcggggcgagaagccatataagtgcgaagagtgcgggaaaggattcacccaggcagcacattttcatatacaccagagggttcacacaggagagaagccttacaagtgcgatgtgtgtggcaagggattcagccacaacagccccctgatctgtcatagacgggtacataccggcgagaaaccatacaagtgtgaggcctgtgggaaagggtttaccagaaacactgacctccacattcattttagagtacacaccggtgagaaaccatataagtgtaaggagtgcggcaaaggcttctcccaggcgtctaatttgcaggttcaccagaatgtccacactggagaaaaacgtttcaaatgcgaaacatgtgggaaaggatttagtcagagttcaaagttacagacgcatcagagggtgcacaccggagagaagccatatagatgtgatgtctgtgggaaagactttagctatagctctaatttgaagcttcatcaggtcatccatactggcgagaaaccttacaaatgcgaggagtgtggaaaaggattttcgtggcgatcgaacctccacgctcaccagagagtgcattccggagagaaaccttacaaatgcgagcagtgcgacaaatccttcagtcaagcgatcgattttcgcgtccaccaaagagtgcataccggagagaagccatataagtgcggcgtttgtggaaagggattcagccagagcagcggcctccaatcacaccaacgggtacatacaggtgagaagccctataaatgcgatgtgtgcggaaagggtttcagatactcaagtcaattcatctaccaccaaaggggccacacaggcgaaaaaccgtacaagtgtgaggaatgcggaaagggattcggacgctcgctgaacttgcggcatcaccagagagtccatactggagaaaaaccccatatctgcgaagaatgtgggaaagcattttcactgccgtccaatctccgcgttcatcttggcgttcacacccgagagaaactgttcaaatgtgaagagtgtggcaaaggattctcacagtctgcacggctggaagctcaccagagagtgcacactggggaaaagccctacaagtgcgacatctgcgacaaggattttagacaccgttcaagactgacctatcaccagaaggtacatacgggtaagaaattatag

SEQ ID NO: 13953 - DNA, 2478 bp, Artificial Sequence
  Description of Artificial Sequence: Synthetic coding sequence
atggagaccctgacaagccgacatgagaagagggcactccatagccaggcctccgccatttctcaggaccgcgaagagaaaatcatgagccaggaacctctctctttcaaggatgttgccgtggttttcacagaggaggaactcgaactgttggattcaactcagcgacagctgtaccaggatgtgatgcaagaaaacttcagaaatttactttcggtgggagaacggaacccactgggggataaaaatggtaaggatactgagtacattcaagacgaggagctccgttttttttcccacaaggagctttcgagttgtaagatctgggaggaggtcgctggcgagctgcccggcagccaagactgtcgagtgaacttgcagggaaaggactttcagttctctgaggacgccgccccacaccagggctgggagggtgcctcaaccccttgttttcccatcgagaattccttggacagccttcagggcgatgggctaattgggctcgagaaccagcagtttcctgcttggagggcaatacggcccatccctatacagggatcctgggccaaggcattcgttaatcaactgggcgacgttcaggagcgctgtaagaatctggatactgaagacaccgtttataagtgcaactgggatgacgacagtttctgttggatctcatgccacgtcgaccaccgatttcctgaaatcgacaagccatgcggttgcaataagtgccgcaaagactgtattaagaattcggtgttgcacagaattaatccgggcgagaatggtctgaaaagcaacgaataccgaaacggttttcgcgacgacgcagatttgccacctcaccctagagtgccacttaaagagaagctctgtcagtacgacgaattctcagagggcctgcggcactccgcacacctgaaccgccaccaacgggtccccactggtgagaaaagcgttaagtccctcgaaagagggcgaggcgtacggcagaacacgcacattaggaaccacccccgggcaccggttggagacatgccatatcgctgcgacgtgtgcgggaagggattccgttataagagcgttttgcttattcaccagggtgtgcacaccggccgtcgcccttataaatgtgaagaatgtggcaaagctttcggacgtagtagcaatctgcttgtgcaccagcgtgtgcacaccggcgaaaagccttacaagtgttcagagtgcggcaaaggcttctcctattcttcagtacttcaggttcaccaacgactccacactggagaaaaaccatatacctgctctgagtgcggcaagggcttttgcgcaaagagcgcgctccacaagcaccagcatattcaccctggagaaaagccttattcgtgcggagaatgcggcaagggattttcatgctcatcccacctgagctctcatcaaaagacgcacacaggggaacggccctatcagtgtgacaagtgcgggaaaggtttcagccacaattcatacctccaggcccatcagcgcgttcacatgggccagcatctctacaaatgtaatgtgtgcggaaagtctttttcctattcaagcggtctcctaatgcatcaacgcctgcacactggcgagaaaccatataaatgtgagtgcggcaaaagctttggaaggtcttctgaccttcacatacaccagcgagtgcatacgggtgaaaaaccatataaatgttccgaatgtggtaagggcttccgtcgcaacagcgatttacacagccaccaaagggtacacacaggtgaacggccttatgtctgcgatgtatgtgggaagggcttcatttattccagcgatctactgatccatcagagggtccacaccggcgaaaagccttataaatgtgccgagtgcggcaaaggcttttcttatagcagcggcctccttatccaccagcgtgttcacaccggggaaaagccctataggtgccaggaatgcggcaaagggttcaggtgcacaagtagcctacataagcatcaacgggtgcatacgggcaaaaaaccatacacctgcgaccaatgcggcaaggggtttagctacgggagcaatctccgcacacaccagcgattgcacaccggagaaaaaccatacacatgttgcgaatgcggcaaggggtttaggtatggcagcggattattatctcacaagcgcgtgcacacaggggaaaagccgtacaggtgccatgtgtgcgggaagggatactctcaaagctcccacctacaggggcatcagagagtgcacacaggagagaaaccatacaaatgcgaggagtgtggcaagggatttggtaggaacagctgtctgcatgtacatcagagggtccacactggcgaaaaaccctatacttgcggagtgtgtggaaaagggttctcgtacacctcgggactccgcaatcaccagcgggtgcacttaggcgagaatccttataagtag

SEQ ID NO: 13954 - DNA, 2478 bp, Artificial Sequence
  Description of Artificial Sequence: Synthetic coding sequence
atggagacgctaacctcccgccatgagaagagggcccttcactctcaggcaagcgctatatcgcaagatcgggaggagaaaatcatgtcgcaggaaccattgtctttcaaggacgtagctgtggtctttacagaagaagagctcgagttgctggatagcacgcagaggcagctctaccaggacgtaatgcaggaaaacttccggaaccttttatccgtcggcgaacgcaaccccttgggcgataagaatggcaaggacacagaatacattcaggatgaagaactgaggttcttcagccataaggagctcagtagctgcaagatatgggaagaagtcgcaggcgaacttcctggctcgcaggattgtcgcgtcaacctgcagggcaaagattttcagttctcggaggacgctgctccgcaccaggggtgggagggagcctcaacgccgtgtttcccgattgagaactccctcgactccctgcagggggacggtctgattggtctcgaaaaccagcagttcccagcatggcgggccatcaggcctattcccattcagggctcctgggccaaggcttttgtaaaccaattaggcgacgtacaggagcgatgcaaaaacctggatacagaagacaccgtgtacaaatgtaattgggatgacgattcattctgctggatttcctgtcatgttgatcaccgcttccctgaaattgataagccttgtggctgcaacaaatgcagaaaggactgcatcaagaattcagtgctgcatcgcattaatcccggagaaaacggcctcaaatccaatgaatatcggaatggatttcgcgacgacgctgaccttccccctcaccctagagttcctctgaaggagaaactgtgtcagtatgacgagttctctgagggcctcagacactctgctcatctcaaccgccatcagagggtaccgactggcgagaaatccgtcaagagtctggaaagaggtcgaggggttaggcaaaacacccatatacggaatcatccacgtgcacctgtgggcgatatgccttatcgctgcgacgtgtgcgggaaggggtttcgctacaagagcgtcctcttgatccaccagggtgtgcacactggtcggcgaccttacaaatgcgaggagtgtggaaaggcctttggccgttcttcaaacctcctcgtgcatcaacgagtgcacacaggcgagaagccatataagtgcagtgagtgtggcaaaggcttctcttattccagtgtcctccaggtgcaccagcgcctgcacacaggcgaaaagccgtacacatgctcggagtgcgggaaaggcttctgtgctaagtccgccctgcataaacaccagcacatacacccaggcgaaaagccctactcgtgcggagaatgcgggaagggcttctcttgctcttctcacctgtcctcccaccagaagacccacaccggcgaacgcccttatcagtgtgataaatgcggaaaggggttttctcataattcctaccttcaagcacaccagagagtgcacatggggcaacacctgtacaagtgcaatgtctgcggaaaatccttttcttacagttccggactcctcatgcatcagcgactccacaccggggaaaaaccctataagtgcgaatgtggaaagtcttttgggcgatcttccgatcttcacatccaccagagagtgcatactggcgagaagccttacaagtgcagtgaatgtggcaagggcttcagacgaaactctgacctccattcccaccagcgggtgcatacgggcgagagaccatacgtgtgcgacgtgtgtgggaagggctttatttactcctctgacctcctgatccaccagcgggtccacaccggggaaaagccatataagtgtgccgagtgcggaaaaggcttctcatacagttccggtttgctgatccaccaaagggtccacacaggagaaaagccctatagatgccaggaatgcggcaaagggttcaggtgtacctcctccctgcataagcaccagcgggtacacactggtaagaagccctacacctgcgaccaatgtggcaaggggttctcttacgggtcgaatctgcgaacccatcagcgattacacaccggcgaaaagccttatacatgctgcgaatgtggaaaagggttccggtacgggagcggcctgctgagccacaaaagagtgcataccggtgaaaaaccttataggtgtcacgtctgtggcaaaggatacagccagtcttcccacctccagggccaccagagagtgcatacgggagagaagccatacaagtgtgaagagtgcggaaaaggattcggacgtaattcttgcttacacgtacatcagcgggtacatacgggcgagaagccttacacctgtggcgtgtgtggtaagggcttcagttacaccagcgggctccggaatcaccagagagtgcatttaggcgaaaatccatacaaatag

SEQ ID NO: 13955 - DNA, 1425 bp, Artificial Sequence
  Description of Artificial Sequence: Synthetic coding sequence
atgaccacattcaaggaggcggtcactttcaaggacgtggccgtcttctttactgaggaagaattgggcctgctagaccccgcacagaggaagctgtatcaggatgttatgctggagaacttcaccaatctcctcagtgttggacatcagccatttcacccatttcatttcctgcgtgaggaaaaattttggatgatggagactgccactcagcgggaaggcaactcaggcggtaagacaattgcagaagctggcccacatgaagactgcccttgtcagcagatttgggagcagactgctagcgatctgacccagagccaggatagcataataaacaactcccactttttcgagcagggagacgtacccagccaagtggaggcgggtctaagcatcattcatacaggccagaaacccagccagaacggcaaatgtaagcagagctttagcgacgtggcaatctttgatccaccacagcagttccactcgggtgaaaagtcccacacctgtaatgagtgcggcaagtctttttgctatatctcagcattgcgcatccaccagagagtgcaccttagagaaaaactgtccaaatgtgacatgcgtggcaaagagttctcccagtccagttgtcttcagacccgagaaagagtccacactggtgaaaagcctttcaaatgcgaacagtgcggtaagggctttcgctgtcgggccattctccaggtccattgtaaattgcacacgggtgagaagccatacatatgtgagaaatgcggacgtgcattcatccatgatttccagctgcaaaaacatcagatcatacacacaggggaaaagccgttcaaatgtgaaatttgcggaaagtcattctgtctgcggtcctcactgaataggcactgtatggtacacacagccgagaagctatacaagagtgaagagtgcggcaagggattcaccgatagcctggacctgcacaagcatcagatcatacatacaggtcagaagccctacaactgcaaagagtgcgggaagtcgttccgctggagttcatatctcctcattcaccaaagaattcattctggggagaaaccctatcggtgtgaggagtgcggcaagggctacatctcaaaaagtggcctgaatttacaccagagagtgcacacaggtgaacgcccctacaactgcaaggagtgtggaaagagttttagccgcgcctcatccatattaaaccacaagaaattacactgccggaagaaaccattcaaatgtgaggattgtggtaagagactggtgcacagaagtttttgtaaagaccagcagggagaccataacggagagaacagctctaagtgtgaggactgtggtaagaggtacaagaggaggctcaatttggacatcattctgagcttgttcctaaatgacatgtag

SEQ ID NO: 13956 - DNA, 1335 bp, Artificial Sequence
  Description of Artificial Sequence: Synthetic coding sequence
atggagccgcccggaccagtgagaggcccactgcaggactccagttggtacgagccctcagcggagctcgtgcagactcgtatggcggtgagtctgacagctgcggagactctcgcactgcagggtacgcagggccaagaaaaaatgatgatgatgggccccaaagaggaggaacagtcttgcgaatacgaaacgaggctgcccgggaaccacagtacatcacaggaaatttttagacagagatttcgccacctgagatatcaggagacccctggaccaagagaagccttatcccagctccgcgtcttgtgctgtgagtggctccgtcctgaaaaacatacaaaagaacagatcctggagttcctggtcctggagcagtttcttaccatcctcccagaggagctgcagtcctgggttcgaggtcaccaccctaagtccggagaagaagctgtgaccgtgctggaggatctggagaaggggcttgaacctgaacctcaagtacctggcccagcccatggacccgcccaagaggagccctgggagaagaaggagagcctgggggccgctcaagaggcgttatccatccagttgcagcctaaggaaacccagcccttcccgaagagcgagcaggtttatctgcattttctgtctgtagtcacagaagatggccccgagccaaaagataaaggaagtcttccacaacctcctattacagaggtagaatcccaggtcttttcagaaaagctggctaccgatacctcaacgttcgaagccacgtcggaaggaactctcgagctccagcagaggaatccaaaggccgagcgccttcggtggagccctgcccaggaggagtcctttaggcagatggtggtcatacacaaagaaattcctacaggaaagaaggaccatgaatgctccgaatgtggtaagaccttcatctacaacagccaccttgttgttcaccagagagtccatagcggcgagaagccgtataagtgctcggattgtggaaagactttcaaacaaagctccaacctggggcagcatcaaaggattcacaccggcgaaaaacccttcgaatgtaacgagtgcgggaaagcatttagatggggcgcacacctggtgcaacaccagagaatccactctggtgagaagccctatgaatgtaacgagtgcggaaaggcgttcagccagtccagctatctctcacagcatcgccggatacattctggggaaaagccattcatttgcaaagaatgtggaaaggcatacggttggtgttccgagctaatacgtcatcgacgtgtgcatgctcggaaagaacccagtcactag

SEQ ID NO: 13957 - DNA, 579 bp, Artificial Sequence
  Description of Artificial Sequence: Synthetic coding sequence
atggcagttagcctgacagcagccgagaccctggctctacaaggtacgcagggccaagagaaaatgatgatgatggggccgaaagaagaagaacagtcctgtgagtacgaaaccaggctgcctggcaatcactctacgagtcaggaaatctttcggcagcggtttcggcacttgaggtaccaggagacccccggaccccgagaggccctgagccagctcagggtcctgtgctgtgagtggctgcggcctgaaaaacacactaaagaacagatcttggaatttctagtcttggagcagtttctgacaattttaccggaggaactgcagagctgggtgcggggccaccaccccaagagcggtgaagaggccgtcaccgtgctcgaggacttagagaaaggactcgagccagaaccgcaagtggggagaggaatatggtccgtaatgggcgctaggctgatgacatttcggcttgacaggggagccgccgtgggggggggcgctaaattcaaaccactacttggacaggtggagcagctggtgtgtgtatcagtgtcagtgttcagcgccttggaaccctag

SEQ ID NO: 13958 - DNA, 1704 bp, Artificial Sequence
  Description of Artificial Sequence: Synthetic coding sequence
ggtcacaagaaccaaaacgaaatagatactttgcaggaagtcagattgcgctttttatcctacgaagatctgatctgctggcagatttgggagcaatttacatctaaactaactagcaaccaagatctgatcatcaacttgcaagggaagagaagtaagctgttgaagcaaggcgattctccctgccaggtctggactggggaatcctcccaggtatcagaagatgagaactatgtaataaaactccagggcgagagcagcaactccattaagaatcaagagttacccctgcgaacaacctgggacttttggaggaagatgtacttgcgggagccgcagaattatcagtcaagatgtcaacaaatcgacgtgaagaacaagttgtgcaaatgcgaccactgcgtgagacagcgcattgcccaccagcatgacgaccatggtgtccataagcgagagaaagccttctctcacaacaactgcgggaaggactgtgtgaaagagtcctcccagcatagtatcatccagtcaggcgaacagacaagcgacgagaacgggaaaggactttcagtaggttccaatctggagctgcaccaacaacttcacctgagagacaaaccgcacgtcaacgtcgagtatgggaaaggcattggttacagctctggccttccaagacatcagtgttttcacatcggcgagaagtgctatcggaacggtgattccggagagggcttctcacaggggagccatttgcagccccaccagcgggtctccacaggcgagaatttatatagatgtcaggtatatgctagaagctccaaccaaaactcctgcctgccatcacatgaactgactcatcccggggaaaaactgtgtacgtgtgggcgctgcggaaaggggtttcaccactccctggacttcgacatccattgtgtggatagcgcaggagaaagggcttgcaagtgtgacgtctacgacaagggcttcagccaaacatcacaactgcaggcacatcagagagtccacactggcgagaaaccatataagtgtgaagtgtgtgataaaggatttagcaaagcctccaatctgcaggcacatcagcggattcacaccggagagaagccttataagtgtgacgtttgtgacaagaattttagccgaaatagccacttgcaggcacaccagagagtacacacgggagagaagccatataagtgtgatacttgtggcaaggatttcagccagatttctcatttgcaggctcatcagcgagtgcataagggggaaaagccttacaagtgtgagacgtgtggcaagggctttagccaatcctcccacttgcaggaccaccagcaggtgcacaccggggagaatccctacaagtgtgacgtctgcggtaaaggcttctcttggtcttcccatctccaggcccatcagcgagtgcacactggcgagaaaccttataagtgcgaggaatgccgtaaaggattcatttggaacagttacctgcatgtgcaccagcggatccatacaggcgaaaagccttataaatgcggcatgtgcggcaagagtttcagtcagacttcgcacctacaagcacatcagcgcgtacacacaggagaaaagccctacaagtgctttgtctgcgggaagggttttagtaaatccagcctgcagatccatcagcgcgtgcacgatggtgactag

SEQ ID NO: 13959 - DNA, 1959 bp, Artificial Sequence
  Description of Artificial Sequence: Synthetic coding sequence
atggtaaagcgctctatgcagcaggaggagttaaccatactgaacatatacgccccaaatactggtgccccgcgctttattcgggctgtcgcatgttttagatcaggcatcttgggctctgtggttcagaaacccctccagccatgtgtgttacctctgcaggagggagaagcggcagttatttacccactttgggaagtgtcccagcgagggacatccgcctcaacagcatccttccccggcttaggcgtaggactagccgtgctaccatcccaggatcctgcgttgcctcagaaagaacaggaaaagatgaccaagttccagctgctggcaatcaggctccggctgcaccttctggacgtggtgggcgacggcgacatccaaggttgtggatgtggtctccaccagggtggagcaggcgttgcaggaccttgccctgaaaaggcagtgccaaggtgcgacgcaggcgagctgcaggagccggctgtgtctggactcagcacactccaaaccagatgtgatatcactgtaggtaagcgtcgccaggccagcgacgatggcgaccggaacccacggcgttgggtgtttaggcaacgaattgcgcatcaacatgatgaccacggggttcataagcgcgagaaagccttcagccacaacaactgcggaaaggactgcgtgaaggaatccagtcagcactccattatccagagtggggaacagactagcgacgagaatggtaaagggttgagcgtgggatcaaatctggaactacatcagcagctacatctccgtgacaagccccacgtaaatgtggagtacggcaaagggataggctattcaagtgggttaccaaggcatcaatgctttcacatcggcgaaaagtgctaccggaatggcgatagcggcgaaggattctcacagggaagccacctccagccacaccaacgcgtgagtaccggggaaaacctgtacagatgtcaggtatacgcacgatctagtaatcagaactcttgcttgccatcccatgagctgacgcaccccggggaaaagctctgtacttgtggcaggtgtggcaagggctttcaccattcacttgattttgatatccattgcgtcgattcagccggagaacgagcctgcaagtgtgatgtttacgacaaagggttttcacagacttcccagctgcaggctcaccagagaggccactcccgcgacaaaacctacaagtgggaggtttccgatcgcattttcaatagaaactccggcctgcatcaaagagtccataccggcgagaagccatataagtgcgaggtgtgtgacaaaggattcagcaaagcctctaacctccaggctcaccagcggattcatacaggggaaaaaccatataaatgcgacgtttgtgataaaaacttttctcgaaatagccacctacaggctcaccagagggtgcatacaggtgagaagccttacaagtgtgatacttgtggcaaggacttctcccaaatcagccatctccaggcccaccaacgagtccataaaggcgaaaaaccatacaaatgtgagacatgcgggaagggtttcagccagagtagtcatctccaagatcatcagcaggtgcataccggagagaatccatataaatgcgatgtctgcggtaagggtttcagctggtccagtcatctacaggctcaccagcgcgtgcacactggtgaaaaaccatataagtgcgaggagtgtaggaaagggtttatttggaattcatatctgcatgtgcaccagagaattcatacgggagaaaaaccctataagtgcgggatgtgcgggaagagtttcagccagactagtcacctccaggcccaccagcgcgtgcacaccggggagaagccatataaatgttttgtctgcggaaaaggctttagtaagtcaagtctctctagcgactccagtgaatccccttag

SEQ ID NO: 13960 - DNA, 2013 bp, Artificial Sequence
  Description of Artificial Sequence: Synthetic coding sequence
atgaccaagtttcaggaaatggtgaccttcaaggacgttgctgttgtcttcacaagagaggaactcgggctgttagatctcgcccagaggaagctgtatcaagatgtgatgctggaaaactttcgaaatttactgagcgtgggctatcagcctttcaagctggacgtaatactgcagctggggaaagaagataaacttcgcatgatggagaccgagatacaaggcgacggttgttccggtcacaagaaccagaatgagatcgacaccctccaggaggtccgattgaggttcttgtcctacgaggatctgatctgctggcagatctgggaacaattcacaagcaaactgacatcaaatcaggatttaattatcaatctccagggcaagaggtcaaagctgctgaagcagggagatagcccctgccaagtttggaccggggagagttctcaggtatctgaagatgaaaactacgtgatcaaacttcagggggagagtagtaattccattaaaaatcaggaattgcccttgcgaaccacgtgggacttttggcgaaagatgtacctacgggaaccacagaattatcagtccagatgccagcagatcgacgtgaagaacaagttatgtaagtgtgatcactgcgttcggcagagaatcgctcaccaacatgatgaccacggagtccataagcgtgagaaggccttctcacataacaattgtgggaaagactgtgtcaaagaaagctcccaacattccatcatacagtcaggagagcagacatcagacgagaatggaaaaggcttatccgttgggtctaacctggaactgcaccaacagctgcacttgcgcgacaagcctcacgtgaatgtcgagtacgggaaggggataggctacagttcaggcctgccaaggcaccaatgtttccacatcggagaaaaatgttaccggaatggcgacagtggcgagggctttagccaaggatctcacctccagcctcaccaaagggtgagcaccggggaaaacctgtacaggtgtcaagtctatgctcgttcatctaaccagaatagttgcctccccagccatgagctgacgcacccgggggagaagctgtgcacgtgtggccgttgcggaaagggctttcatcactccctggactttgatatccattgcgtggactccgccggtgaaagggcttgtaagtgcgacgtatacgataaagggttttctcagactagtcagctgcaggcgcatcagagaggccacagtagagataagacgtataagtgggaagtgagcgatcgtatattcaatcgcaattcagggttacaccaacgggtccatactggtgaaaaaccatacaagtgcgaagtgtgtgacaaaggattcagtaaggccagcaacctgcaggcccatcagaggattcacaccggcgaaaaaccgtacaaatgtgacgtctgtgataaaaattttagcaggaacagtcatctgcaagctcaccaacgggtacacaccggagagaagccttataagtgcgacacatgtggaaaggattttagtcaaatcagccacctgcaggcccaccagcgagtgcataagggtgaaaagccttataagtgcgagacgtgcggcaagggcttcagtcagagtagccatttacaggatcaccagcaagtgcacactggtgaaaacccttacaaatgtgacgtctgcgggaagggtttcagctggtcttcgcatctgcaggcacaccagcgagtgcatactggcgaaaagccctacaagtgcgaagagtgccgtaaaggcttcatttggaattcttatctgcacgtgcaccaacggatccataccggagagaaaccttataaatgcgggatgtgcgggaagagtttttcgcaaacttcacacctccaggcacaccagagggttcacaccggcgagaagccctacaagtgctttgtatgcggaaagggcttcagcaagagcagtctgtcttctgactcctcagaatctccgtag

SEQ ID NO: 13961 - DNA, 321 bp, Artificial Sequence
  Description of Artificial Sequence: Synthetic coding sequence
ggacacaagaaccaaaatgagatagacacactgcaggaggttaggctgaggttcctctcctacgaagacttgatatgttggcagatttgggagcaattcacatccaaacttacaagtaaccaagatctgatcatcaacttgcagggaaagaggtcaaaactgctgaagcaaggggacagcccatgtcaagtgtggacgggggaaagctctcaggtgagtgaagacgagaattatgtcatcaagctgcaaggggagtccagcaactctattaagaaccaggagctgccaagccagaagaagaagaaaaagaagaagaagtag

SEQ ID NO: 13962 - DNA, 2217 bp, Artificial Sequence
  Description of Artificial Sequence: Synthetic coding sequence
atgaccaagtttcaggaagctgtgactttcaaggacgtcgccgtagcttttactgaggaggagttaggcctactcgactcggctcagaggaagctctaccgcgacgtcatgctcgagaacttcagaaacctggtgtctgtggggcaccagagtttcaaacccgacatgatctcccagttggaacgggaggagaaactgtggatgaaagaactgcagacgcaacgaggcaaacactctggtgatcgaaaccagaacgagatggcaaccttgcacaaggcaggtctgcgctgtttctcactgggtgagttatcgtgctggcagatcaagcgtcatattgcgagtaaactggcccggtcccaagattcaatgatcaacattgagggaaaatcctcccagttccctaagcatcatgactcaccgtgtcaggttggcgcaggcgaatcgatccaggcttctgttgacgacaactgtctcgttaatcatattggagaccattcaagtatcatcgaaaatcaggaatttcccacggggaaggtgccaaactcctggagcaagatctaccttaacgagacgcagaattaccagcgctcttgtaagcagacccagatgaaaaataagctttgcatattcgccccctacgtggatatcttcagttgcatatcccaccaccatgatgataacatcgttcataaaagggataaagttcactcaaactccgactgtggaaaagatacactgaaagtgtccccgctgacacaacgttcaattcacactggtcaaaagacctaccaagggaatgagtgcgaggaagcattcaatgattccagcagcttagaactgcacaaacaagtccatctcggcaagaagagtccagcttgttctacacacgaaaaagacacatcttacagttcaggaatcccagtccagcagagcgtgcgcacagggaagaaacgttattggtgccacgagtgtggtaaggggttcagccagtcttcgaacctccagactcaccaacgggttcacacaggggaaaagccttatacctgccacgaatgcgggaaaagcttcaatcagtctagccatctctacgcccatctgcctattcacacgggtgagaaaccttaccgctgcgattcgtgcggaaaagggtttagtcgaagcacagacctgaacatccactgtcgcgtgcatacaggtgagaagccctacaagtgtgaggtgtgcggcaagggattcacccagcgcagccacttacaggcgcacgaacgtatccacacaggcgagaaaccctataagtgtggagattgtggaaagagattctcatgcagctccaacctgcacacacaccagagggtccataccgaagaaaaaccctataagtgcgacgagtgtggtaaatgtttcagcctcagcttcaacctgcattctcaccagcgagtacacactggagagaagccctataaatgtgaggaatgcgggaaagggttttcttccgccagctccttccagagtcaccagcgggtgcatacaggggagaagccctttcgttgcaatgtgtgcggcaagggcttttcccagtctagctacttccaagcccaccagagagtgcacacaggagaaaagccatacaagtgcgaggtctgcggcaagcgcttcaattggagcctaaaccttcataaccatcaaagggtgcataccggcgagaaaccttacaagtgtgaggaatgcggcaagggattctcccaggcatctaatctgcaggctcatcagagtgttcacactggggaaaagcccttcaagtgcgatgcttgccagaaacgcttctcacaggctagtcaccttcaggcccatcagagggtgcacaccggagagaagccctacaagtgtgatacatgcgggaaagcttttagccagcgcagcaacctgcaggtgcatcaaatcatacacacaggcgaaaaacccttcaagtgtgaggaatgcggcaaggagttctcgtggtctgccgggttgtcggctcatcagcgagtacacactggtgaaaagccctacacgtgccagcagtgtggcaaaggattttcccaggcaagccactttcatacccaccaaagggtgcatacaggggaaaggccatacatttgtgatgtgtgctgcaagggctttagccagcggagccacctgatttatcaccaacgcgtccatacaggtggaaatctatag

SEQ ID NO: 13963 - DNA, 1767 bp, Artificial Sequence
  Description of Artificial Sequence: Synthetic coding sequence
tctggcgaccgcaatcaaaacgagatggctacattgcacaaagccggtctgagatgcttctctctgggggagctgagttgttggcaaatcaaaaggcacatcgctagtaagctagcccgcagccaggacagtatgattaacatcgaaggcaaatcctcgcagtttccaaaacaccacgactcaccttgtcaggtcggcgcaggggagagcattcaggcttccgtcgatgataattgccttgtcaatcacatcggggatcacagttctatcatcgagaaccaggaatttcctaccggaaaggtccctaattcttggagtaaaatatatttgaacgaaacccagaactatcaacggtcatgtaaacaaacgcagatgaagaacaaactgtgcattttcgcaccttacgtcgacatttttagttgcatttcccatcaccacgacgataacattgtccataaacgcgataaagtgcactccaactctgactgtggaaaagataccttaaaggtcagtcctctgacccagcgctccatccacacaggccaaaaaacttatcagggcaatgaatgtgaggaagcattcaacgattcttccagcctggagctacacaagcaggtccacctgggcaaaaaaagccccgcctgcagtactcacgaaaaagacacgagctactccagcggaattcccgtccagcagagtgttcgaacggggaaaaagcgatactggtgccacgaatgtggcaaagggttctctcagtcttcaaacttgcaaacacaccaaagagtgcatacaggtgagaagccttatacatgtcatgaatgcgggaagtcatttaatcagtccagtcatttgtatgctcacctgcccattcacactggagagaaaccatatcggtgcgattcgtgcggcaaaggattctctcgttctaccgacctgaatatccactgcagggttcacacaggggagaaaccctacaaatgcgaagtctgtggcaagggattcacacaacggagtcatcttcaggcccacgaacgaatacacactggcgagaaaccttataaaagccagatcttcattcccataagggatttcaaccttcactcacaccagcgagtgcatacaggggagaagccctataaatgcgaagagtgcggtaagggatttagctccgcaagttcattccagtctcaccagagagtccacacgggggagaagccttttaggtgcaacgtgtgcggcaagggatttagccaaagcagttatttccaggcacaccaacgcgtacacactggagaaaagccctataagtgcgaagtctgcggcaagcgattcaactggtctctcaatttgcataatcatcagagagtccacaccggagagaaaccttacaagtgcgaagagtgtggcaagggattcagccaggcctcaaatttgcaagcacatcagagcgttcatacgggggaaaagcccttcaaatgtgacgcgtgccagaaacgtttctcacaagcctctcatttacaagcccaccaacgggtccacactggagagaagccgtacaagtgtgacacatgcggcaaggccttctctcagcggtccaacctgcaggtgcaccagataatccacaccggggagaagcctttcaaatgtgaagagtgtggaaaggagttctcttggagcgccggcctgtcagctcaccaaagagtgcatacaggagagaagccttatacttgccagcagtgcgggaagggattcagtcaggcttcctag

SEQ ID NO: 13964 - DNA, 2217 bp, Artificial Sequence
  Description of Artificial Sequence: Synthetic coding sequence
atgggcaggatccaggaggctgtgaccttcaaagatgtagctgtcgcattcacggaggaggaactggggctgctggattccgcccagcggaaactgtaccgggatgttatgcttgagaactttcgcaatctcgtaagtgtcggtcaccaatcctttaaacctgatatgatcagccagctcgagcgggaggaaaaactctggatgaaggagctgcagacgcagagaggcaaacattcaggcgataggaatcagaacgagatggccacacttcataaggccggcctgaggtgctttagcctcggagaactttcctgctggcagataaagcggcacatcgcctcaaaactggctcggtcacaggacagcatgatcaatatcgaggggaaatcttcacagttcccaaagcaccacgacagtccatgccaggtgggcgcgggcgaaagcatccaggctagtgtggacgacaattgtctggtcaatcacatcggtgaccatagtagcatcatcgagaaccaggagttccccacagggaaggtgccgaatagctggagtaagatctacctgaacgagacccaaaattatcagaggagttgtaaacaaactcaaatgaaaaataagttatgtatcttcgccccatacgtggatatcttctcttgtatttctcaccaccacgacgacaacatcgtgcataagcgagataaggtacattcgaatagcgactgtgggaaggataccttaaaggtctcccccctaacacagaggtccatccatacgggacagaagacctaccagggcaacgaatgcgaagaggcctttaatgattcgtcctctctggagcttcacaagcaggtgcatctcgggaagaagtcccctgcatgctctacacacgagaaagacacctcttatagcagtggcatcccagtacagcagagcgtacgtaccggaaagaagcggtattggtgccacgaatgcggtaaagggttcagccagtctagcaatttgcagacacaccagcgcgtgcataccggggaaaaaccttatacctgtcatgagtgtggtaagtcttttaaccagtcttcacacctctacgcacacttacccattcatactggcgaaaagccttaccggtgtgacagctgcgggaagggattttcacggagtaccgatctcaacattcactgccgagtgcacactggcgaaaagccttataaatgtgaggtctgtggcaaaggcttcactcagaggtctcacttgcaggctcacgaacggatccacacaggcgagaagccatacaaatgtggcgactgcggcaagcggttcagttgtagttcaaatctgcacactcaccaaagagtacacactgaggagaagccatataagtgtgatgaatgcggcaagtgtttttcgctgtccttcaacttacacagccaccagcgggtgcataccggcgaaaaaccctataagtgcgaggagtgcggaaaaggcttttcaagtgcgtcaagctttcagagccaccagagggtccacacaggagaaaagccgtttaggtgtaatgtctgtgggaaaggattcagccagagctcatactttcaggcccaccagcgtgtgcacactggcgagaaaccttacaaatgcgaggtgtgtggcaaaagatttaactggagtctcaatttgcataaccatcaaagggttcacacaggggagaagccgtacaaatgcgaagaatgcggcaaaggattttctcaggctagtaatctccaggcacaccagtcagtccatacgggtgagaagccttttaaatgtgacgcctgtcagaagcgcttctctcaagcctctcacctacaggcacatcagagggtgcacacaggcgagaaaccctacaaatgtgatacatgcggcaaagcatttagccagagatccaacctgcaggtgcatcagattatccataccggagagaaaccatttaagtgtgaagaatgcgggaaagagttttcctggtctgcaggtctgtcggctcaccaaagagtgcacaccggcgaaaaaccatatacttgtcagcagtgtgggaagggttttagtcaggctagccacttccacactcatcagcgagtccacacaggagaacggccctacatttgtgatgtttgctgcaaaggttttagtcaaagaagccatctgatttaccaccaacgcgtccacaccggagggaatctctag

SEQ ID NO: 13965 - DNA, 546 bp, Artificial Sequence
  Description of Artificial Sequence: Synthetic coding sequence
atgggcaggattcaggaggcagtgactttcaaggacgtagccgtggccttcacggaggaagagttgggacttctcgacagtgcccagagaaagctgtacagggatgtgatgctggaaaactttcgaaatctggtgtctgttggacaccagagctttaaaccggacatgattagccaacttgagcgggaggaaaagctgtggatgaaagagctccagacccagcggggcgatagaaaccagaatgaaatggctaccctgcataaagcaggcctgcggtgtttctccctgggggagctatcctgctggcagatcaagaggcacattgcatctaaactcgcccgctcgcaggatagtatgatcaatatcgagggaaaatctagccagtttcccaagcaccacgactctccttgtcaagtgggtgctggggaaagcatccaagcgtccgtggacgataattgcctcgtcaatcacataggcgaccactctagtattattgagaatcaagagttcccaacagggaagaagaagaagaaaaaaaaacagtag

SEQ ID NO: 13966 - DNA, 1740 bp, Artificial Sequence
  Description of Artificial Sequence: Synthetic coding sequence
atgaataagagtcaggagcaggtctcttttaaggatgtttgcgtggactttacccaggaggagtggtatctcttggacccagcccaaaaaatcttgtatcgggacgtaatactggagaactacagcaacctggtgagtgtgggatattgcatcacgaagcccgaagtgatctttaaaatcgagcagggcgaggagccttggatactggagaagggcttcccttctcagtgtcaccccgaacggaaatggaaggttgacgatgttctggaaagctctcaagaaaacgaggacgatcatttttgggagcttctgttccataataataagaccgtgtctgttgaaaatggcgacagaggtagtaagacatttaacctcggcaccgacccagttagcctgagaaactacccatacaaaatatgcgattcttgtgagatgaatttgaaaaacatctctgggctaatcatcagcaagaaaaactgtagcagaaaaaagccagacgagttcaacgtttgcgagaaactgcttctggatatccgccacgaaaagataccgatcggggagaagagttataaatacgaccaaaagagaaatgcaattaactaccaccaggacctctcccaaccatcttttggacagtcattcgaatacagtaagaacggtcagggctttcatgacgaagccgctttttttacaaataagcggagtcagatcggagagactgtgtgcaagtacaatgaatgtggaaggacctttatcgagtcccttaagctgaatatttcgcagagaccccaccttgaaatggagccctatggatgcagcatttgcggcaagagcttctgtatgaatcttcggttcggccaccagcgggcactaactaaggataacccctatgaatacaacgaatatggcgaaatcttctgcgataactcagccttcatcattcatcagggggcctacacaaggaagatcctgcgtgagtacaaagtgtctgacaaaacctgggagaaaagcgcccttctgaagcatcagatcgtacacatgggcggaaagtcctatgattacaacgagaatggcagtaatttcagtaaaaaatcccacctgacgcaattgaggcgagcccacacgggggagaaaacctttgaatgcggcgaatgtggcaaaaccttttgggaaaagagtaatcttacacaacatcaacgcacacataccggcgaaaaaccctatgaatgcacggaatgtggcaaagctttttgtcagaaacctcatttgacaaaccaccaacggacccacactggtgagaaaccttacgagtgtaagcagtgtgggaagacattctgcgtgaagagcaacctgacagagcaccagcgcacacatactggcgaaaagccttacgaatgcaacgcttgtggcaaatcattctgccacaggagcgcccttactgtccaccaacgtacccacacgggtgagaagccctttatttgtaacgagtgtggtaaatcattctgcgtgaagagtaacctcattgttcatcagcgcacacacaccggtgagaaaccttataagtgcaacgagtgtggtaagaccttttgcgagaagtcggcgctaacaaaacaccaacggactcacaccggcgagaagccatatgaatgtaatgcttgcggcaagactttttcccaaaggtctgttctcactaagcaccagcgcatacacactcgtgtaaaggcgttgtccaccagttag

SEQ ID NO: 13967 - DNA, 360 bp, Artificial Sequence
  Description of Artificial Sequence: Synthetic coding sequence
atgaataagagtcaggagcaggtcagcttcaaggacgtgtgcgttgactttacccaagaggagtggtaccttttggatcccgctcagaaaatcctgtaccgggacgtcatcctggaaaactactcgaatctcgtttctgtgggctactgcattacaaaaccggaggtgattttcaagattgaacagggtgaggaaccgtggatcttagaaaaggggttccccagccaatgccaccccgaacggaaatggaaagtcgacgacgttttagagagctcacaggagaatgaggatgaccatttctgggagctgctgtttcacaataataaaacgtggaacctgaagttaatcaaggtggaatag

SEQ ID NO: 13968 - DNA, 1740 bp, Artificial Sequence
  Description of Artificial Sequence: Synthetic coding sequence
atgaataagtcccaagagcaagtgagctttaaggatgtgtgcgtggactttacacaggaggaatggtacttattagatcccgctcagaagattctctaccgggacgtgattctagagaactactctaatctcgtttctgtgggctattgcatcactaagcccgaggtgatcttcaaaattgagcagggggaggaaccttggatactggagaagggctttccctcccaatgtcatccagagcggaaatggaaggtcgacgatgtcctcgaatcaagtcaggagaatgaggatgatcatttttgggagctcttgtttcacaacaataaaaccgtctcggtcgagaacggagatagaggaagtaagacctttaatttgggtaccgatccagtgagtcttagaaattacccatacaaaatatgcgattcctgcgaaatgaacctgaaaaacattagtggtctaatcataagtaagaagaactgttctcggaagaagccagacgagttcaacgtgtgcgaaaagttgctcctcgatattcggcacgaaaaaatccctattggggaaaagagttataaatacgaccaaaagagaaacgccataaactaccaccaggatctgagccagccgtctttcggacagtccttcgagtacagcaaaaacgggcaaggttttcatgacgaggccgctttcttcacaaacaagcgttctcagatcggcgaaactgtttgcaagtataatgagtgcggccgtacttttatcgaaagtctcaagcttaacatatctcagcggcctcacctcgagatggaaccctacgggtgcagcatttgcggaaagagtttctgtatgaacctgcgattcggccaccaacgggcacttaccaaagataacccttacgagtataatgaatacggcgagatcttctgcgacaattctgcatttatcattcaccaaggtgcctatactaggaagatcctgagggagtacaaagtgtccgacaaaacctgggagaagtcagcgctcctgaagcaccagatagtgcacatgggcggaaagtcttatgactacaatgaaaatggctctaatttctccaagaagagccatctgacacaacttaggagagcccacactggagagaaaacttttgagtgcggtgagtgcggaaaaacgttctgggaaaaaagcaacctcacacagcaccagaggacccacacaggggaaaagccctacgagtgcactgagtgcggcaaggcattttgtcagaagccccaccttactaaccatcagagaacacacactggggaaaaaccctacgaatgtaagcagtgcggaaagaccttttgtgtcaaaagcaacttaacagagcaccaaaggacacacactggcgagaaaccttacgagtgcaatgcatgcgggaaatccttttgccatcggtccgcattaacagttcaccaaagaacacataccggcgagaagcccttcatatgcaacgagtgcggaaagtctttttgcgtgaaaagcaatttaatagtgcaccagagaactcatacaggagagaaaccttacaaatgcaatgaatgcggaaaaacattctgcgagaaaagtgccctcactaaacatcagaggacacatacaggtgagaaaccctacgaatgcaacgcctgtgggaagaccttctctcagagaagcgtgttaaccaagcaccagaggatccacacgcgggttaaggccctgtctacaagttag

SEQ ID NO: 13969 - DNA, 303 bp, Artificial Sequence
  Description of Artificial Sequence: Synthetic coding sequence
atgaataaatctcaggaacaggtgagtttcaaggacgtgtgtgtcgacttcacacaggaagagtggtatctgctggatccagcccagaaaatcctgtacagggatgtgattttagagaactattcaaatttggtttccgtcgggtattgcatcaccaagcctgaggttattttcaagatcgagcaaggtgaggagccttggatcttagagaaggggttcccatcgcagtgtcatcccgagcgcaagtggaaagtagatgatgtcttagaatcgtcacaagagaatgaggatgaccacttttag

SEQ ID NO: 13970 - DNA, 210 bp, Artificial Sequence
  Description of Artificial Sequence: Synthetic coding sequence
atgaacaaatcgcaggaacaggtgtcttttaaagatgtgtgtgtagatttcactcaggaggaatggtacctgctggaccccgcccagaaaattctgtaccgggatgtgatcctggagaactacagcaacctggtgtccgtgggctattgcatcacaaaaccagaggtgattttcaaaatcgaacagggcgaggagccatggatcctctag

SEQ ID NO: 13971 - DNA, 1683 bp, Artificial Sequence
  Description of Artificial Sequence: Synthetic coding sequence
atggccgcagcccgtctcctcccagtgcctgctgggccccagcccttgtccttccaggctaaactgacgttcgaggacgtcgcagtcctgttgagtcaagacgagtgggaccgactgtgtcccgcacagcggggcctgtaccggaatgtgatgatggagacatacggaaatgtggtaagcttgggtttgcctgggagcaagcctgacatcatcagtcagttggagagaggggaagacccatgggtgttggatcgcaagggggccaaaaaaagccaaggactttggtcagactactctgataacctaaagtacgaccacaccacggcttgtacgcaacaggacagcctgagttgcccttgggagtgcgaaaccaagggcgagtcccagaataccgatctgtcaccaaaacctttgatttctgaacagaccgtgattctgggcaaaacccccttgggaaggattgatcaggagaataacgaaaccaagcagtctttttgcctcagccccaattctgtggatcaccgtgaagtgcaagtgcttagtcagtctatgccgctcacccctcaccaggcggtccccagcggagaacgcccttacatgtgtgtggaatgtgggaagtgcttcggacgtagttcacacctgctccagcaccagcggatacataccggagaaaaaccgtacgtgtgctctgtttgtggtaaggccttttctcagtcctctgtcctgtccaaacacagaaggattcatacaggagagaaaccttacgagtgtaacgagtgcgggaaggcattccgtgtgtcaagtgatctggcccagcatcacaagatccacactggggagaagccacatgagtgccttgaatgccgcaaggctttcacgcagctttctcatctcatccagcatcaaagaatccacacgggcgagagaccctacgtctgcccactttgtggaaaggcgtttaaccatagcacggtgttgcgtagtcaccaaagggtgcatacaggcgaaaagccccacaggtgcaacgagtgcggaaaaacgtttagtgtgaagagaacacttcttcaacatcagaggatacatactggtgagaagccatacacctgctccgaatgcggcaaggctttttctgatagaagtgtgctaattcagcaccacaatgtgcacacaggtgaaaagccatacgaatgtagcgaatgcggcaagactttctcacatcgatctacgctcatgaatcatgagcggatccatacagaggagaaaccttacgcctgctatgaatgtggaaaggcattcgtgcagcattctcatcttattcagcatcaacgcgtgcacactggagagaaaccgtacgtgtgcggcgagtgtggacacgccttctcagctcgacgctccctcatccaacacgagcgtattcatacgggggagaagccctttcaatgtacagaatgtggcaaggcttttagtctcaaggctaccctgattgttcacttgagaactcatacaggagagaagccctacgaatgtaatagctgtggcaaggcgtttagtcagtattccgtgctcatccaacaccagcgaattcatacgggggagaagccctacgaatgcggagaatgtggtagggcattcaatcagcatggccacttgatccagcatcaaaaggtgcatcggaagctgtag

SEQ ID NO: 13972 - DNA, 369 bp, Artificial Sequence
  Description of Artificial Sequence: Synthetic coding sequence
atggcggcagctaggctgctgcccgttccggccggtccacaagctaaactcacttttgaagacgtggcagttctgctgagccaggacgaatgggaccgcctttgccccgcgcagcgcggcctgtataggaatgtgatgatggagacttatggaaatgttgtcagtctaggcctgccaggatctaaaccagacattatctcccaactcgaacggggcgaggatccctgggtgctggacagaaagggtgccaagaaatctcaagggctgtggagtgactattccgacaatctgaagtatgaccacacaacagcatgtacccaacaggattctctatcctgcccgtgggatccagttccccagaagccttag

SEQ ID NO: 13973 - DNA, 1332 bp, Artificial Sequence
  Description of Artificial Sequence: Synthetic coding sequence
atggccgcagcccggcttctgcccgtgcccgccggcccacaggcaaaactcaccttcgaagatgtggccgtgctcctctcacaagacgaatgggaccggttgtgtcctgctcagagagggctgtataggaacgtcatgatggaaacttacggcaatgttgtttctctaggtttgccgggctctaagcccgacatcatctcccagctcgagagaggtgaggatccttgggttctggatagaaaaggcgcgaagaagagccagggtttgtggagcgactacagcgataacctgaagtacgatcataccacagcatgtacccagcaggacagcctatcatgtccctgggaatgtgagactaagggagagtcacaaaataccgatttaagtcccaaacccctgattagtgagcagacagtgattctgggtaagactcctctcggtcggatcgatcaagagaataacgaaactaagcagagtttttgcctttctcccaactctgtcgatcaccgcgaggtccaagttctctctcagtccatgcccttgactccacaccaggccgtcccgtccggggaacgcccctatatgtgtgtggagtgtggcaaatgttttgggagatccagccacttgttgcagcaccagcggattcacacgggcgagaagccttacgtttgctctgtgtgcggcaaggccttctcccagagcagcgtgctgtccaagcacagaaggatacatacaggcgaaaagccctatgaatgtaacgagtgcgggaaagccttcagggtcagttccgacctggcccagcatcataagatccacaccggggagaagcctcacgaatgtctcgaatgtaggaaagctttcacccagttgagtcacctgatacagcatcaaagaatccacactggcgaacgcccctacgtgtgcccattgtgcggaaaagccttcaatcattccactgtgctccggtctcaccagcgggtccacactggggagaagccgcatagatgcaatgaatgtgggaaaacctttagcgtgaagagaacattgctgcagcaccaacgaatccacaccggcgaaaagccatttcagtgcaccgagtgtggtaaagctttctctttgaaagcaacacttatagtgcatttacggacccacactggcgaaaaaccgtatgagtgcaacagctgtgggaaggcattttctcagtactccgttctgatccaacatcagcgcatccacaccggcgaaaagccatacgaatgtggggagtgcggccgggctttcaaccaacatggacatcttatccagcaccagaaagtgcacaggaagctgtag

SEQ ID NO: 13974 - DNA, 1668 bp, Artificial Sequence
  Description of Artificial Sequence: Synthetic coding sequence
atggcggccgctagattgctgcctgtcccagctggaccgcaggccaaactaaccttcgaggatgtcgcggtgctgctcagccaggacgaatgggataggctttgccccgctcaacggggcctgtaccggaatgttatgatggagacctacggaaacgtggtgtccctcgggctaccaggatccaagcccgacataatttcccagttagagagaggggaagacccctgggtgcttgaccggaagggagcaaagaagagccagggactgtggtctgattactctgacaaccttaagtatgaccatactacggcctgcacccagcaggacagcctcagttgcccttgggagtgtgagacaaaaggagaatcccagaataccgatctgtcccctaaaccccttatttctgagcagacagtgattctcggtaaaactcctctcggacggatcgatcaagagaataacgagacaaagcagtccttttgtctgtcccccaactcagtggaccatcgagaagtgcaggttcttagccagagtatgccacttactcctcaccaggcagtgccatctggagaaagaccatatatgtgtgtagaatgcgggaagtgctttgggcggagcagtcacctgcttcagcatcagcgtattcacacaggagagaagccttacgtgtgcagtgtatgtggtaaggccttcagtcagagctccgtgctctccaagcacagaagaatccacaccggggaaaagccctacgaatgcaacgaatgcggaaaagccttccgtgttagctccgaccttgctcagcatcacaagatccacaccggcgaaaaaccccatgagtgccttgagtgcagaaaagcctttactcaactgtctcatctcatccaacaccagaggattcacaccggtgaaagaccctacgtgtgcccgttgtgtggtaaggctttcaaccactccactgtacttcgcagtcatcagagagtgcatactggcgaaaaacctcatcggtgtaacgagtgtgggaaaacatttagcgtgaagcgcaccctccttcagcaccagcgcatacacacaggtgagaagccttatacctgttcagaatgtggtaaagcctttagcgatcgatctgtgctcatacagcatcacaacgtccacaccggagagaagccatatgaatgcagcgagtgcggtaaaaccttctcacatcggtctacccttatgaaccatgagaggattcacaccgaagagaagccctatgcttgctatgaatgcggaaaggccttcgtgcagcactctcatctgattcagcaccagagagtgcacacaggagaaaaaccttatgtttgtggtgagtgcgggcacgctttctcagccagacggagtctgattcagcatgagcgcatacacaccggtgagaaacctttccagtgtactgagtgcgggaaagcgtttagcttgaaagctacccttattgttcaccttaggactcacaccggggagaaaccctatgagtgtaatagctgcgggaaggccttctcacagtatagcgtgctcattcagcatcaaagaattcacacaggtgagaagccttatgagtgcggggagtgcggtcgcgctttcaatcagcacgggcatcttattcaacatcaaaaggtccacagaaaactttag

SEQ ID NO: 13975 - DNA, 369 bp, Artificial Sequence
  Description of Artificial Sequence: Synthetic coding sequence
atggctgccgcccggctcctccctgtgcctgccggaccccaggcgaagctgacttttgaagacgtggcagttcttctttcgcaggatgagtgggacaggctgtgccccgctcagagagggctgtatcgcaacgtcatgatggagacgtatggcaatgtggtgtccttggggctccccgggtcgaaacccgacattatcagtcagcttgagagaggggaagatccatgggtgttggatcgaaagggtgctaaaaagtcccagggcctctggtctgactactctgataatctcaaatacgaccacacaactgcatgcacccagcaggattcactgtcctgcccctgggatcctgtgccacagaaaccttag

SEQ ID NO: 13976 - DNA, 384 bp, Artificial Sequence
  Description of Artificial Sequence: Synthetic coding sequence
atggcagccgcacgtttgttacccgttccagccggcccccagccgctgtcatttcaggccaaactaaccttcgaggacgtggccgttttgttgtcacaagacgagtgggacagattatgtccggcccagcggggactctaccgcaatgtgatgatggaaacgtacggtaacgtcgttagcctcggtctccccggttccaagccagacatcataagccaattggaacggggcgaggatccgtgggtgctagacaggaaaggagccaaaaaatcccaaggactgtggagcgattacagcgataacttaaagtacgatcacactacagcttgcactcaacaggattcactgagttgtccctgggacccagtgccccagaagccatag

SEQ ID NO: 13977 - DNA, 2016 bp, Artificial Sequence
  Description of Artificial Sequence: Synthetic coding sequence
atggctgcaacgttccaactacccggccaccaggaaatgccgctgacattccaagacgtggcagtctacttttcccaggccgaaggcaggcagctgggaccgcagcagcgggctctgtatagggacgtaatgttagagaattatggcaacgtcgctagcctcggcttcccggtgccaaaacccgagctcatctcccagcttgaacagggaaaagagctctgggtgttaaatctcctgggcgcggaagaacctgacattctcaagtcttgccagaaggatagcgaggtgggaaccaaaaaagagctgtcgattctcaatcaaaaattcagcgaagaagtaaagactcccgaattcgttagtcggcgcttgttaagagacaatgctcaggctgcggaattccgggaggcctggggtcgtgagggaaaacttaaagagcgcgttggcaattcagcagggcaatctctgaataagcccaacatccacaaaagagttctcactgaggccaccgtcgggcgggaaagatcgctgggggaacggacgcaagaatgcagtgcctttgacaggaacctgaacctcgaccagaacgttgtaaggctgcagcgcaataaaaccggagagcgggtgtttaagtgcgacatctgcagcaagaccttcaagtacaactccgacctgagccggcaccaaaggagccacaccggcgagaagccttacgagtgcggtcggtgcggccgggcctttactcacagtagcaatttggtgctgcatcatcatattcacacaggtaataaacccttcaagtgcgacgagtgtggcaagacctttggactcaattctcacctccggttgcatcgcagaatacacactggcgaaaagccattcggttgcggcgaatgcgggaaagcattctcacgttcttcgacgctcattcagcaccgcattatacatactggggaaaaaccctataaatgcaatgaatgtgggcgtggcttctcccagagcccccagctcacacaacaccagcggattcatactggcgagaagccgcacgaatgttcccactgtggcaaggcattctcgagatcttctagcctcattcagcatgagcgcattcacacgggcgaaaagccccacaaatgcaaccagtgcggcaaggcttttagtcagagttcaagcctgtttctccaccacagggtccacaccggtgaaaaaccctatgtttgcaatgagtgcggccgcgcatttggcttcaactcccacctgactgaacacgtgagaatccacacaggtgaaaagccatacgtctgtaatgagtgcggaaaggcctttcgaaggagtagcaccctcgttcagcaccgccgcgttcatacaggggaaaagccctaccagtgcgtcgagtgcggcaaagccttttctcagtcatcccagttgacccttcaccagagggtccataccggcgagaagccatatgactgcggagattgcggtaaggcattttctcgaagaagtaccctgatccaacaccagaaagtgcacagtggtgagactcgcaaatgtcggaaacacgggccagcttttgtacacgggtcctccctgactgctgacggccagatcccaacgggggagaaacacgggagggcttttaatcacggagctaatttaattcttcgctggacggtgcataccggagaaaaatctttcggatgcaatgaatacggaaaagcattctcaccaacctcaaggcctaccgaggatcagatcatgcatgcaggggagaaaccctataaatgccaggaatgtggcaacgcatttagtggcaagtcaaccttgattcagcaccaggttacccacaccggtcagaagccatgccattgttcggtctacgggaaggcatttagccagagtagtcaactgacaccaccgcagcagacccgggtaggggaaaaaccagccctcaacgatggatccaagcggtacttcattcatattaagaaaatctttcaggagcggcacttttag

SEQ ID NO: 13978 - DNA, 1602 bp, Artificial Sequence
  Description of Artificial Sequence: Synthetic coding sequence
atggcgaccagttttcgcacagcgtcttgttggggactgctctcttttaaggacattagtatggagtttacctgggatgagtggcagctgcttgattcgacacagaagtatctttatcgggacgtcatcctggaaaactaccacaatctcattagtgttgggtaccacggcacaaaacctgacttaatctttaagttagaacagggtgaggatccatggatcatcaacgcaaagattagtagacaatcctgcccggacggctgggaggaatggtaccagaacaatcaggatgagctcgaatcaatagaacgcagttatgcatgttctgtgctcggcagattgaatttatcgaagactcacgacagctcccgccagcgactttacaacactagaggaaagagcctgacacagaactctgcaccctctcggtcctatctgcggaaaaacccagacaagtttcacggctatgaggaaccatactttctgaaacaccagagagctcatagcatcgagaagaattgcgtgtgcagcgagtgcggcaaagctttccgctgtaagagtcaactaatcgttcacttgagaattcacacgggggagcggccttacgagtgttccaagtgcgagcgagccttttctgccaaatccaatctcaatgcccatcagcgggtgcacacaggcgagaagccgtactcatgtagcgagtgtgagaaggtgttcagctttaggtcccagctgattgttcaccaggagattcatacagggggcaagccctatggatgctcggagtgcgggaaggcatactcctggaaatctcagctgttactgcaccagcgctctcatactggggtgaagccttacgagtgtagtgagtgcgggaaggccttctccctgaaaagtcccttcgtggttcatcagcgtactcataccggtgtgaaacctcataagtgctccgaatgtggaaaagcttttcgcagcaagagttacttacttgtccacatcagaatgcacaccggagaaaagccctatcagtgtagcgactgcggaaaagccttcaatatgaaaacccagctgatcgtgcatcagggcgtgcacaccggcaacaacccctatcagtgcggcgaatgcggcaaggccttcggacgcaaagagcagctgaccgctcacttgagagcccatgccggagaaaagccatacggatgctctgaatgcggaaaagccttctcatcgaaaagttacttggtgatacacagacgtactcacaccggagagcggccttacgagtgctccctttgcgagcgggccttctgcggcaaatctcagctaattatacatcagagaacccacagtactgaaaaaccctacgaatgtaatgaatgtgagaaggcctacccccggaaagcctccctgcagattcatcagaagacgcattctggcgagaagccttttaagtgttcagaatgcggaaaggcatttacacagaaatctagcttgtcagagcatcagcgagtgcacacaggagagaaaccctggaagtgcagtgaatgtgggaaatcattctgttggaactcagggctgcgaatccacaggaaaacccacaaatag

SEQ ID NO: 13979 - DNA, 939 bp, Artificial Sequence
  Description of Artificial Sequence: Synthetic coding sequence
atgtgttcaccacaggaatccggaatgactgcactgagtgctaggatgttgaccaggtcaagatcactgggccccggtgctggcccgagagggtgcagggaggaacctgggcctctgcgcagaagagaggccgccgccgaggcaagaaagtcccactcacccgtgaaaaggccacgaaaggcacaaaggctccgagtcgcttatgaagggtccgattcagagaagggcgagggcgccgagcctctgaaggtcccagtgtgggaacctcaagattggcagcagcaactggttaacataagagcaatgcgaaataagaaagatgcacctgttgaccatctgggaaccgaacactgctatgattctagtgctccacctaaggtaagacggtatcaggtcctgttatcgctgatgctttccagtcagaccaaggatcaggttaccgccggcgctatgcagagactacgggctaggggactcacagtagatagcatattacaaacggacgacgccacattagggaagttgatttatcctgttggcttttggaggtccaaggtgaagtatatcaaacagacctccgctattctccagcagcattacggaggggatattcccgcgtcagtggctgaacttgttgcccttcctggagtgggcccaaaaatggctcacttagctatggccgtggcttgggggacggtgagcggcattgctgtggatactcacgtgcataggatcgctaaccgcctgagatggaccaagaaagcgaccaaatccccagaagagactcgtgcagcgctggaggaatggctgcctcgggaactgtggcacgagatcaatggcctgctcgttggtttcggccagcaaacatgtctgcctgttcaccccaggtgccatgcgtgccttaatcaggccttatgtcctgcggcccaaggcctttag

SEQ ID NO: 13980 - DNA, 996 bp, Artificial Sequence
  Description of Artificial Sequence: Synthetic coding sequence
atggaacaggcccttgcaggcgcatcctcaggtcgtgagctcggccgccctaaggagctgcagccgaagaaattgcatttatgtcccttatgcggaaaaaactttagtaataactcaaaccttatccggcaccagcgtattcatgctgcagagcggctttgcatgggcgtcgattgtaccgagatctttggcggaaaccccaggttcttgagcctgcatcgggcccatctcggcgaggaggcccataaatgcctggagtgtggaaagtgctttagccagaacacgcatcttactcgccaccagaggactcacactggtgagaagccttatcagtgtaatatctgtggaaagtgcttcagctgtaactccaatctgcatcgacatcaacgcacccacactggcgaaaagccctacaagtgtcctgaatgcggagagatcttcgctcactcatccaacttgttacggcatcagagaatccacaccggagagcgcccttacaaatgcccggaatgcggcaagtcattttcccggtcctcccacctcgtcattcatgagcggacacatgagcgagagcggctctacccttttagcgagtgtggggaggcggtgagtgattccacaccctttctcactaaccatggagcccataaagcggaaaagaaacttttcgagtgcctaacatgcgggaagagcttcaggcagggaatgcaccttactcgacaccagcgaacacacaccggtgagaaaccgtataaatgtaccctctgcggcgaaaattttagccaccgttctaacttaattcggcaccagcggattcatacaggcgagaaaccttacacatgccatgaatgcggcgacagcttttctcacagctctaaccgaatcaggcacctgagaacacacacaggcgagcgcccttacaagtgcagtgagtgtggcgagtctttttcccgctcgtcaagactgatgagccaccaacgtacgcacaccggatag

SEQ ID NO: 13981 - DNA, 1515 bp, Artificial Sequence
  Description of Artificial Sequence: Synthetic coding sequence
atgttggacaactaccgcaacctggtcttcctggggatcgccgtaagcaagccagacctgataacctgtctagaacaggggaaagagccttgcaacatgaagagacatgccatggtggccaagccacccgtcgtgtgttcccattttgcacaagacctatggccaaagcagggattgaaagatagttttcagaaagtgattctgcgaagatatggaaaatatggccacgagaacctgcaactgaggaaagggtgcaagagcgccgatgaacacaaggtgcacaagcgggggtataatggcttaaaccaatgcctcactactacacagagcaagatattccagtgcgataaatatgtcaaggttctgcacaaattcagcaattcaaacatccataaaaaacgccagacaggaaaaaagccttttaaatgtaaagagtgtggcaaaagctgctgcatcctctcacagttgactcaacataagaagactgctaccagggtgaacttctacaaatgcaagacctgcgggaaagccttcaaccagttctccaacctcacgaagcacaagatcattcatcctgaggtcaacccctacaagtgtgaggaatgcggcaaggcgttcaaccagagtctgacattaacgaaacataagaagattcatacagaggagaagccttacaagtgtgaagactgtggcaaggtgttttccgttttttcagtgctgaccaagcataaaatcatccatacagggaccaaaccttataattgcgaggagtgcggaaaaggtttttcgatttttagcactctgacaaaacataaaatcatccatacaggtgagaagccctataagtgtaacgagtgcggcaaggccttcaattggagtagcacgctgaccaaacacaagagaatccatactggggaaaaaccctacaaatgcgaagagtgtggaaaagccttcaaccagagcagtacactaacgcggcataaaattgtccacaccggagagaaaccatacaagtgtgaagagtgtgggaaggctttcaagcgctccaccacactgaccaagcataagcggatctatactaaggagaagccctataagtgtgaggaatgtggcaaagctttttctgtgttcagcacgttgaccaagcataagatcattcataccggagcaaagccctacaagtgcgaggaatgcggctccgcttttagggccttctctaccctcactgaacacaagagagtccatacaggcgagaaaccctataagtgtaacgaatgtggaaaggcattcaattggtccagtacattgaccaaacacaagcgaattcatacaggcgagaagccttacaagtgtgaggagtgcggaaaagcatttaaccggtcttcgaacctcacgcgccataagaaaatccatactggtgagaagccatataagcccaagagatgcgactcagcattcgacaacacccctaatttcagccgccataaacgaaaccatatgggtgagaagtcatag

SEQ ID NO: 13982 - DNA, 1710 bp, Artificial Sequence
  Description of Artificial Sequence: Synthetic coding sequence
atgtcctcagccccgcgtggccctcccagtgtcgcccctctgccagctgggatagggaggtccacagctaaaactcccggcctgcccgggagcctagagatggggcctctgacattcagagatgtggccatagagttctctttggaggaatggcagtgccttgataccagccagcagaacctgtaccgcaatgttatgctcgataattatcggaaccttgtcttcttgggcatcgctgtaagcaagcctgacctgatcacgtgtctggagcaggggaaggagccctgtaatatgaaacgccacgctatggttgcgaaaccgcctgtggtatgttcccattttgcacaagacctatggcccaagcagggcctgaaggattcattccagaaagtgattctgaggcgatatgggaagtatggccatgagaatctgcaactcagaaagggctgtaagtcagccgatgagcacaaagttcacaagcgcgggtataatggtttaaatcaatgcttgacaactacacagtcaaagatctttcagtgcgacaaatatgtgaaagtcctgcataaattcagtaattccaacatccataagaagaggcagactgggaagaagccttttaaatgcaaggaatgcggcaagagctgctgcattcttagtcagctgacccagcacaaaaaaaccgcgacaagggtgaatttctataagtgtaagacctgcggtaaagcatttaaccagttttcgaacctaaccaagcacaaaattattcaccctgaggtcaacccatacaagtgtgaagagtgcggcaaagcatttaaccagagcctcacccttaccaaacataaaaagatccacaccgaagaaaaaccttacaaatgtgaggactgcggtaaagtgttttcggttttttcggtgctgaccaagcataaaataattcacaccggcacgaagccatacaactgcgaagagtgtggtaagggtttttccatcttttccaccctcaccaaacataaaataattcacaccggtgagaagccttataagtgtaatgaatgtggcaaagcctttaactggtcttcaactctcaccaaacacaaacgtatacacactggcgagaaaccatataaatgcgaggaatgcggtaaagcatttaaccaatcctcaactctgactagacacaagatcgtgcacacaggcgaaaagccatataagtgtgaagagtgcgggaaagccttcaaaagatcgacgacgctcactaagcacaaaagaatatacaccaaggaaaagccctacaaatgcgaagagtgcggaaaagcctttagtgtgttcagcacccttacaaagcataaaataatccatactggcgcaaaaccttacaaatgtgaggagtgcggatcagcatttcgagcttttagcaccctgactgaacataaaagggtccatacaggtgagaagccatataagtgtaacgagtgcgggaaggcctttaattggtctagcaccctgaccaagcacaaaaggattcacaccggcgagaagccctataagtgcgaggaatgcgggaaggcttttaatcgaagtagcaacttgactcgtcataaaaaaattcacaccggggaaaaaccatacaaacctaaaaggtgtgactctgcctttgataatactcccaatttcagtcgccacaagcgaaaccatatgggcgagaaaagctag

SEQ ID NO: 13983 - DNA, 246 bp, Artificial Sequence
  Description of Artificial Sequence: Synthetic coding sequence
atgggccccctcactttccgtgatgtcgcaatcgagtttagcctggaggagtggcaatgtctggatacctctcagcagaacctgtatagaaacgtgatgctggacaactatcggaacctggtatttcttggtatcgctgtgtctaaaccagacctgatcacctgcttggagcaggggaaagaaccgtgcaacatgaaaaggcacgcaatggtggccaagccacctgggtggtcagctgttgcttag

SEQ ID NO: 13984 - DNA, 1131 bp, Artificial Sequence
  Description of Artificial Sequence: Synthetic coding sequence
atgaagggcgaggatgctcagccacaagagatggcctctacaagctttcctcgggcaagtggaccaagcccagaattccgtcagcacggggatagcgatgggaaaaggggctcaccacagaaccttcccatcgaacatcactttgcttgtaaggaatgtggggatacctttagactgaaggtgcttctcgttcagcatcagcgggtgcactcagaagagaagggttgggagtgtggggattgtggcaaggtctttcgaggcgtggcggagttcaatgagcatagaaagagccacgtcgcagctgagccacagcccggcccaagccgggcactggaaaatgccgccgagaaaagggaacaaatggagagagaggccaaacccttcgagtgcgaagagtgcggcaagcgcttcaaaaaaaacgcagggctgtcgcagcacctgagggttcactcgagagaaaagccgttcgattgtgaagaatgtggacgctcttttaaagtcaatacgcacctgttccggcaccagaaactgcacaccagcgaaaaaccattcgcatgcaaagcttgttcaagggacttcctggatcgtcaggagctcctcaagcaccagcgaatgcacaccggtcacctcccatttgactgcgatgactgtggcaaatcgttccggggggtgaacggactggccgagcatcaacggatccattctggtgccaagccttacggctgcccccactgcggtaagctgtttaggcgtagcagcgaattaacgaaacatcgccggattcacacaggggagaagccatacgcttgcggtcagtgtggcaaggcatttcggcaatcctccagcctgctggagcatgctagaatacacagtggcgaaaggccctacgcatgtggggaatgtggaaaggccttccgcggaccttctgatctgataaaacatcgccgtatccacagtggtctgaaaccttacgaatgcgacaagtgtgggaaagccttccgcaggtcttctggacttagtcgtcacaggcggattcactcaggtgccaggaggtgtgagtgtagccaatgcggacgggtgttcaaaagacggagcgccctgcaaaagcaccagcctactcatcacgaatag

SEQ ID NO: 13985 - DNA, 990 bp, Artificial Sequence
  Description of Artificial Sequence: Synthetic coding sequence
atgatgagccacccatgcgtttccctgctcggggtcccggtcctcaatccagcccttgtgccccacctcgcgcagggccaggtgctgctggtgtccgatccttctccaaatacagaccccgctaagtattctgaatctacctccgctacaaggcatcagatgaaaggcgaagatgcccagccacaggagatggcctctacaagtttccctcgcgcgtcaggtccatcccctgagttcagacaacacggtgatagtgatggcaaacgcgggtcacctcagaatctgcccatagagcatcactttgcatgtaaggaatgcggcgatacctttagacttaaggtgttactcgtacagcaccagcgagtgcactctgaggagaaaggctgggagtgcggcgactgcggcaaggtgtttcgaggagtggccgagttcaatgagcatagaaagagccatgtcgccgcagaaccacagccaggcccttcccgtgccctcgagaacgcggcagagaaaagagagcagatggaaagagaagccaaaccctttgagtgcgaggaatgtggcaaacggtttaaaaagaatgcaggcttgagtcagcatcttagggtccatagcagggaaaaacctttcgattgtgaagaatgcggtcgaagtttcaaggttaatacccatctgtttcgacatcagaagctccacacctctgaaaaaccctttgcttgcaaagcctgcagtcgggactttctcgatcgtcaggaactcctgaagcaccaacggatgcacactggacatttacctttcgactgtgacgattgcggaaaatcattccggggcgtgaatggtctcgcagagcaccagcgtatacattctggggctaagccctacgggtgcccccactgcggaaagcttttcaggcggtcaagcgagctgaccaagcacaggcggattcacacgggggagaagccctacgcttgtgggctcccctgggcactctag

SEQ ID NO: 13986 - DNA, 1290 bp, Artificial Sequence
  Description of Artificial Sequence: Synthetic coding sequence
atgatgagccacccgtgtgtatctttactcggcgtgcccgtgttaaaccccgccctggtgcctcacctggcacaggggcaagttctactggtctctgatccgtcccccaacacagaccccgctaagtattctgagtcaacctcagccacaagacatcagatgaagggagaggacgctcaacctcaggagatggctagcacttcttttccccgtgcgtccggtcctagcccagagtttcgccagcatggggactcagacggtaagagaggctcccctcagaacctgcccatcgaacatcatttcgcctgtaaagagtgtggtgacacattcagattaaaggtgctcttggtacagcatcaaagagtacattccgaagagaaagggtgggagtgtggtgattgcggcaaggttttccggggcgttgcggaattcaacgaacatcgtaagtcccatgtggccgcagaacctcagccaggtcctagccgagctctcgagaacgcagcagaaaagagggagcagatggagcgcgaagctaagccttttgaatgtgaggagtgtggcaaaaggtttaagaagaatgcagggttatcccaacatcttagagtgcactcacgggaaaagccttttgactgcgaggaatgcgggaggagcttcaaagtgaacacccacttgttccgtcatcagaaactgcacacctccgaaaagcctttcgcgtgcaaggcttgcagccgggacttcctggatcggcaggaactgctcaagcatcagagaatgcatactggacacctgccgttcgactgcgatgactgtggaaaatcattcagaggggtgaatggattagctgaacatcaaaggatccactcaggtgcaaagccgtacggctgtccacattgtggtaagttatttagaagaagtagcgagctcacaaaacatagacggattcacactggcgaaaagccgtatgcatgcggccagtgcgggaaagctttcaggcagtctagctcccttttggaacacgccagaatccatagcggtgagcgcccctacgcttgcggagagtgcggaaaggccttcaggggtccctctgacctgattaagcaccgacggatacacagcggcctgaagccgtatgaatgtgacaaatgcggtaaggccttccgtcgaagttctggactttccaggcacagaaggattcattctggcgcccgccggtgtgaatgcagccagtgcggcagggtattcaagcgccgctccgctcttcagaagcaccagcccacacaccacgagtag

SEQ ID NO: 13987 - DNA, 1380 bp, Artificial Sequence
  Description of Artificial Sequence: Synthetic coding sequence
atgccagaggatctcgtgactttcgatgatgttgcttggtacctgaccacacgggagtggtttaagctcgatccagaacaaagggccctcgaatactatggtaacgtgacatctgtcgcaggggtgcctgtgcttaatcccgctttggtcccgcacctcgcacaggggcaggtcttgcttgtttctgatccctccccgaatacggaccccgccaaatactccgagagcactagcgcgacaaggcatcagatgaagggcgaagacgcccagcctcaggaaatggcatccactagctttccccgggcatctgggccctcgccagaatttcgacagcacggagacagtgacggcaaacgaggttctccacaaaatctgccaattgaacaccatttcgcatgcaaggaatgcggtgacaccttccgtctgaaagtgctgttggttcagcaccagagggtgcacagcgaggaaaaggggtgggagtgtggtgactgcgggaaggtgttccgaggggtcgccgaattcaatgaacacagaaaatctcatgttgctgctgagcctcagccaggaccctctagggcgctcgaaaacgccgcagaaaagagggaacaaatggaacgtgaggctaaaccgtttgaatgcgaagagtgcggcaaaaggttcaaaaagaacgcaggcctgagccagcatcttcgcgtccacagccgggagaaacctttcgactgtgaagagtgcggccgttctttcaaggtgaacacccaccttttcagacatcagaagctccatacatcagagaagcccttcgcttgtaaggcctgcagcagggattttttggaccgccaggagttactcaaacatcaacgaatgcatacaggacatcttcctttcgactgcgacgactgcggcaagtcattccggggagtaaatggattagcagagcatcagcggatccacagtggagcaaagccgtatggctgtccgcattgcggaaagctttttcgccgaagctctgagctcactaagcaccgccgcattcatacaggcgaaaaaccttatgcttgtggtcagtgtggaaaagcattccgacagtcctccagccttctggaacacgcacggattcacagcggggagagaccatatgcctgcggcgagtgtggaaaggcctttcgcggccctagtgatctcatcaagcacagacggattcattctgggttgaaaccttacgagtgcgacaaatgtggcaaggcatttagacgctcgtccggcctcagccgacatcgccgcatccattctggggcccggcgatgcgagtgcagtcaatgcggtagagtatttaaaagaagatcagccctacagaaacaccagcctacgcaccatgagtag

SEQ ID NO: 13988 - DNA, 1620 bp, Artificial Sequence
  Description of Artificial Sequence: Synthetic coding sequence
atggggcactgtagactttgtcatgggaaattcagttcaagaagcctgcggtcaatctctgaacgagcacccggggcttctatggaaaggcctagtgctgaggagagagtgcttgtcagggacttccagagactgctgggcgtggctgtcagacaagaccctactctcagccccttcgtatgcaaatcatgccatgcacagttctatcagtgtcatagtctgctcaaatccttcctacagagagtgaacgctagccctgccgggcggcgcaaaccctgtgctaaggttggggctcaaccccccacgggcgcagaagagggcgcttgcctggtggatctgattacatcctcaccccagtgcctgcatggacttgtgggatgggtgcatggacacgcagcaagctgtggagccctaccccacctccaacgcaccctctcctctgagtattgcggggtcattcaggtggtgtgggggtgcgaccaagggcatgactacactatggatacctccagttcctgcaaggcctttttattagactcggccctagcggtgaaatggccttgggacaaagagactgccccccggttgccacagcatagaggctggaatccgggtgacgcccctcagacatcacagggtagagggaccggtactccagttggagcagaaacgaagacactacctagcaccgatgtcgcccagccgccttctgactcagatgccgtgggaccccggtcaggatttcctccacagccatccctgcctctgtgcagagcacccggccaacttggcgagaagcaactgccctcaagcactagcgacgatagggttaaagacgagtttagcgatttgagcgaaggtgacgttctgtctgaggatgagaatgataaaaagcaaaacgcacagtccagtgatgagagcttcgagccctatcccgaaagaaaggtatctggcaaaaaatcagagagcaaagaagccaagaaaagtgaggagccgcgcattagaaagaagccgggacccaagccaggctggaagaaaaaactccgctgtgagcgcgaagagctccccacgatctataagtgcccttatcagggatgtacagcagtgtacagaggagccgacggaatgaagaagcacatcaaggagcaccacgaggaagtcagggagcgaccctgcccgcaccctgggtgtaataaagttttcatgattgatcgatatctacagcggcacgtgaagttgattcacactgaggtaagaaattatatctgtgacgagtgcggccagaccttcaagcaacggaaacacctccttgtccatcagatgcgccactctggagccaagccattacaatgtgaggtgtgtggcttccaatgtcgccaacgagctagcctaaaataccacatgaccaaacataaagcggagactgagctggacttcgcctgcgaccaatgtggtagacgctttgaaaaggcacacaatctcaatgttcacatgtctatggtccacccccttacgcaaacacaggacaaagcactcccgcttgaggctgaacccccgcctggccccccctctcccagcgtgacaacggagggccaagcagtcaagcccgagcccacctag

SEQ ID NO: 13989 - DNA, 1845 bp, Artificial Sequence
  Description of Artificial Sequence: Synthetic coding sequence
atgaaaagagacaggctaggaaggttcctgtccccggggagtagccgtcagtgtggtgcttcagatggcggggggggcgtgtcaaggacccgcggccggccgtcattatctggtggacctcgagttgacggggccacagctaggagagcatggggaccagtcgggtcttgcggggacgccggcgaagatggggccgacgaggctggagccggacgcgcgctggctatggggcactgtaggctttgtcacggcaaattctccagccgctctctgcgtagtatttccgagcgagcaccaggcgcctctatggagcgaccctccgctgaggagcgggttttggtccgggattttcagaggctgctcggcgtggccgttcggcaggacccaactctctccccttttgtatgcaaaagttgccacgcccagttctatcagtgccacagtctactcaaatctttcttgcagcgagtaaacgcaagccccgctggccgaaggaaaccgtgtgccaaagtgggagctcaaccacctacaggagcagaggagggcgcatgcttggttgatctcatcacatcgagtccacaatgtttgcacggtttagtagggtgggtccatggacatgctgctagctgcggagccctcccccatctgcaacggaccctatcttctgagtactgtggggttatacaggtcgtatgggggtgcgaccaaggacacgattatacaatggatacttcaagctcgtgcaaagcctttctccttgacagtgccctggcagttaaatggccctgggacaaagaaaccgcccctagactaccccagcaccgggggtggaatcctggggacgcacctcagaccagtcagggccgcggcactggcacccccgtgggagcagaaaccaagaccttgcccagtacagatgtggcccaaccaccttccgattcagacgccgtcggacctaggtcaggattcccccctcagccaagcttacccctttgccgggcaccaggccagcttggcgagaaacaactcccctcgagtaccagtgacgaccgtgttaaggatgagttctccgaccttagtgaaggcgacgtgctatctgaagacgaaaacgacaagaaacagaatgcacaatccagcgacgagagctttgaaccctaccctgaacggaaagtctctgggaagaagagtgaatcaaaggaagcaaagaagagcgaagagccaaggattcgaaaaaagcccgggcccaaacccggatggaagaagaaattgcggtgcgaacgtgaggaactgcccaccatatataaatgcccgtaccaaggctgtacagccgtgtatcgcggcgcggatggcatgaaaaagcatatcaaggaacaccacgaagaggtgcgtgagagaccgtgcccccacccggggtgtaataaagttttcatgatcgatcgctacctccagaggcatgttaaactgatccacaccgaagtgcggaattacatctgtgacgagtgtggacaaactttcaagcagcgaaagcacctgcttgtccaccagatgagacactccggcgccaagcctctgcaatgcgaggtgtgcggctttcaatgtagacaacgagcttctttgaagtatcatatgaccaaacacaaggcagaaacagagcttgactttgcttgtgaccagtgtggccggaggttcgagaaagcccataacctaaatgtccatatgtccatggtccacccattgactcagacccaagataaggccctcccgttggaagctgagccaccaccaggccccccctcccccagcgtgacgaccgaggggcaagcagtgaaacctgaacctacatag

SEQ ID NO: 13990 - DNA, 1203 bp, Artificial Sequence
  Description of Artificial Sequence: Synthetic coding sequence
atggatatgagacccgctgccggtccctgtcctaccttccgcgggcattgccccccatcaacagctgcttcctcccgtagctgtggagctgctacacgagccactacaacaccctggatccctgcgcccgctgcaagaccatcctgttggaccgtgcggtggcagtcgagcgggcatgggacaaagagaagaaggcacgggtgccccagcacagaaggcggaactttaggcatgccactccgccctccaagagtggagggtcagggtccacaactgggccttagaccacgcccttgtcccgctcgcatgtggcccagcctgctccggactgcaacccggtggggtccgggccgggcgtcacatctgtcccaggcttgtcctttcgccgggccccagggtagctgggtgaggagctcctttcacctccagcctcgtatgattggcgacgtattatctgaagacgaaaatgacaagaagcagaacgcccaaagctcagatgaaagttttgaaccatatccagagagaaaggtctccgggaagaagtctgagtctaaggaggcaaagaagagtgaggagcctcgaatcagaaagaaaccgggccccaagcctgggtggaaaaaaaagttaagatgcgagcgcgaggaattgccgactatttataaatgcccatatcagggctgcacggctgtgtacagaggtgccgacggcatgaagaaacacataaaggaacaccatgaggaagtgagggagcgcccttgccctcacccaggctgtaacaaagtctttatgatcgacaggtacctgcagcgacatgtgaaactgatccataccgaggttcgaaattacatctgcgacgagtgcggacaaacattcaaacaacgcaagcatctacttgtgcaccaaatgcggcatagcggcgcgaagcctcttcagtgtgaggtctgtgggtttcaatgtagacagagggcctcgctcaaataccacatgacaaagcataaagccgagacagagctagacttcgcatgcgatcaatgcggtagaaggttcgaaaaagcacacaacttaaacgttcatatgagcatggtgcatcccctcactcagacgcaggataaggctctgcctctagaagccgagcccccccctgggcctccatcaccctcggtgaccactgaaggccaagccgtgaagcctgagcccacgtag

SEQ ID NO: 13991 - DNA, 1998 bp, Artificial Sequence
  Description of Artificial Sequence: Synthetic coding sequence
atgatgaagacattcttcagcaccggtcagggtaatactgaagccttccataccgggaccctccagcgtcaagctagtcaccacatcggtgacttctgtttccagaaaattgaaaaagacatccacggatttcagttccagtggaaggaagatgaaacaaatgatcatgctgcgccaatgacagagatcaaagagctaactggatctaccggccaacacgaccaaaggcacgcaggcaacaaacacatcaaggatcagctggggttgagttttcattctcacttgcccgaactgcacatttttcagcccgagggtaagattggaaaccaggtggagaaaagcataaataacgcgagttcagtgagcacatcccagaggatctgttgcaggcctaaaacccatatttccaataaatacgggaacaacagcctgcactcgagcctcctgacacagaagcgcaatgtgcatatgcgagagaagtcgtttcaatgcattgaaagcgggaagtctttcaactgtagtagcctcctgaagaagcaccagatcacccatctcgaagaaaagcagtgtaagtgcgatgtgtacgggaaggtgtttaatcagaaacggtacctggcttgccatcgacgctcccatatcgacgaaaagccctacaagtgtaacgaatgcggaaagatctttggccacaacactagcttgttccttcataaggccttgcacacagccgataagccatacgagtgcgaggaatgcgataaggtgttctcccgaaagtcccatcttgagactcacaagatcatctacactggcggaaaaccttataaatgtaaggtttgcgataaagcctttacctgtaatagttacttggctaagcacacaatcatccatactggcgagaagccgtacaagtgcaatgaatgcgggaaagtcttcaacaggctctcaacattggctagacatcggcgactgcacactggtgagaagccatacgaatgcgaggagtgcgagaaggtcttctcgaggaagagtcacctggagcggcacaagcgcattcacacaggtgaaaaaccctacaagtgcaaagtctgtgacaaagctttcgcttacaactcttatctggccaagcactcaatcatacacacaggagaaaagccctataagtgcaatgaatgcggcaaggtgtttaatcagcagagtactctggcgcggcatcaccgcctacacactgcagagaaaccttataaatgtgaggaatgcgataaggtgttccgatgcaagtcccacctggaacgccataggagaatccatacaggagaaaagccctataagtgcaaagtttgtgataaggcgttccggagtgatagctgcctcactgaacaccagcgcgtgcacactggggagaaaccatacatgtgtaacgaatgtggaaaagtttttagcactaaagctaatctggcgtgtcatcataaactgcacaccgccgagaagccctacaagtgcgaagaatgcgagaaagtgtttagccgtaagtcccatatggaacgccatcggcgtatccacactggtgaaaagccttacaaatgcaaggtatgtgacaaagcttttagacgagattctcatctcgcccaacatcaaagagtgcacaccggcgagaagccttataagtgcaatgagtgtgggaagacctttagacagaccagctcactgatcattcaccgcagactgcacacaggtgagaaaccttacaagtgtaacgagtgtgggaagactttttcccagatgagttcgcttgtgtatcatcacaggctacacagcggtgaaaaaccatataagtgtaatgagtgtggaaaggtgttcaaccagcaggcccacctcgcgcagcaccagagggtgcatacaggcgagaagccctataagtgtaacgagtgtggcaaaacattctctcagatgagtaatctcgtgtatcaccatagactccattccggtgagaagccgtag

SEQ ID NO: 13992 - DNA, 1998 bp, Artificial Sequence
  Description of Artificial Sequence: Synthetic coding sequence
atgatgaagaccttcttcagtactggacaggggaacacagaggcatttcatacagggacccttcaaaggcaggcctctcatcatatcggagacttctgcttccagaaaatcgagaaggacattcacggcttccagttccagtggaaggaagatgaaacaaatgatcatgccgcacccatgaccgaaatcaaggagctgaccggcagtaccgggcagcatgaccaacgccacgccgggaataagcacatcaaggatcagctcggcctgtcttttcattcacatttgccagagctgcacatcttccagcccgaggggaagatcggtaatcaggtcgaaaaatccatcaacaatgcatcatccgtcagtacatctcaacgcatttgttgtcggccaaagacacacataagcaataaatacggaaacaattccttacattccagcctgcttacccagaaaagaaacgtccatatgcgagaaaagtcttttcagtgcatcgagagcggcaaaagcttcaactgctcctctctactgaaaaaacatcagattacgcacttggaagaaaagcaatgcaaatgtgacgtgtatggcaaggttttcaaccagaagcggtatttggcatgccaccgccgctcgcacatcgatgaaaagccctataagtgtaacgagtgtggcaagatttttggacataataccagcctgtttcttcacaaagccctccatactgccgacaagccttatgaatgcgaggagtgtgataaggtcttctcacgcaagtcgcatctggagacacacaagattatctatactggcggtaaaccttacaagtgcaaggtctgtgacaaagctttcacttgcaatagctacttggctaagcatacaattattcacaccggggagaaaccctacaaatgtaacgagtgcggaaaggtgttcaaccgtttaagtactcttgcccggcaccggagactgcacaccggcgaaaaaccctatgagtgtgaggaatgtgagaaagttttctcacgaaagagccatctggagcgacacaagcgaattcacacgggggagaagccatataagtgcaaggtttgcgataaagcattcgcatacaacagttatctagccaagcactcaataatccatactggggagaaaccatataagtgcaatgaatgtggcaaggtcttcaaccagcagagcactctggcgcgtcatcaccgactgcacacggccgaaaagccatacaagtgtgaggagtgtgacaaagtgtttcggtgtaagagccacttagagcgccaccgacggattcatacaggagagaaaccgtacaagtgcaaagtgtgcgacaaggccttccggagcgattcatgcctcaccgagcatcagagggtgcacactggagagaagccgtacatgtgtaacgagtgtgggaaggtcttctccacgaaagccaacctagcatgccatcacaagctgcatactgccgagaaaccttacaagtgtgaagaatgcgaaaaggtattcagccgcaagtcacacatggagcggcatcgtaggatccacacgggagagaagccgtacaaatgcaaagtttgcgataaagcctttaggcgcgactcccatctggcacagcatcaacgtgtacatactggggagaagccatacaaatgtaatgagtgtgggaaaacatttaggcagacgtccagcttaataattcatcgccgtctgcacactggcgaaaagccctacaagtgtaacgaatgtgggaagactttcagccagatgtccagcttagtgtaccaccacaggcttcacagcggcgaaaaaccatacaagtgtaacgaatgcggcaaggtattcaaccagcaggcccacctcgctcaacatcagcgagttcataccggagagaagccatacaaatgtaatgagtgcgggaaaactttttctcaaatgagcaatctggtttaccaccacagactccactccggagaaaaaccctag

SEQ ID NO: 13993 - DNA, 2157 bp, Artificial Sequence
  Description of Artificial Sequence: Synthetic coding sequence
atggctctaccgcagggcctgctgactttcagggatgtggccatcgaattttctcaggaagagtggaaatgtcttgatcctgcccagaggaccctttatcgcgacgtgatgctggagaattataggaaccttgtgagcttagacatcagttcaaagtgcatgatgaagacattttttagtacaggtcagggcaatacagaggcctttcacactggcactcttcagcggcaggcctctcatcatatcggagatttctgctttcagaagattgagaaggacatacacggctttcagtttcagtggaaggaggatgagaccaacgaccatgcagcaccgatgaccgagataaaggaacttactggcagcacaggacaacacgaccagcgacatgctggcaacaaacatataaaagaccagctcgggttgtcctttcatagccacctgcctgaattacacatcttccagcccgagggcaagataggcaatcaggttgagaagagcatcaacaatgcttcttccgtttccacttcccagcgaatctgttgcagacccaaaacccacataagtaacaagtacggcaataactctctccatagctccctgcttactcagaaacgaaatgttcacatgagagagaaaagcttccagtgcattgagtcaggaaaatcattcaattgcagttccctgctgaagaaacaccaaattacacatctcgaagaaaagcagtgtaagtgcgacgtctacggcaaagtgttcaatcagaagcggtacctggcatgtcataggaggtctcatattgatgaaaaaccttacaaatgtaacgagtgtggcaaaatcttcggccacaataccagtctcttcctgcacaaggcactccacaccgccgacaagccatacgagtgtgaggagtgtgacaaggtgttttccagaaaaagtcacctggagacacacaaaatcatctacaccggaggcaagccttacaagtgcaaggtctgcgacaaggccttcacctgtaatagctacctagctaaacatacgattatccatactggggaaaaaccatacaaatgcaacgagtgcggtaaggtgttcaatcgcctgtctactcttgcaaggcaccgccgcctgcacaccggagaaaaaccctatgagtgtgaagagtgtgaaaaagtatttagcaggaagtcccatttagaacgacacaaacggatccataccggggagaagccttacaaatgcaaggtatgtgacaaggcctttgcctataactcataccttgcgaagcatagtataattcacacaggcgaaaagccttataaatgcaatgagtgcgggaaggtcttcaaccagcagagtaccctggcccgccatcacaggctgcacacggccgagaaaccctacaagtgcgaggagtgcgataaggtgttccgatgcaaatcccatctggaaaggcatcgtcgcatacacacaggagagaaaccatacaagtgtaaggtctgtgacaaggccttccggtcagactcgtgcttaaccgagcaccagcgagtacacacaggcgagaaaccatatatgtgcaatgagtgcgggaaggtgttctctaccaaggccaatctggcttgccaccacaagctgcacaccgcagaaaagccttataaatgtgaagagtgtgagaaggtattttcaaggaaaagccacatggagcgacacaggcgcatccatacaggggaaaagccctataagtgtaaagtgtgcgataaagccttcagacgcgacagccatctggcccagcatcaacgcgtacacacaggcgaaaaaccttacaaatgcaacgaatgtgggaaaacattccggcaaaccagtagcttaatcattcacaggcgcctacacactggtgagaaaccatacaagtgtaacgagtgcggcaaaacattttcccaaatgtcttcgctggtataccaccaccggctccactccggcgagaaaccttataaatgtaacgaatgtgggaaggtctttaaccagcaggctcacctggcgcagcatcagcgcgttcataccggagaaaaaccgtataaatgcaacgaatgtggaaaaacattttcacaaatgtccaacctggtctatcatcaccggcttcattcaggcgaaaaaccatag

SEQ ID NO: 13994 - DNA, 2607 bp, Artificial Sequence
  Description of Artificial Sequence: Synthetic coding sequence
atgcgaggcgccgcttcagccagtgtgagggaacctacgcccttacccggaaggggtgctccgcggaccaagcctagggccgggcgagggccgacagtgggtacaccagcaacactggccctgcctgctcgcgggcgtccgcgaagtaggaacggcttagcatccaagggacagcgcggcgccgcccccaccggccctgggcaccgggccttgccaagccgagacacagccttaccccaggaaagaaacaaaaaactcgaggcagttggaacaggtatcgagcctaaagcgatgtcccagggccttgtcacattcggtgacgtcgcagtcgatttttctcaggaagaatgggaatggctgaacccgattcaacggaacctgtaccgcaaagtgatgctggaaaattaccgaaacctcgctagtctagggctttgcgtgagtaagcccgatgtgatttctagtttggagcagggcaaggaaccctggacagtgaagaggaaaatgaccagggcttggtgtccagatttgaaagccgtgtggaaaatcaaggagctgcctctgaagaaggacttctgcgagggaaagctttcccaagctgtgattactgagcgactcacttcttacaacctggaatattcgcttctgggcgagcactgggactatgatgccctgtttgagactcaacctgggcttgtaactattaaaaacctggctgtggactttcggcagcaactacaccccgctcagaaaaacttctgcaagaacggaatttgggaaaataactccgaccttggatcagccgggcactgcgtggcgaaacctgatctcgtgtccctgcttgaacaggagaaagaaccgtggatggtgaagcgtgaacttacagggagtctgttctccggccagcggtctgtgcacgagacccaggagcttttccctaagcaagacagttacgccgaaggcgtgaccgaccgtacctcaaacactaagttagactgctcttcattccgagagaactgggattctgattacgtctttggacggaaactggcagtgggacaagaaactcagtttagacaggagccgatcactcataataaaacactctcaaaggaaagagaacggacctacaacaagagcggccgttggttctatctcgacgattctgaggagaaggtccacaatcgcgactccattaaaaactttcaaaaatcttccgtcgtcattaagcaaactggcatttatgctggcaaaaagctgttcaaatgcaacgagtgtaagaagacatttacccagagcagtagtttgaccgtgcaccagaggattcacactggcgaaaagccctataagtgtaatgaatgcggtaaggcattctcagacggcagttctttcgcgaggcaccagagatgtcacactggaaagaaaccctacgagtgcatcgagtgtggcaaggcatttatacagaatacatctttaattagacattggcggtattaccacactggagagaagcctttcgattgtatcgactgcggaaaggcatttagcgatcacattggcctgaaccagcaccggcgcattcatacaggggagaaaccctataagtgtgacgtctgtcacaaatcttttagatacggttcgagcttgaccgtgcatcagagaatccacactggagagaaaccttacgagtgcgatgtgtgccgtaaggcatttagccaccacgcgtccctgacccagcatcaacgggtacattccggagaaaaaccattcaagtgcaaagagtgcggaaaggcattcagacagaacatccatctcgcttctcatttgaggatacatactggggaaaaaccctttgagtgcgctgagtgcggaaaaagcttctccatctcctcccaactcgccactcaccagcgtatccacaccggagaaaagccttatgaatgtaaagtgtgttccaaggcattcactcagaaggcgcatctcgcccagcatcagaaaacacacacaggtgagaaaccatacgagtgcaaggagtgtgggaaagcttttagccagactacacatctcatccagcaccagcgcgtccatactggagagaagccgtataaatgcatggagtgtgggaaggcttttggagacaattcttcctgtactcagcaccagcggctgcacaccggacagaggccttatgaatgcattgagtgtggcaaggcctttaaaactaagagtagcctgatttgccatcggagatcgcacacaggcgaaaagccttacgagtgcagcgtctgtgggaaggctttcagccatcggcagtcgctcagtgttcatcaaagaatccacagtggcaagaaaccctacgaatgtaaggaatgtaggaaaacattcatccaaattggacaccttaatcagcacaagcgggtccacacaggggaaaggtcttacaactataaaaagtctcgaaaagtattccggcagactgcccatctggcacaccaccagagaatccatactggggagagttcaacctgcccttctttgccatcaacatccaatccggtggacctcttcccaaaatttctgtggaacccaagctcgctgccatccccttag

SEQ ID NO: 13995 - DNA, 1629 bp, Artificial Sequence
  Description of Artificial Sequence: Synthetic coding sequence
atgggtgacatattcctttgtaaaaaagtggagagccctaagaaaaatctgcgcgagtcaaaacagcgcgaagaggatgatgaagaccctgacctgatttacgtgggggtggaacatgttcatcgcgatgctgaagtgctgtttgtcggtatgattagcaactcaaaacctgtagtgtcaaatatcctgaatcgggtgacacccggcagcaaatcccgtcggaagaagggacactttcggcagtatccagcccatgtgtctcaacccgccaaccatgtaacatccatggcaaaggcgataatgccagtgagtttaagcgaggggcgatctacagacagcccagtcactatgaagagctcaagtgagcccggatacaagatgtcaagcccccaggtggtgtcccccaactactccgatagtctgcctcctgggacccaatgtctagtgggggcaatggtgtccggaggaggccgtaatgaatcaagccccgactctaagaggctgtccacctccgacattaacagtagagatagcaagcgggtcaaactgcgggacgggatacccggcgtgccttctctcgccgtcgtaccttcagatatgagcagcacgatttccacaaatactcccagccagggcatctgtaatagcagtaatcacgttcagaatggggtcacctttccctggcctgacgcgaacgggaaggcccacttcaatctgactgatcctgaacgcgctaacgagtcgggactggctatgacagacatcagcagcctcgcttctcagaataaaacctttgatcctaaaaaggaaaatcctatcgtattactgagtaatttctactatggtcagcacaagggcgacggacaaccagaacaaaagactcacactacattcaaatgtttatcttgcgttaaggtcttgaagaacataaagtttatgaatcacatgaagcaccatctggagttcgaaaaacagaggaacgattcctgggaagaccacacaacatgccagcactgccacaggcagtttcctaccccgtttcagctgcagtgtcacattgactcagtgcatattgcgatgggaccaagcgcagtctgtaaaatatgcgagctttcctttgagacagaccaggttcttctgcaacacatgaaagaccaccacaaaccgggggaaatgccctatgtttgccaagtatgtcattatagatcgtccgtgtttgcagacgtagagacccacttcagaacatgtcatgagaatactaaaaaccttctgtgcctgttctgcctgaagttattcaaaacagcgatcccgtatatgaaccattgttggcgccattccagacgccgggtgctccagtgctctaaatgccggctgcaatttctcaccctaaaggaggagattgaacacaaaaccaaggaccaccaaactttcaagaaaccagagcagcttcaaggcttcccccgagaaaccaaagtgattattcagacttctgtgcagcctgggtcctccgggatggcgagtgtaatcgtgtcgaacactgatccacagagcagtcccgtgaaaacaaagaagaaaaccgccatgaacactagagatagtagactgccctgttccaaggattcaagttag

SEQ ID NO: 13996 - DNA, 1632 bp, Artificial Sequence
  Description of Artificial Sequence: Synthetic coding sequence
atggaacagagttgcgaagaggaaaaggaaccagaaccgcaaaaaaatatacaggagaccaagcaagtggatgacgaggatgctgagcttatatttgtaggcgtcgaacacgtcaatgaggatgctgaactgatcttcgtaggggtgacatcgaactccaaaccggtcgtgagcaacattctgaaccgtgtaacacctgggagctggtcccggcggaaaaagtacgatcatctgcgcaaggacacagccaggaagctgcaacccaagtcgcacgagaccgtcaccagtgaggccgtgacagtactaccagcctcccagttggagagtcggtccactgactcccccattatcatagaacccctgagcaagccagactataggaactcctctccccaggtggtgccgaataacagttcagagttgccctccccactgattacatttactgatagcttgcaccacccagtgagcaccgctctgagtgttggcgggattaatgagtcgccacgggtgagtaagcagctgtctacatttgaggtcaatagcatcaaccccaaacgcgcaaaattgagggatggaatcatcgagggaaatagttctgccagcttcccctccgataccttccatactatgaacacccagcagtctactccatcaaacaatgtccacacctccctgtcacacgtccagaatggcgccccatttccggccgcattccccaaggacaacatccacttcaagcccattaacacaaatctggacagggagaatgaactcgccaagactgacatcctatccctcacttcacagaacaagaccttcgaccctaagaaagaaaaccccattgtgctgctttctgacttctactacggccagcacaaaggcgaagggcagcccgagcaaaagacacacacaactttcaaatgtctgtcctgcgtgaaagttcttaagaatgtgaagttcatgaatcacgtgaagcatcacctggagtttgaaaaacagagaaacgactcctgggagaatcatactacctgtcagcactgccacaggcagttccccactccgtttcaacttcagtgccatattgagaacgtccacacggcccaggagcccagtacagtatgcaagatctgcgagctgtccttcgagacagatcaggtcctgctgcagcacatgaaagatcaccataagccaggagaaatgccgtatgtgtgccaggtgtgccactacagaagctcagtgtttgccgatgtagagacacactttcgaacctgtcacgagaatactaagaacctgctttgtccgttctgcctgaaaatctttaagacggccaccccttacatgtgccattacagaggacactggggtaaatctgcccatcagtgcagtaaatgtagacttcagtttttaacgttcaaggagaagatggaacataaaacacagtgtcaccagatgtttaagaagccaaaacaactagagggcctgccaccagaaaccaaagtgactattcaggtttcactggagccgctgcaacccggaagcgttgatgtcgcgagcatcacggtgagtacctcggactctgaaccctcccttcccaggagcaaatccaagatatccaaaaaaagccactag

SEQ ID NO: 13997 - DNA, 1632 bp, Artificial Sequence
  Description of Artificial Sequence: Synthetic coding sequence
atggagcaatcatgcgaggaagagaaggagccggaaccacaaaaaaatatccaggaaacaaaacaagtagatgacgaagacgcagagctgatctttgttggtgttgagcacgttaacgaagatgcagaactaattttcgtgggcgtaacttccaattctaagccggtggtcagtaatatcctgaatagagttactcccggctcttggtctaggaggaaaaagtacgaccacctaaggaaggatactgcccggaaacttcagcccaagtcacacgaaacagtgacatcagaggccgtgactgtgcttccagcctcccaactggagagtaggagtaccgatagtcctatcattatcgaacccctgtccaagcctgattatcggaacagttccccccaggtagttcctaacaacagttccgagctgccttctccccttataacctttaccgatagtttacatcaccccgtgagtacggccctgtctgtgggtggcatcaacgaatccccaagggtgagcaagcagctcagtacttttgaagtcaattccattaatcccaaaagagctaaactgagagacggcattatcgaaggcaactcatccgcttccttccccagcgacacgttccacaccatgaatacacaacagtcaaccccctccaataacgtgcacacaagcctctctcacgtacagaacggagccccgttccccgcagccttcccgaaggataacatacatttcaagcccattaacactaacctagaccgtgagaacgaactcgccaagacagacatcctgtcactgacgagccagaataagacctttgaccccaagaaagagaatcctatcgtcctcctttctgatttctactatggccaacacaagggcgagggtcagcccgagcagaaaacacataccacatttaagtgcctcagttgtgtaaaggtactgaagaacgtgaagttcatgaaccacgttaaacaccacttagaatttgagaagcagcggaatgacagctgggaaaaccataccacttgtcagcattgccataggcaatttccaaccccgtttcagctgcagtgccacattgaaaatgtccacacagcgcaggaacccagcacggtgtgcaaaatttgtgaattgtcatttgaaaccgatcaggtcctcctgcagcacatgaaagaccatcacaaaccgggggaaatgccctatgtctgtcaagtgtgccattaccgcagttcagtcttcgcagacgtcgagacccattttagaacgtgtcacgaaaacaccaaaaacctactttgccctttctgtctgaaaatcttcaaaaccgccacaccttacatgtgccactacagggggcactggggaaaatccgcacatcagtgttcgaaatgccgcctacagttcctgacttttaaagagaagatggagcacaagactcagtgtcatcagatgtttaaaaaaccaaagcaactcgagggactgccccccgaaaccaaggtgaccattcaggtctcactggagcctttgcaacccgggagcgtggacgtggcgagcataacagtgtcaacttctgacagcgagccaagtttacccaggagtaaaagcaaaatttctaagaagtcacattag

SEQ ID NO: 13998 - DNA, 1833 bp, Artificial Sequence
  Description of Artificial Sequence: Synthetic coding sequence
atggacgacgacaagccatttcagcccaagaatataagcaaaatggctgagctgttcatggaatgtgaagaagaggagttagaaccttggcagaagaaggtagaagagacccaggacgaagatgacgacgaactgattttcgtcggggagattagcagcagcaagcccgcgatatcaaatatcctgaaccgaggtcatagctctagttcaagcaagggaatcaagagcgagccccattccccggggattcctgagattttcagaacagcatctcagcggtgtcgggatcctcctagcaaccctgtggcagcgtcacccagatttcatctggtgtcgaaatccagccagagttctgtgaccgtggagaacgccagcaagcctgatttcaccaagaacagccaggttggaagtgacaactccagcattctgttgttcgattcaacccaggaatctttacctcccagtcaagacattcctgccatattccgcgagggcatgaagaacacatcgtacgtgctgaagcacccttctacatctaaggtcaactccgtgacgccgaaaaaaccgaagaccagcgaagatgtaccccaaattaatcccagcacctcacttcccttgattgggagccctccagtgacctcctcacaggtgatgctttccaaaggaacaaacacatcatctccttatgatgccggggcggactacctgagggcttgcccaaagtgcaatgtgcagtttaacctcctcgaccccttaaaataccatatgaagcattgttgtccggatatgattactaagtttctgggggtcattgtgaaatccgaaagaccgtgcgatgaagataagaccgacagtgagaccggcaaacttattatgttagttaacgagttctattacggccgccacgagggcgtcactgaaaaagaacctaaaacttatactaccttcaaatgcttcagttgttctaaggttctcaagaataatatccgctttatgaatcacatgaagcaccatctggagctggagaagcagaataacgagtcctgggaaaatcacaccacgtgtcaacattgttacagacagtatcctacaccctttcaactgcagtgccatatcgagagtacacacacgcctcacgagtttagcactatctgcaagatctgtgaactgagctttgagacagagcatatcttgcttcaacatatgaaagacacccataaaccaggcgaaatgccctacgtgtgccagaaaaagggcgttcatcgttgtccaaaatgccgcctgcaatttctgacatccaaagaaaaggcagagcataaagcacagcacagaacatttatcaaaccaaaggaattggaagggcttcccccaggggctaaggtaacaattcgggcgagcttaggtccgctacaaagcaaattaccaactgcgccctttgggtgcgcccctgggaccagcttcctgcaggttacccctccaacctcccagaataccaccgcccgtaatcctcgcaaatctaacgcgtcaaggagtaaaacctctaaacttcacgctacaacctctaccgccagcaaggttaatactagtaaacccaggggtagaatcgcaaagtctaaagctaagccatcctacaagcaaaagagacagcgaaacagaaagaacaaaatgtcgcttgcactgaaaaacataaggtgccgtcgcggcatacacaaatgtattgaatgccattcgaagattaaggatttcgcctctcacttcagtatctacatacattgctccttctgcaagtataataccaactgcaacaaggccttcgtaaaccacatgatgtag

SEQ ID NO: 13999 - DNA, 2214 bp, Artificial Sequence
  Description of Artificial Sequence: Synthetic coding sequence
atggacgatgacaagccttttcagcccaaaaacatttcaaagatggccgagctgtttatggagtgcgaggaagaggaattagaaccctggcagaagaaggtcgaagagacacaagacgaagacgatgacgagttgatctttgtgggggagatttcgtcatcaaaacctgctatcagcaacattctgaatcgggggcattcaagcagctcgtccaaaggcatcaaaagtgagcctcatagccctggcattccggaaattttccggaccgcgagccaacgttgccgagatcctccctctaacccagtggcagcatcgccgcgctttcatctggtgtcaaaatcatctcaatccagtgttacagtggaaaatgcctctaaaccagatttcaccaaaaacagccaggtaggctcagacaattccagcatcctcctctttgatagtacccaggaatccctcccgccttcccaagacatcccagccatctttagagaaggcatgaagaatacaagctatgtgctgaagcatccttcgacatccaaagtgaatagcgtgacaccaaagaagcccaagacaagcgaggacgtgcctcagataaacccttcaacctccttgcccttgatcggttctcccccagtgactagctcgcaggttatgctgagtaaggggaccaatacgagttccccatacgatgctggagcagactacttacgggcctgcccaaagtgcaacgttcaatttaacctgctggacccactgaagtaccacatgaaacattgctgccccgacatgataactaagttccttggggtgatcgtgaaatcagagcggccatgcgacgaagataaaaccgattccgaaacaggcaagctgatcatgcttgtgaatgaattttactacgggcgacacgagggggttactgagaaggagccaaagacctatacaacatttaagtgtttctcttgctcaaaagttttgaagaacaatattagattcatgaatcatatgaaacaccaccttgaactagagaaacaaaacaacgagtcttgggagaaccacactacgtgccagcactgctataggcagtacccgacgccatttcaactacagtgccacatcgaaagcacacacaccccccacgagttcagtacgatttgcaagatttgcgagttgtcctttgagacggagcacattttgttgcagcatatgaaggatacccataagcccggggaaatgccgtacgtttgtcaagtatgtcagttcagaagctccacattttctgacgtggaggctcattttagggcagcccatgagaataccaagaatctgctctgtccgttttgcttaaaagtgagcaagatggcaaccccgtacatgaaccattacatgaagcatcagaagaaaggcgttcatcgttgccctaagtgccgactccagtttctgaccagtaaagaaaaggctgagcataaggctcagcacaggacatttattaagcccaaggagctcgagggcctcccacctggggccaaagtcactatccgtgcttccctagggcccctccagtcaaaattaccaaccgcacctttcggctgtgcgccaggcacttcattcctgcaagtcactccccccacgtcacaaaataccaccgccaggaatccccgcaaatccaacgcatcccgcagtaagaccagcaaactccacgccacgacttccactgcgtctaaagtcaacacatccaaaccacgcgggcggattgctaagagtaaggccaagccttcttacaagcagaaacgtcagaggaaccgaaaaaacaaaatgagcctcgccctcaagaacattaggtgtagaaggggcattcataagtgcatcgaatgtcactcaaagattaaagattttgcctctcacttcagcatttatatccactgtagcttttgcaagtataataccaattgtaataaggctttcgtaaaccacatgatgtcctcccattctaatcatccaggaaagaggttctgcatttttaaaaagcacagcggcactctaagaggcattactttagtctgtttgaagtgcgactttctagctgattctagcggtctggatagaatggccaagcacctgtcacagcgtaagacccatacctgtcaagtcattattgaaaatgtcagtaaatctacatcaactagcgaaccaactaccgggtgctctctgaagtag

SEQ ID NO: 14000 - DNA, 1833 bp, Artificial Sequence
  Description of Artificial Sequence: Synthetic coding sequence
atggatgatgacaagcctttccaacccaaaaatatatccaaaatggctgagctcttcatggagtgtgaggaggaagaactggaaccgtggcaaaaaaaagtggaagaaacccaggatgaggatgatgatgagctcatattcgtcggagaaatttcctcatctaagcctgccattagtaacatcctgaatcggggacactcaagcagcagtagcaagggaattaagagtgagccccactcacctgggatccccgaaatattccgcacagctagtcaacgatgcagggaccctcccagcaaccccgtcgctgcttctccacggtttcacttggtgagcaaatcctcccaatcctctgtaacggttgaaaacgcgtcaaagcccgactttactaaaaacagtcaagtaggctctgataattcttccatcctgttattcgattctactcaggagagcttgccgccttcccaggacatacccgctatctttcgcgaggggatgaaaaacactagttatgtgctgaagcatccatccacatctaaggtgaattctgtgactcccaagaaaccaaagacatccgaagacgtgccacaaatcaatccaagtacaagcctccccctgatcggctcgccccctgtcaccagctcacaggtgatgctatccaagggaacaaacacttcatcaccctacgatgccggtgcagactatctccgtgcctgtccaaaatgtaacgtgcagtttaacctcctggaccccctgaagtaccacatgaagcactgttgccccgacatgatcacaaaatttctgggcgtaattgttaagagcgagcggccctgcgatgaagataagactgattcggagaccgggaagttgatcatgctcgtgaacgagttttattatggaaggcatgagggcgtcacagagaaagaacccaagacctatacaactttcaaatgtttttcatgcagtaaggtcctaaaaaacaacatcaggtttatgaatcatatgaagcatcatttagaactggaaaagcagaacaatgagagctgggagaatcacaccacgtgccagcactgttaccgacagtacccaactccttttcagcttcagtgtcacatcgagtcgacccacacaccacacgaattttccaccatttgtaaaatctgtgagctatcctttgagaccgagcacattctgcttcagcatatgaaggacacccacaagccgggtgagatgccctacgtgtgtcagaaaaagggtgtgcaccgctgccccaagtgtcgacttcagttccttaccagtaaggagaaggctgagcacaaagcgcagcatagaacctttataaaaccgaaggagttggagggtcttccaccgggtgccaaggtgacaatcagagcgagccttggtcccctgcagtcaaagctgccgaccgctccgttcgggtgtgcacccggtacttcattcctgcaggttacccccccgactagtcagaatacaacagctagaaatcctcggaaatcgaatgcttcccgatctaagacctcaaagctgcacgcaaccacatctacagcatctaaagttaacacctccaaacccaggggccgtattgcgaagagcaaagctaaaccttcttacaagcaaaaaagacagaggaacagaaagaataagatgagtctggccctgaaaaatatccggtgccgccggggcatacataaatgcatcgagtgccattctaaaattaaagattttgctagccatttcagcatttatatacattgtagtttctgtaaatacaataccaattgcaacaaagcgttcgtgaatcatatgatgtag

SEQ ID NO: 14001 - DNA, 909 bp, Artificial Sequence
  Description of Artificial Sequence: Synthetic coding sequence
atggccggcatgtctgaatcctcatttctttcaaagcgtccttctacttccgaggtcaataacgtgaatccgaaaaagcccaaaccgagtgaatccgtgagcggtgctaacagctcagctgtgctcccctccgtgaagagcccctcagttacttctagccaggctatgctggctaaaggaaccaacactagctcaaaccaaagcaagaacggcacccccttcccccgcgcctgtcccaagtgcaatattcatttcaacctgctggaccctctaaagaatcacatgaagtattgttgtccggacatgattaacaactttctgggcctcgctaaaacagagttttccagcactgttaataagaatactaccatcgacagcgaaaaggggaaactcatcatgctcgtgaatgacttctactacggcaagcacgagggcgatgtgcaagaagaacagaagactcacacgacgttcaaatgtttcagttgtcttaagatccttaagaataacatcaggttcatgaatcacatgaaacatcatctggagctggaaaaacaatcgtccgaaagttgggaaaatcacactacctgccagcactgctatagacagtttcccacgccgttccagctgcagtgtcacattgagtctacacacaccccacacgagttctccactatctgcaaaatctgcgagctgtcttttgagacagaacatgtcctgctccagcacatgaaggataatcacaagccaggtgaaatgccttacgtttgtcaggtttgcaactacagaagttccagtttctccgacgtggagacgcatttccgtacaagtcacgagaatactaaaacttgctatgcacgctttgctagcaaactcttgaagctgcagcaccacatctgcatcattatttag

SEQ ID NO: 14002 - DNA, 2940 bp, Artificial Sequence
  Description of Artificial Sequence: Synthetic coding sequence
atgggggataacccctttcagcccaaatccaatagcaagatggcagagctgtttatggaatgcgaagaggaagagctagaaccctggcagaagaaagtgaaggaggtcgaagatgatgacgatgatgagcccatctttgtgggggaaatctcttccagtaagccagccatttctaacatcttgaacagagtgaacccatccagctattcccgtgggcttaagaatggagctctcagcagaggcatcacagctgcatttaaacctacctcccagcattacaccaatcccacatcgaatccggtgcccgcctcgcctatcaatttccatccggagtctcggtcaagcgacagtagcgttattgtacaacctttctctaaacctggatatataacaaacagctcccgcgtggtttccaacaagtccagcgagttattgttcgacctgacccaggacactggcctcagccattatcaggggggccctacattatctatggctgggatgtctgagagctcattcctatccaagagaccttcaaccagtgaggtgaacaatgttaatcccaaaaagcccaagccctctgagtctgtctccggagcaaactcctcagccgtcctgccctcagttaagagcccttccgtcacttcaagccaggccatgttggctaagggcactaacacttcctctaaccagtcaaagaacggcaccccttttccaagagcctgccctaaatgcaacattcactttaatctgcttgaccccctgaaaaatcacatgaaatattgctgtcctgatatgatcaacaatttccttggtcttgccaagaccgaattctcaagcactgtgaataagaacaccactattgatagcgagaaaggtaaacttatcatgcttgtgaatgatttttactatggaaaacacgagggcgacgtccaggaggagcaaaaaacccataccaccttcaagtgtttttcctgcctgaaaatcctgaaaaacaatatcagattcatgaaccacatgaagcatcatttagagttagaaaaacaatctagtgaaagctgggaaaaccatactacctgccagcactgttaccgccaatttcctacccccttccagcttcagtgccacatcgaatcaacccacacgccgcacgagttctctactatctgcaaaatttgcgaactgagctttgagacagagcacgtactgctacagcatatgaaggataatcataagccgggagaaatgccctatgtttgtcaagtatgtaattatcggtcctcatcattctctgatgtagagacgcacttccgtacatcacacgaaaacactaagaatctcctctgcccattctgcctaaaagtgataaagattgctacaccatacatgcatcattacatgaaacaccagaagaaagggattcatagatgcactaagtgccgtctacagtttctgacctgcaaagaaaagatggaccacaagacccagcaccaccggactttcataaagcctaaacagttagagggcctgccacctggaaccaaggtgacaatccgggctagtgtcggccccctgcagtctggtgctagccccactccctcaatttctgcttccgcctcgaccctgcagctgagtccgccaagaacgaaaaatatcactgcgaagaaccccgctaaatctaacacctcaaagcccaacacagtgaaaagtaatgcgtccaaacccaatacaagtaagccaaatgggagtaagtccaagtacaaaccgaagattagtaacatgcagaaaaagcagtccacgttagcctcatcgaataagaagtctaaggtcaatacagcactgcgaaatctgcggtaccgcaggggcatacacaagtgtatcgaatgttgttccgagataaaagacttcgccaaccacttcccaacttacgtgcactgtagtttctgccggtacaatacgtcatgttccaaggcctatgttaaccacatgatgtccttccatagtaacaggccctctaaacgattctgtattttcaaaaagcacagtgaaaacctgaggggtattaccctggtttgcctgaattgtgactttctgtccgacgtttcaggcctggataatatggcaactcacctgtcccagcacaaaacacatacttgccaggtggtgatgcagaaggtgagcgtctgtataccgacttctgagcaccttagcgagctgaagaaagaggcgccagctaaggaacaggagccagtgtcaaaggagatcgctcggcctaatatggcagagcgcgaaacagaaaccagtaactccgagtcaaagcaggacaaggcagcctcatctaaggagaagaatggctgcaacgcaaacagcttcgaaggaagctccactacaaaaagcgaagaaagcataacggtgtcagacaaggaaaatgaaacgtgtctcgctgaccaggaaacagggagcaagaacatcgtctcttgcgattccaacattggtgcagataaagtggagaagaaaaagcaaatacaacatgtttgccaggaaatggaactgaagatgtgccagtccagcgagaatattattctctccgaccagatcaaggaccacaacagcagtgaagcccgtttttccagcaagaacattaaggacttgaggcttgctagtgataatgtctctatagaccaattcttgagaaaacgacacgagcctgagagcgtatcctctgacgtctctgaacaaggcagcatccatctggaacccctgacaccgtccgaggtgcttgagtacgaggctaccgagatcctgcagaaggggagcggagatccctctgcgaagactgatgaagtggtcagcgaccaaactgacgacataccaggaggcaataacccttccacgaccgaagccaccgtagatctcgaggacgaaaaagagcggtcgtag

SEQ ID NO: 14003 - DNA, 1266 bp, Artificial Sequence
  Description of Artificial Sequence: Synthetic coding sequence
atgttagtcaatgatttttactacgggaagcacgagggtgacgttcaggaagaacagaagacacacaccacttttaagtgcttcagctgcttgaagatcctgaagaacaacatccgtttcatgaatcacatgaagcaccacctcgaacttgagaaacagtcatccgaatcttgggagaatcacacaacgtgtcagcactgctaccgccaatttcctacccctttccagctgcagtgtcacatcgagtcaacacatacaccacacgaattttcaacgatctgcaagatctgtgagctgagcttcgagactgaacacgtcctgctgcagcacatgaaagacaatcataaacccggagagatgccatatgtttgtcaggtctgtaactacagaagtagcagtttctcggatgttgaaactcactttaggacaagccacgaaaacaccaaaaacttattgtgccctttctgtctgaaagtaattaaaatcgcgacaccatacatgcaccattacatgaagcatcagaagaagggcattcacagatgcacaaaatgccgtctacagtttctgacctgcaaagaaaagatggatcataagacgcagcatcataggacgtttatcaagccgaagcagttggagggactgccgccaggaaccaaagtaacaatacgggctagcgtaggacctctgcaatcgggagccagtccaaccccatccataagcgcatcggcgtcaacactgcagctgagtcctcctcgcaccaaaaacattaccgccaagaatcctgccaagtctaatacaagtaagcctaatacagtaaagtctaatgcctcaaaaccgaacacgtctaaacccaatggcagtaagtcaaagtataagccaaaaatatcaaacatgcaaaaaaagcaatccacgctggctagctctaataagaaatcaaaagtgaatacggccttgcgcaatttaaggtaccggagggggatacacaaatgcatcgagtgttgtagtgagatcaaggacttcgcgaatcactttcctacttatgtccactgctctttctgtcgctataatacctcctgctccaaggcctatgtcaatcacatgatgtccttccacagcaaccgaccgagcaagcgattttgcatctttaaaaagcatagcgaaaatcttcggtgtgttggcgggcagattgaatgtgacttgcccaaactgcataaacttgtcgtcgagccgcgacttactttaggcctgttgaccccaaacttctag

SEQ ID NO: 14004 - DNA, 2901 bp, Artificial Sequence
  Description of Artificial Sequence: Synthetic coding sequence
atggcagaactgtttatggaatgcgaggaagaagagctggaaccttggcagaagaaagtcaaggaggtggaagatgacgatgacgatgagcccatttttgtgggcgagattagctcgtcaaaacccgccatctccaacattcttaatcgggtaaatccctctagctacagccgcgggctgaagaacggggcactgtcgagaggaataactgcggctttcaagcccacctcacagcactatactaaccccacttctaaccctgtccctgctagtcccatcaattttcacccagaaagccggtcctcggacagcagtgttattgtgcagccgttcagcaaacccggctatataacaaatagcagtcgcgtggtttctaataagagtagcgaactgctgtttgacctgactcaggatacaggcctgtctcactaccagggtggacccaccctgtcaatggccggaatgtccgaaagcagcttcttatctaagaggccatctaccagcgaagtgaataacgttaacccgaaaaagcctaagccttccgagagcgtgtccggtgcaaacagctcagctgtgctgccctccgttaaaagccctagcgtgacgagctctcaggcaatgctcgctaagggtactaacaccagttctaaccagtcaaaaaacggcaccccctttccaagggcatgtccaaagtgtaacatacatttcaatctactggatcccctaaagaaccatatgaagtactgttgcccagatatgatcaacaactttctgggattggcgaagaccgagttttctagtactgtcaataagaatactacaatagatagcgagaaggggaagctcattatgctggtgaacgacttctactacgggaagcacgagggggacgtgcaggaagaacaaaaaacccacacaaccttcaagtgtttcagctgcctgaagattcttaaaaataatatacgctttatgaaccacatgaagcatcatctggaactcgaaaagcaatccagcgaatcctgggagaatcacacaacctgtcagcactgttatagacaattccccaccccttttcaattgcaatgtcatatcgaaagtacgcacacccctcatgagttttccacaatctgtaagatctgcgagctgtcgtttgagaccgaacacgtgctcttgcaacacatgaaggacaaccataaacccggagagatgccctatgtctgtcaggtttgcaattataggtcttctagtttcagtgacgtcgaaacacatttcagaacaagccacgagaacaccaagaatctcttgtgtccattctgtttgaaagtgatcaaaatcgccaccccctacatgcatcattacatgaaacaccagaaaaaggggatccatcgatgtacaaaatgcaggttgcagttcttaacatgtaaggagaaaatggaccacaaaacgcagcaccataggacctttatcaagccgaagcaattggaggggttgccccctggcaccaaggttactattagggcttctgtggggccactgcagtcaggcgccagcccaacaccatctatcagcgcaagtgcatccacacttcagttgtccccccctcgaactaaaaacattacagctaaaaaccctgcaaagtccaatacttcaaagccaaataccgttaagagcaatgcaagcaagcccaacacttcaaaaccaaacggctctaaaagcaagtataaacccaagatctcgaacatgcaaaaaaaacagagcacgttggcctcttccaataaaaaatccaaggttaacaccgccctgagaaatctcagatatcgaagagggattcacaaatgcatcgagtgttgctcagagatcaaggactttgctaaccattttccaacgtacgtacactgctccttctgccgatacaataccagctgctcgaaggcatatgtcaaccatatgatgtcctttcactcaaaccggccctctaagaggttctgcattttcaaaaaacattctgagaaccttcggggaatcacactcgtctgcctgaactgcgattttctctccgacgtatctggattagataacatggctactcatctgagccaacataagacccacacatgccaggtcgtaatgcagaaagttagcgtatgtatcccaacaagcgaacatctgtctgaactgaaaaaagaggcgccagcgaaagagcaggagcccgtgagtaaagagatcgcgcgcccgaatatggctgagcgggaaaccgagacttcaaatagcgagtcaaagcaggataaggctgccagtagcaaagagaaaaatggatgcaatgcaaactcgtttgaaggaagcagcacaactaaatccgaggaatccattaccgtatctgacaaagagaatgagacatgccttgcagatcaggaaaccggatccaaaaatattgtgagctgtgatagtaatattggggctgacaaggtggagaagaagaaacagatccagcacgtttgtcaagagatggaactgaagatgtgtcagtctagcgaaaatatcatcctgagcgatcagattaaggatcacaatagtagtgaggcaagattctcctccaagaacattaaggacttgagactggcgtctgataatgtgtccattgatcagttcttacggaaacggcatgagcctgagtccgtctccagcgacgttagtgagcaagggtcaattcaccttgaaccactgacccccagtgaggttttggagtatgaggcaacggaaattctgcagaaaggctctggtgatccctccgccaaaactgacgaagtagtgagtgaccaaaccgacgacatccctgggggaaacaacccatcgactacagaggctacagtcgatctagaagatgagaaggaacggtcctag

SEQ ID NO: 14005 - DNA, 2244 bp, Artificial Sequence
  Description of Artificial Sequence: Synthetic coding sequence
atggctgagctgttcatggagtgcgaggaggaggaactggaaccatggcagaaaaaggtaaaagaggttgaggacgatgacgatgatgagcccatctttgtcggcgaaatctccagtagcaagcctgccatatcaaacatcctgaaccgggtgaaccccagctcctactcccgcggcctgaagaatggagccctctcccgcggcatcaccgcagcttttaagccaactagtcagcactatacaaatccaaccagcaacccagtacccgcttccccaatcaactttcaccccgaaagccgatcatctgacagctccgtaatagttcagccatttagcaagcccggttatattacaaattccagccgcgtagtgagtaataagtcaagcgaattgttgtttgacctcacgcaggatacaggcctgagccactaccaaggcggaccaaccttgtctatggctgggatgtctgaatccagtttcctgagtaagcgtccttccaccagcgaagtcaataatgtcaatcctaaaaaaccaaaaccctcagaaagcgtgagcggggctaattcatccgccgtactaccctccgtaaaatctccatctgtgaccagctcgcaggctatgctggctaagggtactaatacctcaagtaatcagagcaagaacggtacaccttttccacgggcgtgcccaaagtgcaacatccactttaacctcttggatcccctgaaaaaccatatgaagtactgttgtccagatatgatcaataatttcctcggattggcaaagacagaattctcctcgacagtcaacaagaatacaaccatcgatagcgaaaaaggcaaactcatcatgcttgtaaacgatttctactatggaaaacatgaaggcgatgtgcaggaagagcaaaagactcataccaccttcaagtgcttctcatgtctgaagattttaaaaaataatatcagatttatgaatcatatgaaacaccacctggagctcgaaaaacagtcttccgaatcatgggaaaatcacaccacgtgccagcattgctacaggcaattccctactccattccaactgcaatgccatatcgagagcacacacacacctcatgaattttccaccatttgcaagatttgtgaactttcattcgagactgaacacgttcttctgcagcatatgaaggataaccacaaacccggagagatgccatacgtttgtcaggtatgcaactataggtccagctctttttcagatgtagagactcacttcaggacctctcatgagaacacgaaaaatctgctatgcccattttgtttgaaagtaattaaaattgcgaccccctacatgcatcattatatgaagcatcagaaaaagggaatccatagatgcacgaagtgtcggcttcagttccttacttgcaaagaaaaaatggaccacaagacccagcaccaccgcacatttattaaacccaagcagctggaggggctcccaccaggtacaaaggttaccatcagggccagtgttggaccactgcagagcggagcttctccaacccctagtatcagcgcctctgccagtactctgcagctctcaccccctcgaaccaaaaatattacggctaaaaatccggccaagtcaaatacatctaagcctaacacggtgaaatccaatgcctcgaagccaaacaccagcaagcccaacggcagtaaaagcaaatataaaccgaaaatttcaaacatgcagaaaaagcagagcacacttgcatctagtaataaaaagagtaaagtgaacacggccctgcgtaacctgcgataccggaggggaatccataaatgcatcgagtgctgctctgagataaaggactttgccaaccacttccctacttacgtacactgcagtttttgtaggtacaacacctcctgttccaaagcatacgtgaatcacatgatgtctttccactctaaccggccaagtaagcggttctgcatctttaaaaaacactctgagaatctgagaggcattacactggtgtgcctgaattgcgatttcctttcagatgtgtcaggcctggacaatatggctactcacttgtcccagcacaagacccatacttgtcaggtcgtcatgcaaaaagacgcggaagccgcgcagaggttccagaaaatcagccgagtatatctggatagcgtcccactaagatggacccagcttatgccagtgctttcatttcagggcatgtag

SEQ ID NO: 14006 - DNA, 243 bp, Artificial Sequence
  Description of Artificial Sequence: Synthetic coding sequence
atgggcgataacccttttcagccaaagtccaacagtaagatggccgagcttttcatggagtgcgaagaggaggagttagagccttggcagaaaaaggtgaaagaggtggaggacgacgatgacgatgagcctatatttgtgggggagatcagcagctctaagcctgccatctccaatattcttaatcgagtcaatccctcatcgtacagcagaggcctcaagaacggtgctctttctaggtag

SEQ ID NO: 14007 - DNA, 477 bp, Artificial Sequence
  Description of Artificial Sequence: Synthetic coding sequence
atgggggacaatccattccaacccaaatctaatagcaagatggctgaactgttcatggaatgcgaggaagaggaactggagccgtggcaaaaaaaggtaaaagaagtggaagacgatgacgacgacgagccaatttttgtcggagagatttcctctagcaagcctgccatatccaatatactgaatcgagtcaaccccagttcttattcaagagggcttaaaaatggcgccttgtcgcgggggattacggccgcatttaagcctacgtcacagcactacactaacccaacatccaatcctgttccagcctccccgattaacttccatccagagagcaggagttctgacagcagcgtgatcgtccagccattctctaaacccgtgtcagtttctaagaccattaggccagcacagggctcgatcgggtgttgcctgagcatttcaacggtgccatcttacaacagcgggctatcctag

SEQ ID NO: 14008 - DNA, 2901 bp, Artificial Sequence
  Description of Artificial Sequence: Synthetic coding sequence
atggctgagttgttcatggagtgcgaggaggaagaattggagccctggcagaaaaaagtgaaagaagtggaagacgacgatgacgacgaaccaatcttcgttggggagatctcatcgtcaaaacctgctattagtaatatccttaaccgcgtgaaccctagctcatacagtcgtggcctgaaaaacggagcattgtcccgtggtattacagccgcctttaaacccacatcccagcactacacaaacccgaccagcaacccagtccctgcttccccaattaacttccatccagaatcccggtcatcagattccagcgtcatagtacaacctttttcgaagcccgggtatattaccaattcatccagagtggtctctaataagagcagcgaactcctcttcgatttgacgcaagatactgggctgtcccactatcagggcggacctactctcagcatggctggaatgtcggaatctagttttctgtccaaacgcccatcaaccagcgaagtcaacaatgttaaccctaagaaacctaagcctagcgaatctgtgtccggtgcgaattcgtccgccgtgctgccaagcgtcaagtctccctcggtgacatcttcccaagcgatgctggctaagggaacgaacacgagcagcaaccagagtaagaatgggacgcctttccccagagcttgtccaaaatgtaacatccacttcaatcttttggatcctctgaaaaaccacatgaagtactgttgtcccgatatgatcaacaatttcctgggcctggcgaagactgagttctcatctacagtcaataagaacacaaccatcgattccgaaaagggcaaattgatcatgctggtgaatgacttttattacggcaagcacgaaggcgatgttcaggaagagcagaaaacacacaccacattcaagtgcttttcatgcttaaagattttaaaaaataacatcagattcatgaatcatatgaagcaccatctggagttagagaagcagagctccgaatcctgggagaatcacactacctgtcaacactgctacagacagttccccacgcccttccagcttcaatgccacattgagtctactcataccccacacgagtttagcacaatatgcaaaatctgcgagctgagctttgaaacagagcacgtgcttctccagcacatgaaagataatcacaagcctggggaaatgccatacgtctgtcaggtctgtaattaccggtcctcatctttctcggatgtggagacacattttaggacaagtcacgagaataccaaaaatctcctttgtcctttttgtctgaaggtcatcaaaatagcaacaccatatatgcaccactacatgaaacaccagaagaaaggcattcaccggtgcacaaagtgccgccttcaatttctcacctgcaaggagaaaatggatcacaagacccagcatcatagaaccttcataaaacctaagcaactggaaggcctgccacccggtactaaggtgacaatccgcgcgtctgttggccccctgcagtccggtgcttcgccaacccccagtatttctgcctcagcaagcactttgcaattatccccacctagaaccaaaaacataaccgcaaaaaacccagctaaatctaatacctcgaagccgaacaccgtgaaatctaatgcctccaagcccaacacctccaaacccaacggcagcaaatccaagtataagcccaaaattagcaacatgcagaagaagcagtcgactctggctagttccaacaagaagagcaaggtgaacacagcccttcgaaatctccggtatagaaggggaattcataaatgtatcgaatgttgcagcgagattaaagattttgccaatcatttccccacttacgtgcactgctctttttgcaggtataacacatcttgcagcaaggcatatgtcaaccacatgatgagttttcactctaatcgcccatccaaaaggttttgtatctttaagaagcactctgagaacctgcgcggtataacactggtctgtttgaattgcgacttcctatccgatgtatcagggctggataacatggcaacacacctaagtcagcacaaaacccacacgtgccaggtagtcatgcagaaggtctctgtctgtatccccacttctgaacatctgagtgagctgaaaaaggaggcccctgccaaggaacaggaacccgtatcaaaggagatcgcgcgtccaaacatggctgagagggagacagaaacaagcaactccgagagtaagcaggataaggctgcgtcctctaaggagaagaacggctgcaacgcgaattcattcgagggaagcagtaccaccaagtcagaagagagcataacagtgtctgataaagagaatgaaacctgtctggcggaccaggagaccggatcaaaaaacatcgtgtcttgtgacagcaatattggagcagacaaggtggagaagaagaagcagattcagcacgtgtgtcaggaaatggaactgaagatgtgccagtcttcagagaacataattctgtcagatcaaatcaaagaccacaacagttctgaggcccgattcagctcgaagaatattaaagacttgcgcctggcatcagacaatgtctctatcgatcagttcctgcggaagcggcacgagcccgaatcagtgtctagcgacgtctcagaacagggcagcattcatctggagccattaaccccgtctgaggtgctcgaatatgaagccaccgagattcttcagaaaggaagcggagacccaagcgcaaagaccgacgaggtggtgtctgaccagaccgacgacatccccggtggtaacaatccaagcactaccgaggcaaccgttgacctggaggatgaaaaagagaggagctag

SEQ ID NO: 14009 - DNA, 2688 bp, Artificial Sequence
  Description of Artificial Sequence: Synthetic coding sequence
atgaaaattggcagtggttttctatctggaggagggggaactggctcctccggcggctcaggatctggaggcggtggctcaggtggcgggggaggcggaggttcctcgggcaggagggccgaaatggagcccacattcccccaaggtatggtgatgttcaatcataggctgccaccagtgactagtttcacaagacccgcaggctcggccgcacctcctccacagtgcgtgctgtcaagcagtacttctgcggctcctgcagccgagccccctcctcctcctgccccagatatgactttcaagaaagagcccgcagcttccgccgcggctttcccctcccagcgtacctcttggggcttcctccaatccctcgtatctataaaacaggagaaacctgctgaccctgaggaacaacaatctcatcatcaccaccaccatcatcactacggaggtctttttgcgggcgcggaggagaggagtcctggcctgggtggaggagagggaggcagccatggcgtgatccaggacctgagtatactgcaccagcacgtgcagcagcagccagcccagcaccaccgggatgtcctgttgtcttccagctcccggaccgatgatcaccacggtacggaggagcctaaacaagacacaaatgtgaagaaagccaagagacctaagcccgagtcgcaggggataaaggctaaacgcaagccgtccgccagctctaagccctctttagttggtgatggcgagggagctattctttcaccttctcaaaagcctcatatctgcgaccactgtagtgctgcatttcgcagtagttatcatcttaggaggcatgtcctgatacacactggggaaagaccattccagtgttcccagtgtagtatgggcttcatccagaaatacctgcttcagcgacacgagaaaattcactcccgagagaagccctttgggtgtgatcagtgttctatgaaattcattcagaagtaccatatggagcggcataagcgtacacatagcggagagaaaccatacaagtgcgatacttgccaacagtacttctcccgaacagaccgattgctcaaacacagacgcacctgcggcgaggtgattgtgaaaggggccacatccgctgagccaggatcctccaaccacactaatatgggcaatctggctgtgctctctcaaggaaatacctcctctagcagacggaaaaccaaaagcaaatccatcgccattgagaacaaggaacaaaagactggcaaaaccaacgaatcccaaatcagcaacaatataaatatgcagagttatagcgtggagatgccaaccgtgtccagctcggggggcatcattggtacgggcattgacgagctgcagaaacgtgtgcccaagttgatattcaagaaggggtcccgaaaaaatacagataaaaactatctcaactttgtgagccctcttccagacatcgtagggcagaaatcactgtccgggaagcctagcggcagtctgggcatagtcagcaacaattcagtggagaccatcggactgcttcagtcaacctctggcaaacagggtcaaatctcaagcaactacgacgacgcaatgcagttcagtaaaaagagaagatacctgccgactgccagttccaactcagccttttctatcaatgtgggacacatggtgagccagcaatcagtcatccaaagcgccggggtctctgtgctggataacgaagccccactcagcctcattgactcgagcgccctgaatgcagagatcaagtcttgtcatgataaatcggggattcccgacgaagtgctgcagagcatacttgaccagtatagcaacaaaagcgaatctcagaaggaagatcccttcaatattgccgaacccagagtggaccttcacactagcggagagcactccgagcttgtccaggaagaaaatttgtcccccggcacccagaccccctcaaatgataaggcttccatgctgcaggagtattcaaaatacctgcagcaagccttcgaaaagagtacaaacgcgagcttcactcttggacacggctttcagtttgtctcacttagcagccctctccataaccacaccctctttcccgagaaacagatatacacaaccagccctctcgagtgcggcttcggccaatccgtgacctctgtgcttccctctagcttgccaaagcccccattcggtatgttgttcggatctcaaccaggattatacctcagtgcgctcgatgcaacacatcagcaattgaccccttcccaggaattagacgacctgattgacagccagaaaaatctggagactagctcggccttccagtcatcatcccagaaactgacatcgcaaaaagagcagaagaacctggagagttctaccgggtttcagattccgagtcaggaactcgcctcacagattgatcctcaaaaggacatcgagcccagaactacataccagatcgagaattttgctcaggcctttgggtctcagtttaaatcgggctcaagagtgcctatgacctttattaccaatagcaacggcgaggtggatcaccgggttcgcacaagcgtgagcgatttctctgggtacaccaacatgatgagtgatgtttctgaaccctgctctacacgggtgaagactccaacttcccagtcctaccgttag

SEQ ID NO: 14010 - DNA, 2580 bp, Artificial Sequence
  Description of Artificial Sequence: Synthetic coding sequence
atgaagatcggctccggcttcctatccggtgggggaggcacgggatcctccgggggatctgggagtggaggtggtgggagcgggggaggggggggggggggatctagtggcaggcgcgccgaaatggagcccactttcccccaagcacccgctgcagagcctcctccccctccagccccagacatgacgtttaagaaggaacccgccgccagcgctgcagctttcccctcccagcgcacctcttggggatttcttcagtccctggtctctatcaaacaggagaagcccgcagatccagaggagcagcaaagccaccaccaccaccaccaccatcactacggaggactctttgcgggggcagaggagcgctctcccgggctgggaggtggcgaagggggaagccatggggtcattcaggatctgtccatcttgcatcaacacgtgcagcagcaaccagctcagcatcaccgcgatgtgctgctcagcagtagcagccggacagatgatcaccacgggaccgaagagcccaagcaagacacaaacgtaaaaaaagccaaacgccctaaacctgagtctcaaggcatcaaggcaaagaggaaacccagtgccagttccaagccatccctggtaggtgatggtgaaggggccattcttagtccctcccaaaagccgcacatctgcgaccactgttccgccgcctttcgctcttcctaccacctccgccggcacgttctgattcacacaggcgaaagacctttccaatgtagccaatgctcaatgggatttatccagaaatacctcctccagcgacatgagaagatacatagcagggagaagccatttgggtgcgaccaatgcagcatgaaattcattcagaagtatcacatggagagacacaagcggacccattctggagagaaaccttacaagtgtgacacatgtcaacagtatttctctcggactgatcgactccttaaacatcgcagaacatgcggtgaggtgattgttaagggcgcaactagcgccgagcctggcagctccaatcacaccaacatgggtaatctagccgttcttagtcagggaaatactagctcgagccgcagaaagacaaaaagcaaatctattgccatcgaaaacaaagaacaaaagacaggcaagaccaatgagtctcagatttctaacaatatcaatatgcagagttattcagttgaaatgccaacggtgtcctcctctggtggcattattggaaccggtattgatgaactgcagaagcgcgtccctaagctcatatttaagaagggcagcagaaaaaacacagataaaaattatctcaacttcgtcagcccactgcctgatattgttggccagaaaagtctaagcggaaagcctagcggaagcttggggatcgttagtaataactcagttgagaccatcggcctgctgcagagcacctcagggaagcagggacaaatcagctcaaattacgacgacgccatgcaattttccaagaagagacggtatctcccaacggcttcaagcaatagtgccttctcaatcaacgtcggtcacatggtatctcagcagtcagtgattcaatccgccggagtgagcgtcctagacaacgaggctcctctaagtcttattgatagcagtgccttaaacgctgaaattaagtcctgtcacgataagagtggaattcctgatgaagtcttacagtcaatcctggatcaatactcaaacaaatccgaatcccagaaggaagacccgtttaatatcgctgaaccgcgggtagatctccacacctccggggagcatagcgagctggtacaggaggagaatctatcgccaggtactcaaaccccaagcaacgacaaggctagcatgctgcaggagtactcgaagtacctccaacaagcctttgagaagagcacaaatgcttcatttaccctaggacatggattccaatttgtttccctctcttctcccctacataaccataccctgttcccggagaagcagatatatacaacaagtcctctggagtgtggctttggacagagtgtcacgtccgttctcccttcctcattgccaaagccacccttcggaatgctcttcggctctcagcccgggctttacctcagcgctcttgatgcaacccatcaacagctaaccccttcccaggagttagacgaccttattgattcccagaagaatcttgagacttcaagcgcctttcaatcatcctctcagaaactcacgtcacagaaggagcaaaaaaacctggaatcctcaacgggcttccagataccatcgcaagagttggcctcgcagatagatccgcaaaaggacatcgaaccgcgtactacctatcagatagagaactttgcccaggcgtttggcagccaatttaaatcaggcagtagagtcccaatgacattcattaccaattcaaatggtgaggtcgaccacagagtgcggaccagtgtgagtgacttctccgggtatacaaacatgatgagtgacgtttctgagccctgctctacacgggtcaagaccccaaccagtcagagttaccgctag

SEQ ID NO: 14011 - DNA, 2688 bp, Artificial Sequence
  Description of Artificial Sequence: Synthetic coding sequence
atgaagatcggttccgggtttttgtccggcggcggagggaccggtagttccggcggcagcggatctggtgggggtggcagcggagggggtgggggcgggggatcctccggcaggcgtgcagaaatggagcctacattcccccagggcatggttatgtttaatcaccgcctgccaccagtgactagctttacgcggcctgcagggagtgccgctcctcccccacagtgtgtgctaagctcttcaaccagtgcagcccccgctgcggaaccaccacctccccccgcacccgacatgacgttcaaaaaggagcccgccgcttcagccgccgcctttccttcccaacggacatcttggggatttctccagtcgctggtctcaatcaaacaggagaaacctgcagacccagaagagcagcagtcacatcatcatcatcatcatcaccattatggcggtctcttcgcgggggccgaagagcgatcccccggcctgggtggaggcgaaggagggagccatggggtaattcaggatctctcaatactgcatcagcacgtgcagcaacaacctgctcaacaccaccgggacgtgctgctcagctctagcagcagaaccgatgatcaccatggcacagaggagcccaagcaagataccaacgtgaagaaggccaagaggcctaaacccgaatctcagggaatcaaagcaaagcgtaagccctcagcctctagcaaaccatctctagtgggcgatggggaaggcgccatcctttccccatcccagaagccacacatttgtgaccactgcagcgcagccttccgatcaagttatcatctgcggcgacacgtgctgatccatacaggcgagcgcccattccagtgttctcagtgctccatgggctttatccagaagtatctgctccagagacacgagaaaatccactcacgtgagaagccattcgggtgcgatcagtgttccatgaaatttatacagaagtatcatatggaacggcacaagcgcacccactccggtgagaaaccatataaatgcgatacgtgccagcagtacttttcacgaaccgatcgtttgctgaaacaccgccggacgtgtggcgaagtgatcgtcaagggggccacaagcgccgagcccgggtcatcaaatcataccaacatggggaatcttgccgtgctgtcccaaggcaatacatccagcagcagacgaaagaccaagtccaaatccatcgcaattgagaacaaagagcaaaaaactggaaagaccaacgaaagccagatctccaacaacatcaacatgcaatcctatagtgtggaaatgccaacagtcagctcctccggaggcataatcggtacaggcatagacgagctccagaagagagtgccgaaactgatcttcaaaaagggatctcgcaaaaatacagacaagaattatctgaatttcgtgtcgcccctgccagacatcgtggggcagaagtcactttctggcaagccgtccggctctctggggattgtatccaacaactccgtagagaccattgggctgctccagtccacttccgggaagcagggacagatttctagtaattacgatgatgccatgcagttctccaagaagaggaggtacttacctacagcctctagcaacagtgcctttagtattaacgtaggtcacatggtctcgcagcagtccgtcatacaaagtgctggagtctcagtgctagataacgaggctccattaagcctgatagacagttcagcccttaacgccgagataaagagctgccacgacaagagcgggatacctgacgaagtgctgcaatcgatactagatcaatactcaaataagtccgagtctcagaaagaggatccattcaatatcgctgagccaagagttgacttacatacctcaggcgagcacagcgagctggtgcaagaggaaaacctcagccctgggacacagactccttcgaatgataaggcttccatgctccaggagtatagcaagtacctgcagcaggcattcgagaagtcaactaacgcctcatttacattaggacacggcttccagttcgtgtcgcttagctcacctctgcataaccacacactctttccggagaagcagatctacacaacgtccccactcgaatgtggttttggacagagcgtcacatccgtgcttccctccagcttgcccaagcctcccttcggcatgctgttcggctcacagcctgggttgtatctttctgcattagatgctacacaccagcagctaacaccctcccaggaactcgacgatttgattgactcccagaaaaatcttgaaactagttctgctttccagtcgtcatcccagaaactgacatcgcagaaggagcagaaaaacctggaaagctccaccgggttccagattccatcacaggaactcgcgagtcaaattgatccacagaaggatatagaaccgcgcacaacttaccagatcgagaacttcgcccaagcttttgggagccagtttaagtcaggttctagagtgcctatgacgtttatcacgaattctaatggcgaagtcgaccaccgggtacggacctctgtgtcggatttctccggctacacaaacatgatgagcgatgtctccgaaccatgtagtacccgggtgaagaccccaacttctcagtcatataggtag

SEQ ID NO: 14012 - DNA, 1803 bp, Artificial Sequence
  Description of Artificial Sequence: Synthetic coding sequence
atgggatttatccagaagtatctgttacagcgccacgaaaagattcactcccgggagaagccgtttggctgtgatcagtgcagcatgaaattcattcagaagtaccatatggagcgccacaaacggacacactctggggaaaaaccgtacaaatgcgatacctgccaacagtatttcagcaggaccgatcgtctgttgaaacacagaagaacttgcggcgaagtgatagttaagggagcaactagcgccgagccggggagctctaaccacacaaacatgggcaaccttgcagtcctgagtcagggtaacacatcatcatccaggcgcaagacaaagtccaaaagtatagccatagaaaacaaggaacagaagactggcaaaaccaacgagagtcagattagcaataacattaatatgcagtcctactctgtggagatgcccacggtctcgagcagcggagggattatcgggaccggaatagacgagctgcagaagcgggttccaaaactgatttttaagaaaggatcgcgcaaaaacaccgataaaaactatctaaacttcgtgtcccccctgcccgacatcgtgggacagaagagccttagcggaaagcctagcggtagtctgggcatcgtgtcgaacaacagtgtggagaccattggactgctgcagtccacttccggcaagcaggggcaaatctcaagcaattacgatgacgcgatgcagttttcgaaaaagcgtcgctacctgccgaccgccagctcgaattccgcattctccatcaacgtcggccatatggtgagtcagcagtccgttattcagtctgctggtgtttcagttcttgacaatgaggccccattatctctgatcgatagctccgcacttaacgcagaaattaaatcatgtcatgataagagcggcatccccgacgaggtgcttcaaagcatactcgatcagtacagcaacaagtcggagtctcaaaaggaggacccatttaatattgccgagccacgggtggacttgcacacatctggagaacacagcgagctcgttcaggaggagaatctgagccctggcacgcagacaccatctaacgacaaggcgtccatgctacaggaatactctaagtatttgcagcaggcgtttgagaaatccaccaatgcaagctttactctcggccatgggtttcagttcgtgtcattgagcagccccctgcacaaccacacgctgtttcccgagaagcagatctatacaacatccccactcgagtgtggatttgggcagagtgttacgtctgtgctgccgtcctctctccccaagcctcccttcggtatgctgttcggatctcaaccgggactctacctcagcgcgctggacgccacccaccagcagctgactcccagtcaagaacttgacgacttgatagatagtcagaagaatctggagacctccagcgccttccagagcagttctcagaaactgacttctcagaaagagcagaaaaacttggaatctagcactggtttccagattcccagccaggagctggcaagtcaaattgatcctcagaaagatatcgaacccagaaccacctaccagatcgagaactttgcccaggcgttcggctcccagttcaagtccggcagccgagttccaatgacctttattacaaattccaatggcgaagttgaccatcgcgtgcgaacgagcgtgtcagacttttctggctacaccaacatgatgtcggacgtctctgaaccttgttcgacacgagtgaaaaccccaacaagccagtcctaccgatag

SEQ ID NO: 14013 - DNA, 2016 bp, Artificial Sequence
  Description of Artificial Sequence: Synthetic coding sequence
atgcagtttgtgagcactcgaccacagccccaacagctgggtatccagggcctgggattagacagcgggtcttggtcatgggcccaagcgctcccacccgaagaagtgtgtcaccaggagccagcactgcggggcgagatggcagaaggtatgcctccgatgcaggcgcaggaatgggacatggacgcccgtagacctatgccctttcagttccctcccttccctgacagggcgcccgtattccctgataggatgatgcgcgagccccaacttccaaccgcggagatctctctttggacggttgtggccgcaatccaggcggttgagcggaaagtagatgctcaagcaagtcagctcctgaatcttgagggccgaaccggcactgccgagaaaaaattggcagactgcgaaaaaactgctgtggagttcgggaatcacatggaatccaagtgggcggtactgggcacgctgcttcaggagtacggcctgctccagcgcaggctggaaaatctggagaacctactgaggaaccgcaatttttgggtacttcggttacccccggggtcaaagggcgaagctccgaaggtgcctgtaacctttgtggatattgcggtatatttcagcgaggatgagtggaagaatctggacgagtggcaaaaagaactctacaacaatcttgtgaaagagaattacaaaaccctgatgtccctggatgccgaaggctctgtaccgaagcccgatgctccagtgcaggccgaacctcgtgaagagccctgtgtgtgggagcagcggcatccagaagagcgagaaattcccatggacccagaagctggagcagaaccactcgtgcctgcccaggacgcttctagtcaggtaaagcgcgaagatacgctctgtgtacggggacagagagggctggaggagcgagcgattcccacagaatctataactgatagcccaatttccgcccaggacctgctctctcgaatcaagcaggaagagcaccaatgcgtttgggaccaacaggatctcgcagacagagacattccaactgatcccaacagtgaatctctgatcagcgcacacgatatcctgtcatggatcaaacaggaggaacagccatatccttggggcccaagagatagtatggatggcgagctgggtttggatagtgggccttcggactctctcctgatggtaaagaacccccctcctgcccccccgcaaccgcagcctcagccacagcctccacagccccaactgcagagtcaaccccagccccaatcgcttccacctatagccgtggctgagaatccaggaggcccaccttctcggggcctcttggacgatggattccaggttctgcccggtgaaaggggcagcggcgaagcgccccccggtggagacaggtccacaggcgggggagggggcgacggaggcggcggcggaggaggtgccgaggccggaacaggggctggaggtggttgcggctcatgttgtccggggggcctgcgaaggtctttgctgctgcatggtgctcgtagcaaaccctactcatgtccagagtgtgggaaatcattcggggtccggaagtcactcatcattcatcaccgctcccacacaaaggaacgcccctacgagtgtgcagagtgtgagaagtcatttaattgtcactccggcctcatcagacaccagatgacacataggggagagagaccctataagtgcagcgagtgtgagaaaacctacagccggaaagaacacctgcagaatcatcagcggctgcatactggggaacgcccgttccagtgcgccttatgtggcaagtctttcattcgcaaacaaaacctcctgaagcaccaacgcattcacacaggtgagcgcccatacacctgcggtgagtgcgggaagagctttagatacaaggaatccctcaaagatcatcttagagtgcacagcggaggtcctgggcccggggcacccagacagctgcccccccccccagagcgggattag

SEQ ID NO: 14014 - DNA, 975 bp, Artificial Sequence
  Description of Artificial Sequence: Synthetic coding sequence
atgagagaaccccagttgcctaccgctgaaatcagcctgtggaccgttgtggcggccatacaggcggttgagcgcaaagtcgatgcccaagcaagtcagctgctgaacctggagggccgtaccggcacagcagaaaagaagctcgctgactgcgagaagacagccgtggaattcgggaaccatatggagagcaaatgggcagtactgggtactctgcttcaagagtatggactgcttcagcggaggctggaaaatcttgaaaacttactgcggaacaggaacttctgggtgctgagactacccccaggatccaagggggaggcaccaaaggtcccggttaccttcgtcgatattgcagtgtacttttcggaagatgaatggaagaatctagatgagtggcagaaagaactttataacaatctggttaaggagaattataaaacattgatgtccctggacgcggaagggagcgtaccaaaaccagacgcacccgtgcaggcagaaccctcatacagctgtcccgagtgcgggaaaagcttcggagtgaggaagtctctgatcatccatcacagaagtcataccaaggaaaggccatacgagtgcgccgagtgcgaaaagagctttaattgtcacagcggactaatccgccatcagatgactcatagaggggaacgcccctacaagtgtagcgagtgtgaaaaaacttactcccgaaaagaacacctgcagaatcaccagaggctgcacaccggcgagagacccttccagtgcgctctgtgcggaaagtctttcattaggaaacagaatttactcaagcaccagcggattcacacaggagagcgtccctacacctgtggagagtgtggcaaatcattcaggtacaaagagtctctgaaggatcacctgcgcgtacactctgggggtccaggcccgggggccccccggcagctcccacctccgccagagagagattag

SEQ ID NO: 14015 - DNA, 1392 bp, Artificial Sequence
  Description of Artificial Sequence: Synthetic coding sequence
atgcaattcgttagtaccaggccacagcctcagcagttggggatacagggactcggcttggattccggtagctggtcctgggcccaggccctgcctcccgaagaggtgtgtcaccaggaaccggccctgcgtggtgaaatggctgaggggatgcccccaatgcaggcacaggaatgggatatggatgcacgaaggccaatgccattccagtttcctccgtttcccgatcgcgcgccagtgtttccagatcgcatgatgcgggaaccccaactcccgaccgcagaaatcagtctatggacagttgtggccgcaatccaggctgtagaaagaaaagtggatgctcaggctagtcaactgctgaacctggaggggcgcacaggcacagctgaaaagaagcttgcggactgcgagaaaacagccgtagaatttgggaaccacatggagtccaaatgggctgttcttggcactcttttgcaggagtacggcttgctgcagagacgcctagagaacttggagaacctgctgaggaatcggaacttctgggtgttaagactgccaccgggttctaagggagaggcaccaaaagtgccggtgacattcgttgacatagccgtttacttttctgaggacgagtggaaaaaccttgatgagtggcagaaggaactgtacaataacctggtgaaggagaactacaagacgttgatgtcgttggatgcagagggttccgtcccaaagcccgatgccccggtgcaagccgagcctcgggaagagccctgcgtatgggagcagagacatccagaagagcgggagatcccaatggaccctgaggccggtgctgagcctctggtccccgcacaagacgctagctcccaagtcaaaagggaagatactctgtgcgtgcgtggccaaagaggcctggaggagcgcgccatccccaccgagtctatcaccgactcacccatttctgcccaggacttactcagtcgaataaaacaagaagagcatcagtgtgtgtgggatcaacaggatctggctgatcgtgatatacctaccgaccctaattcggagagcttaatttccgcacatgacattttgtcctggattaagcaggaggagcaaccatatccatgggggcctcgagattcaatggatggggaattagggctcgattctgggccaagcgacagcctcttaatggtgaagaaccctcccccagctccaccacagccacaaccccaaccacaaccacctcagccccaacttcagagccaaccccaacctcagagcttaccacccatcgccgttgcagagaaccccggcggtcccccatctcgcgggctcctggacgacgggttccagcctcatcaaggcgccgccctcagggtgaggtag

SEQ ID NO: 14016 - DNA, 252 bp, Artificial Sequence
  Description of Artificial Sequence: Synthetic coding sequence
atgttcgaaagttgctccgggttctctggtttctgcgcatctcccatcgaggagtctcacggtgcactgataagtagctgcaatagcaggactatgacagatggcctagttaccttccgcgatgtggcaattgacttctcacaggaggaatgggaatgtcttgatccagctcagagggacctgtatgttgacgtaatgcttgaaaactactcaaacctggtgagccttggtaaggtcatttgcctcaagtag

SEQ ID NO: 14017 - DNA, 2040 bp, Artificial Sequence
  Description of Artificial Sequence: Synthetic coding sequence
atggaaagccggagtgtggcacaggccggcgtgcaatggtgcgacctggggtcactgcaagcacccccccccgggttcactctgttctcctgtctctctctattaagcagctgggattactcaagcggatttagcggcttctgcgcatctccaatcgaagagagccatggtgcactgatttcgtcttgtaacagcagaactatgaccgatggcttggtgacttttagggacgtcgccatcgactttagtcaggaggaatgggagtgtctggaccccgctcagcgcgatctctatgtggatgtgatgctagagaattactctaatttggtgtcgttggacctagagtcaaaaacctacgagaccaagaagattttcagtgaaaacgatatctttgagattaactttagtcagtgggagatgaaggataagtctaaaactctgggcctagaagctagtatttttagaaacaattggaagtgtaagagcatttttgagggattgaaggggcatcaggagggttacttctcacagatgatcatctcctatgaaaaaatcccctcttataggaagagcaaaagtctgaccccccatcaaagaattcataataccgaaaagtcttatgtgtgcaaggagtgtggcaaggcgtgttctcatggaagcaagcttgtgcagcatgagcggacccataccgcagagaaacacttcgagtgcaaggaatgtggaaaaaactaccttagcgcataccagctgaacgtgcaccagcgatttcacaccggcgaaaagccatatgagtgtaaagagtgcggaaaaaccttcagttggggctcatcactggtgaagcacgagagaatacatactggcgagaaaccctatgagtgcaaagagtgcggaaaagccttcagtaggggctaccacctgacccagcaccagaaaatccatacaggcgtgaaatcctataagtgtaaagaatgtggcaaagcattcttttggggttccagtctcgccaagcatgaaataattcataccggggaaaagccatacaaatgcaaggagtgtgggaaggcatttagccgtggttatcagttaacgcagcaccaaaaaatccatacgggaaaaaaaccgtatgagtgtaagatctgcggcaaggcattttgctggggctaccaactgacgcggcaccaaatctttcatacgggggagaagccgtacgagtgcaaagagtgcggcaaggctttcaattgtggctcaagtctgatacaacatgaacgtatccatacaggggagaagccgtatgagtgcaaggagtgcggtaaggctttctcccgaggctaccatctatcccagcatcagaagattcataccggggagaagccattcgagtgcaaggagtgcggtaaggcattctcatggggatcttcgctcgtgaagcatgaaagggttcatacgggagaaaagagtcacgaatgcaaggagtgcgggaaaactttctgcagcggctaccagctaacgagacaccaggtttttcacacgggggagaagccatacgaatgcaaagaatgcggaaaagccttcaattgcggttctagtctggtgcagcatgaacggatccataccggcgaaaaaccatacgaatgcaaagagtgcggaaaagcgtttagtaggggctatcaccttacccagcaccaaaaaattcacacgggtgagaagcccttcaagtgcaaggaatgtggtaaggccttctcctggggttcatcactcgtgaagcacgagcgggtccatacaaacgagaagagttacgaatgtaaagattgtggaaaagccttcggtagcggctatcagctctctgtacatcagcgatttcacactggggagaaactgtaccaaaggaaagaatttgggaagacttttacctgcggcagcaaattggtacacgagaggacccattcaaacgacaaaccatataaatacaatgagtgcggtgaggcgttcctttggactacctacagtaacgagaagatagatacggacgagaccctgtag

SEQ ID NO: 14018 - DNA, 1782 bp, Artificial Sequence
  Description of Artificial Sequence: Synthetic coding sequence
atgacaatgttcaaggaggcggtgaccttcaaggacgtggccgtagtgtttaccgaagaggagctgggactgcttgacgtgtcacagcgcaagctgtatcgcgatgtgatgctcgaaaactttcgtaacctcctgtctgtggggcaccagctgagccaccgcgatacttttcactttcagcgagaagaaaagttttggatcatggagaccgccacccaaagagagggcaattcaggcggcaaaatccaaaccgaactcgagagtgtgccggaaacaggccctcatgaagagtggagctgccagcagatctgggagcagaccgcatccgagctgaccagacctcaagattccatatcctcatcacagttctccacacagggcgatgtgccctcccaagtggatgccggcctgagtattatccatattggcgagaccccgagtgagcatgggaagtgcaagaagttcttcagtgatgtgtcgatattggacttacatcagcagctgcacagtggaaaaatcagccacacttgtaacgagtatcggaagcggttctgttactcaagcgcactatgcctccaccagaaagtgcacatgggagagaaacgctacaagtgcgacgtctgtagcaaagccttcagtcaaaattcgcagttacagacccatcagcggatacatacaggtgaaaagccctttaagtgcgagcagtgtggcaagtcgtttagccgaagatctggcatgtacgttcactgcaaattacacacaggcgaaaagcctcatatttgcgaagaatgtggcaaggcatttatccacaactcccaacttagagaacaccagcgtatccacaccggtgagaagcccttcaagtgctacatttgtggcaaatctttccatagcagatccaacctgaacagacacagtatggtgcatatgcaagagaaaagtttcaggtgcgacacttgttccaactcgtttggccagaggtcagccctcaactcccactgcatggatcacacaaaggagaagctttataaatgtgaagaatgtgggcgttcattcacctgccgccaagacttgtgtaagcatcaaatggaccatacaggcgacaagccctataactgcaatgtctgcggtaagggttttcgctggagtagctgcttgtcgcggcatcaacgtgtacacaacggagagacaacatttaagtgcgatggctgtggcaagcgcttctacatgaattctcagggtcactcacaccaaagagcctaccgggaggaggaactgtacaaatgtcaaaaatgtgggaagggttatatctccaaatttaacctcgatctccatcagagagttcacactggggaacgcccttataactgtaaggaatgtggcaaaagctttagatgggcctccgggattctgaggcacaagcggctgcatactggggaaaagccgtttaaatgcgaggagtgcggaaagagatttaccgagaacagcaaactacgcttccaccagcgcattcacacaggagagaagccgtataagtgcgaagaatgtggcaaaggcttccgatgggcctccacacacctcacacatcagaggctacattcacgcgaaaaactgttccaatgcgaggattgtggtaagtccagtgaacacagttcatgtctgcaggatcagcagtcagatcactcgggagagaaaactagtaaatgcgaggactgcggcaagcggtacgagaggagactgaatctcgatatgattctcagtttattcctgaacgatatctag

SEQ ID NO: 14019 - DNA, 2739 bp, Artificial Sequence
  Description of Artificial Sequence: Synthetic coding sequence
atgatcaagtttcagatggtgacttttaaagacgtagccgtcgtgttcacggaggaagaactcgggttacttgactctgttcagagaaagttgtatcgggacgtaatgcttgagaatttcaggaatttactgctggtcgcacaccagccatttaaacctgatcttatttcacaactggagagggaggagaaactgctgatggttgaaactgaaacgccacgggatggctgttctggaaggaagaatcagcagaagatggagtctatacaggaagtgacagtgagctactttagtccgaaggaactgagttcgcgccagacttggcagcagagtgcaggcgggctgattagatgtcaggactttctcaaggtgtttcaggggaaaaactcacagttacaggaacaaggcaactcgctcggacaagtgtgggccggtattccagtgcagatctcagaagataaaaattatatatttactcatattggcaacggaagtaattacatcaaatcgcaagggtatcctagttggagagctcaccatagctggcgcaagatgtacctaaaagaaagccacaactaccagtgcagatgccagcagatctctatgaaaaaccacttttgtaaatgtgattctgttagttggctgagccaccacaatgataaactggaagtacaccgcaaggagaattattcttgccacgactgtggggaagacatcatgaaggtatccctgctcaaccaggaaagcattcagaccgaggagaagccttacccctgtacaggataccgcaaggctttcagcaacgactctagctctgaggttcatcaacaattccatctggaggggaagccttatacctactcatcctgtggcaaaggatgtaattactctagcctgctccatatccaccagaatattgaacgcgaggatgacatcgagaatagccacctcaaatcatatcagagagtccatacagaagaaaagccgtgtaagtgcggtgagtacggggagaattttaaccactgttctccgcttaatacttacgaactcattcacacaggggagatgtcctatagacacaacatctacgaaaaagcattttctcacagcctcgatttgaacagtatatttagggtccacacacgtgacgagcctcacgaatacgaggagaacgaaaatgtatttaaccagagctcttgtcttcaggtgcatcagaagattcacacagaagagaaattgtacaccgatatcgagtatggcaagtcttttatttgcagcagcaacctagacatccagcatcgggtgcacatggaagaaaattcttataattccgaggaatgcgggaacggctttagtctggcctcacacttccaggacctccagatcgttcatactaaggagcaaccctacaagcggtatgtctgctcaaatagcttttcacataacctctacttgcagggtcacccaaagatccatattggcgagaaaccacggaaagagcacggaaatgggttcaactggtcatctaaactcaaggatcaccagagagttcataccggtcagaagccttataaatgcaacatctgcggcaaaggcttcaatcaccgctcagtgctcaatgttcaccagagggttcatacgggggagaagccctacaagtgcgaggagtgtgataaggggtttagtcggagctcttatctgcaggcccatcagcgagtccacaccggcgagaagccctacaagtgcgaggaatgtggaaagggtttcagccgaaactcttacctgcaaggacatcaacgggtgcacactggggagaagccctacaagtgcgaagagtgcgggaagggattttcacggagctcccacctccagggacaccagcgagtacacaccggtgaaaagccttttaaatgcgaagagtgcgggaaaggatttagctggagctttaacctgcagatccaccagagagtgcatacgggcgaaaagccttacaaatgcgaagagtgtggaaagggcttctctaaggccagcacattgctagcccatcagcgagtgcacacaggggagaaaccgtatcaatgtgacgagtgtggaaagagcttttctcagaggtcctatttgcagagccaccaaagtgtccactctggagagagaccctatatctgcgaggtctgtgggaaagggttttcccagagagcttatttgcagggccatcaacgcgttcacacccgcgtgaagccgtacaagtgtgagatgtgtggcaaggggttctcccagagtagtagactggaggcccatagacgcgtgcatacagggggcaagccctacaaatgcgaggtgtgcaccaaaggtttctccgagtcctccaggttgcaagcccaccagcgcgtgcatgtcgaagggcgtccatacaagtgcgagcagtgcggtaaggggttctcagggtatagtagtctgcaggcccaccaccgggtccacacgggcgagaaaccgtataagtgtgaggtgtgcggcaaggggtttagccagcgttcaaatcttcaggcgcaccagcgagtccacaccggggaaaagccctacaaatgtgacgcttgtggaaaagggttcaggtggagcagcggcctgttaatccaccagcgcgtgcacagttcggacaagttttataaatccgaggactacgggaaggattacccctctagtgaaaacctgcacaggaatgaagattccgtactgttctag

SEQ ID NO: 14020 - DNA, 1773 bp, Artificial Sequence
  Description of Artificial Sequence: Synthetic coding sequence
atgattaagtttcaggagcgggtgacttttaaagatgttgctgtggtcttcaccaaggaggaactagccttgctcgacaaagcccaaatcaatttataccaagatgtgatgttggagaacttccggaatctcatgttagtgagggacggcatcaagaacaatatcttgaacctacaggccaagggtctgtcatacctgagccaggaggtgctgcattgctggcagatctggaagcaacgtattcgtgaccttactgtgagtcaagactacatcgttaacctccaggaagagtgttcaccgcatttggaagacgtaagccttagcgaagagtgggctggaatttcactacagatatcagaaaatgaaaattatgtcgtaaatgccatcataaagaaccaagacatcacagcatggcagtccctgacacaggtgctcactccagagagctggaggaaggctaatatcatgacggaaccacagaactcacaggggagatataagggaatttatatggaggagaaactctacagacgcgcacagcacgatgattctctctcgtggacctcttgtgatcaccacgagtcgcaggagtgtaagggagaagatccgggcagacatcccaactgcggcaagaatctgggaatgaagtccaccgtcgaaaagcggaatgccgcacacgtgctcccccaaccctttccatgtaataattgcggggtagcctttgctgacgatactgatcctcacgtgcaccactccacccatctgggcgagaaatcatataagtgcgatcagtatgggaagaactttagccagtctcaggacctgatagtccattgcaaaacccattctgggaaaactccctacgagtttcatgagtggcccatgggctgtaaacagtcttccgatcttcccaggtaccagaaagtttcgtcaggcgataaaccgtacaagtgtaaagagtgcgggaagggatttcgccgctcaagcagtctccataaccaccaccgggttcacacaggtgaaatgccgtataaatgtgatgaatgtggcaaaggctttggtttccgaagcctgctctgtattcatcagggcgtccacacaggcaagaagccttacaagtgcgaggaatgcgggaaggggttcgatcagagctccaacctgctcgtacatcagagggttcacactggagagaagccgtacaagtgctccgaatgcgggaaatgtttcagctcttcgtctgtcttgcaggtacattggaggttccacaccggagagaagccgtataggtgtggcgagtgcggaaaaggcttctcccagtgcactcacttgcatatacatcagagagttcacactggtgaaaagccgtacaaatgcaatgtgtgcggcaaagactttgcctacagcagcgtattacacacccaccagcgggtgcatactggtgaaaaaccatataaatgcgaggtgtgtggaaagtgcttctcctactcatcttacttccatctgcatcagagggatcatattcgcgagaagccatacaaatgcgatgaatgcggaaaagggttctcccgcaattccgacttgaatgtgcacttgagggtgcacacccgagagcggccctataagtgtaaggcctgcggtaaagggttttccagaaactcttatttgttagcacatcagcgtgttcatattgatgagacccagtatacccattgcgaacgtggtaaagatctactgacacatcagcggctacacgagcagcgggaaaccctctag

SEQ ID NO: 14021 - DNA, 2742 bp, Artificial Sequence
  Description of Artificial Sequence: Synthetic coding sequence
atgaccaagtttcaggagatggttacattcaaggatgtggctgtggtgtttactgaagaggaactcgggctgctggactcagtccaacggaagctctatagggatgtgatgctagagaatttcaggaacctactgctggtggcacatcagccttttaaacctgacttgatttctcaattagaacgcgaagaaaagctcctgatggtggaaactgagactcctagggacggatgctccggacgcaagaatcagcagaagatggaatcgattcaggaggttaccgtcagttacttttcacctaaggagttatcttcgcggcaaacctggcaacagtcggcaggcgggctgatccggtgtcaagactttctgaaggtttttcagggcaaaaactcccagctacaagagcagggtaacagtttgggccaggtttgggcggggatccctgtccagatctccgaggataagaattatatcttcacccacattgggaatggatctaactatatcaaatcccagggctatccatcttggagggcacatcactcctggcggaagatgtacctgaaggagagccacaattatcagtgtaggtgccaacagatctccatgaagaatcatttctgcaagtgcgactctgtcagctggctgtcccatcacaacgataaactagaagttcatcgcaaggagaactactcatgtcacgattgcggggaagacataatgaaggtgagtctgctcaaccaggagagcatccagacggaagagaagccttatccctgcacggggtaccgtaaggcttttagcaacgactcgagcagcgaggtgcatcagcagtttcacctggagggcaagccctacacctactccagctgtggaaagggatgtaactacagcagcttactgcacatccaccagaacattgaaagagaggatgatatcgagaactcacatcttaaatcctaccagcgagtacacaccgaggagaaaccctgcaaatgcggcgaatacggggagaactttaatcattgttccccactgaacacttacgaactcattcacaccggagaaatgagctacaggcacaatatctacgaaaaggcattctcccattcactggatctcaatagtattttccgcgtccacactagggatgagcctcatgaatacgaagagaatgagaatgtgttcaaccagagttcatgtctccaggtccaccagaaaatccacacagaggagaagctgtacaccgacatcgagtacggcaaaagctttatctgctcctcgaatctggacattcagcatcgtgttcatatggaggaaaactcctacaattctgaagagtgcggaaacgggttctcactggcgtcacactttcaggaccttcaaatagtccacaccaaggaacagccatataaaagatatgtgtgttcaaattcattttctcacaacctgtaccttcaaggccaccccaagattcacataggggagaagcctcgaaaggaacacggcaatggatttaattggagtagtaaacttaaggaccaccaacgggtgcacacgggccagaagccctataaatgcaacatttgcgggaaagggttcaatcaccgatctgtgcttaatgttcaccagcgtgttcacactggggaaaagccttataaatgcgaggagtgcgacaagggcttctcgcggagtagctatctccaggcccaccaacgggtgcatacaggggagaaaccttataagtgtgaagaatgtggtaaagggttcagccggaactcctacctgcagggacaccaacgggtgcataccggagaaaaaccttacaagtgtgaggagtgcggtaaggggttctctcgatcctctcacctgcaaggacatcaacgtgtacataccggcgagaaaccgtttaagtgtgaagagtgcggcaaaggattcagctggagcttcaacctgcaaattcaccaaagggtgcatacaggggagaagccatataaatgcgaagaatgtgggaaaggatttagtaaagcctctaccctcttggcccaccaacgcgtgcataccggcgaaaaaccatatcagtgtgacgagtgtggaaagtctttctcgcaacgttcttatctacagtctcatcaaagtgtgcattccggggaaagaccctacatttgtgaggtatgtggcaagggtttctcacaaagggcctatcttcagggccaccagcgagtgcacacccgcgtgaaaccatacaaatgcgagatgtgtgggaagggctttagccagtcaagtaggttggaagcccacagacgtgtgcataccggcggcaaaccctataagtgtgaagtgtgtacaaaggggttcagcgagtcctcccggctgcaggcccaccagagggtgcatgtcgagggtcgaccttacaagtgcgagcaatgcggcaaggggtttagcggatacagctcactgcaagcccaccatagggtgcatactggggaaaaaccctacaagtgcgaagtgtgcggcaagggcttttcacagagaagcaacttacaagcccatcagagagtccacaccggggagaagccgtacaaatgcgatgcatgcgggaaggggtttcgttggagttccgggttactgattcaccagagagtccacagcagtgataagttctacaaatcagaagactatgggaaggattatccttcatccgagaacttgcatcgaaatgaggattccgtgctgttttag

SEQ ID NO: 14022 - DNA, 2724 bp, Artificial Sequence
  Description of Artificial Sequence: Synthetic coding sequence
atggtgacatttaaagatgtcgccgtcgtgttcactgaggaggaactcggcctgcttgatagcgtgcagcggaaactctaccgtgacgtcatgctggaaaattttcgtaatctgttactggtggcgcatcagcctttcaagcctgatctcatttcacaattagaacgggaggaaaagcttttgatggtggaaaccgagacgcctcgcgatggatgctcagggcggaaaaaccagcagaaaatggaaagtattcaggaagtgactgtaagttacttctcaccaaaggagctgagctcccgacaaacttggcagcagtccgccggaggattaattagatgccaagatttcctgaaagttttccagggtaagaacagccagctgcaagaacagggcaatagccttggacaggtgtgggccgggatccccgtgcagatttccgaggacaagaattacatcttcacacatattggaaatgggagcaattatattaagagccagggctatcctagctggcgagctcaccatagctggcgtaagatgtacctcaaggagagtcacaactatcaatgtcggtgtcagcaaattagcatgaaaaaccatttctgcaaatgtgacagcgtgtcatggctatcccaccacaatgataaactggaggtgcatcggaaagaaaactactcttgccacgattgcggcgaagatatcatgaaggtaagcctgcttaaccaggagagtatccaaacagaggagaaaccgtatccttgcaccgggtatcgcaaagctttctccaatgattccagcagcgaggttcatcagcagttccacctcgaaggtaagccctatacgtactcatcctgtggcaaaggatgtaattattctagcctgctgcacatccaccagaatattgagcgcgaggatgatatagagaacagccatttgaagtcctaccagagagtgcatacagaggagaaaccatgtaaatgcggcgagtatggggagaacttcaaccattgcagtcccctcaacacctacgagttgattcacaccggtgaaatgagctacagacacaatatctacgaaaaagctttttctcactcactcgacctgaattcaatctttagagtgcacactagagacgagccgcatgagtacgaggagaatgagaacgtcttcaatcagagttcatgtctgcaggtacaccagaagatccatacagaggaaaagttatatactgatatagagtatggtaaatctttcatttgctcatcaaacctggatattcaacatagagtgcacatggaagagaatagctacaacagtgaggagtgcgggaacggattcagtttggcctcccactttcaggacctgcaaatagtccataccaaggagcagccttacaaacgttacgtctgctccaactcgttctcccacaatttgtacctgcagggccacccgaagattcatatcggtgagaagccacgcaaagagcatgggaatggcttcaattggtcttcaaaactcaaagatcaccagagggtgcacactgggcagaaaccatataagtgtaacatctgtggaaaagggtttaaccatagatccgtgctgaacgtgcaccagagggtccacaccggcgaaaaaccttacaaatgcgaagaatgtgacaaaggattcagtagaagttcatacctccaggcccaccagagagtgcacaccggcgaaaagccttacaagtgcgaagagtgcggcaaaggcttctcccggaactcctacctacagggccaccaacgggtgcacaccggcgaaaaaccttacaagtgcgaggagtgtgggaaaggctttagccggagttctcatcttcaaggtcatcagagagtacacacgggggaaaagcccttcaaatgtgaggagtgcgggaaggggttctcatggagctttaacctgcagatccaccagcgagtccatactggtgagaagccttacaagtgcgaagagtgtggaaaaggtttcagtaaggcgagtacactgctcgcccaccaaagggtgcatactggggaaaagccatatcaatgcgacgagtgtgggaaatccttctctcagaggagttatctacagtctcaccagtcggtccattccggcgagcgaccctacatatgcgaggtttgcggaaaagggttctctcaaagggcatacctccagggacaccagcgagtgcatacccgggtaaagccctacaaatgtgaaatgtgcggcaagggatttagccagagcagcaggctggaagctcaccgtcgagtgcataccggaggtaaaccttacaagtgcgaggtgtgcacgaagggtttcagcgagagctctaggctacaggcccatcagagggtgcacgtggaaggtaggccatacaagtgtgaacaatgcggaaaagggttctcggggtatagctcgctgcaagcacaccacagagtccacaccggcgaaaaaccttacaaatgcgaggtgtgcggcaagggcttctctcagcggtccaacctgcaagcacatcagagggtgcatacaggcgagaagccttacaaatgtgacgcctgtggaaagggatttagatggtcctcaggtctgctaatacatcagagagtgcactcctcggacaaattctataagtccgaggactacggaaaggactacccaagttcggagaacctgcatcgcaacgaagactctgtcctattttag

SEQ ID NO: 14023 - DNA, 2742 bp, Artificial Sequence
  Description of Artificial Sequence: Synthetic coding sequence
ctgacagtatgccaggaaatggtgacgtttaaagacgtggccgttgtttttacggaagaagaactggggcttttggattctgtgcaacgaaagctttaccgcgacgtgatgcttgagaacttcaggaacctgctactagtcgcacaccagcccttcaagccagaccttatttcacagcttgaacgggaggaaaaattactgatggtggagactgaaacacctagagacggttgtagtggacggaaaaaccagcagaaaatggagagtattcaggaagtgactgtgtcttacttttcccctaaggaattatcaagtcggcaaacatggcagcaatctgctgggggtctcattaggtgtcaggattttctgaaagtcttccaaggcaaaaattcccagctgcaggaacagggcaactccctgggccaagtctgggctgggattccagttcagatctccgaagataagaactatattttcactcatatcggaaacggatcaaactacatcaaatcgcagggttaccccagctggcgggcccatcatagctggcgcaaaatgtacttaaaggaatcccacaattaccagtgtcgctgtcagcaaatcagcatgaaaaatcacttctgtaaatgtgactcggtcagttggctgagccatcataacgataagctggaagttcatcgcaaagaaaactactcctgccatgactgcggcgaagacatcatgaaggtgagtcttcttaaccaggaaagcatccagacggaggagaagccgtacccctgcactggttatagaaaagctttctccaacgattcatcttccgaagtacatcagcagttccatttggagggtaagccatatacatactcctcatgcggcaagggatgcaactacagtagcttacttcatattcatcaaaatattgagagggaggacgatatcgagaatagtcatctgaagagctatcagagggtgcacactgaggaaaagccatgtaagtgcggtgagtatggagagaacttcaaccattgctcccccctgaatacctatgagctgatccacactggcgagatgagttaccgacataacatatacgaaaaggccttctcccattccctcgatctgaattcaatcttccgggtccacacccgggacgagcctcatgagtacgaggaaaatgagaacgtctttaaccaatcctcttgcctgcaggtacaccagaaaatccacaccgaggagaaattatacactgatatcgaatacggaaaaagcttcatctgctcaagcaaccttgatatccagcatcgcgttcacatggaggaaaatagctacaatagcgaagagtgtggcaatggcttctcattggctagccactttcaggacctccagattgtacacaccaaggaacagccctacaagcgttacgtatgttcaaactcgtttagccacaatctctatctacagggacacccaaaaatccatataggtgaaaagcctagaaaggagcacggaaacggattcaattggtcaagtaaactgaaggatcaccagcgcgtgcacacagggcagaagccttacaaatgtaatatttgcgggaaaggctttaaccataggtctgtgctaaatgtacatcagcgcgtgcacacaggagaaaagccgtacaagtgcgaagaatgtgacaaggggttctcccggtctagttatctccaggcccatcaacgcgtgcataccggcgaaaaaccttacaagtgcgaggaatgtgggaagggcttctctcgcaactcctacctacagggccaccagcgagtgcacactggtgagaagccttataaatgcgaagaatgtggcaaaggcttctcaaggtccagccacttgcaagggcaccagcgggtgcatacgggggagaagccctttaaatgcgaagagtgcggcaagggtttctcctggtctttcaatttacagatccaccagagggtgcacaccggagaaaagccctataaatgcgaagagtgcggaaaagggttctcgaaagcatcgactctccttgcgcaccagcgagttcacaccggtgagaagccgtaccagtgtgatgagtgcggaaagagtttttctcaaagatcatatctgcagagtcaccagtcggtccactccggggagcggccgtatatctgcgaggtctgcggcaaaggcttttcgcaaagggcttatttacagggccatcagcgtgtgcacactcgtgtgaaaccgtacaaatgcgagatgtgcggcaaaggcttcagtcagagcagcaggctggaggctcacagaagagtccacacggggggaaaaccctacaagtgtgaggtttgtaccaaaggcttttctgaaagctcgaggttgcaggcccaccaacgtgtgcatgtggaaggtcgcccctacaaatgtgaacagtgtggcaagggcttttccggatacagctcgcttcaggcccatcaccgagtacacaccggcgagaaaccatataaatgtgaggtgtgcggtaaaggattctcacagagaagcaacctgcaagcacaccagagggtccacacaggagaaaaaccttataagtgtgacgcgtgcggcaaagggttcagatggtccagtggcctgctgatccaccaaagggtccattctagcgacaagttctataaatctgaggactacggaaaggactatccgtccagcgaaaacctgcatcgaaacgaggattctgtgctcttctag

SEQ ID NO: 14024 - DNA, 2793 bp, Artificial Sequence
  Description of Artificial Sequence: Synthetic coding sequence
atgggccttggtccgcgaagccttccatttagcagaaagaggaagagaaagatgaccaagtttcaagaaatggtcacatttaaggacgtggcggttgtcttcactgaggaggaacttggattgttggactctgtacagcggaaactgtaccgggatgtgatgctggaaaactttcgcaacttgctcctggtggcccaccaaccttttaagcccgaccttatctctcagctggaacgtgaggagaagctgctcatggtggagaccgaaacgcctcgtgacgggtgtagcggccgcaagaaccagcagaagatggagtccattcaggaagtcaccgtgtcttatttctctcctaaagagctgtcttctcgccaaacttggcagcagtctgcgggaggtttgatacgttgccaggattttctcaaggttttccagggcaaaaacagtcaactgcaagaacagggcaactctctcgggcaggtctgggcaggaattcccgtccagatttcagaggacaagaactatatctttacacacatcggtaatgggagcaactatattaagtcccagggctacccttcttggagagctcatcacagctggcgcaagatgtacctcaaggagtcgcacaattaccagtgccgttgccagcagatcagcatgaagaatcatttttgtaagtgcgactcggtatcttggttgagccaccacaacgataaactagaggtgcacaggaaggagaattacagttgccatgattgcggtgaggacatcatgaaggtgtcactgcttaatcaggaatctatacagacagaagagaaaccatatccctgtactggataccggaaagcctttagcaacgactcgtctagcgaggtccaccagcagtttcacctggagggcaaaccctacacatactcatcttgcggcaaaggctgtaattatagttcgcttcttcacatccatcagaacatcgaacgagaggacgacattgagaactctcacttgaaatcataccagcgcgtccacacagaggagaagccttgcaaatgtggcgaatacggggagaattttaaccactgctccccactcaatacatacgagctgatccacaccggcgagatgtcctataggcataatatttatgagaaggctttcagccactccctggatctcaacagcatttttagggtgcataccagggacgagccacatgagtacgaggagaacgaaaatgtctttaatcagtctagttgtctgcaggtgcaccagaagatccacactgaggagaaactgtacacagatattgagtacggcaaatcttttatctgctcatcaaacctggatatccagcatagggtccatatggaagaaaattcttacaatagcgaagaatgtggaaatgggttcagtctagctagtcatttccaagacttgcagatcgtccacacaaaggaacaaccctataagcggtatgtatgttcgaattcatttagtcataatctttacctgcagggacatccaaagattcatattggagaaaagcctagaaaggagcacggcaatggctttaattggtcatccaagctgaaagaccaccagcgggtgcacactggccagaaaccctataagtgtaacatctgtgggaagggatttaatcatcggagcgtgctaaatgttcaccagagagtgcataccggcgagaaaccatataagtgtgaagaatgcgacaaaggattcagtagaagttcgtacttacaagcacaccagcgggtccatacaggcgagaagccgtacaagtgtgaagagtgcggtaagggctttagcaggaattcatacttgcaaggacatcagcgggttcacacaggggagaagccttacaagtgcgaagagtgtggtaagggcttctctaggtcaagccacttgcaggggcaccagcgcgtgcatactggcgaaaagccatttaaatgcgaggaatgtgggaaggggttcagctggagttttaatctgcaaatccatcagcgggtccacaccggtgagaaaccctataaatgcgaggagtgtgggaaaggctttagcaaggcttcgactttactcgctcaccagagagttcacacaggagaaaagccttatcagtgtgatgaatgtggaaagagttttagccaacggtcatacctacagtctcatcagtctgtccatagcggggaaagaccctacatctgcgaggtgtgcgggaaggggttctcacagcgtgcttacttacagggccatcagcgggtgcatacacgggtcaagccttacaaatgcgagatgtgtgggaaaggtttttcccagtctagcaggctggaggcgcaccggcgtgtccacactgggggtaagccttacaagtgtgaagtgtgcaccaaaggttttagtgagtcctcgcgactacaggcccatcagcgtgtacacgttgagggccgtccttacaagtgtgaacaatgtggcaaaggctttagcgggtattcttcactacaggcacatcatagagtgcacactggagaaaagccctataagtgtgaggtgtgtggcaaaggattcagtcagagaagcaatctccaggctcaccagcgagttcacaccggcgagaaaccgtataagtgtgacgcttgtggcaaaggtttccgctggtccagtggcctgctgattcaccagagggtgcactcctctgacaaattctataagtccgaggactatggcaaagattatcccagttctgagaatctgcacagaaatgaagacagcgtgttattttag

SEQ ID NO: 14025 - DNA, 1842 bp, Artificial Sequence
  Description of Artificial Sequence: Synthetic coding sequence
tgcagttctgcatttcccgagtcatgtcccttccagaaagaggatggtatgattaagtttcaggttcgcctctctaatctgcaggagcgcgtcactttcaaggatgtagctgtggttttcaccaaagaggagcttgcgctgcttgataaggcccagattaatttgtatcaggatgtgatgctagagaattttaggaatttaatgctggtgcgggacggcatcaagaacaacatactgaatctgcaggccaaaggtctgagttacctaagtcaggaggtccttcattgttggcagatctggaagcagagaattagggaccttactgtttcacaggactacatagttaatctccaggaagagtgcagtcctcatttagaggatgtctccctgtctgaggaatgggctggcatcagcttgcagatttctgagaacgagaattatgtggtaaatgcaattattaaaaatcaggacattaccgcctggcagagtctgacacaggtcctcacccctgaatcctggaggaaagctaacataatgaccgaaccacaaaactctcagggaaggtataagggtatctacatggaagagaaactgtataggagggctcaacacgacgattcattgtcctggacctcctgcgatcaccacgagtcacaagaatgcaaaggtgaggacccaggtagacacccaaactgtggcaagaatctaggtatgaagagtactgttgagaaacgtaacgccgcgcacgtgctgccccagcccttcccatgcaacaactgcggggttgcattcgcggatgatacagacccccacgtgcatcacagcacacacctgggtgaaaaatcgtacaagtgtgatcaatatggcaagaacttctctcagagtcaggacctaattgtgcattgtaaaactcacagcgggaagactccgtatgagttccacgaatggccaatgggttgtaagcagtccagcgatctcccgcgctatcagaaggtttcaagcggggacaagccctataaatgcaaagaatgtggcaagggtttccgtcgctcatcatctctacataatcatcatcgggtccatacaggagagatgccctataagtgcgacgaatgcggcaaggggtttggcttcaggagtcttctctgtatccatcagggagtgcatacaggaaagaagccatacaaatgtgaggagtgcggcaaaggctttgaccagtcttcaaatcttctagtgcaccagagggtccacactggagagaaaccttacaagtgctcggaatgtggcaagtgcttctctagttcgagcgtgctgcaggttcactggagattccacactggcgagaagccttataggtgtggagaatgcgggaaggggttctctcagtgcacacacctccacatccaccagagagtgcacacaggtgaaaagccctataaatgcaatgtatgcggaaaagatttcgcctacagctccgtactgcacactcaccagcgggtccatacaggcgaaaaaccttataagtgcgaggtttgtggaaaatgtttctcctattcatcttactttcacctacaccagagggatcatatacgggaaaagccctataaatgtgatgagtgcgggaaaggattttcaagaaatagtgatctcaatgtgcacctgagagtgcacaccagggagcgtccctataagtgtaaggcatgtggaaaaggctttagccgtaatagctacttactagctcaccagcgagtacacatagatgaaacccagtacacccactgcgaacgtggcaaggaccttctcacacaccaacgactccacgagcaacgggaaaccctgtag

SEQ ID NO: 14026 - DNA, 426 bp, Artificial Sequence
  Description of Artificial Sequence: Synthetic coding sequence
atggagaccgatctggccgaaatgcccgaaaagggtgccctctcttcccaagacagccctcatttccaagaaaagagtacggaagaaggtgaagtggctgcacttcgcctgactgccaggagccaggagaccgtgacattcaaagacgtagccatggactttacgcccgaggaatggggcaaactcgatcccgcacagcgggacgttatgctggagaattaccggaacctggtgagcttatggctgcccgtctccaagccagaaagctacaacctggaaaacggcaaagaacctttgaaattagagcgtaaggctcctaagtcaagttactccgccgtggccgtgatcattctgttccttatcccatacgtgcatttggaaagctggttcagggagattactgggcgacgtatatcaaggtcctag

SEQ ID NO: 14027 - DNA, 1566 bp, Artificial Sequence
  Description of Artificial Sequence: Synthetic coding sequence
atggaaaccgatctcgctgagatgcccgagaagggcgctctcagctcgcaggactccccccactttcaggagaaaagcacagaagagggagaggtcgccgctctcagattgactgctcggtcccaggagactgtaacctttaaggacgtggcaatggactttacgcccgaagaatggggcaaattagaccctgcgcagagagatgtgatgctggagaactaccgcaatcttgtcagcctgtggctgcctgtctccaagcccgaatcttacaatcttgagaacggtaaagaaccgctgaaactggagaggaaggcccccaaatcttcctacagcgacatggagacgaggcctcagtctaaagattctacaagcgttcaggacttttctaaagctgaaagctgtaaagtagccattatcgatagactcacgaggaatagcgtctacgattctaacctggaggcggccttggaatgtgagaactggctggagaaccagcagggtaatcaggagagacacttacgcgagatgttcactcatatgaatagcctctctgaggaaaccgatcacaagcacgacgtgtactggaagagcttcaaccagaaatcagtccttattactgaagaccgcgtgccaaaggggtcatatgctttccataccttagagaagtctttaaagcagaaaagcaatctgatgaaaaagcagagaacctacaaggagaagaagcctcacaaatgcaatgattgtggtgagctattcacataccactccgtgcttattagacaccagcgcgtgcacacgggcgagaagccctacacctgcaatgaatgtgggaagtcgttttctcatagggctaaccttactaagcatcagcgcactcataccagaatcctgtttgaatgctcagaatgtaaaaagaccttcaccgaaagcagtagtttggctacccatcagcgcatacacgtgggggagcggccatatgagtgtaatgaatgtggtaaagggtttaatagaagcacacacttagttcaacatcagctgattcatactggagtgaagccttacgaatgtaacgagtgtgataaagcttttatacatagctccgcccttattaaacaccagcgaactcatactggggagaagccatataagtgccaggagtgcggcaaggctttctcacactgctctagcttgacaaagcaccaaagagtgcacactggggaaaaaccttatgaatgcagcgaatgcggcaaaaccttcagccagtctacacatctggtccaacaccagagaatacataccggcgagaagccctacgagtgcaacgaatgcgggaaaacgttctcgaggtcttccaactttgcaaaacatcaaagaatccatattggaaagaagccatacaagtgcagcgaatgtgggaaggcttttatccattcctcagctctgattcagcatcaacgcacccatacaggagagaaaccctttcgttgtaatgagtgtggaaagagctttaagtgcagctctagcctgatccggcaccagcgggtgcacaccgaggaacaaccttag

SEQ ID NO: 14028 - DNA, 1536 bp, Artificial Sequence
  Description of Artificial Sequence: Synthetic coding sequence
atgggagctctgagctcccaagacagtccccatttccaggagaaaagcaccgaggagggggaagttgcagccctgcgcctgactgccaggtcccaggagacagtgaccttcaaagatgtcgctatggatttcacgcctgaggagtggggaaagttggatccagcacaaagagatgttatgttggagaattatcgaaatctggtgtcattatggttacccgtaagtaaaccagagagctataacctggaaaacggaaaggaaccccttaaactggagcgtaaggcgccaaagtcaagctacagcgacatggaaacccggccccagtccaaagatagcaccagtgtgcaagattttagtaaagctgaatcctgtaaagtcgcaattattgataggcttacccgcaatagcgtgtatgattcaaacctggaagcagcacttgaatgcgagaactggttggaaaatcagcaggggaatcaggagcgccacctcagagagatgttcactcacatgaatagtctgtcagaggagactgaccacaaacacgacgtgtattggaagagctttaaccaaaagagtgtcctcataaccgaggacagagtgcccaagggtagctatgcctttcacacgctcgaaaagtctctgaagcaaaaatcgaacctgatgaaaaaacagcgcacgtacaaagagaagaaacctcataagtgtaacgattgcggcgaactatttacgtatcactccgttcttatcagacatcaaagggtccatacaggagagaagccatatacgtgtaacgagtgcggaaagagcttcagtcatcgggctaatctgacaaaacaccagagaacacacaccagaatcctgttcgaatgttcagagtgtaagaaaacatttactgagtcatcttcacttgccacgcaccagcgaattcacgtgggggagaggccatacgaatgtaacgaatgtggcaagggctttaataggagcacccatctggtgcagcatcagcttatccacactggagttaaaccatacgagtgtaacgagtgcgataaagcctttattcacagctccgccctgataaagcaccagcggactcatacgggggagaagccatataagtgccaggagtgcggaaaggccttcagccactgttcttctctcactaagcatcagcgtgtccacacaggcgagaaaccctatgagtgtagcgagtgcggcaaaactttctcccagagcacacacctcgtgcagcaccagcgtattcatacgggagagaaaccctacgagtgtaatgagtgcggcaagaccttcagcagaagcagcaatttcgcgaagcatcagagaattcatatcggcaagaagccatacaaatgtagcgagtgtgggaaggcgttcatccattcaagcgctctgattcagcatcaacggacccataccggtgagaaacccttcagatgcaacgagtgcggcaagtctttcaagtgctctagcagtctcattcgtcaccagagagtccataccgaggagcaaccctag

SEQ ID NO: 14029 - DNA, 1566 bp, Artificial Sequence
  Description of Artificial Sequence: Synthetic coding sequence
atggagacggacctggctgagatgccagaaaagggcgccctctcaagccaggacagccctcatttccaggaaaaatcgacagaagagggggaagtggccgctttgaggctgacggcacgatcccaagagacagtgacctttaaggacgtggccatggacttcacgcccgaagaatgggggaagctggatccggcacagagagacgtgatgcttgagaattaccgaaacctggtgagtctgtggcttcctgtttctaagcccgagagctacaacctcgaaaacgggaaggagccgctaaagctcgaacggaaagcccccaagtccagctatagtgacatggagacacgccctcaatcaaaagatagcacatccgtccaggacttctctaaggccgaaagctgtaaggtggccataattgatagactgacgagaaatagcgtatatgattccaacctcgaagccgcactcgagtgcgaaaactggctcgaaaaccagcagggaaatcaggagcgacacctgcgggagatgtttacgcacatgaactccctttctgaggaaaccgatcacaaacacgacgtctattggaagagctttaaccagaagtcggtgcttatcactgaggatcgggtccccaagggatcttatgcctttcataccctagagaaatctctcaaacagaaatcgaatctcatgaagaaacagcggacatacaaagagaagaaacctcataaatgtaatgactgtggcgagttgtttacctatcactcagtgctgattaggcaccagagggtgcataccggtgaaaaaccatacacttgcaacgagtgtggcaagagcttttctcatcgggctaacttgaccaaacaccagcgtacgcatacaagaatcttattcgagtgctccgagtgtaaaaagacctttacagagtcttcgtctctcgccacccaccagcgcatacatgtgggagaaaggccatacgaatgcaacgagtgtggaaaggggttcaacagaagcactcatttggtccagcaccagctgatccatactggagtcaaaccttacgagtgcaacgaatgtgataaagcttttattcactcttccgccctgattaaacatcagcgcacccacaccggcgaaaaaccgtacaaatgtcaggaatgcggcaaggcttttagtcactgtagctccctgaccaaacaccagagggtccatacaggggaaaaaccttatgagtgttccgagtgcggcaaaactttctctcaatccacacaccttgtccagcaccaacgcattcatacaggagagaaaccatacgaatgcaatgaatgtgggaaaaccttcagtaggtcttccaactttgctaagcatcagaggatccacatcggaaaaaaaccatataaatgctctgaatgcggaaaggcttttatccatagttctgcattgatccagcatcaaaggacacatactggcgagaaaccattccgctgcaacgaatgtggtaagagttttaagtgttctagctcgctgattaggcaccagcgggtgcacacagaggagcaaccttag

SEQ ID NO: 14030 - DNA, 1566 bp, Artificial Sequence
  Description of Artificial Sequence: Synthetic coding sequence
atggagaccgaccttgccgagatgcccgaaaagggggcattgagtagtcaggattcccctcatttccaagagaaaagcacagaggagggtgaggtggccgctctgcgcctgactgctcgcagccaggaaactgtcaccttcaaggacgtggccatggactttactcctgaagagtgggggaaattagaccctgcccaacgggatgtgatgctggaaaactatagaaatctggtttctctgtggttaccagttagcaagcccgaatcatataacctcgaaaacggaaaagaaccgctgaagctggagaggaaagctcccaagagctcttactcagacatggagacccgccctcagtcgaaggacagtacgtccgtgcaggacttctctaaggctgaaagttgcaaagtggctattatcgaccgccttacacgaaactcagtgtacgattctaatcttgaggctgccttagagtgcgagaattggctcgagaaccaacagggaaatcaagaacgccacctcagggaaatgtttacgcatatgaactcactgtcggaagagactgaccacaaacacgatgtttattggaagagtttcaatcagaagagtgtgctgataacagaggatcgcgtgccaaagggctcctatgctttccatacattagaaaagagcttgaaacagaaaagcaacctcatgaagaagcagcggacctataaggaaaagaaacctcacaagtgcaacgactgcggggagctctttacataccactcagtgctgatccgccaccagcgagtgcatacaggtgagaagccatacacatgcaacgagtgtggtaagtccttttctcatcgtgcgaacttgacaaagcaccagcggactcacaccaggatactgtttgaatgtagcgagtgtaagaaaacatttactgaatccagtagcttggccacacaccagaggattcacgtgggagagcgaccttatgagtgcaacgaatgcggaaaggggtttaacagatcaacccatctggtacagcaccagttaatacacactggagtgaaaccttatgaatgtaacgagtgcgacaaggcgtttattcactcctctgcgctaatcaaacatcagaggactcataccggtgaaaaaccttataaatgtcaggagtgcggcaaagccttctcacattgcagtagcttgaccaagcatcaacgggtgcataccggcgagaagccttacgaatgttcagaatgcggcaaaactttttcacagtccacccatttggtccagcatcagagaatccatacaggtgagaaaccatacgaatgcaacgaatgcggtaagacgttcagcagatcatccaacttcgccaagcaccaacgaatccatatcggcaagaaaccgtataaatgttccgaatgcgggaaagcattcatccacagttctgccctgatccagcatcaaaggacccacaccggcgagaagccctttcggtgtaatgagtgtggcaagtccttcaaatgtagcagctccctgattcggcaccaacgcgttcacacggaagaacagccctag

SEQ ID NO: 14031 - DNA, 1569 bp, Artificial Sequence
  Description of Artificial Sequence: Synthetic coding sequence
atggagaccgacctggcagaaatgcctgaaaagggcgtcttgtctagccaggattctccacatttccaggaaaaatctaccgaagagggagaggtggctgccctgaggctcaccgctcggtcgcaggctgcagccgccgcagcagcccccggctcccggtcacttcgaggcgtgcatgttccgcctcctctgcacccagcgcccgcgcgagaggaaattaagagcacctgcagcttaaaagcatgcttttccctctcactgacactgacatactacaggacagccttcctgctttcaactgagaatgagggtaatttgcacttccaatgccctagcgatgtggagacacgtcctcagtctaaggatagcactagtgtgcaggactttagcaaggcagaatcctgtaaggtggctataatcgatagactgacgcgaaactctgtctatgattcgaacctcgaggccgcactggagtgtgagaattggctggaaaaacagcagggaaaccaggagcgtcacttacgcgagatgtttacacacatgaactctctttctgaggaaactgaccacgagcacgacgtctactggaagagtttcaatcagaaaagtgtgctaatcactgaggatagagtcccaaagggttcctacgccttccacactctggagaagtctttaaagcagaaatctaaccttatgaaaaaacaacgcacttacaaggaaaaaaagccacacaaatgtaatgactgcggagagcttttcacgtgtcactccgtccacattcaacatcaaagagtgcatacgggtgagaaaccatacacctgcaatgaatgcggcaagagcttcagtcatagagctaatctcacaaagcaccagcggacacatactcggattctcttcgagtgtagagagtgtaagaaaactttcacagaatcatctagtctggccactcatcagagaatccatgtgggagagcggccttacgagtgcaacgaatgtggcaagggtttcaacagatcaactcacctagtgcagcatcaactgatacacaccggagttcgaccttatgaatgcaatgaatgcgataaggcctttattcatagtagcgccctcattaagcaccagaggacccatacaggcgagaaaccatacaagtgccaagaatgtggcaaggccttttcgcactgttctagcctgacgaaacaccagcgagtacataccggggagaaaccgtatgaatgctccgaatgcggcaagaccttttcacagtctacacatttagtgcagcaccagagaatccacaccggcgaaaaaccgtacgaatgcagtgagtgcggaaaaacattctctcagtcaagcaacttcgccaaacatcagaggattcatattgggaaaaaaccctataaatgctcagagtgcggcaaggcctttatacacagtagcgcactgatccagcatcagcggacccatacaggagaaaagccttttcggtgcaatgaatgcggtaagtcattcaagtgtagctcaagtctcattaggcaccagcgagtgcacactgaggagcagccgtag

SEQ ID NO: 14032 - DNA, 2286 bp, Artificial Sequence
  Description of Artificial Sequence: Synthetic coding sequence
atgctggcaagcagtaaaaggatgaattcatcctcgaggtcacagatcctgcttaggtggaaatccgacaaggcacagtccggtccttataatgtggagaaggaaatcttgactagccgattcttaagggatacagaaacctgcagacagaacttcaggaatttcccctacccggatcttgctggacccaggaaagcactcagtcagctgagggagttgtgtttaaaatggttaaggccagagattcactccaaggagcagatccttgagttactggtgttagagcagtttctcaccattctccccggtgaggtgcggacttgggtcaaaagtcagtaccccgagtcatcagaggaagccgttacactcgtagaggacctcactcaaatcctggaagaagaggcccctcagaacagtacacttagccaggacacaccggaggaggaccccagggggaaacacgcattccagacaggttggctgaacgacctggtgacaaaggagtctatgaccttcaaggacgtcgcagtggatatcacacaggaggactgggagctgatgcgacccgtccagaaggagctttataagaccgtgacactgcagaactactggaacatggtgtctctgggactgaccgtctatcggccgacggttattcctatcttggaggagccctggatggtaatcaaggagatcctggagggcccctcccctgaatgggagaccaaagcacaggcatgcactccagtggaggacatgtctaagctgaccaaggaagagacacacaccataaagcttgaagacagctacgattatgacgacagacttgagaggagaggtaaaggcggcttttggaagattcacactgacgaacggggctttagcctgaaatcagtcctgagtcaggagtacgaccccactgaagaatgcctgagcaagtatgacatataccgaaacaacttcgaaaagcatagcaatcttattgtccagtttgacacgcagttagacaacaagacttcagtatataatgagggcagagcgactttcaaccacgtgagttacggtattgtacaccggaaaatcctaccgggggagaagccttacaaatgcaacgtgtgcggcaagaagttcagaaagtaccccagccttttaaagcaccaatctacccatgccaaggagaagagctacgagtgtgaggagtgcggcaaagaattcagacacatctcaagcctgatagcccatcaacggatgcatactggagagaagccatacgagtgccaccagtgtggcaaggcattcagtcagagggcccatctgacgatccaccagagaattcacaccggcgagaaaccctacaagtgtgatgactgtggcaaggacttcagtcagagggcacacctgaccatccatcaaaggactcacacaggggaaaagccttataaatgtttggagtgtgggaagacattctctcactcatctagtctcattaaccatcagcgggtgcacaccggggaaaaaccatacatctgtaacgagtgtggcaaaacgttttcccagagcacacatctacttcagcatcagaagattcacacgggcaaaaagccatacaagtgtaatgaatgttggaaagtcttcagccaatcaacatacttaatccggcaccaacggatccactccggcgagaaatgttacaagtgtaatgagtgcgggaaagccttcgctcacagttccaccctgattcaacaccaaacgacccacacaggcgagaagtcatatatctgcaacatctgcggcaaggccttctcgcagtccgccaatcttactcagcatcacagaacgcataccggagagaagccctataagtgttcagtctgtgggaaagctttttcacagagtgtccacctgacacaacatcagcgaatccacaacggtgaaaaaccctttaaatgcaacatatgcggtaaggcctaccgacagggagcaaatctaacgcagcaccagcgaatacacacaggtgagaagccgtacaaatgcaatgagtgcggaaaagccttcatatattcttcatccctcaaccaacaccagagaacccatacgggcgagcgcccatataaatgtaacgagtgcgataaggattttagccagcgcacttgtctgattcagcatcagcgcattcacaccggcgagaagccctacgcatgtaggatctgcggcaagacctttacgcagtcaaccaacctgatccagcaccaacgcgtccacactggcgctaagcatcgcaactag

SEQ ID NO: 14033 - DNA, 2286 bp, Artificial Sequence
  Description of Artificial Sequence: Synthetic coding sequence
atgttagccagctctaagcggatgaattcgtccagtcggtctcagatcctgcttcggtggaagtcagataaagctcagtctggcccctataacgtggagaaggaaatccttacaagccgcttcctacgggacaccgagacctgtcgccagaatttccgcaacttcccctaccccgatcttgccgggccaaggaaggcccttagccaactcagagaactgtgcctcaagtggctccgtcctgaaatccattctaaggaacaaatcttggagctgctggtcctggaacaattcctcacaatcctccctggagaagtccgtacttgggtgaagtcccagtatcctgagtcaagcgaggaagctgtcaccctggttgaagacttgacccagatccttgaggaggaggcgccccaaaatagcactctgagtcaagatactcccgaggaggaccctagggggaaacacgcattccagaccggatggcttaacgatttagtgaccaaggagtccatgacctttaaggatgtggcggtggatattacacaggaagactgggagctcatgcggccagtccagaaagaactatacaagaccgtgaccctgcagaattattggaacatggtgtctctgggtttgacagtctaccggcccacagttatccccatcctagaagaaccttggatggtgatcaaggagatactggaaggacctagccccgagtgggagacgaaagcacaggcctgtactccagtagaagacatgagcaagctcacaaaagaggagacacacaccattaaattggaagacagctatgattatgacgatagattggagaggaggggaaagggagggttctggaaaatccacactgatgagcggggattcagtttgaagagcgtgctgtctcaggagtacgatccaacggaggaatgtctcagcaagtacgacatctacaggaataactttgagaagcatagtaatctcatcgtgcagttcgatacacagttagacaacaagacctccgtgtacaatgagggccgtgccacatttaaccacgtgtcctacggcatcgtccacagaaaaatcttgcccggggagaagccctataagtgtaatgtgtgcggtaagaagtttcgcaaatatccatcattactgaagcaccaaagcacacatgcgaaagaaaaaagttacgaatgtgaggaatgtggaaaagagttcagacatatcagctctttaatcgcgcatcagaggatgcacactggagagaaaccctacgagtgccaccagtgcgggaaagccttctcacagcgagcgcatctcacaatacatcagcgaattcacacaggcgaaaaaccatacaagtgtgatgattgtggcaaggatttttctcagagggcacacctcactattcatcaacggacgcacacaggggaaaagccatataagtgccttgagtgcgggaaaacatttagccattctagcagcctcatcaatcaccaaagagtgcatacaggagagaaaccatatatttgcaacgagtgtggcaagactttttctcagtccacacacctccttcagcaccagaaaatccataccggcaagaaaccatacaagtgtaatgaatgttggaaagtgttctcccaatcaacctatttaattcgccatcaacgaattcactctggcgagaaatgttacaagtgcaatgagtgtgggaaagcctttgcccatagtagcacactcatccagcaccagacaacccacaccggggagaaaagttacatttgcaacatatgcgggaaggccttttctcagagtgcaaacctcactcagcaccatcgcacccacactggagagaagccttacaagtgttccgtgtgcgggaaagctttcagtcagtcagttcatcttacccaacatcaacggattcacaatggagaaaaaccatttaaatgtaatatttgcggcaaggcttataggcagggcgccaatttgacacaacatcaacggatacatactggagagaaaccttataagtgtaatgagtgcggaaaggcgttcatctacagctccagcctgaatcagcaccagcggacacacactggagagcgcccatataagtgtaacgagtgcgacaaagatttctcccagaggacttgcttgattcagcatcagcgtatccacaccggggagaaaccgtacgcttgcagaatttgtgggaagactttcacacagagcaccaacctgatccagcaccaacgcgtacacaccggcgcgaaacatcgaaattag

SEQ ID NO: 14034 - DNA, 174 bp, Artificial Sequence
  Description of Artificial Sequence: Synthetic coding sequence
atgttggcatcgtcaaagaggatgaattcatcctcacgtagccagatcttgttgcgctggaagagcgacaaggcccagagtggcccctacaatgtggagaaagagatcctgactagccgtttcttgagggatactgagacatgtagacagaatttcagaaattttccctactag

SEQ ID NO: 14035 - DNA, 8157 bp, Artificial Sequence
  Description of Artificial Sequence: Synthetic coding sequence
atggccgatgaagaggccgagcaggagagactgtcttgtggggagggcggatgtgttgcagaactgcagcgtctgggggagcgacttcaggagctcgagctacaactgagagaaagcagagtgcccgccgtggaagcggcaactgattactgccagcaactctgtcagaccctgctggagtatgcagagaagtggaagaccagcgaggatccgctgcccctcctcgaagtttacactgtggccatccagagctatgtgaaggccaggccgtatctcacgtctgaatgtgagaacgtggcccttgtgctggaaagactggctctgagctgcgtggaacttcttctgtgccttcctgtcgaactgtctgataaacagtgggagcagttccagacgctggtgcaggtggcccatgagaagctcatggaaaacggaagttgtgaattacatttcctcgcaaccctggcccaggagaccggagtgtggaagaatcccgtcctatgcacgatcctgtcccaggaacccctggacaaagataaggcgtttgagggccccatactccttgatatgaggatcaagcacctcattaagactaaccagcttagccaggcaacagctttggccaagttatgtagtgatcaccccgagatcgggattaaggggagtttcaagcaaacttatttagtttgcctttgtacgtcaagcccaaatggtaaactgatcgaggagatttccgaggtggactgcaaagatgctctagagatgatatgcaacctggagagcgaaggcgacgaaaaatcagctctggtgttatgcactgccttcctcagtcgtcagctccagcagggcgatatgtattgcgcatgggaactcacgctgttctggtcaaagttacagcagagagttgagccaagtatccaggtgtatctggaaagatgtagacagttgtctctcctgacaaaaactgtgtatcacattttctttctgatcaaggtgattaactccgaaacagagggcgcagggcttgctacatgcatagaactgtgtgtgaaagctttgcggcttgaaagcaccgaaaatacagaagtgaagatttctatctgcaagacaatctcctgcctgctgccggatgaccttgaagtgaaacgggcatgtcagctcagtgagtttctgattgaaccaactgtggatgcatattacgctgtcgaaatgttgtacaatcaacctgaccagaagtacgatgaggagaacctgcccatcccaaattcactgcgatgtgagctcttgctcgtcctaaagacccagtggccgttcgacccggagttctgggattggaagaccctcaaacgccagtgcctggcactaatgggagaagaggcctccattgtgtcatccatcgatgagctcaatgacagcgaggtgtacgagaaggtagtggattaccaagaagagagcaaggagacaagcatgaacggcctttcgggcggggtgggcgccaattcgggactcctaaaagacattggcgatgaaaaacagaagaaaagagaaattaaacagcttcgcgaacgcggttttatctccgctaggtttaggaactggcaggcctatatgcagtattgcgtgttgtgcgacaaagaattcctgggacaccgtatcgtgcgacacgctcagaagcactataaggacggaatctatagttgccccatctgtgcaaagaactttaactctaaggaaacattcgtcccccacgtaactcttcatgtgaaacagtcttcgaaagagcgccttgctgctatgaaacccctgcgtcgcttaggtcgcccgccaaagattactactaccaatgagaaccagaaaaccaatacagttgctaaacaggaacagcggcctattaagaaaaattctctctacagtactgatttcatcgtgttcaatgataacgatggcagtgacgacgaaaatgacgacaaagacaagtcgtatgaacctgaagtgattccagtccaaaagcccgtaccagtgaacgaattcaattgcccggtcacattctgcaagaagggcttcaagtattttaaaaacttgatcgcccatgtgaaaggacacaaagacaatgaggacgcaaaacgattcctggaaatgcaatcaaagaaggtgatctgccagtactgtaggcggcactttgtcagcgtgacacacttgaatgatcacctgcagatgcactgtggtagtaaaccatatatctgtattcagatgaagtgtaaagcaggcttcaacagctatgcagagctcctgacacaccgcaaggagcaccaggtttttcgggctaaatgtatgtttcccaaatgtggacggatcttttccgaagcctatctgctgtacgaccatgaggcccagcattacaacacatacacttgtaaattcacaggatgtggcaaagtctatcgctctcagggggaattagagaagcatctcgacgatcattcaacaccccccgagaaggtgctgcctcccgaagcccagctgaatagctctggggacagcatccaaccatctgaagtcaatcagaataccgctgagaatattgagaaggaaagatccatgcttcccagcgagaacaatatagaaaactccctcttagccgacagaagtgacgcctgggataagtctaaagctgaatctgccgtgaccaagcaagatcagatctctgctagcgaattgcgccaggctaacggacccctgagtaatggactcgagaaccctgccaccacgcccttactacaatcgagtgaagtagcggtctcaatcaaggtgtccctcaatcaggggattgaggacaatttcggaaagcaggaaaacagtacggtggagggttctggcgaggctcttgtcaccgatctacacactcccgttgaagacacctgtaacgacctctgtcaccctggcttccaagagagaaaagaacaagactgttttaacgatgcacacgtgactcaaaacagccttgttaactctgagacattgaaaatcggagatctaacaccccaaaatctggaacggcaggtcaacaatctgatgacgttcagcgttcaaaatcaggccgccttccagaacaaccttcccacatccaaattcgagtgtggagacaacgtaaaaaccagtagtaatctgtacaatttgccactgaagactctggagagcatcgcatttgtacctccccagtcagacctgagcaactctctaggaaccccaagcgtgcctccaaaagctccagtgcagaagttttcgtgtcaagtcgaaggctgtactaggacatataattcttcccaatcaatcggaaagcacatgaaaacagcacatccagatcaatacgccgcattcaaaatgcaaaggaagagtaagaaggggcagaaagcaaacaatttaaacaccccgaataacggaaagttcgtatactttcttccatcccctgtgaattcatcgaatcctttcttcactagtcagaccaaggcaaacggaaatcctgcttgcagcgctcagctgcagcatgtgtctcctcccatcttccccgctcacttagcctctgtcagtacaccattgctgtcttcaatggagtccgtcattaaccccaacattaccagtcaggataagaatgagcagggagggatgttatgttctcagatggagaatctcccttccacggctctgcctgcacagatggaagatctcactaagaccgtcctgcccctgaatattgactccggttctgatccctttctgcctctgccagcagagtcgagctctatgtcactgttcccatctcctgccgattccggcaccaactctgtcttctctcagctggagaataatactaaccactactccagccagatcgaagggaatacaaacagtagtttcctgaagggtggtaacggggagaacgcagtgttcccatcccaagtgaatgttgccaataatttttctagcaccaatgcccagcagagcgcccccgaaaaagtgaagaaagatcgcggtcgcggaccaaacggaaaagaacgtaagccaaaacataataaacgggccaaatggcctgcgatcatcagagatggcaagtttatctgctctagatgctaccgggcctttactaatccccgcagtctcggcgggcacttaagtaagcgttcttactgtaaacccctggacggggctgaaatcgcccaggagctactgcagagtaatgggcagcccagtctcctggccagtatgattctgagcaccaacgccgttaacctgcagcagccccagcagagtactttcaatccagaggcctgctttaaagatccttcatttcttcaactgcttgccgaaaatcgaagcccagcgttcctgccgaacacgttccccagaagtggtgtgaccaatttcaatactagcgtgtcacaggagggtagcgagatcatcaaacaagctctggaaactgccggcatcccatccaccttcgagggcgccgagatgctctcccacgtgtccaccggctgcgttagtgatgccagccaggtgaacgccacggtcatgccaaaccctaccgtgccacctctgctgcacaccgtttgccatccaaacacacttctgacaaatcagaatagaacatcgaattcaaaaacctcttctatcgaggaatgctcttctctgcctgtgttcccgacaaatgatttacttttgaagacagtcgagaacggcctgtgtagctcctccttcccaaatagcggtggacctagccagaatttcacctctaattcctcaagagtgagtgtgatcagtggaccgcaaaacacccggagtagccatctgaataaaaaaggtaactccgcttcaaaacgtcggaagaaagttgcccctcccctcattgcacccaacgcgagccagaatttggtgacatccgatctgactaccatgggtctgatcgcaaagagtgttgagattccaaccactaacttacactctaacgtgatcccaacatgtgagccacagagtctggtagagaatcttacacaaaaattgaacaacgtcaataatcagctgtttatgaccgacgtgaaggaaaatttcaaaacatcactagaaagccataccgtgctggcccctttgacactgaaaacagagaacggagactcgcagatgatggctctgaactcatgtacgacaagcataaacagcgacctgcagatcagtgaggacaacgtaatacagaatttcgagaaaaccttagagattataaagacagctatgaattcccaaattctcgaggtcaagtcaggctcacagggagcgggcgaaacctcccagaacgcccagatcaactacaacattcagttacccagtgtgaatacagtgcagaataataagcttcccgactcgagtcctttctcctcattcatttcagtcatgcccaccaagagtaatattcctcagtctgaagtgtcacacaaggaagatcagattcaagagattttggagggacttcaaaaattaaaactcgagaatgatctttcaactcctgcttcacaatgcgtgcttatcaatacctcagtcactctcacacctacacccgtcaagagcactgccgatatcaccgttatccagcctgtttctgagatgatcaatatccagtttaatgacaaagtgaataagccctttgtatgtcagaaccagggctgtaactacagtgccatgacaaaagatgcactcttcaaacactatggtaaaatccaccaatatacccctgagatgatcctcgagattaaaaaaaaccagctgaagtttgcgcctttcaagtgcgtggtgcctacatgcactaagacatttacacggaatagtaacctccgtgcccactgtcagcttgtccatcattttacaactgaggagatggtgaagctgaagattaaacgcccctatgggcgcaaatcgcaatcagagaacgtgcctgctagcagatccacacaggtcaagaagcagctagcaatgacagaagagaataaaaaagaatcccagcccgctttagaactgagggccgagacgcagaatacacactccaacgtggcagtgataccggaaaagcagcttgttgagaagaaatcccccgataaaaccgagagcagcctgcaagtcatcaccgtgacgagcgagcaatgtaacaccaatgcgctaacgaacactcagacaaaaggaaggaagatcaggagacacaaaaaggaaaaggaagagaaaaagcggaagaagccagtatcccagtctttagaatttccaacacgctactccccatatcggccttatagatgtgttcaccagggctgcttcgccgcttttaccatccaacagaatctgatacttcattaccaggccgtgcacaaaagcgacctgcccgctttctccgctgaagtggaggaggaaagtgaggcaggcaaagaatccgaagagaccgagacaaaacagaccctgaaggaatttcgatgccaggtgagcgactgttccagaatattccaggccatcacaggactgatccagcattatatgaaactccatgaaatgacccctgaggaaatagagtctatgacagcctcagtggacgtggggaagttcccttgcgaccagctcgagtgcaagtccagcttcacaacttatctgaactatgtcgttcacctggaggctgaccacggcatcggtttgagggcttctaagaccgaggaggatggggtgtataagtgcgactgtgagggatgcgaccgcatttacgccaccagatccaatctgctacgtcacatcttcaacaagcacaacgataaacataaagcccatctgatcaggccaagaaggctgacccctgggcaagagaatatgtcaagcaaggctaaccaagagaaatctaaatctaaacatagagggacaaaacattcccgatgtggcaaggaaggcataaaaatgccaaaaacgaagagaaagaaaaagaataacctcgaaaataagaacgctaaaatagtccagatcgaagaaaataagccatacagtcttaagcgcggtaaacacgtctattccattaaggcccgtaatgatgccttatctgagtgcacctcacgattcgtgacccagtacccttgcatgataaaaggttgcacctccgttgtcacaagcgaatccaatataattcggcattacaagtgccacaagctgtcgaaagctttcacctctcagcaccgtaacctgctcattgtcttcaagaggtgttgtaacagccaggtaaaagagacctccgagcaggagggggccaaaaacgatgtaaaggatagcgatacctgtgtaagtgagtctaatgataattctaggactaccgccaccgttagccagaaggaggtggagaagaatgaaaaagacgagatggatgagctgactgaactcttcatcaccaaacttatcaatgaggactctacaagtgtggaaactcaggctaacacaagctccaatgtgtcaaacgatttccaggaagacaatctgtgtcagagcgagagacagaaggctagcaatcttaaacgtgtcaacaaagagaagaacgtgagtcaaaacaagaaacggaaagtggaaaaggcagagccggcaagcgcagcagaattaagcagcgttcggaaggaagaggaaactgcagtggccattcaaactatagaggagcatccagcatcatttgactggagtagcttcaagcccatgggctttgaggtctcattcttaaagtttttagaagagagcgctgtgaaacaaaagaaaaatactgacaaagatcaccctaacacaggaaataagaagggatcccattccaatagtcggaaaaacattgataagaccgctgtgacctccggcaaccacgtgtgcccttgcaaggagagcgaaaccttcgtgcaatttgctaacccttcccagctccagtgtagcgacaacgtgaagatcgttctagataagaacctcaaggactgcacagaactggtgttgaagcagctccaggaaatgaagcctactgtgagcttgaagaagctcgaagtccacagcaatgatccggacatgtccgtcatgaaagacatttcaatagggaaggctacaggacgggggcaatactag

SEQ ID NO: 14036 - DNA, 8172 bp, Artificial Sequence
  Description of Artificial Sequence: Synthetic coding sequence
atggccgatgaggaggccgagcaggagcgtctcagctgcggcgagggaggttgcgtggccgaactgcaaagattgggggaacgtctgcaggagcttgagctgcagctacgggagagtcgcgttcccgccgtggaagccgccactgattactgtcagcagctatgccagactctcctggagtatgccgagaagtggaagacttccgaagaccccctgccgctcctggaagtctatacggtcgcaatccaatcttacgttaaagcgagaccttatttaacttccgagtgcgagaatgtcgccctggtcctggagcggttggccctcagttgcgttgaactgctgctgtgtttaccagtggagctctcggacaagcagtgggaacagttccaaaccctggtacaagttgcacacgaaaagcttatggaaaatggaagctgtgaactccatttcctggctacattagctcaggagactggagtgtggaaaaatccagtgctctgtaccatactcagtcaggaacctcttgataaagacaaagtaaatgaatttttagccttcgaaggtcctatattgctggatatgcgtatcaagcacctcatcaagacaaaccagctgagtcaggctacagccttggccaaactatgtagtgatcatcctgagatcggcattaaaggatcattcaaacagacctatttggtatgcctgtgcacctcctctccaaatggtaagctgattgaagagatcagcgaggttgattgtaaggacgctctagagatgatatgtaatctggagtcggagggagacgagaagagtgccctggtgttatgtacagcttttcttagccgtcagctccagcagggtgatatgtactgcgcatgggagcttacgctgttttggagcaagcttcagcagcgtgtggaaccgtcaatccaagtgtatctcgagagatgcagacaactgtctctgctaaccaagaccgtctatcatatctttttcctgattaaggtgattaattcagagacggaaggcgcaggtctggctacatgcatcgagctctgcgtgaaagcgctcagattggagtccactgagaacactgaagtaaaaatctcaatctgtaaaactatatcctgtttgctgcctgatgatctggaggttaaaagagcctgtcaactctcagaattccttatcgaacctaccgtggatgcctactacgctgtggaaatgttgtacaaccagccagaccagaagtacgatgaggagaatttgccaatacctaactctctacggtgtgaacttctgctggtactaaaaacccagtggccatttgaccccgagttctgggattggaaaacactgaagaggcagtgcctggcactaatgggtgaagaagcaagtatcgtctcatcaatcgatgagctgaatgactccgaggtgtacgaaaaagttgtggactatcaggaggagtccaaagaaacaagcatgaacgggttgagcggcggggtgggagctaattctggcctccttaaagacatcggcgacgagaagcagaagaagagagagattaaacagctgcgcgaaagggggttcatcagcgctaggtttaggaactggcaggcttatatgcaatattgtgtgctatgtgataaggaatttctggggcatcggattgtcagacatgctcagaaacattataaagacgggatttatagctgcccaatatgcgctaaaaacttcaattcaaaggagacattcgtaccacatgttaccctgcatgtgaagcagtcctctaaggaaagactggcagccatgaaacccctcaggcgacttggtagacctccaaagataacaactacaaatgaaaatcagaagacaaacaccgtggcaaaacaggagcaacgacccattaaaaagaactccctctattccacggatttcatcgtctttaatgataacgatggctccgacgatgagaatgacgataaagacaaatcttatgaacccgaagtgattccggtgcagaagccagttcctgtcaatgagtttaactgtccagtgaccttctgcaaaaaaggctttaagtatttcaagaatctcattgcacacgtgaaagggcacaaggacaacgaggatgctaagcggtttttagagatgcagtcaaagaaggtgatatgccagtattgccggaggcactttgtttcagtgacacacctaaatgatcacctacaaatgcactgcggctccaagccgtatatctgcatccaaatgaaatgcaaagccggcttcaattcctatgccgaattacttacacaccggaaggagcaccaggtttttcgcgcgaagtgtatgttccccaagtgtgggcggatttttagcgaggcatatctcctctacgaccacgaggcccagcattataatacctatacctgtaagttcacgggctgtggaaaagtttataggagccagggagaacttgaaaagcatttagatgaccactctacaccgcccgaaaaagtgttgccccccgaggcccaactgaacagttcaggagatagcatacagccttccgaagttaatcagaataccgcagagaacatcgaaaaggaaagatcaatgctgccttccgagaacaatatagaaaacagtctgctggcggacagaagtgacgcctgggacaaatctaaggcagagtctgcagtgacgaaacaggaccaaatctccgcctctgaattgcgccaggcgaacgggccactcagcaacggtctcgagaaccccgccacaacacctcttttgcagtctagcgaagtcgccgtcagcattaaggtctctctaaatcaggggattgaagataacttcggcaagcaagaaaattctaccgtggaaggttccggggaggcccttgtgaccgacttgcatacccctgtggaagacacatgcaacgatctgtgtcatccaggctttcaggagcgcaaagaacaggactgcttcaacgacgctcatgtcactcagaactccttggtgaatagcgaaactctgaagatcggcgatctgaccccacagaatttggaacgtcaagtgaataacttgatgacattctcagtgcaaaaccaggcagccttccagaacaacttgcccaccagcaagttcgagtgcggagacaatgtgaagaccagcagtaacttgtacaatttacctcttaagacactcgaatccatcgccttcgtaccaccccagagcgatctctccaacagcttgggaacacccagcgttccccccaaagcacccgttcagaaattttcttgtcaggtcgagggttgcaccagaacctacaattctagtcaaagtatcggaaagcacatgaaaacagctcaccccgaccaatatgctgcatttaaaatgcagagaaagagcaaaaaaggccagaaagccaacaacctgaacacgcccaataacgggaagttcgtgtattttttgccaagtcctgtaaacagcagcaatcctttcttcacctcccagaccaaagccaacgggaacccggcttgcagcgctcagctgcagcacgtgagtccacccattttcccagcccacttagcctccgtgagtacacccctgctgtcttctatggagagcgttatcaatcccaacatcacctcgcaggacaaaaatgagcaggggggtatgctgtgctcccagatggaaaacctgccctccacagcactgccagcgcaaatggaggatttgactaagaccgtgcttcctctgaacatagatagcggatccgacccttttttgccgcttccagctgagtctagcagcatgtccctattcccgtcaccagctgactcaggcactaactcagtgttcagccagctcgaaaataacacgaatcattactcatctcagatcgagggcaacaccaattcgtcattcctcaagggcggaaacggcgaaaacgccgtgttcccgagccaggtgaacgtggctaacaacttctcctcgacgaacgcccagcagagcgcacccgaaaaagttaaaaaggacaggggacggggccccaatggtaaggaacgaaagccaaagcacaataaacgagcgaagtggccggccatcatcagggacggcaaatttatatgcagccgctgctatcgagccttcacgaacccaaggtctcttggaggccacctgtcaaagcgctcttattgtaagcctctcgatggggctgaaattgcccaagagctgctccagtctaatggacagccgtccctactggcctccatgattttaagcactaacgctgtgaatctgcagcaacctcaacaatcgacgttcaatcccgaggcttgctttaaagaccccagcttcctgcagttgttagcagaaaatcggagcccggccttcctcccgaatacctttccccggagtggtgtcaccaacttcaatacgagcgtttctcaggaaggctctgaaattataaagcaagccctagagaccgcaggcatccctagtacatttgagggtgctgagatgctgagtcacgtgtccactgggtgtgtgtccgatgccagtcaggtcaacgcaactgtaatgccgaatccaaccgtgccgcccctgctacacacggtctgtcaccccaacacgcttctgactaatcaaaatagaactagcaactcaaagacctcttctatcgaggagtgtagcagcctgcctgtgtttccgacaaatgatctgctgctaaaaactgttgagaatgggctttgttcgtcctctttcccgaactccggcggacccagccagaattttacatcaaatagctcccgagtgagcgttatatctggcccccaaaacactcggagcagccacctaaacaaaaagggtaattcagctagcaagcgacgcaagaaggtggcccctcctctgattgcacccaatgccagtcaaaacctggttacatctgacttgacgaccatggggctaatagccaaatcagtagagatcccgactactaacctgcatagtaatgttataccaacttgtgagcctcagtctctagttgagaatctgacccagaaacttaacaatgtcaataaccagcttttcatgactgacgtaaaagagaattttaaaacctccttggaaagccatacagtactggcccctttgacgctaaagacagagaatggcgattcccagatgatggccctgaattcctgcactacctccattaacagtgacctacagatatctgaagacaacgtcatccagaattttgagaagaccctggaaatcattaagacagctatgaacagtcagatcctcgaagtaaaaagtggttcacagggagcaggagaaactagccagaacgctcagatcaactataatatccagcttccaagtgttaacacagtccagaacaacaaactgcccgactcttccccattcagctctttcatctcggttatgcctaccaagagtaacatcccccagtcggaagtgtctcataaagaggaccagattcaggaaatcctggagggcctccagaagctgaagctggaaaacgatctctcaacccccgcctcccagtgcgttttgataaatacaagcgttacattaactccgacgccagtgaaatccaccgccgatatcacagtgatacaaccggtgagtgaaatgatcaacatccagttcaatgataaagtgaataagcccttcgtgtgtcagaatcaggggtgcaattatagcgcaatgacaaaggacgcccttttcaaacattacggcaagattcaccagtacactcctgagatgatcctggagattaaaaaaaaccagctcaaatttgccccatttaagtgtgtggtgccaacctgtacgaaaacctttacaaggaattcaaatctccgagcccactgccagctggtccatcactttaccacagaggagatggtaaagctcaaaatcaagcgtccttacggaagaaaaagtcagagcgaaaacgtaccagcttcgcgatcgacacaggtgaagaagcagctcgccatgactgaagagaataagaaagagtcccagcctgcgttggagctacgtgccgaaactcagaatactcattcaaacgtggcagtcatccccgagaagcaactagttgagaagaaaagtccggacaagacagagtcctcactgcaagttatcaccgtgaccagcgagcagtgtaatactaatgccctcacaaacacacaaacaaaaggtcgtaagattcggcgacataagaaagagaaagaggaaaaaaaaagaaaaaaaccggtcagccagagcctggagtttcctacccgatactctccttatcgtccttaccggtgtgtacatcaaggttgcttcgcagctttcacaatccagcagaatcttattttacattaccaggcggtgcataagtccgacctacccgctttcagcgccgaggtagaagaggaatcagaggccggtaaagaatctgaagagacggaaaccaaacagacgctcaaagagtttagatgccaggtgtccgactgcagtcgaatcttccaggccattaccgggcttatccagcactatatgaaactccacgagatgaccccagaagagatagagtctatgacagctagcgtggatgtgggtaaattcccctgtgatcagctcgagtgtaagagcagtttcacaacataccttaactacgtcgtgcatcttgaagccgatcatggaatcggcttgagagcttcaaagacagaggaagatggcgtgtataagtgtgactgcgaaggctgcgacagaatatacgctacacgcagtaacctcctgcgtcacattttcaacaaacacaacgacaagcataaggctcacctgatcaggccaaggcgactaacaccagggcaggaaaatatgtcttccaaggctaaccaggagaagagcaagtccaagcatcggggcaccaagcactccagatgtggcaaggagggcattaaaatgcctaaaacaaagcgtaaaaaaaagaataacttagaaaacaagaacgcaaagatcgtccagatcgaagaaaacaaaccgtattcccttaagcgaggaaaacatgtgtattcgattaaagcaagaaacgatgccttgagcgaatgcacttcccgatttgtcacccagtatccgtgtatgatcaagggctgtacaagtgtggtgacttctgagagtaatattattcgccactacaagtgccataagttgtctaaagcgtttacttcgcagcaccggaatctgttgattgttttcaagcgctgttgcaatagtcaggtgaaggagacttctgaacaagaaggcgccaagaatgacgttaaggactcggatacctgtgtgtctgaatccaacgacaactcccggactaccgcaacagtctctcaaaaggaggtcgagaagaatgagaaggacgagatggatgagctgacagaactgttcatcacaaaactaataaacgaggactcgacatcggtagaaactcaggccaacacgtctagtaatgtgagcaatgactttcaggaagacaatttgtgtcagagcgagcggcaaaaagcctctaacctgaagagagtgaacaaagagaaaaatgtctcccaaaataagaaacggaaggttgagaaggcagaaccagcttccgctgctgagttatcaagcgtgcgcaaagaagaagagacagcagtggccatccaaacaattgaagagcaccctgccagctttgactggagcagcttcaagccaatgggctttgaggtgagttttctgaagtttctcgaggagagcgcggtgaaacaaaagaagaacaccgacaaagaccatcctaatacgggaaataaaaagggctcgcattccaattctcggaagaacattgataagaccgccgtcacctctgggaatcatgtttgcccatgcaaggagtctgaaacatttgtgcagttcgccaacccatcccagctccaatgttctgataatgtgaaaattgtcttagacaaaaacctgaaagattgcaccgaactggtcttgaagcaactgcaggagatgaagccgaccgtgtcccttaagaaactcgaggtgcattccaacgatcctgacatgtccgtgatgaaggacatctccattggaaaagccacaggccgtggccaatactag

SEQ ID NO: 14037 - DNA, 3201 bp, Artificial Sequence
  Description of Artificial Sequence: Synthetic coding sequence
atggaaggcctgttgcactacattaatcctgcacacgctatcagcctgctttcagccttgaatgaggagcgccttaaaggccagctttgtgatgtcctcctaatagtcggcgaccagaagttccgcgctcataagaacgtacttgcagcctcatctgaatacttccagagccttttcactaataaggagaatgagagccagacagtgttccagttggatttctgcgagcctgacgcattcgacaacgtgctcaactacatatattccagcagcttatttgtggagaaaagcagccttgccgcagtacaggagctcggatacagcctgggtatctcatttctcacgaatattgtgtctaagactccccaggccccgtttcccacctgtcccaatcgtaaaaaagtattcgtggaagacgacgaaaattccagtcaaaagaggagcgtcattgtgtgtcagagcaggaatgaagcccaaggaaagacggtgagccagaaccaacccgatgtcagtcatactagtcgtccatctccttccatcgcagttaaggctaatactaataagcctcatgtaccaaagcccatcgaaccgctgcacaatttgagcctgaccgaaaaatcatggcctaaggacagctcggtggtttacgcaaaatccttagaacactctggctctctcgacgaccctaaccggatttccctcgtcaagagaaatgctgtgctccctagcaagcctttgcaagatcgcgaggccatggatgataagccaggtgtgtccgggcaactaccaaagggaaaggccctcgaattagcgctaaaacgcccacgtccccctgtcctctctgtatgctcaagtagcgagaccccgtacctgctgaaagagacaaacaagggtaacggacagggcgaggatagaaacttactgtattattccaaactgggcttagtgataccatcctctgggtcaggatctggcaatcagtctatcgatcgctctggacctctggtgaagtcgttgctgaggcggtctttgagcatggattcacaagtgcccgtatattccccctccatcgacctcaagtccagtcagggctctagttcggtgagtagtgatgctcctggaaatgtgctttgtgcgttatcccaaaaatctagcctgaaagattgctctgagaagactgctctagacgatcgtccccaggtgctgcagcctcaccgcttgagatcattctcagccagccaatctactgatagggagggagccagccccgttacagaggtgcgaatcaaaactgagcctagtagtccccttagcgatcccagcgatattatccgagtgacagtcggcgacgccgctaccaccgctgctgcttcgtcctcctcagtgactcgtgacttatccttgaagactgaggacgatcagaaagacatgagcagacttcccgctaagaggagatttcaggctgacagacgactcccttttaaaaagcttaaggtcaatgaacatggcagccccgtgagtgaggacaacttcgaggagggctcgtctcccactctgctggatgcagattttcccgactccgatctgaataaagacgagtttggcgagcttgagggaacgaggcctaacaagaagttcaaatgcaagcactgcttgaaaatcttcaggtcaactgctggattacaccgtcacgtgaatatgtaccacaatccagagaagccttacgcgtgtgacatttgtcacaaacggtttcatacaaattttaaggtatggactcattgccaaactcagcacggtattgtcaagaaccctagccctgccagtagctctcacgcagtgcttgacgaaaagttccagaggaagctgatcgatattgtaagggaaagagaaatcaagaaagccctgatcattaaactgcggagagggaagccagggtttcagggccagagttcatctcaggcccagcaagtgatcaaacggaacctgcgctcccgcgccaagggagcttatatttgtacttattgcggcaaggcctaccgtttcctgtcccaattcaaacagcatatcaaaatgcaccccggagagaagccccttggggtgaataaagtggcgaagcctaaagagcacgcccctcttgccagtcccgttgagaataaggaggtataccagtgcagactgtgtaacgccaaattaagtagtctgctggaacagggttcccatgagaggctgtgtcggaatgctgctgtgtgtccatactgcagtcttcgattcttcagccccgagctaaagcaggaacacgagtctaagtgcgagtacaagaaattgacctgtctggaatgtatgagaacattcaagtctagtttttcaatctggcgccaccaagtggaagtgcacaatcagaataacatggcccccaccgaaaacttcagtctgcccgtgttggaccataacggagatgttacagggtcgagcagaccacagagtcagcccgaaccaaacaaggtgaatcacatcgtgactaccaaagacgacaatgtattctcagacagcagcgagcaagtcaacttcgactctgaggactcctcatgcctgcccgaagacttgtcactgtctaagcagctgaaaatccaggttaaggaagaaccagtggaagaggccgaagaagaggcccccgaagcatccacggccccaaaggaggcagggccaagcaaagaggcctcgctgtggccctgcgagaaatgtggtaaaatgtttacagttcacaaacagttggagcgacaccaagagttactctgcagcgtgaagccattcatctgccacgtgtgcaataaagcttttcgaactaacttccggctttggtcgcacttccagtcccatatgtcccaggcctccgaagaaagtgcacacaaggagagcgaagtgtgtcctgtccccacaaattcaccaagccccccacctctgccaccaccacctccactcccaaagatccaacctctggagccagactcccccaccggcctttcagaaaatcctacacctgccaccgaaaaactattcgtaccacaggaaagcgacacactcttctatcatgcaccacccctgtctgccataaccttcaagcggcagttcatgtgtaagctatgccatcgcacgtttaaaactgcattttcactgtggtcccatgagcagacccataactag

SEQ ID NO: 14038 - DNA, 150 bp, Artificial Sequence
  Description of Artificial Sequence: Synthetic coding sequence
atggagggcctgctgcactatattaaccccgcacacgccatcagcctgcttagtgcattaaatgaggaaaggttaaaaggacagctttgcgatgtgcttttgattgtgggtgatcaaaagttccgagcacataaaaacgtcctggcctag

SEQ ID NO: 14039 - DNA, 3201 bp, Artificial Sequence
  Description of Artificial Sequence: Synthetic coding sequence
atggaggggctcctgcattacattaacccagcccatgccatttctttactgagcgcactgaatgaggagcgtctaaagggacaactgtgcgacgtgttactgatcgtcggagaccagaaattccgtgctcacaagaacgtattggccgctagctccgaatactttcagtctcttttcaccaataaagaaaacgagtcacaaacagtgttccaattggacttttgcgagcccgatgcctttgataatgtactgaattatatttactcaagctccctctttgtcgagaaatcatctctggctgctgtccaggagttgggatacagcctcgggatatccttcctcacgaatatagtaagcaaaacccctcaggccccatttcccacttgccctaataggaaaaaggtattcgtagaagatgatgagaactcttcccaaaagcgcagtgtgatcgtctgtcagtcacgcaatgaagcccagggcaagacagtgtcgcaaaaccagcctgatgtttcacacacatcccggccttccccatccatcgccgtgaaagccaatacaaacaagccacatgtgccgaaacccatcgaaccgctgcacaatttgtcactgacggagaagagctggccaaaggacagcagcgttgtgtacgcgaaatccttagagcacagcgggtcattagatgatcccaatcgtataagcctggttaagcggaatgccgtcctgccttcaaagcctcttcaggacagggaagcaatggatgacaaacccggtgtgagtggccagttgcctaagggcaaggctctggagctggccctgaaacggcctcggcctcctgttctctctgtgtgtagctctagtgaaaccccttatctcttgaaagaaactaacaagggcaatggacagggagaagatcggaacctactttattattcaaagttaggactggtgatcccatctagtggatccggatcaggcaatcagtctatcgatcggagtggtccactcgtgaagtctctgctcagaaggtcactgtccatggatagccaggtgccagtgtatagtccctctatcgacctaaaaagttcccaagggtcatcaagcgtgtcctcggacgctccaggaaacgtgctttgcgccttaagccagaagtctagtctgaaggactgttctgaaaaaacagccctggatgaccggccacaggtcttgcagcctcatcgcctgcgaagtttctctgctagccagtcaactgacagggaaggcgcttctccagtcactgaagttcggattaagaccgaaccatcttctccgctcagtgatccgtcagatatcatccgcgtaacggtgggcgacgctgccacaaccgccgcagcatcatcatcaagtgtgacacgcgacctatcccttaagacagaggatgaccaaaaagacatgagtagactgcccgccaaacgtcgcttccaggccgaccggcgccttccctttaaaaagctgaaagtaaacgaacacggctcgcctgtgtccgaggacaattttgaagaaggctcctctccaacactcctcgatgcagacttccctgactccgacctcaacaaggacgagttcggggaacttgagggtacaagaccgaataagaagttcaaatgtaaacattgcctcaaaatctttcggtcaactgcgggattgcatcggcacgtgaatatgtatcataacccagagaagccatacgcctgcgatatctgccataaacgattccatactaacttcaaagtgtggacccactgccagacacaacatggcatcgtgaagaatcctagtcccgcaagttcatcacacgcggtactcgatgagaaatttcagcgcaagctgattgacatcgtcagggagcgggaaattaaaaaggccttgataatcaagctgaggcgcgggaagccaggcttccaggggcagtcatctagtcaagcacagcaggtcattaaaagaaatttgcggtccagggcaaaaggtgcatacatttgcacctattgcggcaaagcctacaggttcctttcccagttcaagcagcacattaaaatgcacccgggagaaaaacccctgggcgttaacaaggtcgccaaacctaaagagcacgcgcctctcgctagcccagttgaaaacaaggaagtgtaccagtgccggctgtgtaacgcgaaactctcctcgctactcgagcaggggtctcacgaaagattatgtcgtaatgcggccgtgtgcccatattgctctctgcgcttcttctcccctgaactgaagcaggaacatgaatccaaatgcgagtacaaaaaactcacttgtctcgagtgtatgcgaaccttcaagtcttctttcagcatctggcgacaccaggtcgaagttcataaccagaacaacatggctcccactgagaacttctctctcccagtgcttgatcacaatggagatgttacgggtagcagtagacctcagtctcagccagagcccaataaggtgaaccacatcgtgaccacgaaagacgataacgtgtttagcgattcttcagaacaggtgaatttcgattcagaggatagctcttgccttccagaagacctctctctctccaagcagcttaagatccaggttaaagaggaacccgttgaggaggcagaggaggaggcacccgaggcatctaccgctccaaaggaagcaggcccttcgaaagaggcctcactttggccttgtgagaaatgcggcaagatgtttacggtgcacaaacagctcgaacgccatcaggaattgctttgttcagtcaaacctttcatttgtcacgtgtgcaataaggctttccgcaccaactttaggctttggtcccacttccagagccacatgtcccaggccagcgaggaaagcgcacacaaggagagcgaggtgtgccctgtccctacaaacagcccaagcccaccaccattgccacccccacctccccttccaaaaattcagcctttggaaccggactcgccaaccggtctgtcagaaaaccccacccctgcgaccgaaaagctctttgtgccccaagagtcggacacactattctaccacgcccccccactttcagctattacattcaagcggcaatttatgtgcaagttgtgtcatcgtactttcaaaaccgcgttcagcctctggagtcatgaacaaacacacaactag

SEQ ID NO: 14040 - DNA, 2598 bp, Artificial Sequence
  Description of Artificial Sequence: Synthetic coding sequence
atggaagggctgctacattacattaaccctgctcacgccataagcctgctttccgctttaaacgaggagcggctgaaaggccaactatgtgatgtcctgctgattgttggtgaccagaagtttagggcacataaaaacgtcttggctgctagttcagaatatttccagagcctcttcactaataaagaaaacgagtcccagacagtatttcaactcgacttctgcgagccggacgccttcgataacgttttaaattacatttactcaagttcgctttttgtggagaagagctcactggccgcggtacaggaactgggctactcacttggaatcagcttcctgactaatatcgtctctaagaccccccaggcgccatttcccacctgtccgaatcgcaaaaaggtgttcgtggaagatgacgagaactcatcacaaaaaagatccgtaattgtgtgtcagagtcggaacgaggcccagggcaagacagtgtcccagaaccagcccgacgtctctcacacatcaaggccgagcccttccatcgccgtcaaagctaatacaaataagcctcacgttccaaaaccgattgagcccctgcacaacttatctctgactgagaagtcctggccgaaggatagcagcgtggtgtacgcaaagtcactggagcacagcggctctttagacgatccaaataggatatccctggttaaacggaacgccgttcttccttccaagccactgcaagatcgggaagccatggacgataagccaggtgtatccggccaactcccaaaaggaaaggccttggaactggctctgaaacgaccgcgaccccctgtgctaagtgtatgctcttcctcagaaaccccatatctgctcaaagaaactaataaagggaatgggcaaggagaggacagaaatctgctttattattcaaagctcgggttggtgatcccatcgtcgggaagcggaagcgggaatcagagcattgacagatcaggcccactggtgaagagccttctgaggaggtctctgtctatggattcccaagttcctgtatactcaccaagcatagacttgaagagcagccaggggagcagctccgtgagttctgatgcaccaggaaacgtgttatgcgccctgtcccaaaagtcctcactcaaggactgttcagaaaaaaccgcgctggacgaccgccctcaggtgctgcagccacacaggctgcggtcattcagcgccagccagagtactgatcgcgaaggcgctagtcccgtaacagaggtccgcataaagaccgagccgagctctcccctttctgacccatctgacattatccgcgttactgtcggagacgccgcgacaacagcggccgctagttcctcttctgtgacacgggacctctctttgaagacggaagacgatcagaaagacatgtcaagactacctgcgaagcgccgctttcaggcagataggcgattgcccttcaaaaaactcaaggtgaatgagcatggaagcccagtatcggaggataactttgaagagggaagcagccccactttactggatgctgatttcccggacagtgacttaaacaaggacgagttcgagcagggcagtcacgagcggctttgtaggaatgctgccgtgtgtccatactgcagcctgaggttcttctcgcccgaactcaaacaggaacatgaatctaaatgcgaatataagaagctgacatgcctggagtgtatgcgtaccttcaaaagcagttttagtatatggagacatcaagttgaggtgcacaatcagaataatatggcccccaccgagaatttctcactgccagtcctggaccacaacggggatgtgacaggctcgtctcgaccccagagccagcctgagcccaacaaagttaaccatatcgtgacaaccaaagacgataatgttttttctgacagctctgagcaggtgaactttgattccgaagactccagctgccttccggaagacctgagcctgtctaagcagttgaaaatccaggtaaaggaggaacccgttgaagaggccgaggaagaagcacccgaggcatcaaccgcgccaaaggaagccggtccgagtaaggaggcgtcactgtggccatgcgagaaatgtggtaaaatgttcactgtccacaagcagttggagagacatcaggagttgctttgttcagttaagccattcatttgccacgtgtgcaacaaggcttttcgtaccaacttccgactgtggagccactttcaaagccacatgagccaggcatctgaagagagtgcacataaagaaagtgaggtttgcccagtccctaccaactcaccctcaccccccccattgccccctcccccgccccttccaaagattcagccactggaacccgattcgccgacaggcctttcagagaaccctacccctgcaactgagaaactgttcgtgccacaggagtctgacacccttttctatcatgccccaccgcttagcgccataacctttaaaagacagtttatgtgcaaactgtgtcacagaacttttaagacagctttttctctgtggagtcacgagcagacgcataactag

SEQ ID NO: 14041 - DNA, 3201 bp, Artificial Sequence
  Description of Artificial Sequence: Synthetic coding sequence
atggagggcctgctccactacatcaatcccgctcacgccatctccttactcagcgccttgaacgaggagcggctgaagggccagctatgtgacgtgctcctgatcgtcggggatcagaaatttcgtgctcacaaaaatgttctggccgccagcagtgaatactttcaatccctgttcactaataaggaaaatgagtcccaaaccgttttccaacttgatttttgcgagcctgatgcctttgacaatgtccttaactatatatattcatcctccttgtttgtggagaagtcctctcttgcagcagtgcaggagctgggctactcccttggcatctcgtttctgactaatattgttagcaagacaccccaggctccgttcccaacctgtccaaatcggaaaaaagtcttcgttgaggacgacgagaactcaagccagaagcggtcagtcatagtctgtcagtcgcgaaatgaagctcagggaaagaccgtgagccaaaatcagcctgatgttagtcatacttcgagaccttccccgtctatcgcagtgaaggccaatacaaacaagccccatgtcccgaaaccaatagaacctctgcacaatctgtcacttactgaaaagagctggcccaaagacagctccgtcgtctatgctaaatctctggagcactcaggtagcctagacgacccaaaccgcatttctctagtgaagaggaacgccgtgctcccttctaagccactccaggatcgcgaagccatggatgacaagcccggggtgtccggccagttgcctaagggaaaggctttagaattggcgctcaaaaggccccggccgcctgtgttgtccgtctgctcttcctctgaaacaccatacctattaaaggaaaccaacaaggggaatgggcagggcgaggaccgcaacctcctctactactctaaattgggactcgtgatcccttcctccggctctggtagtggcaatcaatccatcgacagaagcggtccgctcgtaaagtccctccttaggagatctttgtctatggactcccaggtcccggtctattcaccctcaattgacctgaagagctcccagggatccagctccgtttcatcggatgcgcccggcaatgtgctttgcgcactctcacaaaagtcaagtctgaaggattgttcagaaaagacggcattggacgataggccacaagtgctgcagccccatcgcttacggagtttttctgcaagtcagagcactgaccgagaaggcgcctccccagtgacagaggtgagaatcaagactgagcctagttctcctctgagcgatccttcagacattatccgtgtaactgttggagacgctgccaccacagcagcggcctcttcatccagcgttacacgggacctgagccttaaaactgaggacgatcagaaagatatgagtagacttcctgctaagcgccgtttccaagcggaccgacgcttaccattcaagaagctcaaagtgaatgagcatggaagccccgtctccgaagacaacttcgaagaaggaagtagccctacattattggatgctgacttccccgacagtgatctcaataaggacgagtttggcgaactggagggcacgcggcctaataagaaattcaagtgcaaacactgtctcaagatattcagatctactgccggtctacaccggcatgtcaacatgtatcacaatcctgaaaagccatatgcttgcgatatctgccataagcggtttcacaccaattttaaagtttggactcactgccagacgcagcatggaatagtgaagaatccatccccagccagtagctctcacgccgtactcgacgaaaagttccagcggaaattgatagacatagtgcgggagagagagatcaagaaagcgctgatcatcaagttgcgtagaggcaaaccaggatttcaggggcagagctcttcacaggcccagcaggtgatcaagagaaacctgaggtctagggcgaagggagcctatatttgtacctattgcggtaaagcttaccgatttttgtctcagtttaaacagcatattaaaatgcaccccggagaaaaaccacttggggtgaataaggtggctaagccaaaagagcatgcacccctggcatctcccgtggaaaacaaggaagtatatcaatgccgcctgtgcaatgctaaactctcaagtttgctggaacagggaagtcacgagagactgtgtcggaacgcagctgtgtgcccctactgtagtcttcggttctttagtccagaactgaaacaggagcacgagagcaagtgtgagtacaagaaattaacctgcctggaatgtatgagaacctttaagagctccttctcgatttggaggcaccaggtggaggtgcacaatcaaaacaacatggctccaaccgaaaatttcagtttgcctgtgctagaccacaatggcgacgtgactggatcctcaaggccccagtcgcagccagaaccaaacaaggtcaatcacatcgtaaccaccaaagacgacaacgtgttttccgacagctccgagcaggtaaacttcgacagtgaggatagttcctgcctgcctgaagatttatctttatcaaagcagctcaaaatccaagtgaaagaggaaccagtggaggaagccgaggaggaagctccggaagcgagcacggcccctaaagaggctggcccatcaaaagaagccagcctatggccttgcgaaaagtgcggcaagatgttcacagtgcacaagcagctggagcgccaccaggaacttttatgttccgtcaaacccttcatttgtcacgtgtgcaataaagcctttcgcacaaactttcggttgtggtctcacttccagtcccatatgagccaggctagtgaggaatcagcccacaaagaaagcgaggtatgtcctgtgccgactaactcaccatctcctcctccattgcccccaccccccccactccccaagattcaaccactggagcccgactctccaaccggcctgtccgagaatcccacgccagccacagagaagctgttcgtaccacaggagagtgacacactgttctatcacgctccaccgttgagcgccattacattcaagcggcagttcatgtgcaaactgtgccatcgtacttttaagacagcattctccttgtggagtcacgagcagactcacaactag

SEQ ID NO: 14042 - DNA, 360 bp, Artificial Sequence
  Description of Artificial Sequence: Synthetic coding sequence
atggaaggacttctgcattacatcaatcctgctcacgctattagtctgctgtcagcactcaatgaggagcgcctcaaaggccaactctgtgacgttctcttgatcgtgggcgaccagaagttccgggcccacaagaacgttcttgccgctagctctgagtactttcaatccctgtttactaacaaagagaacgagagccaaaccgtgtttcaacttgacttttgcgagcccgacgcatttgataatgtcttgaattacatctacagcagtagcctcttcgtcgagaaaagttcactggccgcagttcaggagctcggctactccctgggaatttcatttctgaccaacattgtttcatag

SEQ ID NO: 14043 - DNA, 150 bp, Artificial Sequence
  Description of Artificial Sequence: Synthetic coding sequence
atggaagggttactgcactatatcaatccagctcacgccatctctttgctctctgccttaaacgaggaaagacttaaggggcaattatgtgacgtactgctcatcgtcggagaccagaagttccgtgcccacaagaatgttttagcttag

SEQ ID NO: 14044 - DNA, 1872 bp, Artificial Sequence
  Description of Artificial Sequence: Synthetic coding sequence
atggctcataagtacgtaggcctgcagtaccacggctccgtgacctttgaagacgtcgctattgctttttctcaacaagaatgggagagccttgactcatcccagcggggactgtatagggatgtcatgcttgagaattaccggaatcttgtgtcgatgggccattctaggagtaagccacacgtgatcgcactcctggagcagtggaaggagcccgaggttactgtcagaaaagacggtcgtaggtggtgtaccgatctgcaactggaggatgatactattggctgtaaggaaatgcccaccagtgaaaattgcccttcttttgctctccatcagaagatctccagacagaagcccagggaatgccaggaatatggaaagactctgtgtcaagacagcaaaccagtccagcacgaaagaattcattcatcagaaaagcctaatagatgcaaggaatgtggtaagaacttcagcaacgggcatcagctcaccatccatcagaggctgcacgtgggggagaaaccctataagtatgagaaatgcggaaaagcctttatttcaggaagcgcttttgtgaagcacggacgcattcacactggagaaaaaccactgaagtgcaaacaatgcggcaaaaccataagtggaagctatcagttgactgtacataaatcgatccacactggaaagaagccctacgagtgtggagaatgcggaaaggccttcttagtgtacggcaaacttacaagacaccagagcactcacaccggcgagaaaccgttcggctgcgaggaatgtgggaaggcattcagtactttttcctatctcgtgcaacaccagcgaatacacacctctgaaaaaccatatgagtgcaaagagtgcggtaaggccttcagcacctcaagtcctctcgccaagcatcagaggatccataccggcgagaagccttacgaatgtaaggagtgcggaaaatcttttaccgtttacggacagctgacccgtcaccagtccattcacacaggagaaaaaccctttgaatgtaaagaatgcggaaaggcgtttcgcctgagctcctttctgcacgcacaccagcgaatccatgccgaaataaagccctatggctgcaaggagtgtgggcgcacattttctagggcttcctacctggttcagcatggcaggctccatactggggaaaagccttacgaatgcaaggagtgtggaaaggcattttcaactggttcttacctggttcagcaccagagaattcatacaggcgaaaagccctatgagtgtaaggagtgtggaaaggccttcatcagccgtcaccagttaactgttcaccaaagagtgcatacaggcgagaagccctacgagtgcaaggagtgtggtaaggcctttcgggtgcatgtgcatctgacgcagcatcgcaaaattcacactgacgtgaagccatatgaatgcaaggagtgcgggaagacattttcccgagccagttacctggttcaacatagccgcatccatacaggcaagaagccatacgaatgcaaagagtgcgggaaagctttctcctcaggatcgtatttggtacagcaccagagaatccacacgggagagaaaccttatgaatgtaacaaatgcggcaaagccttcacagtgtacggacagctgatcggacaccagtctgtacatacaggtgagaaacctttcgagtgcaaagagtgcggcaaagcgttcagacttaattcttttctcacggagcaccagcgagtgcacacaggtgagaaaccgttcaagtgcaaaaagtgtggtaagactttccgctatagttcagctctaaaggtacaccttcggaagcacatgagcgtgattccctag

SEQ ID NO: 14045 - DNA, 945 bp, Artificial Sequence
  Description of Artificial Sequence: Synthetic coding sequence
gaatgtggcaaggcgttttccaccttttcttaccttgtgcaacaccagagaatccacacctccgagaagccctacgagtgcaaggagtgtggaaaggccttctcaacatcttcccctctggctaaacatcaacgaatccacaccggcgagaagccctacgaatgcaaggagtgtggtaagtcattcacagtgtacgggcagttgaccagacaccagagcatccatacgggcgaaaaaccgtttgagtgtaaggagtgcggcaggactttttcccgggccagctacctcgtgcaacatggccggctgcacactggtgaaaaaccctatgaatgcaaggaatgtggcaaggccttttcaacgggttcataccttgtccaacatcagcgtatccatacgggcgagaaaccatacgagtgtaaggagtgcggcaaggcattcattagtcgtcatcagctgacggtgcaccagcgcgtccatactggggaaaagccctatgagtgcaaagagtgtggcaaagcctttagggtacacgtgcacttaacgcagcacagaaaaatacacaccgacgttaaaccgtatgaatgcaaagaatgcggcaaaacattttcaagagcctcttatctggttcagcactctcgcatccatacaggaaagaagccctacgaatgcaaagagtgtggtaaagctttctcttctggatcctaccttgtgcagcaccagagaatccatacgggcgaaaagccctatgaatgcaataagtgcggtaaagctttcacagtttacggtcaactgattggtcaccagagcgtccatacaggagagaagccatttgagtgtaaggagtgtggcaaggcctttaggctgaattcattccttaccgagcaccagcgcgtgcatacaggggagaagccatttaaatgtaagaagtgcggaaagacgttttag

SEQ ID NO: 14046 - DNA, 1629 bp, Artificial Sequence
  Description of Artificial Sequence: Synthetic coding sequence
atggagcctaaggatttgcagctcgaagacgacacaatcggatgtaaggaaatgccaacctcagagaactgccctagcttcgcgttacaccagaaaatttcacgacagaaaccgagggagtgccaggagtatggtaagaccctctgtcaagactctaagcctgtgcaacacgaaagaatacactcctcagaaaagccaaaccggtgtaaggagtgcggaaaaaacttttccaacggacaccaactaacaatccatcagcgcctccacgtgggcgagaaaccatacaaatatgaaaaatgtggaaaggcctttatctccggatccgcgttcgtcaaacacgggaggattcataccggtgagaagccccttaagtgtaagcagtgcgggaaaactataagtggatcctatcagctgactgtccacaagtcaatccatacaggcaagaaaccttatgagtgcggcgagtgtggaaaggcattcctggtatacggcaagctcactcggcaccagtctacacatacaggggaaaaaccctttggctgtgaggaatgcggtaaggctttcagcacatttagttatttggtgcagcaccagagaatccacaccagcgagaagccatacgagtgtaaagaatgtggcaaagctttctccacctcgtctcctctcgctaagcaccagaggatccacacaggtgagaagccctacgagtgtaaagagtgcggtaaaagcttcacagtgtatggtcagcttacacggcaccaatcaattcacacaggtgaaaaacccttcgagtgcaaggaatgcgggaaagcattcagactctcaagttttctgcacgcccaccagaggattcacgccgagattaaaccctatggctgcaaagagtgtggccggaccttttctcgggcttcttacctcgtacagcacggtcgattgcacacgggtgagaaaccatacgagtgcaaagaatgtgggaaagcttttagcactggcagttatctggtgcagcatcaaagaatccacacaggcgaaaagccatatgaatgcaaagaatgtggcaaagcctttatttctcgccatcaactaacagtgcaccaaagagtacatacaggcgagaagccctacgaatgtaaggagtgcggaaaggccttccgggtccacgtccacttgacgcagcaccggaaaatccataccgacgtgaagccctatgagtgtaaagagtgcggaaagacatttagtcgagcatcatatttggtgcagcacagcaggatacacactggcaaaaagccatatgaatgtaaggaatgcggcaaagcatttagcagtggctcctatctggtccagcatcagaggatccacacaggcgaaaagccttacgagtgtaacaaatgcggcaaggcttttactgtgtacggccagttgatcgggcatcaatccgtccacactggcgagaaaccatttgaatgcaaggaatgtggaaaggcttttcgcttaaacagtttcctgaccgagcatcaacgggtgcacactggcgaaaagccctttaaatgcaagaagtgcggaaagacctttcgatactcaagtgccctgaaagtgcacctcaggaagcacatgagtgttattccctag

SEQ ID NO: 14047 - DNA, 1875 bp, Artificial Sequence
  Description of Artificial Sequence: Synthetic coding sequence
atggcacacaagtatgttggcctgcagtaccacgggtccgtgacatttgaggacgtggcaattgccttcagccagcaagagtgggagagcttggattcatcccagaggggcctctatagggatgtgatgctggagaattatcgtaacctcgtgtcgatggccggccattcacgttccaaaccccacgtaatcgctttactggaacaatggaaggagcccgaggtgacagtgaggaaagacgggaggagatggtgtacagatctgcagctggaggacgatacaattggctgtaaggaaatgccaacctcagaaaactgcccttcattcgctttgcatcagaagatttctcgtcagaaaccccgggagtgtcaggagtacggtaagacgctgtgtcaggatagtaagccagtgcaacatgagcgaatccatagttccgaaaaacccaaccgctgcaaggagtgtggcaagaattttagcaacggtcaccagcttacaattcatcagagattgcacgttggcgagaagccttacaaatatgagaaatgtgggaaggcctttatatcaggatcagccttcgtgaaacatggcaggatccataccggcgaaaagccacttaagtgtaagcagtgtggcaagactattagtggttcctaccagctcacggttcataaaagtatccatactggcaagaaaccttatgaatgtggggagtgcgggaaggcctttctagtgtacggtaagttaaccaggcaccagtctacccacaccggagaaaagccatttggctgtgaggagtgcggaaaggcattcagcaccttctcctaccttgtgcagcatcagcgcatccacacctcagaaaagccatatgaatgcaaggagtgcggtaaagctttttcaactagctctcccctcgccaagcaccaaaggattcatactggagagaaaccatatgaatgcaaggaatgcgggaaatctttcactgtgtatggtcaattgaccagacaccagagtatccatactggagagaaacccttcgagtgcaaggagtgcggaaaggcattcagactgtcatcttttcttcatgcccatcagcgaatacacgccgaaattaaaccctatggctgcaaagaatgcggtcgaacattcagcagggcatcttatcttgtacaacacggccggctgcatacaggggagaagccgtacgaatgcaaagagtgtgggaaggccttttcaaccggttcttatctagtgcagcatcagagaatccacacaggcgagaaaccctatgagtgtaaggagtgtggcaaagcctttattagtcggcaccagctgacagtacatcagagggtacacaccggagaaaagccctatgagtgtaaagaatgcggcaaggccttccgagtacatgtgcatttgacacagcataggaaaatccataccgatgtgaagccttatgagtgcaaggagtgtgggaagaccttctctagggcctcttacctggtgcagcactcaagaatacatacagggaagaaaccctacgagtgcaaagaatgtgggaaggctttcagctccggatcctatctggtgcagcatcagaggatccatacgggcgagaagccatatgagtgtaacaagtgcggtaaagccttcacagtgtacggccagctgattggccatcaatcggttcataccggcgagaaacctttcgagtgtaaggaatgtggaaaagcattccggttgaattcattcctgacggaacatcagcgcgtccatacaggggaaaaaccctttaagtgtaaaaaatgtggtaagaccttccgctactctagcgccctgaaggtgcatctgcgaaaacacatgtccgtgataccctag

SEQ ID NO: 14048 - DNA, 1872 bp, Artificial Sequence
  Description of Artificial Sequence: Synthetic coding sequence
atggcccataaatacgtgggcttgcagtatcacggcagcgtgacgttcgaggatgtggctatagcttttagccagcaggagtgggagtccctggactcttcccaacggggactttacagagacgtcatgctggagaattatcgcaacttggtgtctatggggcatagccgctctaaacctcacgttattgcccttttggagcagtggaaggagccagaggttaccgtgcggaaagatggcaggagatggtgcaccgatctgcagctagaggatgacacaattggctgcaaggaaatgcctacctccgaaaattgtcctagtttcgccttgcatcaaaagatatccaggcagaagccaagagagtgccaggagtatgggaaaacactctgtcaggactctaagcccgtgcagcatgagaggattcatagcagcgaaaagcctaataggtgcaaggagtgcgggaaaaatttctccaacggtcaccagctgaccattcaccagcgcctccacgttggagaaaagccgtacaagtacgaaaagtgtggaaaggccttcatttctggatccgcctttgtgaaacacggacggatccacactggagaaaagccactgaagtgtaagcagtgtggcaaaaccatttccggttcttaccagctaaccgtgcacaaatccatccacaccgggaagaaaccatacgagtgcggggagtgcggtaaagcattcctggtgtacgggaaattaactagacaccagtctacacacacaggcgaaaagccctttggctgtgaggagtgtggaaaggccttcagcacattctcatatttggtgcaacaccagcgaatccacacctctgaaaagccctacgagtgcaaagagtgtggcaaagcgtttagtacttcctcccccttagccaaacaccaacggattcacaccggggagaaaccatacgagtgcaaagagtgcggaaagtctttcactgtttacggccagttgacgcggcaccagagtatccatactggcgaaaagcccttcgaatgtaaggaatgtggaaaggcttttcgcctgagctcatttcttcatgcccaccaaaggattcacgccgagatcaagccatacgggtgcaaggagtgtggacgcactttctcacgcgcaagctacctggttcagcatgggcggttgcacacaggagagaagccttatgaatgtaaggaatgcggcaaggcctttagcactggaagttacctcgtccagcaccagcgcatacacactggcgaaaagccctatgagtgcaaagagtgcggcaaggcttttatttcaaggcaccaactgactgttcatcagcgcgtccacacgggcgagaagccttatgagtgtaaggaatgcggaaaggctttccgtgtgcacgtgcacctgacacagcatcgtaagatccacacagacgtgaagccttacgagtgtaaggagtgtggtaaaacattcagtcgagcatcatatcttgtgcaacattcacgcatacataccggaaaaaagccttacgagtgtaaagagtgtggtaaggccttcagcagtggcagttatctggtgcagcatcagcggatccacacgggtgagaagccatatgaatgtaataagtgtggaaaggccttcaccgtgtatggccaactgatcgggcaccagtccgttcacactggcgagaagccatttgagtgtaaggagtgcggaaaggcattccggttgaattctttcctgaccgagcatcagagggttcacacgggggaaaagccgttcaaatgcaagaagtgtggcaagactttccggtactcgagcgccttgaaggtccacctgcggaagcatatgagcgtgatcccctag

SEQ ID NO: 14049 - DNA, 1560 bp, Artificial Sequence
  Description of Artificial Sequence: Synthetic coding sequence
atggcgcgagatctcgtgatgttccgcgatgttgcagtggacttttctcaagaggaatgggaatgcttgaattcttaccaacgaaatctgtaccgggacgtcatcctcgagaattacagcaacctggtgtccctagccggctgttccatctccaaaccagacgtgattacacttcttgagcagggtaaagaaccatggatggtagtccgtgacgagaaacgccggtggacactggatctggaaagcaggtacgacaccaaaaagttatttcagggcaaggatatttacgagatgaacctgagtcagtggaaggttatggagagaattaagtcctgcgggttagaggaacaagagagtcctcatgaagtgtgtttccgacaagtgacaaagactacatcggagaagatgcccacctataggaaattaacgtccctgccactgtatcagaagagtcacaacagagaaaagccctacgaatgtggcgagtgtgggaaggcatttagggtccggcagcaactgacttttcatcaaaggattcacactggggagaaaccctatgagtgcaaagagtgcggcaaggcctttagacaatgtgcccatttgagccggcaccaacggattcacacttcagataaattatacgaatgcaagaagtgcgggaagatttttacatgtgggagcgacttaagagtacatcagcggatacatatcggagaaaagccgtatgagtgtaaagaatgtggcaaagcttttagggttagaggccaactgaatctgcaccagcgcatccacacaggcgagaaaccatacgagtgtaaagagtgcggaaaagcatttaggcagtacgcccacttaacacgccatcaaaggttgaacatcgctgagaagtgctacgaatgtaaagagtgtggacaagcatttttatgctcaacagggttacgactgcatcacaagctccacaccggtgagaaaccctatgaatgcaaggagtgcgggaaagcttttagagtcagacagcagctcactttacatcagaggatccataccggggaaaaaccgtatgactgcaaggaatgtgggaagacattttcccgcgggtatcacttgactctgcaccagcgaattcacactggcgaaaagccttacgagtgcaaggaatgccaaaagttcttcaggcgctactccgagctgattagccatcaggggatccacatcggagaaaaaccttatgagtgtaaggagtgcgggaaggcctttcggctattcagccaactcacacagcaccagagcatacactttggagaaaaaccttttaagtgtaaggagtgtgaaaagacatttcgcttgctctcacaattgacccagcatcaatcaattcatacgggcgaaaagccatacgactgcaaagaatgtgggaaggctttccggctgcattcttcactgatacaacaccagagaatccattctggcgagaaaccctataagtgtaaagaatgtaaaaaggccttccgccaacatagccatctcacttatcatcagcgcatacacaacgtaacttag

SEQ ID NO: 14050 - DNA, 1560 bp, Artificial Sequence
  Description of Artificial Sequence: Synthetic coding sequence
atggcaagggatctcgttatgtttagagatgttgcagtagacttctcccaagaggaatgggagtgtctgaactcctatcagagaaacttatatcgcgatgtgatcctggagaactattcgaatctggtaagccttgccggatgctccatctcgaagccggacgtaattaccctcttggagcagggtaaggaaccatggatggtggtgagagatgagaagcgccggtggactctcgatttggaaagtaggtatgacactaaaaaactattccaggggaaggacatctatgaaatgaacctgagccagtggaaagtaatggaacgcatcaagtcatgcggattggaagagcaggaaagtccccacgaagtgtgttttaggcaggtgaccaaaacaacctcagagaagatgcctacttataggaagcttacatccttaccactatatcagaagtcccacaatcgggagaaaccatacgagtgtggcgagtgtgggaaagctttcagggttagacaacagctgacatttcatcagagaattcacacaggagaaaagccctacgagtgcaaagaatgtggcaaagcatttagacagtgcgcccatctatccagacaccagagaattcacacaagcgataagctgtacgaatgcaagaagtgcggcaagattttcacttgtggaagcgatctgagagtccatcaacgtatacacataggggagaagccttacgagtgtaaagagtgtgggaaggcattccgcgttcgcggccagctgaacctgcatcaacgcatccataccggggaaaaaccatacgaatgcaaggaatgcggtaaagcgtttcgccagtacgcacacctgaccaggcatcagcgcctgaatatcgctgaaaagtgctatgagtgtaaggagtgcggacaggcctttctgtgcagcacagggctgcggctccaccataaactgcataccggtgagaagccctacgagtgcaaggaatgtgggaaggcgttcagggtccgccagcagctgaccctgcaccagagaattcacaccggggaaaaaccttacgattgcaaggagtgtggcaagaccttcagccgggggtatcaccttaccttgcaccagcggatccatacaggcgagaaaccctacgaatgtaaggaatgtcagaaatttttccgacgttatagcgagcttatcagtcaccaggggattcacatcggcgaaaagccctatgagtgtaaggagtgtgggaaggcattcagactgttcagccagctgactcaacaccagtcgattcactttggtgagaaaccgtttaagtgtaaagagtgtgaaaaaacctttcgcctgctgtcccagctcacccaacaccagagcatccacactggcgagaagccttatgattgcaaagaatgcggaaaggcttttagactgcattccagcctgattcagcaccagcgaattcacagtggagagaagccctataagtgtaaggaatgtaaaaaggcatttaggcagcactcacacttgacgtaccatcagcggatccacaacgtgacctag

SEQ ID NO: 14051 - DNA, 1305 bp, Artificial Sequence
  Description of Artificial Sequence: Synthetic coding sequence
atggcccgcgacctcgtgatgtttcgcgatgttgcagtcgacttctcccaggaggagtgggagtgtctcaattcttaccagcggaatctgtaccgcgatgtcatcctggagaattacagtaatctggtgagtcttggctgcagtatttctaagccagacgtaattacacttctcgagcagggcaaagaaccttggatggtggtccgggacgagaaacgacggtggaccttagacttagagagccgctatgacacaaagaaactgttccaaggaaaggacatctatgaaatgaacctgtcccagtggaaagtgatggaaaggattaagtcctgcgggctggaagagcaggaatctccacacgaagtctgttttaggcaggtcaccaaaaccacaagcgagaaaatgcccacgtaccgcaaacttacttctctgcctctgtatcagaagtcgcataatcgtgagaaaccctacgaatgcggcgaatgtgggaaagcctttcgcgtgaggcagcaactgactttccaccagaggatccataccggggagaaaccttatgagtgtaaagaatgcggaaaagctttccgccagtgcgcacacctgtcgagacaccaacggatacacacatccgataagctatatgagtgtaagaagtgtggaaagatctttacttgtggcagcgaccttaggctgcaccacaagctgcatacaggtgagaaaccatacgaatgtaaggaatgcggtaaagcctttcgggttcgacaacaactcacactgcaccagcgaatccatacaggagagaaaccttacgactgtaaagaatgcggaaagacattctccagggggtaccacctgacgctccatcagaggatccacaccggtgagaaaccctatgaatgtaaagagtgccagaagtttttcaggagatattcagagctcatcagtcaccaaggaattcatatcggggaaaagccctatgaatgtaaggagtgtggaaaggccttccgcttgttctctcagctgacccagcatcagtcaattcactttggcgagaagccgtttaaatgtaaagagtgcgagaagacgttcagattgctttctcagctgacacagcaccagagcatacacacaggggaaaaaccatatgattgtaaagagtgtggtaaggctttccgcctgcattccagccttatccagcatcagcgaatccattctggcgagaagccctacaaatgcaaggaatgcaagaaggccttccgacagcactcacatctcacctatcatcagcggatacataatgtgacttag

SEQ ID NO: 14052 - DNA, 1560 bp, Artificial Sequence
  Description of Artificial Sequence: Synthetic coding sequence
atggcccgggatcttgtcatgttcagagacgtcgctgtggacttttcccaggaagagtgggagtgcttaaactcttaccaaaggaatttgtaccgagacgtgattcttgaaaattacagcaacctagtgtcccttgctgggtgcagtatatccaagcctgacgtgataactcttctggagcaaggaaaggaaccgtggatggtggtgagagatgagaagcgaagatggacccttgatctggaatcaaggtacgatactaaaaagctattccagggcaaggacatttatgagatgaatctcagccagtggaaagtcatggagcggattaagtcatgcggactagaagagcaggaaagcccacacgaagtgtgtttccgccaagtcactaagactacatccgagaaaatgcctacctacagaaagctcacgagtctaccgctttaccagaagtctcacaacagggagaaaccatacgaatgtggcgagtgtggaaaggcttttcgggttcgtcagcagctgacatttcatcagaggatccatactggtgaaaaaccatacgagtgtaaggagtgcggtaaagcgtttcggcagtgcgctcatctgagccggcaccaaagaatccacaccagcgataagctgtatgaatgtaaaaaatgtgggaagatatttacctgcggttctgatctcagagttcatcagcgtattcacatcggagagaagccctatgaatgcaaggaatgcggaaaggctttccgggtgaggggccagctgaacctccatcagcggatacacactggtgagaagccatacgagtgtaaggaatgtggaaaggctttccgccagtacgcccacttaacacgacatcagcggctgaacattgccgaaaagtgttatgagtgtaaagagtgtgggcaggctttcctttgcagcacagggctgaggttacaccacaaattgcacaccggggagaagccctatgagtgcaaagagtgtggcaaggccttccgggtcagacagcagctcaccctgcaccaacgaattcacactggagagaagccttatgattgtaaagagtgtggaaagacattctctagaggctaccatctgactctgcatcagcgcattcataccggcgagaaaccatatgagtgcaaggagtgccagaagttctttcgtcggtactccgagctgataagtcaccagggtatacacattggcgagaagccatacgagtgcaaggagtgtggcaaagctttcagacttttctcccagttaacgcagcaccagtcgatccatttcggagagaaaccttttaagtgtaaagagtgcgagaaaacctttagactgctcagccaactcacccaacatcagtccattcataccggggaaaaaccctatgactgcaaggaatgtgggaaagcttttcggctgcattcaagcctgattcagcatcagcgaatccacagcggagagaaaccgtataagtgtaaagagtgtaagaaggccttcagacagcattcacacctgacttatcatcagaggatacataacgtgacttag

SEQ ID NO: 14053 - DNA, 2001 bp, Artificial Sequence
  Description of Artificial Sequence: Synthetic coding sequence
atgcaggaagtcgtgctgctcgacgagtctagtggccctccgagccaacttctttggaccagacaagatacgcagctcccccaggagtccgccctcttacccgctccttaccccgcgtttacaaaagatggctcccaaggaaatctgccgcaggcggatattacgctgatgtcgcaggcacaggagtctgtaacattcgaggacgtggccgttaactttaccaatagagagtggcaatgccttacctacgcccaaagacacctttacaaggatgtaatgttagaaaactatggtaatatggtgtctcttggatttccttttccaaagccccctctgatctcgcatcttgaaagagaggtcgatccttgcgtccaggacccccaggatcgagaatctctgtcatgtagttatcctgtttctgccgataaaatgtggcccgagaatgagaaagcctccagccagcaggagatattcgaaaatggcgaggcttactggatgaaatttaattccctgctgaaggtagactcccgagaccctaaggttcgagaggtgtgtgtacaggatgtcaagttggaaaaccagtgggaaacatctatccgagaaaagctgagagaggaaaaagagggctctgaagaagtcacctgtaagaaaggcaagaaccagaaggtcctttctaaaaatttaaatccaaatagcaagcatagtcagtgcaacaaggttctgattgcacagaagctgcatgaatgtgcaaggtgcggaaagaatttctcttggcatagcgacttgattctgcacgagcagatacacagcggggaaaaaccccacgtttgtaacgaatgcggaaaagcctttaagacccgcaaccaactaagtatgcatagaattatccatactggagagaagccattcaactgcacacagtgtggaaaggcctttaacagtaggtctgctctctgtcgacacaaaaaaacccacagcggagagaagccccacgagtgtcgcgactgtggaaaagcctttaaaacgcgaaatagactgtgtatgcaccagcttatacatacaggtgagaaaccctacaaatgcaactgctgcgggaaggctttccagttcaagcatagcctcacaatccatggccgtatacataccggagaaaagccctatgaatgtgaggagtgcggtaaagctttttctggttcatcagacctgacaaaacacattaggatccatactggagaacgaccttacgaatgctctaagtgtggccgtgctttttctcgttccagtgacttgtcaaaacacaagaggatccatacaagagagaagcactacggatgcccgcaatgcggtaaggacttcagtatcaaggcagagttgactaaacacaggagaatccatacagaagagaaacggtaccgctgtgaggagtgtggaaaggccttccgccataactgcaaaaggagagcccatgaaagggagcataccggagagaaaccgtatcagtgccgcgactgcggaaagaccttccaggataagcactgcctgactatacatcaacgcattcacactggcgagaaaccttataagtgcctggaatgcggaaaagccttttctggtaagagcaatctgactaatcataggcgcatccacacgggcgagaaaccgcacaagtgtgaagtgtgcggcatggccttccaccattcctcggtgttgcgacagcataagcggatccacacaggcgaaaagccttatacttgtagcgagtgtggtaccagcttccgccagggctccgcgctgattgggcataaaagggtccacaccggagagaaaccgtacgagtgcgaggagtgcggtaaggcttttcgggtcagctccaatctcacagggcataagaaacggaaacaccaagtttggagtacacacgagcttgacggctctagaaagtccctgtcccctgtgaccgtctctcagacctcagtggtctcaattttaacatccgcctag

SEQ ID NO: 14054 - DNA, 2001 bp, Artificial Sequence
  Description of Artificial Sequence: Synthetic coding sequence
atgcaagaagtggtccttctcgatgaatcaagcggacccccgagccagttattgtggactcgtcaggatacccaactgccccaggagagcgcactcttacccgccccttatccagcttttaccaaggacggatcacagggcaacctgccccaagccgacattacacttatgtcacaggctcaggaatctgtgacattcgaggatgtagctgttaactttactaacagagaatggcagtgtttgacttacgcccagaggcacctgtataaggacgttatgctggagaattacggtaacatggtgtcactgggatttccattcccgaaaccccctctgatcagtcacctggagcgtgaggtggacccttgcgtgcaggatccacaagatagggagtccttatcctgttcttatcctgtcagcgctgataaaatgtggcccgagaacgaaaaggccagctcccagcaggagatcttcgagaacggggaggcttattggatgaagtttaattccttgctgaaggtcgattcccgggatcccaaggtccgcgaagtttgcgtccaagatgtgaagttggagaaccagtgggaaacaagcattagagagaaacttcgggaagagaaggaaggaagcgaagaagttacctgcaaaaaggggaagaatcaaaaggtgctgtctaagaatctgaaccctaactcaaagcattctcagtgcaacaaggtccttatagcacagaagttacacgagtgtgctaggtgtggaaaaaacttctcctggcatagtgatctgatactgcacgaacagattcactctggggaaaaaccccatgtgtgcaacgagtgtggaaaggcgtttaaaactcgtaatcagctgtccatgcatagaataatacacactggcgagaagcccttcaattgcactcagtgtggtaaagcttttaactcacgcagtgctctgtgtcggcataagaaaactcactctggagagaaaccacatgaatgtcgcgactgcggtaaagccttcaagacccggaaccgattgtgtatgcaccagctcatccataccggtgaaaagccatacaaatgcaactgttgtggtaaagctttccaattcaagcatagtctgacgattcacgggcgtatccataccggagagaagccttatgagtgtgaagagtgtggcaaagctttcagcggcagctccgatttgactaaacacatcagaattcatactggggaacgcccctatgagtgttccaagtgcggcagggccttcagccgctcaagcgatttgagcaagcacaagagaatccatacacgtgaaaaacactatggctgccctcagtgcggcaaagattttagcatcaaagcagaattgacaaaacatagacgcatccatactgaggagaagcggtatcgctgcgaagaatgtggaaaagcgttccgacacaactgtaagcgacgagcccacgaacgggagcacacaggcgaaaaaccatatcaatgtcgggactgtggcaagaccttccaggataagcattgtctgaccatccaccaaagaattcacactggagaaaagccttataagtgtcttgaatgtggcaaggcctttagcgggaaaagcaacctgactaaccaccgcaggattcatacaggggaaaagccacacaagtgcgaagtgtgtggaatggctttccaccacagctcagtgctacgccagcataaacggatccatactggggagaagccatacacatgctctgagtgtggcacctctttccgacaagggagtgctttgatcggccacaaaagggttcacaccggggagaagccatacgagtgtgaggagtgtggtaaagcgtttagagttagcagtaatctgactggccacaagaagcgaaagcatcaggtctggtctactcatgaactggatggaagtaggaagtccctgtcccccgtcaccgtctctcaaacatccgtggtctcgatactcactagtgcttag

SEQ ID NO: 14055 - DNA, 2001 bp, Artificial Sequence
  Description of Artificial Sequence: Synthetic coding sequence
atgcaggaggtggtcctgctggatgagtccagtgggcctccatcccagttactctggaccagacaagacacacagctaccccaggagagtgccctgctcccggccccttacccagctttcacgaaagacggatcccaaggaaatctgccccaggcagatataacgctcatgagtcaggcccaagagtctgtgacattcgaggatgttgcagtcaacttcactaaccgcgagtggcagtgtctcacttacgcacagcggcatctgtataaggacgtcatgttggagaactatgggaacatggtctcactcggcttccctttccctaaaccgccgctgatatctcacctggaaagagaagtggatccatgcgtacaggatccgcaagaccgcgagagtctgtcctgcagttatccagttagtgccgataaaatgtggccagagaatgaaaaggcctcctctcagcaggaaatcttcgaaaacggcgaggcttactggatgaaattcaattcactgctgaaagtcgactcgcgcgaccctaaggtgcgcgaggtgtgtgtgcaagacgtcaaattagagaatcagtgggagacctcaatacgcgagaaattacgggaggagaaagagggaagtgaggaggtgacatgcaagaaagggaaaaaccaaaaagtgctttcgaaaaatctgaatcccaattctaagcatagccagtgcaacaaggtcttgatagcccagaaactgcacgagtgcgcgagatgcgggaaaaattttagttggcattctgatttgatactgcacgaacagatccactccggcgaaaagcctcacgtgtgcaacgagtgtggaaaggcattcaagactcgaaaccagttgagcatgcaccgtatcattcacacaggtgaaaagccattcaactgtactcagtgtgggaaagcttttaattccaggagtgccctgtgtaggcataaaaagacccactctggagaaaagccccatgagtgcagagattgtggcaaggcatttaaaacccgcaacaggttgtgcatgcatcaactgatacacacgggtgaaaagccttataagtgtaattgttgcggaaaagctttccaatttaaacattctctgactatccacgggagaattcatactggtgaaaagccatacgaatgcgaagagtgcggcaaagccttctccggatcctcagacctgaccaaacatattaggatacacaccggagagagaccttatgagtgctctaagtgcggacgggccttctccaggagctcagacctctctaaacataaaaggatacacacgagagagaagcactacggctgtccccagtgtggcaaggatttcagcataaaggccgagctcactaagcaccggcgcatccatactgaagagaaaaggtaccgatgcgaagaatgcgggaaagcctttagacacaattgtaaacggagagcacacgaaagagaacataccggagagaagccttatcagtgtagagattgcggtaaaactttccaggataagcattgcctgaccatacaccagaggatccacactggggaaaagccttacaaatgtcttgagtgtggaaaggcattttccggcaaatctaatctgacaaatcaccggagaattcacacgggcgagaagccacacaaatgtgaagtctgtggcatggctttccatcatagcagtgtacttcgccaacacaaacgcatccataccggagaaaagccttacacttgctcggaatgcggcacatcattccgtcaaggctcggctctgatcggccataaacgcgtgcataccggggaaaaaccttatgaatgtgaagaatgcggcaaggccttcagagtttcaagtaatttgactgggcacaagaagaggaaacaccaggtctggtctacacacgagctggatggcagcaggaagtccctcagccctgttacggtgagccagacctcggtggtgtccattcttactagtgcctag

SEQ ID NO: 14056 - DNA, 2001 bp, Artificial Sequence
  Description of Artificial Sequence: Synthetic coding sequence
atgcaagaagtggttctcctggatgagagtagcgggccgccaagccaactcctgtggacacgtcaagatactcaattgcctcaggaatctgcactgttaccagccccttatccagcattcacgaaagatgggagtcaaggcaacctcccacaagccgacattaccctcatgtcacaggcccaggagagtgtcacctttgaggacgtggctgttaacttcactaatcgggagtggcagtgtttgacttacgctcagcgacacctgtacaaggatgtgatgctggagaactatggcaatatggtatctctcggcttcccctttccaaagccgcccctgattagccatctggagagagaggtggatccatgcgtgcaggatcctcaggacagagaatctttgtcttgcagttacccagtatccgccgacaaaatgtggcccgaaaatgaaaaagcgagttcccaacaggagatcttcgagaatggcgaggcctactggatgaagtttaatagtctgttgaaggtcgattcgcgggacccgaaggtgagagaggtatgcgtgcaagatgtaaagcttgagaaccaatgggagacatccatccgcgaaaagctccgagaggaaaaggagggatcagaagaagttacttgtaagaaaggcaaaaaccagaaggtcctcagtaagaatcttaacccaaactctaagcactcacaatgcaataaggtgctgatagcacagaaactacatgagtgtgcccgttgcgggaaaaacttctcttggcactcggacctcatcctgcacgaacaaatccattccggggagaaacctcacgtatgtaatgaatgcggtaaggcctttaaaacccggaaccagctgagcatgcaccgaatcattcacacaggtgagaaacctttcaactgtacgcagtgcggcaaagcattcaactctaggtccgccctctgtcgccacaagaaaactcatagcggggagaagcctcatgaatgtagagactgcggcaaggctttcaaaacacgcaaccggctgtgtatgcaccagttaatccatacaggcgagaaaccttacaagtgtaactgttgtggcaaggcatttcagtttaaacacagcctgacaatccatggcagaattcataccggtgaaaagccatacgagtgtgaggaatgtggaaaagcattttctggcagttcagatcttacgaagcacatccggatccataccggcgagcgaccctatgagtgtagcaagtgtggaagagccttctcccgctcctctgaccttagcaaacacaagcgcatccacaccagagaaaaacactatggctgccctcagtgtggtaaggatttcagcataaaagctgagctgaccaaacacagacggatacacactgaggaaaagcgctatagatgcgaggagtgtggtaaggctttcaggcataactgtaaacgccgggcccatgaacgggagcacaccggcgagaagccctaccagtgtcgtgattgcggtaagaccttccaggataagcactgcttgacaatccaccaacggatccacaccggggaaaaaccttataaatgtctcgagtgcggtaaggcctttagcggtaagtccaacctaaccaaccaccggcggatacacactggggaaaagccacataagtgtgaagtatgtgggatggccttccatcatagttccgtcctccggcagcacaagcgtattcacactggggagaaaccctatacctgcagcgaatgcggcacctcttttcgccagggttcagctttgatcggccacaaacgggtccacaccggtgaaaagccatacgagtgcgaggaatgtggaaaggcctttcgcgtgtccagcaatcttacggggcacaagaaacgaaagcaccaagtgtggtctacacacgagctcgacggttccagaaaatctctctctccagtaacagtgtcacaaacatctgtcgtatctatcttgaccagtgcatag

SEQ ID NO: 14057 - DNA, 2001 bp, Artificial Sequence
  Description of Artificial Sequence: Synthetic coding sequence
atgcaggaggtagtgcttcttgacgagtcctcagggccacctagccagttactgtggacacggcaggatactcagctgccgcaagagtccgccctgctacccgctccatatccggccttcacgaaagatggcagccaggggaatctcccccaggccgacataacgctcatgagccaggcacaggagtccgtgactttcgaggatgtagctgtgaattttaccaaccgcgagtggcagtgtttgacttatgcacagagacacctttacaaggacgtcatgctggaaaattacggcaacatggtcagtttagggtttcccttcccaaagccacctctgatctcacacctggagagggaagtggacccctgcgtgcaagacccccaagatagagaatcactgtcttgttcgtaccccgtcagtgccgataagatgtggccagagaatgagaaggcctctagccaacaggagattttcgaaaatggggaagcctactggatgaagtttaactctctgctgaaggtggactctagggaccccaaagtccgggaagtctgcgtccaggacgtcaagctcgaaaaccagtgggagacatccataagggaaaaactgcgtgaagagaaagaaggttctgaggaagttacctgtaaaaaaggcaaaaaccagaaagtgctgtccaagaacctcaaccccaactccaaacattcacagtgtaacaaggtgttgattgcgcaaaaactgcatgagtgtgctcggtgcggtaagaatttttcatggcacagtgatctgatcctgcacgagcagattcatagcggggagaagccacatgtctgtaacgagtgcgggaaggcgtttaagaccagaaaccagctcagcatgcacagaatcattcacactggcgagaaacctttcaactgcacacagtgcgggaaggctttcaactcgagatcagcgctgtgccgccacaagaagactcactccggggagaaaccccacgaatgtcgtgattgtggcaaggccttcaaaacaagaaatcggttgtgtatgcaccaactcatccacacaggtgaaaagccttacaaatgcaactgctgtggtaaggcctttcagtttaagcactcactgactattcatgggcgcatccataccggggagaaaccttatgagtgcgaggaatgtggaaaggctttttccggatcctccgatttgacaaagcatatccggatccacaccggcgaaaggccctacgaatgtagtaaatgcggacgcgcattcagccgctcctctgacctttccaagcacaaaaggatacacacccgggagaaacattatggatgtccccagtgcggaaaagatttctctatcaaggctgaacttaccaagcacaggcggattcacactgaagagaagcgttaccgctgcgaagagtgcggtaaggccttccgtcataactgtaagcggcgggcccatgagagggagcacaccggcgagaagccctatcaatgtcgggattgcgggaaaacatttcaggataaacattgtcttactatccaccagaggattcacactggcgagaagccatataagtgccttgagtgtgggaaagcattctctggaaaaagtaatcttaccaatcataggaggattcataccggagaaaagccccacaagtgtgaagtgtgtggtatggcttttcaccattcctccgtgctccgccagcacaagagaattcatacaggagagaaaccttatacttgttctgagtgtggcaccagctttaggcagggtagcgccctcatcggacataagcgcgtgcacactggcgaaaaaccgtacgaatgcgaagagtgcggaaaggccttccgcgtctcttcgaaccttacaggtcacaagaagaggaagcatcaggtgtggtccacacacgaactcgacgggagcagaaagagcttatctcccgtcaccgtaagccagacttcagttgtctctattcttacctccgcctag

SEQ ID NO: 14058 - DNA, 2001 bp, Artificial Sequence
  Description of Artificial Sequence: Synthetic coding sequence
atgcaggaggtggtcctgcttgatgaaagtagcgggcctcctagccagctcttgtggacgcgtcaagatacacaactgccccaggaatctgcgttgctgccagccccctatccagctttcactaaagacggctcacaggggaatctccctcaagccgatattaccttgatgtctcaagcacaggagtcagtgaccttcgaggatgtggctgttaatttcactaatcgagagtggcagtgtctgacatacgctcagcgccacctgtacaaagacgtaatgttggaaaactatggcaacatggtgagtctcggcttccccttccccaaacccccgttaatctcacatttggagagggaggttgatccctgcgtacaggaccctcaggacagagaatccctgtcctgcagctaccctgtcagtgctgataaaatgtggcccgagaatgaaaaggccagctctcaacaggaaatattcgagaatggagaggcttattggatgaagttcaactcccttcttaaagtagactcaagagatcctaaagtgcgagaggtatgcgtgcaggacgtgaagctcgaaaaccagtgggagacatccataagggaaaaactgcgcgaagagaaggaaggcagtgaagaggtcacatgcaagaaggggaagaatcagaaagtcttgagcaagaatctgaatcctaactcaaaacactcgcagtgcaacaaggttttgattgcgcagaagctgcatgagtgcgcacgctgcggaaagaactttagctggcactccgatctgatccttcatgagcagatacattctggagagaagcctcatgtgtgtaacgaatgtgggaaggcttttaagactaggaaccaactgtctatgcacaggatcattcatacaggagaaaaacctttcaactgtacacaatgtggtaaggcttttaatagccgaagcgcactgtgtaggcataagaagacccattcaggcgagaagccgcatgaatgtcgggactgcggtaaagcgttcaaaacacgcaaccggctgtgtatgcaccagctgatccacacgggcgagaagccctacaaatgtaactgctgtggcaaagcatttcagttcaagcatagccttactatccacggtcgaatccacactggcgagaaaccttatgaatgcgaggaatgtggcaaggcgttcagcggcagctccgacttgactaagcacatccggatccacactggggaacggccttatgagtgctccaagtgtggccgggcctttagtcggagttccgatctcagtaaacacaaaagaatccacactagggaaaaacattacgggtgccctcagtgtggcaaagatttcagtatcaaggccgagctgaccaaacaccgaagaatacacaccgaggagaaaagatatagatgcgaagagtgcggtaaggccttccggcataattgtaagcgcagggcccacgagagagagcatacaggagaaaaaccataccaatgccgcgactgcggaaaaacctttcaggataagcactgcctgacaatacatcagcggatacacaccggggaaaagccttataagtgccttgaatgtggtaaagcctttagcggcaagtccaaccttaccaaccaccgtcggattcataccggggaaaagcctcacaagtgtgaagtctgcggaatggcttttcatcacagctcagtgctgcgtcagcacaagcgcatccacaccggggagaagccttatacctgcagcgaatgtggaaccagttttcggcagggttcagcattgattggacataaaagggtgcacaccggtgaaaagccttacgaatgcgaggagtgcggaaaagcattccgagtgtccagtaatttaactggccataaaaaaagaaagcatcaggtctggagcacacatgaactggacggaagtaggaagagcctgagcccagttacggtctcgcagacctcagtggtctctatcctaacctccgcctag

SEQ ID NO: 14059 - DNA, 1725 bp, Artificial Sequence
  Description of Artificial Sequence: Synthetic coding sequence
atgttggaaaactatggcaatatggtaagcctcggctttcctttcccaaaacctcccctaatcagccatctggagcgggaggtggacccgtgcgtgcaggacccccaggatcgggagagcctctcttgtagctaccccgttagcgccgataaaatgtggcccgaaaatgaaaaggccagctctcagcaggaaatttttgagaatggggaggcctattggatgaagtttaatagccttttgaaggtagattccagggaccccaaggttcgggaagtatgtgtgcaagacgttaaactcgagaaccagtgggaaacgtcaatccgggaaaagcttcgagaggaaaaggagggttccgaagaggtgacctgcaagaaggggaagaaccagaaagtcctctcgaagaatttgaaccccaattcaaaacattcgcaatgcaataaggtcttgattgcgcagaaactgcatgagtgtgctcggtgtggcaagaattttagctggcactcagacctgatcttgcacgagcagatccactccggagagaaacctcacgtgtgtaacgaatgtggtaaagcttttaaaacacggaaccagcttagcatgcaccgcattatacatacaggcgagaaaccattcaactgtacacaatgcggcaaagcgtttaactcgcggagtgcactctgtagacataaaaaaacccactcgggcgaaaagcctcacgagtgtagagactgtggcaaggcgtttaaaactcgtaatcggctgtgtatgcatcagctaattcacacaggagagaagccctacaagtgtaactgctgtggaaaggctttccagttcaaacactcccttaccatccacgggcgtattcatacgggtgaaaaaccctacgaatgtgaagagtgcggaaaggccttttccgggagctcagacttgactaagcacatccggattcataccggagagcggccatatgaatgttctaaatgcggccgggcattcagtcgcagtagtgacttgagcaagcataaacgtattcatacaagagagaaacactatgggtgcccacagtgcggaaaggacttttctatcaaggcggagttgaccaagcacagaagaattcacactgaagagaagagataccgctgcgaagagtgcgggaaggccttcagacacaactgtaagcgacgcgcccacgaacgggaacacacaggtgaaaagccttatcagtgtagggactgtggcaagacttttcaggataaacattgcctaaccatccaccagcgaatccataccggcgaaaaaccatacaaatgcttggagtgtggaaaggccttcagcgggaaaagcaacctgaccaaccacaggagaattcataccggtgagaaacctcacaagtgcgaggtgtgcgggatggcctttcatcatagtagcgtgcttaggcaacataagagaatccacaccggtgagaagccatatacttgtagcgaatgtggcacttctttccggcaaggttctgccctcatcggacataaaagagtgcacaccggcgagaagccttacgaatgcgaagagtgcggaaaagccttccgcgtgtcatccaacctgacaggacacaagaagcgcaaacatcaggtttggagtacccatgaacttgacggcagtagaaaatcactgtccccggtaaccgtgtctcagacatccgtggttagcatcctgactagcgcatag

SEQ ID NO: 14060 - DNA, 1725 bp, Artificial Sequence
  Description of Artificial Sequence: Synthetic coding sequence
atgctggaaaactacgggaacatggtgtccctgggcttcccttttcctaaaccgccattaatatctcacctagaaagagaggtagatccgtgcgttcaggacccccaggaccgtgaaagtctgtcatgtagctatcccgtgtccgcagacaagatgtggcccgaaaatgagaaggcatcctcccagcaagagatctttgagaacggtgaagcttactggatgaagttcaactctttactcaaggtggattcacgggaccccaaggtgcgcgaggtgtgcgtacaggacgttaagctcgaaaaccagtgggagacgtccatccgcgagaaactgagggaggaaaaggagggctccgaggaggttacctgcaaaaaggggaaaaatcagaaggtgctctctaaaaatcttaatcctaactccaagcactcccagtgtaacaaggtgctgatagcacaaaagttgcacgagtgcgctaggtgtgggaagaatttttcttggcatagtgacctgatcctgcacgaacagatccactcaggagagaagccccatgtgtgcaacgaatgcggtaaggctttcaaaacccggaaccagctaagtatgcaccgaattatccacacgggggagaagccttttaactgtacccagtgtggcaaggcttttaatagcaggagtgctttgtgcaggcataaaaaaacacatagcggagaaaagccccacgagtgccgcgactgtggaaaagcctttaaaacaaggaatcggctctgtatgcaccagttgattcacaccggagaaaagccatacaagtgcaattgctgtggcaaggcttttcagttcaagcattccctaaccattcacggccgcatacacaccggcgagaagccttacgagtgcgaggaatgtggaaaagccttttctgggagctccgatctgaccaagcatatccgaatacatacgggggaacgcccatacgagtgctccaagtgcggccgagccttctccaggtcgagcgaccttagcaaacataaacgaatccatacccgggaaaaacattacggttgtccacaatgcggtaaagacttcagtattaaggccgagttgacaaaacatagacgaatccataccgaagagaagcgctaccggtgtgaggaatgcggaaaggccttcagacacaattgtaaaaggcgggctcacgagagagagcacacaggggaaaagccttaccagtgccgagactgcgggaagacattccaagataagcattgcctgacgatacatcagagaattcacaccggagaaaaaccatacaagtgtctcgaatgcggcaaagctttctcgggcaagagcaatctcactaaccaccgacgcattcacacaggcgagaagccgcataagtgcgaagtctgtgggatggcgttccaccattccagcgtcttgcggcagcacaagcgaatccacaccggggaaaaaccctatacatgctccgagtgcggcacttcctttaggcagggtagcgctctgatcgggcacaagcgcgttcataccggcgagaaaccttacgagtgcgaggagtgcgggaaggcatttagggtgtcttcaaacctgactggccacaagaagcgcaaacatcaggtctggagcacgcacgagttagacgggtcccgtaaatccctcagccccgtgacagtctcccaaacaagcgtggtttcaatactgacctccgcttag

SEQ ID NO: 14061 - DNA, 1725 bp, Artificial Sequence
  Description of Artificial Sequence: Synthetic coding sequence
atgcttgagaactacggcaacatggtgtccctggggtttccatttcctaagccccccctgatttcccaccttgagcgggaggtggacccctgtgttcaggaccctcaggatcgtgagtctctgagctgctcttacccagtttccgccgacaagatgtggcctgagaatgagaaagcaagctctcaacaagaaatctttgaaaacggagaggcgtactggatgaaattcaattcattgctgaaagtcgacagcagagatccgaaagtccgtgaggtctgcgtgcaagacgtgaagcttgagaatcaatgggagacatctatccgagaaaagctgagggaagaaaaggaaggaagcgaggaagtgacatgtaagaagggcaaaaatcaaaaagtgctttctaaaaatttgaaccctaatagtaagcacagccagtgtaataaagttctcattgctcagaaactccacgaatgtgctcgttgtggcaagaatttctcatggcacagtgatctgattctgcacgaacagattcactcgggggaaaagccccatgtttgcaacgaatgcggtaaggctttcaaaacccggaaccaactgtccatgcacaggatcattcacaccggagaaaaacccttcaactgtactcagtgcgggaaagctttcaactccaggagtgcgctgtgcaggcataagaagacccacagtggggagaaaccgcacgagtgtcgagattgcgggaaagccttcaagaccagaaatcggctttgcatgcatcaacttatccatacaggtgagaagccatataaatgtaattgttgcggcaaagcttttcagtttaaacactcactgaccattcacggcaggatccataccggagagaagccctacgagtgcgaagaatgcggaaaagccttctcgggttccagcgacctgactaagcacattcgcatccataccggtgagaggccctacgaatgcagcaagtgtggtagagcattcagcaggtcctccgatctgtcaaagcataagcggatccacacaagagaaaaacactacgggtgccctcagtgcggtaaagacttttctataaaggccgagcttacaaagcaccggcgaattcatacggaggaaaaaagataccggtgcgaggagtgcggcaaagcgttccgccacaattgtaagcggcgcgcccatgaaagagagcataccggcgagaagccttaccagtgtagagactgtggaaaaacttttcaggataagcactgtcttacaatccatcagcgaatccacaccggcgagaagccatataaatgtttagaatgtggaaaggctttctccggaaaatctaacctgactaatcaccgacgcattcacactggtgagaagccgcataagtgcgaggtctgcggcatggctttccaccatagcagtgtactccggcagcacaagaggatccacacaggagaaaagccttacacatgtagcgaatgtgggacatcctttaggcaagggtctgcactcatcgggcacaagcgggtgcacaccggagagaagccgtacgaatgtgaagagtgtggaaaggcctttagggtttcgtcaaatcttacaggacataaaaagagaaagcatcaggtgtggtccacccacgagttggacggttcaagaaaatccttgtctcctgttacagtatcacagacgtccgtggtctcaatcctcaccagtgcctag

SEQ ID NO: 14062 - DNA, 1725 bp, Artificial Sequence
  Description of Artificial Sequence: Synthetic coding sequence
atgctcgaaaattacggcaatatggtctccttgggctttccttttcctaaaccacccctaataagccatttagagagagaagtagacccctgtgtacaggacccccaagacagggaatccctgagctgttcataccctgtcagtgctgacaaaatgtggcccgagaacgaaaaagcctcttcacagcaggaaatttttgaaaacggggaggcttattggatgaagttcaattctctgttgaaggtcgattctcgggaccccaaagtgcgggaggtgtgtgtccaggatgttaagctcgagaaccagtgggaaaccagtattcgagagaaacttcgcgaggaaaaagaagggtcagaagaagttacatgtaaaaaagggaaaaaccagaaggtactttcgaaaaacctaaaccctaacagtaagcatagccagtgcaataaggtgctcatcgcgcaaaaactgcatgaatgtgcgcggtgtgggaaaaatttctcttggcattctgatttgatccttcacgaacagattcactcaggtgagaagccccacgtctgtaatgaatgcggtaaagctttcaaaacaaggaatcagctgtctatgcacagaatcattcacactggggagaaaccatttaactgtacacagtgcggcaaagccttcaacagcagatcagctctgtgtcggcacaaaaaaacgcactccggcgagaaaccccacgaatgtagggattgcgggaaggcctttaagacaagaaaccggctctgcatgcatcagctgatacacacgggggaaaaaccatacaagtgcaattgttgtggcaaagcgtttcagttcaaacacagcctgacaatccacggccgtatccatacaggagagaagccctacgaatgtgaggaatgtggaaaggccttctccggctcttcagacctcaccaagcacatccgtatccacaccggggaacgcccctacgagtgcagcaagtgcggaagggctttctctcgcagctcggatctgtccaagcataaaagaattcatacacgggaaaagcactatgggtgtcctcagtgcggcaaggatttctccattaaggccgagctgaccaaacaccgtaggattcacactgaagagaaaagataccgttgcgaagagtgcggaaaagccttccggcacaactgtaagcgacgggctcatgagcgtgagcatactggtgagaagccttatcagtgccgagactgtgggaagacttttcaggacaaacactgtctcacaatccatcagcggatccacactggagaaaagccatacaagtgccttgaatgcggaaaggctttttcgggcaagtccaacctgactaatcaccggcgaattcacactggtgaaaagccacacaagtgtgaagtatgcggcatggcatttcaccattcctctgtcctgagacagcataaacgcatccacactggcgagaaaccctatacatgttctgaatgtggcactagttttcgccaggggtcagccctgatcgggcacaaacgagtgcataccggagagaaaccttatgagtgcgaagagtgcgggaaggcctttagggtttccagtaaccttacgggccataaaaagcggaagcatcaagtatggagtacgcacgaactggatggctcccgaaaatccctttcacctgtgacagtctcccaaactagcgtcgtgtctatcctcaccagtgcatag

SEQ ID NO: 14063 - DNA, 1725 bp, Artificial Sequence
  Description of Artificial Sequence: Synthetic coding sequence
atgctagagaactacggaaacatggtgtctctcggcttcccttttcctaagccacccctcatcagtcacctcgagcgcgaggtcgacccatgtgtgcaggaccctcaggatcgcgagtcgctttcatgtagctacccagtcagtgcagacaagatgtggcctgagaacgagaaggcctcatcacagcaggaaattttcgagaatggagaggcctattggatgaaatttaattccctgctgaaggtggattctcgggacccaaaggtgcgcgaggtgtgtgtacaggacgtgaaacttgagaaccagtgggaaacctccattcgggaaaaactgcgagaggaaaaagaagggagcgaggaagtgacgtgcaagaagggtaagaatcagaaagtgctatctaagaacctcaaccctaatagcaaacattcacagtgcaataaagttctgatagctcagaagctgcacgagtgtgcacgatgcgggaagaacttcagctggcatagcgatctcatcctccacgaacagattcactctggggaaaaacctcacgtctgcaatgaatgcggtaaggcttttaaaacccgcaaccagctgagcatgcaccgcattattcacactggcgagaaaccttttaactgtacacagtgcggaaaagccttcaactcaagaagcgcactttgcagacacaagaagacccactccggagagaaaccacacgagtgtagggactgcggaaaggcatttaaaacaagaaacaggctgtgcatgcatcagttaattcatacaggagagaaaccgtacaaatgcaattgctgcggcaaagcctttcagttcaagcacagcctcacaattcatggccgtatccacaccggggagaagccctacgaatgtgaggaatgtggaaaagcattcagcggctccagcgacctcactaagcacatcagaatccatactggagagaggccctatgaatgtagcaagtgtgggcgcgctttttctaggagttctgacctctccaaacataagcgcattcacactcgcgagaagcactatgggtgcccccagtgcggcaaggatttctccattaaagctgaattaaccaaacaccgcaggatccacacggaagaaaaacggtacagatgtgaagagtgtgggaaggcattcagacataactgcaagagacgggcacacgaaagggagcatactggggagaagccataccaatgccgggattgtgggaagactttccaggacaaacactgcctgaccattcatcagagaatacacaccggagagaaaccctacaaatgcctggagtgtgggaaggccttctctggaaagagcaacctgaccaatcaccggcgtatacatacaggcgagaagccccacaagtgcgaggtttgtgggatggcgttccatcacagttccgttctgagacagcacaagaggatccatacgggagaaaagccgtacacctgttcagagtgcgggacttcgttccgacaggggagtgccctgatcggccacaaacgggtgcatacaggagagaaaccatatgagtgcgaagaatgtgggaaggcctttcgggtatcgtccaatctgaccggccataagaagagaaaacaccaggtgtggagcacacacgaactcgacgggtctcgaaagtctctgagcccggtcacagtgtcacaaacaagcgtcgtgagcattttgaccagtgcctag

SEQ ID NO: 14064 - DNA, 1725 bp, Artificial Sequence
  Description of Artificial Sequence: Synthetic coding sequence
atgctcgaaaattatggaaatatggtgtctttagggtttcctttccctaagcccccgcttatttcacatctggaaagagaggtggatccctgtgtccaggaccctcaggatagagagtccttgtcgtgttcctatcctgtatcggctgacaagatgtggcccgaaaacgagaaagcctcatcccagcaggagatttttgaaaatggcgaagcctactggatgaaattcaactccctgttaaaagttgacagtcgagatccaaaagttcgagaagtgtgtgtgcaggatgttaagctggagaatcaatgggagacttcaatcagggagaagcttcgcgaggagaaagagggcagcgaggaggttacatgtaaaaaggggaaaaatcaaaaggttctgtctaagaacctgaatccgaatagcaaacactcccagtgtaacaaagtcctgatcgctcagaagctgcacgagtgcgctaggtgcggcaagaacttctcttggcattctgatttgatcctccacgaacagattcattccggggagaagccacatgtttgcaatgagtgcgggaaggcttttaagactcggaatcagctgtcaatgcaccgaataatccacacaggcgagaagcccttcaactgtacgcagtgcggcaaggcgtttaatagcaggagcgccctctgccggcacaagaagactcattctggcgaaaagccgcatgaatgtcgtgattgtggaaaagcctttaagactcggaacagactatgtatgcaccagctgatccacacaggtgaaaagccttacaagtgcaactgctgcggaaaggcattccagtttaagcactccctcaccatccacggccgcatccacaccggcgagaagccttatgagtgcgaggaatgtgggaaggccttttctggatcctcagaccttacaaaacatatacgcattcacacaggcgagagaccctatgaatgcagcaagtgtgggcgcgcattttcccggagctcagacctgtccaaacacaagcgcatccatacccgcgaaaaacactatggatgcccacagtgcggaaaggacttttctattaaagcggagttgactaagcacagacgcatacatacagaggagaaaaggtatagatgtgaggagtgtggcaaagcatttagacataactgcaagaggcgtgcccatgaaagggagcacacaggggagaagccctatcagtgccgagactgcggaaaaacctttcaggataaacattgtcttacaattcatcagcgaattcataccggcgagaaaccttacaagtgtctggagtgcggtaaggcattttccggtaagagtaacttaactaatcaccgccgcatccatactggggagaagccacacaagtgcgaggtttgcggaatggcttttcatcactcttcagtcctgcgccagcacaagcggatacatacaggtgaaaaaccatacacttgcagcgaatgcggaacgtcattccggcagggaagcgcgcttataggccataaacgggttcacactggcgagaaaccttacgagtgtgaggaatgtggcaaggccttccgggtgtcgtccaatttgactggccacaagaaacggaagcaccaagtgtggagcactcatgagctggatgggagcaggaaatctttgtccccggtgacggtgagccaaaccagtgtggtatcaatcctcacctcagcatag

SEQ ID NO: 14065 - DNA, 1749 bp, Artificial Sequence
  Description of Artificial Sequence: Synthetic coding sequence
atgagcgaaagctggcagcaaccaccccaaacccagccacaacagccccaacccccccaacctcagcatcatgctgagccacccccggctttagccgagcacaccctcccacccggcactgctgagaatcctctgggctgtgcagtgtacggtattctcctccaacctgatcctggtttgcagcctcctcagcatgctccgctgcaagctgctggggagccgggcccaaagtgcggggtctgtgggcatgacctggcacatctgtcgtcaccacacgagcaccagtgcttagccggtcatgataggagcttccaatgcacccagtgcttaaagatctttcaccaagcgacagacttgttggagcaccagtgcgtgcaggcagagcaaaagccatttgtgtgtggagtgtgcaaaatgggattttcccttctaacttccttggcacagcatcattcctctcacagtggcttagtgaagtgttcaatttgtgagaaaacatataagccagccgaagctgcagagccagctacgaccgccgcccctagtctgccggccgccccagcaccctcaaccgtgactccagccgagcaggcagataaaccatatagttgtcccatctgccagaagccgttcaagcacctcagcgagctgtcccgccacgaaagaatacacaccggagagaaaccttataaatgcacgctgtgcgataaaagtttctcccagtcttcacatctggttcaccataaaaggacacactcgtctgaacgtccctacaaatgtgctgtgtgcgagaagacatttaagcacaggagccacttggtgcggcacatgtacgcacactctggtgaacaccatctcttcaggtgtaatgtttgtgaactgcactttaaggaaagctccgagttactgcaacacccctgcacaccttctggtgagcggccatttcggtgcggggagtgccaaaaggcgtttaaaaggccttcagatcttcgccaacacgaaaggacacatagtgccgaacgtcccttcaaatgtgacctgtgccccatgggatttaagcagcagtatgccttaatgcggcaccgccgcacccataagacggaggagcccttcaaatgcgggctctgcgagaaaggcttcggccaaccaagccacctgctgtaccaccaacatgtacatacccttgaaactttgttcaagtgccccgtttgccagaaaggtttcgatcagtcggccgagctcctgaggcacaagtgcctgcctggtgccgcggaacgtccctttaagtgtcctgtgtgtaataaggcgtacaagcgcgcctccgccctgcagaagcatcagctggcgcattgtgccgcagcagaaaaaccgcttagatgcaccctctgcgaaagacggtttttcagttcaagcgaattcgttcagcatagatgtgatcccgcaagagaaaagccactgaaatgccctgattgcgagaagcgatttaagtatgcgtctgatctgcaacgtcaccgaagggtccataccggcgagaagccttataaatgtcctaactgtgataaggccttcaaacagagggagcacctcaataaacaccagggggtgcatgccagagaacagcagttcaagtgtgtttggtgtggcgagaggtttttggacgtcgctctgctgcaagagcactcagctcaacacagtgctgccgccgcagctgctgagggagcttatcaggtagccgcctgcctcccatag

SEQ ID NO: 14066 - DNA, 1209 bp, Artificial Sequence
  Description of Artificial Sequence: Synthetic coding sequence
atgtacacttcggaggagaagtgcaaccagcgaacccaaaagaggaaaatatacaatgtgtgtccccgcaaaggcaagaagatctttatccatatgcacgaaatcattcagattgatggccacatttatcagtgtttggagtgcaagcagaatctctgcgaaaacctggccctgatcatgtgtgagcgaacccacacaggggaaaaaccatataagtgtgacatgtgcgagaaaaccttcgttcagtcaagcgacctgacatcccaccagaggatccataactatgagaagccatacaaatgttctaaatgcgaaaagtccttttggcaccatttggtgctctcaggacatcagagaactcacgcgggaaagaaattttatacttgcgacatctgtggcaagaacttcggtcaatctagtgatctcttagttcatcaaaggagccacactggggagaaaccttacctatgcagcgaatgtgacaagtgtttttcacggtccaccaacttgattcgccacagacggacccacaccggcgagaaaccattcaaatgtttggaatgcgagaaggcttttagcgggaaatccgatttgatcagtcaccagaggacccacacaggtgaacggccctataagtgtaacaagtgcgaaaagagctaccgacaccggtccgcttttatagtgcacaagagggttcacacaggcgaaaaaccatacaaatgcggggcttgcgaaaaatgcttcggccagaagtctgatttgattgtccaccagcgagttcataccggggaaaaaccttataagtgtttggaatgtatgcggagctttacccggtcagcaaacctgatccgccaccaagctacgcatacgcacacatttaagtgtctcgaatatgagaaaagcttcaattgcagtagtgatttgatcgtgcaccaaagaattcatatggaggaaaagcctcatcaatggagtgcttgcgaatcaggctttctgttggggatggactttgtggcacagcaaaagatgagaacccagaccgaagaacttcactataaatacacggtgtgtgataagtccttccatcagagcagcgctcttctgcaacatcagaccgtgcgcatcggggagaagccattcgtgtgtaatgttagcgagaagggtctggaattaagtcctccacacgcctccgaggcaagccagatgtcttag

SEQ ID NO: 14067 - DNA, 1662 bp, Artificial Sequence
  Description of Artificial Sequence: Synthetic coding sequence
atggccttcgaggacgtggcagtctactttagtcaggaggagtggggcctgctcgacactgcccagcgggccctgtacaggcgcgtaatgctcgataactttgctctggtggcaagcctagggctttccacctccagacccagagtcgtgatccagcttgagagaggggaagaaccttgggtcccttctggcacggacactacgctctcacgcaccacataccggcggcggaacccagggagctggtctcttacggaggatcgagacgtctcaggagaatggcccagggccttcccagataccccccccggcatgaccacgtccgtatttccagtggctggagcttgtcactctgtgaaatcccttcagaggcaacggggagcatcgccaagcagggaaagaaaacctactggcgtgagcgttatttattgggagaggctgttgctgggctctggttccggccaggcaagcgtgtcgctgaggctgacctcaccactgcggccacccgaaggggtgcggttgagggaaaaaacacttactgagcacgcactcttaggtcgacagccgagaacccccgaacgccagaagccttgtgctcaggaggtgcctgggaggactttcgggagcgcccaggatttagaggccgccggcggccgtggtcaccataggatgggcgccgtgtggcaggagccccacagattgctgggggggcaagaacccagcacttgggacgaactcggcgaggccctccatgcaggggaaaaatcctttgaatgtcgcgcctgttccaaagtgttcgtaaagtccagcgatttactgaagcacttgaggacccacaccggcgagaggccttacgaatgcgcgcagtgcggaaaggcattttcgcagacttcacaccttactcagcatcagcgaatacactccggagagaccccttacgcctgtccagtctgcgggaaagcgttccggcactcctcctccctggtaaggcatcagaggattcacacagctgaaaaaagtttcagatgtagcgagtgcggcaaagcgtttagtcatggtagtaacctgagccagcatcgcaaaatccatgcaggaggtcgtccctacgcctgcgcacagtgtggcagaagattttgtaggaactcccatttgattcaacacgagagaacccacaccggcgagaagccctttgtctgtgcactgtgtggagcagcgttctcccaaggttctagtctctttaaacatcagcgcgtccacacaggcgagaagcccttcgcatgcccccagtgcggaagggcgttttcccactctagtaatctcactcagcaccaactacttcacactggggagcggccctttcgttgtgtcgactgcggaaaggcctttgctaagggggccgtgttactcagtcatagaagaattcacaccggtgagaaacccttcgtatgtacacagtgtgggcgcgccttccgggaaagaccagctctgtttcatcatcagagaattcacaccggcgagaaaactgttcgcaggagtcgagctagccttcacccacaggcacgttccgtcgcaggcgccagctctgaaggtgctccagctaaggaaactgagccaactcctgcttcagggccagcagcagtgtcccagcccgcagaagtctag

SEQ ID NO: 14068 - DNA, 861 bp, Artificial Sequence
  Description of Artificial Sequence: Synthetic coding sequence
atggcctttgaggacgttgctgtgtatttttcccaggaggagtggggcttgctggacactgctcagcgcgcactatacagacgagtgatgcttgataattttgccctggtggcctcactgggcctgagcacaagcaggcctcgtgtcgtgatccagcttgaaaggggagaggagccttgggtgcccagcggcaccgacactacactaagtcgtactacctatagaagacgcaatccgggatcctggtcattgacagaggatcgtgacgtttcaggcgagtggcccagggcttttcccgatacgccccccgggatgactacatccgtgttccctgtagcgggcgcctgtcacagcgtgaagtccctgcagagacagcgtggagcttcccctagcagggagcgaaagcccacaggggtctcagttatttactgggagaggctactgcttggctcaggttccggccaggcatctgtatccttgagactcacctctccgctccggccgcctgagggagtgcgactgagagaaaagaccctaacagagcacgccctgctcggtagacagccccggaccccagaacgccaaaagccctgtgcccaggaagtgcctgggaggacgttcggcagcgcccaagacttagaggcggctggagggcggggacaccacagaatgggagctgtctggcaagaacctcatagattgctggggggtcaagagccgtccacgtgggacgaactgggcgaggctctacatgccggggaaaaatctttcgaatgtcgcgcttgttcgaaagtatttgtcaagagtagcgacctcctgaagcatcttcggacccgagtcagacaaggcctgcccgcctag

SEQ ID NO: 14069 - DNA, 993 bp, Artificial Sequence
  Description of Artificial Sequence: Synthetic coding sequence
atgggcgcagtgtggcaggagccccatcggctcttaggcgggcaggagccttcgacttgggatgagctgggcgaagctcttcatgcaggggaaaagagttttgaatgcagagcctgtagcaaagttttcgtaaaaagcagcgatctgctgaaacacctcagaacacatactggcgagcgtccctacgaatgcgcgcagtgtgggaaagccttcagtcaaacttcccacctgactcagcatcagcgcatacattccggggagaccccatatgcctgccctgtctgtgggaaagcatttcgacacagcagctccctggttaggcaccagcgaatccatactgcggaaaagagctttcgatgctctgagtgtggcaaggcattctctcacggttccaatctgtcgcagcacagaaaaatccacgccgggggccggccctatgcgtgtgctcagtgcggacggaggttttgtaggaattcccatctgattcagcatgagcgcacccacacaggagagaagccttttgtgtgtgctttgtgcggtgcagccttctctcaaggatcgagcctgtttaaacatcagagggtccatactggggagaaacccttcgcctgtccacagtgtggacgggccttcagtcactctagcaatcttacgcaacaccagctgcttcacaccggcgagcgcccattccgctgtgtggactgcggaaaagcctttgcaaaaggagcggtgcttctaagtcatcggcggatccacacaggcgagaagccctttgtctgcacccaatgtggtagagcctttcgggaacggcccgcactgttccaccatcagcgcatacacactggcgagaaaacagtgagaaggtcccgtgcgtcactacacccacaagcccgttccgtggccggcgcctcctcagagggagcaccagccaaggaaactgaacccactccagctagcgggcctgctgctgtaagtcagcctgctgaagtgtag

SEQ ID NO: 14070 - DNA, 1662 bp, Artificial Sequence
  Description of Artificial Sequence: Synthetic coding sequence
atggcttttgaggatgttgcggtttactttagccaggaggaatggggcctgctggacacagcccagagggcactgtatcggagggtcatgttagataattttgctctagttgcttctttggggctgtcaacctcgcggccaagagttgtaattcaactggagaggggcgaggaaccgtgggtgccttccgggacagatactacactgagccgaacaacgtatcggcggcgaaatcccgggtcttggtccctgacggaggatagggatgtctccggtgaatggcctagagcttttcccgacacacccccaggaatgacgacctccgtttttcctgtggccggcgcttgccatagcgtgaaatcactgcagcggcaacgcggcgcctcaccgtctcgggaaaggaagccaacaggtgtgtcagttatttactgggagcggctgctgctggggtcaggcagcggacaggcctctgtctctctccggctgactagtcctttacggcctcctgaaggcgtacgactgcgagaaaaaacccttacggagcacgctcttctaggccgacaacctcgaacgcctgaaaggcaaaagccgtgtgctcaggaggtcccgggaaggactttcggctccgctcaggacttggaggccgctgggggacgtgggcaccaccggatgggagcagtatggcaggaacctcatagactcctgggcggacaggaaccgtctacctgggatgaactcggagaggcattacacgccggagaaaagtcttttgagtgccgcgcctgctccaaggtgtttgtgaaaagcagcgacctgctgaaacacctgagaactcatactggcgaacgaccttacgaatgtgctcagtgtgggaaggccttcagccagacttctcatcttacacagcatcagagaattcactcgggagagacaccttatgcttgcccagtctgcggcaaagcctttcggcactcatcctctctggtgagacatcagcggatccacacagctgaaaagagcttcaggtgtagcgaatgcggtaaagccttcagccacggatccaatttaagccagcacaggaagatccacgccgggggaagaccatacgcctgtgcccagtgtggccgaagattctgccgtaactcccacctgattcaacacgagagaacccacaccggagagaagcccttcgtttgtgcattgtgcggcgcagccttctcacagggctccagtctgtttaagcatcagcgtgtacatacaggagaaaagcctttcgcctgtccacagtgcgggagagcattctcgcatagttccaatttaacgcagcaccaactcctgcataccggggagaggccttttcggtgtgtggactgtggcaaggccttcgcaaaaggggccgtgcttctgagccaccggagaatccataccggcgaaaaaccctttgtctgtactcaatgtggacgcgctttcagggaacgtcccgcgctgtttcaccaccagagaatacacacaggcgaaaagaccgtgaggcgaagccgtgctagcctgcacccccaagctcggagcgttgcgggagcctcgtcggaaggagcccctgcaaaggaaaccgaaccgaccccagctagcggacccgcagccgtctcccagcctgcagaggtgtag

SEQ ID NO: 14071 - DNA, 1605 bp, Artificial Sequence
  Description of Artificial Sequence: Synthetic coding sequence
atgggtgtgccttccgtggttagtgcgattcctattcgagccgactgctcgtctaagcctcaacccctcctgcaaggccagccccacctttatttcagcccgaagctgctctgtcagctgcgcggcagctttcttcctgttcattcagcctgccccggccccttgctcacaaggatgccacaggcaacaacagtctcactccccctcggctcttggagcctcactgaggatagagatgtttctggggagtggccccgagcttttcctgatacgcctcccggcatgacaacttctgtttttccggtcgccggtgcgtgtcacagtgttaaatccctccagaggcagcgcggggcctctcctagcagggaacgaaaacccacaggagtgtctgtcatctactgggagcgcttactgctgggatctggaagcggtcaagcctccgtgagcctgaggctgacatcgccgctgcgcccccctgagggagtgcgcctgcgagagaaaaccctgacagaacacgcgcttctggggcgacagccaagaacgcctgaacgacaaaagccatgcgcccaagaagtgcctggcagaactttcggatcagcccaggacctggaggccgccggaggacgaggtcatcataggatgggcgccgtctggcaggaaccccaccgtctgctgggtggacaggagccatcaacctgggatgagctgggagaggccctacacgcgggtgaaaaatcatttgaatgtagggcctgctcaaaggtgttcgtgaaatcaagtgacctgttgaagcatctccgcacacacacaggtgaacgtccctacgagtgcgcgcagtgtggaaaggctttcagtcagacaagccatcttacacaacatcagaggattcactcaggggaaactccttacgcatgccctgtgtgtgggaaagctttccgtcactccagtagtctggtccgacatcagcggatccacaccgctgaaaagtcctttaggtgctctgagtgcggcaaggccttctcacacgggtccaatctgagccagcatcggaagattcatgctggaggtagaccatacgcatgcgcccagtgcggacgccggttctgtagaaatagtcatctaatccaacacgaacgcacgcacactggggagaaaccgtttgtttgtgctttgtgcggtgcagcctttagtcagggcagcagtctctttaagcaccagcgggtacacacaggggaaaagccttttgcttgtcctcaatgtggtcgcgcatttagtcattcttctaacctaacccaacaccagttgctacacaccggggagcgtccttttcggtgcgtggactgcgggaaggcctttgccaaaggggctgtgctgctgagtcacaggaggatccacactggtgaaaaacctttcgtatgcacccagtgcggacgggcctttcgggaaaggcctgctctgtttcaccaccaacgcatacatactggcgagaagacgggagaccctggaccagcctgtactcctcgacctgggctgcttcccggccaccaccagaaggttaggcaacgccggaaacctagccccctgcccccgcgagcccaaccttag

SEQ ID NO: 14072 - DNA, 1635 bp, Artificial Sequence
  Description of Artificial Sequence: Synthetic coding sequence
atgacattcgaagatgtggccgtgtacttctcacaggaggagtggggactgcttgacaccgcacagcgcgctctgtatcggcatgtcatgctggaaaatttcaccctggtaacgtctctcggcctctccactagccgacccagggtggtgatccagctcgaaaggggtgaagagccctgggttcccagtggcaaggacatgactctagcaaggaatacctacggccgcctgaattccggctcttggtccctcactgaggaccgcgacgtctctggcgagtggccacgtgccttcccagatactcctccgggaatgactacatccgtttttccagtggcagatgcatgccactcagtaaagtccttgcaaaggcaacccggcgccagccccagccaggaacgcaaaccaaccggtgtttcagtgatctattgggaacggttattactcggaagccgatccgaccaggcgagtattagcttaaggttgacatcccctctgcggcccccaaagagttcgcgacctcgggaaaaaacctttaccgagtatcgcgtgcctggccgacagccacggacccctgagagacaaaagccttgtgcccaagaagtcccgggcagagcctttggaaatgcgtctgacctgaaggcggcgagtggaggcagggatcgccgcatgggggctgcttggcaagaaccccataggctgctgggtggccaggagccgagcacctgggacgaactaggagaggccctgcacgcaggggagaagagtttcgagtgtcgtgcatgtagcaaggtattcgtgaagagttccgacttactgaaacatctcaggacccacacaggcgagagaccatacgagtgtacacaatgcggaaaggctttttctcagacaagccatctgacccagcatcaaagaattcactctggcgagacgccgtacgcatgtcccgtatgcggtaaagcttttcgacactcatcatctctagtacggcatcagcgtatacatacagcggagaagtcctttcggtgttctgaatgtgggaaggcctttagtcatggatctaacctcagccagcaccgcaaaatccatgccggcggcaggccttacgcttgtgcacagtgtggacgcaggttttgtaggaactctcacctaattcaacatgagcgaacacatacgggcgagaagccattcgtgtgtgcactttgcggagccgccttcagtcaaggatctagcctatttctgcaccagagggtgcatacaggtgagaaaccattcgcttgtgcacaatgtggccggagcttctcacgctcatccaatctaacccagcatcagctgcttcacactggtgagagaccctttaggtgcgtggactgcgggaaagggttcgccaagggcgccgttcttctttctcaccggcggattcacactggagagaagccctttgtctgcacacagtgtggacgagcctttcgtgagaggccagccctgctgcaccatcaaaggatccacactacagaaaagaccaatgctgccgcccctgattgcactcctgggcccggatttctgcaagggcaccatcggaaagtgcgcaggggcggcaagccttctcctgtgctgaagccggcaaaggtttag

SEQ ID NO: 14073 - DNA, 1605 bp, Artificial Sequence
  Description of Artificial Sequence: Synthetic coding sequence
atgggggtcccaaccgccgtctccgcaacccctgtgagagccgacgcctcttctaagccacagccactgctgcagtcccagcctcacctcttttttttccccaaacttttgagccgacttctgggctcgccactgcccgtccatagcgcttgtccaggaccactactgacccgcatgccccaggcaaccacggttagtctccgccttggctcatggagtttgacagaggacagggacgtgagcggcgagtggcctagggctttccccgatacaccgcctggcatgaccacaagcgttttcccggttgccgacgcgtgtcacagtgtgaagtcactgcagcgccagcctggtgcatcccccagccaggagaggaagcccacaggagtgtccgtgatttactgggagcggctgctgctcggctccagatccgaccaagcgtcaatttcactacgacttacttctcctctgcgaccaccaaagtcaagccgtccccgggagaagactttcaccgagtacagggtacccggtcgacagccaagaactccagaaagacagaagccctgcgcgcaggaggtaccaggcagggccttcgggaatgccagtgacctgaaggcagccagcggcggacgggatagacggatgggagccgcctggcaagagcctcataggctgctgggcggacaggaacccagtacatgggacgagctcggggaggctctgcatgccggtgaaaaatcttttgagtgtagagcatgctcaaaggtgttcgttaagagctccgaccttctgaaacatttgaggacccatacgggtgagcgaccatatgagtgtacacaatgtggcaaggcattctcccagacctcccatctaacccagcaccagcggatccacagtggagaaaccccctatgcttgtccagtgtgcgggaaagcctttcgtcattcatcctcacttgtgcggcaccagcgcatacacacggcagagaaatccttccggtgttcagaatgcggtaaggcattcagccacgggtccaacctgagccagcaccggaagatacacgctggcggaagaccgtatgcttgcgcccagtgtggacgaagattctgcagaaatagccaccttatccagcacgaacgcacccataccggtgagaagcctttcgtctgtgctctctgcggagctgcttttagtcaaggctccagtctttttctgcaccagcgtgtacataccggcgaaaagcctttcgcttgtgcccagtgtgggaggtccttcagccgctcaagtaacctcacgcagcatcagctgcttcatacgggggagaggcctttccgatgtgttgattgcgggaaaggattcgcaaaaggagctgtgctcctgagccatcggagaattcacaccggggagaaacccttcgtgtgcacgcagtgtggtagggccttccgggaacggccagcccttttacatcaccaacgcattcacacaacagagaagactaatgctgctgcacctgactgcactcctggccccggattcttgcagggtcatcatagaaaagtgagaagaggcgggaaacccagcccagtgctgaaaccagcaaaggtgtag

SEQ ID NO: 14074 - DNA, 1635 bp, Artificial Sequence
  Description of Artificial Sequence: Synthetic coding sequence
atgaccttcgaagatgtcgctgtgtatttttcccaggaggaatggggcctgcttgacaccgcgcagagagcgttatacaggcatgtaatgctagagaactttactctcgtcaccagcttaggtctctccacaagtcgcccgcgagtggtgattcaactggaaaggggggaagagccctgggttccctccgggaaagatatgacgctagcccgaaacacttatggtaggctgaattcaggctcatggagcttaacagaggaccgagacgtcagcggcgagtggccgagggcatttccagatacgcctcctggtatgaccacttctgtgtttccagtagcggatgcctgccactcagtcaaatccctccaaaggcagcccggtgcttcccccagtcaagaaagaaagccaacgggggtgagcgttatttattgggagcgacttctcctcgggtctcggagtgatcaggccagcatttctttgagactgacaagccctttacgtccgccaaaatcttccagaccacgggagaagacatttactgagtatcgggtgccagggaggcagccccgtactcctgaaagacagaagccatgcgcccaggaggttccagggagagccttcgggaacgcctctgatcttaaagctgccagtggaggccgggatcggcgcatgggcgcagcctggcaggaaccacacagattgctgggcggtcaggagccctcgacgtgggacgagctcggggaggctctgcatgctggggaaaagtcatttgaatgcagagcttgtagtaaagtgtttgttaaaagctccgacctgcttaaacatctccggacccacacgggtgagcggccatatgagtgtacgcagtgcgggaaggcgttctctcaaacctcacacctgacacaacaccagcgcatccattcaggggagactccctatgcctgccctgtttgcggcaaagctttccggcactcgagttccttggtgcgacatcagaggatccacaccgcagagaagtcctttaggtgtagcgagtgtggcaaggctttttcccatggcagtaatctgagtcagcaccgtaagattcatgcaggaggacgcccatacgcttgcgcacagtgcggaagaaggttctgtagaaactctcacctgatacaacacgaacggacacataccggagagaagccctttgtttgcgctttgtgcggtgcggcatttagccaggggtccagccttttcctccaccagcgggtccacaccggggaaaaaccttttgcctgcgcacagtgcggccggagcttttctagatcttccaatctgacccagcaccagctccttcatacaggcgagagacctttccgctgtgtcgactgcgggaaaggtttcgctaagggtgccgttctgctaagtcaccggcgaattcacactggagagaagccatttgtgtgcactcaatgcggccgggcatttcgagagcgtcctgcccttttgcaccaccaacggatccacaccaccgagaaaaccaatgccgcggccccggactgcacaccagggcccggtttcctgcaagggcaccatcgcaaagtccgccgtggaggcaagccatctccggtcctgaaacccgccaaggtctag

SEQ ID NO: 14075 - DNA, 1749 bp, Artificial Sequence
  Description of Artificial Sequence: Synthetic coding sequence
atggacttcgaggacgattatactcacagtgcatgccgaaatacttatcagggatttaacggtatggatcgagattacggccctgggagctacggcggcatggaccgagattacggacatggcagctatggaggccagagatcaatggattcctatctgaatcaatcctatgggatggacaatcactcgggcggcggcggaggctctcgattcggtccttatgagagttacgactcccgaagttcgctcggaggtcgagatctctatagatcaggatatggttttaatgagccagaacagagcagatttggtggatcctacggtggccgatttgaatcctcatataggaatagtctggactcctttggtgggcgaaaccagggcggatcttcctgggaagcgccttattctcggagcaaattgcgccctggatttatggaagaccgtggccgagagaactacagctcatacagttcattctcttccccccacatgaagcctgctcctgtggggtcccgtggccgaggaactccggcttatccggagtcaacatttgggagcaggaactacgatgctttcggcggcccttcaactgggcggggcagggggcgaggtcatatgggggacttcggcagcatccaccgtcctggcatagtcgtggactatcagaataaatctaccaatgtcaccgttgccgccgctagaggaataaaaaggaagatgatgcaaccttttaacaagccgtccggtacctttatcaagaagcctaagctcgcgaagcccatggaaaaaatctccctgtctaagtctcccacgaaaaccgatccaaagaatgaggaagaggagaagcgacggatagaagcacggcgggaaaaacagcgcaggcgacgagagaagaacagtgagaagtacggggacgggtatcgcatggctttcacttgcagtttctgcaagtttcgaaccttcgaagagaaagacattgagttgcacctggaatcatcttcccaccaggagactctggatcacatccagaagcaaacaaaattcgacaaagttgttatggagttcttacacgagtgtatggttaataagttcaaaaagacctccattagaaagcagcagaccaataaccagacggaggtcgtcaagattatcgagaaagacgttatggagggggttactgtagacgaccatatgatgaaagtggagaccgtgcactgctccgcctgttctgtctacatacctgcactgcactccagcgtccagcagcaccttaagtctccagatcacatcaagggcaaacaagcctacaaggaacaaattaagcgagaatctgtgctgacggctactagcattcttaataatcctatagtgaaggcacgctatgaaagattcgttaaaggtgagaacccatttgagatccaggatcactcgcaggaccaacagatcgaaggggacgaagaagatgaagaaaaaatcgatgaacctatcgaggaggaggaggacgaagacgaggaggaggaagccgaagaggtgggagaagtggaagaggtggaggaagttgaagaagttagagagggcgggattgaaggtgaaggtaatattcagggagtaggtgagggtggcgaagttggagtcgtcggcgaagtggagggggtgggcgaggtagaagaggtggaggaacttgaagaagagactgctaaagaagaacctgcggattttccagtggagcagcccgaggaaaattag

SEQ ID NO: 14076 - DNA, 213 bp, Artificial Sequence
  Description of Artificial Sequence: Synthetic coding sequence
atggactttgaagacgattatactcactccgcctgccggaacacctatcaagggttcaacggcatggaccgcgattatggccccgggtcctacgggggcatggatcgcgactacggccacggctcttatgggggccaacggtccatggacagctaccttaatcagagctacggtatggataatcattcgggaggaggaggagggtccaggtag

SEQ ID NO: 14077 - DNA, 1482 bp, Artificial Sequence
  Description of Artificial Sequence: Synthetic coding sequence
atggacttcgaggacgactacacgcacagcgcatgtcgcaatacctatcagggcttcaatggcatggatagggattatggccctggttcttacgggggcatggatcgagattatggtcatggaagctacggcggtcagaggtccatggactcctatctgaatcagagttatggtatggacaaccattccggcgggggtggtggcagttctttcagttctccacatatgaaaccagcccctgtggggtcccggggtcgaggcactccagcatatcctgaatctacgttcggctcacgcaactacgacgcgtttggtgggccgagtactggacgcggccggggtcgcgggcacatgggggattttggctccatccacaggcctggaatagtcgtggattatcagaacaaatcaacaaatgtgaccgtcgcagcggcacgtggtatcaaacgtaagatgatgcagccatttaataagccatccggcactttcatcaaaaaacccaaactcgccaaacccatggagaaaataagtctgtccaagtcccccactaaaacagatccgaaaaacgaagaggaagagaaaaggagaatagaagcacgccgcgagaagcagcgccggcgacgtgagaagaattctgaaaaatacggtgatggttaccgcatggcttttacttgctctttctgcaagtttaggacttttgaggagaaagatatcgagcttcacctggagtcctccagtcaccaggaaaccttggaccacattcagaagcagacaaaattcgacaaagttgttatggagtttctgcacgaatgtatggtgaacaaattcaaaaagacaagtatcagaaagcaacagaccaacaatcagacggaagtagtgaagataattgagaaggacgttatggagggcgtgactgtggatgaccacatgatgaaggtcgaaactgtccactgtagcgcctgttcggtttatatacctgctctgcacagcagtgtgcaacagcatctgaagagcccagatcatatcaagggcaaacaggcctacaaagagcagatcaagcgcgaatccgtcctgactgcaacctcaatcttgaacaatccgatagtgaaggcccggtacgaacgcttcgtcaagggagagaaccccttcgagattcaagaccactctcaggatcagcaaattgaaggggatgaggaggacgaagagaagatcgacgaacctattgaggaagaagaagatgaggatgaagaggaagaagcagaagaggtcggcgaagtggaagaggtggaggaggttgaagaggtaagagagggcgggatcgagggagagggcaacatccaaggtgtcggggagggaggggaagttggagtggtgggcgaagttgaaggagtgggtgaggtggaagaagttgaagagctggaagaggaaacagctaaggaggagcccgccgactttcccgttgagcagccggaggagaattag

SEQ ID NO: 14078 - DNA, 1749 bp, Artificial Sequence
  Description of Artificial Sequence: Synthetic coding sequence
atgatgtttaatcgagattacacacactctgcatgtagaaacacgtatcagggcttcaatggaatggatcgggattacggcccaggcagctacggcggaatggatcgagactatggacatggctcctatgggggtcagaggtctatggactcttaccttaaccagtcgtacggcatggacaatcatagcggcggaggaggtgggagccgattcgggccttacgaatcctatgacagcagatccagcctcggtgggcgagacctgtacagatctggctacggtttcaacgaaccagaacaaagcaggttcggaggatcgtatggaggccgattcgagagctcttacagaaattctttggactcctttggcgggagaaatcaggggggatcaagctgggaggcaccttactctcgttctaagcttagaccaggctttatggaagaccgcgggcgtgagaactactcttcgtattctagtttctcgagcccgcatatgaagcccgcgcccgttgggagtagggggagaggaacccccgcctatcctgaatccaccttcgggtcaagaaattatgatgcattcgggggcccatctaccgggcgcggaaggggccgtgggcatatgggtgacttcggctccatccaccggccggggattgttgtggactaccagaacaagagcaccaacgttactgtggccgcagcccgaggtataaaaagaaaaatgatgcagcctttcaacaaaccctccgggacctttatcaaaaagccaaaattggctaaacccatggagaaaatctccctgtctaaatcacctaccaagaccgatccgaaaaatgaagaggaggaaaagcggagaatcgaagcccgaagagagaagcagagacggcggagagagaagaatagtgagaagtacggggacggctataggatggcatttacctgttccttctgtaaatttagaacctttgaggagaaggacatcgaactccatttggagtcctcgtcacaccaggagacgctagaccacattcaaaaacagacaaagttcgacaaggtggtcatggagttcctccacgaatgtatggtgaataagtttaagaaaacatccattcgaaagcagcaaaccaataatcagactgaggtggtcaaaataatcgagaaggatgtgatggaaggggtgacggtcgatgatcacatgatgaaggttgaaactgttcattgcagtgcttgtagtgtatacattcccgccttgcacagctctgtgcagcagcatctcaaaagtccggatcatatcaaagggaaacaggcctacaaggagcaaattaagagggagtctgtgcttacggctaccagtatactgaacaatccgatagtgaaagctcgatatgagcggtttgtgaaaggggagaacccattcgagatccaggaccactcccaagaccagcaaattgagggggacgaggaggacgaggaaaagattgatgaacctatcgaggaagaggaggatgaagacgaggaagaggaggctgaggaagtgggcgaggtcgaggaggtggaagaagtagaagaggtcagagagggaggcatagaaggagaaggcaacatccagggtgtcggggaaggcggggaagtcggggtagttggagaggtcgagggtgtgggtgaggtagaagaggtagaagaactcgaagaggagacagccaaagaggagccggcagacttccccgtcgagcaaccggaggaaaattag

SEQ ID NO: 14079 - DNA, 1131 bp, Artificial Sequence
  Description of Artificial Sequence: Synthetic coding sequence
atgggtgactttggatccatccaccgccctggaatagtcgtggattaccaaaacaagtctacaaacgtgactgttgcagccgcgaggggtattaagaggaagatgatgcaaccgtttaataagcccagtggcacctttatcaagaaaccgaagctggccaaaccaatggaaaagatcagcctcagcaaatcccccaccaagactgacccgaaaaatgaggaagaggagaaacgcaggattgaagcccgaagagagaagcagagacggagaagagagaaaaattctgaaaaatacggcgatggttatagaatggcttttacctgcagcttctgcaagtttaggacctttgaggagaaagatattgagctgcacctggagtcatcttcacaccaggagacccttgaccatatccagaagcaaaccaaattcgataaggttgtgatggagttcttgcacgagtgtatggtgaataagttcaaaaagacaagtattcgcaaacagcagaccaataatcagaccgaagtcgtgaaaattatcgagaaggacgttatggaaggcgtgacagtggacgatcacatgatgaaagtcgagaccgtacattgcagcgcctgcagtgtatatatccctgcattgcactcttccgttcagcaacatttgaaatccccagatcatattaaaggcaaacaggcatataaggaacagattaagcgggagtccgtcctcacggcgacctccattcttaacaatccgatcgttaaggcacgctacgaacgcttcgtcaaaggtgagaacccttttgagattcaggaccacagccaagatcaacagatcgaaggagatgaagaagatgaggaaaagatcgatgagccgatcgaggaagaggaagatgaggatgaggaggaggaggccgaggaggttggtgaggtagaggaagtggaagaagtggaggaggtgagggaaggagggatagagggagaagggaacattcagggcgtgggcgagggaggagaggtgggagtggtgggagaggtagaaggcgtgggcgaggttgaagaggtggaagaactggaagaagaaaccgccaaggaagaacctgccgatttccccgttgaacagcccgaggaaaattag

SEQ ID NO: 14080 - DNA, 1626 bp, Artificial Sequence
  Description of Artificial Sequence: Synthetic coding sequence
atgaggctcaaaatgacgacacggaatttcccggaacgggaagtgccctgcgacgtggaggtggagcggtttacaagagaagtgccctgtttgtcgtccctgggcgacgggtgggattgcgagaatcaggaaggtcacttacggcagtccgcattgacattagagaagccaggtacacaggaggcaatctgcgagtatcccggattcggagagcacctcatcgcctcatctgatctgcctccaagtcagcgagtccttgccaccaatggatttcatgccccagactctaacgtgtcgggtctcgattgtgatccagcgctgccttcctatcccaagtcatacgctgataagaggacaggtgattccgatgcatgtggcaagggattcaatcatagtatggaagttattcatgggaggaacccagttcgcgaaaaaccctacaagtacccagaaagtgtcaagtccttcaaccatttcacaagcttagggcaccaaaagatcatgaaacgcgggaagaagtcctatgagggcaagaactttgagaacatttttacattgtccagttctctaaacgagaaccagcggaatctccccggcgagaagcagtatcgctgtacggaatgcggaaagtgttttaaaaggaactcgagtctggtcctgcatcatcgaacccacacaggggaaaagccatacacatgcaatgaatgcggtaaatccttttccaagaactataatcttattgtgcaccagcgaattcacacgggggagaagccttatgaatgtagtaaatgcggaaaagctttcagtgatggctctgctcttacacagcaccagcgaattcacacaggcgaaaaaccttatgagtgtctggaatgcgggaaaacattcaatcggaactctagccttatactccatcaacgaacacacactggagagaagccatatcggtgtaatgagtgtggaaagcccttcacggacatatcacacctcaccgtgcacctgaggatccatactggggagaagccgtatgagtgttcaaaatgcggtaaggccttcagagatggcagttacttaactcagcacgaacgaactcacactggtgaaaaacctttcgagtgcgcggagtgtggtaaatcattcaacagaaactcgcatctgatagttcatcagaagatccatagtggcgagaaaccatacgagtgtaaggaatgtggaaagaccttcatagagagcgcatacctgatccggcatcagagaatccatacaggagaaaagccctatgggtgtaatcagtgccagaagctcttccgtaacatagctgggttaattagacatcagcgcactcacactggggagaagccttacgaatgtaaccagtgtggcaaagcctttagggatagtagctgtctcaccaaacatcaacggattcacacaaaggaaactccttaccaatgtcctgagtgcggcaagtcattcaaacagaactcgcacttggctgttcaccagcgtcttcatagcagggaaggcccttcccggtgcccacagtgcggaaaaatgtttcagaaatccagtagcttggttcgccatcagcgtgcccatctgggtgagcagcccatggagacctag

SEQ ID NO: 14081 - DNA, 1626 bp, Artificial Sequence
  Description of Artificial Sequence: Synthetic coding sequence
atgcgtttgaaaatgaccacacggaacttcccagaacgtgaggtcccttgcgatgtcgaagtagagcgctttaccagagaggtaccgtgtctgagctccctcggggacggttgggactgtgagaaccaagaaggccatctccggcagtcagcgttgaccctcgaaaagccgggcacccaggaggctatttgcgagtatcccggatttggcgaacacctgatcgccagcagcgacttaccccccagccagagggtgctcgctaccaacggattccatgctccagactcaaacgtgtcagggctggattgcgatccagctctgccttcctatccaaaaagctatgccgacaagcgcacaggtgactcagacgcctgcggcaaggggtttaatcatagcatggaagtcatacacggacgcaatcctgttcgggaaaagccttacaagtacccagaaagcgtaaagtcattcaatcattttacctcgttgggtcatcagaagattatgaagagaggcaagaagtcttatgagggaaagaactttgaaaacattttcactctgtcttcaagcctgaatgaaaaccagcgtaatctgccaggcgagaagcagtacaggtgtacagagtgtgggaagtgtttcaaacgaaattcctcccttgtccttcaccaccgcacccacaccggagagaagccatatacctgcaacgagtgcggcaagtcattctcaaagaactataatttgatagttcatcaaaggattcatactggggagaagccgtatgaatgctccaaatgcgggaaagccttttcagacgggtccgccctgacccagcatcaaaggattcacactggagagaaaccctacgaatgtctggagtgcggaaagacctttaatcgtaactcatctctgattttgcatcagagaacgcatacaggggagaaaccttaccgctgtaacgagtgcggcaagccatttacagatatcagccatctgactgtacacttgagaattcatacaggcgagaaaccgtatgaatgctctaagtgtgggaaagccttccgagatggctcttatcttacgcagcacgaaaggacacacactggagagaagccctttgagtgtgcagagtgcggaaagagcttcaatcgcaatagtcatctgatagtgcaccaaaagatacacagtggtgagaagccatatgagtgtaaagaatgtggcaagacttttatagagtcagcgtatctaatcaggcaccagaggatccatacaggagagaagccatacggttgtaaccaatgtcagaaactctttagaaacattgccggtcttattcggcatcagcgaacccatacaggcgaaaagccttatgaatgcaaccaatgtgggaaagcttttcgcgactcgagctgtctgactaaacatcagagaatccatacaaaggagaccccgtaccagtgccccgaatgtgggaagagtttcaagcagaacagtcatctcgcagtgcaccagcgcctgcacagccgagaaggtccctctcgttgcccccagtgtgggaagatgtttcagaaaagctcctcccttgtgcggcaccaaagagctcacttaggcgaacaacccatggagacctag

SEQ ID NO: 14082 - DNA, 1626 bp, Artificial Sequence
  Description of Artificial Sequence: Synthetic coding sequence
atgaggctcaaaatgacgacacgaaatttccccgaacgcgaggtgccctgcgatgtagaggtggaacgattcacacgcgaggttccatgtctgagctcactcggcgacgggtgggactgcgagaatcaggagggacacttacggcagtccgcacttactctggaaaagccaggcacgcaggaagcgatttgtgagtaccccggtttcggagagcacctgatagcctccagcgatctgcctccctctcaaagggtgctcgcaaccaatggatttcatgcccctgattcaaacgtgagcggcctggactgcgatcctgctctccccagctatcccaaatcatacgccgataaacggaccggggacagtgacgcctgcggtaagggattcaatcactcgatggaggtaatccatgggagaaaccccgtgcgagagaagccctataagtaccccgagagcgtcaagagcttcaaccatttcacctctctcggtcaccaaaagataatgaagcgcggcaagaagagctacgagggaaaaaacttcgaaaacatattcactctatcatccagtctcaacgagaatcagcgcaacctaccaggggagaagcagtatcggtgtacagagtgcggcaagtgtttcaagcgaaattcttcacttgttctccatcacagaacccacactggagagaagccatacacttgtaatgaatgtggaaagtccttcagcaagaactacaacctgattgtacatcagagaatacataccggtgagaaaccatacgaatgcagcaaatgcggtaaggcattctcagatggaagtgcactgacccagcaccagcgtatccacaccggcgaaaagccgtatgaatgcctggaatgcgggaagacattcaatcggaactcaagccttattctgcatcaaagaacccataccggtgaaaaaccatataggtgtaatgagtgcggaaagccattcacagacatctcccatctgactgttcacctgcgtatacacactggcgagaagccttacgagtgtagcaagtgcggaaaggcgtttcgcgatggatcatacttaacccagcatgaaaggacacatacgggggagaagccatttgaatgtgcagaatgcggaaagtcctttaataggaactcacacctcatagtgcaccagaaaatccacagcggcgagaagccctacgaatgcaaggaatgcggcaagacctttattgagtccgcatacctcatcaggcatcagcggattcatactggcgaaaagccatacggatgcaaccagtgccagaagctcttcagaaacatcgccggactgatcagacatcagcgtactcacaccggtgaaaagccatatgagtgcaatcaatgtggcaaggcctttagggattccagttgccttaccaaacatcagcggattcacacgaaagagaccccctaccagtgtccggaatgtggaaagtcatttaagcagaacagccacctggccgttcaccaacgactacatagtagagaagggcctagtcgatgcccccaatgcggaaagatgttccagaagagttccagcttagtgcggcatcagcgagctcacctgggggagcagcctatggagacttag

SEQ ID NO: 14083 - DNA, 2043 bp, Artificial Sequence
  Description of Artificial Sequence: Synthetic coding sequence
atgaagatgaaaaagttccaaatccctgtctcttttcaggatctgacagtgaactttactcaggaggagtggcagcagctggaccccgctcagcggctgctgtaccgcgacgtgatgcttgagaactactcgaatcttgtgagtgtgggctatcatgtcagcaagccagacgtcatatttaagcttgaacagggcgaggaaccatggattgtggaggagttttctaaccaaaactatcctgacattgatgatgcacttgaaaagaataaagaaattcaggataagcacctaacacagacagtgttttttagtaataagactctgattaccgaacgggagaatgtctttggcaagaccttaaatctggggatgaacagcgtgccgagtaggaagatgccgtacaagtgcaaccccggcggcaactcactgaagacaaactcagaagtgattgtagcaaagaaatctaaggagaatagaaagatacctgatggctactctgggttcggaaagcatgagaaaagccaccttgggatgaagaagtatagatacaatcctatgaggaaggcctccaatcaaaacgaaaatctgatcctgcatcagaatattcagattctgaaacagccttttgattataataagtgcggaaaaacattcttcaagcgagcaatattaattactcagaaagggaggcagacagaacgtaagcccaacgaatgcaacgagtgtcgcaaaactttctccaagcggtccacactcatagtccatcagcgtatccacacaggcgaaaagccttatgtgtgttcagactgcaggaaaaccttccgagtgaagacctctctgaccaggcaccggcggattcataccggcgaaagaccctatgaatgcagcgaatgcagaaagacatttatagacaagtccgcccttatcgtacatcagaagatacatggcggcgaaaagtcgtacgagtgtaacgaatgcggcaaaacttttttcaggaagagcgccttggccgagcactttagatcgcacacaggcgagaaaccttacgaatgcaaagaatgcggcaatgctttcagcaagaaaagttacctcgttgtgcaccagcgcacgcacagaggcgagaaacccaacgaatgcaaggagtgcggcaagacctttttttgccaaagcgcattaaccgctcaccagcgaatccacaccggggagaaaccctacgaatgttctgaatgtgagaagacctttttctgccagtcagcattgaatgtgcacaggaggtcacatactggggaaaaaccctacgagtgtagccaatgcgggaagttcctgtgcaccaaatccgcgttaattgctcaccagatcactcatagagggaaaaaatcatacgaatgtaatgaatgtggtaagtttttttgtcataagagtaccctaactattcatcagagaacccataccggcgaaaagcacggggtattcaataaatgtggtcggatcagcatcgtgaaatcaaattgttcgcagtgtaaaaggatgaatactaaggagaacctgtacgaatgtagcgagcacgggcacgcagtctctaagaattcacaccttattgttcaccagaggaccatctgggagagaccatatgaatgcaacgaatgcggccgcacctactgtcggaaatctgctctgacccaccaccagaggacccacacgggacaacggccttacgaatgtaatgagtgtggcaagacattctgtcagaaattttccttcgtagaacaccagcggacacatactggcgagaagccctatgaatgcaatgagtgcgggaagagcttttgtcataaatcagccttcagagtacataggaggatacacacaggcgagaagccttacgagtgcaatcagtgcgggaaaacttataggcggctgtggaccctcaccgaacaccaaaagatccacacaggagagaagccgtacgagtgtaacaagtgcgagaagacattccgacacaagtcaaatttcctgttacaccagaagagccataaggagtag

SEQ ID NO: 14084 - DNA, 1929 bp, Artificial Sequence
  Description of Artificial Sequence: Synthetic coding sequence
atgctcgaaaactattccaaccttgtttctgtaggttaccatgtctccaagccggacgtgatctttaaattagagcaaggggaggaaccttggattgtagaagaattcagcaatcagaactatcctgacatcgacgatgccctggagaaaaacaaggaaatccaggacaagcacctgacccaaactgtgtttttttctaacaagaccctgatcacagagcgagaaaatgtttttggcaagactttgaacctgggtatgaactcagttccatccagaaaaatgccttacaagtgtaatcctggtgggaactcactgaagactaatagcgaggtgatagtcgccaagaaatctaaggagaatcgaaaaattcctgacggctattccgggtttggaaagcatgagaaaagccatctgggcatgaaaaagtaccggtataatcccatgcgtaaggcgagtaaccaaaacgagaatctgatccttcatcagaacattcagatcctgaaacagccctttgattataacaaatgtggaaaaactttttttaaaagagcaatcctgatcacgcagaaaggtcgtcagacagaacgaaagcctaacgaatgtaatgagtgtaggaagacattcagtaagcgtagcaccttgatcgttcaccaacgcattcacactggggaaaaaccctatgtgtgttccgactgccggaagactttccgtgtgaaaacctcacttacccggcatagacgcatacatacaggtgagcggccttatgaatgttccgaatgccggaagacctttatcgacaagagtgcgctgatagtccaccaaaaaattcacggtggcgagaaatcatatgagtgtaacgagtgtgggaagaccttctttcgaaaaagcgctttagcagagcacttccgttctcacacgggagaaaaaccatatgagtgcaaagagtgcgggaacgctttcagcaaaaaatcttacttggtggttcaccaacggactcacagaggtgaaaaaccaaacgagtgcaaggaatgcggcaaaacctttttctgccaaagcgcccttactgcccaccagcgcattcataccggtgaaaaaccatacgagtgcagcgagtgcgaaaagactttcttctgccaaagtgcgctgaatgtccatcgcagaagtcacaccggggaaaagccctatgagtgtagccagtgtggaaaattcctctgcacaaaatccgcgctgattgcgcaccaaattacccacaggggaaaaaagagctatgagtgtaacgagtgcggaaagttcttctgtcacaaaagcaccctcacaatccaccaaagaacacacactggtgagaagcatggggtcttcaacaaatgtggccggatcagtatagttaaaagtaactgcagtcaatgcaagcgcatgaacaccaaagagaacctgtatgagtgcagcgagcacggccacgctgtgagtaagaacagtcaccttatcgtccaccagcgcacaatatgggagagaccatacgaatgcaatgagtgtggccgaacttattgtagaaagtctgccctgactcatcatcagcggactcatacaggccaaaggccctacgaatgcaatgaatgcgggaaaactttttgtcagaagttttcctttgtcgaacatcaacgaacccatacaggtgagaaaccctacgaatgtaatgaatgcggaaagagcttttgccataaaagcgcttttcgggttcaccgcagaatccatacaggtgagaagccatacgagtgcaatcagtgcggaaagacctaccgacgactgtggaccttgacagaacatcagaagattcacaccggggaaaaaccatatgagtgcaacaagtgtgagaagacatttcgtcacaaatctaactttttactgcatcaaaagagtcataaagagtag

SEQ ID NO: 14085 - DNA, 2256 bp, Artificial Sequence
  Description of Artificial Sequence: Synthetic coding sequence
atgggtccacagggagctaggagacaggcatttctggcattcggtgacgtcacagtcgacttcacccaaaaagaatggaggctcctttctcctgcacagcgagctctgtacagagaggtgactcttgaaaactactctcatctcgtctccctgggcatcctccactcaaagcccgaactgattcgccgtcttgaacaaggcgaagttccctggggtgaggaaagaaggagaagaccaggaccatgtgcgggtatctacgccgagcacgtgctcaggcccaaaaacctgggtttggcccatcagcgccaacagcagctgcagttctccgaccaaagcttccagtctgacaccgcagagggacaagagaaagagaagtccacaaaaccaatggcatttagcagtcctcctctaaggcacgctgtgtccagcagaaggcggaacagcgtcgtggagatcgagtcatcacaggggcagcgggaaaaccctactgagattgacaaggttctcaaggggattgagaattctcggtggggcgcgttcaaatgcgctgagagaggccaggactttagccgaaaaatgatggtgatcattcataaaaaagctcatagtcgccagaaactctttacctgcagggaatgtcatcagggtttccgagacgagagcgcccttctgctgcaccagaatacgcatacgggtgaaaaatcttacgtttgctcggtatgcgggagaggatttagtctcaaagccaatctgctacgtcaccagaggactcactccggtgaaaagcctttcctgtgtaaagtgtgcggaaggggatacacaagcaagtcataccttaccgtacacgagcgcacccacactggagagaaaccatatgaatgtcaagagtgcggaaggcggttcaatgataaatccagctacaataaacacctgaaagcccatagcggcgaaaagccatttgtatgcaaggaatgtgggcgcgggtacacaaacaagagctattttgttgtgcacaagcgcatccatagcggcgagaaaccttacagatgccaggaatgcggacgaggtttttctaacaagagccaccttataacacatcagcgtacccacagcggagagaaaccctttgcctgtagacaatgcaaacaatcattttctgtgaagggatctctactgcgtcaccagagaacccattccggagaaaagccctttgtctgtaaggattgcgagcgctcattctctcagaaatccaccttagtgtatcaccaaagaactcactcaggagagaagccattcgtatgccgagagtgcgggcagggcttcatacaaaaatcaacactggtgaagcatcagattacccattccgaagaaaaaccatttgtgtgcaaggattgtggccgtggcttcatacaaaagtctaccttcaccctgcaccagaggacacattccgaggagaagccctacggatgtcgtgagtgtgggcggcgcttccgggacaaaagctcttataacaagcacttgagagcccatttgggcgagaagcgattcttctgtcgtgactgtggccgagggtttaccttgaagcccaacctgaccatccaccagcgaacccactcaggagaaaagccattcatgtgtaagcaatgcgagaagagtttttcactgaaggctaatctcctgcgtcaccaatggactcattctggagagagaccgtttaattgtaaggactgcggacgggggtttatcctgaaaagcactctgctttttcaccagaagacacactccggagaaaaaccctttatttgttccgaatgtggtcaaggatttatttggaaatccaatcttgttaaacaccagctggctcatagcggtaagcaaccattcgtttgcaaagaatgtgggagaggcttcaactggaagggcaatctgctgacacatcaacggacccactctggcgagaagcccttcgtttgcaacgtctgtggtcagggcttctcttggaagcgtagccttacacgccaccactggcgcatccattctaaggaaaaaccctttgtgtgccaggaatgcaaaagaggctacaccagcaagagcgacctgactgtgcatgagagaatccataccggcgagaggccttacgagtgtcaagagtgtgggaggaagttctcaaataaatcttattatagcaaacacctgaagaggcatcttagagagaaacgattttgtaccgggtccgtgggagaggcatccagttag

SEQ ID NO: 14086 - DNA, 1920 bp, Artificial Sequence
  Description of Artificial Sequence: Synthetic coding sequence
atggggccccaaggcgctagaagacaagcatttttggccttcggtgacgtaacggtggacttcactcagaaggagtggcgattgctgtccccagcacagagggcattgtacagggaagtcactctcgaaaactattctcaccttgtcagcttgggtattctgcactcaaaacccgaattgatccggcgtctggagcagggtgaagtaccctggggagaggaacgacggcgaaggccagggccctgcgcaggcatctacgccgagcatgtcctaaggcccaaaaatctgggcctggcccatcagcgacagcagcagttgcagttcagtgatcagtccttccagagtgatacggctgagggacaggagaaggaaaaatctacaaaaccaatggcgttctctagcccaccactgcggcatgcagttagctccaggagacgcaactctgtcgtcgaaatagagtcctcacaagggcagcgcgaaaatcccactgagattgataaagtgctgaagggaatagaaaactctagatggggggcatttaaatgcgcggagagaggacaggattttagcagaaaaatgatggtgatcattcacaaaaaggctcattcgaggcagaagctgtttacgtgcagggagtgtcaccaggggtttcgggacgagtccgctctcctgttacatcagaatacacacacaggcgaaaagagctatgtgtgcagtgtgtgcggacggggcttctctctgaaggctaacctgctcaggcaccagcgtacccacagcggcgaaaagccttttctttgcaaagtctgcggccgcggatacacatcgaaatcctatttgaccgtgcacgaaagaacccacacgggagaaaaaccctacgagtgtcaggagtgcggcagacgcttcaatgacaaaagttcctacaacaagcacttgaaagctcacagtggcgagaagcccttcgtgtgtaaagagtgcgggcgggggtataccaacaaaagttacttcgtggtgcacaagagaattcattccggggagaaaccttatcgatgccaagagtgtggacgtggattttcaaataaaagccacctgataacccatcagagaactcatagtggcgagaaaccttttgcatgtagacaatgtaagcagagttttagtgtcaaggggtcgttacttcgacatcagagaactcattccggagagaagccattcgtctgcaaggattgtgagaggtcattttcgcagaaatccacactggtgtatcaccagcgaactcacagtggtgagaaaccttttgtgtgccgggaatgcggacagggcttcatccagaagtcgacgctcgtgaagcaccagatcacccatagtgaggaaaagcccttcgtgtgcaaagattgcggtaggggatttatccaaaagagcaccttcacactccatcaaagaacccattctgaggaaaagccatacggctgtcgtgagtgcggaagaaggttccgagataaatcatcatacaacaaacacttaagggctcacctgggtgagaaaagattcttctgccgcgactgcggacgaggttttactctgaaacccaacttgactattcaccagcgcacacactctggcgaaaaaccttttgtttgcaacgtgtgcgggcaaggattcagctggaagcggagtctgactagacatcattggaggatccacagcaaggagaagccctttgtatgtcaggaatgtaaacgggggtatacatccaagtctgacttgactgtgcatgagcgtattcatacaggcgagaggccgtatgagtgtcaggaatgtggccgcaagttctccaataagtcttattattctaaacacctgaagagacatctccgggagaagaggttttgcaccggttcagtgggcgaggccagctcttag

SEQ ID NO: 14087 - DNA, 2256 bp, Artificial Sequence
  Description of Artificial Sequence: Synthetic coding sequence
atgggcccacagggtgctcgcaggcaggctttcctggccttcggagatgtgaccgtggactttacccagaaggagtggagacttctgtcaccagcgcaaagagcactgtatcgcgaagtgacactagaaaattactcccacctggtttctctgggcattcttcattccaagcccgaacttatccgaagactggagcagggagaggttccctggggcgaagaacgccggcggcggcctggtccctgtgccgggatatacgcagaacatgttctcaggcctaaaaacctcggtttggcgcaccaaagacagcaacaactacagttctccgaccagtccttccagagcgacaccgccgaaggacaggagaaggaaaagagcacgaaacctatggcgtttagctccccccctctaaggcacgctgtgtctagcagaaggcgcaattctgtcgtggaaatcgagtcttctcaaggacagcgggagaatccaaccgaaatagacaaagttctgaaaggcatcgagaacagtcgctggggtgcttttaaatgcgctgagcggggacaagatttttccaggaagatgatggtcatcatacacaaaaaagcccattcaagacagaaactgtttacatgtagagagtgccatcagggtttcagagatgagtctgcgctgctcttgcaccaaaatactcacactggtgagaaaagctatgtttgctccgtgtgtggcaggggcttcagtctcaaagcaaatctcctgcgacatcaacggacccatagcggtgaaaagccattcttgtgcaaggtgtgtggccgaggctacacatccaagagctacctgaccgtccacgagcgaacccacactggcgagaagccatatgagtgccaagagtgcgggcgtaggttcaatgataaatcaagctacaacaagcatctgaaggctcactccggtgaaaagccatttgtgtgtaaggagtgtggacgaggctacacgaacaagtcctatttcgtcgttcacaagcgaatccattccggtgagaagccataccggtgtcaggagtgtggccgggggttctcgaacaagtctcaccttattacgcatcagcgtacacacagtggcgagaagcccttcgcatgccgacaatgtaaacagagtttttcggtcaaaggctctcttctgcggcaccagaggactcattccggagaaaaaccttttgtctgtaaggattgtgaaaggtcattcagccagaagtccacactggtttaccaccaacggacacattccggcgagaagcctttcgtctgtcgtgaatgcggtcaaggcttcatacagaaatcaacactagtgaagcaccagattactcattctgaggaaaagccattcgtctgtaaagactgtgggcggggattcatccaaaaatccacattcactttgcaccagcgcacccactcagaggaaaaaccatatggatgtagagagtgtggaaggcgtttcagggataagagcagttacaacaagcatctcagagctcatttgggggagaaacgcttcttctgtagggactgcggacgcggcttcactctaaaaccaaatcttaccatccaccagcggacgcattcgggagagaagccctttatgtgtaaacagtgcgagaaatctttttcattgaaggccaacctcttgcggcaccagtggacccacagcggagaaaggcccttcaattgcaaagactgcggaaggggtttcattctgaaatctacgctgctgttccatcagaagacccatagcggtgagaaacctttcatctgtagcgagtgcggccagggcttcatctggaagtccaacctcgttaagcatcaactggcccattccgggaagcagccattcgtctgcaaagagtgcgggaggggctttaactggaagggaaatctgctgactcaccaacgcacacattcaggcgagaaacccttcgtgtgcaacgtctgtggtcagggcttctcttggaaacgcagcctcacccgccatcactggcggattcatagtaaggagaaaccttttgtctgtcaggagtgtaagcgcggatatacttctaaaagtgacctgactgttcacgaaaggatccacactggagaacgcccctacgaatgccaggaatgtggtagaaaatttagcaataagtcatactattccaagcacctcaaacggcacctgcgcgagaagcgcttctgtactggtagcgttggcgaggcctcttcatag

SEQ ID NO: 14088 - DNA, 2160 bp, Artificial Sequence
  Description of Artificial Sequence: Synthetic coding sequence
atgggcccccagggtgcgcgtagacaggcatttcttgcattcggtgatgtaaccgtggatttcacccagaaggaatggcgccttctgtcgccagcccagcgcgcactgtatcgcgaagtgaccctggagaattatagtcatctggtgagcctggggatctatgctgaacatgtgctgcgtccaaagaatctaggtttggcccatcagcgccagcagcagctacagttcagcgatcagtcattccagtcggacacagctgaaggacaggagaaagaaaaatccaccaaaccaatggcctttagctctccgcccttacgccacgccgtgtcaagccgtcgacggaacagcgtggtcgaaatcgaaagctcccagggccagcgcgaaaacccaacggagattgacaaagtgctgaaaggaattgaaaatagtaggtggggggcatttaaatgtgctgagcgcggccaagacttctcaagaaagatgatggttattattcataagaaagctcatagcagacagaaactgttcacttgcagagagtgccaccagggatttagagatgaatccgccctgctgctgcatcagaatactcacacaggagaaaagtcatacgtctgctcagtatgcggaaggggttttagtctcaaggccaatctgctccgccaccagagaacgcatagtggcgaaaaaccctttctctgcaaggtttgtggccgcggctacacgtcaaaatcttatctaacagttcatgagcgcactcacactggggagaaaccatatgagtgtcaggaatgcggtcgccgctttaatgataaatcttcatacaataagcacctgaaagcccacagcggggagaagcccttcgtgtgtaaagaatgcggaagaggctatacgaataagagttatttcgtggtgcacaagcgaatccattctggagagaagccctatcggtgccaggaatgtgggaggggattcagtaacaaatctcacctgattacccatcagaggacacacagtggtgaaaagcccttcgcctgtcgccagtgcaaacaatcgttctctgttaaggggagcctgctccgccatcaaagaactcactcaggcgaaaaacctttcgtgtgtaaagattgtgagaggtcattcagccagaaaagcacccttgtttaccaccagaggacccattcaggtgaaaagccttttgtgtgccgcgaatgcgggcagggctttatacaaaagtccaccctagttaagcatcagatcacccactccgaggagaagccgttcgtgtgtaaggactgtggaagaggctttattcaaaaatccacctttacgctccatcagcgtacccacagcgaagaaaagccgtatggttgtcgcgaatgtggacgacgctttcgggataagtccagttataataagcacctgcgagctcatctgggggagaagagattcttctgtagagattgtggtcgaggatttacgctgaagcctaaccttactatccaccaacgaacccactcaggtgaaaagccctttatgtgtaaacaatgtgaaaagtcatttagcctgaaggcaaatctgctgcgtcaccaatggacgcactccggggagcgcccttttaattgcaaggactgcgggcgtggattcatacttaagtccacactcttgttccatcagaaaactcatagcggggaaaaacccttcatctgtagcgagtgtggccaaggattcatttggaaaagtaacctagtcaagcatcagctcgcacacagtggcaagcagccctttgtttgcaaggagtgcggcaggggctttaactggaaaggaaacctgctgacacatcagaggacgcattccggcgagaagcccttcgtgtgcaacgtgtgtgggcaggggttcagctggaaaaggtctctcacaaggcatcactggaggatccatagcaaagagaagcccttcgtgtgtcaggaatgcaaaagagggtatacctccaaatcggacctcaccgtgcatgagcggatccacacaggagaaaggccttacgaatgtcaggagtgcggccgtaaattttccaataaatcctattacagcaagcacctgaaacgtcacctcagggagaagagattttgtacaggctctgttggagaggcctcctcctag

SEQ ID NO: 14089 - DNA, 2544 bp, Artificial Sequence
  Description of Artificial Sequence: Synthetic coding sequence
atggcgcaagcgatttttgaggccttggaaggaatggataatcagacggtgctcgcggtccagtcactactggatggacagggcgccgtgcctgatccaaccggacaatctgtcaacgcaccgcctgcgatacagccactagatgacgaggatgtcttcctctgtgggaagtgcaaaaaacagttcaacagtttgccggcatttatgacacacaagcgcgaacagtgccagggaaacgcaccagccctggccactgtctcactggcaacgaatagcatttatccaccctcggcagcacctactgccgtgcagcaagctcctacgcctgccaacaggcagatctccacttatattaccgtacccccttcacctctcattcaaacactggtccagggaaacatcctggtatcagacgacgtgctgatgtcggccatgagcgccttcacaagcctggaccagcctatgccgcaggggcccccccccgtgcagtcttccctgaatatgcattctgtgccttcctatctcacacaaccccctcctcccccccctcccccccctcccctacccccacctccgcccccgcagcccccccccccaccaccccagagcttagggccccccggcaggcctaatcccggggggaacggcgttgtggaagtgtatagcgcagccgcgcctctcgcgggctctgggacagtagagatccaggcactgggtatgcagccctacccccctttagaggtgcccaatcagtgcgtagaacccccggtgtatccaactcccactgtatactctcccgggaagcagggattcaagcccaaaggacccaatccagccgcgccaatgacaagtgccaccggagggaccgtggccacattcgattcaccggcaacactaaagacccgcagggccaaggccgcgggaaagcccaaggcccagaaattaaagtgctcctattgtgacaaatccttcacaaagaatttcgacttacagcaacatattcgatctcacactggcgaaaagccgttccaatgtatagcctgtggacgggcctttgcccagaagagcaatgtgaaaaagcacatgcaaacacacaaagtctggcccccaggtcactccggaggaactgtcagccgcaattcagttacagtccaagtgatggctctcaatccatcccgccaggaagatgaggaatccaccggtctgggacagcctctcccaggggccccgcaaccccaagctctttcgaccgccggcgaagaagagggtgataagccagagagtaagcaggttgtcctgatagattcatcctatctctgccaattctgcccttccaaattctcaacctattttcagctgaagagtcatatgacccagcacaagaatgagcaagtgtacaagtgtgtggtgaagtcatgcgcccagacatttcctaagctggacactttccttgaacatataaagtcacaccaagaagagctgagctatcggtgccacctgtgcgggaaagattttccatctctgtacgacctgggcgttcaccaatatagtcattccctgttgcctcagcactcacccaagaaagacaacgctgtctataagtgtgtcaagtgcgtcaataagtactcaacaccggaagcactcgaacaccatctccagaccgccacgcacaattttccatgcccacattgtcagaaagtctttccatgtgaaagatacctccggcggcacctgcctacacacgggtcggggggcaggtttaaatgccaggtctgtaaaaaattcttcagacgtgaacactacttaaaactacatgctcatattcacagcggtgagaaaccttacaaatgttcggtctgtgaatctgcatttaatcggaaagataagcttaagagacatatgctgatccacgaaccctttaaaaagtataagtgcccatttagtacacacactggctgctccaaggaatttaataggccagacaaactaaaagcacacatccttagtcactccggaatgaagttgcataagtgcgccttgtgcagcaagtccttctccagaagagcccatctggctgagcatcagcgggcacatactggcaactacaaatttcgctgtgcaggatgcgccaagggtttttcgcgccataagtacctgaaggatcaccgttgccggttgggaccacagaaagacaaggatctacagacgcgccgaccaccacaacggcgggctgcacctcggagttgcggcagcggcggccgtaaagtcctgacaccacttccggatcctttgggtctggaggaactcaaggacaccggggcaggtctggtgccagaggcggtgcctgggaagcctcccttcgccgagccggatgccgtcctgtcaatcgtggtgggaggagccgtaggggccgagactgaattggtggttcctgggcatgctgagggacttgggagcaatttagccctggctgaacttcaggcaggagctgaggggccttgcgcaatgctcgccgtaccggtgtacattcaggcatcagagtag

SEQ ID NO: 14090 - DNA, 2565 bp, Artificial Sequence
  Description of Artificial Sequence: Synthetic coding sequence
atggcccaggccattttcgaggcccttgagggcatggataaccaaaccgtcctcgctgtccaaagtctcctggatggccagggcgccgtgccagacccgacagggcagtctgtcaacgctccacctgccatacagcctttggacgacgaggacgtcttcctctgtggaaagtgcaaaaaacagtttaacagtctccccgctttcatgacacacaaacgcgaacagtgtcagggcaacgcaccggcattggctacggtctcacttgccacaaacagcatctatccgcctagcgccgcaccgaccgcagtgcagcaggccccaacacctgcgaaccggcagatctccacctatatcaccgtgcccccgagccccttgatccagacattagtgcaggggaacattttggtctccgacgacgtcttaatgagcgctatgtctgcctttacgagtcttgaccaaccgatgccccaaggaccccctccagttcaaagttcattaaacatgcattcagtgccatcatacctaacacagccccccccccccccacctcccccgcctcccctcccgccaccccctcccccccagcctcccccacctcccccacagagtctcggcccacccggccgacccaacccggggggtaacggtgtggtggaggtctactccgctgccgcacctctggccggttctggtaccgtggaaattcaggccctgggaatgcagccctatcctccacttgaagtccccaaccagtgcgttgaaccacccgtgtatccgacaccaacagtatattcacctgggaaacagggctttaagccaaagggccctaaccccgccgcccctatgacaagcgcaactgggggcacagtagctaccttcgattcccctgctactctgaaaactcgtcgcgctaagggggcccgggggcttccagaggccgcaggcaagccaaaagcccagaagctcaagtgctcctactgtgacaaatcctttactaagaacttcgacctgcagcagcacatcaggagccatacaggggaaaagcccttccagtgtattgcctgtgggcgggcattcgcccagaagagcaacgtaaaaaagcacatgcagacccacaaagtctggcctcccgggcatagtggcgggaccgttagccggaactccgtaacggtacaagtgatggccttgaacccatctcggcaggaggatgaagaatccactggtctcgggcaacctcttcccggagctcctcagcctcaagccctgtccacagctggagaggaagagggggataaaccggaaagcaaacaggtggtactcatcgacagctcttacctttgtcagttttgtcctagcaaattctccacctatttccagttaaaatctcatatgacgcaacacaagaacgaacaggtgtataaatgtgtagtcaagtcatgtgcccagacttttcccaaactggatactttcctcgaacacatcaagagccaccaagaagagctgtcttaccgctgccacttatgcgggaaggattttcccagcttatatgatcttggcgtccaccagtacagtcactctctattgccccagcacagtcctaagaaagataacgccgtctacaaatgtgtgaagtgcgtgaataagtattctactcccgaagctttagagcaccacctgcagaccgccacacataacttcccgtgtccccactgtcaaaaggtgttcccatgcgagcgatatttaagacgtcatctccccacacacggtagcggcggaaggttcaagtgccaagtgtgcaaaaaatttttcaggagagaacattacttgaagctacacgcgcatatccacagcggcgagaagccctacaagtgttcagtctgcgagagcgctttcaatcgcaaggataagctgaaaaggcacatgctgattcacgagcccttcaaaaagtacaagtgcccattttcaacgcataccggctgctctaaagagtttaatcgacccgataaactgaaagcacatattcttagtcactcgggcatgaaactccacaaatgtgccctgtgctctaaaagcttctctcgaagagcacacctggcggaacatcagagagcacataccggcaactataagttcagatgtgccggatgtgctaaagggtttagcagacacaagtacctgaaagaccatagatgccgcctggggccccagaaggataaagatctccagacacgcaggcctccacagcgtagggccgccccacgctcatgcggcagtggcgggcgcaaggtgctcaccccactgccggatcctttggggctggaggagcttaaggacaccggagcagggctagttccagaagctgtgccaggaaagcctccgttcgcagaaccagacgcagtgctttcaatcgtggtcggaggcgccgtgggcgcagagaccgaactcgtggttcctggccacgccgaaggtttgggttctaatctcgctctcgctgaacttcaggccggcgccgaggggccatgcgcaatgttggcagtgcctgtctatatacaggcatctgaatag

SEQ ID NO: 14091 - DNA, 1800 bp, Artificial Sequence
  Description of Artificial Sequence: Synthetic coding sequence
atgatgctgccatatccaagtgctctcggggaccagtattgggaggaaattctcttgcccaagaacggagagaacgtcgaaacaatgaaaaaattaacacagaaccataaggccaaaggcctgccctctaatgataccgactgcccccagaagaaggaagggaaggcccagatcgttgttccagtcacctttcgagatgtgaccgtcatttttactgaggccgaatggaagcgcctgtctccagagcaacggaatttgtataaagaggtgatgctggagaactaccgaaatctgctgagtttagccgagcctaaacccgagatttacacttgtagtagctgccttctcgcatttagctgtcagcaatttctttcccagcatgtgttgcaaatattccttggtctttgcgcggaaaatcactttcaccccggcaacagcagccccggacactggaaacagcagggtcagcaatacagccacgtttcatgctggttcgagaacgctgagggacaggagaggggaggggggagcaagccctggtcagcccggaccgaagagcgcgagaccagccgggcattcccaagccctctgcagaggcagtccgcctctcctaggaaggggaatatggtggtcgagaccgaaccctccagtgcgcaaaggcctaaccccgtgcagttggacaaaggactgaaggagttggagaccttgcggtttggagcaatcaattgtcgggagtatgagcctgatcacaacctggaatccaactttataaccaacccccgcactttactaggtaagaaaccttacatttgctctgactgtggccgtagctttaaggaccgttccacactcattcgccatcaccgaatccattctatggagaaaccttatgtctgctccgagtgtggccggggcttcagccagaaatccaacctgagtcggcaccagcgaacccatagcgaggagaaaccctacctctgcagggaatgcgggcagtcttttcggtctaagtctatcttgaaccgacatcagtggacacactcagaagaaaaaccttacgtctgtagcgagtgtggcaggggctttagtgaaaagtccagcttcatccggcatcaaagaacacattcaggagaaaagccgtacgtgtgcctagaatgcggtcgatccttttgtgacaaatccactctgcgtaagcaccaacggattcactctggcgaaaagccgtatgtgtgtcgtgagtgcggcagagggttcagccagaatagtgacctgattaagcatcagcggacccaccttgacgagaagccctacgtgtgcagggaatgcggaaggggcttctgcgataagagcactttgatcatccatgaacggacacattcaggcgagaaaccttacgtgtgtggcgagtgtggacgtggcttctcgcggaaatccctcctcctcgtgcaccagcgtacacactccggcgaaaaacactacgtatgtcgcgagtgtagaaggggttttagtcagaaaagcaatttaatccgacaccagaggacccactctaatgaaaagccctacatttgtcgcgagtgcggcaggggcttctgcgacaagagcacattgatagtccacgaaaggactcattccggggagaagccctatgtgtgctccgagtgcggaagaggatttagcagaaagtcacttctgctggtgcaccagcgcacacattccggagagaagcattatgtgtgccgcgagtgcggccgtggattctcccacaaaagcaacctgattcggcaccagcgaacccactag

SEQ ID NO: 14092 - DNA, 357 bp, Artificial Sequence
  Description of Artificial Sequence: Synthetic coding sequence
atgatgctcccatatccaagcgccctgggagatcaatactgggaggaaattctgctgcccaagaatggcgagaatgtcgaaaccatgaagaaattaacccagaatcacaaagccaaagggctcccgagcaacgacaccgactgcccccagaaaaaggagggcaaagctcagattgtagtccctgtgacatttcgggatgttacagtgattttcacagaagcggagtggaagcgcctcagccccgagcagagaaatttgtataaagaagttatgttggagaactaccgcaaccttcttagcctgggccaggagattgagacaatcctggccaacattgtcaaatcacatctgtactag

SEQ ID NO: 14093 - DNA, 306 bp, Artificial Sequence
  Description of Artificial Sequence: Synthetic coding sequence
atgatgcttccctatccgagtgctctcggagatcagtattgggaggagatcctgctccccaaaaatggggagaatgttgagactatgaagaagttaacacagaatcataaagccaaaggcctgcccagcaacgacaccgattgtccacagaaaaaagaaggaaaggcgcaaatcgtggtgcccgttacgttccgggatgtgacagtaatctttacagaagcagagtggaagcgactgtctcccgaacagcgaaatctgtacaaagaggtgatgctcgaaaattaccggaatctactgagcctttag

SEQ ID NO: 14094 - DNA, 435 bp, Artificial Sequence
  Description of Artificial Sequence: Synthetic coding sequence
atgatgctgccctacccttccgctctcggggaccagtattgggaagagatcctgttgccaaaaaatggagagaatgtggagacaatgaaaaaattgacccagaatcataaggccaaaggtctgccttctaatgacacagactgcccacagaaaaaagagggtaaggctcagattgtggtgccagtcactttcagggatgtgactgttatcttcacggaagccgaatggaaaaggcttagcccagagcaacggaacctgtataaagaggtaatgttagaaaattaccgtaacctactgtcgctcgccgagccgaagcccgagatttatacatgttcttcatgcctgctggcattttcctgccaacagttcctgtcgcaacacgtcctgcagatattcctgggactgtgcgctgagaaccacttccatccaggatag

SEQ ID NO: 14095 - DNA, 342 bp, Artificial Sequence
  Description of Artificial Sequence: Synthetic coding sequence
atggagaatttaacgaaacattcaatagagtgctccagctttcgcggcgactgggaatgtaagaatcagttcgagagaaagcagggaagtcaggagggccacttttcagaaatgatcttcacgcccgaggacatgcccaccttctctatccagcatcagcgcattcacactgacgaaaaactgctggaatgcaaagaatgtggcaaagatttctcctttgttagtgtgctggtacggcaccagcggatacacacgggggaaaagccttatgaatgcaaggaatgcggaaaagcgttcggctcaggcgctaatctcgcctatcaccagcgtattcacacctag

SEQ ID NO: 14096 - DNA, 759 bp, Artificial Sequence
  Description of Artificial Sequence: Synthetic coding sequence
atggccttcagtagcggttcagctctgaccaggcatcaacgaatccatacaggggaaaaaccgtatatctgcaatgagtgcggaaaagcattttcttttggatccgccctcacaaggcaccagcgaattcacactggagaaaagccatatgtgtgcaaagagtgcggtaaagcatttaacagcggcagcgatctaacccagcaccagaggattcacactggcgagaaaccatatgagtgtaaggaatgtgaaaaggcatttcgatcggggtcaaagctgattcagcaccagagaatgcataccggcgagaagccttacgagtgtaaagagtgtggaaagacatttagttccggttcagacctgacgcaacaccatcggatccacacaggggagaaaccctacgaatgcaaggagtgtgggaaagcattcggctccggaagtaagcttatacagcatcagctgattcacacgggtgaacggccatatgagtgcaaggagtgtggcaagtctttttcgtctggaagtgcactgaacaggcaccaacgcattcacactggcgagaagccttacgaatgcaaggagtgcggaaaagcgttctacagtggatcatccctcactcagcatcagaggattcatactggggagaagctgtatgagtgcaagaattgcggcaaagcatatggtagggatagcgaattccaacaacacaaaaagagccacaacggcaagaaactgtgcgagcttgagaccatcaattag

SEQ ID NO: 14097 - DNA, 1467 bp, Artificial Sequence
  Description of Artificial Sequence: Synthetic coding sequence
atggagaacttgaccaagcactcaatcgagtgcagttcttttagaggagattgggaatgcaagaaccaattcgaacggaaacagggatcacaggaagggcacttttctgaaatgatttttacccccgaggacatgcctacattttctattcagcatcagcggatccacaccgatgaaaagctgctagaatgtaaagagtgtggaaaggatttctcctttgtaagcgtactcgtcagacatcagcgcattcatactggggagaaaccctatgaatgcaaagagtgtgggaaggcttttggtagcggggccaatctggcctaccatcagcgaattcacactggagaaaaacccttcgaatgcaaagagtgtggaaaagcttttgggtccggatctaatttaacacatcaccagaggatccacacaggagagaaaccatatgagtgtaaagagtgcggtaaagccttttcgtttggcagcgggctcattcgccaccagattatccattccggagagaaaccatatgaatgcaaagagtgcggaaagtccttctcttttgagtccgcattaattcgccaccaccggatccacacaggggaaaagccatacgagtgcattgactgcggcaaggccttcggtagtgggtctaatctcacacagcaccggaggatacacactggcgagaagccttacgaatgcaaggcatgcggtatggcgtttagcagcggatcagcactgacccgacatcagagaatccacaccggcgagaagccctatatctgtaatgaatgcgggaaagcgttctcctttggatccgcgctgacaagacaccagagaattcataccggcgagaagccttatgtgtgtaaggaatgcggcaaggcatttaattccggcagtgacctcacgcagcaccagcgtattcataccggagaaaaaccatatgagtgcaaagaatgcgagaaagcctttagaagtggttctaaacttatccagcaccagcgcatgcatactggcgaaaagccgtatgagtgcaaagagtgcggaaagacattcagtagtggttcagacctgactcaacaccaccgcattcacacaggtgaaaagccctacgagtgcaaggagtgcggtaaggctttcggttctggcagcaagttgatccaacatcagttgatccacacgggtgagcgcccttacgaatgtaaggaatgcgggaaatccttctcttctgggagcgccctcaaccggcaccagcgcattcacaccggggaaaagccgtatgaatgcaaagagtgtggaaaagcattctactcagggtcctccctgacccagcaccaacggatacatactggtgaaaagctttacgaatgtaagaattgtggcaaggcgtacggaagagactcagagttccagcaacacaaaaagagtcacaacggaaaaaaattatgcgaacttgagacaataaattag

SEQ ID NO: 14098 - DNA, 1467 bp, Artificial Sequence
  Description of Artificial Sequence: Synthetic coding sequence
atggaaaacctgacgaagcactcaattgaatgcagcagttttagaggtgattgggagtgcaaaaatcagttcgagcgtaagcaaggtagtcaggagggccacttttcggaaatgatcttcacacccgaagacatgccgaccttctcaattcagcaccagcgcattcacactgacgaaaagttattagagtgcaaggagtgtggtaaggactttagcttcgtgtcagtgcttgtaagacaccaaaggatccatactggagaaaagccatatgaatgtaaagagtgtggcaaggccttcggaagcggcgccaatctggcttatcaccagcgcatccacaccggcgagaagccttttgaatgcaaggagtgcgggaaggccttcggttcgggcagcaacttgactcaccatcagaggatccatacgggggagaagccatacgagtgtaaggagtgtggcaaagcattctcctttgggtccgggttgatcaggcaccagattatccattccggtgaaaagccttatgagtgcaaagaatgtggaaagagtttttccttcgaaagtgcactgattcggcaccacaggatccacacaggcgagaagccttacgaatgcattgactgcggtaaagctttcggctcgggctcgaacctcacccagcatcggagaattcacacaggcgaaaaaccctacgagtgtaaggcatgtggcatggcctttagctccgggagcgccttaacccgccaccagaggatacacaccggcgagaaaccatatatctgcaacgaatgcggcaaggccttttctttcgggtccgcgttgacaaggcaccagcggattcataccggagaaaaaccatacgtatgcaaggagtgtggtaaagcttttaactcaggttcagatctgacgcagcaccagcgcatacacactggtgaaaaaccttatgagtgcaaggaatgcgaaaaggcctttcggtcgggctctaaactgatccagcatcagcgcatgcacactggcgagaagccctatgaatgcaaagaatgtggcaagacgttctcaagtggaagcgacctcactcagcatcatcgaatccacaccggcgagaagccctatgagtgcaaggagtgtgggaaagccttcggctccgggagcaagcttatccagcatcaactgattcacacaggtgagaggccatatgagtgcaaggagtgtggtaaatccttcagtagcggaagtgctttgaatcgacaccagaggatccacactggcgaaaagccttacgaatgcaaagagtgcggcaaagcattctattctggcagcagccttacgcagcaccagcgaattcacaccggagagaagctctatgagtgcaaaaactgtgggaaggcttacgggcgcgatagcgaattccagcaacacaagaaatcacacaatggtaagaagctatgcgagctggagaccataaactag

SEQ ID NO: 14099 - DNA, 228 bp, Artificial Sequence
  Description of Artificial Sequence: Synthetic coding sequence
atggagaacctaaccaagcactccatagagtgcagcagcttccgtggagactgggagtgtaaaaatcagttcgagaggaaacaagggagccaggaaggacacttctcagaaatgatcttcactcccgaggacatgccaaccttttctatccagcatcaaagaatccatactgacgaaaaactccttgaatgcaaagaatgcggaaaagactttagctttgtctcctag

SEQ ID NO: 14100 - DNA, 1467 bp, Artificial Sequence
  Description of Artificial Sequence: Synthetic coding sequence
atggaaaatctgacaaaacactctatcgagtgcagctcatttcggggcgattgggaatgtaagaaccaatttgagcggaagcaaggatcccaggagggccatttctcagaaatgatcttcacacccgaggacatgccgacattttctattcagcatcagcgtattcacaccgacgaaaagctcctggagtgcaaagagtgcggcaaggacttttcattcgtcagtgtcctcgtccgtcaccagcgcatccacaccggcgagaagccctatgagtgcaaggagtgcgggaaagcattcggatccggcgccaatctggcttatcatcagaggattcacacaggcgagaagcccttcgagtgcaaagagtgcgggaaggcattcggcagtgggtctaatctgactcaccatcagaggattcatacgggggaaaagccgtatgaatgcaaggagtgcggcaaagccttttctttcggatcaggcctcatcagacaccaaatcatccattctggagagaaaccctatgaatgcaaggaatgtggcaagtccttcagcttcgagtccgccttgattcgccaccaccgaatacacacgggggagaagccttatgaatgtatcgattgcggcaaggccttcggcagcgggtcaaacctcacacagcaccggcgaatccacacaggcgaaaaaccttacgagtgcaaggcatgtgggatggcattctcctccggctccgccctgaccagacaccaaaggattcacaccggcgaaaaaccatacatatgcaatgaatgtgggaaagctttcagctttgggtccgctctgacgcggcatcaaaggatccatacaggtgaaaaaccttacgtgtgcaaagagtgtgggaaggctttcaacagcggctccgacctgacgcagcatcaacgtatccacactggcgagaagccctatgagtgcaaggagtgtgaaaaagcctttagatcagggtccaagttaatccaacaccagaggatgcacaccggagaaaaaccttatgagtgcaaagaatgtgggaagacattcagcagcggatcggaccttacccaacaccatcgtatccacaccggagaaaagccttacgagtgcaaagagtgtggtaaggcctttggcagtgggtctaagctcatacaacatcaactcattcacactggtgaacgcccctatgagtgcaaggaatgtggaaagtccttttcatccggctccgccctgaatagacatcagcggatccacaccggagagaaaccctatgagtgtaaggaatgcggaaaggccttctatagcggcagctcccttactcagcatcagaggatccatacaggggaaaaattatatgagtgtaagaactgcggcaaggcctacggtagggactcagaattccaacaacacaaaaagtctcataacgggaaaaagctgtgtgagcttgaaactataaattag

SEQ ID NO: 14101 - DNA, 960 bp, Artificial Sequence
  Description of Artificial Sequence: Synthetic coding sequence
atggaatatccagcgcccgctacggtgcaggcagccgatggcggcgccgcaggtccgtactcttccagtgagttgctcgaaggtcaggagccagacggggtgagatttgatagagaaagggccaggaggctttgggaagcggtgtctggggcacaacccgtcgggcgggaggaggcccagttttttccacacagccgaacagtaattccgatcctggtgctctcagaaacctactccttatgtcaccctgtggagcacatgattcagaaaaatcagtgcctgttcacaaacacgcagtgtaaagtctgttgcgcccttctcatatctgagtctcaaaagctcgcgcactaccagtctaagaagcacgcaaataaggttaagagatacctcgcaatacacggcatggaaacccttaaaggggaaactaagaaattggattccgaccagaaatcctctcggagcaaagacaaaaaccaatgctgccccatttgtaacatgaccttcagctcacccgtggtagcgcagtcccattaccttgggaagacacacgccaagaacctaaagctgaaacagcagtctaccaaggtggaagctttacaccagaaccgggaaatgatcgatcccgataagttctgctccctgtgtcatgccaccttcaacgatcccgtgatggctcagcagcactatgtaggcaaaaaacaccgtaaacaggaaacaaaactgaaactcatggctaggtacggtcggctggcagatcccgctgtcacggacttcccagccggaaaaggctatccatgcaaaacttgcaaaattgtcttgaactctatagaacagtatcaggcccacgtctcaggttttaagcacaagaatcagtcccccaaaaccgtggccagctccctcggccagatcccaatgcaacgtcagcccatccagaaggacagcacgacactcgaggactag

SEQ ID NO: 14102 - DNA, 885 bp, Artificial Sequence
  Description of Artificial Sequence: Synthetic coding sequence
atggagtatcctgcccctgcaacagttcaggctgcagatggcggcgcagccgggccatactccagctctgagttactggaaggtcaggagccagacggggtacggtttgatagagagagggcccgccgcctctgggaggctgtgtcaggcgctcagcccgtgggccgggaagaggtagagcacatgattcagaaaaatcagtgcctcttcaccaacacgcagtgcaaggtctgctgtgcacttcttatttccgagagtcaaaaactggctcactatcagtctaagaagcacgccaataaggtaaaaagatatctcgcaatccacggcatggaaacccttaagggggaaaccaagaaactcgatagcgatcagaaaagctctagatccaaggacaaaaaccagtgttgccctatctgtaacatgacttttagcagcccagtggtggcccagagccattacctaggtaaaacgcacgcaaagaatctgaaattaaagcagcagagcaccaaggttgaggctctccatcaaaaccgggaaatgatagatccggacaaattctgttccctgtgtcacgctacttttaatgatccagtgatggcccagcagcattatgtggggaaaaaacacaggaaacaggagaccaagctgaagctcatggcgagatacggaagacttgccgatccggctgtgacagactttccagccgggaaggggtatccatgcaaaacgtgtaagatagtgctcaattcaattgaacagtaccaggctcacgtctctggctttaagcacaaaaatcaatccccaaagacagtcgcatcatcactggggcagataccaatgcagagacagcccatccagaaagacagcaccaccctcgaggactag

SEQ ID NO: 14103 - DNA, 960 bp, Artificial Sequence
  Description of Artificial Sequence: Synthetic coding sequence
atggaatatcccgcacccgctacagtacaagctgccgacggcggtgcagccggtccttacagctcttcagaacttcttgaaggccaagaacccgacggcgtgcggtttgatcgggaacgagcaaggagactctgggaagcagtatctggggcacagccggtcggacgcgaggaggctcagttttttccgcactccaggaccgtgattcctatcctagtgttgagtgagacctactctctttgtcatcccgtggaacacatgatccaaaaaaatcagtgcttattcacaaacacgcagtgtaaagtgtgttgcgcccttcttatctccgagagccagaaactggcccactatcagtccaaaaagcatgctaacaaggttaaaaggtacctggccattcatggcatggagaccttaaagggcgagaccaagaaattggactccgatcagaagtcaagtaggtcgaaggataagaaccagtgctgccctatttgcaatatgactttctctagcccggtggtggcgcaatctcactatcttgggaagacacacgctaagaatctcaagctgaaacaacaatctaccaaagtggaagccctgcaccagaatcgagaaatgatcgatcctgacaaattttgttccctgtgtcatgcaaccttcaatgaccccgttatggctcaacagcactatgtggggaaaaaacaccggaaacaggagacaaagctcaagctgatggcaaggtatggcaggctggcagatcctgccgtgacggactttcctgccggtaaaggctacccgtgtaaaacctgcaagatcgtgttaaatagtatcgaacagtaccaagcccatgtttcgggttttaagcacaaaaatcagtctcctaaaaccgtggcttctagcctgggacagattcccatgcagcgccaacccatccagaaggactccaccaccttggaggactag

SEQ ID NO: 14104 - DNA, 789 bp, Artificial Sequence
  Description of Artificial Sequence: Synthetic coding sequence
atggaataccctgctcccgccacagttcaggctgcggacggaggagctgccgggccatactcttccagcgagcttctcgaggggcaggaacccgacggagtgcgttttgaccgggaacgggccagaagactctgggaggccgtgagtggcgcacagccagtgggtagagaggaggtcgaacatatgatacaaaagaaccagtgcctgtttactaatacacaatgcaaggtctgttgtgcacttttgatttccgagagtcaaaagttggcccattatcaaagcagtcgctctaaggacaagaaccaatgttgcccaatttgcaatatgacgttctccagcccagtcgtcgcacagtcacattacctgggcaagacacatgcaaagaacctgaagctcaagcaacagtccactaaggtggaagcgctgcaccagaatagagagatgattgacccggacaagttttgctctctgtgtcatgccacttttaacgacccagtcatggcccaacagcactacgtcggaaagaagcatagaaagcaggaaacaaagcttaagctgatggccaggtacggacgactggccgaccccgcagtgaccgatttccccgccggcaaagggtacccgtgcaagacatgcaagatcgtgctcaattctatcgaacaatatcaggcccatgtgtccggtttcaaacataaaaatcagagcccaaagaccgtagcttcctctctgggccagattccaatgcagcgccaaccgatccaaaaggattcaaccactctagaggactag

SEQ ID NO: 14105 - DNA, 591 bp, Artificial Sequence
  Description of Artificial Sequence: Synthetic coding sequence
atggaatacccagctcctgccaccgtgcaagccgctgacggcggcgctgcggggccttacagcagctccgaattactcgagggccaggagccggacggagttcgcttcgacagagagcgtgccaggcgactctgggaagctgtcagtggagctcagcctgtggggcgggaagaggctctctccaagcgcctgacgaaccctttcctggtagctagcacactggccctccaccagaatcgtgagatgattgaccctgacaaattttgctcactgtgtcacgccacctttaatgatccggtcatggctcagcagcactacgtcggcaaaaaacataggaaacaggagacaaagttaaaattaatggctaggtacggaagactggccgaccccgccgtcaccgattttccagcaggcaaggggtatccctgcaaaacctgcaagattgttctgaatagcattgaacaataccaagcccatgtgtcaggcttcaagcacaagaaccagtcgcctaaaactgtggcctcctcactcggccagattcccatgcagcgccaacctatacagaaggacagcaccaccctggaagattag

SEQ ID NO: 14106 - DNA, 933 bp, Artificial Sequence
  Description of Artificial Sequence: Synthetic coding sequence
atggagtacccggccccagcgaccgtgcaggctgcagacggtggggcggccggtccctactcatcttccgagctcttggagggccaagagccagacggcgtccgttttgaccgcgagagggccagaaggctttgggaggcagtcagtggcgctcagccagttggcagagaggaggttgagcatatgatccagaagaaccaatgcctcttcactaatacccagtgtaaagtgtgctgtgctctcctcatctcagaatcacagaagctcgcacactaccaaagcaagaaacacgccaataaagtcaagagatatctggctatccatgggatggaaacactgaagggggagacgaagaagttagacagtgaccaaaagtccagtcgtagcaaggataagaatcagtgttgtccgatctgtaatatgacattcagtagcccggtggtcgctcagagccactacctgggaaaaacccatgcgaagaacctgaagctgaagcagcagtctaccaaggttgaggcactgtctaaacgccttaccaaccctttcttggtcgcgtcaactctcgccctgcaccagaaccgggaaatgatcgacccggacaagttctgctccctgtgtcacgccacttttaacgatcctgttatggcacaacagcactacgtgggcaaaaaacatcgaaagcaagaaactaagttaaagttgatggctcggtacggacggcttgctgacccagccgtgacggattttcctgccggcaaaggctatccttgcaagacctgcaagatcgttctgaacagcatcgagcagtatcaggctcatgtaagtggcttcaaacacaagaatcagtcccctaagaccgtagcatcttcactgggccaaattccgatgcagcgccagcccatccagaaggatagtacaacactagaggattag

SEQ ID NO: 14107 - DNA, 357 bp, Artificial Sequence
  Description of Artificial Sequence: Synthetic coding sequence
atggaataccctgcaccagccacagtccaagctgccgatggcggggcagctggaccctacagttccagcgagctgctcgaagggcaggaacccgacggcgtgaggtttgatagagaaagagccaggcggctatgggaagcagtgtccggggctcagcccgtgggccgggaagaggccggaaaaggatacccttgtaaaacctgtaagattgttctgaatagcatcgagcagtaccaggcacacgtctccggcttcaagcacaagaatcagagtcctaagactgttgcctcctccctggggcagatcccaatgcagcgtcagcctatccagaaagactcaacaactctagaggattag

SEQ ID NO: 14108 - DNA, 2520 bp, Artificial Sequence
  Description of Artificial Sequence: Synthetic coding sequence
atggcactcacccaggggcaggtcacgttcagggacgtcgcgatcgagttctcacaagaggagtggacatgtttagatcctgcccagaggaccctctacagggatgtgatgcttgagaattaccggaacttggcttcactcggcatctcctgctttgacttgtcgattattagcatgctggagcagggaaaggagcccttcacactggaatcacaggtgcagatcgctggcaatccagacgggtgggaatggataaaagccgtgataacggcgctaagttcagaattcgtcatgaaagacctgttgcataagggtaaaagtaacacgggtgaggtctttcagacagtcatgctagaacgtcaggagagtcaggatattgagggatgctcttttagagaagtccagaaaaacacccatggcctggagtaccaatgtagggacgccgaagggaattacaagggagttttactgacacaggaaggtaatctgacgcatggacgggatgagcatgataaaagggacgcccgtaataaacttattaagaatcaactgggcctttctctgcagtcacacctccctgaactccagctttttcagtatgaaggaaaaatttacgagtgtaatcaggtggagaagtcttttaataacaatagctcggtctcgccgccccagcagatgccctacaatgtgaagacacatattagtaaaaaatatctcaaagattttatctcctccctactgctgactcagggccagaaggccaacaactggggatcaccttataagagcaacggctgcgggatggtctttccccagaactcccatcttgcctcccaccagcggtcccatactaaagagaagccttacaagtgttatgaatgcggtaaggctttcagaacgcgcagcaatctgaccacccatcaggtcatccatacaggagaaaagcggtacaagtgcaatgagtgcggaaaagtcttcagccgtaactcccaattgtcacagcaccagaagatccacacaggggagaaaccctacaagtgcaatgaatgtgggaaggtgtttactcaaaattctcacttggttagacataggggtatacacacgggcgagaaaccctataaatgcaatgagtgtgggaaagcgttccgcgctagatcctccctcgctatacaccaggcaactcacagcggtgaaaaaccctataaatgtaatgaatgtggaaaggtcttcacacagaattcacatctgaccaatcattggagaatccacacaggggagaagccctataagtgcaatgaatgtggcaaagcctttggcgtgcgctcatctctggcgatacacctggtgatccataccggagagaaaccctataagtgccacgagtgcggaaaagtcttccgccggaatagtcacctcgcaagacaccagctgattcacaccggggagaagccatacaagtgcaacgagtgcgggaaggccttccgagcacactcaaatttgactacccaccaagtgatccacactggagaaaagccttataagtgcaacgaatgtgggaaggtctttacccagaattcacatttagccaatcatcagaggatacacaccggagtgaagccatatatgtgtaatgagtgtgggaaagccttctcagtgtacagctcgctgaccactcatcaggtcatccacaccggggagaagccatacaaatgcaacgagtgtggcaaggtgtttacccagaacagccacctggcccggcaccgcggcatccatacaggtgaaaagccttacaagtgtaacgaatgcggaaaagtgtttagacacaattcctacctgtcccgccatcagagaattcacaccggtgaaaaaccatacaagtacaacgaatatggaaaagcattctctgaacacagtaacctgacgacacatcaggtaatccatactggggagaagccatataaatgtaacgaatgtggcaaggtttttacacagaatagccacttagcccggcacaggcgagtgcacacagggggcaaaccttaccagtgtaatgaatgcggaaaggccttctcgcagacctccaaactagcaagacaccagcgagtgcacactggggagaagccatacgagtgtaaccagtgtggtaaggccttcagcgtccgctcgagtcttacgacccatcaggccattcacaccggcaagaagccatataagtgcaacgagtgcggtaaagtgttcactcaaaattcacacttggctaggcaccgggggattcacacaggcgagaaaccatacaagtgcaacgagtgtggcaaggctttctcccagacatccaagctggctcgtcaccagaggatacatactggagaaaaaccatacgagtgcggcaagccgttctccatatgctccagtctgaccacccaccagactattcacactggcggaaagccatacaaatgcaatgtctggaaggtgctcaagagcgaattcaagccatgtaagccctcgcagaattcctag

SEQ ID NO: 14109 - DNA, 282 bp, Artificial Sequence
  Description of Artificial Sequence: Synthetic coding sequence
agccggaattcacaactatcacagcatcagaagatccataccggggaaaagccctataagtgtaatgagtgcggaaaagttttcactcagaattcccacttggtccgccaccgaggtattcacaccggcgagaaaccctacaagtgcaacgagtgcggcaaaccattctctatttgcagctccctaacgacacaccagaccatccacacagggggaaaaccatacaaatgcaatgtgtggaaagtgttgaaaagcgagtttaagccatgcaagccatcatag

SEQ ID NO: 14110 - DNA, 2523 bp, Artificial Sequence
  Description of Artificial Sequence: Synthetic coding sequence
atggctcttacccaaggccaggtaactttcagggacgtagccatcgaattcagtcaggaggaatggacatgcctggaccccgcccagagaactctgtatagggatgtgatgctggagaattatcgaaacctagcaagccttgcaggaatctcatgttttgatctgagcattatctccatgctagagcagggcaaggaacctttcactttagagtctcaagtccagatcgcaggcaatcccgatggttgggaatggatcaaagctgtgataactgccttgtcttccgagttcgtaatgaaagatcttctccacaagggaaagtcgaataccggggaggtttttcagacggtgatgctggagcggcaggagtcccaggacattgaggggtgttctttcagggaagtacaaaagaatactcatgggctcgagtaccaatgcagggatgccgaaggcaactataagggcgtgcttcttacccaggaggggaatctaacccacggtcgcgacgaacatgacaagcgcgacgctcgaaataagctaattaaaaaccagctcggacttagccttcagagtcatctgccagaactccagctttttcagtatgaaggcaagatctatgaatgtaaccaggtggagaagtctttcaataacaactcctctgtttcccccccacagcagatgccatacaacgttaagacccacatttcaaagaaatacctcaaggactttatatcatccctactcctgactcagggccaaaaggcaaacaattggggctcaccttacaagtccaacgggtgtggcatggtgttcccacagaattctcatttggcgtctcatcagagatcccatacaaaagaaaagccttacaaatgttatgagtgtggtaaggctttcagaacccgctccaatctcaccactcatcaggtgatacacaccggggaaaagcggtacaaatgtaacgagtgcgggaaggtgttctcgagaaattcacagctctcacagcatcagaaaattcataccggcgaaaagccttataagtgtaatgagtgtggcaaggtgttcacccaaaacagccacctggtgcggcacagagggatacataccggcgaaaaaccttacaaatgtaacgaatgtggtaaggcctttcgagcaagaagcagccttgccatccatcaggcgacccacagcggtgagaagccttacaagtgcaacgagtgcggcaaggtctttacgcagaactctcatcttaccaaccactggagaattcacaccggggaaaagccctacaagtgcaacgaatgcggaaaagcattcggggttaggtctagcctcgcgatccatctggtaatccatacaggagaaaaaccttataaatgtcacgaatgcggcaaggtattcagaaggaattcacatttagcccggcatcaactcattcatactggcgaaaaaccttacaaatgcaacgaatgcggcaaagcattccgcgcacatagtaacctgacaacccatcaggtcatccacaccggtgagaagccctacaaatgcaacgagtgcggcaaggtcttcacccagaacagccacctcgccaaccaccagaggatccataccggtgtaaagccctacatgtgcaacgagtgtggcaaggctttttcagtgtactccagcctcaccacccaccaggtgattcataccggagagaaaccctataagtgtaacgagtgtggaaaggtgtttacgcaaaacagccatttggcgcgacacagaggtatacacacaggagagaaaccatataaatgcaatgaatgtgggaaggtcttccgccataactcctacctgtctcgccaccagaggatccacacgggggagaagccctataaatacaacgaatatgggaaggccttctccgagcactccaatctaacaacacaccaagtgattcacacgggagagaaaccttacaaatgtaacgagtgcggcaaggtcttcacccaaaacagtcatcttgcccgacaccgcagggtgcatacaggcggcaaaccatatcagtgtaacgaatgcggcaaagcttttagccagacgtctaagctggctcggcaccagagagtgcataccggggaaaagccttacgagtgtaatcaatgcggcaaagcattctccgtgcggtcatctctgacaacacaccaagctatacatacaggcaaaaagccatacaaatgtaatgagtgcggcaaggtgtttacacaaaactcacatttggcacgccacaggggcatccacacgggcgagaagccttacaagtgcaatgagtgtggaaaagctttttcacaaacgtcaaaactggctagacaccagcgcatccacaccggcgagaagccttatgaatgcggcaaaccattcagcatttgttcatccctaaccacccatcagacaattcatacgggcggaaagccttacaaatgtaacgtctggaaggtgctgaaatctgagttcaaaccatgcaaaccgagccagaattcttag

SEQ ID NO: 14111 - DNA, 1599 bp, Artificial Sequence
  Description of Artificial Sequence: Synthetic coding sequence
atgattcaggcccaagagtcaattacgttggaagatgtggcagtggattttacatgggaggagtggcaactgttgggcgcagcacagaaagacctctatagggacgtaatgctcgaaaactatagtaacctggtagccgtcgggtaccaagctagcaaacccgatgcgctcttcaagctggaacagggcgagcaactttggaccatagaggacggaattcacagcggcgcctgctccgacatctggaaggtggatcatgttcttgagcgccttcagtcagaatctctggtgaatagaagaaagccttgccatgagcatgatgctttcgagaatattgtgcactgtagtaagtctcagtttctgttaggccagaaccatgacatcttcgatcttcgtggtaagagtttaaagtctaacctgacccttgttaatcagtcaaaaggttacgagattaagaattccgtggagttcacaggaaatggtgactcatttctccacgccaatcacgaaagattgcatacagccattaaattccccgccagccagaaactcatatctacaaaaagccaattcatcagccctaagcatcaaaaaacccggaaactggaaaaacaccacgtatgtagcgagtgtggcaaagcatttattaagaagagttggctgacggatcatcaggtgatgcacacaggcgaaaaaccacaccggtgctcactgtgcgagaaagcctttagccggaaattcatgttgaccgaacaccaacgaactcatacgggagaaaagccgtatgagtgcccagagtgcgggaaagctttcttgaagaaaagccgcctaaatatacatcaaaagacccacacgggcgagaagccctacatctgcagtgagtgcgggaagggatttattcagaaaggtaacctgattgtgcatcagcggattcacaccggcgagaaaccctatatatgtaatgaatgtggaaagggcttcatacagaaaacttgcctgatcgcgcaccagaggttccacacagggaagaccccatttgtttgtagcgaatgtggaaagtcatgctcacagaaatcagggctaataaaacaccagcgcatccacaccggtgagaagccattcgagtgtagcgaatgtggtaaggccttttcaactaagcaaaaactgatcgtccaccagcggacacacactggagaacgcccttatggttgtaatgaatgtgggaaagcattcgcatacatgtcgtgcttggtaaagcataagaggatccacacacgagagaagcaggaggccgctaaggtggagaacccccctgccgagcggcacagttctctgcatacctcagatgtgatgcaggagaaaaacagtgctaatggcgctacgacccaggtgcctagcgttgccccccaaacgtccctgaacatttcaggcctgctcgctaatcggaacgtggtgctggtgggtcaacccgtggtcaggtgtgccgcctctggcgacaacaggggtttcgcacaggaccgcaacttggttaacgcggtgaacgtggttgtaccatccgtgatcaactatgttcttttttacgtgaccgagaatccgtag

SEQ ID NO: 14112 - DNA, 1818 bp, Artificial Sequence
  Description of Artificial Sequence: Synthetic coding sequence
atggctgccggccagcgggaagcccgcccacaggtgagcctcacatttgaggacgtggcagtgctgttcacacgagacgagtggcgaaaactggccccgagtcaacgcaacttgtatcgcgacgttatgctagaaaattaccgaaacctagtgtctcttgggcttccatttaccaaacccaaggttattagcttactgcagcagggagaggacccttgggaggtggagaaggacggctctggtgtgagttctctgggttctaagtcgtctcataaaaccacgaagtctacacagacacaggacagcagtttccaaggactaattcttaagaggtctaatagaaacgtgccctgggatctaaaattggagaagccttatatttatgagggccggttagagaaaaagcaagataagaaaggatcctttcaaatcgttagtgcgactcacaagaagatcccaaccattgaaaggtcgcacaaaaataccgagctgagtcagaattttagcccaaaatctgttctcatacgtcaacagattctcccccgtgaaaagacgcccccaaagtgtgaaattcagggaaatagtctgaagcagaacagtcaactattgaaccaaccaaagatcactgctgacaaacgttacaagtgtagcctgtgcgaaaaaacctttattaatactagctcactccggaaacacgagaaaaatcattcgggagagaagctcttcaaatgtaaagaatgcagtaaggcctttagtcagtccagcgcattgatccaacatcagatcactcacacaggcgaaaagccctacatatgtaaagaatgcgggaaggcctttaccctctcaactagtctgtacaagcatcttaggacccacacggtcgaaaagagttatcgctgcaaagagtgcggcaaatctttttcaagaaggagcggcctgttcattcaccagaagattcacgccgaagaaaacccttgcaagtataacccggggcgaaaggcaagctcgtgcagtacttctttaagcggctgccagagaatacattccagaaagaagtcttacctctgcaacgagtgtgggaacaccttcaaatcctccagtagcctgagatatcatcagcggatacacaccggggagaagccatttaaatgttcagagtgtggacgcgcattcagtcagagcgcttctctaattcagcatgagcgaatccatactggggagaagccctacagatgtaacgagtgtggaaagggtttcactagcatatccagactaaaccgtcataggataatccacactggcgaaaaattctacaactgcaacgagtgtgggaaggccctatcatcccattccaccctgatcatccatgagcggatacataccggcgagaagccgtgcaagtgcaaagtgtgcggtaaggcattccgacagtcatctgcactgattcaacaccaacgcatgcataccggcgagcgtccttacaagtgcaacgagtgcggaaaaacatttcgatgtaactccagcctgagcaaccatcagcgcattcacacaggcgagaaaccttacagatgcgaagaatgtggcatttctttcggtcagtcatctgcattaattcagcaccggaggattcataccggtgagaagccctttaaatgcaatacctgcgggaagacgttccggcaatcatcttctcgaatagctcatcagcggatccatacaggtgaaaaaccatacgaatgcaatacgtgtggcaaactgttcaatcacaggtcaagtctgactaatcactacaaaattcatatcgaagaagacccctag

SEQ ID NO: 14113 - DNA, 408 bp, Artificial Sequence
  Description of Artificial Sequence: Synthetic coding sequence
atggctgcgggccagcgggaagcgcgaccgcaggtgtcactgaccttcgaagatgtggcagtgttattcacccgagatgagtggaggaagctggcccccagccagcggaatctctacagggatgtcatgctggagaattacaggaatctggtctccctgggactgcccttcacaaagcctaaagtcatttcactactgcagcaaggggaagatccttgggaggtcgaaaaagacggatctggagtatcttcccttgggagtaaatcttcacacaaaactacgaaatctacccagacacaggactcaagtttccagggcttaatcctgaaaaggtcgaacaggaacgtgccctgggatttgaagctggaaaagccctacatctacgaagggcgcctggaaaagaagtag

SEQ ID NO: 14114 - DNA, 1839 bp, Artificial Sequence
  Description of Artificial Sequence: Synthetic coding sequence
atggccgccggccagagggaagcacgcccacaggtctccctcacatttgaggatgtagctgttttgttcacatgggacgaatggcgcaagttggccccatctcagcgaaatctgtacagagatgtgatgctcgagaactataggaatctagtcagcctggggctgagtttcaccaagcctaaggttataagcctcctgcagcagggggaagatccctgggaggtcgaaaaagactcgtccggggtctccagcctgggctgcaagagcacccccaagatgacaaagtcaacccagactcaagattccttccaagagcagattcgaaaacgactgaagagagacgagccttggaactttatctctgagaggagctgcatatacgaagagaagctcaaaaaacagcaggacaagaatgagaatcttcagatcatctccgtggcccacaccaaaatcttgactgtggatcgttcccacaaaaatgtggagttcgggcagaacttttaccttaagtctgtcttcatcaaacaacagcggttcgctaaggaaaagaccccatccaaatgtgaaatacagcgcaactcctttaagcagaactctaacctcctaaaccagtccaagattaaaactgccgagaagaggtataagtgttccacatgtgaaaaggcattcatccataactccagcctgaggaagcatcagaaaaatcacaccggcgagaaactattcaaatgtaaagagtgtctgaaggctttttcccagtcgtcagccctgatccagcaccagagaactcatactggcgagaagccctatatttgcaaggaatgtggaaaggctttctctcactccgcaagcttgtgtaaacatctgcgaacacacactgtcgaaaagtgttacaggtgtaaggaatgtggcaagtcttttagccggaggtcaggactcttcatccaccagaagatccatgcacaggagaacccacacaaatacaacccaggacgcaaggcttcctcctattcaacttccctgtctggaagccagaagattcatcttaggaagaagtcctatctgtgtaatgaatgtgggaatacctttaaaagcagcagttcactgcgctaccatcagcgcatccataccggggaaaaacccttcaagtgctcagagtgcggtcgggccttctcgcaaagtgcatccctgatccagcacgagaggatccacaccggtgaaaagccatacagatgtaacgaatgcggaaagggattcactagtattagccggctcaaccggcatagaatcatccacaccggagaaaagctttataactgcaatgagtgcggaaaggctctctccagccactccactctgatcatccacgaacgcatccatacaggtgagaaaccatgtaagtgtaaagtttgcggtaaagccttccgccaaagctctgcacttattcaacaccagaggatgcacactggagagcgtccttacaaatgtaatgagtgtgacaagacctttcgctgcaatagctcactcagcaatcatcaaaggatacacactggcgaaaaaccttatcggtgcctcgagtgcgggatgagctttggtcaatccgcagcccttattcagcaccagagaattcataccggcgaaaaaccattcaaatgtaacacatgcggaaaaacgtttcggcagtcctcctccctcatcgctcaccagagaatccataccggggagaagccatatgagtgcaacgcttgtgggaaactcttcagtcagaggtcatcgctcactaaccattacaaaatccatattgaagaggattccctcaaggctgatctacacgtttag

SEQ ID NO: 14115 - DNA, 405 bp, Artificial Sequence
  Description of Artificial Sequence: Synthetic coding sequence
atggctgccgggcagagagaagcccgccctcaggtctccctgactttcgaagatgtggcggtgctgtttacttgggacgagtggcggaagcttgccccttcccagcgcaatctctatcgagacgtcatgcttgagaattacaggaacctggtgtccctgggattgagctttactaaaccaaaggtgattagcttgcttcagcagggcgaagacccttgggaggtcgagaaagactcttctggcgttagtagtctgggctgcaaatcaacccccaagatgacaaagagcactcagacccaggactccttccaggagcagatcaggaagcggctcaaacgcgacgagccatggaattttatttcggagcgatcctgtatttacgaggaaaaattgaagaaacagtag

SEQ ID NO: 14116 - DNA, 1665 bp, Artificial Sequence
  Description of Artificial Sequence: Synthetic coding sequence
atggcggtcgacctgctgagcgcccaggagccggtgaccttcagagacgtggcagtcttcttctctcaagatgagtggctccatctggacagcgcccagcgcgccctttaccgagaggtgatgctggaaaattacagcagcctcgtatctttaggaataccctttagtatgccaaaacttatccaccagctgcagcaaggggaagatccatgcatggttgagagagaagtgccaagcgatacaagattggggtttaaaacctggctagagaccgaagccctgccacatagacaagatatttttattgaggagacctcccaaggaatggtgaagaaagagagtatcaaggatggccactgggacatcaactttgaggaggcggtagaatttgaatccgagatcgaagaggaacaagaaaaaaaacccctgaggcagatgatcgattcacacgagaaaacaatcagcgaggatggcaatcacacttcgctcgagctcggcaaatctctgttcaccaataccgccctggttacacagcagagcgttcctatcgagagaatcccaaacatgtactacacatttgggaaagacttcaaacagaactttgatctgatgaaatgtttccaaatttacccagggggaaaacctcacatatgtaacgaatgcgggaaatcattcaagcagaaccttcatctcattgagcaccagagaattcacaccggcgaaaagccatacaagtgtaacgagtgcgagaagacattctcccaccggagttctttgctgtctcaccaaagaattcacactggggaaaagccttataaatgtaacgagtgtgagaaggccttctctaactcctctactttgatcaaacatctcagagtgcacacaggggagaaaccctatagatgcagagagtgcggcaaagcgttttctcagtgctcaacgctgacagttcaccagagaattcacactggtgagaaactgtacaagtgcggagagtgtgaaaaggcgtttaactgtcgcgcgaaactgcaccgtcaccagcggattcacaccggcgagaagccttataaatgttctgagtgtggcaaaggttatagtcagtttacctcactggcagagcaccagagattccatacaggcgagcagttatacacttgcctggagtgtgggcgaacattcacacgcatcgtcactctgattgagcaccagcgcatacacaccggacagaagccgtatcagtgcaatgaatgtgaaaaagccttcaatcagtattcctccttcaatgagcacaggaaaattcataccggcgagaaattgtacacctgtgaggagtgcgggaaggcctttggttgcaagtccaatctgtaccgccaccagcgtatccatactggcgaaaagccatatcagtgcaaccagtgcggaaaggcctttagtcagtactcattcttgaccgaacatgagcgaatacatactggcgaaaagctgtataaatgcatggaatgcgggaaagcatacagctaccgctccaacctgtgtcgacataaaaaggtgcacaccaaagagaagctgtataaatggaaagagtacggaaaaccttttatttgctccagcagcttgactcagtatcagcgcttttttaagggtgacaaggcttacgaagtgtag

SEQ ID NO: 14117 - DNA, 1707 bp, Artificial Sequence
  Description of Artificial Sequence: Synthetic coding sequence
atgagacgatctgttctggttcggaaccccggacataagggtctgcgaccggtgtacgaagagctcgactccgactccgaggatctggaccctaacccagaagaccttgaccccgtgtcggaagatccggagcctgaccctgaagatctaaatacagtgccagaggatgtagatccaagctatgaggaccttgagcccgtgtccgaagatttggaccccgatgccgaggctcctggctccgagccccaggacccagatcctatgtcatctagttttgacctggatccggatgtgatcggccccgtccctctgatccttgacccaaatagtgatacattatctcccggcgaccccaaggtggatcccatcagcagtgggctgacggctacaccacaggtcctggctacgtccccagcggtgctgcctgcccccgcatctccaccccgcccattcagctgcccagattgcggccgagcgttcaggagatcttccggcttatctcaacaccggcggacccactccggagaaaagccatacagatgccccgactgtggaaaatccttttctcatggcgccacccttgctcagcaccgcggcatccataccggtgctcgaccttaccagtgcgctgcatgtggaaaggcgtttggctggcggtcaacgcttctgaaacatcgttcttcacactctggcgagaagcctcaccattgccccgtgtgcggtaaagcttttggacatggcagtctgctcgcacagcacttacgcactcacgggggtccccgaccccataaatgtcctgtttgtgccaaaggctttggacagggatctgcgcttttgaaacatctccgtacacacacaggagagaggccctacccttgtccccagtgtggcaaggccttcgggcagagcagcgcactgttacagcaccagaggacacataccgccgagcgaccatacagatgtccacattgcggcaaggcttttgggcagtcaagcaacctgcagcaccaccttaggatccataccggcgagaggccttacgcatgtcctcactgctccaaggcgttcgggcagagctctgccctgctgcaacatctacacgtgcattccggcgaacggccttacagatgtcaactctgtggcaaggcattcggccaggcttcctcattgaccaagcataagagagtccacgagggggccgcagctgccgccgccgctgccgcagccgccgccgccgctgctgccgctggtttaggtctcgggcccggactgtcacccgccagtatgatgcggccgggacaagtctctctcctcggccctgatgccgtgagcgtgctcgggtctggcctaggattgtctcccggcacaagcagtgggcgaaatcccgacccaggtagcgggcctggcacactacctgacccatcttctaagccccttccagggtcacgttcaacgccatcgccgacaccagtcgaatcctccgatcctaaagccggccatgatgcaggccccgacctcgttccctcacccgacctggatccggtcccatctcccgatccagatcctgtacccagtcccgacccaaaccccgtctcgtgtccggatccctgttcgccaacgaggggcacagtatccccagcacttccaaccggtgaatcgcccgagtgggtgcaagaacagggggccctactcggacctgatgggtag

SEQ ID NO: 14118 - DNA, 1707 bp, Artificial Sequence
  Description of Artificial Sequence: Synthetic coding sequence
atgaggagatccgtgttggtacggaaccctggccataagggattgaggccagtatacgaagagcttgatagtgacagcgaggacttggaccccaaccccgaggatctggatccagtctcggaggatcctgaaccagatccagaggatctgaacaccgtgcctgaagatgtagacccaagctacgaggatctggagcccgtgagcgaggacttagaccccgatgcagaggcacccggatcggagccacaggatccagatccgatgagctcgtcgtttgatcttgatcctgacgttattggtcccgttccactaatcctggaccctaactccgacactctttcacccggggaccctaaagtggaccctataagctctgggctgacagctacaccccaggtgttggcaacttcccctgccgtactccctgcaccggcctctccgccacgccccttttcgtgtcccgactgcggcagagcttttcggcggtccagcggtctgagccagcacaggagaacgcattctggtgaaaaaccttaccggtgtcccgattgtgggaaatccttttcacacggcgccacactggcccagcataggggtatccatacaggggcgcgaccctaccaatgtgccgcatgcggtaaagcgtttggctggcggagcacactcttaaagcatcgctcatcgcacagcggagagaaacctcaccattgtcctgtctgcggcaaagcctttggtcacggctcgttgttagcccaacaccttcggacacacggggggccacgacctcataagtgccccgtttgcgccaagggatttggacagggcagtgctttgctcaaacacctgcgtactcacaccggtgagcggccgtacccttgtccccagtgcggcaaggcatttggacaaagttcggccttgctgcagcaccagaggacacacacagctgagagaccctataggtgcccccactgtggaaaagctttcggtcagagttccaatcttcagcaccacctgcgcattcatactggagagaggccctacgcctgcccccattgtagcaaagcctttggccaatcatctgctttgttacagcatctccatgtccacagtggcgagcgtccttatcggtgtcagttatgcggtaaagccttcggacaggcgtcctctctcacaaaacacaaacgtgtgcacgagggagccgcagcggcagccgcagcagctgcagcagccgcagcggccgccgcagccggcctgggcttaggcccggggctgagcccagcttccatgatgcgcccaggccaggtgagtctgctcggtcctgatgctgtgtcggttcttggctcagggcttgggttgtctccaggaacatccagcggaagaaatcccgatcctggcagtgggcccggcaccctccctgacccatcatcgaagcctctgcctggatctcgcagtacgccttcccctacaccagttgagtctagtgatcccaaggccggccatgacgccggccccgacctggtgccgtcaccagacctggacccggtcccttctccggaccccgaccccgttcccagtccagaccccaaccctgtaagttgtcctgacccttgttctcccacacgtggtacagtttctccagccctgcccactggagaaagccccgaatgggttcaggagcagggtgctctgctgggtcccgatggctag

SEQ ID NO: 14119 - DNA, 1707 bp, Artificial Sequence
  Description of Artificial Sequence: Synthetic coding sequence
atgcgtcgctctgtgcttgtgaggaacccgggtcataaaggcctgcggccagtttacgaagagctggactccgatagtgaagacctcgaccccaatccagaggacctagatccagtgagtgaggatcccgagcctgatcccgaagacctgaataccgtccccgaagatgtcgacccctcatacgaggatcttgaaccggtgtccgaagacttggatcccgacgccgaagcacctggcagcgaaccgcaggatccagaccctatgagctctagcttcgacctcgatccggatgtgatcggccctgtcccacttattttggatccaaattctgatacactctcaccaggtgacccaaaagtagaccctatctcttctggtttgaccgcgacacctcaagtcctggcgactagtcccgctgtgctaccagcacccgcttcaccgcccaggccgttctcctgcccggactgtgggagagctttcagaagaagcagtggcttgtctcagcatcgccgcacacattcgggggagaagccatacagatgcccagattgtggaaaaagttttagccatggcgccaccctggcacaacacagagggattcacacaggcgcccggccttaccagtgcgcagcatgcggcaaagctttcgggtggcgctccactttactgaagcatcgctcatcccatagcggggaaaagccccaccactgtcctgtatgcggcaaggccttcggccatggttctcttctagcgcagcacctgaggactcacggagggccccgcccgcacaagtgccccgtgtgcgctaaggggttcggacagggatcggccctgttaaagcacctgcgcacacataccggagaaaggccctatccctgcccccagtgcggaaaggcgttcggtcagtctagcgctctgctgcagcaccagcggactcacacagcggagcgcccctaccgctgtccccactgtggcaaggcgtttggccagtcctcgaatttgcagcaccacctccggattcatactggcgaaagaccctatgcctgccctcactgctcaaaggcctttggtcagtccagcgccctgctgcagcatttacacgtgcacagtggcgagagaccatataggtgccagctctgtggaaaggcattcgggcaggcttcttcgttgaccaaacataaaagagtgcatgagggagctgctgcggctgctgcagcggctgccgccgccgccgctgccgccgctgctggcctgggcctgggacctggactatcgcccgcatccatgatgcggcccgggcaagtgagtctgctgggacctgatgccgtttcagtgcttggaagcggcctgggcctttcccctggaacctcgtccgggcgaaaccccgatccgggaagtggccctggtacgcttcctgatccatcttcaaaaccgctacccggaagtcgctctactccatcgcctaccccggtcgagtcctctgaccccaaggcaggtcacgatgctggacccgacttggtgccatctcctgacctggatcccgtacctagtcccgaccctgatcctgttccaagcccggatcccaaccctgtaagttgtccagacccttgctcccccactcgcgggactgtgagcccggctctgcccaccggggaatcccccgagtgggtgcaagagcagggcgccctcctggggccagacggctag

SEQ ID NO: 14120 - DNA, 1263 bp, Artificial Sequence
  Description of Artificial Sequence: Synthetic coding sequence
atgagccgaagtagcccctccgggaaaggccactcccgcatggctgagccccgattcaataacccatacttttggcctcctccaccaaccatgcccagtcaactcgacaacttagttctgataaacaagattaaggagcagcttatggctgagaagatcagaccacctcatctgccccctacttctgcgtcgtcacagcagcccctcctagtccctccggccccagcagagagtagtcaggctgttatgagcctccccaagctccagcaggtcccagggctccacccccaggcggtgcctcagcctgatgtggcccttcatgccaggccagccacctccacagtcaccggactcggtctttccacccgcacgcctagcgtgagtacgtcagaatcatccgcgggggctggaacggggacgggaacctctaccccgtccacccctaccaccacatctcaatctcgactgattgctagcagtccgactctgatctctggaatcaccagcccccccttgcttgattctatcaaaaccatacagggacatggcctgcttgggcctcctaaaagcgaacgcggccggaagaagatcaaggctgaaaatcctggcggccctcccgtactcgtggtgccttacccaatcctggcttctggagagacagctaaagaagggaaaacctaccgctgtaaggtctgccccctgacattctttaccaagagcgagatgcagattcattcaaaaagccataccgaggccaagccacacaagtgcccccattgtagtaagtcattcgccaatgcctcatacctcgctcaacacctccgaattcatctgggagtgaaaccataccattgctcttactgtgacaagtctttccgccagttgagccacctgcagcagcacactagaatccacacaggggaccgtccgtataaatgccctcaccctggatgtgagaaagcattcactcagttgtcaaacttacaaagccatcaaagacagcacaacaaggataagccgtacaagtgtcccaattgctatcgagcatactctgactccgcgagtctgcaaatccatctctccgcacacgcgatcaaacacgctaaagcatactgctgctcaatgtgtggtagggcgtatacctctgagacctacttaatgaaacatatgagtaaacatactgtggtggagcatctggtttcccaccactcaccacagcgcactgagtcgcccgggatccctgtgcgcatatcgctcatctag

SEQ ID NO: 14121 - DNA, 1263 bp, Artificial Sequence
  Description of Artificial Sequence: Synthetic coding sequence
atgtccaggagcagccctagcgggaagggccactctaggatggcagagcccagattcaacaatccttatttttggccccccccgccaacaatgccctcccagctcgacaacctggttcttataaataaaatcaaagagcaactgatggcggagaagattcgaccaccccatctacccccaaccagtgcttcctctcagcagccactcttggtcccccctgcgccagccgagagtagccaggctgtgatgtcactgccaaagctccaacaagtgccagggctacatccacaggctgtcccccagcccgacgttgctctccacgcacggcctgccactagtacagtgactgggcttggcctctctacaagaacaccttccgtctccacatctgaaagctctgccggagccggtactgggaccggaacaagtacaccttccaccccaactacaacttcccagagtcggctgatagcttcctctcctacccttataagtgggattacaagccctccattgctggacagtatcaagacaattcaaggacacgggctcctggggccccctaagtctgagagagggcgaaaaaaaatcaaagccgagaatcccgggggccctcccgttctggtcgtgccatacccaatcttagctagtggagagaccgctaaggaaggaaaaacctatcgctgtaaggtgtgtcccctgaccttcttcactaagagcgagatgcagattcacagcaagtcacatactgaagctaaaccacacaagtgtcctcactgctccaagtcttttgcaaatgctagctacctggcccagcacttgaggattcatttgggagtcaagccttaccactgcagctattgcgacaagtcattcaggcagctcagccacctgcaacagcataccagaattcacacgggagacaggccatataaatgtccccacccgggatgcgaaaaagccttcacccagttgagcaatctgcagtcccaccagaggcagcataacaaagataagccctacaagtgccctaactgttatcgggcctactcagatagcgccagcctgcagatccatctcagcgcccacgctatcaaacatgccaaagcttattgctgcagtatgtgtggccgggcttacacatccgaaacttaccttatgaaacacatgagtaaacatacggtggtagaacatttggtgtcccatcactcacctcagcgcactgaatctcccggtatccccgtgagaatctctctcatatag

SEQ ID NO: 14122 - DNA, 2235 bp, Artificial Sequence
  Description of Artificial Sequence: Synthetic coding sequence
atgcagaaagaaatgaaaatgattaaggacgaagatgtccacttcgatctggccgttaaaaaaaccccttctttcccgcattgtttacagcctgtggcttctcgcggcaaggccccccaacgtcatccattccctgaggccctgcgcgggcctttctcccagttcaggtatgagccgccccccggggatcttgatggattcccaggtgtctttgaaggagctggatcaaggaaaaggaagtcaatgcctacgaagatgccttacaatcatcccgccgaggaggtcacactggcgctacatagtgaggaaaacaaaaaccacggcctgcccaatctgccacttttgttccctcagcctccccgtcccaagtatgacagccagatgattgacttatgtaatgtggggttccaattctataggtctcttgaacactttggcggcaaacctgttaaacaggaaccaatcaaaccgtctgctgtgtggccacagcccacccccaccccgttcctgccgactccctacccgtattaccccaaggttcatcctggcctgatgtttcctttttttgtccccagttcttcgccctttccattctcccgccacacctttttacctaagcaacctcccgagccactgttgccccggaaagcggagccccaggagagcgaggaaacgaagcagaaggtagagcgcgttgacgtcaacgttcagattgacgatagctactacgtagacgtgggaggcagtcagaagagatggcaatgcccaacctgcgaaaagagctataccagcaagtataacttggtcacgcacatcttagggcactccgggatcaaaccacatgcctgtacacattgcgggaagttgttcaaacaattgtcccacctgcacacacatatgctgactcatcaagggactagaccacataaatgccaagtatgtcacaaagcgtttacacagacgtctcacttaaaaagacacatgatgcagcactctgaagtaaagccccataactgcagggtgtgcgggaggggcttcgcttacccctccgaactgaaagcgcacgaagcaaagcacgctagcggacgcgaaaatatctgcgtggagtgcggtttggattttccaacactagctcagctgaaacgccatcttactacccaccgggggccaatccaatacaattgcagcgaatgtgacaagacctttcagtacccaagccaactacagaatcacatgatgaagcacaaggatataagaccctacatttgttccgaatgcggaatggagtttgtgcaacctcaccacctgaagcaacattcattgacccataaaggagtgaaagagcacaaatgtgggatatgtggccgggaatttacgctccttgccaacatgaaacggcatgtcctgatccacaccaacataagggcttatcaatgccacctctgttacaagagcttcgtgcagaagcagactttgaaagcacacatgatcgtccacagtgacgttaagccgttcaagtgtaagctgtgcgggaaggagtttaacaggatgcacaaccttatggggcacatgcatctgcatagtgactcaaagccatttaagtgtttatattgtccctcaaagttcacgctaaaaggcaacttaacacggcatatgaaagtaaagcatggagttatggagcgaggcctccactcacaagggctaggccgcggaagaatcgcccttgcccagactgctggagtgcttaggtccctggaacaggaggagccttttgacttaagtcaaaagaggagggccaaagtgccagtgtttcagagtgacggagaaagcgcacaaggcagtcattgtcacgaggaggaggaggaagataattgctacgaggtggagccttactctccaggcctcgcgcctcagtcgcagcagctttgtacaccagaagacctgagtacaaaaagcgaacacgcccctgaagttcttgaagaagcctgcaaggaagaaaaagaggacgcctctaagggcgaatgggaaaagagaagtaagggcgatttgggggcagaaggcggtcaagagcgggattgcgccggcagggatgagtgcctgagccttagagccttccaaagcacccggcggggtccttcattctcggactatctgtacttcaaacatagagatgagagtctgaaagaactccttgagagaaagatggagaaacaggccgttttactgggaatctag

SEQ ID NO: 14123 - DNA, 717 bp, Artificial Sequence
  Description of Artificial Sequence: Synthetic coding sequence
atgaagaatgtggctaacacggttacgatctcacacatactgccccatatcaaaattatacacacagaagagaagccggacaagtgcgaggagtgcaacaaggtgttcaactggagctcgacacacaccaagtacaaacgaatccacaccgaggacaagttctataagtatgaggaatgcgataaaagctttaaaaatatttctaccctcatcacgcacaagataatatatgtggttgagaagttttataagtgcgaagaatgtggcaaagtttttttcttttttctcaaatggagcctgaccctgtctcctaagctggagtgtaacggcgcaattagtgtccactgtaatctgaggctgctgggctcctctgactcacttgcgtctacttctcaagccgccgggatcgcgggtgcatgccaccatgctcagcttatctttgtcttcttagttgagaccgggttccatcatttcgaccaggccggattcgagttattgacgagcagcgatccacccgctctggcaagccaaagtgcacccaagtgttgggattacaagcatgagccactctcacccgtggagtgcgggaaggtctttaataagctctccaaccacacaggggaaaaactgtacaaacctaagcggcatgattctgcccttgagaacaccctgaacttttcgaaacataagaggaatcattctgttaagaagccatag

SEQ ID NO: 14124 - DNA, 1686 bp, Artificial Sequence
  Description of Artificial Sequence: Synthetic coding sequence
atgattaccagccagggatctgtttcgtttcgggacgtgacagtcggctttacgcaagaggaatggcagcacctggacccagcccagagaaccttgtatcgtgacgtcatgctggagaattacagtcacctagtcagtgtgggttattgcatacctaagcctgaagttattctaaaactggagaaaggtgaggagccctggatcctggaggaaaaattccccagccagtctcatttggaactcataaacactagccgtaattactcaatcatgaaattcaacgagtttaacaaaggaggaaagtgcttttgcgacgagaagcacgagatcatccattccgaggaggaaccttccgagtacaacaagaatggcaacagcttctggctaaatgaggatctgatttggcatcaaaagatcaaaaactgggagcagagtttcgaatataacgagtgcggcaaagccttccccgagaactcactgtttttggtccacaagcgaggatataccggacaaaagacttgcaaatatacagagcacggaaagacttgcgacatgagcttcttcatcactcaccagcagacccacccgcgagaaaatcattatgggaatgaatgcggcgaaaacatcttcgaagagagcatacttctggaacatcagtcagtataccccttcagtcagaaactcaatctaacgcctattcagcgtacccacagcataaacaatataattgaatataacgagtgcggaacctttttttcggagaaactcgtgctccacttgcagcagcgaacgcacactggtgagaaaccttacgaatgccacgagtgtgggaagaccttcactcagaaatctgctcatactcgtcaccagaggacacacacaggcggtaaaccttacgaatgtcatgagtgtggcaagactttctataagaactctgacctgattaagcatcagcgcattcatactggggaaaggccctacgggtgccatgaatgcgggaagtctttctcggaaaaatctacactgacccagcatcaacgaacacatacgggtgagaagccttatgagtgccatgaatgtgggaagaccttttcgtttaaaagcgtgttgactgtacaccagaagactcacaccggtgaaaagccctacgaatgctatgcctgcggtaaagctttcttacgaaaatccgaccttatcaagcaccaaaggatccacactggtgagaagccatatgaatgcaatgaatgcggaaaatccttctcggaaaaatccactcttacaaagcacctgcgcacgcacactggagaaaagccctacgaatgtatccagtgcgggaagttcttttgctactactctgggttcaccgagcatttgcggcgtcataccggggaaaaacctttcggctgcaatgagtgtgggaaaacattcaggcagaaaagtgccctgatcgttcaccagcgtacccatattagacaaaagccatatgggtgcaaccagtgtggaaaatccttctgtgtcaagtcaaagctcatcgcacatcacaggacccatactggcgagaaaccatacgagtgcaacgtgtgcggtaaatcattttacgtgaagtctaagctgaccgtgcatcagagaattcatctgggccggaatcctatcaatgtcgtgaatgagggcaactactcaggctag

SEQ ID NO: 14125 - DNA, 1686 bp, Artificial Sequence
  Description of Artificial Sequence: Synthetic coding sequence
atgatcacctcccaaggaagtgtgtctttcagagacgtaaccgtggggtttacgcaggaggagtggcaacatctggatccagctcaacgcacattgtacagggacgtgatgctcgagaattattctcacctggttagtgtaggctactgtattccaaaaccggaggttatcctcaagttagagaagggtgaagagccctggattctcgaagaaaaatttccttcccaatcccaccttgagttgattaacacaagccgcaactactcaattatgaagttcaacgagttcaataaaggaggtaagtgcttctgcgatgaaaaacacgaaattattcactcggaggaggaacctagtgaatataacaagaacggaaattccttttggctcaacgaagatttgatatggcaccagaaaatcaaaaattgggagcagtcctttgagtacaatgaatgtgggaaggccttcccagaaaactccctgtttcttgtgcacaagcgcggatacaccggacagaaaacgtgtaaatatactgaacacggaaagacgtgcgacatgagctttttcattacccatcagcagacacaccctagggagaaccactacggcaacgagtgtggagaaaatatcttcgaagagtctattctgcttgagcaccagtcggtctatccattcagccagaaattgaatttaacaccaatccaacgaacccatagcattaataatatcattgagtacaatgagtgcggcactttcttctcagagaagctggtccttcaccttcagcagaggacccataccggtgagaaaccttatgaatgccatgagtgtggcaaaacctttacacaaaagtctgcccacaccaggcaccagcgcacgcacacaggaggaaagccttacgagtgccatgaatgcggtaagactttttataagaattcagacctaatcaagcaccagcggatccacaccggggagcggccttatggttgccatgagtgcggaaaatctttctctgagaagtcaaccctcactcaacaccagagaacccacacgggtgagaagccatatgaatgccacgaatgcggtaaaacattctctttcaaaagcgttctgacagtgcaccagaagactcataccggagagaagccctacgaatgttacgcctgtggcaaagcctttttacggaaaagcgacttgattaagcatcagcggattcataccggagaaaaaccgtacgagtgtaatgagtgtgggaaatcattttcagagaaaagtacactcaccaagcacttacgtacccacaccggcgagaaaccctacgagtgtatacagtgcggcaagttcttttgttactatagtgggttcactgagcacctccggcgacacacaggcgagaagccattcgggtgcaacgaatgcgggaaaacctttcgacagaagtcagcactcatcgtccaccaaagaacacacatcaggcagaagccgtatggttgcaaccagtgtgggaagtctttttgtgtgaaatccaaactaatagcccaccacagaacacatacaggagagaaaccatacgagtgcaacgtgtgtggtaaaagcttctacgtgaagtctaagctgacagtccaccagaggatccatctgggaaggaatccaatcaacgtcgtgaatgaaggcaattacagcgggtag

SEQ ID NO: 14126 - DNA, 1188 bp, Artificial Sequence
  Description of Artificial Sequence: Synthetic coding sequence
atgcgcaacataatgtacttcggaggaacttgccaaagccctgcgttacctgcccttgtaaggccacctgcgccaccgctgcaaccctccttggacattaaaccttttctgccattcccactcgacaccgcagccgccgtcaatctgttcccaaattttaatgcaatggatcctattcagaaagccgtgatcaaccacaccttcggagtgcctcttcctcaccggcgaaagcagattatctcatgtaatatatgtcagctgagattcaacagtgatagtcaggcagccgcccactataaaggcaccaagcacgcaaagaaactgaaggctctggaggccatgaagaacaaacagaagagtgtaactgcaaaggatagcgccaagacgactttcacatccatcacaaccaacacaatcaacacttcatccgataagacagacggaactgcaggaacgcccgctatcagcacgacaactactgttgagatacgcaagagctctgtgatgacaaccgaaattaccagcaaggtcgagaaatccccaactaccgcaacgggaaatagttcatgtccatctaccgagacagaggaagaaaaggcaaagaggctgttgtattgtagcctttgcaaggttgctgtcaattctgcctctcagctggaggcacataacagcggcactaagcacaagactatgctggaagctaggaatggctccggaactattaaagctttccccagggctggagtaaaggggaaggggcccgtcaacaagggtaacactggtctccagaataagacctttcattgcgagatctgcgatgtccacgtaaacagtgagacacagctcaaacaacatatttcttctaggagacataaagatagggcagcagggaagcctcctaagccaaagtattctccctataacaaactgcagaaaactgcccacccgctgggagtgaaattggtgtttagcaaggaacctagtaagcccttggcacctcgaatccttccaaaccccttggcagccgccgcagctgccgctgctgtcgccgtgtcttccccgttttccctccggacggcaccagcagctactctctttcagactagcgctctgccaccagccctgttacgaccagcacctggccctatcaggacagcacataccccagttctttttgccccttattag

SEQ ID NO: 14127 - DNA, 1077 bp, Artificial Sequence
  Description of Artificial Sequence: Synthetic coding sequence
atggagagcttaaggggaaacaccgctcaggggcccacgaacgaagaagattataaaaacgaagggcagctaagtcgtcagaccaaatgcccagcccagaaaaaatcctcatttgagaacactgtggttagaaaggtcagcgttacattgaaagaaatcttcaccggagaagaagggccagagtccagcgaattcagtctgtcaccgaacttggatgcacaacagaagattcccaagggccacggatctccaatttcaaggaagaatagtaaggacaacagcgacctgattaaacatcaacggcttttcagtcaaagaaagccctgtaagtgcaacgaatgcgagaaagccttctcgtaccagagtgatttgttagtccatagccgcatccatggcggcgagaagccctttgaatgtaacaagtgtggtaaaagtttttcccggagcacccacttaattgagcaccagcgtacacacaccggtgaaaagccatacgagtgcaatgagtgcggcaaggctttttccagatcaactcatctttcattgcaccaacggattcataccggcgagaagccctatgaatgctcagagtgtggcaaggctttctccagaagcactaatctctctcagcatcaacggacccacacacaggagcgcccatataagtgcaacgagtgtggcaaagcgttcggggataggagtacaattatccaacaccaacgaatacacaccggagagaatccatacgaatgcagcaaatgcggcaaggcgtttagctggatctcttccctcactgagcaccagagaactcacacaggggaaaatccctacgagtgtagcgagtgtggcaaagtgttctccagaagttcaagcctgaccgagcaccaaaggattcattccggtgagaagccacacgaatgccgagtctgcggcaaaggcttttctaggtcctcatctctgataatccaccaacgtactcacaccggggagaagccatataagtgtaatgactgcggaaaggctttctgtcagtcttccaccctgatcagacaccagcaccttcatacaaaggaatag

SEQ ID NO: 14128 - DNA, 402 bp, Artificial Sequence
  Description of Artificial Sequence: Synthetic coding sequence
atggagtccctaagaggcaatacagcccaggggccgacaaatgaagaagattacaagaatgagggccaactctcccgccagacaaaatgccccgcccaaaagaaatcctcttttgagaacacagtggtgcggaaggtgtccgtcaccctcaaggagatcttcactggcgaagagggccccgagagctctgaattctcgctgagtcccaatctggacgcccaacagaagatccccaagggccacggcagccccatctcgaggaagaactcaaaggataactcggacctgataaagcaccagcggctgtttagccagcggaaaccttgcaagtgcaatgagtgcgagaaggcattctcttatcagtctgatttactggtccacagcaggatacacgggggctag

SEQ ID NO: 14129 - DNA, 1686 bp, Artificial Sequence
  Description of Artificial Sequence: Synthetic coding sequence
atgaactcatctttgactgcccagaggcgaggcagcgatgctgagctcggaccatgggtgatggccgccaggtcaaaggatgcagccccgtcccagcgagatggtttattaccggtgaaggtggaggaagactcccccgggtcctgggaaccaaactaccctgccgccagtccggatcccgaaacatccagactgcatttcagacagctcagataccaggaggtcgccggcccagaggaagctctttcccgactccgcgagctttgcagacggtggctgaggcccgagctgctttctaaggagcagatccttgagctgctagtgttggaacagttcttgacgattctgcccgaagagttacaagcctgggtccgagaacactgccccgagtcgggagaagaggcagtagcagtcgtgagggctttacaacgggctttagatggtacatccagtcaaggtatggtcacatttgaggacacagccgtgtctttgacgtgggaggaatgggaacggctcgatcctgcccgaagggatttctgccgtgaatctgcacagaaggattctggaagcacggtcccaccgtcactagagagcagggtggaaaacaaagaactcattccgatgcagcagattctggaagaggctgagccacaaggccagctccaggaggccttccaggggaagcgtcccctcttttcgaaatgcgggtccacacacgaggacagagtagagaagcaatctggagaccctctgcccctgaaactggagaactcgccagaggcggaggggctgaatagcatctctgacgtcaacaaaaatggcagtattgagggtgaggattccaagaacaatgagttacaaaattctgctcgctgctcaaatctcgtgctgtgtcagcacattcccaaggctgaacgacctaccgattctgaggaacacggcaataagtgcaagcagtccttccacatggttacctggcacgttctgaagccacataaatccgattccggggactccttccatcacagctcacttttcgaaacccaacggcaattacatgaggagagaccatacaagtgcggaaattgtggcaagtccttcaaacagcggtcggaccttttcaggcaccagagaatacatactggcgaaaaaccttatgggtgccaggagtgcggcaagagcttttcccaatctgctgccctgactaagcatcaacgcactcacactggcgaaaaaccgtatacgtgccttaaatgcggcgaacgctttagacaaaacagccacctaaatcggcaccagtcgacccactccagggataaacatttcaaatgcgaagagtgcggtgaaacatgtcacatttccaatctgtttaggcatcaaagactgcacaagggcgaacgcccttacaaatgcgaggaatgcgagaaaagctttaaacaacgaagcgatctattcaagcatcatcgaatccatactggagagaagccctacgggtgttctgtttgcggaaaaagatttaaccaatcggcaactctgattaaacatcagcgcatacacaccggcgagaagccctacaagtgtctggaatgtggggaacggttccgtcaatccactcatctcattagacaccagcggattcaccagaacaaagttcttagcgccggtagggggggatcccgcctatag

SEQ ID NO: 14130 - DNA, 489 bp, Artificial Sequence
  Description of Artificial Sequence: Synthetic coding sequence
atgaattccagtctaaccgcccagcgacgcggatctgacgctgaactgggcccctgggtcatggccgcgaggtccaaggacgccgccccctcacagcgagacgggctgttaccagtcaaggtcgaggaggacagccctggaagctgggaacctaattacccggcggctagccctgatccagagacctctaggctccatttcagacagctgagatatcaagaagttgccggccccgaagaggccttaagcaggctgcgcgaactttgtcgacgttggttgcgccctgagctgctttcaaaagagcaaatactggaacttctcgtgcttgaacaattcctgaccatcctaccagaagaactacaggcctgggtgcgggaacactgcccagaaagcggggaggaggctgtggctgtggtgagggccctccagagggcactggacggtaccagcagccaggtgtggaaagccgaatggcgaacaaaatcttag

SEQ ID NO: 14131 - DNA, 1416 bp, Artificial Sequence
  Description of Artificial Sequence: Synthetic coding sequence
atgaaagggaactatgaatcactgatcagtatggactatgccattaatcagcccgacgtgctgtcacagatccagccagagggcgagcacaatacggaggaccaggccggtcctgaggaatctgaaatccccactgatccatcggaggaaccaggcatctccacctcggacatactgagctggatcaagcaagaagaagagccgcaagtgggagcaccacccgagtcgaaagagtccgacgtgtacaagtctacctacgccgatgaggaactggtaattaaggctgaggggctggcccgcagtagcctgtgtccagaggttccagtacccttctctagcccgcccgccgctgctaaagatgccttcagcgacgtcgcctttaaatctcaacagtctacaagcatgacaccctttggccggccggcaaccgatctcccggaagcttccgaaggtcaggtcacctttacacagctagggtcatacccattacctccaccagtcggagagcaggtcttttcctgccaccattgtggcaagaacctgtctcaggacatgctgctgacgcatcaatgctcgcatgctaccgagcatccgcttccttgcgcacaatgccctaaacattttaccccccaggcagacctctcctccacctcacaggatcatgcttccgagaccccacccacctgccctcactgcgctcggacgtttactcacccttctcgcttgacctaccatctcagggttcacaacagtaccgaacgccccttcccctgccctgactgtcccaaacggttcgctgaccaagcccgactaacttcgcaccggcgcgcccacgccagcgaaaggccattcaggtgcgcccagtgcggccgctccttctctcttaagatctcgctgctcctgcatcagagaggccatgctcaagagagaccattctcttgcccacaatgcgggattgacttcaacggccactcagctctgatcagacaccagatgatacacactggcgagcgcccatacccttgtaccgattgttctaaaagtttcatgagaaaagaacatctcttgaatcacaggcggttgcacaccggcgagcgccctttttcctgtcctcattgcggaaagtcctttatacgaaaacaccaccttatgaaacatcagcgtattcacaccggtgagagaccatatccttgttcttactgtggtcgaagttttagatataaacagacactaaaggaccatcttagatccggccataatggcggttgtggtggggacagcgacccaagtggacaacccccaaaccctcccggtcccctcattaccggcctcgagacatctggcttaggggtcaatacagaggggctagagaccaatcagtggtatggggaggggagtggcggaggcgtcctctag

SEQ ID NO: 14132 - DNA, 1416 bp, Artificial Sequence
  Description of Artificial Sequence: Synthetic coding sequence
atgaaaggaaactacgagtcgttaattagcatggattatgccatcaaccagcccgatgtgctttcccagattcagcctgaaggggagcacaataccgaggaccaagctggtcccgaggaatcagagattcccaccgacccctccgaggagcccggaataagcacttctgacatactctcttggattaagcaggaagaggagccacaggtgggagcgcctcccgagagcaaagagtctgacgtgtacaagtctacttacgccgacgaagaattggtgattaaagcagaaggactggccaggtcctcattatgccccgaggttcctgtcccgttctcaagtccgcctgccgctgcgaaagacgccttttcagacgtagcctttaagtcccagcagagcacttccatgacaccttttggtagacccgctaccgacctccctgaagcatccgaaggtcaagtaaccttcactcaactggggagctatcctctcccaccccccgtgggcgaacaagtgttcagctgccaccactgcggaaaaaacttgagtcaggacatgcttctgacgcatcagtgttcacatgcgacagaacacccactaccttgtgcgcagtgtcctaaacatttcaccccgcaggctgatctgtcatccacatcacaagaccacgcatccgagaccccccctacctgtcctcattgcgccagaacctttacacacccttcccggttaacataccatctgcgcgtgcacaactcaactgagcggccatttccatgtcccgattgtcctaaaagatttgcagaccaagccagactaactagtcatagacgggctcacgccagtgagagaccgttcagatgcgctcagtgcggacgctccttcagtcttaagatctctttgctgctccatcaaagagggcatgcacaggaaaggcccttcagctgcccccaatgcggaatcgattttaatggccacagcgctctgatacggcaccagatgattcacaccggcgagaggccttatccgtgtacggattgtagtaagtcctttatgcggaaggagcatttactgaaccataggcgccttcacaccggggagcgcccattttcctgcccacactgcggcaagtctttcatccgcaaacaccacttaatgaaacaccagagaattcacaccggtgagcgcccttatccctgtagctactgtggtaggtcctttaggtacaagcagaccttaaaagatcacttgcgaagcgggcataacggagggtgtgggggggattctgatccttctgggcagccccccaaccccccagggcctcttatcaccggactggagacctctgggctgggcgtaaacacggaagggttagagaccaatcagtggtatggcgagggttcgggcggaggagtattgtag

SEQ ID NO: 14133 - DNA, 1416 bp, Artificial Sequence
  Description of Artificial Sequence: Synthetic coding sequence
atgaaaggaaattatgaaagcctcatctccatggactatgccattaaccagcctgatgtgctgagtcagatacagcccgaaggcgagcacaacacagaggaccaggctgggcccgaagagtccgaaatccccacagaccctagcgaggagcccgggattagtacaagcgatatcttaagctggatcaaacaggaggaggaaccccaggttggcgcgcctccagagtccaaagagagcgatgtgtacaagtccacctatgctgacgaagaactcgtcattaaggccgaagggctggcaagatcttcgttgtgcccagaagttccagtccccttctcatccccaccagccgccgctaaagacgcgttctctgacgtggcctttaaatcccagcagagcacctcaatgactccattcggacggcccgccaccgacctgcccgaggcctccgaaggccaggtcaccttcacccaactcggaagttatcctcttccacccccagtgggggaacaagtgtttagttgccaccattgcggaaagaatctttcccaggatatgcttctgacccaccaatgttcacacgctaccgaacaccctcttccctgcgcacagtgccctaagcatttcactcctcaggcagatctgtcctctacctcccaggatcacgcatctgagacaccacccacttgtccccattgcgctagaaccttcacccacccttctcgcctgacttatcacctccgggtccataattctacagagcgccctttcccctgtccagactgccctaaaagattcgctgaccaggcccgcctcacttctcaccggcgagcgcacgcgtccgagcgaccattccggtgtgctcagtgtgggagatcattctccctcaagatctcgttactcctacatcaacggggacacgcacaggagaggcccttctcatgcccccagtgtggcatcgactttaatggtcactcggcactcataagacaccagatgatccacactggggaacgcccatacccatgcacggactgcagtaagtcgtttatgaggaaagaacacctgctcaatcacaggcgtctccatacgggggaaagacctttttcctgtcctcattgcggaaagtcattcattagaaaacatcatcttatgaagcaccagcgtattcatacaggggagcggccctatccctgctcctactgtggtaggtcttttagatacaaacagacgctcaaggaccacctgcggagcgggcataacggtggatgcggcggtgacagtgaccctagcggacagccccccaacccacctggaccacttataacaggcttggaaaccagtggtcttggggtgaatactgagggcctggagactaatcagtggtatggcgaaggaagtggaggcggtgtactgtag

SEQ ID NO: 14134 - DNA, 1929 bp, Artificial Sequence
  Description of Artificial Sequence: Synthetic coding sequence
atggcagaagcagctccggcccctacatccgagtgggatagcgaatgtctgacgtcactacagccactgcctctgccgacaccacccgctgccaacgaggctcacctccagacggccgcgattagcttgtggaccgtggtcgccgcggtccaagcgattgagaggaaggttgaaatccattctaggagactccttcacctggaggggcgcacaggaaccgctgagaagaaactggctagttgtgagaaaacggttactgagctcggcaaccagctagaaggaaagtgggcagttctcgggacattactgcaggagtacgggctgttacagcgaagattagaaaatctggagaatctcctgcggaatagaaatttctggatcctgcgcctgcctccaggaattaaaggtgatatccctaaggtgccagtggcctttgatgatgtgagcatttacttttctaccccagaatgggagaagcttgaggagtggcagaaggagctctataaaaacattatgaagggaaactacgagagcttaattagcatggattacgccatcaatcagccagacgtgctcagccaaattcagcctgagggcgagcacaatactgaggaccaggcaggccccgaagaatcagaaatcccaaccgacccgtccgaggagcctggaatatcaactagtgacatattgagttggatcaagcaggaggaggaaccacaggtaggggcccctcctgagagtaaagagagtgacgtctataagtcaacatatgcagatgaagagctcgtcataaaagccgaaggcctcgctcgcagctcactgtgccctgaggtaccagtgccctttagttcaccaccagccgcagcaaaagacgcttttagcgatgtcgcatttaaaagtcagcagagcacatccatgaccccattcggacgtcccgctacggacctgccagaggcgagcgagggacaggtcaccttcacccagttaggctcttacccactgcctcctccagtcggggagcaagtttttagctgccaccattgtggtaagaacctgtcacaggacatgctcctgacgcatcagtgctcccacgccaccgaacatccgttaccatgtgctcaatgtccaaagcactttaccccccaagccgatttgtcatcaacatcccaggatcacgcctcagagactccacctacgtgcccacactgtgcgaggacgttcacccacccatcaagacttacatatcacttacgggttcacaactccaccgagcgaccgttcccctgtcccgattgtcccaaacgcttcgcagaccaagcccgcctgacatcccaccggcgggctcatgcgtccgagcgaccctttagatgcgcccagtgcggccgatcttttagtttgaagatcagtttgcttctccatcagcgcgggcacgcacaggagcgcccatttagctgcccccagtgcggtatagactttaatggacacagcgccctcattcggcaccagatgattcatacaggagaaagaccttatccttgcacggattgtagcaaaagctttatgcgtaaggagcatctgttgaatcatcggcgcctgcacaccggggaaaggcccttctcctgtccacactgcggaaaatcattcattagaaaacatcatctgatgaaacatcagcgcattcacaccggcgagaggccatatccatgttcttactgcggccggtcatttcgctataagcagactttaaaagaccacctgaggagcgggcataacgggggatgtgggggagattcggacccatccgggcagccacctaacccacctggccccctgatcacgggactcgagacctctggccttggcgtcaacactgaagggctggagactaaccagtggtatggcgaggggtccggcggcggtgtgctgtag

SEQ ID NO: 14135 - DNA, 1416 bp, Artificial Sequence
  Description of Artificial Sequence: Synthetic coding sequence
atgaagggaaactatgagagcttgattagtatggactacgcgatcaaccagcctgatgtgctgagtcagatacagcccgaaggcgagcacaataccgaggatcaggccggacctgaggagagtgaaatccccactgaccccagtgaggaacccgggatctcgacatcggacatcctttcatggatcaagcaggaggaggagcctcaggtgggcgcgcctcctgagtcaaaggaatcagatgtatataagagtacctatgctgacgaagagctagtaatcaaggctgagggtctcgcccggtcgagcctctgccccgaggtccccgtccccttttcatcccccccagccgccgccaaagatgccttcagcgacgtcgccttcaaaagtcagcagtcaactagcatgaccccctttggaaggcccgctaccgacctgcccgaggccagcgagggccaggttactttcacccagttggggagttacccactgccgcctcctgtcggcgagcaggttttctcgtgccaccattgtggcaaaaatctctcacaagacatgctactgacacatcagtgctctcatgctacagagcacccactcccctgtgctcagtgtcccaaacatttcacccctcaggccgacctgtccagcaccagccaggaccatgcaagcgagacaccgccaacctgcccacattgcgctaggaccttcacacacccctccaggctgacatatcacctgcgagtgcataacagcaccgagcgccccttcccatgtccagactgccccaagcgattcgccgaccaagcaaggttgacaagccatagacgggctcatgctagtgagcgcccctttcgttgcgcccagtgtggcaggagctttagcctgaaaatatctctcctgctccaccagcgggggcatgctcaggaacggccgttcagctgcccacagtgtgggattgacttcaacggacactccgctttaattcgccaccagatgatacacaccggtgaacggccatatccctgcacagactgctcaaagtctttcatgagaaaggagcatctgctgaaccaccgacgactgcacactggtgaacggcccttttcttgtccgcactgcgggaagagcttcattcgaaagcaccatctcatgaagcaccagcggatccacacaggggaaaggccctacccgtgttcttactgtggaagaagctttcggtataagcagacacttaaagaccatctgaggtctggtcacaacggcggctgtgggggcgatagcgacccaagtgggcagccgccaaatcctcccggccctctgattacagggctcgagacgtccggcctgggcgtcaatactgaagggcttgaaacaaaccagtggtacggagaggggtccggagggggcgtcctttag

SEQ ID NO: 14136 - DNA, 1416 bp, Artificial Sequence
  Description of Artificial Sequence: Synthetic coding sequence
atgaaagggaactacgagtccttgatttccatggattatgccattaatcaaccagacgtcctgtcacagattcagcccgagggagaacacaacacagaagatcaagctggtcctgaagagtctgagataccgactgatcccagcgaggagcccggcatatccacttcggacatcctgtcctggattaaacaggaagaggaaccccaggtcggcgccccccccgagagtaaagaaagcgatgtgtataagagtacctacgcagatgaagagctcgttatcaaagccgagggattagcaaggagcagtctctgtcccgaggtccctgtgcctttttcctcaccgccagccgccgcgaaggacgccttcagtgatgtcgctttcaagtcacaacagtctaccagcatgacaccattcggtcgcccggcaaccgatttgcccgaggccagtgaggggcaagtgacattcactcagctcggtagctatccactaccgcctcccgtgggagaacaggtgttttcctgtcaccactgtggtaagaacctcagtcaggatatgctgttgactcaccagtgctctcacgccaccgagcacccccttccctgcgctcagtgtcctaagcacttcacaccccaggccgatttgtccagcacgagccaggaccacgccagtgaaacccccccaacttgcccacattgtgcaagaacgtttacgcatccgagccgcttgacctatcacctgcgagtgcacaactcaacggagcgcccttttccatgtcctgactgcccaaagcgcttcgctgaccaggcgcgcctgactagccacaggcgggcccacgcaagcgagcggccattcagatgtgcacagtgtggccgttcatttagtttaaagatctccctgcttctccaccaacggggccacgcccaggagagaccatttagctgcccacagtgcggcatcgacttcaacggccattcagccctgatccgccatcagatgatccacaccggagagaggccatacccatgcaccgattgctccaaaagtttcatgcggaaagaacacctcctgaatcatcgccggttgcacactggcgagcgacccttcagctgcccacattgcgggaagtccttcatcaggaagcaccatcttatgaagcaccaacgcatacacactggggaacggccctacccatgcagttattgcggtcgaagcttccgctacaagcaaacactcaaggatcatttacgctccggccataacggtggttgtggcggagactcggatccgtccggccagccccctaatcctccgggaccccttataactggactggaaacgagcggccttggggtgaatacagaaggcctggagaccaatcagtggtatggggaaggatccggaggtggtgtcttgtag

SEQ ID NO: 14137 - DNA, 1944 bp, Artificial Sequence
  Description of Artificial Sequence: Synthetic coding sequence
atgattgggctgatccagggccggcgcctcgccgaacagacctccgagtgggactccgagtgcctgactagccttcagcctctccctctacctacgccacccgccgccaacgaggcacatctgcagacagccgccatcagcctgtggacagtcgtggctgccgtccaagccattgagcgcaaggtggagatccacagccgcagactgctgcacctggaaggacggactggcacagccgagaaaaagctggcctcctgtgaaaagaccgtgactgagctggggaaccagttggaaggcaaatgggctgtactcggcaccctgctacaggagtacggtctgctgcagaggcgtctggagaatctggaaaatctcctccgcaacagaaacttctggatcctgagactgccccctggtataaagggagacatacctaaggtgccagtggccttcgacgatgttagcatttacttcagtacccccgaatgggagaaactggaagagtggcagaaagaactgtataagaacatcatgaaaggaaactacgagagcctgatcagcatggattacgctattaaccaaccggacgtgctgtcccagatccagccagagggcgagcacaacactgaagatcaggcagggcctgaggagtcagaaatcccgaccgatccttccgaagagccaggcatctctacctctgacatattaagctggattaaacaggaggaggagcctcaggtcggtgccccaccagaaagcaaggagtcggacgtatacaaatctacgtatgccgacgaagaactggttataaaggccgaggggctcgcccggtcttccctctgcccagaagtgcctgtaccgttttcctcccctcccgctgcagcaaaggacgcattctcggacgtggcatttaagtcacagcagagcaccagcatgaccccattcggacgacccgcaacagatcttcctgaagcatctgagggtcaggttacttttacgcagttggggagctacccccttcctcccccagttggtgaacaagttttcagttgccaccattgcggtaaaaacctgtctcaggacatgcttcttacccatcaatgctcacatgccacagaacatccacttccatgcgcccagtgtcctaagcacttcaccccgcaggccgacctaagcagcacctcccaggaccacgccagtgaaaccccacccacctgccctcattgtgctcggacttttacccacccatccagactaacctaccacctgcgcgtccacaactcgacagaaaggccgttcccgtgccccgattgcccgaaacgatttgcagaccaggcccggttgaccagccataggcgagcacacgctagcgagcgtccatttcgctgtgctcagtgcggccgaagcttcagcctcaaaatcagtctcctgctccatcaacggggtcatgcgcaggaacgccccttttcctgcccccagtgtggtatcgatttcaatgggcacagcgccctgattagacatcagatgatccatacaggcgagcggccttatccttgcaccgactgctcaaaatccttcatgagaaaggaacatctccttaatcacaggcggttacataccggtgagcgccccttcagctgtcctcattgtggcaaaagtttcattcgcaagcaccacctgatgaaacaccaacggattcacactggagaacggccctacccatgctcatattgcggacgttcattcaggtataagcaaacattgaaggaccacttgcggtctggacataatgggggctgcggaggggatagtgatcctagcggccaacctccaaatcctccagggccactgattactggacttgagactagtggtctgggcgtgaatactgaaggtttggagactaatcaatggtacggcgagggttccgggggcggagttctatag

SEQ ID NO: 14138 - DNA, 6747 bp, Artificial Sequence
  Description of Artificial Sequence: Synthetic coding sequence
atgatggatagcgagaacaagccagagaacgatgaagatgagaaaataaacaaggaagcccaggatctgaccaaactcagcagtcataatgaagatggagggcctgtgagcgacgtgatcgcaagtttccctgagaatagcatgggcaaacgaggtttcagcgaaagctcaaattccgactcagtggttattggtgaggatcgcaacaagcatgccagtaagcgtcggaaactagacgaagccgagcccctaaagtcaggcaaacagggcatttgtcgcctggagacatcagagtcttcggtcactgaaggtggaattgccctcgatgagactggaaaagagacgttcctgagtgattgtactgtaggaggcacgtgtttacccaacgccctgagcccatcctgcaacttcagtacgatagacgttgtttcactaaaaacagatactgaaaaaactagtgctcaagagatggtaagtctagatttggagagagagagcccattcccgcctaaggagatctctgtgtcatgcactattgggaacgtggatacagtgcttaagtgtagcatctgcggacacctgttcagctcttgttctgacctggaaaaacacgctgaatctcatatgcaacaacccaaggaacacacgtgctgccactgttctcacaaggccgaatcctcttcagcgctgcacatgcatatcaaacaggctcacgggccacaaaaggtcttctcctgtgacctgtgcggttttcagtgttccgaagaaaacctgctgaatgcccattatctggggaagacacacttgagaagacagaacttagcagccaggggaggatttgtgcaaatcctgacaaaacagccatttccgaagaaatcccgcaccatggcgaccaagaacgtgcactctaaacctcgcacaagcaaatcaattgcaaagaattcagatagcaaggggctgcgaaatgtgggcagcacctttaaagacttcaggggcagtatcagcaagcagtccggttcgtcgagtgagttgctggtagagatgatgccttcgcgcaatactctctctcaggaggtggagattgtcgaggagcatgtaacaagtttaggtctggctcaaaatcctgagaatcaatcaagaaaactggacaccttagtgacttccgagggactattggagaagctggaatcgaccaaaaatacactgcaggctgctcatggaaactctgtcacaagcagacctcgaccagaacgcaatatcctggtgctagggaactcctttagacggcgatcaagcaccttcacactcaagggtcaagcgaaaaagaggttcaacctcctcggcatcaaacgaggcactagtgagactcaaagaatgtatatgaagcaccttcgcacgcagatgaagacgcacgatgccgagtcagtcctgaagcacctggaggcatgtagctccgtgcagcgcgtttgtgtaaccacgagtgagacacaggaagctgagcagggacaaggtagtgcgaggccaccggactcaggactccactccctgactgtcaagccagcatctggatctcagactttgtgcgcgtgtactgactgcggccaggttgccactaatcgtactgatctcgagatccacgtcaagcgctgtcacgcaagggagatgaaattttactgccgaacctgcgatttttcatcaatgagccgacgggatctagacgagcaccttcactcaaatcagcaccagcagactgccagcgtcctgtcctgtcagtgctgtagctttatcagtctagatgagattaacctgcgtgatcacatgaaggagaagcacaatatgcactttctgtgcactccctgtaatctcttttttcttagcgagaaggatgttgaagagcataaggcaacagaaaaacatattaattctctcgtccagccaaaaacgctgcagagcagcaactcggatttagtactgcagacactgcctctcagcaccctcgaatccgaaaatgctaaagagtccatggatgattccggaaaggccagtcaagaggagccgcttaaatctagagtctctcatggcaatgaagtaaggcacagtagcaaaccccaattccaatgtaagaagtgcttttacaaaacgcggtcttccaccgttctcactagacatataaaattaagacacggccaagactaccattttctctgcaaggcttgcaatctttactcacttagcaaggaaggcatggaaaaacacatcaaacggagcaaacatctggagaatgcaaaaaagaataacatcgggctctcctttgaggagtgcattgaacgcgtctgcataggagctaacgacaagaaggaagagtttgatgtgagcggaaacggtcgtattgagggacacattggagtgcagttgcaggagcactcttacctggagaagggaatgctggcatcggaagagctgtctcaaagtgggggtagcacgaaggacgacgaactggcttctactacaacacccaaacgaggacgcccaaagggcaacatctcgcgcacttgcagccattgcggtcttctagcatcttctataaccaatctcactgtccatatacgcaggaagcacagtcaccagtactcgtatctgtgcaaggtctgcaagtactacacagtgacgaaaggcgacatggaacgccactgcgccacaaagaagcataaaggccgtgtggaaatagaagcctctgggaaacactccagcgatataatcgtgggtcctgagggtggctctcttgaggcgggcaaaaagaacgctggatcagccgttacgatgtctgatgaacacgcaaataagcctgcagagagccctacatctgtgctggagaagcccgaccgcggaaactcaatagaagctgaggtggagaacgtgttccatagcctcgacggcgaagtgaactcccatctcctcgataagaaggagcagataagtagcgagcctgaggatttcgcacagcccggggatgtatattcacaacgcgacgtcacaggcaccggggagaacaagtgtctccactgcgagttctctgcccactctagcgcttcactcgagctgcacgtgaagaggaaacacaccaaagaatttgaattctactgtatggcttgcgactattacgctgtcacacgacgggagatgacccggcatgcagcaaccgaaaagcataagatgaagcgacagagctacctgaatagcgccaatgtcgaggccgggtccgccgacatgtccaagaacatcattatgccagaagaggaacatcagcagaacagcgaagaattccaaattataagtggtcagccatctgatacactgaaaagcagaaacgcagccgactgcagcatactgaatgagaataccaacctggacatgtcaaaagtcctctgtgcggctgacagcgtcgaagtggaaactgaagaggaaagtaactttaacgaagatcacagtttctgcgagacttttcagcaggctccagtaaaggacaaggtacgaaagccagaggagatgatgtcccttacgatgtcttctaactacggctcgccgagccgctttcagaacgagaactctggctcctccgcactgaattgtgagactgccaagaaaaaccacgagatttcaaacgatgccggggaactgagggttcattgcgaaggtgaagggggcaatgccggagacggaggtggagttgtgcctcatcgccacctgtgtcctgtcacattggatggggagcgttccgcagagagccccgtgttggtggtgacccgaattactcgtgaacagggcaacctggagtccggggggcagaatagagtggcccgcggccatggcttggaggatctgaaaggcgtgcaggaagacccagtgctcggaaataaagaaattcttatgaactcccagcatgaaaccgagtttattctggaagaggatggacctgcttcagacagcactgtcgagtcttcagacgtgtatgagaccatcattagcattgatgataaagggcaggccatgtactcatttggaaggttcgatagcagcataatccggatcaaaaacccagaggatggagaattgattgaccagagtgaggaaggacttattgccaccggggtgaggatttccgaactccccctgaaggactgcgcacagggcgtgaaaaaaaaaaagtctgaggggtcttctatcggagagagcacgcggatacggtgtgatgactgcggatttttggcagacggcctgtcaggtctgaatgtgcacatcgccatgaaacaccctacaaaggagaaacacttccactgcctcctatgtggcaagtcgttctatactgagagcaacttgcaccaacatctggctagtgcagggcatatgcgcaacgaacaagcttctgtggaggagttgcccgaagggggcgccaccttcaaatgtgtcaaatgcacggaaccattcgactccgagcaaaacctgtttttgcacattaagggacagcacgaagagttgctgcgcgaagtgaataaatacattgtagaagatacagagcaaattaatcgggagcgggaagaaaaccagggaaacgtatgcaaatattgtgggaagatgtgccgcagctccaacagtatggcgttcctcgcccatatccggacccatacgggctctaaaccctttaagtgtaaaatctgtcacttcgcgactgcccaactgggcgatgccaggaaccatgtgaaacgacacctgggcatgcgggaatataaatgccatgtctgtggcgtagccttcgttatgaaaaagcatttgaacacacacttgctgggaaaacacggtgtgggcacccctaaagagagaaagttcacttgccacctctgcgataggtcctttacagaaaagtgggcattaaataatcatatgaagcttcataccggcgaaaaaccttttaaatgcacatggccaacctgccactactcgtttttgactgcaagcgccatgaaagaccactatagaacccacacaggcgagaagtcctttctctgtgacttatgtggattcgccggtggcacacggcatgctcttacaaagcacagacggcagcacacaggcgagaaacccttcaagtgtgacgagtgcaatttcgcttctaccacacagtcccacttaaccagacataaacgagttcatactggagaaaagccttatagatgcccatggtgcgactataggtcaaactgcgcagaaaatatccgaaagcatatactgcacactgggaagcatgaaggcgtcaagatgtataactgccccaaatgcgattacggcacgaatgttcccgtcgaattccgcaaccacctgaaagaacagcatcccgacatcgagaatccagatttggcatacctgcacgcaggcatagtgtctaaatcatacgagtgccggttaaaggggcaaggggccacattcgtggagactgatagcccttttactgctgctgctctcgccgaagagccacttgttaaggagaaacctctgcgctcgtccaggaggcctgcacctccgccggagcaggtgcagcaagttatcatattccagggatatgatggtgagtttgccctggatccatccgttgaggagactgccgctgcaaccctgcagactcttgccatggctggccaagtagctagggttgtccacatcacggaagatgggcaagtgatagcaacctcccaatccggagcccatgtggggagcgtcgtcccgggcccaatcctgcccgagcagctggcagacggcgccactcaagtggtagtcgtgggaggaagcatggaaggccacgggatggacgagtctctgtctcctggcggcgccgtcatacagcaggtaactaaacaggaaatcctgaatctatctgaggcaggggttgctccacccgaggcatcctccgctttggacgctctcctgtgcgcagtaacagagttgggtgaagtcgagggacgagcaggcttggaggaacagggtcgtcctggggccaaagatgtgctgattcaactgcctggtcaagaggtctctcatgttgctgcagaccccgaggctcccgaaatccagatgtttcctcaggcccaggagtcccctgcggctgtggaggtactaacgcaggtggtgcatccctcggctgccatggcatctcaggaaagagcccaggtggcatttaaaaaaatggtacaaggcgtattgcagtttgccgtgtgtgacaccgccgctgccggacagcttgtcaaagatggggtgacacaggtcgtggtttctgaagagggtgctgtgcatatggtggccggagagggcgctcagataattatgcaggaagcacagggcgaacatatggacctcgtcgagtctgacggggagattagtcaaatcatagtaactgaggaactggtgcaagccatggtgcaggaatcctctggaggttttagcgaaggaacaactcattatattctgactgaactacctccgggagtgcaggacgagcctggattatactcacacacagtgttagagacagccgattctcaggaattactgcaggccggcgcaaccctgggaaccgaagccggtgcccccagtagagcagagcagctggcatctgtagtcatctacacccaggagggttcgtcagccgccgcagcaatccagtcccaaagggaatcttccgaattgcaggaggcatag

SEQ ID NO: 14139 - DNA, 4983 bp, Artificial Sequence
  Description of Artificial Sequence: Synthetic coding sequence
atgatggattcagagaacaaaccagaaaacgacgaggacgaaaagattaataaggaagcacaagacctgaccaaactgtccagccacaacgaagatggtggtccagtgagcgacgttattgcttcgtttcctgaaaattctatgggaaagcggggtttcagcgagtcttctaactcagactctgtcgtgattggtgaggaccgtaacaagcacgcttcgaagcgcaggaagctggacgaagccgaacccctgaaaagtggcaaacagggaatctgtcggttggagacaagtgagtccagcgtgaccgaaggcgggatcgcactcgacgaaaccggaaaagaaacttttctttctgattgtaccgtgggaggaacctgtttgcctaacgccctgagccccagttgcaacttctcgactatcgatgtagtgagcctgaaaaccgacacagaaaaaaccagcgcccaggagatggtgagtctggatctggaaagagaatctcccttccctccgaaggaaatttctgtgtcttgcaccattggtaacgtggacacggtgttgaagtgttctatctgtgggcatttattctcttcatgctctgacctcgagaagcacgcagaaagccacatgcagcagcctaaggaacacacctgctgtcactgctcccataaagctgagagttcctcagccctgcacatgcacatcaagcaggcacacggtccccagaaagtcttttcctgtgacttgtgcggatttcaatgtagcgaagagaatctgctcaatgcccactatctaggaaagacccacctgaggagacagaacctggccgcccgcggaggtttcgtgcagattctgacaaaacagccattccccaaaaagtccagaaccatggctacaaagaatgtgcattcgaagcctaggactagtaaatccatcgccaaaaatagtgatagcaagggactgaggaatgtcggctccacttttaaagatttccgaggctccattagcaaacagagcggctcatccagcgaattgctggtggagatgatgccaagtaggaatacgcttagtcaagaggtggagatagttgaggaacacgtgactagtttggggctggctcagaaccctgaaaaccagtcacgaaaactggacacgcttgtgacaagcgagggcctcctggagaagctcgaatctactaagaataccctgcaggccgcccacgggaacagcgtcacctctagaccacgccctgaacggaatattctggtgctgggaaatagttttcggagaaggagctcaaccttcacgctgaagggtcaagctaaaaagagatttaacctgttgggaatcaaacgtggcacaagtgagactcaacgcatgtatatgaagcacctcagaacccagatgaagacacatgacgccgagagcgtactcaagcacctcgaagcttgttcaagtgtgcagagagtgtgtgtgactacaagtgaaacccaggaagcagaacaggggcagggaagcgcgcgcccgcccgacagcggcctgcactccttgacagtgaaaccagcctctggatctcagaccctttgtgcatgcaccgattgtggccaggtcgcaactaatagaacggatttagagatacatgtcaaacggtgtcacgccagggagatgaagttttactgcaggacttgcgacttttcttctatgtcgcgccgagatcttgatgagcacctgcacagtaaccaacatcagcagaccgccagcgtgctgagctgccagtgttgtagcttcatctctctagacgagatcaacctcagagaccacatgaaggagaagcacaacatgcacttcttgtgcactccctgcaacctgtttttcctctctgagaaggacgttgaagagcacaaggcaactgagaagcacattaactcactggtgcagcctaaaactttgcagtctagtaatagtgatctggttttacaaaccctacctctctccactttggaaagcgaaaacgctaaggaatcgatggacgactccggcaaggcatcacaggaggaaccgctgaaaagtagagtctcacatgggaatgaagtgcgccatagcagcaaacctcagtttcagtgcaagaagtgtttctacaaaaccagatctagcactgtcctaacacgccatatcaaattgaggcacggacaagattaccattttttgtgcaaggcttgcaatttgtacagcttatctaaggaagggatggaaaagcacatcaagcgctctaaacacctggaaaacgctaagaagaacaacatcgggctcagttttgaagaatgcatcgaacgggtatgcatcggtgccaatgacaaaaaagaggagtttgatgtgagcggaaatggccgcattgagggtcacatcggggtccaactgcaggaacacagttaccttgagaaaggtatgttagcaagcgaggaactgtcccaatctggagggtcgacaaaggacgatgagctagcttccaccaccaccccaaagaggggtaggccaaagggcaatatttctagaacctgcagtcattgcggcctgctggcttcatctataaccaatcttaccgtccatatacgtcggaagcactctcaccagtactcttacctttgcaaggtgtgcaaatactacacagtgacaaaaggggacatggagagacactgcgcaacgaaaaaacacaaaggcagggtggaaatagaagcaagtggcaaacacagctccgatattattgtaggaccagaaggcggctctctggaggcaggcaaaaagaatgccggcagtgcagtcacgatgagtgatgaacacgccaacaaacctgctgaaagccctaccagcgtccttgagaaaccggaccgaggaaactctatagaggcagaagttgagaacgtgtttcacagtctcgatggcgaggtcaacagtcacctactggacaaaaaggagcaaatcagcagcgagcctgaggactttgctcagcctggcgatgtctattcccagcgagatgtaaccgggaccggtgagaacaaatgtctccattgtgagttctcagctcactcctctgctagtttagaacttcacgttaaaagaaagcacacaaaagagttcgagttctattgcatggcatgcgattactacgcagtgacgcggcgcgaaatgactcgccacgccgccactgaaaagcataagatgaagagacagtcctatctgaactcagccaacgtagaggccgggagcgccgacatgtcaaaaaacattatcatgccagaagaggaacaccagcagaattcagaggaattccaaatcatctctggacagcctagtgatactctgaaaagcagaaatgctgccgactgctccattctgaatgaaaataccaatctagacatgagcaaagtgctgtgcgccgccgactccgtggaagtggaaacagaagaagagagtaacttcaatgaggaccactctttttgcgagacatttcagcaggcaccggtgaaggacaaggtgagaaaacctgaagaaatgatgtcactgactatgtcgtccaactacggatcccccagtagatttcagaatgaaaattcggggtcaagcgctctgaactgcgagaccgcaaagaagaaccacgaaatttcgaacgacgccggtgaattgagggttcattgtgagggagaaggcgggaacgcgggcgacggcggcggcgttgtaccccataggcacctgtgccctgtcaccctggatggcgaaagatcagccgaaagcccagtattggtggtcacccgaattaccagggagcaggggaatctcgagagtggcggacagaatagagtagccaggggccacgggttagaggacttgaagggcgtgcaggaggacccagtgttgggaaacaaggagatactgatgaattcccagcatgaaacagagttcatcttagaggaggacggacctgctagcgatagcaccgtggagtcaagcgacgtatatgaaaccatcatcagcatcgacgacaaggggcaagccatgtattcttttgggcgctttgactcatctatcatcaggatcaagaaccccgaggacggcgagctgatcgaccagagtgaggagggactgatcgccacaggggtccgaatcagtgagcttcccctgaaagattgtgcacaaggggtgaagaagaagaaatccgagggcagctccattggtgaatcaacccggatcaggtgtgatgactgtgggtttctggctgacgggctgtcaggcctaaacgtccacattgccatgaagcatcctaccaaagaaaagcactttcactgtctgctatgtggcaaaagcttctatactgagtcaaacctgcaccagcatctcgccagtgccgggcacatgaggaacgaacaggccagtgtggaagaactgcccgagggcggagcaacttttaaatgcgttaaatgtacagaaccattcgacagcgagcagaacctctttttgcacatcaagggacaacatgaggagcttctgagagaagtgaataagtacatcgtcgaggacacagagcagatcaatcgcgagcgtgaggagaaccaagggaatgtctgtaagtactgtgggaaaatgtgccgctcatcaaattcaatggcattcctcgcacatatacgcactcataccggttcgaagccgtttaagtgcaagatctgccacttcgctacggctcagttaggggacgcccggaatcacgtaaaaaggcacctgggaatgcgggagtacaaatgccatgtttgtggggtggctttcgttatgaaaaagcatctgaatacgcatctcctggggaagcatggtgtgggcacgccgaaagaaagggtcaaggtagcttatcggaagatagggacgctgccaggcattcaaaataacaggaatgcctcctcagccagtgaagctcaatcattgtgcgagcacttctcatag

SEQ ID NO: 14140 - DNA, 5448 bp, Artificial Sequence
  Description of Artificial Sequence: Synthetic coding sequence
atgatggactctgaaaataagcccgagaacgacgaagacgagaaaatcaacaaggaagcacaggatctgactaaactgagcagccataatgaagatggcggtcccgtgagcgatgtgattgcctcatttcctgagaatagtatgggcaagaggggtttctcagagagcagcaactcggatagtgtggtgatcggggaagatcgcaataaacacgcttccaaaaggcggaagctggacgaggcggagcccctgaaatcaggcaaacagggcatctgccggctggagacatctgagtctagcgtcacagagggaggtattgccttggacgaaacagggaaggaaaccttcctgtccgattgtacagtgggcggtacttgtctccccaacgcactgtctccgagctgcaacttctctacaatagatgtcgtgagcctaaagaccgatacggagaagacatcggcccaggagatggtgagcttggatcttgaacgagagagccctttcccgccgaaggaaatctctgtaagctgtacgatcggaaacgtcgacaccgtactcaagtgtagcatctgcgggcacctgttctcctcttgcagtgatctggagaagcatgccgaatcccacatgcagcaacctaaagagcatacctgttgccactgttctcacaaggcggagtcgagcagtgctctccatatgcatattaagcaggcgcatggccctcagaaagtgtttagttgcgacctctgcggttttcagtgttctgaagagaatctactgaacgcgcactacttgggaaagacacatctccggcggcaaaatttggcagctcgggggggttttgtgcaaatactcacaaagcagccgttccctaagaaatctcgcactatggcgaccaaaaacgtgcattccaagcccagaacatctaagtctatcgctaaaaattcggatagtaaaggcctgagaaatgtgggatcaactttcaaagatttcagaggctctattagtaagcagagcggctcttcaagcgaactgctggttgaaatgatgccctcccgaaatactctctcgcaggaggtcgaaatagtggaggaacacgtgaccagtttagggctcgcgcaaaaccccgaaaaccaatctagaaaactggacactctggtgactagtgagggcctactggagaagctggagtcaactaaaaatacccttcaagcagctcacggaaacagtgtcacctctcgcccccgacccgagcgcaatattttggtgctcggcaacagttttcggcggcggtcctctacttttactttaaagggccaagctaaaaaacgattcaacctcctgggcatcaaacggggaacttctgagacgcagcgaatgtacatgaagcacctgcggacacagatgaagacacatgacgcagaatctgttctcaagcacttggaggcgtgcagtagcgttcagagagtctgcgtaacaacctccgagactcaagaagctgagcaggggcagggctcagctaggccacctgactctggcctccacagccttactgtgaaacctgcatctgggtcacagacattgtgtgcttgcacagactgtggccaggtcgctaccaatcggactgacctggagatccacgtgaagcggtgtcatgctcgcgagatgaagttttattgtcggacctgtgactttagctccatgtctcgccgagatttagatgagcacttacacagcaaccaacatcagcagacagcatccgtcttgtcatgtcaatgctgctcgtttatttctctggatgaaatcaacctgagagatcacatgaaggagaagcacaatatgcacttcctgtgtacaccctgtaacctgttcttccttagtgagaaggatgtggaggagcataaagccaccgagaagcacattaattctcttgtgcagcctaagaccctccaaagtagtaacagtgaccttgttctacaaactctcccactttccaccctagagtctgaaaatgccaaagagagcatggatgattcaggaaaggcaagtcaggaggaaccattgaagtccagggtctcccacggaaatgaggttcggcacagttctaagcctcagtttcagtgcaagaagtgtttttacaagaccaggagctctaccgtgctgactcgccacatcaagctgaggcacggtcaagactatcattttctctgtaaagcttgtaacctgtattctctctctaaagagggcatggagaagcacatcaagcgctcaaagcatcttgagaatgcgaagaaaaacaatattggcctgtctttcgaagagtgtatagaacgcgtttgtatcggtgccaacgataagaaggaagagttcgatgtatccggcaacgggcgcatcgagggccacattggggtgcagctacaggaacacagctatctagagaagggaatgttggcgagtgaggagttatcacaatccggggggtccaccaaggatgatgagctggcatccaccactacccctaagagagggcggcctaagggcaacatcagtcgcacatgttctcactgtgggcttctggcgagctcaatcacaaacctcaccgttcacattagaagaaagcattcacaccagtactcctacctttgtaaagtgtgtaagtactatacggttactaaaggcgacatggagaggcactgcgcaaccaagaaacataagggcagggtggaaatagaggcctctgggaaacattcgagcgacatcatcgtcgggcccgaaggaggttcgctagaggctgggaagaagaacgcaggaagcgcagtgaccatgtcggacgagcacgctaataaacctgccgaatccccaacgtcagtcttggagaaacctgatcgcggtaactcaatagaagccgaagtggagaatgtttttcatagcctggacggagaagtcaattcccacctcctagacaaaaaggaacagatatcaagtgagccagaggacttcgcccagcccggcgatgtgtatagtcaaagagatgtgacaggaaccggcgaaaataaatgtctccactgcgagttctcagcacactcaagcgcctctctggagctgcacgttaaaagaaagcatacaaaggaattcgagttttactgtatggcctgtgattactacgcggtgactaggagagaaatgacaagacacgctgccaccgagaagcacaaaatgaaacggcagagctatctgaactcagccaacgtggaggcgggatctgctgacatgagtaaaaacataattatgcccgaggaggagcatcagcagaattctgaggaatttcagatcatctctggccaacccagtgacactctgaagtctagaaatgccgccgactgctccattctcaacgagaacaccaacctggatatgtcaaaagtgctgtgcgccgcagattctgtggaggtggaaaccgaagaagagagcaatttcaatgaggatcacagtttttgcgagacctttcaacaggctcctgtcaaagacaaggtgcggaaacctgaggaaatgatgtccttgactatgtctagcaattacggatctccgtcccggttccagaacgaaaattctgggtcgtccgctttgaactgtgaaacagctaaaaaaaaccatgaaatttcaaacgatgcgggtgaactgcgagtgcattgtgagggtgagggcggcaacgcaggtgacggaggtggtgtggtgccacatcgacatctctgcccggtgacacttgacggcgaacggtcagcggaaagtccagttttggtggtgacgcggataactagggaacaggggaatcttgagtcaggcggtcaaaaccgggttgccaggggtcacggcctagaagatttgaagggggtacaggaggatcccgtcctaggaaacaaagaaattctgatgaactctcagcacgagaccgagtttatcttagaggaagatggtccagcctccgactcaacggtggagagcagcgacgtgtatgaaaccatcatttccatcgatgacaagggccaggcaatgtactcgttcgggagattcgatagttctattataaggattaaaaaccccgaggatggtgagttgatcgaccagtccgaagaggggctcatcgccaccggtgtgaggattagcgagctgccacttaaagattgcgcacaaggagtaaagaaaaagaaatctgaaggatctagcattggcgaaagcacccggatacgttgtgatgactgtggatttctcgccgatggattgtcaggcctgaatgtgcatattgccatgaaacaccccaccaaggagaagcactttcactgtctgctttgcggaaagtccttttacaccgagtctaatctgcaccagcatctggcatcagctggccatatgagaaatgagcaagcaagtgtagaggaattgcccgagggtggcgccactttcaagtgtgtcaaatgcactgagcctttcgactccgagcagaatctgtttttgcatatcaaggggcagcacgaagaactgctgcgtgaagttaacaaatatatcgtggaggataccgaacagattaaccgcgagcgggaggagaaccagggcaacgtctgtaaatactgcgggaaaatgtgtaggtcttcaaattcaatggcgtttcttgcacatatccgaacccacacagggtcgaaacctttcaagtgtaaaatttgtcacttcgccaccgcacaacttggtgacgctagaaatcacgttaaaagacacctgggcatgagagagtacaaatgtcatgtgtgcggtgttgctttcgtaatgaaaaaacaccttaatacgcacctgctggggaagcatggcgtgggcaccccgaaggagagaaagtttacttgtcacctatgcgaccgctcttttacagaaaaatgggcccttaataatcacatgaagctccataccggagaaaaacccttcaaatgtacttggccaacctgccattacagctttttgactgcttctgctatgaaggatcattatcgcactcatactggggagaagagttttttatgcgacctgtgtggatttgctgggggcactcgtcatgccctgacaaagcaccgccgtcaacacactggcgagaagccatttaagtgtgacgaatgcaatttcgcctcaactacccagtcgcacctgacgcgacataaaagggttcataccggtgagaaaccatatcgctgcccatggtgtgattacagaagtaactgtgcagagaatatacgcaagcacattcttcacacaggcaaacatgaaggtgtcaagatgtacaactgtcctaaatgtgactatggcaccaatgtgcctgtcgagtttcgaaatcatcttaaagaacagcatcctgatatcgaaaatcctgacttagcttatcttcatgccggcaaaggccagaaattgtag

SEQ ID NO: 14141 - DNA, 4983 bp, Artificial Sequence
  Description of Artificial Sequence: Synthetic coding sequence
atgatggactcggagaataagcccgagaacgatgaagatgagaagataaacaaagaggcacaagacctcacaaaacttagctctcacaacgaagatggcgggccagtatctgacgtcattgcatcattcccagagaacagtatggggaagcgggggttctcggagtcgagcaattccgactcagtcgtgatcggcgaagatcgcaataaacacgctagtaaacggaggaagttggacgaagccgagcccctgaagagtgggaagcagggcatctgccgccttgaaacatctgagagcagtgtgaccgaaggaggaatcgctctggatgagaccggcaaggagaccttcctgagcgattgtactgtcggcggcacctgtctgccaaacgctctctctccttcctgtaatttctccactatcgacgtggtcagcttgaaaactgacacagagaagacctctgcacaggaaatggtctccctggacctggaacgggaatccccattccctccgaaggagatctcggttagttgcacaatcgggaatgtcgacactgttctgaaatgctcaatctgtggtcatctgtttagttcctgctccgaccttgagaaacacgcagaaagccatatgcaacaacccaaggagcacacttgctgccactgttcccacaaagctgagtcgtcctcagccctgcatatgcacataaagcaagcccatggacctcaaaaggtgttttcatgcgatctttgtggattccagtgcagcgaagagaacctcctgaacgcccattatctggggaaaactcacctcaggagacagaacctggcagccaggggaggtttcgtgcagatcttaacaaagcagcccttccctaaaaagtcgagaactatggcaaccaagaatgtgcattccaagccccgtactagcaagtcgattgccaagaattcagatagcaaaggacttcgcaacgtaggttctactttcaaagatttccggggatcaatatcaaagcagagcggcagttcatctgagctgctcgtggaaatgatgccttctcggaacacgctgtcacaggaggtcgaaatagtggaagagcatgtaacaagtttaggactggctcagaaccccgagaaccagagcagaaagctggatacactggtgacctcggaaggcttgctggagaagctggagtcgaccaaaaacacgctccaagccgcgcatggaaattccgttaccagccgcccacggccggagcgtaatattttagtcctcggtaattcttttcgcagacgcagctccacgttcaccctgaaaggacaagctaagaagcggttcaatctgcttggtatcaagagaggcaccagcgagacccagcgcatgtacatgaagcatcttaggactcaaatgaaaacgcatgatgctgagtccgtcctgaaacacttggaggcctgcagctcggtacagagggtatgcgtgacgacctctgagactcaagaggctgaacagggccaggggagcgcacgaccacccgacagcggactgcactctttgaccgtgaaacctgccagtggcagccagaccctgtgcgcttgtactgattgcggacaggtggccacgaacagaacagatctggaaatacatgtcaaaaggtgccacgctagagagatgaagttctattgccgcacctgcgatttttctagtatgtctcgtcgagatctagatgagcatttgcatagtaaccagcaccagcagacagcatccgttctttcctgccaatgttgttctttcatctctttggatgagatcaatctgcgggatcatatgaaggagaagcacaatatgcactttttgtgcacgccatgcaacttgttctttttgagcgaaaaagatgtagaggagcataaagctacagagaaacacatcaacagccttgtgcaaccgaagacactccagagctctaactctgatctggtcttacaaaccctgcctctgagtacactggaaagtgagaacgctaaggagtctatggacgacagcggcaaagctagccaggaagagccactgaaaagccgtgtgtcccacggcaacgaggtcaggcacagctcaaagccccaattccaatgcaagaagtgcttctacaagacacggagcagcactgtgctgactcggcacattaagctgcgacatggacaggactaccacttcttatgtaaagcgtgtaatctctacagcttgtctaaagaaggcatggagaagcatattaaaagaagtaaacaccttgagaacgccaaaaaaaacaatataggcctgtcattcgaagaatgcatagaaagggtgtgcattggtgcaaatgataaaaaggaggagttcgacgtcagtggtaacggacggattgagggccatatcggcgtgcagctgcaagagcactcctatctggagaagggcatgctcgcctcagaagagctcagccagtcggggggctccactaaggatgatgaactagcatcaaccacgacacccaaacggggcagaccaaagggcaatatctccaggacttgttcccactgtggccttctcgcctcatccattactaatctcactgtccacattaggcggaagcacagtcatcaatacagctatctttgcaaagtgtgcaaatactacactgtgacaaaaggtgacatggagagacactgcgccacaaaaaagcacaaaggccgggtcgagattgaagcttctgggaagcatagtagtgatatcattgttgggcccgagggagggtccctggaagccgggaagaagaacgccgggtctgcggtcacaatgagcgatgagcatgcgaacaagcctgcggagtccccaacttccgtgttagaaaagcccgaccgcggtaatagcatcgaggctgaggtggaaaatgtgttccattcacttgacggagaggtcaattcccatctgttggacaagaaagagcagatatcaagtgaacctgaggatttcgcacagcctggtgatgtatatagtcagcgggatgtcacaggcaccggcgaaaataagtgtctgcattgcgaattttcagcacattcaagcgcttccctggagttgcatgtgaaacggaaacacactaaggagttcgagttttactgcatggcctgtgattactacgcggtcacgcgccgggagatgactcggcatgccgcaacagaaaagcataaaatgaaaaggcagtcgtacctcaactctgcgaatgtggaagcgggatctgccgatatgagcaagaacatcatcatgccagaggaagagcaccaacaaaactctgaagagtttcagattatcagcggccagccaagcgatacactgaagtctaggaatgcggcagactgctctattcttaatgagaatactaacctagatatgagcaaagtgctgtgcgcggccgactcggtggaggtcgagaccgaagaggagagcaatttcaacgaagatcatagtttttgtgaaactttccaacaggctccggtcaaagataaggtgcgcaaaccggaagagatgatgagcttgacgatgagtagcaattatgggagtcctagccgatttcaaaacgagaactccggcagttccgctctgaactgcgagaccgcaaagaagaaccacgaaattagtaatgatgctggggagttaagagtccactgcgagggagagggcggtaatgccggcgatggcggaggcgtggtaccacaccggcacctgtgccctgtcacactggatggcgaacgttctgcagaatcacccgtcctggtggttacacggattacccgagagcaaggcaacctggagtcaggtggccagaatagggtggcacgagggcacgggctagaggacttgaagggggtgcaggaggacccagtgctgggcaataaggagatccttatgaacagtcaacacgagacagagtttatccttgaagaagacggccctgctagtgacagcaccgtggagtccagtgacgtgtatgagaccataatctccatcgatgataaaggccaagctatgtactcctttggccgattcgacagttctattatcaggattaagaacccagaagacggggaactgattgaccagtcagaggaaggtctgatcgctacaggtgtgcgcattagcgaacttcccctcaaagattgcgcccagggcgtaaaaaaaaaaaagagcgagggaagctctattggggagtcaacccggattaggtgcgatgattgtggatttctcgccgatggcctcagcggtttgaacgtgcatatcgccatgaagcaccccacgaaggagaagcatttccattgcctgttatgcggcaagtctttctatacagagtccaacctgcaccagcacctcgcatctgccggacatatgcggaacgagcaagcttccgtggaagaactgcctgaggggggcgccacttttaagtgtgtgaagtgcacagaacctttcgattcagagcagaatttgttccttcatattaagggccagcatgaagagttactgcgtgaggttaataagtatattgtggaagacacggagcaaatcaatcgagagagggaagaaaatcaggggaatgtgtgcaaatattgcgggaagatgtgcagaagttcaaactccatggcgttcctggcccacatcaggacccacacaggctcaaaaccattcaagtgtaaaatttgtcactttgctacagcccaactgggggatgctaggaaccatgtgaaaagacacctaggcatgcgcgaatacaagtgccacgtgtgcggcgtagctttcgtaatgaagaagcatttaaatacccatctgctgggtaagcatggcgtgggtacaccgaaggaaagagtgaaggtcgcctatcgtaaaatcgggacgctccccggcatccagaacaataggaatgcttcttcagcgagcgaagctcagagcctgtgtgaacatttcagctag

SEQ ID NO: 14142 - DNA, 2163 bp, Artificial Sequence
  Description of Artificial Sequence: Synthetic coding sequence
atggaggaagcagaggaattgttgttggagggcaaaaaagcattgcagctagcacgcgagccgaggctggggcttgacctgggctggaaccctagcggcgagggatgcacacaggggctgaaagacgtccccccagaacctacaagagacattctggctctaaaatcgttgccccggggtctggcactgggcccgtcactagcaaaagagcagcgtctcggcgtctggtgcgttggcgaccccctgcaacctgggcttctctggggacccctggaggaggagagcgcttccaaagagaaaggtgagggtgtaaagcctcgccaggaagagaatttaagccttggcccgtggggggatgtgtgcgcctgtgagcagtcatcaggctggacctcccttgtacagagggggcgactggagtcagagggcaacgtggctcctgtgagaatttccgaaagactgcatctccaggtgtatcagttagtgctgccagggtctgaacttctcctgtggcctcagccctcgtcagagggaccaagtttaacccaaccaggtctggacaaggaagcggcggtcgctgtggtgaccgaagtggagagcgccgtgcagcaagaagtcgccagcccaggggaagacgcagccgaaccttgcatcgaccctggatcacaatctcctagcggcattcaagctgaaaacatggtgtcccccggtctgaagttcccgacacaggaccgcatttctaaagactctcagccactgggacctttgctgcaagacggtgacgttgacgaagaatgtcccgcccaggcccagatgccccctgaattacagtcaaattccgctactcaacaggatcccgatggcagcggggcttcattctccagctctgcccggggtacacagcctcatggctatctggcaaagaaactccactccccctccgatcagtgcccgcctcgagctaagactcccgagcccggggcccagcaatctggatttcctacacttagtaggtcccccccaggccctgccgggtccagtcctaaacaaggtagacggtacaggtgtggggagtgtgggaaggccttcctccaactttgccaccttaaaaagcacgccttcgttcatactggacacaaaccgttcttgtgtactgaatgtgggaagtcctacagtagtgaagagtcttttaaggcacacatgctcgggcatagaggagtaaggcccttcccctgccctcaatgcgataaagcctacggaactcaacgcgacctgaaagaacaccaagtggtacactcaggcgcacgccccttcgcatgcgatcagtgcggtaaggccttcgccagaaggcccagcctgcgtctgcatagaaaaacccatcaggtgccagctgcccctgcaccctgtccttgccctgtttgtggtcgcccgctggcaaaccagggcagcctacggaatcatatgaggctgcatacaggcgagaaaccgttcctgtgtcctcattgcggaagagcctttcggcagcgaggcaatctgcgaggacacctgaggctgcataccggcgagcgtccgtatcgatgcccccactgtgcagacgcttttcctcagctgccggagctgaggcgacacctgattagccacactggggaagctcatctatgtcccgtatgcggcaaagccctgagggaccctcatacactgagagcccacgaaaggttacattccggcgagagaccatttccctgtccacaatgtggccgggcttataccctggcaacaaagctgcgcagacatctgaagtctcacctggaagacaaaccatatagatgtcctacctgtggaatgggatacaccctgcctcaatctcttagacgacaccaactgtcccacagaccagaggcgccctgtagtccaccttccgtgccatccgcagccagcgagccgaccgtagtgctgctacaagcagagccccagcttttggacactcacagagaagaggaagtgagtcctgccagggacgttgtggaagtgacgataagcgaaagtcaggaaaaatgcttcgtcgtgcccgaggagccggacgccgccccatccctcgttcttatccataaagacatgggactgggggcctgggcagaagtggttgaggtggaaatgggaacctag

SEQ ID NO: 14143 - DNA, 597 bp, Artificial Sequence
  Description of Artificial Sequence: Synthetic coding sequence
atggagaagcccgcggggagaaaaaagaaaacacccactccaagggaggaggctgacgtgcagaagtccgctctgagagaagaaaaggtgtccggcgaccgcaaaccaccagagagaccgacagttcccagaaaaccaaggacagaaccatgtctgtcaccagaggacgaggagcacgtctttgacgcgtttgatgccagtttcaaagacgacttcgaaggtgtgccagtgttcattccgttccaacgcaagaagccttacgagtgcagcgaatgcggacgtatttttaagcacaaaacggaccacatcaggcaccaacgagtgcacacaggcgagaagccctttaaatgcgctcaatgtgggaaggcctttcggcactcttcagacgtgacgaagcatcagagaacccatactggggaaaaacccttcaaatgcggagaatgtgggaaggcatttaattgcggcagcaacttactcaaacatcagaagactcacactggagaaaaaccatacgagtgtactcactgtggtaaagcatttgcgtacagcagttgcctgattcggcaccaaaaacgacatcccagaaagaaaccctag

SEQ ID NO: 14144 - DNA, 597 bp, Artificial Sequence
  Description of Artificial Sequence: Synthetic coding sequence
atggaaaaaccagctggacgaaagaaaaaaacccccacgccccgggaggaggcggacgtccagaaatctgccctgcgcgaagagaaagtgtctggggaccgaaaacctcctgagcggccaaccgttccaaggaagccccgcacagaaccttgcttatcccccgaggacgaggaacacgtctttgatgcgttcgacgcctccttcaaggatgattttgagggagtcccagtgtttatcccctttcagcgaaaaaagccgtacgagtgcagcgagtgcggacgcatattcaagcacaagaccgaccacatcaggcatcagcgggtgcataccggagaaaagcctttcaaatgtgcccagtgcggtaaggcatttaggcatagttccgatgttaccaagcaccagcggactcacaccggtgagaagcccttcaagtgcggcgaatgtgggaaagcatttaactgcggctctaatctcctcaaacaccagaagacccacacaggagagaagccatatgaatgcacacactgtggaaaagcctttgcctacagctcatgcctgatcaggcatcaaaagcggcatccacgtaagaagccttag

SEQ ID NO: 14145 - DNA, 597 bp, Artificial Sequence
  Description of Artificial Sequence: Synthetic coding sequence
atggagaagccggctggcaggaagaagaaaacacccacacctagagaggaagcagatgtgcaaaagtctgcactgcgggaggagaaagtgagcggagaccgaaagccccctgaacggcctaccgtaccgcggaagcctaggactgagccatgtttatccccagaagacgaggagcacgtgtttgatgcttttgatgcaagcttcaaagacgatttcgaaggtgtgccagttttcatcccgtttcagcgtaagaagccttacgagtgctctgaatgcggacgcatctttaaacacaaaacagatcatattcgccaccaacgggtgcacaccggtgagaagccctttaaatgtgcacagtgtggcaaggcattccggcacagctcagatgttacgaaacatcaaaggacacacactggtgagaagccgtttaagtgcggcgagtgtggaaaggccttcaactgcggaagcaatctgctcaaacaccaaaaaacccatacgggtgaaaaaccgtacgaatgcacccattgtggtaaagcctttgcctatagctcttgcctcattcgtcatcagaagcgccaccccagaaagaaaccttag

SEQ ID NO: 14146 - DNA, 1296 bp, Artificial Sequence
  Description of Artificial Sequence: Synthetic coding sequence
atgctgtccgacgagctcgagagcaagccagagctcctggtccaatttgtgcaaaatacttcgataccacttggtcagggtcttgtcgaatcagaagccaaagatatcacatgcctgagcctgttgcctgtaaccgaggcctctgaatgctcccgcttaatgctccctgacgataccaccaatcactctaactcaagcaaagaagtcccaagctccgctgtgctgcgctccttgcgagtcaatgttggccctgatggtgaagagacgagagcacagactgtgcaaaaatcaccagagttcctttctactagcgagagttcatcgttgcttcaggacctccaacccagcgattcgacttcattcattttattaaatttgacaagagccggattgggatcttctgcagaacatctggtgtttgtgcaggacgaagccgaagacagcggaaacgactttttgtcatcagagagcacggatagcagcatcccctggtttttaagggttcaggaactggctcatgattcgctgatcgctgcaaccagggcccaattagctaagaacgctaagaccagttccaacggcgagaacgtgcacctgggttccggtgacgggcagtctaaggactccggtcctttaccacaggttgagaaaaagctgaagtgtactgtggagggatgtgaccgtacttttgtgtggcctgcacactttaaataccacctcaagacacacaggaatgacagatcttttatttgcccagccgaggggtgcggaaagtctttctatgttttgcaaagactgaaagtccatatgcggactcataatggcgaaaagccgttcatgtgtcatgaatcaggttgcggcaagcagttcactaccgcagggaatcttaagaaccatcggcgcatacacacaggagagaagccttttctatgcgaagctcaaggctgcgggcgaagcttcgcagaatattcttccctccggaagcatctggtggtgcactctggggagaagcctcatcagtgtcaggtttgtgggaaaacgttctcccaaagtggtagtcgcaatgtgcatatgcggaagcatcacctgcagcttggtgccgcggggagccaggaacaagagcagaccgaagtgctcgctgagggctcacccaggtccctgtcgagtgtgcccgatgtaacccaccatttagtgacgatgcaatctgggcggcagtcttacgaagttagcgttcttacagcggtcaatccccaggagcttctaaatcagggggatctgactgagcgccgcacctag

SEQ ID NO: 14147 - DNA, 1278 bp, Artificial Sequence
  Description of Artificial Sequence: Synthetic coding sequence
atgctgccggacgataccacgaaccacagtaacagttctaaagaggttccatcgtcagcagtgcttcgctctctccgggttaacgtaggacccgatggagaggagaccagagcacagaccgtacagaagtctcctgagttcctgtccacaagtgagagttcctcgttgctccaggatttacaaccgagtgattctacatcctttattctgttgaatctgactcgcgcaggcttggggtccagcgcagagcatctcgtgtttgtgcaggatgaggccgaggacagcggcaatgactttctgagttcagagtctacggatagtagcattccttggtttctccgggtccaagagctggctcacgattctcttatcgccgccacacgcgctcaactggccaagaacgctaagaccagttctaacggcgagaacgtgcatctgggttccggcgatggacagtcaaaagattccggccccctcccgcaggtggagaaaaaacttaaatgcaccgtggagggatgcgatcggacgtttgtctggcctgcacattttaagtaccatctgaagacccaccggaatgacaggagctttatttgccccgccgaggggtgtgggaagagcttttatgtgttacaacgtcttaaagtgcatatgagaacacataatggggagaagccattcatgtgtcatgaaagcggctgtgggaagcaatttactactgcggggaacctgaagaatcatcggcggattcatactggtgagaaaccgttcctgtgcgaggcccaggggtgcggccgtagtttcgctgagtactcatctttaaggaagcatctggtagtgcattcaggtgaaaagcctcatcagtgccaggtgtgcgggaaaacattttctcagagtggctcaaggaatgtgcacatgcggaaacatcatctgcagctaggggccgcaggttcccaggaacaagagcaaactgcagagcctcttatgggaagctctctgttggaagaggcttcagttccaagcaagaatctcgtcagcatgaactcacagccatcactgggcggagaatcgctgaatctgccaaacacaaatagcatactaggagtcgatgacgaggttctggccgaggggtccccccgctcgctttcatcagtcccggatgtgacccaccacctggttaccatgcagtccggaagacagagttatgaggtgtctgtcctcacagccgtgaatccccaagagcttctgaaccagggagacctgacagagcgtcggacctag

SEQ ID NO: 14148 - DNA, 1551 bp, Artificial Sequence
  Description of Artificial Sequence: Synthetic coding sequence
atgctctccgatgaattagaaagcaaaccagagcttcttgtgcagttcgttcagaatacctctataccgctggggcaggggttagtcgagtctgaggcgaaagacatcacatgtttgtccttgctgcccgtaactgaagcatctgaatgctccaggctgatgttacccgagcccgtcccatggcgagaggaggacgggaaatctggttgttcggacctgaacgataccacaaaccatagtaacagctccaaggaagtcccctcatctgcagttcttaggtcgttgcgggtgaatgttggccctgacggcgaagagacacgcgcccagacagtgcagaagtccccagagttcctgtcaacatctgaaagctctagtctgttacaagacttgcaaccttcagacagcactagcttcatcctgctgaatctgacccgggctggccttggcagctcagcagaacaccttgtattcgtccaagacgaggctgaggactctggaaatgactttctgtccagtgaaagcaccgattccagcatcccatggttcctgcgggtccaggaattagcccacgatagcttgatcgcagcaacccgtgcacagctggctaagaatgccaagaccagcagcaatggtgagaacgttcatctgggtagcggcgatggacagagtaaagattccgggccactcccgcaggttgaaaagaaactcaaatgcactgtcgaagggtgcgataggacattcgtgtggcctgctcacttcaaataccacctgaagacccatcgcaatgacaggtcatttatctgccctgctgaggggtgcgggaagtcgttttacgtgctgcagcggctcaaggtgcacatgcgcacacacaatggtgagaagcccttcatgtgtcacgaatccgggtgtggaaaacagtttaccaccgccggaaacctgaaaaaccatcgcaggattcatacaggagaaaaaccatttctctgcgaagcgcaaggttgtgggaggagctttgctgagtatagttcactgcggaagcacctagtggtacactccggagagaaaccccaccagtgccaggtttgcggaaaaacttttagtcagtctgggtctagaaatgtgcacatgagaaagcatcatctccaactgggagccgctggctcccaagagcaggaacagaccgccgagccactcatgggtagtagcctccttgaagaagcctctgtcccatccaaaaatttagtcagcatgaactctcagccctcacttggtggagagagcctaaatctgccaaacactaacagtattcttggcgttgatgatgaagtgttggctgagggctcccccagaagtttatcctccgtgccagacgtgacccatcacttggtgaccatgcagtctggacggcagtcctatgaagtttcagttctcaccgccgtgaacccccaagagtcgctggccccattacctcggcttgaatgtagcggcgcatttagcgcccattgcaatctgtgtctgcctggctcctcagactctcctgcctctgctagctag

SEQ ID NO: 14149 - DNA, 1404 bp, Artificial Sequence
  Description of Artificial Sequence: Synthetic coding sequence
atgctgagtgatgaacttgagtccaagcccgagctcctggtgcaattcgtccaaaacacctccattcccctgggacaggggctggtcgaaagcgaggcgaaggatattacctgtctgtccttactcccagtgaccgaagcgagcgagtgcagtcgtcttatgttgccagacgacactacaaaccattctaattccagcaaggaggtaccaagctcggcggtgctccgaagcctgcgcgttaatgtgggcccagacggagaggagtttctgtccacgtctgagtcatcctccctcctgcaagatctccaaccttccgacagtacatccttcatcttattaaatctgacaagagctggtcttgggtcttcagctgagcatctcgtgtttgttcaagacgaggccgaagactcaggcaatgacttcctctcttctgagtcaacggatagtagcattccatggtttttaagggtccaggagctggcacacgatagcctgattgccgctacacgggcccagcttgccaagaacgcaaagacatcgtccaatggagaaaacgtacatttaggatccggcgatggacagtccaaggactccggtcccctgccccaagttgaaaagaagctgaagtgcactgtcgagggctgcgatcgaaccttcgtctggcccgcgcattttaagtaccacctgaaaacgcaccggaatgatcggagctttatctgccctgcagaaggctgtgggaaaagcttttacgttttacagcgactgaaagtgcacatgaggacccataacggcgagaaaccctttatgtgtcacgagtctggatgcggcaagcaattcacaaccgctggcaatcttaaaaatcatcggcggatccacaccggggaaaaaccatttctttgtgaggcccaaggatgcggacggtcatttgccgagtacagttctctgcgcaaacacctggttgtgcatagcggggaaaaaccgcatcagtgccaagtttgcgggaagacgtttagccaatccggaagccgcaacgtccatatgcggaagcatcatttgcaacttggggccgccggatcccaggagcaggagcagactgcagagccgttaatggggtcatcacttctcgaagaggccagcgttcctagcaaaaatctcgtttctatgaattctcagcctagccttgggggagaatcattgaatctgccaaacaccaacagtattcttggagtcgatgacgaggtccttgccgagggcagtccgcggtctctcagcagcgtgccagatgtcactcaccaccttgtgacgatgcagtcaggacgtcagtcatatgaggtgtctgttttgacagctgtgaacccccaggagctcctgaatcagggcgatctgacggagaggaggacatag

SEQ ID NO: 14150 - DNA, 1218 bp, Artificial Sequence
  Description of Artificial Sequence: Synthetic coding sequence
atgctgtcggacgaactggaatcaaaacccgagctgctggtgcaattcgtccaaaatacctccatccccctggggcagggcctggtggagagtgaagcaaaagatatcacctgcctatccctgcttccagtgacggaggcaagcgagtgtagcaggctgatgctgcccggtctaggttccagtgctgagcacctcgtgttcgtccaggatgaggctgaagattcgggcaacgacttcctgtcaagcgagtccacagacagtagcatcccctggttcctccgggttcaggagttggcccatgactctctgatagccgccactcgcgcgcaactggccaagaatgcaaaaacctcgtccaatggcgagaacgtgcacctcggatcgggagatgggcagtcgaaagatagcgggcccctcccccaggtggagaagaaattgaagtgcacagtcgagggctgcgatagaacctttgtgtggcctgcccattttaaatatcacctgaagacccacagaaatgatagaagcttcatctgcccggcggaggggtgcggcaagagtttctacgtgcttcagagactaaaggtccatatgagaactcataatggtgaaaagcccttcatgtgtcatgaatctggttgcgggaagcagtttacaacggcgggcaacctcaagaaccatcgcagaattcatactggggagaagccatttctttgcgaagctcagggatgtggccggagttttgccgagtatagctctctcagaaagcacctcgtggtgcatagcggggaaaagccgcatcagtgccaagtctgcgggaagactttcagccagagcggaagtcggaatgtccatatgcggaaacatcacttgcaactgggagccgccgggagccaagagcaggagcagacagcggaaccactcatgggttcatctttactggaagaggctagtgtgccctctaagaacttagtgtcaatgaactcgcaaccttccctgggcggggagtctttgaaccttcctaatactaattcaatccttggcgtcgatgatgaggtgctagccgaaggaagcccaaggtccctttctagtgtgcccgatgtgacccaccatctcgtgacaatgcaatccggcagacaaagctacgaggtgagcgtactcacagcagtgaaccctcaggagctgttgaaccaaggtgacctgactgagaggcgaacatag

SEQ ID NO: 14151 - DNA, 213 bp, Artificial Sequence
  Description of Artificial Sequence: Synthetic coding sequence
atgctgagtgacgaactggagtccaaacctgagttactggtccaatttgtgcagaacaccagcatacctctcggtcagggtctagtggaaagtgaggccaaagatatcacttgtctcagcctgctaccggtcacagaggccagcgaatgttccaggctaatgttacccgatgatacaaccaatcactctaatagcagcaaggaggtcccttag

SEQ ID NO: 14152 - DNA, 1437 bp, Artificial Sequence
  Description of Artificial Sequence: Synthetic coding sequence
atgctgtcggatgaattggagtccaagcctgaattgttggtgcagttcgtgcagaacactagcatccctttaggccaaggcctggtcgagtccgaggcaaaggatatcacttgtctgtcccttctccccgtgactgaggcaagcgaatgttctaggctgatgcttccagatgacacgactaaccacagcaacagtagtaaagaggtgccgagctccgcggtgctccgatcgttacgggtgaatgtgggccctgatggggaagaaacacgcgctcagaccgtccagaaaagccccgaattcctgagcacgagcgagtcatcaagcttactccaagacctgcagccctccgattccacctcattcatcttgctgaacctgaccagagcaggcttaggcagcagtgcagaacacctggtgtttgtccaggacgaagcagaggacagcgggaacgactttctgtctagcgagagtaccgattcaagcatcccttggttcctgagagtgcaggagctggcccacgattctctcatcgccgcgaccagggcccaactggcaaagaacgcgaaaacgagttctaatggcgaaaatgttcatttaggttctggagacgggcagtctaaggactcaggccctctcccacaagtggagaaaaaattaaagtgtacggtggaggggtgcgaccgaacatttgtgtggccagcccacttcaaatatcatctgaaaacacatagaaatgatcgatctttcatttgccccgccgaagggtgcggtaaaagtttctatgtgcttcagagactgaaggtacatatgagaactcacaacggggagaagcctttcatgtgccatgaatctgggtgcggcaagcagtttaccacggctggaaacctgaaaaaccatcggagaatccacacaggagagaagcccttcttatgcgaagcacagggctgcggtagatcttttgcagagtactccagtctgaggaagcatctggtggtgcacagcggtgagaagccccaccagtgccaagtatgtggcaaaacttttagtcagagcggttctaggaatgtgcacatgagaaagcatcatctccagctcggcgccgcaggatctcaggagcaggagcaaacggctgaaccactcatgggcagttccctacttgaggaagcctccgtaccctcaaaaaacctcgtctctatgaattctcagccatcgctggggggagagagcctcaacttaccaaataccaatagtatcctcggggtcgacgatgaagtcctggccgagggtagtccgaggtccctgagcagcgtcccggacgtcactcatcatttggttacaatgcagtcagggcggcaatcctatgaagtctcggtgttgacagcggtcaatccacaggagctgctgaaccagggtgatctcaccgaaagacgtacatag

SEQ ID NO: 14153 - DNA, 225 bp, Artificial Sequence
  Description of Artificial Sequence: Synthetic coding sequence
atgctctctgacgagctagaaagtaagccagaactactggtccagtttgtacaaaatacttcgattcccctgggacagggcctcgtcgaatccgaggcaaaagacatcacttgcctgagccttctgccagtgaccgaagcatccgaatgtagccggctgatgttgcctgacgacactaccaaccattcaaactcctctaaagaagtgccttccagcgcagtgtag

SEQ ID NO: 14154 - DNA, 381 bp, Artificial Sequence
  Description of Artificial Sequence: Synthetic coding sequence
atgttgagtgacgagctggaatccaagccagagctcttggtacaatttgtacagaatacctcaataccactgggacagggacttgtcgagagcgaagctaaagatataacctgcctgagcctccttccggttaccgaggcctctgagtgctcccggcttatgctaccggatgatacaacaaaccactcaaactcaagcaaagaggtgccttcttctgccgtgttgagatcgctgagggtcaacgtgggacctgacggggaggagacccgcgctcagaccgtccagaagtcacccgagtttctatcaacttctgaaagctcaagcctcctccaggacttacagccaagcgattctacatctttcatacttctgaacctgtag

SEQ ID NO: 14155 - DNA, 819 bp, Artificial Sequence
  Description of Artificial Sequence: Synthetic coding sequence
atgctgtctgacgagctggagagcaaaccagagctcttggtgcagttcgtgcaaaacacttcaattcccctgggacaaggtctagtggaaagtgaggctaaggatataacgtgcttatcattgttgccagtcaccgaggcgagtgagtgctctagactgatgctgcctgatgacacaactaatcatagtaactcatctaaagaagtcccatcaagcgcagtcctccgatccctccgagtgaacgtcggccctgacggggaagaaacgagagcacagactgtgcagaagtccccagagttcctgtcgacaagtgagtcttcatcattgttgcaggacctgcagccgtcagattccaccagcttcatcctgctgaatctaacacgcgctggattagggtcctcagcagaacatttagtgtttgtgcaggatgaagccgaggattctggcaatgattttctgtcttccgaatctacggactcttcaatcccttggttcctgcgggtgcaagagcttgcccatgattctctaatcgcagcaactcgcgcccagttggcaaagaacgctaaaacctcttccaatggtgagaatgtgcacctggggagcggcgacggccaatcaaaagactctgggccactgccccaggtggaaaaaaagctgaagtgtaccgtggaaggttgcgaccgcacattcgtctggccagctcactttaaatatcaccttaaaacccaccgcagattgtgggaaaagttgttgtgcgccgctgaggcggaaggcgcccacgaggacccacaatggagagaagcattgtacgttccatag

SEQ ID NO: 14156 - DNA, 939 bp, Artificial Sequence
  Description of Artificial Sequence: Synthetic coding sequence
atggaagagaagcctagtgggccaatccccgacatgttggcgactgccgagccatcttccagcgagaccgataaggaggtgctgtcaccagctgtgcccgctgctgcaccttcttctagcatgtccgaggagcccgggcccgaacaggcggccacccccccggtctgggaaaggggcggcgcgggtgggatgcaacaaggttcttctccagcccctgacagctgtcagcccggccctggaccatcccctggcctgaccagtattgtatcaggtacctcggaggacctccggccacctaggcgcagacccccgcctgggaaacagattccgtgcagttcgcctggctgttgcctgagcttcccgtctgtgcgtgaccttgcacagcacttgcggacacactgtccgcccacacagagtcttgagggcaagctgttccggtgcagcgcactgtcatgtactgaaacttttccaagcatgcaggagctggtggctcactcaaaactgcattacaagcctaaccgctattttaaatgcgaaaattgcttgctccggttcagaacccatcggagcctgttcaagcacctgcacgtgtgtgccgagcacgcccagtcaccggctccacctccaccaccagccctggatcgcgaacctcctgctcctgagcgacctcccgaggtcgatccggccagcgcccctggcctgccgttcccacttctggagccgttcacaacacctgcccctgcacctacgggtccatttttgccttacctgaatcctgcgccgtttggactgtcccctccacggctcaggcccttcctggccgccgcaccgggccctccagctagtagcgctgctgtgtggaagaagtcacagggtgccggctcttctcctcgcaggccccagggtggtagcgatgcaccttctggggcatgtagatag

SEQ ID NO: 14157 - DNA, 1173 bp, Artificial Sequence
  Description of Artificial Sequence: Synthetic coding sequence
atggaggagaaaccctcgggccccatccccgatatgctggcaaccgccgaaccttctagtagcgagactgataaagaggtgctgtctcctgcagtacccgccgcagcaccttcgagcagtatgtcggaggaaccaggtcctgaacaggccgcgactcccccagtgtgggaacggggtggcgcaggggggatgcagcagggtagctctcccgcgccagattcatgtcagcctggtcccggcccaagccccgggttgaccagtatcgtgtccgggacgtccgaagatctgagaccacctcgcaggcggcccccgccaggaaagcagattccctgctcaagccccggctgctgccttagcttcccgagcgtgagggatttagcgcagcatctgcgcacccattgtccaccaactcagtcactggaaggtaagctgttcaggtgttcagccctcagttgcaccgaaacctttcccagcatgcaggagctggttgcccatagtaaattgcattacaaaccgaaccggtattttaaatgcgagaactgtctgctaaggttcaggacacacagatctcttttcaagcacctccatgtgtgtgccgaacacgcccagtcaccagcgccgcctccaccccccgcgctcgatcgggagccccctgcccccgagcgcccaccagaggtggatccagcaagcgctccaggcctgccctttccattgctcgagccattcacaacccccgcccccgcccctactggacctttcctcccgtacttgaatcccgcccctttcggactctcaccacctcgcctgcgcccctttctggcagcagctccggggccacctgcgtctagcgcagcagtctggaagaagagccagggagctggatccagtccccgccgtccacaggggggctctgatgctccgtctggtcatgcagcaccatctaggatcgtttgggaacacacccgaggccgttatagctgcatgcagtgcgccttcagcaccgcttcccgccccgctatgacacttcatcttgaagaccacagacctggcgccccagccgcacctgctgccggcccaccccggccagacgcccccgccgacccggcacccttggcaccgaaagtttcccctttattgagcgagggcgaacttcctgtattctctcagctgtag

SEQ ID NO: 14158 - DNA, 1785 bp, Artificial Sequence
  Description of Artificial Sequence: Synthetic coding sequence
atggccgctgcggtcctaagggattcgactagcgtccctgttaccgccgaggccaaactgatgggattcactcaagggtgcgtcacttttgaggatgtggccatctatttcagtcaggaggagtggggacttctggatgaagctcagaggttgctgtatcgggacgtaatgttagagaatttcgcgctcatcaccgctcttgtctgttggcatggaatggaggacgaagagacccctgagcagtccgtgtcagtggaaggcgtgccacaagtacgcacccccgaggcatctccttctacgcagaagatacagagctgcgatatgtgcgtaccgttcctgacagacattttgcacctgactgacttgcctggtcaagaactctacctgaccggagcttgtgccgttttccatcaagatcaaaaacatcattccgccgagaaaccactcgagagcgacatggataaagctagctttgtgcagtgttgcctgttccacgagagcgggatgccgttcacaagttccgaagtgggaaaagactttctggcaccattaggtatattgcagccccaggcgatcgccaattacgagaaacctaacaaaatctcaaaatgtgaagaggcttttcacgtgggtatctcacactataagtggtcacagtgtcgcagggagagctcacataaacataccttttttcatccgcgcgtctgcaccgggaaacgactatatgagtcctccaaatgcggaaaagcatgttgttgcgagtgttccctcgttcaactgcagcgggtccatcccggcgagagaccttacgagtgttctgagtgtggcaaaagcttctcccagacttcacaccttaatgaccacagaagaatccataccggagagaggccttacgtctgcggacaatgcggcaaatctttctcacagcgggccacactaataaagcaccatcgcgtgcatacaggcgagaggccttatgagtgtggcgagtgcggcaaatcgttttcccagtcttcgaacctgatcgaacactgcaggatccacaccggcgaacgaccgtacgagtgcgatgagtgcggaaaggcgttcggaagcaaaagtacccttgtaagacatcagcggactcatactggcgaaaaaccatatgaatgtggcgaatgtggaaagctcttccggcagagtttttccctcgtggtccatcaaaggatccatacaaccgcaagaccttatgaatgtgggcaatgtgggaagtctttcagtttaaagtgcggactcatacagcaccagctgattcatagcggagcaaggccctttgaatgtgacgaatgtggtaaatctttctctcaacgaaccactctcaacaagcaccataaagtgcatactgctgagcgtccgtacgtctgcggcgagtgtggtaaagccttcatgtttaaatcgaaattggttcggcaccagaggacccataccggagagagaccgttcgaatgtagcgaatgcggcaaattctttcgccaatcttacactctcgttgagcaccagaaaatacataccggattgaggccctacgactgtggacaatgcgggaaaagttttatccaaaaatcttctttgattcagcatcaagtggtgcatacaggcgaaagaccgtacgagtgtggaaagtgcggcaaaagtttcacacagcatagcggcttgatccttcacagaaagtcacacaccgttgaacggcccagagattcctccaaatgcggaaaaccgtatagtcctcgcagtaatattgtgtag

SEQ ID NO: 14159 - DNA, 1434 bp, Artificial Sequence
  Description of Artificial Sequence: Synthetic coding sequence
atggccgctgcggttctgcgagactctaccagcggctgcgtgacctttgaggatgttgcaatttatttctcacaggaagagtgggggttactggacgaagcccaacgccttctgtatcgcgatgtcatgctggaaaatttcgcacttataaccgcactagtttgttggcatggtatggaggacgaagaaacgccggaacagtccgtgagcgtggaaggggttcctcaggttcgaacgccagaagcttcaccctctacccaaaaaatccagtcttgtgatatgtgtgtgcctttcctgacagatatcctgcatttaaccgatctacctggtcaggagctctatctgacaggagcctgtgccgtctttcatcaggatcagaagcaccatagcgccgagaagccgctagaatccgatatggacaaagcatccttcgtccagtgctgtttgtttcacgaaagcggcatgccctttaccagctctgaggtcggaaaagattttctagcaccgttgggtatcttacagccccaggcaatagccaactacgaaaaacccaataagatctccaaatgcgaggaggcttttcacgtaggcatctcccactacaagtggtcccaatgcagaagagagtcgtcacacaaacacacttttttccatcccagagtgtgtaccggaaaaaggttatatgagtcctcaaagtgtggaaaagcttgctgttgcgaatgcagtctcgtgcagctccagagggtccacccaggcgaaagaccatatgagtgcagcgagtgcggaaagtcttttagccagaccagccacctcaacgaccaccggagaattcacaccggggaacgcccctactacgagtgcggcgaatgcggcaagtccttcagccagagtagtaatctcatcgagcactgccggattcatacaggggagcggccatacgagtgcgacgagtgtgggaaggcgtttggttctaagagtaccctggtgagacaccagcgaacacataccggcgaaaaaccatatgaatgtggagaatgtgggaaactgtttcgccagagcttctccctggtggtccaccaaagaatccacactacagcaagaccgtacgaatgtggacagtgcgggaaaagtttctctcttaagagcaagctggtgcggcatcagcgaactcataccggggaacggccttttgaatgcagcgagtgtggcaagtttttccggcagtcatatactctggtggagcatcaaaaaatccacactggcctcagaccctatgactgcggacagtgtggtaagagtttcattcaaaaatcctccctgattcaacaccaggtcgtccataccggggagcgaccctacgagtgtgggaagtgtgggaagtcttttactcaacacagtgggctaatcctgcaccgcaagagccacaccgtttag

SEQ ID NO: 14160 - DNA, 1419 bp, Artificial Sequence
  Description of Artificial Sequence: Synthetic coding sequence
atgggattcacgcaggggtgtgttacctttgaagatgtggccatatacttctctcaggaggaatgggggctcttggacgaggctcaaagactgctttatcgggacgtgatgctggaaaactttgcactcatcacagcactggtgtgctggcacggcatggaggacgaggagacccctgaacagtcagtgagcgtagaaggggttccacaggtaagaactccagaagcttccccgagtactcagaaaatccagtcctgcgacatgtgtgtaccattcctgactgacatcctgcacctgaccgacttgccagggcaggagctctatcttactggggcatgcgccgtgttccaccaggaccaaaagcaccacagcgctgagaagcctctggaaagcgatatggacaaagcgagcttcgtgcagtgctgcctatttcatgagtcaggaatgccctttacaagctccgaggtggggaaggactttctcgccccactgggcattttgcaacctcaggctatcgcgaattatgaaaagcctaacaagatatccaaatgcgaggaggcatttcacgtcggcatttcacactataaatggtcacaatgtcgcagagaatctagccacaagcacaccttcttccacccacgcgtctgtactggcaaaagattgtatgaaagcagtaagtgcggtaaggcgtgctgttgtgagtgctcgctagttcagcttcagagagtccatcccggcgagaggccctacgaatgctccgaatgtggaaaaagtttctcccagaccagccatctgaacgatcaccgccgtatccacacaggtgaaaggccgtacccttatgaatgcggcgaatgcggcaaacttttcagacagtcctttagccttgtcgttcaccaaagaatacatacaaccgcaaggccttatgagtgtggccagtgcgggaaaagcttttcactcaagtgtggcctcatacagcatcagctgatccattctggagcccggcctttcgagtgcgacgagtgtgggaaatcgttcagccagagaaccacgctcaacaagcatcataaggtccatacagcagaacgaccttatgtatgtggagagtgcggcaaggcgttcatgttcaagagtaaactcgtaaggcatcaacggacccacactggcgagcggcccttcgagtgctccgaatgcggcaagtttttcaggcaatcttacacgcttgtagagcaccagaagatccacaccggcctacgaccctacgattgcgggcagtgcgggaagagtttcatacagaagagtagcttaatccagcaccaggtggtacatacaggagaaagaccatacgaatgcgggaagtgtggaaaatcatttacacagcattccgggttgatattgcacaggaagtcccacacagtgtag

SEQ ID NO: 14161 - DNA, 1728 bp, Artificial Sequence
  Description of Artificial Sequence: Synthetic coding sequence
atggccgccgcggcgccgcgccggcccacacagcaggggaccgtcacgttcgaggacgtggccgttaactttagccaagaggagtggtgccttctcagtgaagcgcagcgctgcctctaccgtgacgtgatgttggagaaccttgctcttatttccagcctggggtgttggtgtgggagcaaggatgaggaggcaccttgcaagcaaaggatttccgtgcagagagagagtcaatcccgaactccaagagccggggtgtcccctaaaaaggcccatccatgtgagatgtgcggccttattcttgaagatgtgtttcactttgctgaccatcaggaaacgcaccacaagcagaagttaaaccgctccggggcatgcggcaaaaatctcgatgacaccgcttacctgcaccaacaccagaagcaacacattggcgaaaaattctaccggaaatccgtcagagaggcctccttcgtgaagaagaggaaactccgagtcagccaggagcccttcgtattccgcgagtttggtaaggacgtccttccctcctccggcctctgccaggaagctgcggcagtggaaaagaccgatagcgaaaccatgcatggccccccattccaggagggaaagacaaactacagctgcggcaagcgcaccaaagccttcagtaccaaacacagcgttatcccgcaccagaagctgttcactcgggatggctgttacgtatgttcggactgtgggaagagtttttcaaggtacgtgtcatttagcaatcatcagcgcgaccatacagccaaggggccatacgattgtggggagtgcggtaagagctatagtaggaaatcgtctctgatccagcaccagagggtgcacactgggaagaccgcctacccttgcgaggaatgtggcaaatcatttagccagaaggggagtctgatttcgcaccagcgggttcacactggagagaggccttatgaatgtagggagtatggtaaaagctttggccagaaagggaacctgattcagcaccagcagggccacacaggagagcgtgcgtaccactgcggggagtgcggaaagagttttcgccaaaagttttgctttatcaatcaccagcgggtgcatacaggcgaaaggccctataaatgcggggagtgtggcaaaagttttggtcagaagggtaatttggtgcaacaccagcgagggcataccggtgagaggccctacgagtgtaaagagtgcggtaagtcattccggtaccgatcgcatcttacagaacatcaacgcttgcacactggagagcgcccctataattgtagagagtgcggcaagctgttcaaccggaaataccacttgctggtgcatgagagggtgcacactggggagaggccctatgcctgcgaggtgtgtggtaagcttttcggcaataagaattgtgtcaccattcatcagagaattcatacaggtgaaagaccatacgaatgcaatgagtgtggcaagagtttcctatcatcctccgctctccacgtgcacaagcgggttcacagtggccagaagccctataagtgttcagagtgcgggaaaagtttcgctgaatgcagctcactgatcaaacatcggcgaatccatactggggaaagaccgtatgagtgtacaaaatgtggaaaaacctttcagcgaagtagtacactgctgcatcaccagtctagccataggcgaaaagccctgtag

SEQ ID NO: 14162 - DNA, 1131 bp, Artificial Sequence
  Description of Artificial Sequence: Synthetic coding sequence
atgcatgggccgcctttccaagaaggtaaaactaattatagttgcggaaagcggaccaaggcgttctccacgaaacacagcgtgatcccccaccaaaagttatttaccagggatggctgctatgtgtgcagtgattgcggtaagagcttcagccggtacgttagtttctccaatcaccagagagatcatacggctaaagggccttatgactgtggcgagtgcgggaagtcttactcgaggaaaagcagcctcattcagcatcagcgggtccacactggaaaaacagcctacccctgtgaggagtgcgggaaaagcttttcacagaagggatctctgattagccaccaacgagtccataccggcgagaggccatatgagtgccgcgagtatggcaagtcgtttggccagaagggcaacctgatacagcaccagcagggacatacgggtgagcgcgcttaccattgtggagagtgcggtaagtccttccgtcaaaagttttgcttcatcaatcaccagagggtgcacaccggcgagaggccctacaagtgcggcgagtgcggtaagtcattcggccaaaagggaaacctggtccagcaccagcgagggcatacgggcgaacgaccatatgaatgtaaggaatgtggtaagtctttcaggtacagaagccacctgactgaacaccagcgcctccacacaggagaacgcccttataattgccgtgaatgcgggaaactttttaatagaaagtaccacctactcgttcacgagcgagtgcatactggcgagcgtccttatgcatgcgaggtgtgcgggaaactgtttggaaataaaaattgtgtgacaatccaccaaaggatccacacaggcgaaagaccgtatgagtgtaatgagtgcggcaaatcctttctatcgtcttccgccctccacgtccataaaagagtgcacagcgggcagaaaccttataaatgcagtgagtgcggaaaatccttcgcagagtgcagctccctgataaaacaccgtagaatccataccggagaacgaccctatgagtgcacaaaatgtgggaagacctttcagagatcttcaaccctgctccatcatcagagctcccaccgccggaaggcactgtag

SEQ ID NO: 14163 - DNA, 2031 bp, Artificial Sequence
  Description of Artificial Sequence: Synthetic coding sequence
atgcaaggaaccgtcgcctttgaggacgtcgccgtcaatttcagccaggaggagtggagcttgctgagcgaagtgcagcgctgcctgtatcatgatgtgatgctcgaaaactgggtgttgatttcctcacttggatgctggtgcggtagcgaggatgaagaagccccaagcaaaaagtcgatctcaatacagagagtgagtcaggtatcaacaccaggtgctggcgtcagtccgaaaaaggcccattcatgtgagatgtgtggcgctatcttgggggatatattgcacctggctgaccatcagggtacccaccacaaacagaaactgcatcgatgtgaagcatggggcaacaaactctacgattccagtaatcggccacaccaaaaccagtatctgggcgaaaagccctacagatcatctgtggaagaggccctcttcgttaagagatgtaagttccatgtgagcgaggaatctagcattttcatccaaagtggcaaggactttcttccgagttccggactgctcctgcaggaggccacccatactggcgaaaagagtaactcaaaaccggagtgcgagagcccgttccagtggggggacacacactactcatgtggagaatgtatgaaacatagctcaacaaagcacgtttttgttcagcagcaacgcctcccttcccgagaggaatgttattgctgggaatgcggaaagtcattctcaaagtatgattctgtctctaatcatcagcgcgtacacacaggcaaacgaccatatgaatgcggagaatgcggcaagtcgtttagccataaaggaagtctggtccagcatcagagagtccatactgggaaacggccatacgagtgtggagaatgtggaaagtctttttcccacaagggttctctggtgcagcatcagcgggtccacacgggggaacggccatacgaatgtggcgagtgtggcaaatcttttagtcagaacgggacactgatcaaacaccaaagggttcacacaggcgaaaggccctatgaatgtgaagagtgcggcaaatgtttcactcagaaaggaaatctgattcaacaccaacgaggtcatactagcgagcgcccatacgaatgcgaggagtgtggaaagtgcttttctcagaaaggcacacttacagagcatcatcgggttcatacccgagagcgcccctatgaatgcggggagtgcggtaagtcatttagccgtaaggggcaccttcggaatcaccaaagggggcatacaggggagaggccatatgaatgcggggagtgcggaaaatcttttagccgcaagggcaacttgatacagcaccagaggtctcacaccggcgagagaccatacgagtgccgcgaatgtagaaagctgttccgaggaaagtcccacctcattgaacaccaaagggtgcatacaggggagcgtccctacgaatgcaatgagtgcggcaaatcatttcaggactcctccggattcagagtgcatcagcgggtacatacaggggagaaaccattcgagtgttccgaatgtgggaagtctttcccacagtcgtgttctttactgaggcaccgtagagtacacactggagagcgaccttacgagtgcggcgagtgcggtaagtcgtttcatcagtcgagctcactgcttaggcatcaaaaaacacataccgccgagcggccttatgagtgccgggaatgcgggaaattcttcagcagtcttttggaacatagaagagtgcatacaggcgagcggccctatgaatgccgggaatgtggcaagaccttcactagacggtccgctcatttcaagcaccaacggttacacacccgaggtaagccctatgagtgctcagaatgcggcaaaagcttcgctgaaacatttagcttgaccgagcatagaagagtacacacgggtgagcggccttacgagtgcagtgaatgcggaaagagctttcaccgcagcagttctttgctccgccaccaacgggtgcatacagagcggtctccctataagtag

SEQ ID NO: 14164 - DNA, 2094 bp, Artificial Sequence
  Description of Artificial Sequence: Synthetic coding sequence
atgcaggagggcctccaccgtatgacatgggactgcatcgccatcggcagccatgaaaattccgttcaagggacggtagccttcgaagacgtagcagtaaatttctcccaggaagaatggtcattgctcagtgaagtgcagaggtgcctgtaccacgatgttatgctcgagaattgggtcttaatctcttccctcgggtgctggtgtgggtcagaggacgaggaggctccttctaagaagtctattagcatccaaagggtatcccaggtcagcacccctggtgctggagtgtctccaaagaaagcccatagctgcgagatgtgtggagcaattttaggagatatcttacacctagcagaccatcagggcacccaccacaaacaaaaactccaccgctgtgaagcatgggggaacaagctctatgacagttcaaatcgcccccaccaaaatcaatacctgggcgaaaaaccttatcggtcgtctgtggaggaggctctgtttgtgaagagatgcaaatttcacgtttcggaggagagctccatcttcatacagtctggcaaagacttcctaccgtccagtggcctcttactgcaagaagctacccataccggggagaagtccaattcgaagccggagtgtgaatcaccattccagtggggagatactcattattcatgtggagaatgcatgaagcattcctcaacgaaacacgtttttgtgcaacagcaacgcctacctagcagagaggagtgttattgttgggagtgtggaaagagtttctctaaatatgacagtgtcagtaaccatcagcgcgtgcacacaggtaaacgcccttatgagtgcggcgaatgcggaaagtccttttcacataaaggttctttggtccagcatcagagagtgcacaccgggaagaggccctacgagtgcggtgagtgcggcaagtcattttcccataaagggagcttagtccagcatcagagagtgcacactggcgagcgcccgtacgaatgcggcgaatgcggcaaatccttcagccagaacggcacccttattaaacaccagagagtgcatactggggagcgcccttacgagtgtgaggaatgcggaaaatgctttacccagaaggggaacttaatacagcatcagcgagggcacaccagcgagcggccttacgagtgtgaggaatgcggaaagtgtttcagtcagaagggcaccttgacagagcaccacagagtgcacacaagggagcgcccctatgaatgtggcgagtgcggtaagtccttttcacgtaagggccaccttcgcaaccaccaaagaggtcacaccggagaacggccctatgagtgtggcgagtgcggaaaaagcttctctcgtaagggaaacctgatccaacaccagcgtagtcacacaggagagcgaccatatgagtgtcgcgaatgtagaaaactgttcagggggaaatcgcacctaattgagcatcagagagtgcacacaggagagagaccctacgagtgcaatgagtgtggaaagtcctttcaagactctagtggatttcgcgtgcatcagagggtccacactggggagaagccgtttgaatgcagcgagtgtggcaagtcgtttccgcagtcttgctctctgctgcggcaccgaagagtccacacaggcgagcgtccatacgagtgcggggagtgtggcaaatctttccatcagtcatcgtccctgctccgccaccagaagacccatactgctgaacgcccatacgagtgccgggagtgtggcaagtttttttctagtttactggaacataggcgggtgcacactggcgaacgtccatatgaatgcagggagtgtggaaagacttttaccagaagatctgcccacttcaaacaccagcggctgcacactaggggaaagccctacgaatgttctgaatgcggtaagtccttcgctgagaccttctctctaacagaacataggcgcgttcacaccggagaacgtccttacgagtgctccgaatgtggtaagagctttcacaggtcctcctctttattgcgtcaccaaagagtacataccgaacgcagtccctacaaatag

SEQ ID NO: 14165 - DNA, 1929 bp, Artificial Sequence
  Description of Artificial Sequence: Synthetic coding sequence
atggcggctgcggctctcagactgccagctcaggtggtgggcgttgaccaaaaaatgaggcgccacctgctgaggcgtgcgtttctttacaaagaatgcctccgctcggccctgctaggccaggtgtctcctaagaaggcccacagctgtgagatgtgcggcgcaatacttggagacatcctgcacctggcagatcaccaaggtactcaccacaaacagaagttgcatcgttgtgaagcctggggcaataaactctacgattcttctaataggccacaccagaaccagtacctgggagaaaaaccgtacaggtcgagcgtcgaggaggctctcttcgtgaagaggtgtaaattccacgttagtgaggagtcctctatatttatccagtctgggaaagattttctcccgtcctcagggcttcttttgcaggaagccacacacaccggggagaaaagcaatagtaaacccgaatgcgaatccccctttcagtggggcgacactcactactcttgcggagaatgcatgaagcatagttctacaaaacatgttttcgtgcagcagcagagactgccgtccagggaagagtgttattgctgggaatgcgggaaatcatttagtaagtacgatagcgtgtccaaccaccagagggttcacaccggaaaaagaccatatgagtgcggagagtgtggaaagagctttagccacaagggatccctggttcaacatcagcgcgtgcacacaggaaagaggccttacgagtgcggagaatgcggtaagtcttttagccacaagggatctctggttcaacaccagagggtgcacacaggcgagaggccttacgagtgcggcgagtgtggcaagagtttctctcagaatggtactctaatcaagcaccaaagagtgcacaccggggagagaccctatgaatgcgaggagtgcggtaaatgcttcacgcaaaaaggcaacctgattcagcatcagagggggcatacatcagagagaccctacgagtgcgaagaatgcggaaagtgcttcagccagaagggcacccttactgagcatcatagggtccatacacgggaacgtccgtacgagtgtggcgagtgcggcaagtccttttcacgcaaggggcacttgagaaaccaccagcgggggcacaccggggagaggccttatgagtgtggagagtgtggcaagtcgttctctcggaaaggtaacctgattcagcatcagagatctcacacaggggaacgaccctatgagtgcagagaatgccgaaaactttttcgcgggaagtctcatctgattgagcaccagcgcgtgcacacgggagagcgcccgtacgaatgcaatgagtgtgggaaaagcttccaggacagctcaggcttcagagtccaccagcgagtacacaccggagagaagcccttcgagtgctcagagtgcggcaagtccttcccacagtcctgtagcctgctccggcaccgcagggttcatactggcgaaaggccctatgaatgcggggagtgtggaaaatcatttcaccagagtagttctctgctgagacatcagaagactcataccgccgaacgaccatacgagtgtcgagaatgtggtaaattcttttctagtcttctcgagcatcgcagggtgcataccggagaaagaccctacgagtgtcgggagtgcggtaagacatttacgagacgatctgctcattttaagcaccaaagactgcacacaaggggtaagccttatgagtgttctgaatgcggcaagtctttcgccgaaacattcagcctgacagagcaccgccgcgtgcacactggagagcggccatatgagtgttcggagtgcggaaagtctttccatagaagtagctccttgcttcgtcaccaacgcgtgcacaccgaaaggtcaccttataagtag

SEQ ID NO: 14166 - DNA, 1083 bp, Artificial Sequence
  Description of Artificial Sequence: Synthetic coding sequence
atgccggaattggtggtgacagctttattggcccccagccgcctaagcctgaaactgttgagggcctttatgtggagtttggttttctcggtggctctcgtggccgccgctgtctatggctgcattgcgctaacccatgtcttatgtagaccacgtcggggatgctgtggtagaagacggagcgcctcacccgcctgtttaagcgacccgtcgcttggcgagcacggtttccttaatctcaaatcttccggtcttaggctgcactatgttagtgcagggcggggaaatggtccgttaatgctgttcctccacggattccctgaaaattggttttcctggaggtatcagttgagagaattccagtcccgtttccacgttgtcgctgtggatctccgaggctatggcccctcagacgcgcctcgagatgttgattgctatacaatcgatttactgctagttgacatcaaagatgttatcctcgggctgggatatagtaagtgtatcctggtggctcatgattggggcgctctgcttgcctggcatttcagcatctactacccaagtctcgtcgaaagaatggtggtcgtatcaggagctcccatgagcgtgtatcaggactattccctccatcacataagccaattctttagatcccactatatgttcctgttccagctgccatggctgcctgagaagctgctctctatgtccgactttcagatcctgaagactacgctgactcacagaaagacaggaattccgtgtttgacgcccagtgagctggaggccttcctgtacaatttctcccagcctggtgggttgacaggtcctctcaactattaccggaatctctttcggaactttccactggagccacaggagctgacgactcccactctattactgtggggagaaaaagatacctaccttgagctcggtttagtagaggcgattggatctcggttcgtccccggtaggctggaggcacatatccttcccggtatcgggcattggattccccagtccaatccccaggagatgcaccagtacatgtgggcttttctccaggatctgctggattag

SEQ ID NO: 14167 - DNA, 1290 bp, Artificial Sequence
  Description of Artificial Sequence: Synthetic coding sequence
gaccctgtacaggggtatgtaacttttgaggatgtcgccgtatatttcagccaggaggaatggagactgctcgatgacgcacagcgcttgttgtaccgaaatgtgatgctggaaaactttacactcctggcgagcctgggcaagcatcctgagttgggttcggcttttcccccgtttccgcgggagcgctcacttgccgtgagcctgatggaccttattcccggtggcctgagtgtgcaactttcacaccagtgtgattgctgtctgaccgtattatttctcgtgctgcatgtatctccatcccaccagcagaacccaagcgctgtggctttcactgagtgcgtggtggtcgggatggagcggctcctgagctctaatattcaacaacaccagaagcagcattgcggagaaaagcccctcaagcggcaagaagggcgtgtgcctgttctgcgtagctgtaaagtgcatctcagcgagaagtccctgcagagccgcgaagtcgggaaggcactcctgattagctccggagtgttaaaacaccaggtgacccacaccggcgagaaatcacacaggtcctctaaatcaagggaagcctttcacgcaggaaagcgtcactataaatgctccgagtgtggaaaagcattcggccagaagtacctgctggtccagcaccagcggcttcacaccggcgagcgtccatacggctgcagcaactgcggcaagtcgttctccagaaacgctcatttgattgaacaccagcgtgtccataccggagagaaaccctttacatgttcggaatgcggcaaggcattccgccacaattcaacactcgttcagcatcataagatacatacaggagtcagaccatacgaatgtagcgaatgtggcaaacttttctcgttcaacagttcactaatgaaacaccagaggatacacacaggggagaggccatataaatgttccgaatgtgggaaattttatagccataaatctaatcttataaaacactggcgcgtgcacaccggtgaacggccttataagtgtagtgactgtggcaagttcttcactcagtgcagttctctaatgcagcaccagaaggtccacaccggtgaaaaacccttcaaatgcaacgagtgcgggcgttttttcagagagaattctacccttgtgcgccatcagagggtacacacgggtgccaagccatacgaatgtagagagtgtggcaaattctttagtcaatccagcactttgatgcagcatcggaaggtacacatcggcgagaagccgtag

SEQ ID NO: 14168 - DNA, 1437 bp, Artificial Sequence
  Description of Artificial Sequence: Synthetic coding sequence
atggctgcagcggctcttcgagatcccgcccaagtacccgtggccgcggacctactgactgatcacgaagaacagggttacgtgaccttcgaagacgtggccgtgtacttttctcaggaagaatggcgcctgctggatgacgcgcagcgactgttgtatcgcaacgtaatgctggaaaactttacccttctagcatcactgggctgctggcacggggctgaggctgaagaagcaccggagcagatcgccagcgtgggcctgctctctagcaacattcagcaacaccagaagcaacactgcggcgagaagcccctcaagagacaagaaggacgagtaccggtgttgcggagttgtaaagtacacttatctgagaagtcattgcagtctagggaggtaggaaaagcactcctgatatcatctggagtccttaaacaccaggtgacccatactggggagaaatcacaccgcagttctaagagtcgggaggcttttcatgccggaaaacgtcactacaagtgctctgagtgtggcaaggcgttcgggcagaagtatttactggtgcagcatcagagactgcatgctggcaagaaaacctatgagtgctccgaatgtggcaagctctttcgggacatgtccaacttgtttatccaccagatcgtgcacacaggcgaaaggccctacggttgctcgaactgcgggaagtccttcagccgcaatgcacatctgatagaacaccagagagtgcacactggcgagaagcctttcacgtgcagcgaatgcggtaaggcttttcgtcataattcaaccctggtgcagcaccacaagatccatacaggggtgagaccttatgagtgtagtgagtgtgggaagctgttctcatttaacagtagcctcatgaaacatcagcggattcacaccggcgagcggccctataaatgctccgaatgtgggaaattctattcgcataagtccaatttgattaaacactggagagtgcacaccggggagaggccttataagtgttccgattgtgggaagttcttcacacagtgcagctcattgatgcagcaccagaaggtacacaccggcgagaaaccatttaagtgtaatgagtgtgggaggttttttcgtgagaattcaaccctcgtgcgacaccagagagtgcacacaggggcaaaaccctacgaatgccgagaatgtgggaagttcttttctcagagtagtaccctgatgcagcacaggaaagtgcatatcggagaaaaaccattcaagtgcaacgaatgcggaaggttgttccgcgaaaactcctcgctcgtgaagcaccagcgagtgcacacaggcgccaaaccttatgaatgccgtgaatgcgggaaattcttccggcataattcttccctgtttaaacacaggcgtattcacaccggggagatgcagtag

SEQ ID NO: 14169 - DNA, 1329 bp, Artificial Sequence
  Description of Artificial Sequence: Synthetic coding sequence
atggccgccgcggcattgagggatccagcccagcaggggtatgtgacattcgaggacgtggccgtgtattttagtcaggaggagtggcgactgctggatgatgctcagagactgctttacagaaatgtaatgctcgaaaattttacacttttggccagcttaggattggcatctagcaagacacatgaaattactcaacttgaatcctgggaagaaccatttatgccagcatgggaggttgtgacatcagcaattcctagaggatgctggcacggagccgaggccgaagaggctcctgagcagatcgccagcgtgggcctgctaagctccaacatacagcaacatcagaagcagcactgcggcgagaaaccactgaaacgccaggaaggaagagtgcccgtgctacgatcatgcaaggtacaccttagtgagaagtctctgcagtcaagggaggtgggcaaggcactgttgattagttccggagttcttaaacaccaggtgactcataccggcgaaaagagccacaggtccagcaagtcccgagaggccttccatgcaggtaagagacattacaaatgttcggagtgtggaaaggcgttcggccagaaataccttcttgtgcagcaccagagactacatgctggaaagaagacatacgagtgctcagagtgcggcaaactcttcagagacatgtccaatctatttattcaccaaattgtgcacaccggcgaaagaccatatggctgctcgaactgtggaaaaagctttagccggaacgcgcacctgattgagcatcaaagagtgcacactggagagaagccatttacttgctccgagtgtgggaaggcttttaggcacaactccacactggtacaacatcacaagatccacaccggcgtacggccttatgaatgttctgagtgtgggaaactgttctcatttaattctagtctgatgaagcaccagcgcatacacactggagagcggccttacaaatgtagcgaatgcggcaagttttactctcacaagtccaacttgatcaaacactggagagttcatacgggagaaaggccctacaaatgctccgactgtggtaagtttttcacacagtgctcatccctaatgcagcaccaaaaagtccacacaggcgaaaagccctttaagtgcaacgaatgtggccgattcttccgtgaaaactctagcctggtaaaacaccagcgggtgcacaccggcgctaagccatacgagtgcagggaatgtgggaagttctttaggcacaactcatctctgttcaagcaccgcaggattcataccggggagatgcagtag

SEQ ID NO: 14170 - DNA, 1395 bp, Artificial Sequence
  Description of Artificial Sequence: Synthetic coding sequence
atggcagcagccgcccttcgggatcctgcccagggctatgtcacatttgaggatgttgcggtatacttcagtcaagaggagtggcgcctactcgatgacgcccagcgccttctctatagaaacgtaatgctggaaaattttaccctgctggcatccctcgggtgctggcatggcgcggaagcagaggaagcacccgaacagattgcctccgtcgggctcttgtcatcaaatattcagcagcaccagaaacaacattgtggggaaaaaccactgaagaggcaggaaggacgggttccggtattacgtagctgcaaggttcatctctctgagaagagtctccagtcacgtgaagtcggaaaagcgcttcttatttcgagcggggtactgaaacaccaggtgacacacaccggcgagaagtctcaccggtcttctaagagcagggaggccttccacgcggggaagagacattacaagtgctcagagtgtggtaaagcctttggacagaaataccttctcgtacagcaccagaggctccatgccgggaaaaaaacatacgaatgctccgaatgtggcaaactttttagggacatgtccaacctgttcattcaccagatcgttcataccggagagaggccatacggatgctctaactgtggaaaatctttttcccggaacgctcatctgattgagcaccaaagagtgcataccggcgagaagccattcacctgttctgagtgcgggaaggcattcaggcataattctaccctggttcaacaccataagatccataccggcgtccggccttatgagtgcagcgagtgcggcaagctgtttagttttaattcatcccttatgaagcaccagagaattcacactggggagcgaccgtacaagtgttccgagtgtggtaaattctatagccacaaatccaatcttatcaagcactggcgagtgcacactggcgagcggccctacaagtgttccgattgtggtaaattttttactcagtgctcatccttgatgcaacaccagaaggttcacaccggcgagaagcccttcaaatgtaatgaatgtggccgttttttcagggagaactcaacactagttagacatcagcgggttcataccggcgccaagccctatgagtgtcgtgaatgtggtaagtttttttctcagtcatcgactctcatgcagcatcgcaaggttcatatcggcgagaaaccatttaagtgcaatgagtgtggcaggctgttccgggaaaattctagcttggttaaacaccagagagtgcacacgggcgcaaagccctatgagtgtcgcgagtgtgggaagttcttccgacataactcttccctgtttaagcaccgaagaattcacacaggtgaaatgcagtag

SEQ ID NO: 14171 - DNA, 1536 bp, Artificial Sequence
  Description of Artificial Sequence: Synthetic coding sequence
atggccgctgccgcccttagagaccccgctcaggtgcccgtggcggccgatttacttacagaccacgaggagcagggctacgtgaccttcgaagatgttgctgtatacttcagtcaagaagaatggcgattactcgatgacgctcagagactactctacaggaacgtaatgttagaaaacttcaccctattggcgtcattaggactagcgtcatctaagactcatgagatcactcagttggaaagttgggaagagccgtttatgcccgcttgggaggttgtgacaagcgcaatcccccgcggttgttggcacggcgcagaagccgaggaggctcctgagcagatcgccagcgtaggccttctgagttcaaacattcagcagcatcagaaacagcattgtggcgaaaaaccactgaagcgacaagagggtagggtccccgtgctgcgctcgtgcaaagtgcatctgagcgagaaaagtttgcagtcccgcgaagtgggaaaggccttgttgatatcctcgggcgtcctgaaacatcaagtgacacatactggagagaagagccataggagttctaaatcccgggaggcttttcacgccggaaagaggcattacaagtgctctgaatgtggcaaggcctttggacagaagtatctgctggtccagcaccagaggctgcatgccggcaagaaaacttatgagtgtagcgagtgtgggaagttgtttcgtgacatgtctaacttattcatccaccagatcgtacatacaggcgaaaggccatacggctgttccaattgtgggaaatcatttagtagaaacgctcatctcattgagcatcagagggtccatactggtgagaaacccttcacatgttccgagtgtggaaaggcttttcgccacaactcaacactggtacagcaccacaagatccacacaggggtgcgcccttatgaatgttccgagtgtggaaaactgttttcctttaattcttctctgatgaaacaccagaggatccatacaggcgaaaggccctacaaatgctcagaatgtgggaagttttattcccataaaagtaaccttatcaaacactggcgtgtgcacactggtgaacgcccctacaagtgttctgactgcggcaagtttttcacccaatgcagctcactgatgcagcaccagaaagtgcacaccggagagaaacccttcaagtgtaatgagtgcggccgtttctttagagaaaactctactttagtccgacatcagcgggtgcatacaggtgccaagccatatgagtgtagagaatgtgggaaattcttttctcagtctagcaccctgatgcagcacaggaaggttcacatcggggaaaagccatttaaatgtaatgaatgcggtcgactcttccgagaaaactccagtttggtgaaacatcagcgcgtacacaccggcgcaaagccttacgaatgcagggagtgcgggaagtttttcagacacaacagttccctgttcaaacacaggaggattcataccggagaaatgcagtag

SEQ ID NO: 14172 - DNA, 1497 bp, Artificial Sequence
  Description of Artificial Sequence: Synthetic coding sequence
atggccgccgccgctctgagagacccagctcagcagggatacgtcaccttcgaagatgtggccgtgtacttttctcaggaagaatggagactgttagatgatgcacagcgcttgctgtatcgcaacgtcatgctcgagaactttacgttacttgctagtcttggtctggcaagctctaagacacacgagataacgcagctggaatcttgggaagagccttttatgccagcttgggaggtcgtcacttccgctattccgcgtggttgctggcatggagctgaggccgaagaagctcccgagcaaatcgcatccgtcggcctactgagcagcaacattcagcagcaccagaagcagcactgtggtgagaagccactgaaaaggcaagagggaagagtccccgtgctgcgttcttgcaaggtacacttatccgagaaaagcctgcagagtcgtgaggtcggtaaggctctgttaatctcctccggggtgttgaaacaccaggttacccataccggcgagaagtcccataggagctcaaaaagccgcgaagcctttcacgctggaaaacgacattataagtgttccgaatgcggtaaggcctttggccaaaagtatctactggtccagcaccaaagattgcatgccggcaagaagacttacgagtgttctgaatgtgggaagctgttcagagatatgtctaacctattcatccatcagattgtgcacaccggggaaaggccctacggatgttccaattgtggaaaaagtttctcccgcaatgctcaccttatagagcatcagcgcgtgcacaccggagaaaaaccgttcacatgctccgaatgtgggaaggccttccgtcataatagcaccctggtccagcaccacaagatacacacaggggtgagaccatacgaatgcagcgaatgcggcaagctgttcagttttaattcgtccttgatgaagcaccagcgcatccataccggagaaaggccatataagtgttccgagtgcgggaaattttattcccacaagtccaacctcatcaaacattggagggtgcacacgggggagcgcccgtacaagtgcagcgattgtggcaaatttttcacacaatgttcctcgctaatgcagcaccagaaagtacatacaggcgagaaaccgttcaagtgcaatgagtgcggtcgatttttcagggagaactctactctggtgaggcaccagcgggtacatacaggggccaaaccctatgagtgtagagagtgtgggaaattcttctcccaatcctcaacactgatgcaacaccgaaaagtgcacatcggggagaagccgttcaagtgcaacgagtgcggtcggctgttccgcgagaattctagcctggtgaagcatcaaagagtgcatacaggagcaaaaccatatgagtgcagagagtgcggaaagttttttcggcataacagttcattgtttaagcataggcgaatccataccggggaaatgcagtag

SEQ ID NO: 14173 - DNA, 477 bp, Artificial Sequence
  Description of Artificial Sequence: Synthetic coding sequence
atggccgcagctgctctgcgcgatcctgcccaagtccctgtcgccgctgatctgctcaccgaccatgaagagggctacgtcacctttgaggatgtggcggtctatttctcccaggaggagtggagattactggatgacgctcaaaggctgctctacaggaatgttatgctggagaattttacactcttggcttctttaggctgctggcacggcgccgaggccgaggaggctccagaacagattgcaagcgttggactgctggaggtgctcgccaagcagggaggctgcagcgggaagaagacttatgagtgttctgagtgcggcaagctgttccgcgatatgtctaatctctttatccatcagatagtccacaccggcgagcgtccctatggatgttctaactgcggcaagagtttctctcgaaacgctcacctgatcgagcatcagagggtccacacaggtgagaagcccttctag

SEQ ID NO: 14174 - DNA, 1494 bp, Artificial Sequence
  Description of Artificial Sequence: Synthetic coding sequence
atggccgctgcagccttgagggaccctgcccaggggtacgtcacattcgaggatgtagccgtatacttctcccaggaggaatggagattgctcgatgacgcccagaggctgctgtatcggaatgtgatgcttgagaactttacactgctagcctccctaggcttggcctctagcaagacccacgaaatcacacagcttgaatcttgggaggagcctttcatgcccgcctgggaggttgtgacaagtgcaataccgcgcggctgctggcacggagcggaggcagaagaagccccagaacagatcgcctcggttgggcttctgtcctccaacattcaacaacaccagaagcaacattgcggggaaaaacccttgaagaggcaggagggtagagtcccagtgttacgaagctgcaaagtccacttgtccgaaaaatctttacaatcgcgcgaagttggcaaagcgctcctcatcagtagcggtgtcttgaaacaccaagttacccatacaggagaaaagtcgcacagaagtagtaaaagtcgcgaagctttccacgccggcaagaggcattacaaatgcagcgagtgcggcaaagctttcggccagaagtacctcttggtgcagcatcaacgtctgcacgcaggcaaaaagacttatgagtgttctgagtgcggtaagctgttcagagacatgtctaacttatttatccatcaaatcgtgcacacaggcgagcgcccctacggatgttccaattgcgggaaaagctttagtaggaacgcccacctcatagagcaccagagagtgcatactggcgagaagccttttacctgtagcgagtgcggcaaggcgttcagacataacagcaccttagtgcaacaccacaaaatccacaccggcgtgaggccctatgagtgttccgagtgtggcaaactcttttcttttaatagctctttgatgaaacaccagagaatacacacgggcgagagaccttataagtgcagcgaatgcgggaagttttatagtcataagagcaacttgattaagcattggcgggtccatactggagagcgcccttataaatgttcagattgcggcaagttttttacccagtgttcgtccttgatgcaacaccagaaagtacataccggagagaagccctttaagtgcaacgagtgcggcaggtttttcagagagaattccaccctcgtccggcatcagcgggtgcatacgggcgctaagccatatgagtgtagagagtgcggtaaatttttctctcagtcgagcaccctgatgcaacatcgaaaagtccatatcggcgagaagccattcaagtgcaacgagtgcggccgccttttccgagagaatagctcactggtaaaacaccagcgtgtccacacaggcgcaaaaccatacgaatgcagagaatgcggaaaatttttcaggcacaatagtagtctctttaaacacagaagaatccacactggggagatgcagtag

SEQ ID NO: 14175 - DNA, 1335 bp, Artificial Sequence
  Description of Artificial Sequence: Synthetic coding sequence
atggccgcagccgccctgcgagacccggcacaagtgcctgtggccgccgacctgctgacagatcatgaggagcagggctacgtgacattcgaggatgtggcagtgtatttctcccaggaggaatggagactcctggacgacgcccagagactgctgtacagaaacgtgatgctggaaaattttacactactggccagcctcggactggcttcaagcaaaactcacgagatcacccagctggagagctgggaggagcctttcatgcccgcatgggaggtggtcacatccgcaatacctcgcggatgttggcatggcgccgaagccgaggaagcaccagaacaaatcgccagtgttggtctgttgagcagcaacatccagcagcaccagaaacaacactgcggcgaaaagccactgaagaggcaagagggccgcgtccctgttctgcgatcttgcaaggtacatctttctgagaaaagtctgcagagtcgagaagtgggaaaggctctgctgataagctcaggggttctcaagcatcaggtcacgcacactggagagaagagccatagaagctctaaatcacgcgaggcattccacgctggaaagagacactataaatgctctgagtgtggcaaggcatttgggcagaaatacctgttggtgcaacatcagagactgcatgctggaaagaaaacatatgaatgttccgagtgtggaaaactatttcgagacatgagcaacctttttattcatcagattgtacacaccggagagcgaccctacggctgctcaaactgcggtaaaagcttctctcggaacgctcatctgatcgaacatcagcgcgtgcataccggcgagaagcccttcacttgttccgagtgtggaaaggccttcagacacaattcgaccctggttcaacatcacaaaattcacaccggggtgaggccatatgaatgcagtgaatgcggtaagctgttctccttcaatagttcgttgatgaagcaccagagaatccatactggcgagaggccgtacaagtgttctgagtgcggaaaattttatagtcacaaatcgaatcttattaaacattggcgtgtgcatactggggagagaccatataaatgttcggactgtggaaagttctttactcagtgctcctcattaatgcagcaccagaaggtccacactggggagaaacccttcaagtgtaacgaatgcggtcgattcttcagggaaaactctactctggtgaggcatcagagggtgcatactggtgccaagccgtacgaatgtcgcgaatgcgggaagttttttagtcaatcctccaccttaatgtag

SEQ ID NO: 14176 - DNA, 366 bp, Artificial Sequence
  Description of Artificial Sequence: Synthetic coding sequence
atggcagccgcagctcttcgtgaccctgcccagcagggctacgtgacttttgaggatgtcgccgtttatttcagtcaggaagagtggcggttactggatgatgcacagagactcctctataggaacgtcatgcttgaaaatttcactctccttgcatccctgggttgctggcatggagctgaggccgaggaggcccctgagcagatcgcaagcgtgggcctactatcctccaacatccagcagcaccagaagcagcattgcggagagaagcccctgaagcgccaggagggcagagttcccgtgctgcgctcctgtaaggtgcacttatcagagaaaagcctgcaatctcgagaggtgggaaagtag

SEQ ID NO: 14177 - DNA, 408 bp, Artificial Sequence
  Description of Artificial Sequence: Synthetic coding sequence
atggcggccgccgcactgagagaccctgctcagcaagggtatgtgacatttgaggatgtggcagtttatttcagccaggaggagtggaggctgttggacgacgcccagagactactgtacagaaacgtaatgttagagaatttcacattgctggcctccctagggctggcaagtagtaaaactcacgaaattacacagctggagtcctgggaagagccatttatgcctgcctgggaggtcgttacttccgcgatccctagaggatgctggcacggagcagaggccgaggaggctcctgagcagatcgcatcagtaggactgctgagttctaatatacagcagcaccagaaacagcattgtggcgagaagcccttgaaaagacaagagggcagagtgcccgtactgtag

SEQ ID NO: 14178 - DNA, 1611 bp, Artificial Sequence
  Description of Artificial Sequence: Synthetic coding sequence
atggctagaaaactcgttatgtttcgcgacgtggctattgatttcagccaagaagaatgggagtgccttgattctgcccagcgggatctttaccgtgacgtaatgctcgaaaattattccaatttagttagcttggatctgcccagcagatgcgccagcaaagacttgagtcctgaaaagaacacttatgaaactgagctgagtcagtgggagatgagcgatagactcgagaactgcgatctcgaggaatccaattctcgggattaccttgaagccaagggcaagatggagaaacagcaggagaaccagaaggaatactttaggcagggaatgataatctatgacaagatgagcatctttaaccagcatacctacctgtctcagcattcccgatgtcacagtacagaaaagccttacaaatgtaaagaatgtgggaaagcctttcggcgcgctagtcacctaacgcaacatcagtccatccacacaggagaaaagccatacgagtgtaagcagtgcgggaaagcattcagtcgcgactcgcagctgtcactgcaccagagactgcatactggtgagaaaccatacgcctgcaaagaatgtgggaaggctttcactcagtcaagtcagttgatactgcaccatagaatccacacaggcgagaagccatataaatgcgaggagtgtggcaaagctttcattcgaagcagccaactgacgcgccaccagaaagtgcacacgggagaaaaaccatatgaatgtaaggagtgcggaaaggctttcacgcagaactcacagctgacgttacaccagagactgcatacgggagagaaactgtatgagtgcaaggagtgtcggaaggtcttcacgcagctctctcaactgatccttcacaagcgaatacatacaggagagaaaccctacgagtgcaaggagtgtggcaaagcattcatttgcgggagtcagctgtcacagcaccagaagatacataatggagagaaaccctacgagtgcaaggagtgtggccgcgcctttattcgggggagcttattaatgcaacaccaaaggattcacactggcgaaaaaccctacaaatgtgaagaatgtggtaaggcttttatccgcggtagccaattgacacaacaccaaaggattcataccaatgagaagccttatgagtgtaaagaatgcgggaagatgttttcccatggttcacaattgacgcaacaccagcgaatccataccggggagaaaccctaccagtgcaaggagtgtgggaaggcctttaatcgcggcagcctcctgacacggcatcagcggatccacaccggagagaagccatacgaatgtaaagaatgtggcaagacgtttagtcgcggttcagaactcacccagcacgaaaggatccatacagcttttttagctgggcagcaggacagaagtgatatctatatgtcacggcgctttactaagtctattttcccagtttttttctccgtcccaacaatgtggacttccaagctggagctccgctattctcacggggactttgaaaatggtatatgggtcctgtggattatggaacaaaaataccggcggtccctgcaaccctag

SEQ ID NO: 14179 - DNA, 2067 bp, Artificial Sequence
  Description of Artificial Sequence: Synthetic coding sequence
atggcacgcaagctcgtcatgtttcgcgatgtcgccatcgatttcagtcaggaggagtgggagtgcctggacagtgctcaacgggatttatatcgagatgtcatgctcgaaaattacagcaacctggttagccttgatctcccaagcaggtgcgctagcaaagacctgagtcctgagaaaaacacgtacgagactgagctgtcgcaatgggagatgtccgatcggctggagaactgcgacctcgaagagtcgaacagcagggactacctcgaagccaagggaaaaatggagaaacagcaggaaaatcaaaaagaatacttccgtcagggcatgattatctatgataagatgtccattttcaaccagcacacatacctcagtcagcattccagatgccattctactgagaaaccatacaaatgcaaagagtgcgggaaagcatttcggagagccagccaccttacccagcaccagagtatccatactggagagaagccttacgagtgtaaacagtgcggcaaggctttttctcgggattcacagctatccctccatcagaggttgcacactggcgagaaaccctatgcttgcaaggagtgcgggaaggcatttacccagagtagccagctgatcctccaccatcggatccacactggtgagaagccctataaatgtgaggagtgtgggaaggcttttatccggagctcccagctgacacgacaccagaaggttcacacgggggagaagccctatgagtgtaaggagtgcggcaaagcctttacccagaactcccaactcactttgcaccagagactgcataccggagagaagctctatgagtgtaaagagtgtcgcaaggtctttacgcagttgagccagctcattctccataagcgcatccatacgggagagaagccctatgaatgtaaagaatgcggaaaggccttcatctgcggctcccagttaagccagcatcagaaaatacataacggcgagaaaccctatgaatgtaaggaatgtggccgtgctttcatcagaggttctctgttgatgcagcaccaacggattcatacaggggagaaaccatacaagtgtgaggagtgcggaaaggcattcatccggggatcacagcttacacaacaccagaggatacatacaaacgagaaaccgtatgaatgtaaagagtgcgggaaaatgttctctcatggttcacagctgactcagcatcagcggattcacaccggcgagaaaccttaccagtgcaaggagtgtggcaaggccttcaatcgaggttcgcttctgacaagacaccagaggatccataccggcgagaagccttacgaatgcaaagagtgcggcaagaccttttcaagaggctcagaactgacacagcatgaaaggattcacaccggagaaaaaccttacgagtgcaaggaatgtggcaaatctttcattagagggtcacagctgacccagcaccaaaggattcataccggagagaagccctatgaatgtaaagaatgcaggatggcgtttacacagtctagtcacctctcccaacaccagagacttcatactggagaaaaaccttatgtctgcaacgagtgcgggaaggcctttgcgcgtggcctgctgcttattcagcatcaaagaatccatactggggaaaaaccatatcagtgtaaagaatgcggaaaagcatttattagaggcagtcagctgacgcagcaccaaagaatccacaccggagaaaagccctacgaatgtaaagagtgcggaaaggccttcagccatggctcacagctgaccctacaccaaagaattcatactggagaaaaaccatatgagtgccgggaatgcagaaaggctttcacacagtcctcccacctgtcccggcaccaaaggattcacacaggcgagaaaccttatcagtgtaaggaatgcgggaaagccttcacgcgagggagccagctgactcagcaccagcgcatccacatctcggagaagtctttcgagtataaagagtgcggaattgatttctcccatggctctcaggtgtacatgtag

SEQ ID NO: 14180 - DNA, 1665 bp, Artificial Sequence
  Description of Artificial Sequence: Synthetic coding sequence
atggccgcggcagatttatctcatggacattacttaagtggagatccagtttgcctgcatgaggagaaaactccggcaggcaggattgtggcagattgccttaccgactgctaccaagactctgtcacctttgatgacgtggcagtagactttacccaggaggagtggacgctcctcgattcaacacaacggagcctctacagcgatgttatgttggagaactacaagaacttggccactgtgggggggcagattatcaagccaagcttgatcagttggcttgagcaggaggaaagtcggaccgtccagggcggagtccttcagggctgggagatgcgacttgaaacacagtggtcgatcctccagcaggatttcctgcggggccaaacatccatcggcattcagcttgagggaaagcacaatggaagagaattatgtgattgcgaacagtgcggggaggtatttagcgagcacagttgcctcaagactcatgttcgaacccaaagcacaggaaacacccacgattgcaatcagtatggaaaggattttctcaccctctgtgagaagacatcaacaggcgagaaattgtctgaattcaaccagtcagagaagatctttagtttaacacctaacattgtgtatcagagaacatccacacaggaaaagtctttcgagtgctcccactgtggcaagtcctttattaacgagagttatctccaggctcacatgcgaacacataatggggagaaactttatgaatggcgaaattatggccccgggtttattgacagtacaagtctttccgtattaatcgagaccttgaacgccaaaaagccatacaaatgtaaagaatgcggcaaggggtaccgctaccccgcttatctcagcatccacatgagaacacacactggagagaagccctacgaatgtaaagaatgcgggaaagcttttaattactctaacagcttccagatccacggacggacacacacaggcgaaaagccttacgtctgtaaggagtgtgggaaagcctttacccaatattcaggcctttccatgcacgttaggtcgcacagtggtgataagccgtatgagtgtaaagaatgtggtaagtcattcctgacctcgtcccgcctgatacagcacattcgcacgcatactggggagaaacctttcgtgtgtgtggagtgcggaaaggcctttgcggttagctcaaatttaagcggtcatttgagaacacacacagaagagaaagcttgcgagtgtaaaatttgcggtaaggtgtttggttatccctcctgtttgaataatcacatgcggacacacagcgcccagaaaccatacacttgtaaagagtgtggaaaagcctttaattactccactcacttaaagatccacatgcggattcacaccggggagaaaccatatgaatgcaagcagtgcggcaaagctttttcccactcctccagtttccaaatccacgagaggacacacaccggagagaaaccttacgagtgcaaggagtgtggcaaagctttcacttgctcctctagtttcaggattcatgaaaaaacccacacagaggaaaagccatataagtgccaacagtgtggcaaggcttatagtcatccaagatctttacgtagacatgagcagattcattag

SEQ ID NO: 14181 - DNA, 1665 bp, Artificial Sequence
  Description of Artificial Sequence: Synthetic coding sequence
atggccgccgccgacctgtctcatggtcactatctgtccggcgatccagtgtgccttcatgaagagaagacacccgccggcagaatcgtcgctgattgcctgactgattgctaccaggattcagtgactttcgatgatgtggccgtggactttacccaagaagagtggacactgcttgactcaacgcagcggtcgctatactctgatgtgatgcttgaaaactataagaaccttgcgaccgtcgggggccagatcataaaaccaagtttaatctcctggttggaacaggaagagtccagaaccgtacaaggaggggtgcttcaagggtgggagatgcgcctcgagacgcaatggagcatactgcagcaagattttttacgtgggcaaactagcatcggcatacagcttgaggggaagcataacggtagggagctttgtgactgtgaacagtgcggggaggtcttctctgaacacagttgtctgaaaactcatgtgagaactcagagtactgggaatacacacgattgcaaccaatatggtaaggacttcctaacactgtgtgaaaaaaccagcacgggcgaaaaattgtccgaatttaatcagtcagagaagatttttagcctgacacccaacatagtgtatcagcggacctcaacacaggagaagtcatttgagtgtagccattgcgggaagagtttcattaacgagtcttatttgcaggctcatatgagaacacacaatggagagaagctgtacgagtggaggaactatggccccggcttcatcgactccacaagtctgtccgttctaattgagactctgaacgcaaagaagccttacaagtgcaaggagtgcggcaaagggtatcgctaccctgcctatttatcaattcacatgcggacacacacgggcgagaaaccatacgaatgcaaggaatgtggcaaggcttttaattatagtaattcgttccagatccacgggcgcactcacaccggcgagaagccctatgtgtgtaaagagtgcgggaaggccttcacgcagtacagtggactgtctatgcacgtgcgcagccactctggagataagccatatgaatgcaaagaatgcggaaaatcttttctgacaagttcaaggcttatccagcatattcgcactcacaccggagagaagcctttcgtctgcgtagagtgcgggaaggcctttgccgtctcttcaaacctctccggccacctgagaacacacaccgaggagaaagcctgcgaatgcaagatctgtgggaaggtttttggataccccagctgtctgaataatcacatgcgtacacactcagctcagaagccttatacgtgtaaggaatgtggaaaggccttcaattatagtacccatttaaagatccacatgagaattcacaccggtgagaaaccctatgagtgcaaacagtgcggaaaagccttttctcactccagcagctttcagatccacgagcgaacccatacaggtgagaagccgtatgaatgcaaggagtgcggcaaggcgtttacgtgctctagctcatttcgaattcacgagaagacccacacagaagaaaaaccttataagtgccagcagtgcggtaaagcatatagtcacccccggagtctgcggcggcacgagcagatacattag

SEQ ID NO: 14182 - DNA, 1626 bp, Artificial Sequence
  Description of Artificial Sequence: Synthetic coding sequence
tccgatggtgacattaacgagcgcagggtcctcactcggagtcaccttgcgggctggcagctgctcatctgcccgatggactctgtgacttttgacgatgtggcggtcgatttcactcaggaagagtggactttgcttgattccacgcaaagaagcttgtattcagacgtcatgttagaaaactataaaaatttagcaacagtgggggggcagatcattaagccttctctcattagctggctggagcaggaagaatctcgaaccgtccagggcggtgtactacaggggtgggagatgcgccttgagacccagtggtccattctccagcaagattttttgaggggccaaacttccatcggaattcaattagaaggcaagcacaatgggagggaactgtgcgattgcgaacagtgcggcgaagtgttttctgagcattcttgcctcaagacacatgtccgaactcagtcaactggcaacacccacgattgtaatcaatacgggaaagatttcctaaccctatgcgaaaaaacctcaactggggaaaaactcagtgagtttaaccagtccgaaaagatcttttccctgacccctaacattgtctaccaacgcacctccacccaggaaaagagttttgaatgttcacattgtggaaaatcctttatcaacgagtcatatcttcaggcccacatgaggactcacaacggtgaaaagctttacgaatggaggaactacggcccaggatttattgactccacttccctgtctgtgttgatcgaaactctaaacgcgaaaaaaccttataagtgcaaggagtgtgggaagggataccgctatcccgcgtacctgagcatccacatgaggacacataccggtgaaaagccttacgagtgtaaagaatgcgggaaggccttcaactatagcaattctttccagatacatggacgtacccacacgggagagaaaccctatgtctgcaaggagtgcggaaaagcatttacacagtacagtggcttgagcatgcacgtaaggagtcactcaggcgacaagccttacgaatgtaaggagtgcgggaagtctttccttacaagtagtcgcctgatccagcacattagaactcatacaggcgaaaagccctttgtctgtgttgaatgtggaaaagccttcgcagtgagcagcaatctcagcggacatttgcgcacacatacagaagagaaggcctgcgaatgcaaaatttgcggaaaagtgtttggctatcccagttgcctcaataatcacatgcgtacccactcagcacagaagccatacacatgtaaggagtgcggaaaagcatttaactactccacgcacctaaaaattcatatgcgtatccatacaggcgagaaaccctacgaatgtaaacagtgcggcaaagcattctcccatagctcctccttccagatccacgagcgtacgcataccggcgagaagccttacgagtgtaaagagtgtggtaaggctttcacctgtagcagttcttttagaatacacgagaaaacacatacagaggagaagccatataagtgtcagcagtgtggcaaggcctactctcaccctcggagtcttaggaggcatgagcagattcattag

SEQ ID NO: 14183 - DNA, 2025 bp, Artificial Sequence
  Description of Artificial Sequence: Synthetic coding sequence
atgggacctctcacttttactgacgtcgccatcgagtttagtctcgaagagtggcaatgcctggacacggcacagcagaacctgtaccggaacgtcatgctcgaaaactacagaaaccttgtgtttctcgggatagcagtaagtaagccagaccttatcacatgcttggagaaggagaaagaaccatgtaaaatgaagagacacgaaatggtcgatgaaccacccgtcgtatgcagtcactttgctgaagacttttggcctgagcaagatatcaaagatagttttcaaaaagttactctaaggaggtacgataaacggggccacgagaacctccagttgcgcaagggatacaaaactgttggggactgtaaactctacaagggtggatataacggactgaaccagtgcctgactctcacacagtctaagatgtaccactgtgatatctatgtgaaggtgttttatgcattcagcaacgccgaccgctataaaacacggcataccggcaagaagcccttccagtgtaaaaagtgcggcaagtcattttgtatgctgtctcagcttacccaacataaaaaaattcatatacgtgaaaatacctaccgatgtaaagaatttggtaatgcattcaaccagtcgtccgccctcaccaaccataaacggatctacgttggcgaaaagcactatcggtgcgaggagtgcggtaaagcttttaatcactactccaccctgacgaaccacaagcgtattcacactggggagaaaccttacaagtgtaaagagtgtgggaaggccttttctcggtatagcacactgactacccataagagaatccactctggtgagaaaccttataaatgcgacgagtgcggcaaaaccttctcaatttctagcactttcacgaaacataaaattatccacaccgaagagaagccctacaagtgtaaagaatgtggcaaagcctttaaccggagtagcaccttaaccagccacaagcgcatccatacgggtgagaaaccgtacaaatgcgaagagtgcggcaaggcttttaactggtctagcacgcttaccaaacacaaggttatccacaccggggagaaaccctataaatgtgaagaatgtgggaaagctttcaaccagtcctccagactcaccaggcacaaaaagatacataccggagaggagccatataaattcgagaagtgcggccgggtctttacttgttcttcaaccctgacgcaggataagaaaatccacacaggagaaaagccgtataattgtgaagagtgcgggaaagtgttcacatacagttccacacttactcgccataagagaatccacacagaggaaaagccttataagtgcaacgagtgcggcaaagcctttaaccgcagcagtcatctcacgtcccaccgaaggattcatacgggcgagaaaccttacaagtgtgaggaatgcggaaaagcttttaaacagagctcaaatctgaatagccacaaaaagatccattcgggggaaaagccctataagtgcgaagaatgtggcaaggcttttatcctgagcagtcgcctgactcagcacaaaaaaattcacacaggagagaaaccctacaagtgcgaagaatgcgggaaagcattcaatagaagctcgcggctcactcagcataagaagatccatacaggagagaagccctataagtgcaagcagtgcgacaaggcctttactcactcctcaaatctgagcagccacaagaagatccatagtggggaaaaaccatacaagtgcgaggagtgtgggaaggcctttaaccggtcctcgcggctcacccagcataagaagatccatactagagaaaaaccttataaatgtgaggagtgcgccaaagccttcacaagaagttcacgcctgacacagcacaaaaagatccacaggatgggtgtggttgcccatgcttgtaaccctagcaccctgggcggccgcggcggccgcattaccagaagcggggatcgcgatcgaccaggctag

SEQ ID NO: 14184 - DNA, 1731 bp, Artificial Sequence
  Description of Artificial Sequence: Synthetic coding sequence
atggatgatcttaaatacggggtgtatcccctgaaagaggccagtggatgcccaggggctgagcgcaatttactggtgtattcctactttgagaaagagactctcactttccgagatgtcgctattgagttttccctggaggagtgggagtgcctgaatccggctcagcagaatctttacatgaatgtcatgctcgagaactacaagaacctggtattcctgggtgttgcagtctctaaacaggaccctgtaacttgcctcgagcaggagaaggagccatggaatatgaagcgacatgagatggtcgatgagcccccagccatgtgttcctatttcaccaaggacctttggcccgagcaagatatcaaggatagcttccaacaggtgatcttgcgaagatatggcaaatgtgagcacgagaacctgcagttgcgcaaaggtagcgcctcggtggatgaatacaaagtgcacaaggaaggatacaacgagttaaatcagtgcctcaccacgacccagagcaaaattttcccttgtgataagtacgtgaaagtcttccacaaatttctgaacgccaaccggcacaagacacgacatactgggaagaagccctttaagtgcaaaaagtgtggtaaaagcttctgtatgctcctgcatttatcgcagcacaaaagaatccacatcagagagaattcataccagtgcgaagaatgtggtaaagccttcaaatggttcagtacattgacacgccataaacgcatccacactggcgagaaacctttcaagtgcgaggaatgtgggaaagcctttaagcaaagcagtactcttacaacgcataaaattatacacaccggtgaaaaaccgtatcgctgtgaagaatgcgggaaggcattcaatagatcatcacacctgaccacccacaaaatcatccataccggagagaaaccctacaaatgcgaggagtgtggtaaggcgttcaatcagtcctccaccctcagcacccataagtttatccacgcaggtgagaagccatacaaatgcgaggaatgtgataaggctttcaatagattcagttatctgactaaacacaagattatacacacaggggaaaagtcctataaatgcgaggagtgtggcaagggtttcaactggtcctctactctgactaagcacaagcggatccatacgggagagaagccatacaagtgtgaagtatgcggtaaggcctttaacgagtccagcaaccttaccacccacaaaatgattcatactggagagaagccttataaatgcgaggagtgcggcaaggcgttcaatcgttcaccacagctaactgcccacaagattatccacaccggcgaaaagccatataagtgcgaagagtgtggcaaagccttttctcagtcctcaatcctgaccacacataaaagaatacacacaggcgaaaaaccctataagtgcgaagaatgtggaaaagcttttaacagaagctcaaatctgacaaagcataaaataattcacaccggcgagaagtcttacaagtgtgaggagtgcggcaaggcctttaaccagagcagcaccctgacaaaacataggaagatccacacaagacagaagccctacaactgtgaagagtgtgacaatacattcaaccagagctcaaacttgatcaagcagaacaattcatactggagagaaacgttacagatgtccagaatgtgggagtccctctag

SEQ ID NO: 14185 - DNA, 1563 bp, Artificial Sequence
  Description of Artificial Sequence: Synthetic coding sequence
atgcctcagctcagtttgtcctccctgggactttggcccatggcagcatccccgtggctactcttgctgttggtgggcgcgtcttggctcctggcccgaattctggcgtggacttacaccttctacgataattgctgcaggttaagatgtttccctcagccccccaaacgcaattggttccttgggcacttaggactcattcacagcagtgaagaaggactgctgtatacgcaatctctggcttgtacattcggcgacatgtgctgttggtgggttggaccatggcacgctatagtgagaatttttcatccgacctacatcaagccagtcctctttgcaccagcagccatcgtccctaaagataaagtgttttactcattcctgaaaccttggttaggagacgggttgttgttgtcagccggggaaaagtggagtcgtcataggaggatgctcacaccagcgtttcacttcaatatcctaaagccatatatgaaaatcttcaacgaaagcgttaatatcatgcacgcaaagtggcagctgctggcctccgagggttcagcccgtctcgacatgtttgagcacatcagcctcatgacactggactcactgcagaaatgtgttttcagttttgattcccactgccaggagaaaccctccgaatacatagcggccattcttgaactttccgcgctggtgaccaaacgccaccagcagattctgctttacatcgacttcctctactacctgaccccggacgggcagaggtttaggcgggcttgcagactcgtccacgatttcaccgacgccgtgatacaggaacgaaggagaacgctcccaagccagggcgtcgatgacttcctgcaggcaaaagcgaaatcaaaaacgttggatttcattgatgttctgctcctgtccaaagatgaagacgggaagaagctgtctgacgaggatattcgggcggaggccgacacgtttatgtttgaaggccatgacacaactgcctcgggactgtcctgggttctctaccatctcgccaagcatcccgaataccaggaacggtgtaggcaagaggttcaggagcttctaaaggatcgagagccaaaggagattgaatgggacgacctggcccagctgccatttctgacgatgtgcattaaggaatcactgcgcctgcaccccccggttccagctgtgtccagatgttgcacacaggatattgtgctacctgatggaagagtgatacccaaaggtatcatatgcctgatctcagtatttggcacccaccacaaccccgccgtctggccagaccccgaggtctacgatccctttaggtttgatcccaagaacatcaaagagagatctccccttgccttcattcctttttcagcgggtccccgaaattgtatcgggcaggcatttgcaatggccgaaatgaaagtcgttctgggtctcaccttgctgagattcagggtcttgccagatcacaccgaacctcggaggaaacccgaactggtcctgcgcgctgaaggagggctttggctgcgggtggaaccgctgtcttag

SEQ ID NO: 14186 - DNA, 2022 bp, Artificial Sequence
  Description of Artificial Sequence: Synthetic coding sequence
atgatgtttcaggactctgtagcttttgaagacgtggccgtgacatttacacaggaggagtgggccttgctggacccctcacagaagaacttgtgcagggacgtgatgcaggagacttttaggaacttagcctctattggaaaaaagtggaagccccagaacatctatgttgaatacgaaaatctgaggcggaatcttcggattgtgggagagcgcctctttgagtccaaggaagggcaccaacacggtgagatcctgactcaagtgcccgatgacatgttaaagaagacaacgaccggcgtcaagagttgcgaatccagtgtatacggtgaggttggctccgcccattcttcgctgaatcgacatattcgagatgacaccggtcacaaagcatacgaataccaggaatatggacagaaaccgtacaagtgtaaatattgtaaaaaaccatttaactgtttatcttctgtgcagacccatgagagagcacatagcgggaggaagctgtacgtatgtgaggagtgcggaaaaacttttatctcgcactctaacctgcagaggcaccggattatgcaccgaggcgatggtccttataagtgcaaattctgcggcaaagccttaatgttcttgtccctgtatcttattcataagaggactcatactggcgagaagccatatcagtgtaagcagtgcggcaaggccttttctcacagcagtagcttaagaatccacgaaaggactcataccggggagaagccctacaaatgtaacgaatgcggcaaggccttccacagtagcacatgtttacacgctcacaaacgaactcacaccggagaaaagccatacgaatgtaagcagtgtgggaaggcgttttcaagctcacactcatttcagatccatgagaggacacatacaggggagaagccctacgagtgcaaagaatgtggaaaggcatttaagtgtccttcatcagtgcggcgccacgaacgtacacactcgagaaagaagccttacgagtgtaagcactgcgggaaagttttatcctacctgaccagctttcagaatcacctgggcatgcataccggggagattagccacaagtgtaagatctgtgggaaggcgttctattcaccctcgagtcttcaaactcacgaaaagacacatacaggcgaaaagccgtacaagtgcaaccagtgtgggaaagccttcaattcatcaagcagctttagatatcacgagagaacacatacaggagagaagccgtatgaatgtaagcaatgcggaaaggccttcaggagtgctagcctgttgcagacacacggcagaacacacacaggtgagaagccatacgcttgcaaggagtgcgggaagcctttcagcaatttttctttttttcaaatacatgaacggatgcatagggaagagaagccttatgaatgtaaggggtatggaaaaaccttcagcctgccgtccttgtttcatagacatgagcgcacccacactgggggcaaaacctacgagtgtaagcagtgcggacgttctttcaattgcagctcatcattccggtaccacggacgcactcacacaggcgagaaaccctacgaatgtaagcagtgcgggaaggcttttagatctgcttcccaactgcaaatacatggtcgcacccacactggcgagaaaccctatgagtgcaaacaatgcggcaaggccttcggcagcgctagtcacctccagatgcacggccgcacacacactggggaaaaaccttatgaatgcaaacagtgcggaaaatccttcgggtgcgcgtctcgcttgcagatgcatgggaggacacacactggcgagaagccatacaagtgtaagcagtgtggcaaagctttcgggtgtccctctaacctgcgtcggcacggtcggacacatacaggagagaaaccgtataaatgcaaccagtgcggcaaagtgtttaggtgtagtagtcagctgcaagtccatggtcgggcgcactgcattgatactccctag

SEQ ID NO: 14187 - DNA, 1917 bp, Artificial Sequence
  Description of Artificial Sequence: Synthetic coding sequence
atgcaagaaacattcaggaatctggcctctattggtaagaaatggaaacctcagaatatttacgtggaatatgagaacttgaggcgtaatctgagaatcgtgggagagagactgttcgaaagcaaagagggccaccaacacggggagatactcacccaggtgccggacgacatgctcaagaagacaactaccggtgttaagtcgtgtgaatccagcgtgtatggcgaagtggggtctgcccactcctcgcttaatcggcacattagggatgatacaggacataaggcatacgaatatcaggagtatggacaaaagccttacaaatgtaagtactgcaagaagcccttcaattgtttgtccagtgtgcaaacccacgagagggcacactctggtcgcaagctgtatgtgtgtgaagaatgcggaaagactttcatctctcacagcaatctccagagacaccgcataatgcaccggggcgatggcccttataagtgcaagttctgcggaaaggctctaatgttcctgagcctatacttgattcataagcgcacccacaccggagaaaagccttaccaatgcaaacagtgcggcaaagcattttcgcactcaagcagcctgcgcattcacgagagaacgcataccggggaaaagccatacaagtgcaacgaatgtggaaaagcattccactcctctacctgcctccacgctcataaacgcactcatactggggagaaaccctacgaatgcaaacagtgtggaaaggccttttcctcctcccattcatttcagattcacgagaggacccatacaggggaaaagccctatgagtgcaaggagtgcgggaaggctttcaagtgccctagctctgtccggcggcacgagaggacacattctcggaagaagccttatgagtgcaagcactgtgggaaggtgctgtcttatctgacaagttttcagaaccaccttggaatgcataccggagagatctcgcataaatgcaaaatctgcggcaaggcattttattctccgtcatcactccagacacacgagaagacccatacaggagaaaagccatacaaatgcaatcagtgcgggaaggcttttaactccagctccagcttcagataccacgagaggacgcacaccggggaaaagccctatgagtgcaaacagtgtggcaaagcatttcgatccgcaagtctgctgcagacccatggcagaacgcatactggcgagaagccttacgcctgcaaggaatgcggaaaaccttttagcaacttctccttcttccagatccatgaaaggatgcacagggaagagaagccctacgagtgtaaaggctatggaaagaccttctctctgcctagcctattccaccgccatgagcggacacacacaggaggcaaaacctatgaatgtaagcagtgcggaaggagcttcaactgcagctcttccttccgttaccatggaaggacacataccggcgagaagccatatgagtgcaaacagtgtggcaaggcgttccggagtgcaagccagttgcaaatccacgggagaacccacactggggagaagccctatgagtgcaaacagtgtgggaaagcctttgggtctgcatcccatctgcaaatgcatggtcggacccatacaggcgaaaaaccttacgagtgcaagcaatgcggcaaaagttttggctgcgctagccggttacagatgcatggccgcacccacacgggagaaaagccgtataaatgcaagcagtgtggaaaggcatttggttgtccatccaatctacgccggcacggccgcacacatacaggagagaaaccttacaaatgtaatcaatgcggaaaggttttcagatgcagcagtcagctacaggttcatggcagggcccactgtatagacacgccttag

SEQ ID NO: 14188 - DNA, 159 bp, Artificial Sequence
  Description of Artificial Sequence: Synthetic coding sequence
atgcaagagacatttagaaacctcgcatctattggtaaaaaatggaaaccacagaacatttacgtcgagtatgagaaccttagacgcaacctccgcatcgtaggagagcgtctattcgagagtaaagaaggtcaccagcatggcgaaattttgacatag

SEQ ID NO: 14189 - DNA, 360 bp, Artificial Sequence
  Description of Artificial Sequence: Synthetic coding sequence
atgcaggagacattcagaaacctagcgtctataggaaagaaatggaagccccaaaatatttatgtggagtatgaaaaccttcgtcggaatctgcgcattgttggggagcgcctgtttgagtcaaaagaaggccatcaacatggggagatccttacccaggtgccagatgacatgctgaagaagacaacaaccggagttaaatcctgcgaatcgtccgtctacggagaagtaggttccgcccattccagccttaataggcacatccgggatgataccgggcacaaagcatacgagtatcaggaatacggccaaaagccatacaaatgcaagtactgcaagaaacctttcaactgcctgtag

SEQ ID NO: 14190 - DNA, 1458 bp, Artificial Sequence
  Description of Artificial Sequence: Synthetic coding sequence
atgcgcgataaccgggcagtgtcattgtgccagcaggaatggatgtgcccaggcccagcgcagcgggccttgtaccgcggcgccacccagaggaaggattcccatgtgagtttagccaccggggtgccttggggatacgaggagaccaaaacactcctggccattttgtcctcttcgcagttttacggaaaactgcaaacctgtcaacagaacagccagatttatcgtgcaatggctgagggcctctgggagcaagggtttttaagaacgcctgagcagtgccggactaaattcaagtccctgcagctttcatacagaaaggtgcgaaggggcagagtgcccgagccgtgtattttctacgaagagatgaatgctctatctggcagttgggcttccgctccacccatggcttccgacgcagtgcccggccaggagggttctgatatagaggccggtgagctgaatcaccaaaatggggaacctacagaagtggaagacgggaccgtagacggcgccgaccgggatgagaaggatttcaggaatcccggccaggaggtgcggaagcttgacctgcctgtcctgttcccaaacaggctcggatttgagttcaagaatgagataaaaaaggagaacctgaagtgggacgactcagaggaagtagaaattaacaaggcactccaacgcaaaagtcgcggcgtgtattggcactccgagttgcagaaagggctggaatcagagccgacctcgaggaggcagtgcaggaattcacctggggagagtgaggaaaagaccccctcccaggaaaagatgtcacaccaaagcttttgtgcgagagacaaggcatgcacccacattctgtgcggaaaaaactgtagccagtcagtgcactctcctcataagcccgccctcaaattagagaaagtgtctcaatgtcctgagtgcggcaagacgttctccaggtccagctacttggttaggcaccaaagaatccatactggcgaaaaaccacataaatgcagcgagtgcgggaaaggattttccgagcgttcgaatctgactgcacatctcagaacacacactggcgaaagaccttatcaatgcggacagtgcggcaaatccttcaatcagtcctcaagtttaatcgtgcaccagcgtacacatacaggcgaaaaaccgtatcaatgcatcgtttgtgggaaacgattcaataatagttcacagtttagtgcacaccgccggatccacaccggcgagtccccgtataagtgcgccgtgtgtggcaaaatctttaacaattcatcccatttcagcgctcatcgaaagacccacacgggcgagaagccctacaggtgctcccactgtgagcgaggtttcaccaagaattccgccctaaccaggcaccagacagttcacatgaaagctgtcctgagtagccaggaaggacgcgacgctctctag

SEQ ID NO: 14191 - DNA, 2094 bp, Artificial Sequence
  Description of Artificial Sequence: Synthetic coding sequence
atgatggccgccgtgaaatctacagaagctcacccttcgtcgaataaggaccctactcaaggacagaaatcggccttgcagggtaattctccggactctgaggccagccgacagaggtttcgtcagttttgttaccaggaagtgacaggacctcacgaagccttcagcaagttatgggaactgtgctgccagtggctccgccctaagactcactctaaggaggaaattctcgaacttctggtgctagaacagttcctaacgattcttcctgaggagattcagacttgggttagagaacagcatccagagaacggggaagaggcggtcgctctcgtcgaggacgtgcaacgggcccctggtcaacaggttctggatagtgagaaagatctgaaagtcttaatgaaggaaatggcccctcttggggccactcgggagtcgcttcgcagccaatggaaacaggaagtgcagcctgaagagcctacctttaagggttctcagagttcccaccagagacccggagaacagagcgaggcctggctggcaccccaagcaccacgaaacctccctcagaataccggtctgcacgatcaggagactggggccgttgtctggacagctggctctcaaggcccagctatgagagataacagggcagtgtcgctgtgtcaacaggaatggatgtgcccaggcccggctcagcgagccctatataggggagcgactcagcggaaagattcccacgtgtccctggcaactggggtgccttggggctacgaagaaacaaaaacccttcttgccatcttaagctcgtcccaattctatggcaagttgcagacatgtcaacaaaactcgcaaatttatcgtgcaatggccgagggcttgtgggagcaggggttcctgcggacaccggagcaatgccgcactaagtttaaaagcctccaactgtcttaccgcaaagtgaggaggggccgggtgccggaaccatgcatcttttatgaggagatgaatgcattgtcaggctcctgggcctccgccccgccaatggctagcgacgctgtacccggtcaggaaggatcagacattgaggccggagagctcaatcaccagaatggggagccgacagaagtggaggacggtaccgtcgatggagccgacagggacgaaaaggacttccggaatccgggccaggaggtgagaaagctagatttaccagtcctgttccccaatcgtctggggttcgagtttaagaatgagataaaaaaagaaaacctcaagtgggatgatagcgaagaggtggaaattaataaggccctccagcgcaagtcccgcggcgtgtactggcactccgaactccagaaggggctggaatcagaacctacctcaaggaggcagtgcagaaactcgcccggagagtctgaagaaaagaccccctctcaagaaaagatgagccaccaatcattttgcgcacgcgacaaagcttgcacacacatcctttgtggaaagaattgttcccagtccgtccacagccctcataagccagccctgaaactggaaaaggtgtctcagtgccccgagtgtggcaagacattctcacgcagctcctatctcgtgcggcatcagcggattcatacgggggagaagcctcacaagtgttctgaatgtggtaaagggttcagcgagcgatccaacctgacagcccatctgagaacccatactggcgagcgcccctaccaatgtggacagtgtggaaagtccttcaatcagtcgagctcccttattgtccaccaaagaactcataccggcgaaaaaccctatcagtgtattgtgtgcggcaaacgcttcaacaatagctcccagttcagtgcacacaggcgcattcacaccggggaatcaccctacaagtgtgctgtgtgcgggaagatatttaataactcttctcacttcagtgcacatcgcaaaacacacacgggcgaaaaaccatacaggtgctcccactgcgaacgaggattcacaaaaaattctgccctaactcgccaccagaccgtgcacatgaaagcagtcctgtctagtcaagaaggaagggatgctctgtag

SEQ ID NO: 14192 - DNA, 2094 bp, Artificial Sequence
  Description of Artificial Sequence: Synthetic coding sequence
atgatggccgctgtcaaatctaccgaggcacaccccagctccaataaggatcccacacagggacaaaaaagtgcgttgcaggggaacagtccagacagcgaagcctcccgacagcggttccgccagttttgctaccaagaggtgaccggaccgcacgaggcattcagcaagttatgggagctgtgttgccagtggctgcgtccaaaaacccactctaaagaggaaatcctggaactgctcgtcctcgagcagtttctgaccattctaccagaggaaatacagacgtgggtgcgggagcagcaccccgagaacggagaagaagccgtggctctcgtggaggatgtgcagcgggcccccgggcagcaggtcctggattcagaaaaagatctgaaagtgcttatgaaggagatggcgccactcggtgctaccagagagtctctacgaagccagtggaagcaagaggttcaacccgaagagccgacattcaaaggttctcaatcctctcaccagcgacctggggagcagagcgaggcctggctggcccctcaggctccccgaaacctacctcagaacacaggactgcacgatcaagagaccggggcagtggtgtggaccgcaggaagccagggcccagccatgcgtgacaacagggccgtttccctgtgccaacaagagtggatgtgcccaggtccagctcagagagctttataccgtggggcaacccagaggaaggactctcatgtaagtttggccacgggcgttccctgggggtatgaggagaccaaaactctgttagctatactatctagcagtcagttctacggcaaacttcagacctgtcaacaaaactcccagatctaccgggctatggccgaaggcctgtgggagcaaggcttcctgcggacgcccgaacagtgcaggacaaaatttaaatccctccagttgtcatatagaaaagtccgaagaggccgagtgccagagccatgtatcttttatgaggaaatgaacgccctgtccggtagttgggcctccgccccgcctatggcttcagacgccgtcccaggccaggaagggtctgacattgaggcaggggagctgaatcatcagaacggcgagcccacagaggtagaggacggcactgtcgatggggccgaccgcgacgaaaaggatttcagaaacccaggtcaggaagtaagaaagttggatctgcccgtcctcttccctaaccgcttggggtttgagtttaaaaacgaaatcaagaaggagaacctcaaatgggacgattcagaagaggtggagattaataaagccttgcagcgaaagtcccgcggggtttactggcacagtgagttgcaaaaagggttagagagtgagcccacaagtcgaagacaatgtcgcaacagtcctggagaaagtgaggagaaaacccctagccaggagaagatgagccatcagtcgttttgcgctcgcgataaagcctgtacccacatcctgtgtggaaagaattgctctcagtccgtgcatagtccacacaaacctgcgctgaagttggagaaagtcagtcagtgtccagagtgtggaaaaacttttagtcggtcttcctatctggtgaggcaccagcgcatccacacaggcgaaaaaccccataagtgcagtgagtgtggtaaggggttctctgaacgctccaaccttactgcacatcttaggacccatacaggagagaggccttaccagtgcggtcaatgcgggaagagcttcaaccagtcctcctctctaatagtacatcagcggacacacacaggtgagaagccatatcagtgtatcgtgtgtgggaagcggttcaataacagttcccaatttagcgcccataggcggattcataccggcgagtcgccatacaagtgtgcagtgtgtggaaagatattcaataacagctcacatttcagtgcccataggaagacgcacaccggcgagaagccctacaggtgtagtcattgcgagcggggattcaccaagaattctgccctaacgaggcaccagactgtccacatgaaggctgttttatcaagccaggaaggacgtgacgcattgtag

SEQ ID NO: 14193 - DNA, 771 bp, Artificial Sequence
  Description of Artificial Sequence: Synthetic coding sequence
atggccgccgttaaatcaaccgaggcgcacccatcttcaaacaaagaccccactcagggacagaaaagcgcacttcaggggaactctccagattcagaagcaagccgccagcgatttcgacagttctgctatcaagaggttacagggccgcacgaagccttctccaagttgtgggagttgtgttgccaatggctcagacctaagactcacagtaaggaggagattctggagctgctggtgttagagcaattcctgaccatattgccggaggaaatccaaacctgggtcagagagcaacaccctgaaaatggcgaggaagctgtggcactagtagaggacgtgcagagagcacctggccaacaggtcctcgactccgaaaaagacctgaaagtgttaatgaaggaaatggcccctctgggagctaccagggagtcactgcgtagccaatggaaacaggaggtgcagccagaggagcccacatttaagggaagccagtcaagccaccaacggcccggtgagcagtcagaggcctggctggcgcctcaggccccgcgaaacctccctcagaacaccggtctacatgatcaggagactggggcagtggtgtggacagccggctcgcagggtcccgccatgcgagacaatcgagcagtgagtttatgtcagcaggagtggatgtgccctggcccagctcagcgagccttgtataggggcgcaacccaaaggaaagactcccacgtatccttagctacgggagccctgggcctatag

SEQ ID NO: 14194 - DNA, 648 bp, Artificial Sequence
  Description of Artificial Sequence: Synthetic coding sequence
atgcgggataaccgggccgtgtctttgtgtcagcaggagtggatgtgtcctggccccgcccagagagccctgtacaggggcgcaacacaacgaaaggacagccatgtgtccctcgctactggagttccttgggggtatgaagaaacaaaaacccttctggcaatactttccagcagtcagttttacggtaaactgcaaacctgccagcagaattcccagatctaccgtgctatggcggaagggctttgggaacagggcttccttcggactcctgagcaatgccggacaaagttcaagtctttgcagctgtcgtatcgtaaggtgagacgcggcagggtccctgagccgtgcattttttacgaagagatgaacgccctgtctgggtcctgggcctcagcccccccgatggcctcagatgctgtcccaggccaggaggggtccgatatcgaggccggcgagcttaaccatcagaatggggaaccgactgaagtggaggacgggacagtggatggcgccgacagggatgaaaaagacttccggaacccaggccaggaggtaaggaaactcgacctacctgtcctgttccccaatcgcttaggtaaaactcccctcgccttaatggtgaaagggtggcaaagtccgttgtag

SEQ ID NO: 14195 - DNA, 1227 bp, Artificial Sequence
  Description of Artificial Sequence: Synthetic coding sequence
atggcggagggtctttgggaacagggctttctgaggactccagagcagtgtcggaccaagttcaagtccctgcagttgtcatataggaaggtgagacgcggacgtgtgccagagccatgcattttctatgaagaaatgaacgccttaagcggttcttgggcaagcgcgccgcctatggcctccgatgccgtccccggacaggaaggctctgacattgaagcaggcgagctgaatcatcagaatggagagccaacagaggttgaagacgggaccgtcgacggcgccgatagggacgagaaagactttaggaatcccggccaagaagtgcggaagctagacctcccagtcctttttccgaaccggctgggtttcgaattcaaaaatgaaatcaaaaaagagaacttgaaatgggatgactccgaagaggttgaaattaacaaggcccttcaaaggaaaagtcgaggcgtctattggcatagtgagctgcaaaagggcctcgaatctgagcccacaagtcgaagacagtgcagaaacagccccggtgaaagtgaggagaagacaccatcccaggaaaagatgtcccaccagagtttctgtgcccgtgacaaagcatgcacccatatcctgtgcggtaaaaactgtagccagagcgtgcatagcccacacaagcccgccctgaagctagagaaggtgtctcagtgtcccgagtgcgggaagacattttctcgatcgtcctacctggttcgccaccagagaatccatacaggtgaaaaaccacacaaatgctccgaatgcggcaagggattctcggaaagatcaaacttaactgcccatctgagaacccatactggagagaggccctaccaatgtggccaatgtggtaagtcattcaaccagtcttcctcccttatcgtacaccagagaacccacactggcgagaaaccctaccaatgcattgtgtgtgggaaaagattcaacaactctagtcagttttccgcccaccggagaattcacacaggcgaatctccttacaagtgcgctgtatgtggaaaaatttttaacaacagcagccacttcagtgctcataggaagacacatacaggggagaaaccttaccggtgtagtcactgtgaaagagggttcacgaagaatagcgccctgacaagacatcaaacagttcacatgaaggccgtgctttcgtctcaagagggcagggacgctctgtag

SEQ ID NO: 14196 - DNA, 2457 bp, Artificial Sequence
  Description of Artificial Sequence: Synthetic coding sequence
atggactccgaatctaatattccatcgggcacaattcagtctaggaaaggcctgcagaataaaagccagtttaggacaattgctccaaaaatagtccccaaagtgctgaccagtcggatgctgccatgtcatagtccctctagatccgatcaagtgaatctgggcccatccataaattctaaactattgggaatgagcactcagaattatgctcttatgcaggtggccggacaggaggggacattcagcttggtggcactgcctcatgtggcaagtgctcaacccatccagaaaccccgaatgagcctgcctgagaatttgaagctgcccatcccccgctatcagccaccacgaaacagcaaagcatcacgcaagaagcctattctgattttccctaaaagcggttgttctaaagcccctgcgcagacccaaatgtgtcctcaaatgtctccatcacctccgcatcacccagaattgttgtataagccttccccatttgaagaggtgccttctctggaacaggcccccgcttcgatcagcactgctgcgctgaccaatgggtctgatcacggagacctgaggccgcctgtgacgaacacacacggatccttgaaccctccagccacgcctgcttcttctacgccagaagaaccagcgaaacaggatcttaccgctctttctggtaaggcacatttcgtgtcaaagatcacaagcagcaagccttctgccgtggcctcagaaaagttcaaagagcaggtggacctagccaagaccatgactaaccttagccctaccattctaggtaatgccgttcagctcatttcttccgtccccaagggaaaattaccaataccaccttattccagaatgaagacaatggaagtgtataaaatcaaatctgacgctaatattgcgggattttcgctccccgggccgaaagcagattgtgacaagattccaagtacaactgagggcttcaacgccgcgacaaaagtggcgtcaaggctcccggtgccccaagtatcccagcagtcagcttgtgaatctgcattttgcccacccacaaaactcgacctaaaccacaagacaaaattgaacagcggcgccgctaaacggaagggaaggaagcgcaaagtcccagatgagatcttggccttccagggaaagaggcgtaaatatataattaataagtgtagggatgggaaggagcgggtaaagaacgatccccaggagttcagagatcaaaaactaggcaccctaaaaaaatacagaagcattatgccaaaaccaatcatggtcatcccaacccttgcctcacttgcttcccccacaacactgcaatcacagatgttaggaggcctgggccaagacgtcctgctgaacaactctctcacccccaagtacctgggttgcaaacaagataattcgtcctctcccaagccatctagtgtgttccgcaatggtttcagcggtattaagaagccttggcaccgatgccacgtatgcaaccaccattttcagtttaaacaacatctccgggaccacatgaacacccacaccaatcgccggccctacagctgtaggatctgtaggaagagctacgtcagaccagggagcctgtccacacatatgaaactgcatcatggggaaaaccgcttaaagaagctgatgtgctgtgaattttgcgcaaaggtgttcggccatattagagtgtattttggccacctgaaggaggtacacagggtcgttatttccacagaaccagctccctccgaactccagcctggagacattcctaaaaaccgagatatgtctgttagagggatggagggcagcctggagcgggagaacaagagcaaccttgaagaggactttctgctgaaccaggcagatgaggtgaagttgcagataaaatgcgggagatgtcagattacagctcagagcttcgcagagatcaagttccaccttctagatgtacacggagaagagatcgaagggcgcctgcaggagggcacgtttcctgggagcaaaggaactcaggaagagctggtccaacacgcgagccccgattggaagaggcaccccgagagggggaaaccggaaaaggttcactcttcatctgaagagtcgcatgcctgtccacgcctgaaacgccagctgcacctccatcagaacggggtggagatgctgatggagaacgaggggccacagagcggtacaaacaaacctcgtgaaacttgccaaggcccggagtgccccggcctgcatacgttcttgctgtggtctcactctggtttcaactgtctcctctgcgccgagatgctgggaaggaaggaagatctgctacaccactggaagcaccagcataactgcgaagatccaagtaagctgtgggccatccttaacactgtctcaaatcagggggtcatagagctttccagcgaggctgagaagtag

SEQ ID NO: 14197 - DNA, 2487 bp, Artificial Sequence
  Description of Artificial Sequence: Synthetic coding sequence
atgcagaacagcgtgtcggtgcccccaaaagatgagggagagtccaatatcccttctgggacgatacagtcgaggaaaggactgcaaaacaagagccagttccggacgatcgcccctaaaatcgtacccaaagtcctaaccagccgcatgctgccttgtcactcccctagccgctctgaccaggtcaatctaggtcccagtattaattctaagctactcgggatgagcacgcagaattacgccctgatgcaggtcgctggacaggagggcaccttttccctggtggctctcccccacgttgccagcgcacagcccatccagaagccacggatgagcctacctgaaaacttgaagctgccaatcccgaggtaccagcctcctagaaactccaaggcatcaaggaaaaagccgatactgatctttccaaagtcaggatgtagcaaggccccagcacaaacacagatgtgcccccagatgtcaccatcccctccccaccaccctgagctcctgtacaagccgtctccttttgaggaggtgccatctttagaacaagcaccagcctccatttctacagctgctctgacaaatgggagcgaccatggcgacctacgaccccctgttactaatacacatgggagtctgaatcctcccgctacccccgcatcgtccacccctgaggagccagcaaaacaagacttaacggcccttagcggaaaagctcactttgttagcaagattaccagtagtaagccgagcgccgtcgcatccgaaaagttcaaagagcaggtagatttggctaagacgatgacaaacttgtccccaaccatcctgggaaacgctgtccagctgatcagtagtgtgccaaaaggaaagttgccaattccaccctacagccggatgaaaacaatggaggtttacaaaataaaaagcgatgccaacattgcaggattcagcctgcctggtcctaaggcggattgcgataagatcccttccacaacggaagggttcaatgcagctacaaaggtggcatcacggcttccagtacctcaggtgtcccagcaatcagcctgtgaaagtgccttctgccctcccacaaaactggacctgaatcacaaaactaaactcaattcgggcgcagcaaaacggaagggccggaaacggaaggtcccggacgaaatcctcgcttttcaagggaagagacggaagtacattatcaacaaatgccgagatgggaaggagagagtgaaaaacgacccacaggagtttcgggaccagaagctaggaaccctgaaaaagtatcgcagtatcatgccaaaaccaattatggtcataccaaccctggcctccctggccagcccaactactctccaatctcagatgctgggtggcttggggcaggacgtgctgctgaacaacagcctcacccctaagtatctggggtgtaaacaggataatagtagctctccaaaacccagttccgtttttcggaatggcttctccggaattaagaagccgtggcatcgatgtcacgtgtgtaaccatcactttcagtttaaacagcacctgcgtgatcacatgaatacacatacaaacagacgcccatattcctgccgcatatgtcgcaaaagctacgtgcggcccggcagtctgtctactcacatgaagctgcaccatggagaaaatcgcctgaaaaaactgatgtgttgtgagttctgtgccaaagttttcggtcacatccgcgtgtactttgggcacctgaaggaggtacacagagtggtaatcagcacagaacctgctccaagtgaattgcagcctggcgatatcccaaaaaatcgggacatgtccgtcagggggatggaaggttccctggagcgtgagaacaagtccaatctcgaggaggactttctgttgaatcaagctgacgaagtcaagctgcaaataaaatgtggaaggtgccagattactgcacagagctttgccgaaattaagtttcatctgttagacgtccacggagaggaaatcgaaggacggttgcaggaggggactttccccgggtccaaggggacacaagaagaactggtgcagcacgccagtccagattggaaacgacatcctgaacgcggtaagcccgaaaaggtgcacagctctagcgaagagagccacgcttgccctagattgaagcggcagctccacctccatcagaacggggtagaaatgctgatggagaatgaggggccgcagagcggcaccaacaagcctcgtgagacatgccagggtcccgagtgcccagggttgcatacctttctgctctggtcacactccggatttaactgtctcctctgcgcagagatgctggggcggaaggaggatctgctgcaccattggaagcaccaacataattgcgaagacccgtctaaactgtgggcaattctgaatactgtttctaaccagggcgtgatcgagctgtcctctgaggccgagaagtag

SEQ ID NO: 14198 - DNA, 1179 bp, Artificial Sequence
  Description of Artificial Sequence: Synthetic coding sequence
atgccaaagccaatcatggttataccaacactggcttccctggcctctcccacaaccctgcagagccagatgcttggtggccttggacaggatgtcctgctgaacaacagtttgaccccaaagtacttgggttgtaagcaagacaactccagctcgccaaaacccagttcagtttttcggaacgggttctccgggatcaagaagccttggcaccgttgccatgtttgcaaccatcatttccaattcaagcaacaccttcgggaccatatgaatactcatactaacagacgaccatactcctgtaggatctgccggaagagctacgtcagaccgggaagtttgagcactcatatgaagctgcaccacggcgaaaaccggctaaagaagctcatgtgttgcgaattctgtgctaaagtcttcggacacattagggtgtactttggccaccttaaggaagtgcacagagtggtaatttccactgagccagctccctccgagctccagcccggcgacatcccgaagaacagagacatgagcgttaggggcatggaaggaagtctggagcgggagaacaaatctaatttagaagaagactttttgttgaaccaagctgatgaggtcaagctgcaaatcaaatgcggccgctgtcaaataacagcgcaatcctttgccgagatcaaatttcacctcttagacgtgcatggagaggagatcgagggcagactgcaggagggaactttcccaggaagtaaggggactcaggaggagctggtgcagcacgcatcaccagattggaaaaggcatcctgaacggggtaagcccgaaaaagtgcattcaagttcggaagaaagccacgcatgtccacgcctcaagaggcagcttcacctgcaccaaaacggcgtggaaatgcttatggagaatgaaggtccacagagtggaaccaacaaaccccgggagacttgtcagggccccgaatgccctggactgcacacgtttctcctctggtcccatagtgggttcaattgcttactgtgtgcagagatgctcggaaggaaagaggacctactgcatcactggaaacaccagcacaactgcgaggacccctccaagctgtgggccattctaaacaccgtgagtaatcagggcgttatagagctctccagcgaagcagagaaatag

SEQ ID NO: 14199 - DNA, 2487 bp, Artificial Sequence
  Description of Artificial Sequence: Synthetic coding sequence
atgcagaactctgttagcgtgccaccaaaggatgagggcgaatcaaatatcccttcagggacaattcagagccggaagggcctacagaacaagagtcaatttcgcactatcgctccaaaaatagtgccgaaggtgctgacttccagaatgctgccttgccacagtccgagtcggtcagaccaggtgaacctaggtccttccattaatagtaagctgctcggtatgtccactcaaaattacgctctgatgcaggtcgcggggcaggagggcaccttctctctggtggccctgccacacgtagccagcgctcaaccgatacagaaacccaggatgagcctgcctgagaacctgaagctacccatcccccgataccagccaccaagaaattctaaggcatctcggaagaagcccatcttgatttttcccaagtccgggtgtagcaaagctcccgctcagacccagatgtgcccacaaatgagcccgagcccaccgcatcacccagagctgctgtacaagcctagcccgttcgaagaggtgccctcccttgagcaggcccccgcctcgattagcaccgccgctctgacaaacggtagcgaccatggggatctccgccccccggtcacaaatactcatggatcactgaatcccccagcgacacccgccagctccacaccagaggagcctgccaagcaagacttgactgccttaagcggtaaggctcattttgtctcaaagatcacaagctcaaaaccttctgccgtggcctcagagaaattcaaagaacaggtcgacttagctaaaactatgactaacctttcccccaccattctcggtaatgctgtacagctcatatcttctgtacctaaggggaaacttccaatccccccttacagccgaatgaagacaatggaagtctataagatcaaatcagatgcaaacatagcgggattctctttaccaggtcccaaagcggattgtgataagatcccctccactacggagggtttcaatgcggccacaaaggtggctagccgcctgcccgtgcctcaggtgagtcagcagtctgcatgtgaatccgccttttgccccccaaccaagctcgacctgaaccacaagaccaaactgaattccggagccgccaagcgcaagggaagaaaacgcaaagtacccgatgagattctggcatttcagggaaaaagaagaaaatacattatcaacaagtgcagagatggaaaggagcgggttaaaaatgatccacaggagtttagggatcagaaattgggtacgttgaagaagtatagatcgatcatgcccaaacctatcatggtgattcctaccttggcctcactggcttcccccacaaccttacaatcacagatgctgggagggcttggccaggacgttctgctgaataattccctgacacctaagtacctcggctgcaagcaagataattcctcttccccaaagccctcttccgtgttccgtaatggattttctggcatcaagaaaccctggcacagatgtcatgtatgtaatcatcatttccagtttaaacagcacttgagagaccatatgaacacccatacaaatagacgcccatactcgtgccggatttgtagaaagtcctacgtccggcccggctctttgtccacccatatgaaacttcaccacggcgagaatcgacttaagaagcttatgtgttgtgagttctgtgcaaaagtgttcggacacatccgggtgtacttcggacacctaaaggaagttcaccgagttgtgatttcaacggagcctgctccttccgagcttcagcctggagacattcccaagaatagggatatgtccgtccgaggaatggagggtagcctcgagcgagagaataagtcgaatttggaggaggacttcttgctgaaccaggctgatgaggttaagctccagatcaagtgcggtcgctgtcagatcaccgcccagtcttttgccgaaattaaattccatcttctagatgtacatggagaggaaatcgaaggaagactgcaggaaggcacgttcccaggctctaagggcactcaggaagagctggtgcagcacgcctctcccgattggaagcgccatccggagcgggggaagcctgagaaggtgcatagttcctctgaagagtcgcacgcttgtccacggcttaaacggcaactgcacttgcatcagaacggggtggagatgttgatggaaaacgagggtccccagtctggcacgaataagccgagagaaacctgccaagggcccgaatgccctggcctgcatacattcctgctgtggtcccacagcggattcaattgccttctttgtgctgagatgttgggacggaaagaggacctcctgcaccattggaaacatcagcataattgcgaagatccatctaaactgtgggccattctgaacactgtgagcaaccaaggcgtcatagaacttagtagtgaggcagagaaatag

SEQ ID NO: 14200 - DNA, 1644 bp, Artificial Sequence
  Description of Artificial Sequence: Synthetic coding sequence
atgcagaacagcgtgtccgtgccacccaaggatgagggagagtccaatattccatccggcacgattcagtcgcgtaaaggactgcagaacaaaagtcagtttaggactatcgcccctaagatcgtgcccaaggttcttacctcaagaatgctaccatgtcattctcccagccgatccgaccaagatttgaggcccactgtaatccgatacccgccaccccaaaaagctctcatgcagccaccgcgatggcaagccggctatctgtttcacaaaactaagctgaactcaggcgcggccaaacgcaagggtagaaaacgcaaagtccctgacgaaattctggccttccagggcaagcgcaggaagtatattattaacaagtgtcgggatggtaaggaacgagtaaaaaacgatccccaggagttcagggaccagaagttagggacactgaagaagtatcgctcaatcatgccgaagcccatcatggtcattccaacgttggcctctctcgcctcacctaccactcttcaaagtcagatgctgggcggactgggacaagacgtgctcctcaataattcgctcacacccaagtacctcggatgcaaacaagacaattcaagctccccaaaaccaagctccgtgtttcgtaacggattcagtggaatcaagaagccatggcacaggtgccacgtgtgcaatcaccactttcagttcaaacagcacttacgcgaccacatgaacacacacacaaatcgcagaccatacagttgcagaatatgccgtaaatcttacgtgaggccaggatctttgtctacacatatgaagctgcatcacggcgagaatcgtcttaaaaaattgatgtgttgtgagttctgcgccaaggtgttcggccatatcagagtgtacttcggtcatctcaaggaggtacatagagtggtgatttccaccgaacctgcgccaagcgagctccaacccggggacattccaaagaaccgtgacatgtccgttcgtgggatggagggttctctggaacgagaaaacaaatcaaatcttgaagaagattttctgctgaaccaagcagacgaagtgaagctccaaatcaagtgcggtcgctgccagattacagcacagagctttgccgaaatcaaattccacctgttggacgtgcacggggaggagatcgagggacgcctccaggagggaacgtttccagggtccaaagggacccaagaagagctggtacagcacgcctccccggattggaagcgacatcccgaacgtggaaaacccgagaaggtgcactcctctagcgaagagtctcatgcgtgcccacggctgaagcgccagctccacctgcatcagaatggcgtggagatgttgatggaaaatgagggtcctcagtcaggcacaaacaagccccgggagacttgtcaggggccagaatgtccaggtcttcatacctttttgctgtggagccacagcggcttcaattgcctattatgcgcagaaatgctaggcaggaaggaagatctcctccaccactggaagcaccagcataactgtgaggatccctcaaagttatgggcaatactgaataccgtctctaatcaaggcgtgatcgaattgagcagcgaggctgaaaaatag

SEQ ID NO: 14201 - DNA, 2487 bp, Artificial Sequence
  Description of Artificial Sequence: Synthetic coding sequence
atgcagaacagcgtcagcgttccccccaaggatgagggggaaagcaacatcccttctggaactatccagtctagaaaaggcctgcaaaataagagtcaattcagaaccatagccccaaaaatagtaccaaaggttctcacgtcacgtatgctgccttgccactctccaagccggtctgatcaagtgaacctgggcccctccattaactccaaattgttgggtatgtctacccagaattacgccctgatgcaggtggcgggccaggaaggaaccttttccctagtggcactgcctcacgtcgcaagcgcacaacctattcaaaaacctagaatgtctctgcccgaaaacctcaagcttccgatcccacgataccaaccgccccgtaactctaaggcttctcgaaagaagcccatcctgatctttcccaaaagcggttgctctaaagccccggcacagacccaaatgtgccctcagatgagcccgtcccccccccaccaccctgagctgctgtacaagccttctccgtttgaggaagtgccaagtctcgaacaggcccccgcttcaatttctacagcagccctgacaaatggcagtgatcatggagacctccgacctcctgtaactaatacccacgggagcctgaacccccccgccactcctgcttccagcactccagaggagcctgccaagcaagatctgacagctctgtctggtaaggcccattttgtgtcgaaaattaccagtagtaaaccaagcgccgttgcgagtgaaaaattcaaggagcaggttgacttggccaagacaatgaccaacctgtctcctacgattttaggaaacgccgtccagctgatcagttccgtgcccaaagggaaactaccaataccaccttactctcggatgaaaaccatggaagtgtataagataaaatctgatgccaacatcgctggcttcagtctgccggggccaaaggctgattgtgacaagatccctagtaccactgaggggttcaatgcggcaactaaggtggcaagccggttgcctgtcccccaggtgagccagcagagtgcttgtgagtcagccttttgcccacccaccaaactggacctcaaccacaagacaaagctgaactcaggagcagctaagcggaaaggacggaagcgcaaagtccccgatgagatcctcgcttttcagggcaagagacgaaagtacatcattaacaagtgcagggatgggaaggagcgcgttaaaaacgaccctcaggagttccgagaccagaagctcgggacactgaagaaataccgatctatcatgcctaagccaatcatggtgattcctactctggcctcactcgcctcccccactactctgcaaagccagatgctcggcggattagggcaggatgtgctcctcaataacagcctgaccccaaaatacctaggttgtaaacaggacaattcctcctccccaaagcccagcagcgtgttcagaaacggcttttcaggtatcaagaagccgtggcacagatgtcatgtatgtaatcatcacttccagttcaagcagcatcttagggatcacatgaacactcacaccaacaggcgcccctacagctgtagaatatgccggaagtcctacgtccgacctggttccttgtctactcacatgaagcttcaccatggcgagaaccgcctgaaaaagctaatgtgctgtgaattctgtgctaaagttttcggccacattcgggtttatttcggtcatttgaaggaagtccatcgtgtggttatcagtacggagccagccccatctgagctgcagcctggcgatattccaaaaaaccgagacatgagcgtgcggggtatggagggctccttagagcgggagaacaagtctaacctagaggaggatttcctccttaatcaggccgacgaggtcaagctgcagattaaatgcggacgatgtcagatcaccgcccagtcttttgccgagattaaattccacctgctggatgtgcatggagaggagatcgaaggacggttgcaggaaggcacatttccagggagcaaaggaactcaggaagaattggtccaacacgcctcccccgattggaagcgtcaccctgagcggggtaaacccgaaaaggttcattcatcttcagaagaaagccatgcatgtcctcggttaaaacgacagctgcatttgcaccagaacggggtcgaaatgcttatggaaaacgagggcccacagtctggaacgaacaaacccagagagacatgccaggggccagagtgtcctggcttacacacctttctcctgtggtcacacagcgggttcaattgcctgctttgcgccgaaatgctggggcggaaggaggatcttcttcatcactggaagcaccaacataactgcgaagacccctctaagttgtgggcgatattgaacactgtgagcaatcagggggtgatcgaattaagctccgaggccgaaaaatag

SEQ ID NO: 14202 - DNA, 2487 bp, Artificial Sequence
  Description of Artificial Sequence: Synthetic coding sequence
atgcagaactctgtatccgtaccccctaaggatgaaggtgagtcaaatataccctctggcacaattcaaagcagaaaggggttgcaaaacaagtcccagttcagaactattgccccaaaaatcgtaccaaaggtcctgacaagccgcatgctgccttgtcacagcccatctcgatccgaccaggtgaacctcggcccgtccattaacagtaaactgctgggaatgtcaacacagaattacgccctaatgcaggtagcgggccaagagggaactttttcacttgtggctctcccccacgttgcctctgcccagccaattcaaaagcctcgcatgagtttgccagaaaacctgaagctgcccatcccaaggtatcagcctccgcgcaactccaaggcctcaaggaaaaagcccatcctgatctttccaaaatccgggtgctccaaagcgccggcacagactcaaatgtgtccccagatgtctccctcccccccacaccatcctgaacttctgtataagccttctccatttgaggaggtcccctctctggaacaggccccagcttctatcagcactgctgcattaaccaacggttctgaccatggcgacctcaggccacccgtgacaaacacgcatggttctctgaacccacccgctacgcccgcctcctccacacctgaggaacctgccaaacaggacctgacagcattgtcaggtaaagcgcacttcgtgtctaagatcaccagcagcaagccgagcgctgtggccagtgagaagtttaaagagcaggttgacctcgctaagactatgactaatttgagtcctacgatcctgggcaatgcagtgcaactgatctcctctgttcccaagggcaagttacctatcccaccatactccaggatgaagaccatggaggtttacaaaatcaaatccgacgcgaatatcgccggcttctccctgcctggcccgaaagccgattgcgacaagatcccaagcactaccgaggggttcaacgcggcaacgaaggtggcctcacggctgccggttccacaagtctctcagcaatctgcctgcgaatctgcattttgtcccccaacaaagctggacttgaatcacaagaccaaattgaatagcggagcagccaagcgcaaaggccgcaaaaggaaggttcctgacgaaatattagcttttcagggcaagaggagaaaatatattattaacaaatgtcgagatggcaaagaacgggtgaagaacgatcctcaggagttccgtgaccagaagctgggcaccctgaagaagtacaggtctattatgcctaagcctatcatggttatacccactctggcaagcttggcttccccaacaacgctgcagtcacaaatgctcggcggcctgggccaggacgtgctgctcaataattctctgacacctaaataccttgggtgcaagcaagacaactccagcagcccgaagccctcaagtgtattcaggaacggcttcagcggcatcaagaaaccatggcacagatgtcacgtttgcaatcatcacttccagtttaagcagcatttacgggaccacatgaacactcatacaaaccgccgtccttactcatgccgtatctgcagaaagtcctatgtcagacccggaagtctttccacccacatgaagctgcaccatggagaaaaccgactgaaaaagctgatgtgttgcgagttttgtgccaaggtgttcggacatattcgcgtgtacttcggacatctgaaggaggtgcatcgtgtcgtgatcagcacagagccggcaccatctgaactccaaccaggagacattcctaagaatagggatatgtctgtgaggggaatggaaggctctcttgaacgtgagaataagagtaatctggaggaagattttttgctgaatcaggcagatgaggtgaaattgcagatcaagtgtggtcggtgtcagatcactgcacagagttttgccgaaatcaagttccacctgcttgatgtgcatggagaggaaattgagggccgccttcaggaagggacctttcctggctctaaaggtactcaggaggagctggtacagcacgctagtccggattggaagcgacaccccgagagaggaaagccggagaaggtgcatagcagctccgaagagagtcatgcctgtcccaggctcaaacggcagctgcatctgcaccaaaacggcgtggagatgcttatggagaacgagggtccacagtctgggacaaacaaaccccgagagacttgccagggacctgaatgccccggcctgcataccttcctcctgtggtcacattcagggttcaactgtcttctatgcgccgaaatgctgggcaggaaagaagacttactgcaccattggaaacaccagcataactgtgaggatcctagcaagctctgggccatcctgaacacagtctctaatcagggcgtgatcgaactgagctctgaagcggagaagtag

SEQ ID NO: 14203 - DNA, 2457 bp, Artificial Sequence
  Description of Artificial Sequence: Synthetic coding sequence
atggattccgagagcaacatcccttccggcacaattcagtcccgcaaggggctgcagaataagagccagttccgaactatcgctcccaaaatagtgcctaaagtactgacttccagaatgctcccctgccatagtccttcacggtcagatcaagtgaacctgggcccttccattaacagcaaacttttaggcatgtccacccaaaattacgccctcatgcaggtggctggccaggagggaacctttagtcttgtcgctctccctcacgtggccagtgcgcagccaatccagaagccccgcatgagtcttcctgaaaacctcaaactccccataccaaggtatcagccccctagaaacagcaaagcatctcggaaaaaacctatcctcattttccctaaatcaggatgtagcaaggcaccggcacagacacagatgtgtccccagatgtctccttctccgccacatcatccagagctgctatataaaccaagccctttcgaggaggttccctcccttgagcaggcgcctgcgagtatatcaaccgctgcactaacaaacggcagcgatcacggcgatcttaggccaccagtcaccaacactcacggttccctgaacccaccggccactcccgctagctccacccctgaggagcctgccaagcaggacttgaccgccctgtccgggaaggctcacttcgtctcaaagatcaccagttcaaaaccttctgccgtggcgagcgagaagtttaaagaacaagtcgacctcgccaagaccatgacaaacctttctcctactattcttggaaacgctgttcagctgatctcatcggtcccaaaaggtaaactgccgatcccaccatattccagaatgaagacaatggaagtgtacaaaattaaatccgacgccaatatagctgggttctcactccctggccctaaggctgactgtgacaaaataccaagcaccacagagggcttcaatgctgcaacaaaggtggcgtcccgtctacctgtcccgcaggttagccaacagagtgcctgtgaaagtgcgttttgccctcctactaagttagacctcaaccacaagacaaagctcaactccggtgcagccaagaggaagggcagaaagcggaaagtccccgatgagattctcgcttttcaagggaaacggcgcaagtacatcataaataagtgtcgagacggcaaggaacgagtcaaaaacgacccgcaggaattcagggatcagaagttgggcactctgaagaagtaccggagtataatgcccaagccaatcatggttattccaactctggcctctttggccagtcccacgaccctccagtctcagatgctgggggggttgggtcaagacgtgctcctgaacaactcactgacacccaaatacctgggctgtaaacaggacaactcctcgagccccaagccgtccagcgttttccggaacggattctccggtattaaaaagccttggcatcggtgccacgtctgtaatcaccacttccagttcaaacagcatctgcgggaccacatgaacacccatactaatcggcgtccgtactcttgtaggatctgccggaaaagctacgtgcgacctgggtccctttcaacacatatgaaactgcatcacggagaaaacagattgaagaagctaatgtgctgcgaattttgtgccaaggtgtttggacacattcgcgtctacttcggtcacctcaaagaggtgcatcgcgtagtaatctccacagagcctgctccgtcggaactgcaacccggcgacattcccaagaatagagacatgagcgtgcgcggtatggagggctcactcgagagagaaaacaagtctaacctcgaagaggacttcctcctcaaccaggccgacgaggtaaagctgcagattaaatgtgggcgctgccagattacagcccagagctttgcggaaattaagtttcacttgttagacgtccacggtgaggagatcgaagggagattacaggaaggcacctttcctggctccaagggaactcaggaagagctggtgcagcatgcttctccagattggaagcgtcaccccgaacgaggcaagccagagaaggtccacagttctagcgaagagagtcacgcctgcccccggctgaaacgacagctgcatctgcaccagaatggagttgagatgcttatggaaaacgagggaccacagtctggaacaaataagccccgggaaacgtgccagggtcctgagtgcccagggctgcacaccttcctgttgtggagccacagcggattcaattgtttgctctgcgccgaaatgctcggtcgaaaggaggacctgctccatcactggaaacatcaacataactgtgaagacccgtctaaactttgggcaatactcaacaccgtcagcaaccagggagtgattgaattgagctcagaggctgagaaatag

SEQ ID NO: 14204 - DNA, 2457 bp, Artificial Sequence
  Description of Artificial Sequence: Synthetic coding sequence
atggattccgagagcaacatcccatcagggactattcaatctcggaaaggactccagaataaatctcagtttcggactatcgctcccaagatcgtcccaaaagtactgactagtaggatgctcccctgccactccccaagccgttccgatcaggtgaacctaggaccttcaatcaattccaagcttctaggaatgtctacgcaaaactatgcccttatgcaggtggcagggcaggagggcacattctcactcgttgcattgccgcatgtcgcctcagctcaacctatccaaaagccccgtatgtccctgcccgagaatttaaagctgcccattccgcggtatcagccacccagaaattcaaaggcttctcgaaagaaacctattctgatttttcccaagtcaggatgttcaaaagcgcccgctcagactcagatgtgcccccagatgtccccttcgccccctcaccatccagagctcttgtataaacctagtccctttgaagaagtgccgagcctggagcaggcacccgcttccatcagtaccgccgccctaacaaatggttcagatcacggagacctccgtcctccggtcacgaacacacatgggtcattaaaccccccagccactccagcatccagcacccctgaggagccggccaaacaagatttgacagctctgagcggcaaagcacactttgtttctaagatcacttcttcgaaaccttccgccgttgcctcagagaaatttaaggagcaggtcgacttggccaaaacaatgacaaacctctcacctaccattctgggcaatgccgttcaattaatcagcagcgtgcctaagggaaaactcccaattccaccctattcaagaatgaaaacaatggaggtctataagatcaaaagcgacgccaacattgctggattctctttgccagggcctaaggcagactgtgataaaattccttccacaacagaaggcttcaacgccgccacaaaggtggcctctcgcctccctgtaccacaggtgtcccagcagtccgcatgcgagtccgccttctgccctcctacaaaactcgatctgaaccacaaaacaaagttgaattccggagctgcaaaacggaagggacgcaaaaggaaggttccagacgagattctagccttccaaggaaaacggcggaagtacattattaataagtgcagagatggcaaggagcgtgtcaaaaatgacccccaagagtttagggatcagaaattaggcacacttaaaaagtatcgctctattatgcctaaacctattatggtgatccctactctggcaagcttggccagtccgacaactttgcagagccagatgctggggggactgggacaggacgtcctcctgaacaactctttaacacctaagtacctgggttgtaagcaggataactcctcgagccctaagcccagctccgtgttcaggaacggtttctccgggattaagaagccctggcatcgatgtcatgtctgtaaccaccacttccagtttaaacagcacttaagggatcacatgaacacacacaccaatcgacgtccctacagttgtcgcatatgccgcaagtcttacgttcgcccaggctctctttctacccacatgaagttgcatcatggagagaataggctcaaaaagttaatgtgctgcgaattctgtgcaaaagtgtttggccatattagggtgtacttcggccatcttaaggaagtgcatcgagtcgtaatttcaaccgaaccagctccctccgaattacagccgggggacatccccaaaaaccgggatatgagcgttcggggcatggaaggctccctcgagcgcgagaacaagagtaaccttgaggaagattttctcctgaaccaagctgacgaggtcaagctgcagataaagtgtggccgctgtcaaattaccgcccagagcttcgctgaaattaagtttcatctgctcgatgtgcacggagaggagattgaaggtcggcttcaagaagggacattccctggttccaaagggacgcaggaggagctggtgcagcacgcctcacccgactggaaacgccacccagaaagagggaagcctgagaaggttcatagctcctctgaggaaagccacgcttgtccacggctcaaacgtcagttgcatctccaccagaatggggttgagatgttgatggagaatgaaggcccccaaagtggaactaacaaaccacgcgaaacctgtcaggggcctgagtgccctgggctgcatacattcctgctgtggtcccactctggcttcaattgcctcctatgcgctgagatgttgggaaggaaagaagatctgctacaccactggaaacatcagcacaactgcgaagacccctccaaactatgggccattttgaacaccgtgagcaaccagggcgtcatcgagctctccagcgaagccgagaaatag

SEQ ID NO: 14205 - DNA, 2340 bp, Artificial Sequence
  Description of Artificial Sequence: Synthetic coding sequence
atgctgccttgccactccccctcaagaagtgaccaggtgaatttagggccctctatcaattctaagcttctaggaatgagcacacaaaattacgccttgatgcaggttgctggacaggaaggaaccttctctttggtagcactcccccatgtggcgagcgcccagccgattcagaagcctcgcatgtcattacccgagaacctgaagttgcctatcccaaggtaccagcccccaaggaattcaaaggcatctcgaaagaagccaatccttatatttcccaaaagtggatgcagcaaggcccctgcccagacccagatgtgccctcaaatgtccccatctccaccccatcaccccgaactgctgtataagccctcaccattcgaagaggttccatctctggagcaggccccagcatcaatttccacggccgccctcaccaacgggtctgatcacggggacttacgcccacccgtcaccaacactcatggatctctgaaccctccagccacaccagcttccagcacccctgaagaaccagctaaacaggatctcacagccttgtcagggaaagctcactttgtgtctaagattaccagctcaaaaccatcagctgttgccagtgagaagtttaaggagcaggtggatcttgcgaaaacaatgacaaatctctctcccaccatactcggtaacgccgtccagctcatctccagcgttcccaaaggaaaacttccaatcccaccttatagccgaatgaaaactatggaagtgtacaagatcaaatcagatgctaacattgcgggatttagtctgcccgggccgaaggcagattgcgacaagatcccgagcacaacagagggatttaatgcagccaccaaagtagcttcccggttacctgtaccacaggtcagccaacagtctgcctgtgaaagtgccttttgtcccccaactaaactcgatttgaatcataaaactaaactgaacagcggtgctgccaagcgcaaagggcggaaacgtaaagtgcccgatgagatcctcgccttccagggcaaacgtaggaaatacatcatcaataaatgtcgggacgggaaggaacgggtgaaaaacgacccacaggagttcagggaccagaaactgggcactcttaagaagtaccgtagcattatgcccaaacctattatggtaattcctacactcgcatccttggcgtccccgactacccttcagagccaaatgcttggaggtctaggccaggacgtcctcttgaataatagtctgactcctaagtacctgggctgcaagcaggataatagtagcagccctaaaccaagctccgtgttcaggaacggctttagcggcattaagaaaccctggcaccgctgccacgtttgtaatcaccatttccaatttaagcagcatctgcgggatcacatgaacacccacacaaaccgccgaccttactcctgcaggatctgtcgaaagagctacgtgaggccagggagcctctcaacacatatgaagctgcatcacggtgaaaacagactcaagaaactgatgtgctgtgagttctgcgctaaggtcttcggtcacatccgggtgtattttggccacctgaaggaagtgcatagggtggtcatttccacagagccggcccccagcgaactacagcctggcgacattcctaaaaaccgagatatgagcgtgcgcggtatggaaggctcactggaaagggaaaacaagtctaatctcgaggaggacttcctcttaaatcaggctgacgaggtcaaactgcagattaagtgtggtcgctgtcaaatcaccgctcagagtttcgctgaaataaaattccatctcttggatgtgcacggcgaggagatagaagggcgcctccaggaaggcaccttcccaggaagtaagggaacccaggaagaattggtacaacatgcgtcacctgattggaaacgacaccctgaaaggggaaaacccgagaaggttcattcttctagcgaggagtcccacgcgtgccctagactcaagcgccagctgcacctccaccagaacggagtcgaaatgctaatggagaacgagggccctcagagcggcactaataagccgcgggaaacttgccaggggccagagtgtcccggattacacactttcctgttgtggtcccacagcggttttaattgtcttctttgtgccgagatgctggggaggaaggaagatctcctgcaccactggaagcaccagcacaactgcgaagacccaagcaaactgtgggccatactaaatacagtgtctaaccagggagttatagagctgagttccgaggccgaaaaatag

SEQ ID NO: 14206 - DNA, 1500 bp, Artificial Sequence
  Description of Artificial Sequence: Synthetic coding sequence
atgctttccctgtccccaatcttgttatacacatgcgaaatgtttcaggatcccgtcgccttcaaggacgtcgccgtgaattttacacaagaagagtgggccctcctggacatcagccaaaaaaatttatatagagaggtcatgttggagacgttctggaaccttacctcaattggtaaaaagtggaaggaccagaacattgaatatgagtatcaaaatccacgccgcaactttcgatccgtgacagaagaaaaagttaacgagatcaaggaagacagccattgcggagagacatttacccccgttccagatgacagactcaatttccaaaagaagaaggcaagcccagaggtcaagagttgcgatagtttcgtatgtgaggttggtctcggcaattctagctctaacatgaacattcggggggacaccgggcacaaggcttgtgaatgccaggaatacggaccaaaaccttggaagtcccaacaacctaagaaagcatttagatatcatccaagccttcgtactcaggagagggatcataccgggaagaagccctatgcatgcaaagagtgtgggaaaaacatcatctaccattcttccattcagcgtcacatggttgttcattccggggacggcccgtataaatgcaagttttgtgggaaggctttccattgtctgagcctttaccttatccatgagcgaacacacacaggggagaaaccctacgagtgtaaacaatgcggaaaaagtttcagctatagtgcaacccacagaatccacgaaagaactcacatcggagaaaaaccctatgagtgtcaggagtgcggaaaagctttccatagccctcgctcctgccacaggcatgaaagatcccacatgggtgagaaagcataccagtgcaaggaatgtggcaaggcctttatgtgtcctaggtatgtaagacgacatgaacgcacacatagcagaaagaagctgtacgaatgtaagcagtgcgggaaagcactgtcctccctcacatctttccagacccacatacggatgcattctggagaacggccttacgaatgtaaaacgtgtgggaagggcttttactctgccaagtcattccagcgccatgagaagacacattccggagagaagccttacaaatgtaagcagtgcggtaaagcatttaccagaagcgggtcattcaggtaccacgagcggacacatacgggcgagaaaccctacgagtgcaaacaatgtggcaaggccttccggagcgctccgaatctgcaactacatggcaggacacataccggcgaaaaaccttatcagtgcaaagagtgtggaaaggcttttcggagtgcctcacaattacggattcacaggcgtatccacaccggagagaagccctacgaatgcaaaaagtgtgggaaggcatttaggtacgttcaaaattttcgattccatgagcggacgcagacacacaagaatgcactctggcgcaaaacgctctag

SEQ ID NO: 14207 - DNA, 1788 bp, Artificial Sequence
  Description of Artificial Sequence: Synthetic coding sequence
atggatccggttgcctttaaggacgtagccgtgaatttcacacaggaggagtgggcgctgctggatatctcacaaaggaagctgtacagggaagtcatgctggagactttccggaacctgacaagtttggggaagcggtggaaagatcagaatattgagtatgaacatcaaaatcctcgtagaaactttagatcactaatcgaagagaaggtgaatgagataaaggatgattcccactgtggcgaaacgtttactcccgtgcctgacgataggctgaacttccaagaaaaaaaagcaagccccgaagtcaagtcttgtgagtcttttgtttgcggtgaagtcggcctgggcaactcttcttttaacatgaatattcgcggagacatcggccataaggcatatgaataccaggagtacgggccaaaaccttgtaagtgtcagcagcccaagaaagcctttaggtaccggcccagcttcaggactcaggaaagagatcacactggagaaaaacctaacgcttgcaaggtgtgtggaaagacatttattagccattccagcgttaggaggcacatggtgatgcactccggagatggcccttacaagtgcaagttttgtgggaaggcattccactgtctgcgcctctacctgatccacgagcggattcacaccggagagaaaccttgtgaatgtaagcagtgtggaaagtcattttcttatagtgccacccataggatccataaacgaactcacacaggggaaaagccttatgagtaccaggagtgcggaaaagcattccactctcctagaagttatcgcaggcatgagcggattcacatgggggagaaggcttaccagtgtaaagaatgcgggaaagcctttacttgtcccagatacgtgcgcatccacgaacgaactcacagtcggaagaacctgtatgagtgtaaacagtgcggtaaagcactttcctctcttacctccttccagacacatgtgcgcctccactccggtgagagaccttatgaatgcaagatctgcggaaaagatttctgctccgttaacagtttccaacgccacgagaagattcatagtggagaaaagccatataagtgcaaacagtgtgggaaagcattcccccattcatcctccctgaggtaccacgaacgcacccacaccggcgagaagccttatgaatgcaagcagtgcggcaaagctttccgctctgcttcccacttgcgggtccatggtagaacccataccggtgagaagccatacgaatgtaaggaatgtggcaaggctttcagatacgtgaacaatctacagtcccatgaaagaactcagactcacattcgtatacattcaggagagagaaggtataagtgcaaaatttgcggcaagggattttactgtccaaaatcatttcagcgtcacgaaaaaacacacaccggagaaaagctgtacgaatgcaaacagcgctcagtagtgccatctgtagttccagtaccctttgacattatgaaaggcctcacactggaacgaagcccaatcaacgcctcaaacgtgggcaagccaagcgagctttgccagagctttgagtgtatggtgggtttaacactgaagcgtaaccccatgagtgtgtctaatgacggtaagcctagcgacctgcctcacacttttgagtacgtggtgggtcataccatggagagaagtcctatgcatgtcaggaacgtgggcaatccatctgaccttcctaggacattcgagttcatgaaagggcacaagcatacgtag

SEQ ID NO: 14208 - DNA, 2082 bp, Artificial Sequence
  Description of Artificial Sequence: Synthetic coding sequence
atggatagcgtcgccttcgaagatgtggctatcaacttcacttgcgaagaatgggctcttctagggccctcgcaaaagtctctatacagagatgtcatgcaggaaacaatacgcaatctggactgcatcggcatgatttggcagaaccacgatatcgaggaggatcaatacaaggatctgcgtcggaatcttcgttgccacatggtagaacgagcttgcgaaatcaaagacaattcccaatgtgggggaccgtttactcagacccaggatagcattgtcaatgaaaagatcccaggcgtcgatccctgggaaagctctgagtgcaccgatgtgctgatgggaagatcttctcttaattgctatgtccgtgtcgattccgagcacaaaccctgtgagtatcaggagtatggcgagaagccgtatacccacacgcaatgtggaacagccttttcttatcaaccttgtttccagatccacgagcgtccacaacacggaaagaagctctacgactgtaaagaatgtgcctcattctccagtctcgagaacctgcagaggcacatggcagctcatcacggtgacggccctaggatttgtaagctatgtggaaatgcttttatttggccgtccctctttcacatgctgcgcaggacacacacggaagaaaagccttatgagtatgaacagtgttccacggccttccccgcctatagctcaacattaaggcatgagagaacccactccggagagaagccctatcaatgcaaacagtgcgggaaggccttctcttgcagctgttacacccagctgtatgaaaggacacatactggggagcagagctatgagtgcaaacagtgtggtaaggctttttaccaccttgggagtttccagaggcatatgattgtgcacactggcgatggtccccacaagtgcaagatctgcggtaagggcttcctgtcaccctcgtccgtgaggcgtcataagaggacacatactggagaaaaaccatacgaatgtaaatactgcggaaaagcattttctgattgtacggggtttaggcggcatatgataacacatacaggggatggcccccacaagtgcaaagtttgcggaaaggcctttgactctccctcgctgtgtagacgacacgagacaacgcacacaggggagaaaccatacaaatgtgagtgtggcaaggccttcagcgatttttattacttccgcaatcacgaaaccactcacactggggagaaaccctacaagtgcaaacagtgtgggaaggctttcatctgttgcacatatctccaaattcacgaacggatacacaccggcgagaggccttataaatgtaagcaatgcggtaaggccttcagaagttcaaattacatccgtgtgcacgagaaaacacataccggagagaagccttacgaatgcaagcagtgtggaaaggcacttagccatctaaagtcatttcaaaggcacatgataatgcatactggagatggccctcataaatgtaaaatctgtggaaaatctttcgacagtccaagctctttcaggaggcacgaacgcattcatactggcgagaggccttacaagtgcaagttatgtggcaaagggttcaggtccagcagctacatccagttgcacgagcggacgcacacaggagaaaaaccctacggctgccaacagtgtggcaaggctctttccgatttgagctcctttcgtcgccatatgattacacatactgggaacgggccacataaatgcaaaatatgcggcaaaggattcgattatccgagctccgtccaacgacatgagcggacccatactggggaaaagccgtacgaatgtaaagaatgtggcaaagctttttcgcacagcagttacctgcgaatccatgaaagagtacatactggcgaaaagccatataaatgtaaagaatgcggcaaaccattccactgtccatccgccttccacaaacatgaaaggacgcatagtatggagaagccctacaaatgcaaggaatgcggtgaggcctttcactgcatcagttcctttcacaaacatgagatgacacattag

SEQ ID NO: 14209 - DNA, 1881 bp, Artificial Sequence
  Description of Artificial Sequence: Synthetic coding sequence
atggtggaacgtgcctgcgagatcaaggacaatagccagtgcggagggccgtttacacagacacaggactccatcgttaatgagaaaatacccggcgtcgacccatgggagtcatctgaatgtaccgatgttctgatgggacggtcaagcctgaattgttacgtgcgagtggatagcgagcataagccttgcgagtaccaggaatatggtgagaagccctacacccacactcagtgcggtacagcttttagctatcagccatgttttcagattcatgaacgccctcagcatgggaagaaactatatgactgcaaggagtgtgcaagcttttcatctctagagaacctccagcgtcacatggcagcccaccatggggatggccccaggatatgcaaattatgtggaaatgccttcatctggccaagcttgttccacatgctgcgccggacccatacagaagaaaaaccctacgagtacgagcaatgcagcactgcattccccgcttattcgtcaacactgcgtcacgagagaacacactctggagaaaagccctaccagtgcaagcagtgtggcaaggcattttcttgtagttgttacacacaactttatgagaggactcatactggcgagcaatcctacgaatgcaagcagtgcggtaaagccttctatcacctcggctcctttcagagacatatgatcgtgcacactggggacgggccccacaaatgtaagatctgtgggaaagggtttctaagcccatcatcagttaggcgtcacaagcggacccatacaggagaaaaaccttacgaatgcaagtattgcggaaaagcctttagcgactgcactggtttcagaaggcacatgataacacacaccggggacggcccccataagtgtaaagtctgtggaaaagcatttgactcaccttctctgtgccgcagacacgagacgacacataccggtgaaaagccctataaatgtgagtgcgggaaagcgttctctgacttttattacttcagaaatcacgagacgacccatacaggtgaaaagccatataaatgcaagcagtgcggtaaagctttcatatgctgcacctatttgcagatccatgagagaattcataccggtgagcgaccatataagtgcaagcagtgcggtaaagcgtttagatcatccaactatattcgcgtccacgagaaaactcacaccggtgaaaagccctacgaatgtaagcagtgtggaaaggctctgtcccatttaaagagtttccaaaggcacatgattatgcatactggtgacggaccccataaatgcaaaatctgcggtaagtctttcgacagcccgagcagctttagacgtcacgagaggatccataccggagaacgtccctataaatgcaagctctgcggtaaaggctttcgctctagcagctacattcaacttcacgagcggacacacacaggtgagaagccatatggatgccaacagtgcgggaaggcactgtccgacctaagctccttccgtagacacatgattactcatactggcaatggcccacataagtgcaagatttgcggtaaggggtttgactatccgagttccgtgcagcgtcacgaacgtacccacacaggcgaaaaaccctacgagtgcaaagagtgtggtaaagccttcagccactcttcttaccttcggatccatgaacgggtccataccggtgagaagccatacaagtgcaaggagtgcggtaaacctttccactgtcctagcgcgtttcataaacacgagaggacacacagcatggagaagccgtataagtgcaaggagtgcggagaggcatttcattgcatctctagctttcataagcatgaaatgactcactag

SEQ ID NO: 14210 - DNA, 1884 bp, Artificial Sequence
  Description of Artificial Sequence: Synthetic coding sequence
atgatagtgttcggaggcgaagaccgcagtgatctgtttctacctgattcacagactaatgaagagaggaaacagtacgacagcgtcgcctttgaggatgttgcagtgaactttacgcaagaggagtgggccctcctgggaccctcccagaagagtctgtaccgcgacgtgatgtgggaaaccatccggaatctggattgcataggcatgaaatgggaagacacaaatatagaagaccagcacagaaatccaagacggagtttacggtgtcacatcatcgaacgtttcagtgagagcaggcagcctgattctaccgtcaacgagaagccccccggcgtggacccttgtaagagtagtgtgtgcggagaaatcatggggtgtagcttcctcaactgttatataaccttcgacgcaggacataagccagacgaatgccaagagtacggtgagaaacctcatacccacaagcagtgcggcacagctttcaattatcatcacagctttcagacccaagaacgcccgcacactggcaagaagagatacgattgcaaggagtgcggtaagacgttttctagttcaggcaacctccggaggcacattatcgtgcaaaggggcggcgggccgtacatatgtaagctctgcggcaaggctttcttttggccttctttgttccgcatgcacgagcgtacacataccggagagaaaccttatgagtgcaagcagtgttgcaaggcattccctatttacagcagttacctgcggcatgaacgcacccatacgggggaaaaaccttacgaatgcaaacattgttccaaggcgtttccagattactcgtcatatgtaagacatgaaagaacacataccggcgaaaagccttacaagtgcaaacgctgcggccgcgccttctcagtctccagcagcctgaggattcacgaacgaacacacacaggagagaaaccttacgagtgtaagcagtgtggaaaagcctttcatcacctcggatcgttccagcggcacatgatccgacacacaggggacggaccccataaatgtaagatttgcggaaaaggttttgactgcccatcctccctccagagccatgagaggactcacaccggagagaagccatacgagtgcaaacagtgtgggaaggccctgtcacaccactcgagctttaggagccacatgattatgcacaccggtgatgggccccataaatgtaaggtctgcggcaaagctttcatttatccttctgttttccagggtcacgagcgaacacacacaggggagaagccatacgagtgcaaagagtgtggcaaagcctttcggatctccagcagtttaaggcgccacgagaccacccacactggcgaaaagccttacaagtgtaaatgtggtaaagcctttatcgatttttatagcttccaaaaccacgagacgacccataccggtgagaaaccgtacgagtgtaaggagtgcggcaaagccttttcttgtttcacgtaccttagccaacatcggcggactcacatggcagaaaagccttacgaatgcaagacctgcaagaaggctttcagccacttcggcaacttaaaggtgcacgagcgaattcacaccggggagaaaccatacgagtgcaaggagtgtcgaaaggccttctcctggttgacctgtctactaagacacgagaggattcataccggaaaaaaatcatacgagtgtcaacagtgtgggaaagcctttactaggagcagatttctgagaggacacgaaaaaacgcataccggcgagaagatgcacgaatgtaaggaatgcgggaaagccttgagcagcctgtccagtctccaccgccataagcggacccattggcgtgacacactgtag

SEQ ID NO: 14211 - DNA, 1677 bp, Artificial Sequence
  Description of Artificial Sequence: Synthetic coding sequence
atgaagtgggaggataccaacattgaggaccaacaccggaatccccgaaggagcctgcgctgccatatcattgaacggttttccgaaagtcgtcagccggattcaacggtcaatgaaaagccccccggtgtggatccttgtaaaagctctgtttgcggagagattatgggatgcagcttcttaaattgttacattacatttgacgcaggtcacaagcctgatgagtgccaggagtatggtgagaagcctcacactcacaagcagtgcggaactgcattcaattaccatcacagcttccagacccaggagcggcctcacacaggtaaaaagcgctacgattgcaaggagtgtggaaaaacattctcatccagcggcaatctgcggcgccacatcattgtccaaagaggaggcggcccttacatttgcaagctgtgcggtaaggccttcttctggccgtccctctttaggatgcatgaaaggacccacactggtgaaaagccctacgaatgtaaacaatgttgtaaggcgttcccgatttactctagttacctccgccacgagaggacccacaccggcgagaaaccatatgaatgtaagcactgttccaaggccttccccgattatagcagctatgtccggcacgaacggacacacaccggtgagaaaccctataaatgtaaacgctgcggaagagcttttagcgtctcaagcagccttaggattcacgagcgcactcatacaggggagaagccctatgaatgtaagcagtgcgggaaagcttttcatcacctgggatcatttcaaagacatatgatccgccatacaggagatggcccacacaaatgtaagatttgcggaaagggattcgactgccctagcagccttcaatcacatgaacgcacacacaccggggagaaaccctacgagtgcaagcagtgcggcaaggcactcagtcatcattccagcttccgaagccacatgattatgcacaccggcgacggacctcacaaatgcaaggtatgtggcaaggcgtttatttatccttccgtgttccaggggcacgagagaactcatactggcgagaaaccctacgaatgcaaggagtgcggcaaagccttcaggatctctagctcgctcaggaggcatgaaactacccataccggagaaaagccgtataagtgtaagtgtggcaaggctttcattgatttctacagtttccagaatcacgagaccacgcacactggcgaaaagccatacgaatgtaaagaatgcggtaaagcattctcctgtttcacttaccttagtcaacacaggcgaacgcatatggccgaaaaaccttacgagtgtaagacctgcaaaaaagccttttctcattttgggaacctgaaagtccatgagcggatccatactggggagaagccctatgagtgtaaagagtgcaggaaagcgttctcatggctgacttgcctgctcaggcacgagcgaattcacaccgggaaaaagagctacgagtgtcagcagtgtgggaaggcattcacaaggtctcgtttcctacgaggccatgagaaaactcacaccggggaaaagatgcacgagtgtaaagaatgcggcaaggctttgtcatccctgtctagtctgcacaggcataaacgaacccactggcgcgatactctttag

SEQ ID NO: 14212 - DNA, 2016 bp, Artificial Sequence
  Description of Artificial Sequence: Synthetic coding sequence
atggcctctgtcgcccttgaggatgtagctgtaaacttcactcgggaggaatgggctttgcttggcccttgccagaaaaatctgtataaagatgtgatgcaggagacaatccgcaatcttgattgcgttgtgatgaagtggaaggatcaaaatatcgaagaccaataccgctaccctcgcaaaaacctgcgatgtcgtatgctggagcgatttgttgagtctaaggatgggacgcagtgcggggaaaccagctcccagattcaagattccatcgtcaccaagaatactctgcctggtgtgggaccatgcgagtcatcaatgcgaggtgagaaggtgatgggccactcctccttgaactgttacattagagtgggcgctggacacaaacctcacgaataccatgaatgcggggaaaagcccgatacgcataagcagcgaggcaaagcgttttcatatcataatagcttccaaacccatgagaggctccacacgggtaaaaagccatatgactgtaaggaatgcggcaagagtttcagctctctcggaaacctgcagaggcatatggccgtgcaacgcggcgatggaccttacaagtgcaagttgtgtgggaaagccttcttttggcccagtttgcttcacatgcatgagaggacgcataccggtgaaaagccttatgagtgtaagcaatgctctaaggccttctcgttttactcatcatacctgagacacgaaaggacgcacacaggagagaaaccctacgagtgtaagcagtgctccaaggcatttccattttacagcagctacctcaggcatgagagaacacatactggtgagaagccttacaagtgcaagcagtgtagtaaggccttccccgattcctcctcctgtcttattcacgagcggacccacaccggcgaaaagccatacacgtgcaagcagtgcggcaaggcattctcagtgtccggcagccttcaacgacacgaaaccactcactcggccgagaagccctacgcttgccagcagtgcggaaaagcattccaccacttaggaagcttccagcggcatatgatccggcataccggcaacggaccgcataaatgcaagatctgcggcaaaggattcgactgcccctctagtcttcagtcacacgagcggactcataccggagaaaaaccatatgagtgcaaacagtgcggcaaggcgctctcccatcggtcttcatttagaagccacatgatcatgcatacaggtgacggtccccacaagtgtaaagtgtgcggcaaggccttcgtgtacccaagcgtgttccagcgccacgaacgcactcacacggctgaaaaaccctacaagtgtaaacagtgtggtaaggcttataggatctccagttccctgcggagacatgagactacacatactggagagaaaccatacaagtgcaagctggggaaggcttgtatcgacttttgcagcttccagaaccacaaaaccacacacaccggcgagaagccatacgaatgcaaagagtgtggaaaggcattcagtcggtttagatatctgtcgcgacataagagaacacatacaggcgagaagccatatgaatgcaaaacctgccgtaaggcattcgggcactatgataaccttaaggtgcacgagcggatccacagtggagagaaaccttacgagtgcaaggagtgtggcaaagctttttcttggctcacttgtttcctccgccatgagcgcatacacatgcgcgaaaagagttatgagtgtccacaatgtggcaaagccttcacccacagccgtttcctgcaagggcatgagaagacccatactggggagaacccttacgagtgcaaggagtgcggcaaagcctttgcctctctgagctctttacaccgacacaagaagacacactggaagaagactcatactggagaaaatccgtatgagtgcaaggaatgtggcaaggcttttgcgtctctctcttccctgcatcgccacaaaaaaacccattag

SEQ ID NO: 14213 - DNA, 1932 bp, Artificial Sequence
  Description of Artificial Sequence: Synthetic coding sequence
atggcaagcgtggctctggaagacgtggcagtaaattttaccagggaagagtgggccctgttaggcccctgccaaaagaatttatacaaggatgtaatgcaagagactatcagaaacctggattgtgtggtaatgaagtggaaagatcagaatatcgaagaccagtacaggtatcctcgcaagaatctcaggtgccgcatgttagaacggttcgttgagtccaaagatggcacccaatgcggcgagacaagtagccagatccaagattcaatagtaaccaagaatacgctgcctggtgtcgggccctgcgagagcagcatgcggggggaaaaggtgatgggccattccagccttaattgctacatacgggtgggggccggacataagcctcacgaatatcacgagtgtggtgaaaagcctgatacacacaagcaacgtggcaaggctttctcctaccacaactcatttcagacacacgaacggctacataccggaaagaagccgtacgactgcaaagagtgcgggaagagtttctcatctcttggaaatttacagaggcacatggccgtgcaacgaggtgatggcccatacaagtgtaaactgtgcggaaaagctttcttctggccttctctccttcatatgcatgaacgaacacacacaggtgagaagccctacgaatgtaagcagtgttctaaggcctttagcttttatagttcctatctcaggcatgaaagaactcacactggggagaagccctatgagtgcaaacaatgcagtaaagccttcccattctatagttcctatctcaggcatgaaagaacccacactggcgaaaaaccttataaatgcaagcaatgctccaaagcattcccagattcatccagttgtctgatccatgagcgaacacacaccggggaaaagccctatacctgcaagcaatgcggcaaagcattttctgtgtcagggagcctacaacgccacgagacgacacatagcgccgagaagccctacgcatgtcagcagtgcggcaaagcctttcaccatttaggaagctttcaacggcatatgattcggcacaccggcaacggtccccacaagtgtaagatctgtggcaaagggtttgactgtcccagtagcctccagagtcacgagcgcactcacaccggtgagaaaccatatgaatgtaaacagtgcggaaaggcactcagtcatagaagcagcttcaggtcccacatgattatgcacacaggcgacggcccccataaatgtaaagtttgcggaaaggcctttgtataccccagcgtctttcagaggcacgaaagaacccacaccgcagaaaaaccatataagtgcaaacagtgtgggaaggcctaccggatttcctctagcctacggagacatgagacaacacacaccggcgaaaaaccttacaagtgcaaactgggcaaagcctgcattgacttctgtagctttcagaaccacaagacaacacacacaggagagaagccctacgaatgtaaggagtgtggcaaagctttctccaggtttcggtacctaagtagacataaacgaacccacaccggagagaaaccctacgagtgtaaaacttgcaggaaagccttcggccattatgataacttaaaagttcatgaacggattcatatgagagaaaagagctacgagtgtccccagtgcgggaaggcattcacacatagtagatttctccaggggcacgaaaaaacccatactggagagaacccttatgaatgcaaggagtgcgggaaggctttcgccagtctgtctagcctccatcggcataagaaaacacactggaaaaagacacacaccggtgagaacccttatgagtgcaaagagtgcggaaaagcctttgcaagcctgtctagcttgcatagacacaaaaagactcattag

SEQ ID NO: 14214 - DNA, 1053 bp, Artificial Sequence
  Description of Artificial Sequence: Synthetic coding sequence
atgccacctggtagatggcacgccgccagtagcggtcccgtttttgagggggctcgcctgcaaactgtcaaaaaagaagaagaggatgaaagttacacaccagttcaggcggcccggcctcaaactttgaaccgccccgggcaggagctctttcggcaactctttagacagctgcggtaccatgaatccagtggccctctcgaaacattgagccgcctgcgggagttgtgcagatggtggctcagaccagatgtcctgtctaaagctcagatcctggagctcttagtgctggaacaatttctctctatcctcccaggcgagctgagagtatgggtgcaactgcataatcctgaatcaggagaggagtggccctgttggcggagttgtcgcggcaccttgatgggccatcccggcggaacaagggcaccagaacccagatgtgctctcgacggctatcggagccgctcagcccaaatctggagtctcgcctcccccctgcggagttcgtcagctctaggcgaccatcttgaaccgccatacgaaatcgaggcccgcgacttcctggccgggcagtcagatacaccagcggcccagatgcctgccctgtttcctagagaagggtgtcctggggatcaagtgacgcccactaggtcacttactgctcagttgcaagagacaatgacctttaaagacgttgaagtcaccttttcgcaggacgagtggggctggcttgacagcgctcaacgcaatctgtatagggacgtgatgttggagaactacaggaacatggctagcctggtcggcccatttacaaagcccgcacttatcagttggcttgaggccagggagccgtggggccttaacatgcaggccgctcagccaaaaggcaaccctgtggctgcccccacaggggatgatctccagtctaagacgaacaaatttattctaaatcaggaaccccttgaggaagccgagaccttagcagtgagctccggctgtccggccacctccgttagcgaagggataggcctccgagaatcattccagcagtag

SEQ ID NO: 14215 - DNA, 3096 bp, Artificial Sequence
  Description of Artificial Sequence: Synthetic coding sequence
atgcccccgggaagatggcatgccgcttaccctgcccaggcacaatctagtagagagcgcgggcggcttcagactgtgaagaaggaggaagaggatgaatcttatacacccgtgcaggccgcccgcccacagacgttgaatcgccccggccaagagctgttcaggcagttatttaggcaattacgatatcacgagagttctggacccctggaaacactgtctcggctccgggagctctgccgttggtggctgaggcctgacgtgcttagcaaggcacagatattggagctgctcgtgctcgagcagttcctctcaattttgcctggagaactaagagtatgggttcagctacacaaccccgaatcaggagaagaggccgtggcactgttagaggaacttcagcgagatttggacggaacgagttggagggatcccggccccgcccagtcccccgacgtccattggatggggacaggagccctgagaagcgcacagatctggagcctggccagtccgttgagatcctcttcggcattgggggatcacctcgaacccccttacgagatcgaagcaagagacttcctcgccggccagtcggacaccccagcagcccaaatgccagccttgtttccacgggaagggtgtcccggggatcaggttacccctacgcgctccctcaccgcccagttacaagagacgatgacattcaaagatgtggaagtgaccttttctcaggatgaatggggatggctcgacagcgcccagagaaatctgtacagggatgtgatgctggagaactatcggaatatggccagccttgtgggcccgttcaccaagcccgcccttatttcatggttggaggcgcgcgagccatggggtctgaacatgcaggctgcccagcccaaaggaaatccagtggcagcacccacaggagatgacctgcaatccaagactaataaatttatactgaatcaggaaccactggaggaggcggagacactcgccgtctccagcggctgtcctgccacctctgtgtcagagggtatagggctcagggagagctttcagcagaagtccagacagaaggaccaatgtgaaaatcccattcaggtgcgagttaagaaggaagagacaaacttttcgcacaggaccgggaaggacagtgaggtgtctggctccaactcactggatctgaaacatgtcacttatttaagagtgtcgggcagaaaagagtccctgaaacacggctgcgggaagcatttcagaatgagctcgcatcactatgattacaaaaagtacggtaagggtctgcgccatatgataggtggattctcactacaccagagaatccacagtggattaaagggaaacaagaaggatgtatgcgggaaggacttcagcctttcatcccaccaccagagaggccagtccttacacacagtaggcgtgtccttcaaatgttccgactgtggccgaactttttctcactcctcgcatctcgcctatcaccagcgcttgcacactcaggagaaagcatttaagtgtcgggtgtgcggcaaggcttttcggtggagtagcaattgcgcacggcatgaaaagatccataccggcgtaaagccatacaaatgcgatctgtgcgaaaaggcattcaggcgtctcagtgcgtatcgcctgcaccgtgaaactcacgccaagaaaaaattcctcgagttgaatcaataccgcgctgctctcacatactcaagtgggtttgatcatcacctgggagaccagtccggggagaagctcttcgactgctcgcagtgccggaaatcctttcattgtaaatcttatgtactggaacaccagaggattcatacccaggagaaaccatacaagtgtactaagtgccggaaaactttccgatggcggtctaatttcacccggcatatgaggctgcacgaggaagaaaaattctataagcaagatgaatgtagagaggggttcagacagtcccccgactgttcccagcctcagggggccccagccgtggaaaagacgtttctgtgtcaacaatgcgggaagacattcactcgcaaaaaaaccctggttgaccaccagagaatccacaccggagaaaaaccgtaccagtgctcagactgtggtaaggactttgcctataggtcagctttcatcgtgcacaagaaaaagcatgctatgaagagaaaaccggaagggggaccaagcttttcccaggatactgtttttcaggtcccgcaatccagccactcaaaggaagagccttacaagtgttcccaatgtggcaaagcctttagaaaccatagttttctcctaatccaccagagagttcatacaggggagaagccttataagtgcagagaatgcggaaaggcattcagatggagttctaatttataccgccaccaaagaatccattctcttcagaagcaatatgattgccacgagtccgagaaaacacccaacgtggagccaaaaattctgacaggcgagaaaagattttggtgtcaggagtgtggtaagaccttcacacgcaaacgcaccttgctggaccacaaaggcatccacagtggggagaagagatacaaatgcaatctctgcggcaagagctatgatagaaattatcgtctggtcaaccatcagcggattcactccacagagcgcccctttaaatgccaatggtgtgggaaagaatttataggacggcatacactctcttcccatcagaggaagcacactcgggcagcccaggccgaacggtcccctcccgcacggagttcctcccaggatacaaagctcaggctgcaaaagctaaagccttcagaagaaatgccattggaagactgcaaggaggcttgctctcaatcaagccggctcaccggcctccaagacatcagcatcggcaaaaaatgccacaagtgttcaatatgcggtaagacctttaacaaatcaagccagctgatctcacacaagagattccatacccgggagagacccttcaagtgctcaaaatgcggcaaaaccttccgatggagtagcaacctagcccgtcacatgaaaaatcacatccgggactag

SEQ ID NO: 14216 - DNA, 3096 bp, Artificial Sequence
  Description of Artificial Sequence: Synthetic coding sequence
atgccccccggtagatggcatgccgcttacccagcccaggcgcagtctagcagggaaagaggcaggcttcaaaccgtgaagaaagaagaggaagacgagtcatacacacctgtgcaggccgccagacctcaaaccctgaatagacctgggcaggaactgtttcggcagttgttccggcagctccgataccatgagtcctcgggtccgctggaaaccctgtcgcgcctgcgagaattatgtcggtggtggttgcggcctgacgtgctgtcaaaggcccagattctggaactcctggttctcgagcagtttctgtcaatcttaccaggtgagcttagagtctgggttcagctccacaaccctgaaagcggagaagaagccgtggccctgttggaggagctccaaagggatttggacgggaccagctggcgggatcccggtcctgcccagagtcctgacgtgcattggatgggcactggagctcttcggtctgctcagatctggtctctggcatccccactccggtcatccagcgctctcggggaccatttggagcctccctacgagattgaagcaagggacttcctggccggccaatcagatactcccgcagcgcaaatgccagctcttttccctagagagggttgccccggagaccaggtgacacccacgcgatctttgacagcgcagctgcaagagactatgactttcaaggacgtggaagttacattctctcaggacgagtggggctggttggacagcgcccaacgcaacctgtacagggacgtgatgctcgagaattaccgaaatatggccagtctggttggtccatttactaagcccgcactcatatcttggctggaggcgcgggaaccctggggcctcaatatgcaagccgcgcagcctaagggtaatccagtagccgcccccactggggacgaccttcagtctaaaaccaacaagttcatcttgaatcaggagcccctggaagaagcagagacgctggccgtcagctccggctgccccgccacctctgtctctgagggtatcgggctgcgagaatctttccagcagaagagcagacagaaagatcagtgtgagaacccaatacaggttcgggtcaagaaagaggagaccaacttcagccatagaaccggcaaggacagcgaagtgagtggctcaaactccctggatctcaagcacgttacttatctaagggtctcaggacgaaaagagtccctcaaacacgggtgtggcaagcacttccggatgagctcacatcattacgactataagaagtatgggaagggtctaaggcacatgattgggggtttctccctccatcagaggattcatagcggccttaaaggcaacaagaaagatgtttgcggtaaagattttagcctctcttcgcatcaccagcgtggccaatccctgcacaccgtgggtgtcagttttaagtgcagcgactgtggccgaacttttagtcactcgtcccatctggcctaccaccagaggctgcatactcaggagaaagccttcaagtgcagggtgtgcgggaaagcctttaggtggagttcgaattgtgcacgtcatgaaaagattcacactggtgtgaagccctataagtgtgacttatgtgaaaaagcgtttcgcagactgagcgcataccggctccacagggagactcatgcaaagaagaaatttcttgagctcaaccagtaccgcgccgctctgacttattcatctggattcgatcatcacttaggtgatcaaagcggggaaaagctgttcgactgtagccaatgtagaaagtctttccactgcaaatcctacgtgttagagcatcagagaattcatactcaggagaagccctataagtgcaccaagtgcaggaaaaccttcaggtggcgctccaatttcactcgccatatgagattgcacgaggaggagaagttttacaagcaggatgaatgcagggaagggttccgtcagagtcctgactgctcacagccccagggcgctcctgcagtggaaaaaacattcctatgtcagcagtgcggcaagacttttacccggaaaaagacactggtcgaccaccagagaatccacaccggggaaaaaccctaccaatgcagcgactgtgggaaggactttgcataccgttccgctttcatagtgcacaaaaaaaagcatgccatgaagaggaagccagagggcgggccttctttttctcaagacacggtttttcaagtcccccaatctagccacagcaaagaagaaccatataaatgttcccaatgcggcaaagcctttcggaaccatagcttcctgttaatccatcagagggtgcatacaggggaaaaaccttataagtgccgtgaatgtggaaaggcatttcggtggtcctcaaacctctaccgccaccaacgcatccactctttgcagaaacagtacgactgccacgaaagcgagaagaccccgaacgtggagcctaaaatcttaacaggcgaaaagcggttctggtgtcaggagtgtgggaagacctttacacggaagcgcaccctgctagatcacaaaggcatccattccggggagaaacggtataagtgtaacctttgcggaaagtcctatgacaggaattatagacttgtaaaccatcaaagaatacactctacggagagacccttcaagtgccaatggtgcgggaaggagttcatcggccgtcataccctgtcatcacaccaaaggaagcacactcgggctgcgcaggccgagcgcagccccccggcacggtcttcaagtcaggatacaaaactgcgcctgcagaagttgaagccaagcgaggagatgccactggaagattgtaaagaggcttgtagtcagagctcgcgcctcacggggctccaagacataagcatcgggaaaaagtgtcacaaatgtagcatatgcggcaagacgtttaacaaatcttcacagttaatcagccataagagattccacacccgcgagagaccatttaagtgtagtaagtgtggaaagacttttcgttggtcttctaacctcgcccgacacatgaaaaatcatattagggactag

SEQ ID NO: 14217 - DNA, 822 bp, Artificial Sequence
  Description of Artificial Sequence: Synthetic coding sequence
atgcctcctggaagatggcatgctgcgatcagttccggcccagtgtttgagggcgctagagctctccaaacagtgaagaaggaggaagaagatgaatcttatactccggtccaggccgcaagaccccagaccctgaaccggccaggccaggagctattcaggcaactattccggcagttgcgctaccacgagagcagtggaccactggaaacattgtctcggctgcgggagttgtgccggtggtggttacgacccgatgtgctgtcgaaggcacagatattggaactgttagtgctggagcagttcttgtccatcctccctggcgagctgcgggtctgggtgcagttacacaaccccgagagcggcgaagagctgtggccgtgttggcgttcgtgcaggggcactctgatgggacatcccggcggaacccgagctctccctgaacctaggtgtgccttagatggctatagaagccttagaagtgctcaaatctggagcctggcaagccccctgcgatccagctcagccctcggcgatcatctggagccaccatatgagatcgaagcccgcgatttcctggctggtcaatccgacacacctgcagcacagatgcccgccctttttcctcgcgaaggatgtccaggggaccaagtgacgcccacacggtctctcacagcccagttacaggagactatgactttcaaagacgtggaggtgacgttttcccaagatgaatggggctggctggactctgctcagcgcaatctgtatcgtgacgtcatgctcgagaactataggaatatggcttccctgggcaaatag

SEQ ID NO: 14218 - DNA, 1353 bp, Artificial Sequence
  Description of Artificial Sequence: Synthetic coding sequence
atgcccagtcccctagggccaccgtgcctgcctgttatggatccagaaaccaccctagaggagccagagaccgcccgcctgaggtttaggggtttctgttatcaggaggtcgcaggcccgcgcgaagcacttgctcggctccgggagctgtgttgccagtggttgcaacccgaagcccactctaaggagcagatgctggaaatgctcgtgctggaacaattccttgggactctgccccccgaaatacaggcctgggtgagaggccagcgtccgggctctcccgaggaagccgccgcactggtggaaggattgcagcacgaccctggtcagctgctcggctggataaccgcccatgttctgaagcaggaagtgttacccgctgctcaaaagaccgaagaaccccttgggtccccccacccatctggcactgtagagagtccgggcgagggcccgcaggacaccaggatagaaggatctgtccagctctcttgcagcgtgaaggaggaacccaatgtagatggccaggaggtggccccctcatccccccctctcgccgcccaatccccggaggggaatcacgggcatcaggagcccgcgtccactagtttccacccccccagaatccaggaagaatggggactcctggaccgctctcagaaggagctctactgggacgcaatgttggagaagtacggtaccgtagtttcactcggacttccgccccaccagccagaggctcaagctcagtctgagctggggatgctgctcactggaaccggtgtgtgccgtagccttcgcagcggcaacgagagcgagggaccccccggctgtccagaggcacagcccccacagggtcccggacctgcagcctgggagggactcagcggggccgcgacacccgctccgacagtccgccccggaaccccccctgtgcccactcaacctacgccagccgagactaggctagaacctgctgctaccccgagaaagccatacacctgcgagcagtgtggccgcggcttcgactggaagagcgtgttcgtgatccatcacagaacgcatactagtgggccaggggttcagagccctgggttggcaaccggggaatctaccgagaaaccaccgcagggtgaagttgctttcccccatcatccccgccgcagccttacaggccctcggagctacccatgcgaagagtgcggctgctccttctcttggaaaagccagctggtgattcacaggaagtcccatacggggcaacgtagacacttctgttcagattgcggaagggcattcgactggaagagccaattagtcatccatagaaaaggccacagacccgaggtcccatag

SEQ ID NO: 14219 - DNA, 1044 bp, Artificial Sequence
  Description of Artificial Sequence: Synthetic coding sequence
atgagcatggatagaaaatggcatcccccagctttacatctgcagcattctccattgaggggcacaatggacaccaagaaccaacccccacacccgtctactcaccccgggtttcgccgttctgggggatgctggacagggcaccgcaggaattgtacaggcatgcgctgctggcggtctacagctcagtggtctccttgggtgaggaccagtcaaccacatcctgcacctcttcccggagcttgtacccaccccgctgctggactggccggtcaggggctgtgtgcaacgagtccaacacaactttctcacctgccggaggagcatccagtgacctatcagaacaggcctcaccccagttttatgcagaccccatgtctgaccgttcctcctactcgcgcaggacttcccccgcaccagcccgaagcccaggctcagtccgaactgggaatgctgctgactggcaccggggtgtgcaggagcctgcgttcaggcaatgagtccgaagggccacctggctgtcccgaggctcagcccccgcaaggcccgggccccgcggcctgggagggcttgtcaggtgctgccacacccgccccaacagtgcggcctggtacgcctcccgtgcccacccagcctacacccgcggagactcgcttggaaccagctgctaccccgagaaagccttacacttgtgaacagtgcggcaggggcttcgattggaagagtgtctttgtgattcaccaccggactcacacaagcggacccggcgtgcagagccccggcctggctaccggagagagtacagagaaacctccccagggagaggtagcctttcctcatcatcctagacggagcctcacaggtccaagatcttacccgtgtgaagagtgcggctgttccttcagctggaaatcccagctagttatacacagaaagtcccacaccgggcagcgtagacatttttgcagcgattgtggacgtgcgttcgactggaaatcccagcttgtaatccatcgtaagggacacaggcctgaagtgccttag

SEQ ID NO: 14220 - DNA, 468 bp, Artificial Sequence
  Description of Artificial Sequence: Synthetic coding sequence
atgcccagccccctgggccctccttgtctacctgtgatggatccagaaacgactctggaggagcccgagacagcaaggttacggttccgaggtttttgttatcaagaggtggccggccctagggaagccctagcccgcttgcgcgagctgtgctgccagtggctgcagcctgaagctcacagtaaagagcagatgttggagatgttagtcctggagcagttcctgggaaccctgcctcccgaaattcaggcctgggtgcggggccaaagacccggcagtcctgaagaagccgccgccctagtggaaggactccagcacgatcccggacagcttttggggtggattacagctcatgttctcaagcaggaagtgctgcccgccgcccagaagactgaggaacctctgggggctcccacaccccaggggcaatggtcccccctgggaaaggtccctcgaacgcccgagtag

SEQ ID NO: 14221 - DNA, 1269 bp, Artificial Sequence
  Description of Artificial Sequence: Synthetic coding sequence
atgccctctcccctgggccctccttgtctcccggtcatggaccctgagacaacgctcgaagagcctgaaaccgccagactccggtttcgggggttctgctaccaagaagttgcagggccacgggaggcattggcaagactaagggagctgtgctgccagtggttacagccggaggcccattcaaaggagcagatgctcgaaatgttggtgctcgagcagttcctgggcacactccccccagagatccaggcctgggttcgggggcagcggccaggcagccctgaggaggccgccgccctggtggaggggcttcaacatgacccaggacagctgctgggctggattaccgcccatgtgctcaaacaagaggtactcccagccgcacagaaaactgaggagccacttgggtcaccacatccctctggaaccgtggaaagcccaggggaaggtcctcaggacacacgcatcgagggctccgtgcaactgagttgctccgtgaaagaggagcctaacgttgacgggcaagaagtcgccccttcttctcctcctctcgccgctcagtccccagagggcaatcatggccaccaagaaccagcctctacttcctttcaccccccaagaatccaggaggagtgggggctgctcgatcgaagccagaaggaactgtactgggacgccatgctcgaaaagtatggaacggtggtcagcctaggcctgccgcctcaccagcccgaggctcaagcccagtccgagctggggatgctcctgacaggtacgggcgtgtgtcgttcactgaggtccggcaacgaatccgaaggtccgcccggatgtcctgaggcacagcctccacagggaccagggcctgctgcgtgggagggcctctcaggtgctgctaccccagcccctaccgtacgtccgggcacacctcccgtgcccacccagccaactcccgcggagacacgcctcgagcccgctgccacacctaggaaaccttatacttgcgaacaatgcggacgtggcttcgactggaaatctgtatttgtgatccatcatcgaacccacactagcggcccgggggttcagtccccagggctcgcaactggggagtccaccgagaagcctcctcagggcgaagtagcgttcccccatcatcctaggcgttctctgaccggcccacgatcctacccttgcgaggaatgtggatgttccttttcttggaagtcacagctggttatccatcgcaagtcacatagaccagaagttccatag

SEQ ID NO: 14222 - DNA, 1353 bp, Artificial Sequence
  Description of Artificial Sequence: Synthetic coding sequence
atgccctcacctttgggccctccgtgcctgcccgtaatggaccccgaaacaacattagaagagccggaaactgctcgcctgagattccggggcttctgttaccaagaggtagccggaccgagggaagctctggcgcggcttagggagctctgttgccagtggctccagcccgaggcacattctaaagagcagatgctggaaatgctggtgctggagcagtttctcgggacactgccgcctgaaattcaggcttgggtgcggggacaacgaccggggagtcctgaggaggccgcagcacttgtcgagggtctccagcacgacccaggtcaactgctggggtggatcactgcccatgtgctgaagcaagaggtgctgcccgccgctcagaaaaccgaagaacctctgggttcaccccatccctccggcacagtggagtcacccggtgaaggcccccaagacactcgtatcgaaggaagcgttcaactgtcatgttcagttaaagaagaacctaacgtagacggacaggaagtggctcccagttccccacctctggccgcccaatcacccgaaggaaaccatgggcatcaggagcctgcctccaccagtttccatccccctcggatccaggaagaatgggggctcttggaccggagccagaaggaactgtactgggatgctatgttggagaagtacggtactgtagttagcttggggctgccgcctcatcagcctgaagctcaggcccagagtgaattgggcatgctgctcacggggactggtgtttgtaggtcccttcggtcaggcaacgagtcagaagggcccccaggttgccccgaggctcaaccccctcaggggcctgggcctgccgcctgggagggactgtctggagcggctacccccgcccctacagtgcgtcctggaaccccccctgtgccaacccagccaacacctgctgagacacggcttgagcccgccgcaaccccacgaaaaccatacacatgcgagcaatgtgggcgcggctttgattggaagagcgtctttgtcattcatcatcgcacccacacctcaggcccaggggtccaatcaccagggctcgccacaggggaaagcactgaaaaacccccacagggggaagtggcttttccccaccaccctcgaagaagcttaacaggccctcgctcttatccttgcgaagagtgtgggtgttcattttcctggaagtcacaattggtgatccacagaaagagccacaccggccaaaggcgccatttctgcagtgactgcgggcgggcattcgactggaagagtcaactagtcattcataggaaggggcatcgccctgaagtgccttag

SEQ ID NO: 14223 - DNA, 3042 bp, Artificial Sequence
  Description of Artificial Sequence: Synthetic coding sequence
atgggcgaccccggcagcgaaatcatagaaagtgtgccaccagccggccctgaggcctcggaatctaccaccgacgaaaatgaggacgacatccagttcgtgtcagaagggccactgagaccagtgttggagtacatcgacctagtttcatcagatgacgaggaaccatccacatcttacaccgatgagaatatcaagagaaaggaccacatcgactatcagaaggacaaggtggctctcactctcgcccgattggcccgacacgtcgaggtcgagaaacaacagaaagaagagaaaaacagagcctttcgggagaaaatcgattttcagcacgcccatgggctccaggagttggaatttatcaggggccacagtgataccgaggccgctagactgtgcgtagaccagtggctcaagatgcccgggctgaagaccgggaccatcaactgtggaaccaaatccagtttcagacgcggcggtcatacctgggtgtctgggaaacccattctgtgtccaataatgcattgtaacaaggagttcgacaatggccacttgctactgggccacctgaaacggtttgatcatagcccttgtgatccaaccatcacgcttcacggcccattctttagtagctttgcttgtgttgtctgctacaaaaaattcgtgactcagcagcagtatagagatcacctctttgataaagaggctactgatgacggacacaataataaccttttgccgcagataattcagtgctttgcatgtccaaattgcttcctccttttctcccggaaggaagagtgctcgaagcatatgtcaggcaagaaccacttccaccagtcctttaaactgggagacaataaagggattgctcatccaatttcgttcccgagtttcgcaaaaaagcttctgatctctctttgcaaagatgtcccgttccaagtaaaatgcgttgcatgccacaagacactgaggtcacacatggaattgaccgcccacttcagggttcattgtaggaacgcaggcccagtagcagtcgccgaaaagtccattacccaagtcgccgaaaaatttatactgcgcggatattgccccgactgtaaccaggtattcgtggacgagacctctacgcaaaaccacaaacagaacagcggccacaaagttagagtgatcaactcagtcgaggagagcgtcctgttgtactgccactcgtcagaaggcaataaggatccatcatccgacttgcacctgttactcgaccagagtaaattctccagtttgaaacgaaccatgtcaataaaagagtccagttctcttgagtgcatcgcaattcctaaaaagaagatgaatcttaaagataagagtcatgaaggcgtggcctgtgtgcagaaagagaaatccgtggtaaagacctggttttgcgagtgtaaccagagattcccgtccgaggacgctgtggagaaacacgtattttccgctaatacaatgggctataagtgtgtggtctgcggcaaggtttgtgatgactccggggttatcagattgcacatgagtcggatccacggaggcgctcatctaaataatttcctgttctggtgccgcacgtgcaagaaagaactgacgcggaaagatacgattatggcacacgttacggaattccataacggacacaggtacttctatgagatggacgaggtcgagggtgaaactctgccctcctcctccacgacacttgacaacctcaccgcaaacaaaccatctagcgctatcacagttatcgatcactcacctgccaactcgagtcctcgaggtaaatggcagtgccggatttgtgaagatatgtttgattcccaggagtacgtgaaacagcactgtatgagcctggctagccataagttccacagatattcgtgcgcccattgccggaagccctttcataaaattgagacgttataccgccactgtcaggatgagcacgacaatgaaattaaaataaaatatttttgcggcctatgcgaccttattttcaacgttgaggaggcctttctgtcacattatgaagagcatcacagcatcgactacgtatttgtgtccgaaaaaaccgagacttctatcaaaacggaagatgattttccagtcattgaaacttccaatcagctgacatgtgggtgccgcgagtcatacatatgcaaggtcaacaggaaagaagattattcaagatgcttgcagatcatgttggataaggggaagttgtggttccggtgttctctttgcagcgctacggcacagaacctcaccgacatgaatactcatattcatcaagtgcacaaggaaaaatctgacgaagaggagcagcagtacgtaattaagtgtggtacctgcacgaaagcatttcatgatccagagagtgcccagcagcattttcacaggaagcattgtttcctgcagaagccgtccgtcgcccactttggcagtgagaagtcaaacctgtataagttcacagctagcgcctcacataccgagcgcaagctgaaacaagcgatcaactattcgaagagtttggacatggaaaagggcgttgaaaatgatctgagttatcagaatattggtggcaatacgaattggaaaccccccttaaattgtaagatctacaattacctgaacaggattggatgcttcttccttcatcccagatgctcaaagcgtaaggatgccgcagatttcgcgatttgtatgcacgctggccgactagatgaacaactgcctaagcagatcccgtttactatactaagcggtgaccaagggtttctggagctggaaaaccaattcaaaaaaacccagcggccagcccatattcttaacccacaccacttggagggcgatatgatgtgcgctctccttaatagcattagtgacaccactaaggagtgtgactctgacgacaatatgggcgccaagaacaccagcattggagaagaattcatctccaccgaagatgttgagctcgaggaggcaatccggcgcagtctggaggaaatgtag

SEQ ID NO: 14224 - DNA, 3186 bp, Artificial Sequence
  Description of Artificial Sequence: Synthetic coding sequence
atgggagaccctggctcagagattattgagtccgtcccccccgccggaccagaggctagcgaatctactactgacgagaacgaagatgacatacagttcgttagcgagggtcccttgaggcccgtgcttgaatacatcgatttggtctccagcgatgatgaggaacccagcacctcctataccgacgagaacattaagcggaaggaccatatcgactaccagaaagacaaagtcgcactcaccctcgcgcgacttgctagacatgtggaggtcgagaagcagcaaaaagaggagaagaatagggcctttagagaaaaaatagacttccagcacgcccacggactacaggagctggaattcattcggggccattctgatacggaagccgccaggctttgcgtcgaccagtggctgaaaatgcctggattgaagacagggacaataaactgtggcactaagtcgagctttcgcagggggggccacacctgggtgtcaggtaaacctatactgtgtcctattatgcactgcaacaaagaattcgacaatggacatttgctgctcggtcacctgaagcgctttgatcactccccatgtgaccccaccatcacacttcatggcccattcttctctagctttgcctgtgtggtgtgctataagaaatttgtgacacagcagcaataccgtgaccaccttttcgataaggaagccacggatgatgggcataacaacaatttattacctcagattatccagtgctttgcatgccctaattgcttcctgcttttcagtcggaaggaggagtgttccaagcacatgtctggaaaaaaccacttccaccaatcatttaagttaggcgataacaaaggaatcgcacaccctatcagtttcccttcctttgccaagaaactactgatcagcttgtgcaaagacgtgccattccaggtgaagtgcgtagcgtgccataaaacactacgctcacacatggagctaaccgcccacttcagggtgcactgcaggaacgccgggcctgttgccgtggcagagaagtcaatcactcaagtcgctgagaagttcattttaaggggatactgccctgactgtaatcaagttttcgtggacgagacatcaacacagaatcataaacagaattcaggacacaaggtccgtgtcattaacagcgtcgaggagtcagttcttttgtactgccacagttcagagggtaataaggacccaagtagcgacctgcaccttctgttggaccaaagtaagttcagctcactgaaacgcaccatgtccattaaggagtcaagcagccttgaatgcatcgccattcccaagaagaagatgaatctgaaagacaagtcgcatgagggcgtggcttgcgtgcagaaagaaaagagtgtggtcaagacctggttttgtgagtgtaaccaaagattccctagcgaggatgcagtagaaaaacacgtgttctccgcaaatacaatgggctacaaatgtgtcgtgtgcggaaaggtctgcgacgactctggcgtgattcgactgcatatgtccaggatccacggcggagcccacctgaacaactttctgttttggtgccgcacttgcaagaaggaactaacccggaaagatacgattatggcccatgttactgagttccacaatggccaccgatacttctatgaaatggacgaggtcgaaggagagacactcccctcctcatccacgactttagataacttgactgccaacaaaccctctagcgctatcactgttattgatcacagccctgctaattcctcacctaggggcaaatggcagtgtaggatctgtgaggatatgttcgactcccaagaatacgttaagcagcactgcatgtctcttgcgtcccacaagtttcacaggtattcttgcgcacactgtaggaagccatttcacaaaatcgagaccctctaccgacactgtcaagacgagcatgacaacgaaatcaagatcaagtacttttgtggcttatgcgatctaatctttaatgtggaggaggccttcttgtctcactatgaagaacatcattctatagactatgtcttcgtgagtgagaaaaccgaaacatcaattaaaaccgaggacgatttccctgtgatcgagacgtctaaccaactgacttgcggttgtcgcgaatcctacatctgcaaagtcaatcgcaaagaggactactcccgctgtctgcagatcatgcttgacaagggcaagctatggtttagatgctcactctgtagtgcaacagcccagaacctgacggacatgaacacccacattcaccaagttcacaaagagaagtcagatgaagaagaacagcagtatgtcatcaaatgcggcacatgcaccaaagcatttcacgaccctgaatccgcccaacaacattttcatcgtaagcattgtttcctgcagaaacctagtgtggctcactttggcagcgagaagtccaacctctataagtttacagctagtgctagtcacactgagaggaaactcaaacaggccatcaactattctaagtcgctggatatggaaaaaggagtggagaatgacctttcctaccagaacattgaagaagaaatcgtcgaactgcccgatttggattatctcaggactatgactcacatagtcttcgttgacttcgataattggtctaacttctttggacatcttcctggccatttgaaccagggcacctttatttggggttttcaaggcggcaacacaaattggaaacctccgctcaattgcaagatatacaattatctgaaccgcatcggctgcttttttctccatcctaggtgctccaagcggaaagacgcagcagacttcgcgatatgcatgcacgctggccgcctagacgaacagctgcccaagcagataccgtttactatcctgtccggcgaccagggattcttggaacttgagaaccagttcaaaaaaacccagaggcctgcacatatcctgaacccgcaccacctggagggcgacatgatgtgtgctcttctcaattccatcagtgacactacgaaagaatgtgatagcgacgacaatatgggcgccaagaatacatcgatcggcgaagagttcatctcgaccgaggacgttgagcttgaggaggcaataagaaggtcactcgaagagatgtag

SEQ ID NO: 14225 - DNA, 1680 bp, Artificial Sequence
  Description of Artificial Sequence: Synthetic coding sequence
atgggagaccctggaagtgaaatcatcgaatcggtacctcccgcaggaccagaagcctccgaatccacgacagacgagaacgaagacgacatacagttcgtcagtgagggtccccttaggcccgtgttggagtacatcgatctggtatcctcagatgatgaagagccttctactagctacactgaccgtatgccggagagcaaggtaccaagttctgagaaccataggcccgagatgtgcagtagttgtaatgtgcccttacctattggtgacagctcatcctttagcggtagctgtagctcgtctcccgaacgtatagtctcccaaacctcaagcgtcgaaaaccctctggaaaatcagaaaaacgatcagaataactccgacactaaaatttcggaaacagagacactgaaaagtagccagaatttccagacactgccaagttctccactcctcgttccccaggagtccctcgcttcttccgaggtgaaggaaaacctacgtatcgattctagttccgcctctcagcacggcagagacgcgatcctgtacttacagactcaggtcgccgagatgtctagagtgatccgtgacctgcagtcacgatcttgctttagatttcaccatagtcgtccatcggaaaattcgtctgttccttgggacatcagcacaagtaaggaagagaatctgtccactgtggaagaagaaacggattataaatcacctagcgctgatgataaaggtcagccatcagatccatcccaaagcagctttacaggactgctaaaacgaatggagcagaggggagtgattaaaagggtgactctgcagtccgaggcagagtcatgcgagggaaaacccgactgcgtcactagtaagaaacgcctggtaccacctttgcaccccctgctccggattgccaccaccgaggtgttcaaggatccggctgactgccacccttcgtcgtttatgggacatcgcgtttaccctgtggctaaagacacctctccatttcagcctaaccctcctgctgagggccctattgtcgaagctttagagcactctaagcgaggcaacacaacatcacctttagacagcacctctaaagaaatggaggttatggggtgcaggttttaccacgcagctagcatagctgcacgggctgccagctacatggcctatatgactcaataccagagaaagttgtgggaggacatggaagacctggtgcatgaccccgaattcgacagaggaaaagcccgctgtatcatctctgatggaatggacgctggattgtggcagttatgcaccacaagagacatcatggactctgtggtccgcgtaatggcaatggcgatagactacaggaggcaggcatggctacgtttaactagcttgacaaagaaaacccaagaaaaaatttcccaccttccatttgatgggacatccctgtttggacaggatgtgaaggcggtcgtagcggaagacaataatattaaggagaatgactacaaggaccacaaatactataatcagcacagatatttttactcccatgatcagaaagctcattatcacaaccgcggctactccaagggggattggtataagccacggaaccacccttatagataccgcaaaaagggagatagccctgagcgacatggatataaaaactag

SEQ ID NO: 14226 - DNA, 1569 bp, Artificial Sequence
  Description of Artificial Sequence: Synthetic coding sequence
atggccgtatcccacttaccaacaatggttcaggaaagcgtcacgttcaaagacgtggcgatcctctttacacaggaagaatggggacagttaagccccgcccaaagagcactgtacagggacgtcatgctggaaaattactcaaacctagtatccctgggacttcttggtccaaaacctgataccttctcacaactcgaaaaaagagaggtctggatgccagaagacacaccgggtggattctgtttggattggatgaccatgcccgcctccaaaaaaagcacagtcaaagctgagattccagaggaggaactcgaccagtggaccattaaagagcggttcagcagcagcagccattggaaatgcgcctccctcttggagtggcaatgtggaggacaggaaatctctctgcagagggtagtcctcacccatccaaacacgccttcacaagaatgcgatgaatccggttctacgatgagcagctccctccactccgatcagtcccagggctttcagcccagtaaaaacgcatttgagtgctccgaatgtggcaaagtctttagtaagagctccactctcaataaacaccaaaagatccacaatgagaaaaacgccaaccagaagatccacattaaggagaagcggtatgagtgccgcgaatgtggcaaagcgtttcaccaaagcactcacctgatccaccatcagcgaattcatactggggagaagccatacgaatgcaaggagtgtgggaaggcatttagcgtgtctagcagtctgacgtaccaccaaaagattcacacgggtgagaagcctttcgagtgtaacttgtgtggaaaagcattcattcgcaacatccatctggcccaccaccataggattcacacgggtgaaaagccattcaagtgtaatatctgcgagaaggcttttgtctgccgtgcccatctcacgaaacatcagaacatacattccggagaaaaaccgtataagtgcaacgagtgtggcaaggcattcaatcagagcacctcatttcttcagcatcagagaatccatactggagaaaaaccgtttgaatgcaacgaatgcggtaaggcatttcgggttaatagctcacttactgagcaccagcggatacataccggcgagaagccatataagtgtaatgaatgcggcaaggccttccgcgataactcctcttttgccagacacaggaaaatccatactggcgaaaaaccctatcggtgcgggctgtgcgagaaagccttccgcgatcaaagcgccttagctcagcaccagcgcattcatacgggagaaaaaccctacacctgcaatatctgcgaaaaggcgttttccgatcatagtgctctgacacagcacaaacgcatccatacgcgagaaaaaccctataaatgcaaaatttgcgaaaaggcctttattagaagtacccatcttacacagcatcagcgcatacacacaggggaaaagccatacaagtgtaacaagtgtggcaaggctttcaatcagactgctaacttaatccaacaccagcgtcatcatatcggggagaaatag

SEQ ID NO: 14227 - DNA, 1569 bp, Artificial Sequence
  Description of Artificial Sequence: Synthetic coding sequence
atggcagtaagtcacctgcccactatggtccaggaaagtgtgacatttaaggatgttgcaattctcttcacccaggaagaatggggccagctttctcctgcccaaagagccctgtaccgagatgttatgttggagaattattctaatctcgtgtctcttggtttgctgggtcctaagcccgacaccttctctcagcttgaaaaaagagaggtgtggatgcctgaggatactccaggcggcttctgtctcgactggatgactatgccggcctccaagaagtcgaccgttaaggccgagattcccgaagaagagctggatcagtggaccattaaggagcgattttcatcctcctctcactggaaatgcgcgtcgctactcgagtggcaatgcggcggacaggagatctcccttcagcgtgtcgtgttaacccaccctaataccccttcacaggagtgtgatgagagcggttccacaatgtcctcatctctccacagtgaccaaagccaaggcttccagccttccaagaacgcttttgaatgttcggagtgcgggaaggtattctcaaaatccagcactctcaataagcaccagaaaatacacaatgaaaagaatgccaatcagaaaatccacataaaagagaagcgctatgaatgtagagagtgcggcaaagcctttcaccagagcactcacttgatccaccatcagcggatacacactggcgagaaaccatatgaatgtaaggaatgtgggaaagcattcagtgtgtcctctagtttaacctaccatcaaaagatccacaccggggagaaaccatttgaatgcaatctttgtggcaaggcgtttattcgaaatattcatctggcgcaccaccaccgaatccacaccggagagaaaccattcaaatgtaatatctgcgagaaagctttcgtgtgtagggctcacctgaccaaacatcagaatatccactcgggagaaaaaccttacaagtgtaacgaatgcggtaaagcatttaaccagagtacctcattcctgcagcatcaacggatccataccggggagaagccttttgagtgtaatgaatgtgggaaggcgttcagggttaattcctctctgactgaacatcagcgaatccataccggagagaaaccttataaatgcaacgagtgcggaaaagccttcagagataattctagtttcgcaaggcacagaaaaatccacaccggggagaagccttaccgctgtggactatgtgagaaagcatttagggaccagtctgcccttgcccagcaccagcgtatccacaccggagagaaaccttatacttgtaatatctgtgagaaagccttttcggaccattctgccttaacccaacacaaaagaatccataccagggagaaaccatacaagtgcaagatctgcgagaaagctttcatacgctcgactcacctaacccagcatcagcgaattcacaccggggagaagccctacaagtgcaataagtgtggcaaggctttcaaccaaaccgcaaatctcatccagcaccagcgccaccacattggtgagaagtag

SEQ ID NO: 14228 - DNA, 7521 bp, Artificial Sequence
  Description of Artificial Sequence: Synthetic coding sequence
atggaagtgttgcagtgcgacggatgtgattttcgtgctccatcatacgaggatctgaaagcccacatccaggacgtccatactgctttcctgcagcctacagacgtggcagaagacaacgtgaacgagctgaggtgcggttcggtcaacgcttccaatcagactgaggttgaatttagcagtatcaaggacgaattcgccattgcggaagatctgagcggccagaacgctacaagcctcgggacgggagggtactatgggcatagcccagggtactatggccagcatattgccgctaaccctaagcccacaaacaagtttttccagtgtaagttctgcgtccgctattttcggagtaaaaaccttttaatcgagcacactcgaaaagtccacggcgcacaggccgaaggcagttcttccggtcctcccgtgcctggttcgctgaactacaatataatgatgcacgaagggttcggcaaggtgttctcttgtcaattttgtacctataagtcaccacggagagcaagaatcatcaagcaccagaagatgtatcacaagaataacctcaaggagacaacagctcctcctcccgctcccgccccaatgcccgaccccgtcgtccccccggtgtctttacaggacccctgtaaggagctccctgccgaagtggtggagcgctcaatcctcgaaagcatggtaaagccactaaccaagtctagggggaatttctgctgcgagtggtgctcctatcagacaccccggagagaacggtggtgtgaccacatgatgaaaaagcatcgctctatggttaagatactgtcaagccttcggcagcagcaagagggaaccaaccttccagacgtacccaataagtctgcccctagccctacttccaacagcacttatctgactatgaacgccgcctctcgtgagatacctaacaccaccgtttctaactttcgcggctccatgggcaactccatcatgagacccaattcgtcagctagcaaattttcgcccatgtcttacccccagatgaagcctaaatccccccacaacagcggcctggtgaaccttaccgagaggagcagatacggcatgaccgacatgacgaacagtagcgcagacctggaaaccaacagcatgctcaacgactcgtcatccgacgaggaactcaacgaaatcgacagcgaaaacgggctctcggccatggaccatcaaacaagtggcttgtctgccgagcagctcatggggagcgacggcaacaagttacttgagaccaagggaatcccatttcgtagatttatgaaccgcttccagtgtcccttctgtccttttctgactatgcaccgcagaagtatcagccgtcacattgaaaacattcatctatctggcaaaactgctgtgtataagtgtgacgagtgtcctttcacatgtaagagtagcctgaagctcggcgcgcataagcaatgccataccgggacaacaagcgactgggatgctgtcaactctcagtccgaatcaatctcttcatctctgaatgaaggtgtagtgagctacgaatccagttctatcaacggccgaaaaagcggcgtgatgcttgacccgcttcagcaacagcagcctccccagccccctccaccacctccccctcctccccctagtcagccacagccactgcagcagccacaacccccacaactccagccacctcaccaggttccgccgcagccccaaacacagcccccccctacacaacagccacagccacctacacaggcagcccctctgcatccatacaaatgcaccatgtgtaactatagtacaactactctcaaaggcctgagggtgcaccagcagcacaaacatagcttttgtgacaatctcccaaagtttgagggccagcccagctccctccccctagagaatgagacagactctcacccttctagtagcaataccgtgaagaagtctcagacttccatcctagggctctcctctaagaacaatttcgttgccaaggcatcccgaaaactggctaacgattttcctctggatctgtcgccagtgaaaaaacgcacaaggatagatgagatcgcaagcaacttacagtcgaagattaaccaaacaaagcagcaggaggatgccgtgataaatgtggaggatgatgaagaagaggaagaagacaacgaagttgaaatagaggtagagttggacagagaagaggagccaacagaacccatcattgaagtgcctactagtttcagcgcccaacagatttgggtgagagacacctctgaaccccagaaggaacctaattttcggaatatcacccacgattacaacgcgactaacggcgccgaaatagaattgacgttaagtgaggacgaagaagattattatggctcatccacaaatctaaaagaccaccaagtgtctaacaccgccttacttaatacacagacacctatatacggcaccgagcataactccgaaaatactgattttggagattctgggagactgtactattgcaaacactgcgatttcaacaataagagcgcccgtagcgtctcgactcactatcagcgcatgcacccctatatcaagttttcattcagatatatcctggacccgaacgaccacagcgcagtgtatagatgtctggaatgctatatagattacacaaatttcgaggacctgcaacaacactacggtgagcatcatccggaggcaatgaacgtcctgaatttcgatcattctgatttgatataccgctgtaggttttgtagctatactagccctaacgtgcgctcgctcatgccacattatcagaggatgcatccaacagtgaagattaacaatgctatgattttttcatcctacgtcgtggagcaacaggaaggactgaacaccgaaagccagaccctcagggagattctaaactccgcaccgaagaatatggccacctctacgcccgtggcacgtggcggagggttgcccgccacatttaacaaaaatacccctaagacatttacaccagaatgtgagaatcaaaaggacccactggtcaataccgtggtcgtctacgactgtgacgtgtgctccttcgcctcccccaatatgcactctgtgctggtgcattatcagaaaaaacatcccgaggagaaagctagctattttagaattcaaaagactatgcggatggtcagtgtcgatagaggatcggctctctcccagttgagtttcgaggtcggagctccaatgagccccaagatgtcgaatatgggctcccctcctccaccacaacccccccctccagatctttccactgaattgtattactgcaagcactgctcctattcaaacaggagcgtcgtgggagtcctagtacattaccagaagagacatcccgagattaaagtgaccgctaagtacatacggcaagcccctcctacagcagctatgatgcgcggggtcgaaggccctcagggtagcccccgtccaccagcgcccatccaacaactgaataggtccagctcagaacgcgatggccctcccgtggagaacgagatgtttttttgtcagcattgcgattacggtaatcggacagtgaaaggggttctcatccattaccagaaaaagcatagggattttaaagctaacgctgatgtgatccgccaacacaccgctacaatccggtctctctgcgaccgcaatcaaaagaaacccgcctcctgtgtgctggtaagtcctagcaacctggaaagggataagaccaagctaagggccctcaagtgccgccagtgcagttacaccagtccatacttctatgcactgagaaagcacattaagaaggaccatcctgcactgaaggctacagtgacctcaatcatgcgttgggccttcctggatggcctcattgaagccggctaccactgcgagtggtgtatttattcacatactgagccaaacggcctactcttacactaccagcgccggcacccagagcactacgtcgattacacgtatatggcgacgaaactttgggccggccctgaccccagcccaccttctctgactatgcccgctgaagcaaagacgtacaggtgcagggactgtgtgtttgaggcggtctcaatctgggatatcaccaatcactatcaggcgttccatccctgggccatgaatggggatgaaagcgtcctgctggatatcatcaaggagaaggatgccgtcgagaagcctatccttagtagcgaagaacttgctggacctgtaaattgtgagaattctatccctacccctttccccgagcaggaagccgagtgccccgaggacgctagactttcccctgaaaagtccctccaactagcaagtgcgaatccagctatttctagtaccccctaccagtgcacagtgtgccagagtgaatacaacaaccttcacgggttgttgactcactacgggaagaaacaccctggaatgaaggtgaaggcagccgactttgctcaagatatcgatataaaccccggcgccgtgtacaagtgccggcattgcccctatatcaacacgagaatacatggtgttctgacccactaccaaaagcggcacccgtcgatcaaagtgaccgccgaggactttgttcacgacgtggagcagtccgccgacatcagccagaatgacgttgaggaaacatcaaggattttcaagcagggctacggggcatacagatgtaaactctgtccctacacccatggaaccctggaaaaactgaaaatccattacgagaagtatcacaatcagccggaattcgatgtcttttcgcagtcaccccctaaattaccggtgcccctcgagcccgaaatgacaactgaagtcagtccttcccaggtcagtatcacagaggaagaggtcggcgaggagccagtgtctacatcacatttttctacaagtcatctagtcagccacaccgtattccggtgccagctgtgtaaatatttttgttcaacccgcaaagggattgcccggcattatcgtatcaaacacaacaacgtcagagcccagcccgaggggaaaaataatctgttcaaatgcgccctgtgtgcctatacaaaccccatcaggaaaggcctggcggctcattaccaaaagcgacacgacattgatgcgtattatacccactgcttggcggctagccgtactatctccgacaagcccaacaaggtaattataccatctcctccaaaggacgatagccctcagttatcagaggaacttcgacgagccgtagaaaagaagaaatgctccctttgttcattccagagtttttccaaaaaaggtatcgtatctcattacatgaaacgacatcctggagtcttcccaaaaaaacaacatgccagcaaactgggcggatactttaccgccgtctacgcggatgagcacgagaagcccacactgatggaggaagaggagaggggaaattttgagaaggctgaagtcgagggtgaagcccaggaaattgagtggcttcctttccgctgcattaaatgctttaagctgtctttctccacagctgaactcctttgcatgcattacaccgaccaccactctcgggacctgaagagggacttcattatcctgggtaatggccctcggctgcaaaactccacctaccagtgtaaacactgcgactcaaaactgcagagcacagcagagctgacttcgcatttaaatatccataatgaggaattccagaaacgggccaaacggcaggagcggcgtaaacaattgttgtcaaaacaaaaatacgcagacggtgcgtttgctgactttaaacaggagcggccgtttggacatctcgaggaggtgcccaaaattaaagaacgcaaagtggtaggatataagtgcaagttctgtgtggaagtgcacccaacactgcgggcaatctgcaaccatctgcgcaaacatgtgcagtatggcaatgttccagcagtgtcggccgccgtgaaagggttaagatcacacgaaaggagccacctggccctggcaatgtttactagagaagacaaatattcttgtcagtattgttccttcgtgtctgccttcagacacaacctggatcgccacatgcaaacccatcacggccaccacaagccctttagatgtaagttgtgttcctttaagtccagttacaactccaggttgaaaacccacatccttaaagctcacgcaggcgagcacgcgtataagtgctcatggtgttcattttctaccatgaccatctctcagctcaaggagcactccttgaaggtgcatggaaaggcactcacgctaccaaggccacgtatcgtatccctgctgagttcacactcgcaccactcatcccagaaagctacccctgccgaagaagtggaggattctaatgatagcagttactccgagccgcctgacgtccagcagcagctaaatcattaccagtccgctgctctggcccgcaataactcccgggtgtcccccgtgcccctcagtggcgctgcagcaggtaccgaacagaaaaccgaagcggtgttgcattgtgagttttgtgaattttcgtccgggtacattcaaagtattagaagacactatagggacaagcacgggggcaagaagctgttcaagtgtaaggactgctcattttatacggggttcaagtcagcatttacaatgcatgtcgaggctggacatagcgccgtgcctgaagagggccccaaagacctccgctgtccactttgtctttatcatactaagtataaacggaatatgatcgatcacatcgttctccatcgggaggagcgcgtcgtgccaatcgaggtgtgtcgtagtaagctcagtaagtacctccagggggtagtctttagatgtgacaaatgcacatttacatgttctagcgacgagagtctccagcagcatatcgaaaaacacaacgaactcaaaccttataaatgccaactctgctactacgagacaaaacataccgaagaactggattcgcacctgcgtgacgaacataaggttagccgaaacttcgaacttgtcggacgggtgaacctcgatcagctggagcagatgaaggagaaaatggagtccagtagcagtgatgacgaggacaaagaggaggagatgaatagcaaagccgaggatcgcgaactgatgaggttctctgatcacggggccgctctcaacaccgaaaagcggtttccatgcgagttttgtgggcgagcctttagtcaggggagtgagtgggaacgacatgttctccggcatggcatggcgctgaacgacacgaaacaagtgagccgcgaggagattcaccccaaggagatcatggaaaattccgtcaagatgccttctatagaggaaaaggaggatgacgaggccatcggtattgacttctccttaaaaaacgaaacagttgccatatgcgttgtaacagccgataaaagcctgctagagaacgctgaagccaagaaagagtag

SEQ ID NO: 14229 - DNA, 627 bp, Artificial Sequence
  Description of Artificial Sequence: Synthetic coding sequence
taggagcactctctgaaggtgcacggcaaagctctgacactgccaaggccccgcatcgtcagtctgttgtctagccacagccatcattccagccaaaaggcgactccagccgaggaggtggaggatagcaatgatagctcatatagcgagccccccgacgtccaacagcagttgaaccattaccagagcgcagccttggctagaaacaacagtcgggtgtcccccgttcccctgtctggagcagccgcgggaacggagcagaaaacagaggcagtgctgcactgcgagttctgtgagtttagttcaggctatatccagtccatcaggcgccattatcgggataagcatgggggcaaaaaacttttcaaatgtaaggactgttccttctatactgggtttaaatccgccttcaccatgcatgtcgaggccgggcacagcgctgtgcccgaagaaggccctaaagatctgagatgccctctgtgcctgtaccacactaagtacaagaggaacatgatagaccacatcgtgctgcatagaggcaatctgtccaatctcgtatttttggatgcagcagggggtcgacagcaaagatggccaagccgggatgccctgtccgagtggcagtag

SEQ ID NO: 14230 - DNA, 7701 bp, Artificial Sequence
  Description of Artificial Sequence: Synthetic coding sequence
atggaggtgctgcagtgcgatggctgtgacttcagggcacctagctatgaggatttaaaggctcacatccaggatgtgcataccgctttcctacagcccactgatgtcgcagaagacaacgtaaacgaactgcggtgcggaagcgtgaatgcttctaatcagactgaggtggagttcagctctattaaggacgagttcgccattgccgaggatttgagtgggcagaacgcaactagtttgggtaccggtggatattacggtcacagccccggatattatggccagcacattgcagccaaccccaagcccactaataagtttttccagtgtaaattctgcgtccgctacttcagatctaagaacctgctcattgaacacactcggaaagtgcatggtgcacaggctgagggcagtagctctggccccccggtcccagggtcactcaactataacattatgatgcatgaggggttcgggaaagtcttcagctgccaattctgtacttacaagtctcctcggagagcacgtatcatcaagcaccagaagatgtaccacaagaataatctcaaagagacaacggctccacctcctgcaccagctccaatgcctgaccccgtcgtgccgcccgtgtcactgcaagacccctgtaaagagctgcctgcagaggtggttgaacgctctattttggagtccatggtcaagccactaaccaagagcagagggaatttttgctgcgagtggtgttcctaccagacaccgcggcgcgagcgatggtgcgaccacatgatgaaaaaacatagaagcatggtgaagatcctttcctcacttagacagcaacaggaaggcaccaatctgcctgacgtgcctaacaagtccgcgcctagccccacaagtaactccacttatttaactatgaacgctgcgagtagagaaattccaaacacaaccgtgagcaattttcggggttctatgggcaattccatcatgcggcctaacagcagtgcctctaagttttccccaatgtcttacccccagatgaagcccaaaagtcctcacaattcaggactcgtgaatctgacagagagaagtaggtatggcatgaccgatatgactaactcttccgccgacctcgagactaactctatgctgaacgactcttcgtccgacgaagagctgaacgaaatcgactctgaaaatgggctcagcgcaatggaccaccagacttctggcctttcggcagaacagctcatgggatctgacggcaacaaattactggaaactaaaggcattccattcagaagatttatgaatcggttccagtgccctttttgccccttcctcacaatgcacaggcgctcgatcagcaggcacatcgagaatattcatctgagcggcaaaacagctgtgtacaagtgtgacgagtgcccctttacttgcaagtcctccctgaagctaggcgcccataaacagtgccacacggggaccacatcagattgggatgctgtaaactcacagtcagagtcaattagttcatctctcaatgaaggggtggtaagttatgaatcaagcagtattaacgggcggaagtccggtgtcatgctagacccgctccagcaacagcagcccccgcagccaccgccccctccccctcctccgcctccgagccagccccagcctctccagcagcctcagccccctcagctgcagcctcctcatcaggtgcctcctcagccacagactcaaccccccccgacacagcaacctcagccccctacacaggctgctcccctgcatccttacaagtgtactatgtgcaattacagcactactaccttaaagggtttgcgtgtccatcagcagcacaaacatagcttttgtgacaatctgccaaagtttgaagggcagccatccagcctgcctctggagaatgagacggacagccatcctagttccagtaatactgtgaagaaatcgcagacaagtatccttgggcttagcagtaaaaacaacttcgtcgccaaggctagcagaaagttggctaacgatttccctcttgatttgagtccagttaagaagcgcacaaggattgacgaaattgcatcgaatctgcaaagcaagatcaaccagaccaagcaacaggaggatgctgtaattaacgtcgaagacgatgaggaggaagaggaagacaatgaggtggaaatcgaggtggagctggatagggaagaagaaccaactgaacctatcatcgaggtgccgactagtttttccgcccagcagatctgggtgcgggacacatcagaaccacagaaagaaccaaatttcaggaacatcactcatgattacaacgccacaaacggtgcggagatcgagctgactctgtcggaggatgaagaagattattacggatcctcaacgaatcttaaagatcatcaagtctctaatacagctctgttgaatacccagacacccatatacggtactgaacacaacagcgaaaatactgacttcggggactccggacgcttgtactactgcaagcactgcgactttaacaataagtctgccaggtcagtgtccacacactatcagaggatgcacccatatattaagttctctttcagatatatcctggaccctaatgaccacagcgccgtctataggtgccttgaatgctacatcgactacacaaatttcgaggaccttcagcagcattatggggagcaccaccctgaggccatgaacgttctgaattttgaccattcggatctgatctaccggtgccgtttctgctcttatacgagccccaacgtgaggagccttatgccccactaccagaggatgcatccaaccgtaaagatcaataatgccatgatattttcgtcctatgtggttgagcagcaggaaggtctgaataccgagtctcagaccctccgggagatcctgaacagtgcgcccaagaatatggctacctcaactcctgtggcgcgggggggcggtttgcccgccacatttaataagaacacgccaaagacttttacacctgagtgcgaaaatcaaaaagacccactggttaacacagttgtcgtctacgactgtgatgtgtgttcgttcgcctctcctaacatgcatagcgtacttgttcactatcagaagaaacaccctgaagagaaagcatcttattttcgcatccaaaaaacaatgcgcatggtcagcgtggatagggggtcagctctatcgcagctcagctttgaggttggcgctcctatgtcacctaagatgtcaaacatggggtcaccccccccccctcaaccgcccccccctgatttaagtacggagctctactactgcaaacactgctcttactcaaaccgatccgttgtcggagtgttagtgcattatcaaaaacgccatcctgaaattaaggtcacagcaaagtacatccgccaggcgcccccaacagcagccatgatgagaggggtcgaaggacctcagggatcgccgcggcccccagcccctatccaacaattgaataggagttcctcagaacgggacggcccccccgtggagaacgaaatgttcttctgtcaacattgcgattacggcaacaggaccgtgaagggcgtgctgatccattaccagaaaaaacacagggactttaaagccaatgccgacgttatcagacagcacacggctacaattagaagtctttgtgatcgcaatcagaaaaaacctgcgagttgtgtcctcgtgtcccctagcaacctggaacgcgataaaaccaagctgcgagccctgaagtgccgccaatgctcatacacatccccctacttctacgctctgagaaagcatatcaagaaagaccaccccgctctgaaggccacggttacttccataatgcgctgggcattcctggatggactgatcgaagctggataccactgtgagtggtgtatctatagccacactgaacccaacggattgctcctccattatcagcggaggcacccagagcattatgtggattacacttatatggcgaccaaattgtgggccggccccgatccaagtcccccttctcttacaatgcctgccgaagcaaaaacctacagatgccgcgactgtgtcttcgaggccgtcagcatttgggatataaccaaccattaccaggccttccacccctgggccatgaacggcgatgaatcggtactcttggatataataaaggagaaggacgctgtggaaaagccaattttaagttccgaagagctggctgggcccgttaattgcgagaattccatacctacaccctttcccgagcaggaagccgaatgcccagaagatgctagactgagcccagagaagtccctccaattggccagtgccaacccagccatcagcagcactccttaccaatgcactgtctgccagagcgagtacaataacctgcacggcctgctgacccactatggcaagaaacaccccggcatgaaagtgaaggcagctgactttgctcaagatatcgacattaaccccggcgctgtgtataaatgtcggcactgcccctatatcaacacccgtatccacggcgtgctgacacattaccagaaacgtcacccttccatcaaagtgaccgcagaagattttgtccacgatgtcgagcagagtgcagacatctctcaaaacgatgtggaggagacttcccgaatcttcaaacaggggtatggcgcatatcgctgtaaactctgtccgtacactcatggcacacttgaaaagctgaaaattcactatgaaaagtatcacaatcagccagagtttgatgtatttagccagtctcctcccaaactgcctgtgccactggagccagaaatgaccacggaggttagcccgtcacaggtctctattactgaagaggaggttggcgaagagcccgtttccacaagtcacttttccacttctcacctcgtgagtcatacagtttttagatgtcagctgtgtaagtacttttgctcaacgcggaagggtatcgctagacactatcgcataaagcacaataatgtgagagcccagccggagggtaagaacaacctgttcaaatgcgctttgtgcgcctatacaaacccgatccgaaaaggccttgccgctcattatcaaaaacgacacgacatagatgcttactacacccattgcctggccgctagcaggactatctcagacaaaccaaataaagtaattatcccaagcccccccaaggatgacagcccacagctgtccgaagagctaagacgtgctgtggaaaaaaagaaatgttccctgtgctcatttcagtccttttcgaagaaaggcattgtgtcccactacatgaagcgtcacccgggcgtattcccaaagaaacagcatgcctccaagctcggaggctatttcactgccgtgtacgccgatgaacacgagaaacctaccctgatggaggaggaggaaagagggaacttcgaaaaagctgaggttgagggtgaagctcaggaaatcgagtggttgccgttcagatgtatcaagtgtttcaagttgtctttcagtacggccgagttgctgtgcatgcactatacggaccatcactcccgggatttgaagcgagacttcattatactgggtaacggaccccgccttcaaaatagtacatatcagtgcaagcactgtgacagtaagctgcagtccacggccgagctgactagccacctgaatatacacaatgaagagttccagaagcgggccaagaggcaggagcgtaggaaacagctcctcagtaagcagaaatatgccgacggcgcattcgccgactttaagcaggaacgcccattcggtcacttggaggaagtgcctaaaatcaaggaacggaaagtggtaggatacaagtgcaaattctgcgttgaggtacaccctacacttcgtgccatctgtaaccatttacgcaagcacgtccagtacggcaatgtgcccgccgtttctgctgctgtcaaggaagccgatgaccctgcgcatctcttcttggatggactcgaggccgccaaggatgccagcggcgctttggtcgggagggtggacggagaacattgcctactcgatggcatgctcgaagacgagacacggccaggagggtaccactgctcccagtgcgacagagtgctgatgtcaatgcagggtttgcgcagccatgaacggtctcatctggccctggccatgttcaccagggaggataagtacagctgtcagtactgttccttcgtatctgcctttagacacaatctggatcggcacatgcagacacatcacggtcaccataaacctttccgctgtaagctttgctcatttaaatcatcctacaactcccggttaaaaacacatatcttgaaagcccatgcgggggagcacgcttataaatgcagttggtgctctttctctacgatgacgatctcacagcttaaggagcacagcctgaaagtacacggaaaggctctgacgttgcccagacccagaatcgtctctctcttatcttcacatagtcatcatagcagccagaaggccactccagctgaggaggtggaagattctaatgattccagctattctgaacccccagacgttcagcagcaactgaaccactaccaaagcgctgccctcgcccggaacaatagcagggtaagcccagttccattgtcaggggctgctgcaggaaccgagcaaaagaccgaggccgttctccactgtgagttctgcgagttttcatctggttacatacagtccatccggcgtcactacagagacaagcacggcgggaagaagctctttaaatgtaaggactgctccttttataccggttttaagagcgcgttcacaatgcatgtggaagccggtcactcagcagtgccggaagagggccccaaggatctcagatgtccactctgtctctatcacacaaaatacaaacgaaatatgatcgaccatatcgtgctgcatagagaagagcgggtcgtgccgatcgaagtctgcagaagtaaactcagcaagtacctccagggcgtcgttttcaggtgcgataagtgcacattcacctgctcctccgatgagagtctacagcagcatatcgaaaagcacaacgagttgaagccctataagtgtcagctgtgctactacgagaccaaacatactgaagaactggatagccatctgagggacgaacataaagtgtcacgcaacttcgaacttgttgggagggtcaacctcgatcaacttgagcagatgaaagaaaaaatggaatcttcaagctccgacgacgaggacaaagaggaggagatgaacagcaaagccgaggacagggagctcatgcgttttagtgaccatggagctgcactcaacaccgagaagcgatttccctgcgagttttgcggccgcgccttctcacagggctccgagtgggagcgacacgtgctccgtcacggcatggccctgaacgatactaagcaggtctccagagaagaaattcaccccaaggagatcatggaaaattcagtgaagatgccttccattgaggagaaggaggatgacgaagcaatcggtatcgacttttcattgaagaatgaaacagtggctatttgcgtggtaactgccgataagtcgctgctcgagaacgccgaggccaagaaagagtag

SEQ ID NO: 14231 - DNA, 1392 bp, Artificial Sequence
  Description of Artificial Sequence: Synthetic coding sequence
atgcagactcatcacgggcatcataagcctttccgttgcaaattgtgcagcttcaagtcttcgtacaattcccgcctgaagacccatatactgaaagcacatgccggcgaacacgcctacaagtgctcttggtgcagtttctctactatgaccatttctcagctcaaggaacactctctgaaggtgcatggcaaagcgctgacgttgcctcgcccaagaattgtgtccctcttgtccagtcatagtcaccactcctcacagaaggccacccctgccgaagaggtggaagattctaacgattccagctactctgagccacctgatgtgcagcagcaattgaaccactaccaaagcgctgctctagccagaaataattcgcgagtctcccccgtccccttgtcaggcgccgcggccggcactgagcagaagaccgaggcagtactccattgcgaattctgcgaattcagctccggatacatccagtccatccgacgccactatcgcgacaagcatggcggaaagaaactgttcaagtgtaaggactgctcgttttacactggctttaagtcagctttcaccatgcacgtggaggcgggacattccgctgtaccagaagaagggccgaaggatctgcgctgtccgctctgtctgtatcatactaagtacaagaggaatatgattgaccacatcgtgttgcatagggaggaacgggtggtcccaatcgaagtatgccgcagcaaactctccaagtatctgcagggagtggtttttcgttgtgataaatgcacatttacttgctcatctgatgagtcgctgcagcagcatatagaaaaacacaatgaattgaagccttacaagtgtcaactgtgttattacgaaactaagcatacagaggaattggatagtcacttgcgggacgagcacaaggtttctcgaaacttcgagttggtcggtcgggttaacctggaccagctggaacaaatgaaggagaaaatggagtccagtagttctgacgacgaggacaaagaagaagagatgaacagtaaggccgaggaccgggagctgatgagattcagcgaccacggagctgcgttgaataccgaaaagaggttcccatgcgaattttgcggccgggccttcagtcaggggagtgagtgggagcgccacgtcctccgacacggcatggccttgaatgacacaaaacaggtctccagggaagagatccacccgaaagagatcatggaaaacagtgtgaaaatgcccagtattgaagagaaggaagatgacgaggctattggaatcgacttctcacttaaaaatgaaactgtggcaatctgtgtagtgactgcagacaaaagtctacttgaaaacgctgaggcaaaaaaggagtag

SEQ ID NO: 14232 - DNA, 1569 bp, Artificial Sequence
  Description of Artificial Sequence: Synthetic coding sequence
atggcacttccccagggcctgctcacctttcgagatgtggccatcgagtttagtcaggaggagtggaagtgcttggatcctgctcaacgaaccctgtaccgcgacgtaatgttggagaactataggaatttggtgagcttagacattagttcaaagtgcatgttgaaaactctgtcttcaaccgggcagggcaacaccgaggtgatccataccggcactctccacaggcaggcgtcccatcatatcggcgagttctgcttccacgagatcgagaaagacatccacggatttgaatttcagtggaaggaagatgagaccaacggtcacgcagccccgatgacagaaatcaaggagctcgctggtagcactggacaacacgaccagaggcatgccggcaacaaaaggattaaggatcaacttggcagctcatttcatctccaccttccagagccccacatttttcagagcgagggaaagatcggcaatcaggttgagaaaagcattaataatgcatcttcagtgtccacctctcagcggatttgctgtcgccctaaaactcatatctcgaacaagtacgggaacaattctcttcactctagcttgctgactcagaagtgggaggtgcacatgcgcgaaaagtcattcgagtgtatccagtcgttcaagagttttaactgtagctctctgctgaaaaaacatcagattatccaccttgaagaaaaacagtgtaagtgcgatgtgtgcggaaaagtttttaatcagaaaaggtaccttgcctgtcatcggcgatgccacactggggaaaaaccttacaagtgtaacgaatgtggcaagacgtttggccacaatagttccttattcatacataaggccctccacaccggggaaaagccatacgagtgtgaagagtgcgataaggttttctccagaaagtcccatttagaacggcacaaaaggattcacacgggagaaaagccctacaaatgtaaggtatgcgatgaggcattcgcgtataacagttacctggcaaagcacacgattctccacaccggggagaagccgtacacatgtaacgaatgtggcaaagtgtttaacagattatcaactctggcacgacaccacagactccatacaggggaaaagccctacaaatgcgaagaatgcgacaaggtattctctcgcaagagccatctggaacgccaccgcagaattcactctggtgaaaagccttataagtgcgaggagtgctgcaaggttttctcgcgtaagagtaacctggagcgacacaggcgcatacacactggggagaagccttacaagtgcaaagtgtgtgataaggcgtttcagagagatagccacctggctcagcaccagagagtgcacaccggtgaaaaaccctataagtgcaacgaatgtggcaaaacctttggtcagacttcctcgctcattatccatagaaggttgcacacaggcgaaaagccctacaaatgtaacgagtgtggtaagaccttctcccagatgtcatcgttggtttaccatcacagactgcattccggcgaaaaaccatag

SEQ ID NO: 14233 - DNA, 1410 bp, Artificial Sequence
  Description of Artificial Sequence: Synthetic coding sequence
atgttgaagaccctcagctcaaccggtcagggcaacacagaggtgatccataccggcactctgcatcgtcaggcatcccatcacatcggagagttctgctttcacgagatagaaaaggacattcacggattcgagttccaatggaaggaagacgagacgaatggtcacgcggccccgatgacagaaatcaaggagctggctggtagtacagggcagcatgaccaacgccacgccggaaataagcgtattaaagatcagctggggagtagcttccatctccacctccccgagccgcacatctttcagagtgaagggaagatcgggaaccaggtggaaaaatcgatcaataacgccagttctgttagcacaagccagcgtatttgttgtcgccccaagacccacatatctaataaatacggaaacaattctttacacagttcactcctcactcagaaatgggaggttcacatgcgggaaaagtcttttgagtgcatccagtcattcaaatcattcaattgttcaagcctcctgaagaaacaccaaattatccacctcgaagagaaacagtgtaagtgtgatgtgtgtggtaaagtttttaaccagaagcgctaccttgcctgccacaggaggtgccacaccggtgagaaaccttataagtgtaacgagtgtggaaaaaccttcggacataacagctcactttttatccacaaggccctccacactggggagaagccctacgagtgtgaagaatgtgacaaggtgttttctagaaaatctcacctcgaaagacataagagaatccacaccggtgagaaaccctacaaatgtaaggtgtgcgacgaggcgttcgcatacaactcttacctggccaagcacaccattctccatacgggcgaaaagccatatacctgtaatgaatgcggcaaggtatttaacagactaagtactcttgctcggcatcacagactgcacacgggcgaaaagccgtacaaatgtgaggagtgtgataaagtgttctcgagaaagtctcacctggagagacatcgtagaatccatagcggggaaaagccttataagtgcgaggaatgctgcaaggttttcagtcgaaagagcaatctggagaggcaccggcgaattcacaccggcgagaagccctataagtgtaaagtgtgtgacaaggcatttcaaagggactcacatctggcacaacatcagagagtgcatacaggagagaaaccctataagtgtaacgagtgtgggaagacctttggacagacttcgagcttgatcattcatagacggctgcacaccggcgaaaagccctacaagtgtaacgaatgcggcaaaaccttttcgcagatgagtagtctcgtgtaccaccacaggctgcattcaggggaaaagccatag

SEQ ID NO: 14234 - DNA, 654 bp, Artificial Sequence
  Description of Artificial Sequence: Synthetic coding sequence
gtttttaaccagaagcgatacctcgcgtgccacagaaggtgccacaccggagaaaagccttataagtgcaatgagtgcggcaagacgttcggacataacagcagcctcttcatacataaggctttgcatacaggcgagaaaccatatgagtgtgaggagtgcgacaaggtgttttctcgcaaatctcacctggagcgtcacaagagaatacacacaggagagaaaccttacaagtgcaaagtctgcgacgaggccttcgcgtacaactcatacctggcaaaacataccatcctgcatacaggggagaagccttacacatgtaatgaatgcggcaaagtgtttaatcggttgtccaccctggctcgacaccaccggcttcacacaggcgagaagccctataagtgcgaggagtgtgacaaggtcttttcacggaagtcacacctcgagagacaccgtcgaattgtagagcggaatctaacaaatgtgaagaatgtcgccaagtttagctcccagattaagccaggtaaaactcaggagtttatcctcgagcgtaatcatacaaatgttagattcgtgactcggctctcacggggaatccacacatggcataacatccgggaatttatattggagaggaacttaacatctgtgtag

SEQ ID NO: 14235 - DNA, 1410 bp, Artificial Sequence
  Description of Artificial Sequence: Synthetic coding sequence
atgctgaaaaccctctcttccactgggcagggaaataccgaagtcattcacaccggtaccctgcaccggcaggccagtcatcacatcggggagttctgcttccacgaaatcgagaaggacatacacggatttgagttccagtggaaggaagatgagaccaacggccatgcggcgcccatgacagagattaaggagctggctggctcaacaggccagcatgatcaaaggcatgcaggcaataagagaattaaagatcagctagggtcgagttttcacctgcacctaccggaacctcacatctttcagagcgagggaaagattggtaaccaggttgagaagtctattaataacgccagcagcgtgtcaactagccagagaatctgttgcaggccaaaaacccacataagcaataagtatggcaacaattccttgcacagtagtctccttacccaaaagtgggaggtacatatgcgagagaaatcattcgagtgcatccagagtttcaaatcctttaactgcagcagcctgctgaaaaagcatcagatcatacacctcgaggaaaaacagtgcaagtgcgatgtgtgtggcaaggtctttaatcaaaaacggtacctcgcatgtcatcgtaggtgccatactggtgagaagccctacaagtgtaatgaatgcggaaagacatttggccacaattcctcccttttcatacataaggcactgcacactggagaaaagccctacgagtgtgaagaatgcgacaaggtgttttcccgaaagagtcatttagagaggcacaagcgcattcatactggtgagaaaccgtacaagtgtaaggtctgtgatgaagccttcgcttacaacagttacctcgccaagcacacaattctccacacaggcgaaaaaccatacacatgcaacgagtgcggcaaggtttttaatagattgagtaccctggctcggcatcaccggcttcacacaggcgagaagccttataaatgtgaggaatgcgacaaagtttttagccgcaagtcccacctggaaagacatcgccggattcacagcggtgagaagccgtataaatgtgaggagtgctgcaaggtcttctcccggaaatctaacctcgagcggcaccgcaggatccacacaggcgagaagccctataaatgcaaagtatgcgacaaagcttttcaacgcgactcgcatttggcacagcatcagcgcgttcacaccggtgaaaaaccctacaaatgtaacgaatgtgggaaaaccttcggacagacgtcatccctgatcattcacaggcggctccatactggcgagaaaccttataagtgtaatgagtgtggaaagacattttctcagatgtcaagtcttgtataccaccatcgcctgcattctggggaaaagccttag

SEQ ID NO: 14236 - DNA, 1569 bp, Artificial Sequence
  Description of Artificial Sequence: Synthetic coding sequence
atggcactcccccaaggcctgctgacattcagggacgtggctattgaattttcccaggaagaatggaaatgtttggatccagctcagcggaccctctacagggatgtgatgctggagaattatcgaaacctggtgtccctcgacatctccagtaagtgcatgctcaagactttatccagtaccggccagggcaacacagaagtaattcatactggaacgttgcaccgacaggcgagccaccacattggcgagttctgctttcacgagattgaaaaggacattcatggcttcgagtttcaatggaaggaggatgaaacgaacgggcacgctgccccgatgactgaaattaaggaactcgctggaagcactgggcagcacgaccagagacacgccgggaataaaaggataaaagatcagctgggctctagttttcatttgcatttgcccgagcctcacattttccagagtgaggggaaaattggcaatcaggtggagaagtccattaacaacgctagtagcgtgtctacaagccagcgtatatgctgcaggcccaaaacacacatttcgaacaagtatgggaataattctctgcatagcagcctgctgacccagaagtgggaggttcacatgcgggagaagtcgttcgagtgtatccaatcctttaaatccttcaactgctcttctcttttgaagaagcaccagatcatccacctcgaggagaagcagtgcaagtgtgacgtctgcggtaaagtgtttaaccagaagagatatctggcttgccatcgtcggtgccataccggcgagaagccttataagtgtaacgaatgtggcaaaacgttcggacacaatagtagcttgtttatccacaaggccttgcacaccggggagaagccctatgaatgcgaggaatgcgacaaggtcttttccagaaagagtcatctggaacgtcataagagaattcataccggggagaagccctacaagtgtaaggtctgcgatgaagctttcgcctataactcctatctcgctaaacacaccatcctgcataccggggaaaaaccctacacatgtaacgagtgcggtaaggtgtttaaccgcctttcaaccctggctaggcatcaccggttgcacacaggtgagaagccatacaaatgcgaggagtgtgataaggtgttcagcagaaagagtcacttagaaagacaccgacgcattcattccggcgagaagccctataagtgcgaagagtgctgtaaagtgttctcacgaaagtctaatttggagcgccataggcgcatacataccggagaaaaaccatacaaatgcaaagtctgcgacaaagcatttcagagagactcacatctggctcaacaccaacgcgtgcacaccggagagaagccctataaatgtaatgagtgtggcaagacatttggacagacaagctctttaattatccatcgccgcctccacaccggggagaaaccttataagtgcaacgaatgtggaaagacgttttctcagatgagttctctcgtgtaccatcatcgattgcatagcggggagaagccgtag

SEQ ID NO: 14237 - DNA, 2154 bp, Artificial Sequence
  Description of Artificial Sequence: Synthetic coding sequence
atgaaaagtcaggaagaggtggaggtagcgggaatcaaactttgcaaagccatgagtctaggcagcgtaacctttactgatgttgcgattgatttcagccaggacgaatgggaatggctgaatctggcacaaagatcgctgtacaagaaagtcatgctcgaaaactataggaatctggtgtccgttggtttatgtatctcgaaaccggatgtgattagcctgctcgagcaagagaaagacccctgggtcatcaaaggaggtatgaatcgcgggctctgccccgatctggagtgtgtctgggtgactaagagccttagtcttaaccaggatatctatgaggagaaactgccacccgctattatcatggaaaggctgaagtcttatgatctagaatgttcaacgcttggtaaaaactggaaatgtgaagatctgtttgaaagagagttggtgaatcagaagactcattttcgtcaagagaccattacccatatcgacaccctgatcgagaagagggaccattctaacaagagcgggactgtgttccacttgaataccttatcatatatcaagcagatattccccatggaggagcggatttttaacttccataccgacaaaaaaagtctcaagacacacagcgtggttaagaagcataagcaggacagaggcgagaagaagctgctcaagtgtaatgactgtgaaaagatcttctccaaaataagcaccctcacgttgcaccagcgcatccataccggggagaagccatatgagtgcatagagtgcggtaaggcctttagccagtcagctcatctcgcccagcatcaacgcatccatacgggagagaaaccatttgagtgtaccgagtgtggtaaggctttctcccagaacgcacacctggtacagcaccagagagtgcataccggagagaaaccctatcagtgcaaacagtgtaacaaagccttttcacagttagcacatcttgcccagcaccagcgcgtacacaccggagaaaaaccatacgaatgcattgagtgcggaaaagcgttttctgactgctcgagcctggcccatcaccggcgaatccacacggggaagaggccttacgagtgtatcgactgcggaaaggcgttccggcagaacgcttcactgatccgccacaggaggtattatcacaccggcgaaaaaccctttgactgtattgactgcggtaaggcattcacagaccatattggattaatccagcataagaggacgcacacgggggaacggccctataagtgcaacgtctgcgggaaggcattcagccatggctcctcgctgacagtgcaccagcggattcacactggagaaaaaccatacgagtgtaatatatgcgaaaaggccttcagccatagggggtccttgacattacaccaaagggtgcataccggtgaaaagccgtatgagtgtaaggaatgcggcaaggctttccgacaatctactcatcttgcacatcatcagcgtatccatacaggcgaaaagccgtatgaatgcaaggagtgctctaagacattcagtcagaacgctcacttggcacaacatcagaagattcacacaggagagaagccatacgagtgcaaggaatgcggtaaagccttttctcagattgcgcatcttgtccagcatcagcgagtgcataccggcgagaagccctacgagtgtatagaatgtggaaaggccttttcagacggatcgtacctggtgcagcaccagcggctccattctggcaagaggccatacgagtgtctggaatgtggaaaagcctttagacagcgagcttccttaatttgtcatcagaggtgccatacgggcgaaaagccctacgagtgcaatgtttgcgggaaagcattctcacatcgcaaatccctgaccctacaccagaggattcatactggggagaagccatacgagtgcaaggagtgctcgaaggccttttcccaggttgcccatctgacccttcacaagagaattcacactggggagcgaccatacgaatgtaaagaatgcggcaaggcgttccggcagtcagttcatctggcacaccatcagcggattcacacaggagaatcttccgtgatactcagcagcgcgctgccttaccaccaggtcctgtag

SEQ ID NO: 14238 - DNA, 2154 bp, Artificial Sequence
  Description of Artificial Sequence: Synthetic coding sequence
atgaaatctcaggaggaggtggaagtggccgggattaaactatgtaaagctatgtcactggggtcagtgacattcacggacgttgctatagactttagccaggacgagtgggaatggcttaatctggcccagagaagtctgtacaagaaggtaatgttggaaaactacaggaacctcgtgtccgtgggattatgcatcagcaagcctgacgtgatcagtctcctggaacaggaaaaggatccctgggtgatcaagggcggtatgaacagaggcctgtgtccagacctcgagtgcgtctgggtgacgaagagtctaagcctcaatcaggacatttatgaggagaagttgccaccagctattatcatggagcggctgaagtcatacgacctcgagtgctcaaccctcggtaaaaattggaagtgtgaggatttgtttgagagagaactagttaatcagaagactcacttccggcaagagacgatcacccacatcgacactctgatagagaagcgggaccacagtaataagtccgggactgtttttcacctgaacacattgagctacattaaacagattttcccaatggaggagcggatctttaattttcacacagacaaaaaatccctcaaaacacactcagtggtaaaaaagcacaagcaggaccgcggggaaaagaaactgttaaagtgtaatgactgcgagaaaatcttctccaaaatctccaccctcacgctccatcaaaggatccacacgggagagaagccctatgaatgcatcgagtgtggcaaggccttcagccaaagcgcccacttggcccagcaccagcggattcacaccggggaaaaaccctttgaatgtactgaatgcgggaaagccttcagccagaatgcccatctggtgcagcaccagcgggttcacacaggcgagaagccttatcagtgtaagcagtgtaacaaagcattcagtcaactagcacacctcgctcagcatcagcgagtgcacacaggcgagaagccctatgaatgtattgagtgcggcaaagcattctcagactgttcttcgcttgctcatcaccgacggatccacaccggcaagcgcccatacgaatgcattgactgtgggaaagccttcaggcagaacgcttccctgatacgacatcgcagatactaccacacaggggaaaagcctttcgactgtatcgattgcggaaaggcctttaccgaccacattggactgattcagcataaacgtactcatacaggggaacgtccttacaagtgcaacgtgtgtggaaaggccttcagtcacggatcctcgctgactgtacatcagagaatccacaccggagagaagccttacgaatgtaatatctgcgaaaaggccttctcacatcgcggatcacttaccctccaccaacgtgtccatactggcgagaagccctacgagtgtaaagaatgcggcaaagcgttccgccagagcactcacctcgcccaccatcaacggatacacaccggggagaaaccatatgagtgtaaagagtgcagcaaaacattttctcagaacgcacacttggcacagcaccagaagatccataccggagagaagccatatgaatgtaaggagtgcgggaaagcctttagccaaatcgctcacctggtgcagcaccagagggttcacacaggggagaagccatacgagtgtatcgagtgtggcaaggcgttcagtgacgggtcatatctggttcaacatcagcggctgcattccgggaagaggccatatgaatgtctggagtgtggcaaagctttccgtcaacgagccagcctgatctgccatcagcgttgccatacaggcgaaaagccgtacgagtgtaatgtttgcggaaaagccttttctcacaggaaatccctcaccctccaccagcgcatccacactggcgaaaaaccatatgaatgtaaggaatgcagcaaagcattttcacaggtggcccacctcacgctccataagcgcattcacaccggcgaaagaccctatgaatgcaaagaatgcgggaaggcctttaggcagagtgtgcaccttgcccatcatcagcggattcatacaggggagtcgagcgtcatccttagctcggctcttccctatcaccaggtactttag

SEQ ID NO: 14239 - DNA, 1881 bp, Artificial Sequence
  Description of Artificial Sequence: Synthetic coding sequence
atgaacgtagaggtggtaaaggtgatgcctcaggacctggtgaccttcaaggatgtggctattgatttttcccaggaagagtggcaatggatgaacccggctcagaagaggctgtaccggtcaatgatgctcgaaaactaccaatccctggtgagtctgggcctgtgcatcagtaagccttatgttattagcctgctggagcagggccgcgaaccctgggaaatgacttcggaaatgacacggagcccattttctgattgggagagtatttacgtcacgcaggagctgcctctgaaacagtttatgtacgacgacgcatgtatggaggggatcacctcctatggtctggaatgctccacatttgaggaaaactggaagtgggaggatctttttgaaaaacagatgggctcgcacgagatgttctccaagaaggagattatcacccacaaagagactattaccaaggagacggagttcaaatacaccaagttcgggaagtgtattcatctagagaacattgaagaatccatctacaatcatactagtgataagaaaagctttagcaagaacagtatggttataaagcataagaaagtgtatgtgggaaaaaagctgtttaaatgtaacgagtgcgacaaaacttttacgcattcctctagtctaaccgtgcactttcgcatccatacaggagagaagccctatgcgtgcgaggaatgcggtaaggcctttaaacaacgacaacacctcgcacagcaccacagaacccatacgggggagaagctcttcgagtgtaaagaatgccgcaaggcatttaaacaatcagagcaccttattcaacatcagagaatccataccggagagaagccgtataaatgtaaggagtgtaggaaggcattccggcagccagcccatctggcgcagcatcaacgtatccatacgggcgaaaagccttacgagtgcaaagaatgcggcaaggctttttcagatgggagttcgtttgcccgtcaccaaaggtgtcacacaggtaagcgaccatacgaatgcatagaatgcggcaaggcctttcgctataatacctcctttatccggcattggcgctcttaccatacaggcgagaaaccgtttaactgtattgactgcggcaaagcgttctcggttcatattggactgattctgcaccgaaggatacacacgggggaaaaaccctacaaatgcggtgtctgcggcaagacgttctcgagtggaagcagccggacagtacatcagagaattcacaccggcgagaagccatatgagtgtgatatttgcggtaaagattttagccaccacgctagcctcacccaacaccagcgggttcattctggcgaaaaaccctatgaatgcaaggagtgtggcaaagccttcaggcagaatgttcatctggttagtcaccttagaatccacaccggcgaaaagccctacgagtgcaaagagtgtggaaaggcctttcggataagctcacagttggctacccatcagcgaatacacacaggggagaagccatatgaatgtatcgagtgtggaaatgccttcaaacagcggtctcacctggcacaacatcaaaagacacataccggagaaaaaccatacgagtgtaatgaatgtggcaaggcctttagccagacctcaaacctgacacagcatcaacggatccataccggagaaaaaccctataaatgcactgagtgtggtaaggctttctctgatagttcatcttgtgctcagcatcagcggttgcacacgggacagaggccctaccagtgcttcgagtgcggcaaggcgtttcgaagaaaactctccctgatctgccatcagcgcagccacactggcgaggagccgtag

SEQ ID NO: 14240 - DNA, 2616 bp, Artificial Sequence
  Description of Artificial Sequence: Synthetic coding sequence
atggccgaggagtttgtgactctgaaggacgttggtatggacttcacattaggcgactgggagcagctggggttggagcagggagacactttctgggatactgccttagacaactgccaggacttgttcctgctagatcccccccgcccaaatctgacttctcatcctgatggaagtgaggacttggagcccctcgccggaggtagtcccgaggctacttctcccgatgtgacagaaaccaaaaatagccccctgatggaagacttcttcgaagaaggctttagtcaggagataatcgaaatgttaagcaaggatgggttctggaacagtaacttcggcgaggcttgcatagaggatacttggctcgatagtctgctaggagaccctgagtcactgctcagaagcgacatagcaactaatggggaaagcccaactgagtgcaagtcccacgagctcaaacgggggctatcccctgtgagcaccgtttccacaggtgaggattctatggtgcacaatgtaagcgagaaaacccttacacctgcgaaatcaaaagagtataggggggagtttttctcttactctgaccattctcagcaggactctgtgcaggagggggagaagccctaccagtgctccgagtgcgggaagagtttttctggttcttatagactaactcaacattggatcacacacacccgcgaaaagcctactgtgcaccaggagtgtgagcaaggcttcgaccgaaacgctagcctctctgtctatcccaaaacccacacgggctacaagttctacgtctgtaacgagtacggtacgaccttctcacaatcaacctatctgtggcaccagaagacgcacactggggaaaaaccttgcaagtcccaggactctgaccatccccctagtcatgacacacagcccggcgaacaccagaaaacgcatacggacagtaaatcttacaactgtaacgaatgcggtaaagctttcacccgtattttccaccttaccaggcaccaaaaaatccatacgcggaagcgttatgaatgttctaaatgccaggcaacctttaacctcagaaagcacctaatccagcaccaaaagacccacgccgctaaaacaacatcagaatgccaggagtgcggcaagatctttagacactcatctctactaatagagcaccaggccctgcacgccggcgaggaaccatacaagtgcaatgaacgcggtaaaagttttcgacataacagtacattgaaaatccaccagagggtgcatagcggggagaagccttacaagtgttctgagtgcggaaaggcctttcaccgacatacccacctcaatgagcaccgacggattcacaccggttaccggcctcacaaatgtcaggaatgcgtcagatccttctcccggccctcccatctgatgaggcaccaggccatccatactgccgagaaaccatactcatgcgccgagtgtaaagaaacctttagcgataataaccgcctggtgcagcaccagaaaatgcatacagtgaaaactccctacgaatgccaagagtgcggagagcgttttatttgcggcagtactttgaagtgccacgagtccgtccacgctcgtgaaaaacagggatttttcgtgagcgggaaaatcttggaccaaaatcctgagcagaaagagaaatgcttcaaatgtaacaaatgcgagaaaactttcagctgtagcaagtacctgacccagcatgagcgcattcacacccggggagtgaagccgttcgaatgcgaccagtgtggaaaggcattcgggcagagcaccagactgattcaccaccagaggatccactctcgtgtcagattgtacaaatggggcgaacaaggtaaagccatcagctctgcatctttaatcaagctgcaatcttttcataccaaagaacacccattcaagtgcaacgagtgtgggaagaccttcagtcactctgcacacctgtctaagcatcagctcattcatgccggtgagaacccatttaagtgctcaaaatgtgatcgggtctttacacagagaaattacctggttcagcacgaacgtacacacgcacgcaaaaaacctctcgtgtgcaacgaatgcgggaaaacctttcggcagagctcctgcctctcgaaacaccagaggattcacagtggggagaaaccgtacgtgtgtgattattgcggaaaggccttcggactttcggccgaactggttcgccaccagaggatccacaccggggaaaagccgtacgtttgccaggaatgtgggaaagcttttactcaatcatcatgtctcagcatacacagaagagtccataccggagagaaaccctaccgatgtggggaatgtggtaaagcatttgcccagaaggcaaacttgacacagcaccagagaattcacaccggtgaaaagccttacagctgtaacgtatgtggaaaggcctttgtgctctctgctcacctgaaccagcacctccgggtccatacccaagaaactctgtaccagtgccaaagatgccaaaaggctttcagatgccacagctctctctcaaggcaccaacgcgtgcataataagcagcaatattgtctctag

SEQ ID NO: 14241 - DNA, 2616 bp, Artificial Sequence
  Description of Artificial Sequence: Synthetic coding sequence
atggccgaggagtttgtcactctgaaggatgtggggatggacttcacccttggagattgggaacaacttggtttagaacaaggtgacaccttctgggacacggcgttggacaactgccaggatctttttttgctggaccctccgagaccgaatcttacgtcccatcccgacggaagcgaggacttggagcctctggccgggggatcccctgaggccaccagcccagacgtgactgaaactaagaacagccctctgatggaggatttttttgaggaaggcttttctcaggaaattattgagatgctgagcaaggacggtttttggaattccaactttggagaggcttgtatcgaagacacatggctcgacagcctattgggggatcctgagtccctgcttcgcagtgatattgcaacgaacggcgaaagccccaccgagtgcaagagtcacgagctcaaacggggcttgtcacccgtaagcaccgtgtccacaggagaggactcaatggtccataatgtgtccgaaaaaacccttactcccgctaagagtaaggagtacaggggcgagtttttttcttactcagatcacagccagcaggatagcgtgcaggagggcgagaaaccgtaccagtgttccgaatgtgggaaaagtttcagcggatcttatcggctgacccagcactggataacgcacactagggagaaacccaccgtccaccaggaatgcgagcagggctttgataggaacgcttccctatcagtttatcctaagacccatactggttacaagttttatgtctgtaatgagtacggtaccacattcagccagtcgacttatctgtggcatcagaagacccacactggcgagaagccgtgtaagtcgcaggacagtgaccaccccccctcccacgatacacagccgggtgaacatcaaaagacacacaccgacagtaagagctataactgtaacgagtgcggtaaggcctttacaagaatttttcaccttaccaggcaccagaaaatccacactcggaagcgctacgaatgcagcaagtgccaggctaccttcaatctgagaaagcatttgatccagcaccagaagacccacgctgcaaagaccacatccgagtgccaagagtgcggaaaaatatttcgtcacagctcccttctcatcgaacatcaggcccttcacgctggagaggaaccgtataaatgcaacgaaagaggcaagagcttcaggcacaattcaacactgaaaatccaccagagggtgcatagtggggagaagccctacaaatgttcggaatgcgggaaggccttccacagacacacccacctgaacgaacaccgccgcattcacacggggtataggcctcataagtgccaagaatgtgtccgctcattttctcgcccaagtcatctgatgaggcaccaggcaatccacactgcagagaaaccgtacagctgcgctgagtgcaaggaaacattctctgataacaaccgcctcgtccagcaccagaaaatgcacacggtgaaaactccttacgaatgtcaagagtgcggagaacgctttatttgcggatcaaccctgaaatgccacgagagcgtgcacgcaagggagaaacagggattctttgtgtccggcaagatattggatcaaaatcccgagcagaaggagaagtgctttaaatgcaataagtgcgaaaagacattttcctgcagtaaatacctgactcagcacgaaaggatacacacaagaggcgtaaagccctttgagtgcgatcagtgtggaaaggccttcgggcagagcaccagattaatacaccatcagaggatccactctcgagtgcgactttacaagtggggcgagcaaggaaaagccatctccagcgcgtctctcatcaagctgcagagtttccacacaaaggaacatccgttcaagtgtaacgagtgcggcaaaactttctctcacagcgcgcacttatcgaaacaccagcttattcatgctggggaaaaccctttcaaatgcagtaagtgcgaccgcgtctttactcagagaaattaccttgttcaacatgaacggacacacgcacgtaagaagcccttggtgtgtaatgagtgcggcaaaactttcagacagagctcttgtctgtctaagcatcagagaatccactccggggagaagccatacgtgtgtgactactgtgggaaggcctttggcctctccgccgagttagtgagacaccaacgcattcataccggcgagaaaccctacgtctgtcaggaatgcggaaaagcttttacacagagcagctgcctgtcaattcaccggagggtgcacactggagagaagccataccgatgcggtgagtgcgggaaggcattcgcccaaaaggccaacctgactcagcatcagcgcattcacacaggtgagaagccctatagctgcaatgtgtgcggaaaggcctttgtcttatctgcacacctgaaccagcacttacgcgtgcacacccaagagaccctgtaccagtgtcagcgttgtcagaaagcctttaggtgtcattcgtccctgtccaggcaccaacgagtccacaacaaacaacaatattgcctgtag

SEQ ID NO: 14242 - DNA, 2580 bp, Artificial Sequence
  Description of Artificial Sequence: Synthetic coding sequence
atggatttcacactaggcgactgggagcaattgggcctggagcagggagataccttttgggataccgctctggataactgtcaggacctgttcttactggatcctccacgtcccaatctgacgtcccacccggatgggtccgaagacttggaaccacttgctgggggttctccagaagccaccagtcctgacgtgaccgagacaaagaatagccccttaatggaggacttttttgaggagggctttagccaggagatcatcgaaatgcttagcaaggacggcttttggaacagcaattttggggaggcctgtattgaggacacctggctcgacagtctgctcggagaccctgagagcctactgaggagcgacattgccactaatggtgaatccccaactgagtgtaagtcacatgagctcaagaggggactctctcccgtgagcactgtctctacaggcgaggattccatggtgcataatgtcagtgaaaagacgctgactcccgccaaaagcaaggagtatcgcggagaatttttctcatattcagatcactctcagcaggacagtgtccaggaaggagaaaagccctaccagtgctcagaatgtgggaaatcctttagtggctcgtatagacttacacagcattggatcacccacactagagagaagcctaccgtccaccaggagtgtgaacagggatttgataggaacgctagtttgtccgtgtatcccaagacacacaccggatacaaattctatgtatgtaatgagtatgggacaacattctcccaaagtacctatctgtggcaccagaagactcacaccggtgaaaaaccctgtaagtcgcaagattcggaccacccaccctcccatgacacacagcctggagagcaccaaaaaacacacaccgatagcaagagctacaattgcaacgaatgtggtaaagcttttacccggatttttcacctcactcggcatcagaagatacacactcgaaagcgttatgaatgtagcaagtgccaggcaacgttcaacttaagaaagcaccttatccagcaccaaaaaacccacgccgccaagactacatccgagtgtcaagaatgtgggaagatctttcgacatagctctttactcatcgagcatcaagcccttcacgctggcgaagaaccgtataagtgcaatgagcggggcaagtcattcaggcacaactcaacactcaaaatccatcagagagtgcattctggggagaaaccctacaagtgttctgaatgtggtaaggctttccaccgtcacacccatctgaatgaacacaggcgtatacacactggatatagaccgcataaatgtcaggagtgcgttcgtagtttttcccgtcctagtcacctgatgcggcaccaggccattcacacggccgaaaagccatattcctgcgctgagtgcaaagagacctttagcgataacaatagactcgtgcagcatcagaaaatgcacacggttaaaacaccctacgagtgccaggaatgtggagaacgtttcatttgtggctctaccctgaagtgtcacgagagcgttcatgcccgggaaaaacaagggttctttgtgagcgggaagattctggaccagaatccggaacagaaggaaaaatgtttcaaatgtaacaagtgtgagaaaacattttcatgcagtaagtatcttacgcagcacgaaagaatccacaccagaggagtgaagccctttgaatgtgatcaatgcggaaaagccttcggccagtcaacgaggcttatacaccaccagcgaatacatagtagagtccgactctacaagtggggcgagcaggggaaggccatctcatctgccagcttgattaaattacagagctttcataccaaggagcatccattcaaatgcaatgaatgcgggaagaccttttcgcacagcgcacacctgagcaaacaccagttgattcatgcgggcgagaaccccttcaagtgttctaagtgcgaccgcgtgtttactcaaaggaattacctggtccagcatgagaggacccacgctcgcaagaaaccattggtctgcaacgaatgcggtaagacttttcggcagtcttcatgtctctccaagcaccaacgcatacattccggcgaaaaaccctacgtgtgtgattattgcggtaaggccttcggtctatcagcagagcttgtccgccaccagagaatacacactggcgagaaaccttacgtgtgtcaggagtgtggaaaggcctttacccagtcttcttgtctgtcaattcaccggagggttcacactggggaaaagccctaccggtgtggagaatgcgggaaggcttttgctcaaaaagcaaatcttacccagcatcaaaggattcataccggagagaagccatattcttgcaacgtttgtggcaaagcctttgtgctgtccgcccatcttaatcagcaccttcgtgttcacactcaggagacactttaccaatgtcagaggtgccagaaggccttccggtgccacagttccctcagtcgccaccagcgcgtgcataataaacaacaatattgtctttag

SEQ ID NO: 14243 - DNA, 2616 bp, Artificial Sequence
  Description of Artificial Sequence: Synthetic coding sequence
atggctgaggaatttgtcactcttaaggatgtcggcatggacttcaccctgggcgattgggagcagttgggactagaacagggtgacaccttttgggacacagccctggataactgtcaggatctgttcttactagatcccccaaggcctaacttaacatctcaccccgacgggtcagaagacttggagcccctcgccggaggcagccccgaggcaacctctccggatgttaccgaaacaaagaatagtcctctcatggaggacttcttcgaagaaggctttagtcaggaaatcatcgaaatgctcagcaaggacggtttctggaactcaaatttcggcgaggcgtgcatcgaggacacatggctggatagcctgctaggggaccccgagtcactcctgaggtctgacattgctaccaatggcgagagcccaacggagtgcaaatcccacgaactgaagagagggctgtctccagtatctacagtttccaccggtgaagacagcatggtacataatgtgtccgagaagacacttaccccagccaagtcaaaagaatacagaggtgaatttttttcctacagcgatcactcgcagcaggactccgtccaagagggagagaagccgtatcagtgcagtgaatgcgggaagagcttctcaggctcttaccgcctcactcagcactggatcacccataccagggagaaacctacagtacaccaagagtgcgagcagggttttgaccgcaatgccagcctgtccgtctaccctaagacccacaccggctataaattctatgtgtgtaacgaatacggtacaacttttagccagtctacctacctgtggcaccagaaaacacacactggtgagaagccttgtaaatctcaggactccgaccatcctccgagtcatgacacgcaacccggggagcatcaaaagacacatactgattctaaaagttataactgtaacgaatgtggtaaggcttttacacgcatatttcacttgacgagacatcaaaaaatccacacacggaagcggtatgaatgcagcaagtgccaagccacttttaacctgaggaaacatttaatccagcaccagaagacccacgcggccaaaaccacaagcgagtgtcaggagtgcgggaaaatattccgtcatagtagtctgctcatcgaacaccaagctctgcatgctggcgaggagccctacaaatgcaatgaacgcggaaaatcctttagacataattcaactctcaaaatccaccagcgggtgcacagcggcgagaaaccttacaagtgcagcgaatgtgggaaggcctttcatcgacacacacacctgaacgagcaccggcgaatacacactggatatcgaccccataagtgccaggaatgcgtacggtctttttcgcgcccgagccaccttatgcgtcaccaggctatccataccgctgagaagccatacagttgtgcagaatgcaaggaaacattctccgacaacaaccggttggtgcaacatcaaaaaatgcatacagtgaagacaccctatgagtgccaagaatgtggcgaacggtttatttgtggtagcaccttaaagtgtcacgaatcagtacacgcccgcgagaagcagggattcttcgtcagcggaaaaatccttgatcagaacccagagcagaaagaaaagtgctttaagtgtaacaaatgtgagaaaacattcagttgtagcaaatatctcacccagcacgaacgaattcatactcgcggtgtcaaaccctttgagtgcgaccagtgtggtaaggcctttggacagagcacacgactgatccatcatcagcgtatacatagtagggtacgattgtacaagtggggcgaacaaggaaaggcaatcagttcggcctccttgatcaaattgcagtcttttcatacaaaggagcacccctttaaatgtaatgagtgtggcaagactttttcccacagcgcgcatttatccaagcaccagctcatccacgcaggcgagaacccttttaagtgcagtaagtgcgatcgcgtgtttacgcagcgaaactatcttgtgcagcatgaacgcacgcacgccaggaagaaaccgctggtctgcaatgaatgcggaaagacgttcaggcagtcctcctgtttaagcaagcaccaacgcattcatagcggggagaagccctatgtatgcgactattgtggcaaggcgttcgggttgtctgctgaacttgtgaggcaccagaggatacacacaggagagaagccttacgtctgtcaggaatgtgggaaagcgtttacacagtcctcatgcctatccatccaccgcagagtgcatactggggagaagccctaccggtgcggtgaatgcggcaaggctttcgcacaaaaggccaacttgacgcaacatcaacgaattcacaccggggaaaagccctattcctgcaacgtgtgcggaaaagcctttgtgctgagtgcccacttaaatcagcatctgcgagtccatacgcaggagacactttaccagtgccaacgatgccagaaagcctttagatgtcactcctccctgtcaagacaccagagagtccacaacaaacagcaatactgtctttag

SEQ ID NO: 14244 - DNA, 1575 bp, Artificial Sequence
  Description of Artificial Sequence: Synthetic coding sequence
atggccaaaaggcctggccccccaggaagtagagagatgggccttttaacattcagagatatcgccatcgaatttagcctggaagagtggcaatgccttgattgcgcccagcgtaacctgtatcgcgacgttatgctcgagaattatagaaacctggttagcctgggtatcgcagtttccaagccagacttaatcacctgcctggagcagaacaaggagtcccagaatatcaagcggaatgagatggtcgccaaacatccagtgacccggagtcacttcactcaggacttgcagcccgaacaaggcattaaagactctttgcagaaagttattcccaggacgtatgggaagtgcggacatgagaaactgcagttcaaaaagtgctgcaagtcagtcggtgagtacgaagtgcacaagggtggctacagcgaagtaaaccagtgtctgtccacgacccagaataaaattttccagacacataagtacgtaaaagtgttcggcaagttctctaatagcaaccgggataagacacggtacactggcaacaagcattttaaatgcaataaatacggcaagtctttctgcatgttatcccacctgaatcagcatcaggtgattcacacacgggagaagagctacaagtgcaaggaatgtggcaagtcatttaactgttcttcaaatcatacaacccataaaataatacatacaggcgagaaaccataccggtgcgaggaatgtggcaaggctttctcttggtcggctaatctgacccggcataagaggacgcacactggagagaagccttacacttgcgaagaatgcggacaggcattccgtcgttcaagcgctttgaccaaccataagcgtatccataccggcgagaggccctacaagtgcgaagaatgtggcaaggcgttctctgtcagctctacactcaccgatcataagcgcatccataccggagagaagccttgccgctgtgaggagtgtggcaaagcattttcctggagttctaatctgacaaggcataaacgtattcatacgagggagaaaccatacgcatgcgaagagtgtggccaggcgttttccctgtcttctaacctgatgagacaccgcaggattcataccggcgagaagccctacacctgtgaggagtgcggccaggactttaggcgctcctcagcacttacaatccacaaacggatccatacaggagagaggccgtacaagtgcgaggaatgtggcaaggtatttagcctctccagcacattaacagaccataaaaggatccacaccggggaacgcccatataagtgcgaggagtgtggtaaggcattctccctctctagcacgttgacagatcacaaaagaattcatacgggcgagagaccctatacctgtgaagaatgcggtaaagctttcaattgtagctcaacactaatgcaacataaaaggattcatacgggcgagaaaccttataagtgcgaagagtgtgagcaggcttttaagtggcactcctctcttgctaagcacaagataatacacacgggggagaagccatacaagtgtgagtag

SEQ ID NO: 14245 - DNA, 1857 bp, Artificial Sequence
  Description of Artificial Sequence: Synthetic coding sequence
atggaaagggccgttgagccctggggacctgaccttcatcgcccagaagagcgggagccgcaaagaggcgcccggactgggcttgggtccgagaatgtgatcagccagcctaatgagtttgagcacactccccaggaagacgatctggggtttaaagaggaagatctggcccccgaccacgaagtgggcaacgcttctctgaaacccgaggggattcagaactgggacgacctttgggtgcagagggaagggcttggaaaaccccaacctcgggaccgcgggccaaggctcctaggcgaaccacgatggggacaggcttcttctgatcgcgccgccgtgtgcggagaatgcggaaaaagctttcgccagatgtccgaccttgtcaaacatcagcggacgcacacaggggagaagccttacaagtgtggggtttgcggtaaaggcttcggtgattcaagtgcccgcatcaagcatcagaggacccactctggggagaaaccttaccgtgccagaccaccagctcaggggccccccaaaatcccacgatctagaatcccagctggagagcgtccaaccatttgtggcgagtgcggcaaatccttccgccagtcatctgatctggttaagcaccaaaggacccacacaggggagaagccctataaatgcggaatctgtgggaagggcttcggtgacagctctgccaggatcaagcaccagagaactcaccggggggagcagccaccccgtccagtagtcccccgtcggcagccaagtagggcggctacagctgccacgcagggacctaaagctcaagacaagccctacatctgcaccgattgcgggaaacgctttgtgctgtcctgctccctgctgtctcaccagaggagtcatctaggaccaaaacctttcggctgtgacgtgtgcggcaaggagttcgcacgagggagtgatctagttaagcaccttcgcgtgcataccggagaaaaaccatacctgtgccccgaatgtggcaaggggtttgccgattcttccgccagggtcaagcacctcaggactcacagtggcgagcggccccacgcctgtcctgaatgcgacagaacattcagcctgagcagcacgttattgaggcacagactgacacatatggaaccccaagacttcagttttccgggttaccctctcccggcactgattccgtcgcctccacctcctcctctgggtacaagcccccctcttacgcccagaagccccagccattccggggagccatttgggctacctggcttggaacccgagcctggtggcccacaggccggcgagccacccccacccctggccggagacaagccccacaagtgccccgagtgcggcaagggcttccgccgatcgtccgacttagtgaagcaccaccgggttcacactggcgaaaagccttatctctgccccgaatgtggaaagggttttgcagattcaagtgcgcgggtgaagcacctgcgtactcaccgtggagagcgggctaggccaccccctccgtccactcttcttcgaccccacaatccgcctggtcccgtcccgatggctcctcgcccaagagtacgggcccagccctctggcccttcccagcctcatgtctgtgggttctgtgggaaagagtttccacggtctagtgacctcgtgaagcacagaaggacacataccggcgaaaaaccttacaaatgcgcagaatgcggcaaaggttttggtgacagctccgccaggatcaagcatcagagaggtcacttagtgctcacgccttttgggataggggatggtagggcccgccccttgaagcaagaggccgccacagggttggaatag

SEQ ID NO: 14246 - DNA, 432 bp, Artificial Sequence
  Description of Artificial Sequence: Synthetic coding sequence
atggaacgagctgtcgagccctggggtcccgacctacaccgcccagaagagcgggagccccagcggggagctagaactggactgggtagcgagaatgtgatcagccaacctaatgagtttgagcatacaccgcaggaggatgatctcgggtttaaagaagaagacctggcacctgatcacgaggtgggtaatgcttctttgaaacccgagggtatacagaattgggatgatctgtgggtgcagcgggagggcctgggcaagccacagccccgagacagggggccacgcctgttgggcgaacccaggtggggacaagcctcctccgaccgggcagctgtatgcggtgaatgcggaaagtcattccgccagatgtctgatcttgtgaaacatcaacggacacatacaggagagaagccatacaagtgtggatag

SEQ ID NO: 14247 - DNA, 444 bp, Artificial Sequence
  Description of Artificial Sequence: Synthetic coding sequence
atggaaagggctgtcgagccctggggtccagaccttcataggcctgaagaacgggagccccaacgcggagccagaacaggccttggtagtgagaatgtcatatctcagccaaacgagttcgagcacacaccccaggaagacgacctgggctttaaagaggaggacctggcccccgaccacgaagtaggaaacgcctcattaaagccagagggaatacagaattgggacgacctgtgggtgcaacgtgagggtctcggcaagccccagcccagagatcgcgggcctagattattaggggagcctcgttggggccaagcctcttccgatagggccgctgtgtgcggggaatgcgggaagtctttcagacagatgagcgaccttgtcaaacaccagaggacgcacactggagagaagccttacaagtgcggagtttgcgggaaatag

SEQ ID NO: 14248 - DNA, 2235 bp, Artificial Sequence
  Description of Artificial Sequence: Synthetic coding sequence
atgcaagctgtggtcccactcaataaaatgacagccatcagccccgagccgcaaactttggcttcgaccgagcagaatgaggtcccacgggtggtgaccagtggagagcaggaagccattctacgaggaaatgccgctgacgctgaatcattcaggcagcgattccggtggttttgttattcagaggtggctggaccgcgcaaagcattaagtcagctgtgggaactttgcaatcagtggctgaggccagacattcacactaaggagcagattcttgaattattggtttttgagcaatttctgacgattctgccaggggagattcgaatttgggtgaaatctcaacatccggaatcatcggaagaggtggtgacactgatcgaagacctgacacagatgctggaggagaaagaccctgtgtcccaagattccaccgtatctcaagaggaaaatagtaaggaggacaagatggtgactgtttgtcccaataccgagtcctgcgaatccattactctcaaggatgttgcagtgaacttttcaaggggggagtggaaaaagctggaacctttccagaaagaactgtacaaagaagtcttgctggaaaatctccgaaacctcgagttcctggattttccagtgagcaaactggaacttattagccagctgaagtgggtggaactgccctggctccttgaggaggtgagcaaaagcagcaggttggatgaatccgccctggataaaatcattgagcgctgcctgcgagacgatgaccacgggcttatggaagaatctcagcaatattgcggcagctctgaagaggaccatgggaatcagggcaacagcaaggggagagttgcccagaataagacattaggctcaggttctagagggaagaaatttgatcctgataagtcaccatttggacacaactttaaggaaacctctgacctgattaagcatctgcgcgtgtaccttagaaaaaaatccagaaggtataatgaatcaaagaagccctttagcttccacagtgacctcgtgcttaatcgtaaggaaaaaactgcaggagagaaatctcggaaatctaacgacggtggcaaagtcctcagtcattcctcagccctgacagagcaccagaagcggcagaaaattcacctgggagataggagtcaaaagtgttcaaaatgtggaattatcttcatcagacggagtaccctgtcccgtcgtaagactcctatgtgcgaaaagtgccgtaaagactcctgccaggaagctgcactaaacaaagatgaagggaatgaaagcggggaaaagacccacaagtgcagcaaatgcggaaaagcctttggttatagcgcaagcctgaccaagcatcgacggatccacacaggcgagaaaccatacatgtgcaacgaatgtggtaaggccttcagcgattcatcttccctgactccccatcacagaacccatagtggagagaagcctttcaaatgcgacgactgtggaaagggcttcactctgtcagctcatctgatcaaacatcagcgcattcatacgggagagaaaccttataaatgcaaggactgcggaaggcccttttctgattctagttctctcattcagcatcagcgtattcacaccggcgagaaaccttatacatgctctaattgcggtaagagttttagccattcatcttccctttcaaagcaccagcgaattcatacaggagaaaagccttataagtgtggggagtgcggaaaggcttttaggcagaacagttgtctgactcggcatcagcggatccatacaggagaaaagccttacctgtgcaacgattgcggtatgacctttagccattttacgagtgttatttatcaccaacggttacacagcggagagaaaccatacaaatgtaatcagtgcgagaaagccttccccacacactctttgttgagccggcatcagcggatccacacgggcgtcaaaccttataagtgcaaggaatgcgggaagtccttcagccaaagctcctccttaaacgagcaccatcgcatacacaccggtgaaaaaccctacgagtgcaactattgtggcgccaccttttctcgttctagtattcttgtcgagcacctgaaaatccatacggggagaagggaatatgaatgcaatgaatgcgagaagacctttaaatcaaattctggcctgataaggcatcggggatttcattctgctgagtag

SEQ ID NO: 14249 - DNA, 735 bp, Artificial Sequence
  Description of Artificial Sequence: Synthetic coding sequence
atgcaggctgtggtgcccctaaataagatgactgcaatttccccggagccacaaactctcgcttccactgagcagaacgaggtaccacgagttgtcacctcgggggaacaggaagccatactgaggggtaatgccgcagatgctgaaagctttagacaaagattcagatggttttgctattcagaagtggcaggaccccgtaaggctctctcccagctctgggaactgtgcaatcaatggttgagacctgatattcacactaaagagcagatcctagagttgcttgtgtttgagcagttcctcaccatcttgccgggcgagatcagaatctgggtcaagagtcagcatcctgagtcgagcgaagaggtcgtaaccttaatagaggacctaacccagatgctggaggagaaagaccctgtcagccaggactccacagtaagccaagaggagaactccaaggaggacaaaatggtaacagtgtgtccaaataccgaatcctgtgaatcaattacgttaaaagacgtcgccgtcaatttctcaaggggagagtggaaaaaattagaacctttccaaaaggagctctataaggaagtgttgctggagaatcttcgcaacctcgagttcttagattttcccgtgtcgaagctggagttaatctctcagttaaaatgggtagagttgccgtggttgttggaagaagtttctaaatcgtctcggctcggatccgttatttag

SEQ ID NO: 14250 - DNA, 771 bp, Artificial Sequence
  Description of Artificial Sequence: Synthetic coding sequence
atgcaggctgttgtaccactaaacaagatgacggcaatttctcctgagccacagacgcttgcatccaccgagcagaacgaggttcccagagtcgtcacatctggcgagcaggaagctatattgcgggggaacgctgcagatgccgagtcgtttcggcagcgattcaggtggttttgttattcagaggtggctggcccccgaaaagcactcagtcagttgtgggagctctgcaaccagtggttgagaccggacatccacaccaaggaacagatcctggagttgctggtctttgaacagttcctgacaattttgccaggcgaaataaggatctgggtcaaatcacagcaccccgagagctcggaggaagtcgtgacgttgatagaggatctgacacagatgctcgaggaaaaagacccagtgagccaagacagcactgtgagccaagaggagaactctaaagaagataagatggtgacggtgtgtccaaacaccgagtcatgtgagagtatcactttaaaagacgtggctgtgaatttttcccggggcgaatggaagaagctggagccctttcagaaggaactttacaaggaggtcctcttagagaacctgagaaatctcgaattcctcgactttcccgtatccaagctggagttgatttcccagctaaaatgggttgagttaccctggttgctcgaggaggtctcaaaaagttccagactggatatccatggcgcagtgaagaagatgcagatgttttcagaggccgagtag

SEQ ID NO: 14251 - DNA, 537 bp, Artificial Sequence
  Description of Artificial Sequence: Synthetic coding sequence
atgcaggccgtagttccattgaataaaatgacagccattagtccggagccacagacactcgcgtccaccgaacaaaacgaggttccccgtgtcgtgacaagtggggagcaggaggcgattctacggggtaatgcagcagacgccgagtcattccggcagcgattccgatggttctgctactccgaggtggccggtcctcggaaggcactgagccagctgtgggaactttgtaatcaatggctcaggcctgacattcatactaaggaacagatccttgagttgcttgtctttgagcagttcctaacaattctgccaggtgagatcagaatctgggttaagagtcagcaccccgagtcctccgaagaggtggtgactctcatcgaagaccttactcagatgcttgaggagaaaggcgagatctatcggtggcgtgaagaggcaggagacatagcaagtaagagcgagtcaaaattcctcaaaaggcgccaattcacggctaaggaggaatccgaagtgcgcagttgggactgggtgtag

SEQ ID NO: 14252 - DNA, 2451 bp, Artificial Sequence
  Description of Artificial Sequence: Synthetic coding sequence
atgctcgagaattacttcaatctcatctctgtagggtgtcaggtgccgaagcccgaagtcatctttagccttgaacaggaggagccatgtatgcttgacggtgagatcccatcacagtcacggccagacggcgacatcggatttggccccctgcagcagagaatgtctgaggaagtctccttccagagcgagatcaatattaacctcttcacacgggatgatccgtatagcatactggaagaactgtggaaggatgatgagcacaccaggaaatgtggcgaaaaccagaacaaacctttatctcgcgttgtttttataaataaaaagacactcgccaatgattctatatttgaatacaaagacatcggcgaaatcgtccacgtcaatacacatctcgtttcctctagaaaaaggccgcataactgtaatagttgcggcaagaacctggagcctatcatcacactctacaaccggaataacgctaccgagaacagcgacaagactattggcgatggcgacatcttcacccacctgaatagccacacggaagtcaccgcttgtgagtgcaatcagtgcgggaaacccctccaccataagcaggcactcatccagcagcagaagattcacacacgtgaatccctgtatttattctccgattacgtcaacgtattttcccccaagtcccacgcattcgctcatgaatccatctgcgctgaggagaaacagcacgagtgtcatgagtgtgaggctgtattcacccagaagtcacaactggatgggagtcagcgcgtgtatgccgggatttgcactgagtatgagaaagacttttctctgaaatccaatagacagaaaaccccatacgagggcaattattataagtgttccgactacggtcgggccttcattcagaagtctgacttatttcggtgtcaaaggattcacagcggggagaagccctacgagtacagcgagtgcgagaagaacctacctcagaactccaatctgaatattcacaagaaaattcacacaggcggcaagcattttgaatgcacggagtgcggaaaagcctttactcgcaagagcactctgagtatgcatcagaaaatacataccggtgagaaaccgtacgtctgtactgaatgcggcaaggccttcatccgcaaatcccacttcatcacccatgagagaattcatactggagaaaaaccctacgagtgctcggattgcggcaaaagctttatcaagaagtcccagttacatgttcatcagagaatccacactggagaaaacccgtttatttgttctgagtgtggtaaagtgttcactcataagactaatctgattattcaccagaagattcacacaggtgaacgtccgtatatatgcacagtttgcggaaaggctttcacagaccgaagtaatctcatcaagcaccagaagatccacaccggagaaaaaccctacaagtgctccgattgcggcaagagctttacgtggaagtcccgacttcgcatccatcagaagtgccatacaggcgagagacactatgagtgttcagaatgtggaaaagcatttatccagaaaagcaccctgtccatgcaccagagaattcaccggggcgagaaaccgtatgtatgtaccgagtgtggaaaagcctttttccataagagtcatttcattacacacgaaaggattcacacaggagaaaagccctatgagtgctctatttgcggtaagagctttaccaaaaagtcccagcttcacgtccaccaacagatccataccggggagaaaccctacaggtgcgccgaatgtggcaaagctttcaccgacagatcaaacttattcacacaccagaaaatccataccggcgagaaaccttacaagtgctctgattgcggaaaggccttcacccgcaaatccggcctgcacatccaccagcagtcccacaccggagaacgccactacgagtgcagtgaatgtggtaaggcattcgcacgaaaaagtactctaatcatgcaccagcggattcataccggggagaagccttatatttgcaacgaatgtgggaagagttttatccagaaaagtcacctcaacagacacaggaggatccacaccggggagaagccatatgaatgttctgactgtggcaagagttttattaagaagagtcagcttcatgagcatcatagaattcacaccggcgaaaagccctacatttgcgccgagtgtggtaaagcctttacgatcagaagtaatcttattaaacaccaaaagattcatactaaacagaaaccatacaaatgctccgatctgggaaaggctttgaactggaagccgcagctgtcaatgccacagaaaagcgacaacggcgaggtcgaatgttctatgccacagctgtggtgtggcgacagcgaaggcgatcaggggcagttgagctctatttag

SEQ ID NO: 14253 - DNA, 2559 bp, Artificial Sequence
  Description of Artificial Sequence: Synthetic coding sequence
atgactaaatctcttgaaagcgttagttttaaggatgtaaccgtcgacttctcacgtgacgagtggcagcagttggacctagctcagaaaagcctttacagggaggtgatgcttgaaaactactttaacctgatatccgttgggtgccaggtcccgaagcccgaagttattttctccctggaacaggaggagccatgtatgctcgacggcgaaataccatcacagtcccgccccgacggggatataggcttcggacccttgcaacagaggatgtcagaggaggtcagtttccagtcagagataaacattaacctgttcacgagagacgacccatattctatcctggaagaactctggaaggacgatgaacacacccggaagtgcggcgaaaatcaaaataaacccctttcaagagtggtcttcattaataaaaagacactggccaatgatagcatctttgagtacaaggacataggcgagatcgtgcatgtcaatacacacctggtctcttctagaaagcggcctcacaattgcaatagctgcggcaaaaatctagagccgatcatcaccctctataacagaaacaatgccaccgaaaattcggataaaactataggagacggagatatctttacacaccttaacagtcacacagaggtgaccgcatgtgaatgcaaccagtgcgggaagccactccaccataaacaggctttgattcagcaacaaaagattcatacacgggagagcctctacctgttctccgattacgttaacgtgttctcccctaaatctcatgccttcgcgcatgagtccatttgtgccgaggaaaagcagcacgagtgtcatgagtgtgaagccgttttcacccaaaaaagtcagctagacggttctcagagggtgtatgctggaatttgtacagagtatgaaaaagatttttccttaaagtctaaccgtcaaaagactccttacgaaggaaactattataagtgttctgactacggccgggcgttcattcagaagagtgatctgtttcgctgccagcgcatccactccggagagaagccgtatgaatattctgagtgtgagaaaaacttgcctcagaactcaaacttaaacatccacaagaagatccacactggagggaaacactttgagtgcaccgagtgcggaaaagccttcacccgaaaaagtactctgtcgatgcaccagaagattcatactggcgaaaagccttacgtgtgcacagaatgtggcaaggctttcattaggaagtcccattttataacccacgagagaatacacactggagaaaagccctatgagtgcagcgactgcggaaaatcttttattaagaaatcccaactgcacgtccaccagcgcatccacaccggcgagaacccttttatctgctccgagtgtggaaaagtcttcacccacaaaaccaacctcatcatccaccagaagatccacacaggcgaaagaccgtatatctgcactgtgtgcggcaaggccttcacagatcggagcaacctcattaagcatcagaagattcacacgggcgagaagccctacaaatgctctgattgcggtaagtccttcacctggaaatctcggcttcgcatccaccagaagtgtcacaccggcgagcggcactatgagtgttcagaatgcggcaaggccttcattcaaaaatctactctgtccatgcatcagaggatccacagaggagagaaaccctatgtttgtaccgagtgcggcaaggctttcttccacaaaagccacttcataactcatgaacgtatacacacgggcgaaaaaccttatgagtgctccatctgtggaaaatcattcactaagaagtctcagttgcatgtccaccagcagattcatacaggcgagaagccgtaccggtgcgcggagtgcggaaaagctttcacggatagaagtaacctgtttacacatcagaagattcacactggcgagaaaccatataagtgtagtgactgcggtaaggctttcacccgcaaatccggcctgcatatacatcaacagtcacatacaggggagcgccattatgagtgttcagaatgtggaaaagcatttgcgagaaaaagcaccctgattatgcaccagcggatccacaccggagagaaaccctacatatgcaacgaatgcggcaagagtttcatccaaaagagccatctgaacagacaccgccgcattcacaccggcgaaaagccgtacgaatgttctgactgtggcaaatctttcataaagaagagccagttacacgagcaccaccgtatccatacaggggaaaagccatatatctgtgccgagtgcggcaaggccttcacgatacgctccaaccttataaaacaccaaaagatccacacaaaacagaagccctacaaatgctctgacttgggaaaggcactcaactggaagccccaattgagcatgccacagaaatccgacaacggggaagttgaatgcagcatgcctcagctctggtgcggggactccgagggtgaccaggggcagttaagtagcatctag

SEQ ID NO: 14254 - DNA, 2451 bp, Artificial Sequence
  Description of Artificial Sequence: Synthetic coding sequence
atgctcgaaaattacttcaacctgatcagcgtgggatgccaggtcccaaagcctgaggtgattttctcacttgagcaggaggaaccttgtatgctagacggagaaattccaagccaatcacgccctgatggagacattgggtttggcccactccaacagcggatgtctgaagaggtaagtttccagtcagagattaacatcaacctgtttactagggacgacccctattcaatcctggaggagttatggaaagatgatgagcacactagaaagtgcggggagaaccaaaataaaccactctcccgggttgtgtttatcaacaagaaaacactggccaacgacagcatttttgagtacaaggacattggagaaattgttcacgtgaatactcatttggtgtcgagcaggaaaagaccccataattgcaattcctgcggtaagaacttggagcccatcatcactctctacaacaggaataatgcaacagagaactctgacaagacaatcggcgatggcgacatattcacccatctgaactcccacactgaagtgacggcttgtgagtgcaaccagtgtggaaagccactccatcacaagcaggccctcattcagcagcagaaaatacacactagagagtctctgtatttattctccgattacgtgaatgtgttttcacctaagagccatgcatttgctcacgagagtatatgtgccgaggagaagcaacacgaatgtcacgagtgtgaggcggtctttacacagaagagccagctggatggctcccaacgcgtctacgccggcatttgcacggaatacgaaaaagacttctccctgaaatcgaacaggcagaagactccatacgagggtaactattataagtgcagcgactatggccgggcttttatacagaagtctgacctttttcggtgtcagcggatccatagcggggagaagccctatgaatattcagaatgtgaaaagaatctccctcaaaactccaacctgaacatacacaaaaagattcacactggaggcaagcatttcgagtgcactgaatgtgggaaggcatttacccggaaatcgacattatccatgcaccagaagattcatactggagaaaagccttacgtgtgcactgagtgtggaaaggcatttatacgcaaatcacactttatcacacacgaacgtattcataccggagaaaaaccttacgagtgcagtgattgcggaaagtcattcataaagaaatcccagctacacgtgcatcagaggattcacactggcgaaaacccatttatttgtagcgaatgcggaaaagtcttcacacataaaactaacctcatcatacatcaaaagattcataccggagagaggccatatatctgcaccgtttgcggtaaggcgtttaccgaccgtagcaacctcataaaacaccaaaagatccacaccggagagaaaccctacaaatgctcagactgcggcaaaagctttacctggaagtctcgcctcaggatacatcagaaatgccatacaggtgaacggcattatgaatgttcagagtgtgggaaggccttcatccagaagagtactctgtccatgcaccaacggatacatcggggagagaagccttacgtctgcaccgaatgcggaaaagccttttttcacaaaagccattttattacacatgagcgcattcacacaggcgaaaagccctacgagtgttccatctgcggcaagagctttaccaagaaatcccagcttcacgtgcaccagcaaatccataccggcgagaaaccgtataggtgcgcagaatgcggtaaggcatttaccgatcggagtaacctcttcacgcatcagaaaatacataccggtgagaagccatataagtgtagcgactgtgggaaggcctttactcggaaaagcggcttacatattcaccagcagtcccacactggagagagacactacgaatgtagtgaatgtggcaaagcattcgctcgaaaaagtacgcttatcatgcaccagcgcatacatacaggagagaaaccatacatctgcaacgagtgcggtaaatcattcatccagaaaagccacttgaaccgtcatcgcagaattcatactggtgagaagccgtacgagtgttcggattgtggcaagagttttatcaagaaatctcagctccacgagcaccaccggatccatacaggggaaaaaccctacatttgtgctgagtgtgggaaagcgttcaccataagaagcaacttaatcaaacaccaaaaaatacataccaaacagaagccgtacaagtgcagcgatcttggcaaggctctcaattggaaaccacaactgagcatgccacagaaatctgacaatggtgaggttgagtgctccatgccccagctctggtgcggtgacagcgaaggagatcagggtcagctctcctctatttag

SEQ ID NO: 14255 - DNA, 2565 bp, Artificial Sequence
  Description of Artificial Sequence: Synthetic coding sequence
atgagtgtgttgtcccttcccgaaagcgtcagctttaaagatgtgaccgttgacttcagcagggatgaatggcagcagcttgatttggctcagaaatctctatacagagaagtaatgctagagaattatttcaatctgattagcgtcggttgccaggtccccaagcctgaagttatatttagcctggaacaggaggagccttgcatgctggacggagagatccccagtcagtctaggcctgatggtgacatagggttcggtccgctgcagcagcggatgtctgaggaagttagttttcagagcgaaatcaatatcaacctttttacgcgggacgacccctatagcatcctggaggaactgtggaaagacgatgaacacactcgcaagtgcggggagaaccagaacaagccactctccagggttgtgttcatcaataaaaagaccctggctaacgacagtatcttcgagtataaggacatcggcgagatagtccatgtcaatactcatctcgtatcatctcgcaaacggccacacaattgtaatagctgtggaaaaaatctggaaccgataatcacgttgtacaatcgcaataatgccacagagaattctgataagacaatcggcgatggggacattttcacccacctgaattctcataccgaagtcaccgcctgcgaatgtaatcagtgcgggaagcctttgcaccacaagcaagccctcatacaacagcagaaaatacacacacgcgaaagcctgtatctgttctcagattatgtgaatgtgttttcccctaaatcccacgcgttcgctcacgaatccatatgcgccgaagaaaaacaacacgagtgccatgagtgtgaggctgtctttacccaaaagtctcaattggatggaagccagcgtgtctatgctggcatatgcaccgagtatgaaaaggatttctctcttaaatctaacagacagaagacaccctacgaggggaattactataaatgcagcgattacggtcgtgcctttattcaaaagagcgatctattccgttgtcaaaggatacacagtggcgagaaaccctatgaatatagtgaatgcgagaaaaatcttccacagaattccaaccttaacatccataaaaaaatccatacaggcgggaagcactttgagtgcacggaatgcggcaaagcttttactcggaaatcgaccctgagtatgcatcagaagattcataccggggagaagccttatgtgtgcaccgagtgcggcaaggctttcatcagaaaaagtcactttattacgcatgaacgcatccatacaggagaaaaaccctacgaatgttccgactgcggcaagtcatttattaaaaagtctcagctccacgtgcatcaaagaatccacaccggagagaacccattcatatgttccgagtgtgggaaagtttttacccacaagacaaatttaatcattcaccagaagatccacactggagagcgaccatacatatgtacggtatgcggtaaggcctttacagacagatccaatctcattaaacatcagaagatccacacaggagaaaaaccatacaaatgctcagactgtggaaagtcatttacctggaaatccaggctgaggatccaccagaagtgccacacaggcgaacgccattatgaatgtagtgaatgtggaaaagcctttattcagaaaagcacactgtctatgcaccaaagaatacacaggggggagaagccttatgtctgtaccgaatgcgggaaagcttttttccacaagtcccatttcataacacacgagcgaatacacacgggagaaaaaccgtacgagtgttccatctgtggcaaatctttcactaagaagagtcaactgcacgtgcaccagcaaatccacacaggggagaagccctatcggtgtgctgagtgcggtaaggcttttacagaccggagcaatctgtttactcaccagaagattcatactggggagaaaccttataagtgcagtgattgcggcaaagcattcactcggaaaagtgggcttcatatccaccaacagtcgcatacaggagaacggcattacgagtgtagcgagtgcggcaaagctttcgctcggaagtctacactgattatgcaccagcgaatccataccggcgagaagccatatatatgcaatgaatgtggcaaaagtttcatccagaagtctcacctgaatcgccatcgccgcatacacactggagaaaagccttacgaatgtagtgactgtggtaagagttttataaagaagtcccagcttcatgagcaccacaggattcacactggcgagaagccctacatttgcgctgaatgcggaaaggccttcactatccgcagcaatctcataaaacatcagaagatccacaccaagcagaaaccatataagtgcagcgacctgggcaaggccctgaactggaagcctcagctcagtatgcctcagaagagtgacaatggcgaagtggaatgctctatgcctcaactgtggtgtggcgatagcgagggagatcagggacagctgtcctccatatag

SEQ ID NO: 14256 - DNA, 1326 bp, Artificial Sequence
  Description of Artificial Sequence: Synthetic coding sequence
atggcaccccgtgcccaaattcaaggtccattaactttcggggacgtggccgtcgcgttcacgcggatcgagtggcgacacttagacgcagcccaaagagctctgtaccgggatgtcatgctggaaaactatgggaatttagtctcagtgggattgctctctagtaaaccaaaactgattacccagcttgagcagggcgctgagccctggaccgaagttcgagaggcgcctagtgggacgcacgccgtagaggattactggttcgaaacaaaaatgagcgctttgaagcagagcacctcagaggccagcgttctcggagagaggaccaaaagcgttatgatggaaaaggggttagattgggagggacggtcctccactgagaagaattataagtgtaaggaatgcggcaaagtcttcaagtataactccagtttcatctcccaccaacgtaaccatacctcggaaaaaccccacaagtgcaaggagtgtggcatcgcattcatgaattccagttccttgctcaatcatcataaggtgcacgccggtaagcagccctataggtgcattgagtgcggcaagttcctgaaaaagcacagcacattcatcaatcatcagagaattcattcccgcgagaagccccacaagtgcattgaatgcggaaaaacattccgaaaaaattcaattctactgtctcaccaacgcatacatactgggcagaagccttataagtgtaacgactgcggtaaagcatttgcgcaaaacgccgcccttacccgccacgagcgcatccattccggtgaaaaaccttttaaatgcaataaatgcggtcgggcttttcgagataactcaactgtgctggaacaccagaaaattcatacgggagagaaaccatatcagtgcaacgagtgcggcaaggcatttcgtaagtcctcaactttaatttcccatcagcgcatgcatacaggggaaaagccataccattgcagtaaatgtggcaagtccttcagatatagcagctccttcgccggtcaccagaagactcatagtggaaataaaccctatcagtgtagggattgtggtaaagcatttaccaagtctagtaccctgacgggacatcagagaatccataccggggagaaaccatatcactgtaaaaaatgtggcaaggcattcaggcactcttctgggctggtggaacaccaaagacttcataccggtgagaaaccctacaaatgtaacgagtgtggtaaggcttttccgcgtagcagcgccctaaagcagcacaagaagatccacaacaaagagagggccatgaagtgttcttag

SEQ ID NO: 14257 - DNA, 1326 bp, Artificial Sequence
  Description of Artificial Sequence: Synthetic coding sequence
atggctcctagggctcagattcaggggccccttacttttggcgacgtggctgtggcgttcacaaggatcgagtggcgccacctagacgcagcccagagggcgctctatagagatgtgatgctagaaaactatggaaatctggtgtccgtgggtctcctgtccagcaaaccaaagttgatcacccagttagagcagggggctgagccatggacagaagtgcgcgaagccccaagtggtacccatgccgtggaagattattggttcgagacaaagatgtctgcactgaaacaaagtacatccgaagcctctgtcctgggcgaacgaaccaagtcagtgatgatggaaaaggggcttgattgggaggggaggtcgagcacagaaaaaaactacaagtgcaaggagtgcgggaaggtctttaagtacaattcctccttcatatcacatcaacgaaaccatacgtcagaaaagccacataagtgtaaggaatgtggtattgcttttatgaactcctcttccttgttgaatcatcataaagtgcacgcaggcaagcagccgtaccgttgcattgagtgtggcaaattcctgaaaaaacactccacgttcataaaccatcagaggatccacagtcgggagaagccccataaatgtatcgaatgcggcaagacctttcgaaaaaattccatactgttatctcaccagcgaatacacacaggtcagaaaccatataaatgcaacgattgtggcaaggcatttgctcagaacgctgccttgaccagacacgaacggatccacagcggggaaaagccattcaagtgcaacaagtgtgggagggctttccgcgataactccactgtgttggaacaccaaaagatccatacgggcgagaaaccataccagtgtaatgagtgcggcaaggcctttagaaaatccagcaccctcatttcacaccaacgtatgcatactggggagaaaccataccactgttccaagtgtgggaagtctttcaggtatagctcatcattcgctgggcaccaaaagactcacagtgggaacaaaccctaccagtgtagagattgcggaaaggccttcactaaaagttcaactctaacaggccaccagaggatacacactggcgaaaagccataccattgtaaaaagtgtggaaaagcatttcgccactcctctggcttggtagaacatcagcgcttgcacactggagagaaaccatacaagtgtaacgaatgtggtaaggcgttcccacgctcaagcgcgttaaaacagcacaaaaagatacacaataaagagcgggcgatgaagtgcagttag

SEQ ID NO: 14258 - DNA, 1053 bp, Artificial Sequence
  Description of Artificial Sequence: Synthetic coding sequence
atgtctgcactgaaacaatcaacatccgaagcctctgtgctgggtgagcgcacaaagagcgtgatgatggagaaaggcctggactgggagggaaggtcctccaccgaaaagaattataagtgcaaggaatgtggcaaggtcttcaaatataacagttcttttatcagccaccagagaaaccatacatccgagaagcctcacaagtgtaaagaatgtggcattgcctttatgaactccagcagcctgctgaatcaccacaaggtgcatgctggtaagcagccatacagatgtatcgaatgcgggaagtttttgaagaagcactccacatttatcaaccatcagcggatccacagccgggaaaagccacacaagtgtattgaatgcggcaaaacgttcaggaagaatagtatattactctcccaccagcgaatccacactggacagaaaccatacaagtgcaacgattgcggcaaggcctttgcccagaatgcagctttaacgaggcacgagaggatccattccggggagaaacccttcaaatgtaacaagtgcggtcgtgcctttcgcgacaattctacagtgctcgaacatcagaagattcatactggcgaaaagccgtatcagtgcaatgagtgcggcaaagcgttccgcaaatcatccactctgatctctcaccagcgcatgcacaccggggagaagccttaccattgttctaaatgtggcaaaagttttagatacagttcttccttcgctggacaccagaagactcactctggaaacaagccctatcagtgtcgagattgcggtaaagcttttacaaagtcttcaactcttaccggtcatcagcggatacacactggagagaaaccttatcactgtaagaaatgcggcaaggcctttcgtcattcctccggcctggtagaacatcaaaggttacacaccggcgagaagccctacaaatgcaatgaatgtggcaaagcttttccccgtagctccgccctgaagcagcacaagaagattcataataaggagagagcgatgaaatgctcctag

SEQ ID NO: 14259 - DNA, 354 bp, Artificial Sequence
  Description of Artificial Sequence: Synthetic coding sequence
atggcgcctcgcgctcaaattcagggtccattaacgtttggcgatgttgcagtcgctttcacccgcatagagtggagacacttagacgctgcacagcgggcactatatcgagatgtgatgctcgagaattatggtaatctagtcagcgtaggcctgcttagctctaagccgaaactgataacccagttggagcagggcgcggagccgtggaccgaggtaagagaggccccgagcggaacacacgccgtggaggactactggttcgagacaaagatgtccgcactcaaacagtctacctcagaggccagtgtgcttggcgaaagaactaagtctgtcatgatggaaaaggggtag

SEQ ID NO: 14260 - DNA, 1392 bp, Artificial Sequence
  Description of Artificial Sequence: Synthetic coding sequence
atgcccggccctctgagatcacttgagatggagtctctgcagtttcgagatgttgcagtggagttcagtttggaggagtggcactgtctggataccgcccagcagaatctttatcgggacgtaatgctagaaaactaccgccacttggtgttcctgggcatcattgtctctaaacccgacctgattacgtgtcttgagcaagggataaaaccccttactatgaagcggcacgagatgattgctaagcccccagtggtttgcagccactttgcccaggatctatggcctgagcagtccatcaaggactcttatcagaaagttattcttagaaaattcgagaagtgtgggcacggtaacctgcattttaaaaaaggttgcgagtccgttgatgagtgcaaacttcataagagaggatataatgggctcaaccagtgtttaaccacaacacagagtaaaatcttccaatgcggcaaatacgttaaagtgtttcaccaattctcgaatagtaaaaggcacaagagaagacatacagaaaaaaaacccctgaaatacatcgagggggacaaagcattcaaccaatctagtacacacactactcacaagaagatcgatacgggtgagaagccttataagtgtgaagagtgtggaaaggcattcaacagaagttcccacctgaccacacacaaaattacccacactcgggaaaagccttacaagtgcgaagaatgcggcaaggtcttcaaatacttttcgtctttcacgacccataagaagatccattcaggcgaaaagccttatatctgcgaagaatgcggaaaagccttcatgtacccgtacaccttaacgacgcacaagatcatacacaccggggagcagccgtacaagtgtaaggaatgcgataaagcctttaatcacccagcgaccctgtcaagtcataagaagatccacacaggagagaagccttacacatgtgataagtgcgggaaagccttcatctcttccagcatcctgtctaaacatgagaagatccataccggggagaaaccttataagtgcgaagagtgtggaaaggctttcacacggtccagccacctgactatgcacaagatcatacacactggagagaagccttataaatgcgaggaatgcggaaaagcctttacctggagtgccggccttcataaacatagacgcacacataccggcgaaaaaccctacaagtgcgaggagtgcggcaaagcgtacacaaccagttccaacttaactgagcacaaaacaactcacactggggagaaaccctataaatgcaaagaatgtggaaaagcttttaactggtcctctgacctgaataagcacaaacgtattcacatcggtcagaaacccaggacatag

SEQ ID NO: 14261 - DNA, 1509 bp, Artificial Sequence
  Description of Artificial Sequence: Synthetic coding sequence
gtttctagatgtatttggtccagcagaagcccgctgagatactcagtgagtagcgcccctagaggcccccccagcgtggctctatgccctgtgggaatcggtaggtccactgcaaagatgcctgggcctttgcgctcactggagatggagagcctgcagttccgagatgttgccgttgagttctcactcgaggagtggcattgtttggatactgcgcagcagaatctttatagggacgttatgctcgaaaattatcgacacttggtgttcctcggtatcattgtgagcaagcccgacctgattacatgtctcgagcagggaataaagccgctgacaatgaagaggcacgagatgattgcgaagccccctgtcgtttgctcgcatttcgctcaggacctgtggcctgagcagagcattaaggactcataccagaaggtaatactccgtaagtttgagaaatgcggacatggcaacctccatttcaagaaaggctgtgagagcgtcgatgagtgcaagctacataagagaggttataatggtctcaaccagtgcctaactacaacccagtctaaaatctttcaatgcggtaaatacgtgaaggtgttccaccaattctcgaacagcaagcggcacaagcgacggcacacggaaaagaaaccactgaaatatatagagggggataaagcatttaatcaaagcagcacgcacactacccataagaaaatagacactggcgagaagccttataaatgtgaggaatgcggaaaggcatttaatcgatcatcacacctgaccacccataaaatcacacacacgagggagaaaccatacaagtgtgaggagtgcggcaaagtcttcaaatacttttcttcatttaccacacataagaaaattcatagtggcgagaagccgtatatatgtgaggagtgcggcaaggcttttatgtatccatatacactcaccacgcacaagatcatccacaccggggagcaaccttacaagtgtaaagaatgcgacaaagcgtttaatcacccagccactctcagctcgcataaaaagatacacaccggcgagaagccatatacttgcgataaatgcggtaaagcgttcatctcatcctccatcttgagcaaacatgaaaaaattcacacaggagagaagccctacaagtgcgaggaatgcggaaaggcttttaccagaagttctcatctgacgatgcacaagattatccacaccggcgagaaaccatataaatgtgaagagtgcggaaaggcatttacttggtctgctggcctgcataagcatcgcagaacacacactggcgagaaaccttataaatgcgaggaatgtggtaaggcgtacacgacatcaagtaacctgactgaacataaaacaactcacacaggcgaaaaaccatataagtgcaaagaatgcggcaaagcttttaattggagtagtgaccttaacaagcataaacggattcacatagggcagaagcctaggacatag

SEQ ID NO: 14262 - DNA, 573 bp, Artificial Sequence
  Description of Artificial Sequence: Synthetic coding sequence
tgacggcctcggccaagaaccccttcacgcggaccctctgacctgaggtttagaggggaagccggcctgcgccgcgtctttttgaagaaagctggtggcagcgtttccttcagcgacgtcgccgtggggtttacacaggaagagtggcagcatctggatagtgcccagcggaccccctatagggacatgatgctcgagaactattctctgttgctctctgtggggtactgtatcacaaaacccgaagtagtgtgcaaactcgagcacggccaggtgctttggatattagaagaggaatcccccagccaatcccacctcgactgttgcatcgatgacgacttgatggaaaagaggcaagagaaccaggaccagcacctgcaaaaagttgactttgtgaacaacaaaacactgacaatggaccggaacggcgtgttgggcaagacattcagcctggatactaaccctatcctctctaggaaaatcagaggcaattgtgattcgtccgggatgaaccttaacaatatttcagagctgattatcagtaatagatcatccttcgtgagaaacccatag

SEQ ID NO: 14263 - DNA, 1347 bp, Artificial Sequence
  Description of Artificial Sequence: Synthetic coding sequence
atggcgtcgagaccacggcccaggactccatctcgcggaccaagcgatttgcgtttcaggggtgaagcgggattgcgacgcgttttcctgaagaaggcaggagggtcggtgagcttcagcgatgtcgccgtggggttcactcaagaggaatggcagcacctggatagcgcccagagaaccccctatcgcgacatgatgctcgagaattactcactccttctttccgtaggctactgcatcacgaaacctgaagtcgtatgtaagctcgagcacgggcaggtgctgtggattttagaagaggaatctccttcacagagccacttagattgttgtattgatgacgatctaatggagaagcgccaagaaaaccaggaccagcacctgcagaaagtggattttgtcaataataagactctcaccatggacagaaatggagttctgggcaaaactttcagccttgacacaaatcctattctgtctaggaaaattagaggcaactgcgattctagtggcatgaacctgaacaacattagcgagttgatcatttccaatagaagttcctttgtccgaaaccctgccgaatgtaacgtgcggggcaaatttctgctgtgtatgaaacgagaaaatccttacgcccgagggaagcctctcgagtacgatggcaacggaaaggccgtttctcagaacgaagacctgtttcgccatcaatacatccagacactgaagcagtgttttgaatacaaccaccgcggatataccgaggagaggaatccgatgaacgccctaaacgtgggcaaattgctggatattgggcacgctctgcaatatatcaaagagcatactagggataagacgtacgagtgcaatgaatgcggcaagaacttttgtgaaaagtccaacctccatgtacaccagcgtacccacaccggagagaagccctacggctgtaacgaatgccagaaagctttcggcgatagaagcgctctcaaggtacaccagcgtatccatacaggagaaaaaccatacgaactccaccagcgcactcacaccggcgagaaaccttatgcatgcagtgagtgtggtaagacattctatcagaagagctccctgaccacccaccaaaggacccacacaagggagcagccctacgagtacaatgagtcattctaccagaatccaaatttcacaaagtgtcaaagggacaacattgaagagactttagtgaacatcctcaaggcgcagaaaccttctccttcttggactcgctccatcgctgaaaccacccaggtaggcgggtccgtctctttaaaggacgtgactgtggattttacgcaggaggagtggtag

SEQ ID NO: 14264 - DNA, 627 bp, Artificial Sequence
  Description of Artificial Sequence: Synthetic coding sequence
atgatgctggagaactacagtttgctgctgtctgttggatactgtatcactaaaccagaggtggtgtgtaagcttgagcatggccaagttctgtggatcctggaagaggaaagcccatcacagtcccatctagactgctgcatagatgatgacctgatggaaaagcgtcaagaaaaccaagaccagcacctgcagaaggtagatttcgtaaacaataaaaccctgactatggaccgtaatggagtccttggcaaaacattcagcttagacacaaatccaattctcagccggaagatccgggggaattgtgactccagtggtatgaacctgaataacatatctgaattgataattagcaatagaagttcatttgtacgcaaccctgcagaatgtaacgtcagaggcaagtttcttctttgtatgaaaagggaaaatccttatgcacgcgggaagcctctggaatatgacgggaacgggaaagcagttagccagaacgaagatctgtttcgccaccagtatatccagactctaaaacaatgcttcgagtataatcaatgtggtaaggcctttcatgaggaggccgcgtgtagtacccacaaacgggtatgttcctgggagactttatag

SEQ ID NO: 14265 - DNA, 420 bp, Artificial Sequence
  Description of Artificial Sequence: Synthetic coding sequence
atgatgcttgaaaactacagtctgctgctttctgtggggtattgcataaccaaaccagaggtggtatgcaagttggagcatggacaggttttgtggatcctggaggaagagtccccatcacaatcccatctcgactgttgtatcgacgacgatctcatggagaagcgccaggaaaatcaggatcagcaccttcaaaaggtcgacttcgttaataacaaaaccctgacgatggataggaatggtgtgttgggtaagacattctcattggatactaatccgatcctatctcgtaaaatcagaggaaattgcgatagctccgggatgaatctcaataatatctccgagctcattatttcaaataggtctagcttcgtcaggaacccagcagagtgtaacgttcgggggaaattcctgctgtag

SEQ ID NO: 14266 - DNA, 360 bp, Artificial Sequence
  Description of Artificial Sequence: Synthetic coding sequence
atgatgctcgaaaattactcactgctgctgagtgtgggttactgcattactaagcccgaagtggtgtgtaaattggagcacgggcaagtgctgtggattctggaagaagaatctccttctcaatcccacttagattgctgtatagatgatgatctgatggaaaaacgccaggagaaccaggaccaacatctgcaaaaggtggacttcgtgaacaacaaaacccttaccatggaccggaacggggtgctgggaaaaacattctctttagataccaatcccatcttatctcgaaagattcgagggaattgtgattctagcgggatgaatctcaacaatatctcggagctgatcatcagctag

SEQ ID NO: 14267 - DNA, 1023 bp, Artificial Sequence
  Description of Artificial Sequence: Synthetic coding sequence
atgcctgagtggcccccttgtctgagtgtcgcgccagcgcttgttataactatggcagcagggaagggagcaccactgtccccttccgcagaaaaccggtggcgcctttcggaacctgagttggggaggggctgcaagcccgtgttgcttgagaagaccaaccgccttgggcctgaggccgctgtggggagggctggacgcgacgttgggagcgctgagctagcgctgttggtcgctcccggcaagccacggccaggcaaacccctgccacctaagactcgtggcgagcagcgccagagcgcattcaccgagcttccccgtatgaaagatagacaggtcgacgctcaggctcaagaaagagagcacgacgacccaacaggacagccaggcgctccgcagctgacccagaacatcccgcgcgggcccgcaggtagtaaggtgttcagcgtatggccttccggggctaggtcagaacaacggtcagccttttcaaagcctacgaaacgcccggccgaaaggcccgaactcaccagcgtgtttcccgcaggcgaatccgccgacgccctcggcgaactatctggcttgctaaatacaacagacctggcatgttggggaaggctgagcaccccaaagctgcttgttggcgacctgtggaacctacaagccttaccacagaatgcccccctatgctctacgtttcttggagcacctactttgtggcttgaacacactcaggctcaggtgcctcctccatctagttcttctaccacatcatgggctctgcttccccccacattgactagcctaggactttctacccaaaattggtgcgccaagtgtaacctgagtttccgactgacatccgacctggtcttccacatgcgatcacaccacaagaaagagcatgctggacctgatcctcactcacaaaagagacgggaagaggcgctcgcctgcccagtgtgccaggaacactttcgagagcgccatcacctgagccgccacatgacctctcacagctag

SEQ ID NO: 14268 - DNA, 222 bp, Artificial Sequence
  Description of Artificial Sequence: Synthetic coding sequence
atgcccgaatggccaccatgtctctcagtggcaccggctctagtaatcaccatggctgcagggaaaggagctcccctgtctcccagtgcagagaacagatggcgcttgagcgaaccagagctagggagagggtgtaagcctgtactcctggagaagacaaaccgattggggccagaagccgcggtaggcagggccggcagagatgtgggctcagccgaatag

SEQ ID NO: 14269 - DNA, 360 bp, Artificial Sequence
  Description of Artificial Sequence: Synthetic coding sequence
atgcccgagtggcccccttgtctgagcgtcgctcctgctctcgtgattaccatggccgctggcaaaggagccccgttatctccgagcgccgagaatcggtggagactgtcagagcctgagctgggaaggggctgtaagcctgtcctgttggagaaaactaaccggctaggacccgaggctgctgtcggaagggccggacgcgatgtgggctccgcggagctagctcttctggtggcacccgggaagcctagaccaggaaagcccctcccgcctaaaacccgcggagagcagcgtcagagcgcgttcacggagctaccccggatgaaggaccgccaagtggatgcccaggcccaggagtag

SEQ ID NO: 14270 - DNA, 318 bp, Artificial Sequence
  Description of Artificial Sequence: Synthetic coding sequence
atgcccgaatggccaccttgcctttccgttgcccccgccctcgttatcacaatggcagcagggaagggggcccctctgtcaccatcagccgaaaaccgatggcggttgtcagaacctgaactgggacggggctgtaagccggtgcttcttgagaagacaaatagacttggtccagaggccgccgtaggtagagcaggaagggacgttggctcagctgagctcgccttattagttgcccctgggaagcccagacccgggaagccattgccacctaagacccgaggggaacaacgtcagtctgcctttaccgagctgtag

SEQ ID NO: 14271 - DNA, 261 bp, Artificial Sequence
  Description of Artificial Sequence: Synthetic coding sequence
atgcctgagtggcccccgtgtcttagtgtggcgcccgctttggtaataacaatggctgccgggaagggcgccccactgagcccctccgccgagaacagatggcgtttgtccgagcctgagctgggaaggggatgtaaacctgttctgctcgagaagactaatagactcgggcctgaggctgcagtgggacgcgccggacgcgacgtcggcagcgccgaactcgctttactggttgctccaggcaaaccacggccgggctag

SEQ ID NO: 14272 - DNA, 210 bp, Artificial Sequence
  Description of Artificial Sequence: Synthetic coding sequence
atgccagaatggccgccttgcctgtccgtggcccctgccttggtgatcacaatggccgcgggaaagggtgcaccactctccccatccgccgaaaaccgatggcggttgtctgaaccagaattgggacggggttgtaaaccagtgctactcgaaaaaacaaaccggctgggccctgaagcggcagtggggcgtgcagggcgggatgtttag

SEQ ID NO: 14273 - DNA, 393 bp, Artificial Sequence
  Description of Artificial Sequence: Synthetic coding sequence
atgcctgaatggccaccctgcctgagtgtcgccccagctctcgtgattaccatggccgccggcaagggcgctccgctctctccaagtgcagagaacagatggaggctgagcgagccggagcttggacgcggatgtaaacctgtgctgcttgaaaaaactaatcggcttgggccagaagccgccgtgggcagagccggcagagacgttggaagcgcagagctggcactattagtggctcctgggaaaccaagacccggcaagcctctgccacctaagactcgtggagagcagcggcagtctgcctttaccgagctgccgagaatgaaggacaggcaggtggacgcacaagcacaggagcgagagcacgatgacccaacagggcagccaggatag

SEQ ID NO: 14274 - DNA, 1590 bp, Artificial Sequence
  Description of Artificial Sequence: Synthetic coding sequence
atgaggaggaacagctccctctcttttcaaatggaaaggccgctggaggagcaggttcagtccaagtggtctagcagtcagggaaggaccggtaccggcggcagcgatgtgctgcaaatgcaaaattcagaacaccacgggcagagcattaagactcagactgatagcattagccttgaggacgtggccgtgaactttacactggaagaatgggcattactggatccgggacagcggaatatctacagggatgtgatgcgtgccacattcaaaaatttggcttgtattggcgagaaatggaaggatcaggatattgaagatgagcacaagaaccagggccgcaatctgcgcagccctatggttgaagccctctgcgagaataaggaggactgcccctgtggaaagtctacctcacagatccccgatctgaatactaacctggaaaccccgacaggcctgaagccctgcgactgcagcgtatgcggagaagttttcatgcatcaggtgtctcttaatcgccatatgagaagtcatacagaacagaagccaaacgagtgccacgaatatggagagaagccccataaatgcaaggagtgcgggaaaactttcaccagatcatctagcatcaggacccacgagaggatccacaccggcgaaaagccatacgagtgtaaggaatgcggcaaagccttcgctttcctgttttcattccgtaaccacatccggatccataccggtgagactccatacgaatgcaaggaatgtggcaaggcctttaggtatttaacggccctgagacgccacgaaaagaaccacaccggtgagaaaccctataaatgtaaacagtgcgggaaggccttcatatattatcagcccttccttacacacgaaagaactcatactggggagaaaccctatgaatgtaagcagtgcggcaaggccttctcatgcccaacctacctgcgcagccatgaaaagacccatactggagagaagccattcgtctgtcgcgagtgcggtagagcatttttttcccactcatctttgcgcaaacacgtgaaaacccacactggcgtccagccatatacctgcaaaaaatgcggggaggcgttcaagagctcctctagctgtgaagtacacgaacgcacccacttcggggagaagccatatgagtgtaaacagtgtgggaaggccttcaattcttcctcttatttgcaactgcacgagcgcgtccacaccggggaaaagacctacgaatgcaaagaatgtgggaaggccttcttatattctactcactttagaatacacgagcgaactcatacccgtgagaagccttatgagtgtaaacaatgcgggagggtgttcatctatttcagccatctaagacggcatgagcggtctcacacaggcgtcaagccttgcgagtgcaaacagtgcggcaaggcctttacctgcctgaacagtctcaaagtccataaaagaattcatacgggggagcggcctttccagtgcagacagtgcggaaaggccttctcttattccaagtccttgcacgtccatgagcgcacccactccaggcagaagccgtag

SEQ ID NO: 14275 - DNA, 1314 bp, Artificial Sequence
  Description of Artificial Sequence: Synthetic coding sequence
atgggggagaggctcttcgaatcagcagaaggatcccaatgcggtgagacatttacacaagtgcctgaagacatgctgaacaagaagacactgcccggagtgaagtcctgtgaatctggtacctgtggggagattttcatgggatatagcagtttcaacagaaatatacgaacggatactgggcaccagccccataaatgtcaaaaattcctggagaagccgtacaagcacaaacagcggagaaaggctctgtcccacagccactgcttcagaactcatgaacgaccccatactcgcgaaaaaccttttgactgtaaagaatgcgaaaagagcttcatttcacctgcctcaattagaaggtacatggtcacacactcaggtgacggcccctataagtgcaagttctgcggtaaagcgctcgactgcctttctctgtatctgacccatgagcggacacataccggcgaaaagcggtacgaatgcaaacaatgcggcaaggctttctcctggcactcctcagttcgcattcacgagcgcactcacaccggtgaaaagccatacgagtgcaaagaatgcgggaagagctttaatttctcgtcttcctttaggagacatgaacgtacacatacaggggagaagccctataaatgcaaggagtgtggtaaggcatttaactgtccatcaagtttccatagacatgaacgaacacacaccggcgaaaagccttacgagtgcaaactctacggcaaggcactttctcgactcattagtttccggcgccacatgcgcatgcacaccggagaaagaccacacaaatgtaagatatgcgggaaggccttttacagcccatctagctttcagaggcacgagcgctcccacacaggcgaaaagccctacaaatgcaagcaatgcggaaaggcattcacatgctcaacctcatttcagtaccatgaaagaacccataccggagagaagccagacggctgcaagcagtgcgggaaagcattccggagcgctaaatatatacgcattcacgggcgtacccatactggcgagaagccctatgagtgtaagcagtgtggcaaggccttccattgtgtttcatctttccatcgtcatgagcggacccatgcaggagaaaaaccctatgaatgcaagcattgtggcaaagctttcacttgttctatttatatcaggatacatgagcggatccacacaggggagaagccctatcagtgtaaggaatgtggaaaggctttcatccggtcgagctattgtagaaagcatgaacgtactcacactattaacatctag

SEQ ID NO: 14276 - DNA, 420 bp, Artificial Sequence
  Description of Artificial Sequence: Synthetic coding sequence
atgggagaacggctgttcgaaagcgctgaagggagtcaatgcggagaaaccttcacccaggtgcccgaggacatgcttaataagaagaccctgcctggcgttaagtcttgtgagtctggcacttgcggcgagattttcatgggctactccagcttcaaccggaatattaggaccgacaccggccaccaaccacacaagtgtcagaagttccttgagaagccatacaagcacaaacagagacgcaaggcacttagccacagtcactgctttagaacccatgagcggccacatacacgcgaaaagccctttgattgtaaggagtgcgaaaaaagcttcatatctccagccagcatccgacgttacatggttacccactccggagacggtccctataaatgcaagttttgcgggaaggcatag

SEQ ID NO: 14277 - DNA, 1230 bp, Artificial Sequence
  Description of Artificial Sequence: Synthetic coding sequence
atgggggagcgcttgtttgagagcgctgagggctcacagtgtggggaaaccttcacccaggtgcctgaagatatgcttaacaaaaaaacactgcctggagtgaaatcgtgcgaatctgggacgtgtggcgaaatctttatgggatattctagcttcaacaggaatattcggaccgatacgggccatcagcctcataagtgtcaaaagttcctagaaaaaccgtataaacataagcagcgccgcaaagctcttagccattcacattgtttcagaacacacgaacggccccacaccagagaaaagccatttgattgtaaggagtgcgaaaagagcttcatttcacccgcttccattcgcagatacatggtgacccattcaggtgatgggccttacaagtgcaagttctgtggcaaggcgctcgattgtctttccctatatctgacccacgagcggactcatacgggggagaaacggtacgaatgcaagcagtgcggcaaggcattttcttggcacagttcagtgagaatccacgagcgcacccacaccggcgaaaaaccatatgaatgtaaagagtgcggtaaatcttttaatttctctagcagtttccgcagacacgagagaacccacaccggagaaaaaccatatgagtgcaaattatacggaaaggccttgtcccgcttgatcagctttcgccggcatatgcgtatgcacactggggagcgcccccacaaatgcaagatttgcggtaaggcattttacagcccttcctcatttcagcggcacgaaaggtctcatactggtgaaaagccatacaaatgcaaacagtgcgggaaagcgtttacctgcagcacctcttttcagtaccacgaacgcacacacacaggagagaagcccgacggatgcaagcagtgtggtaaggccttccgaagcgccaagtatatcagaatccacggtcgcacccacacaggcgagaagccttatgagtgcaagcagtgtggtaaggcgttccactgcgtctccagctttcacagacatgagcgcacccacgccggtgagaagccatatgagtgtaagcattgtggcaaagccttcacctgcagcatctacattcgaatacacgaacgcattcacaccggtgagaagccgtaccagtgcaaggaatgtggaaaagccttcattaggagctcgtactgtcggaagcacgaaaggacacatactatcaacatatag

SEQ ID NO: 14278 - DNA, 1596 bp, Artificial Sequence
  Description of Artificial Sequence: Synthetic coding sequence
atgctcgaaaactatagaaatctggtgttcgtcgggattgcagccagcaaaccagacctgatcacatgtcttgaacaggggaaggaaccctggaatgtgaagagacatgaaatggtcgccgaacctcccgtagtgtgcagttattttgcgagggacctgtggccaaagcaaggcaagaagaactacttccagaaagtcattctcaggcggtataagaagtgcgggtgtgaaaacctgcagctgcgaaaatactgtaagtcaatggacgagtgcaaagtgcacaaggagtgttataatggcctgaatcaatgtctcacgaccactcagaacaaaatctttcagtgtgacaagtatgtgaaggtatttcacaaattttcaaattctaacagacacaccattagacatactgggaagaaatcatttaagtgcaaagagtgcgagaaatcattttgtatgctcagccacctggcccagcataagcgaatccactcaggtgagaaaccatataagtgtaaagaatgtgggaaggcctacaacgagacaagtaacctgagcacccataaacgcatccatacaggaaagaagccctacaaatgcgaggagtgtggcaaagcttttaataggttatcacacctcacaactcacaagataatccatacagggaaaaagccctacaagtgtgaggagtgtggtaaagcctttaaccagtcggcaaatctcactacacataaaaggattcacaccggtgagaagccttataaatgtgaggagtgcggcagagccttcagccagagtagtacccttaccgctcacaagatcatccatgctggagagaagccttataaatgcgaggagtgtgggaaggctttctcccaatctagtacattgaccacccataagattatacacacaggggaaaaattctacaaatgcgaagagtgtggaaaagctttttcacaactgtcccatctaaccacacataaaaggattcacagtggggagaaaccatacaagtgtgaggagtgtggcaaggctttcaaacagagttcaaccttgaccactcataagaggatccatgccggcgagaaattttacaaatgcgaggtgtgctccaaagcctttagccgattcagtcatctgacaacacacaagcggattcacacaggggagaagccgtacaagtgcgaagagtgcggcaaagcttttaacctctcctcccagctgaccacccacaaaattattcacaccggtgagaagccttataaatgcgaagagtgcggaaaagcctttaatcagtcctcgaccttgtctaaacataaggtcattcacacaggggagaaaccttacaagtatgaagaatgtgggaaagcctttaatcaatcaagccacctcacaacacataagatgatccacactggggaaaagccgtataaatgtgaggagtgcggcaaagcttttaacaattcctctatactgaaccgccacaagatgatccataccggggaaaaactctataaacctgagtcctgcaataacgcctgcgacaatatagctaagatttccaaatataagaggaactgtgcgggtgaaaagtag

SEQ ID NO: 14279 - DNA, 1941 bp, Artificial Sequence
  Description of Artificial Sequence: Synthetic coding sequence
atgaacgaatgcaatgtgcataaggaggggtataacgaactaaatcagtatttgacaacaactcagagcaagatttttcagtgtgacaaatacgtgaaagtgttccacaaactgcttaatagcaatcgccataataccaagcatacaggcaagaaaccattcaaatgcaagaagtgcggaaaatcgttctgcatgctcctgcacctgtgtcagcataagagaatccacatccgggagaacagctaccgctgcgaggagtgcggtaaggcattcatctggttctccacattgacgcgccatcgaagagtccacactggcgagaagagctacaagtatgagtgcgggaagtcatttaatcaggacagtaatctcaccacccacaagcgtatccacacagggcaaaagccctataagtgtgaagagtgtggaacaagcttctaccagttctcatatctcactagacataaactcatacacacaagggaaaaaccgtacaagtgcgaacagtatggcaaaacatttaatcagtcatctacactcacagggcataaaatcatacataacggcgagaaaccttataagtgcgaggagtgcggcaaggcctttagcattttctccacacctactaagcataagatcattcacacagaagaaaagagtcatcgctgcgaagagtattgtaaagcctacaaagagagttcacacctcactactcacaaacgtatccacactggtgagaagccatacaagtgcgaggaatgtggaaaggctttttcaatcttctccactttgacaaagcacaagattatccatacagaggaaaaatcccatcggtgcgaggaatgtggtaaggcctataaggaatcctctcacttgacaacacataaaagaattcacaccggtgaaaaaccttataaatgcgaagaatgtggcaagactttcagtgtgttctccatattgactaaacataagatcatacacaccgaggaaaagccatataagtgtgaggagtgtggcaaggcctttaagcgtagcagtaccctcaccaagcaccgcattatacatacagaagagaagccatacaagtgtgaagaatgtgggaaagcttttaatcagagcagcactctttcaatacataagattatccatactggcgaaaagccatacaagtgcgaagaatgcggtaaggcctttaaaaggagtagcaccctcacaatccacaaaatgatccatactggcgaaaagccttataaatgtgaggaatgtggaaaggccttcaataggagctcacacttaacaactcataaacggatacacacgggccacaaaccttacaaatgtaaagaatgcgggaagtcattctccgttttcagcactctaacaaaacataaaataattcacactgataaaaagccatataagtgcgaggagtgcggcaaggcttttaaccggtcttccatattatcaattcataagaagatccataccggcgagaaaccttacaagtgcgaagagtgcggaaaagctttcaaaagaagcagtcatctggcaggacataagcagattcattcggttcaaaagccctacaaatgtgaggaatgcgggaaagccttctcgatattcagtaccttaacaaagcacaagataatccataccgaggaaaagccatacaagtgtgaaaagtgtggcaagacgttttacaggttttcaaacctgaacactcacaagattatccatactggagagaaaccttgcaagtgtgaggagtgcggaaaggccttcaaccattccagcaacttgatcaaacacaagctcatccacacaggtgataagccttacaagtgcgaagcctgtggcaaagccttcaggaggtcctctcatctgtcacggcataagataatccacataggcatacacaccgaagagactgtccagaagtag

SEQ ID NO: 14280 - DNA, 2325 bp, Artificial Sequence
  Description of Artificial Sequence: Synthetic coding sequence
atgcctggcccaccggaaagccttgacatgggtccattgacctttagagacgttgcgattgagttctccctggaggagtggcagtgtctcgatacagctcaacaggacctgtatcgcaaggtcatgctggaaaactaccggaatctcgtcttcttgggcatcgccgtgtcaaagcctgacctggtaacatgtctggaacaaggcaaggacccctggaacatgaaaggtcactctactgttgttaagcctccagtgatctgctcccattttgctgaagacttctgtcctggccccggaatcaaggactcatttcagaaagtgatactgagggagtacgtcaagtgcggccataaagatctccagctgcgtaaagggtgcaagtctatgaacgaatgcaacgtgcataaggaagggtacaacgaactcaatcagtacttgacgaccacccagtccaaaatttttcagtgcgataagtacgttaaggtcttccacaagcttctaaatagcaaccgtcataatacaaagcatactgggaagaaacccttcaagtgtaagaagtgtggtaaatcattctgtatgctattgcacctttgtcagcataagaggatccatattcgagaaaacagttacaggtgtgaagagtgcgggaaggctttcatttggttttccactctaacaagacacagaagagtgcatacgggtgaaaaaagctataaatacgaatgcggcaagagcttcaaccaggactccaacttaacaactcacaagcgaatccacactggtcaaaagccatataaatgcgaagagtgcgggacaagcttctaccagttcagctacttgactcggcacaaacttatccatacacgggagaaaccctataagtgcgaacagtatggcaagacgtttaaccagagctcaaccctgactgggcataaaatcatccataatggggagaagccctacaaatgcgaagagtgcggcaaagccttctccattttctccaccccaactaaacacaaaataattcacaccgaggaaaagtctcaccggtgtgaagaatattgtaaagcctacaaagagagctctcatctgactactcacaagagaatacacactggcgaaaagccttacaaatgcgaagaatgcggcaaggcattcagcattttcagtacactaaccaagcataagataattcatacagaggaaaagagtcaccgctgtgaagaatgtgggaaggcctacaaggagtcctcccatctcaccacgcacaagcgtatccacactggcgagaagccctacaaatgcgaagagtgtggaaagactttctccgtttttagtatcttgaccaagcataaaatcatccacaccgaggagaagccctacaagtgcgaagaatgcgggaaggcattcaagcgttcttctacgttgaccaaacatagaattattcatacagaggagaagccctacaaatgcgaggagtgcgggaaagcctttaaccagtcctcgacacttagtattcacaagatcattcacactggagaaaagccatacaagtgcgaagagtgtgggaaagcttttaagcgttcatcaacactgacaatccataaaatgatacacaccggagaaaaaccctacaaatgcgaagaatgcggcaaggcctttaatcgcagctcgcacttgacaactcacaaacgcattcacactggccacaaaccttacaagtgcaaagaatgtgggaaatcattcagcgtgttttcaaccctgaccaaacacaaaattatccatactgataaaaagccgtataaatgcgaggagtgtgggaaggcatttaataggtccagcattctttccatccataagaagatccataccggagagaaaccttacaagtgcgaggagtgcggcaaggcgtttaagcggagctcacatctggcaggccacaagcaaatccactcagttcagaaaccatacaaatgcgaggagtgtgggaaagcgttctctattttttccaccctgaccaagcacaagattatccacaccgaggagaagccttataagtgtgaaaaatgtgggaagacattttacaggttctccaacctgaatacacacaaaatcatccacaccggtgaaaagccctgcaagtgcgaggagtgcggtaaggccttcaaccactcttccaaccttataaagcataagctgattcacactggggacaagccatataaatgtgaggcctgcgggaaggccttccggcgctcctcacacttatctcgccacaaaatcatccacatcggaatccatacggaagaaacagtgcagaagtag

SEQ ID NO: 14281 - DNA, 312 bp, Artificial Sequence
  Description of Artificial Sequence: Synthetic coding sequence
atgccaggaccacccgaatctctagacatggggcctttaactttccgcgacgtcgccatcgaattcagcttggaagagtggcagtgcctcgacactgcccagcaggacctgtacaggaaagtgatgctggagaactaccgtaatctggtgttcttagccgggatagccgtgagtaagcctgacctggtcacttgcttagagcagggcaaggatccatggaatatgaagggtcactcaaccgtggtgaagcctcccgttgaaacagggtttcacagattttcccaggatgggttgtaccttcttacaagttag

SEQ ID NO: 14282 - DNA, 1497 bp, Artificial Sequence
  Description of Artificial Sequence: Synthetic coding sequence
atggagagcccccgaggctggacccttcaggtcgctcctgaagagggccaagtgctatgcaatgtcaagacagcaacgcggggactctctgaaggtgcggtatctggggggtggggtgcatgggaaaactccacggaagtgccacgagaggccggagacgggcagagacagcaagctactctgggggccgcagatgagcaaggtggccctggacgggagctcgggccagccgacggcggcagggatggggctggccccaggagcgaacccgccgacagagccctgcggcccagtcctctgccggaggaaccaggttgcaggtgcggggagtgcggaaaggcattcagccagggttcttacctgctgcagcaccgtcgcgtccatacgggcgaaaaaccttacacctgtccggagtgcggcaaggccttcgcatggtcttctaacttatcccagcaccagaggattcactccggagaaaaaccatacgcatgtagggagtgtggaaaggcgtttcgtgcgcatagtcagctgatacatcatcaagagacacattcaggactgaagccctttcgatgtcccgattgtggtaagtccttcggccgctcaaccaccctagtgcaacaccgcaggacacataccggagagaaaccttacgagtgtcccgagtgtggcaaggccttctcctggaactccaacttcctcgaacatagaagagtgcatactggagcacgaccacacgcctgcagagattgcggaaaagcatttagccagagctccaatctggcggagcatctgaagatccacgctggcgcgcggcctcatgcctgcccagattgtggaaaggccttcgtgcgcgtggccggcctgcgccaacatcgtagaactcatagcagtgaaaaaccttttccatgcgccgagtgtgggaaggcatttcgcgaaagctcccagctactccagcatcagcgaactcataccggcgaaaggcccttcgagtgtgcagaatgtggccaggcttttgtgatgggctcttatttagccgagcacaggcgagtgcatactggtgaaaaacctcacgcctgcgcccagtgcgggaaggcatttagccagagaagcaatctcctctctcatcgccgaacacactcaggcgctaagccttttgcttgcgcagattgtgggaaggcctttaggggatcaagtggtctggcccaccatcgacttagtcatactggtgagcggccttttgcttgcgcagagtgcggcaaggctttcaggggttcaagcgagctccggcagcatcagcgcttgcactctggggaacgtccattcgtgtgtgcccactgcagcaaagcctttgttagaaagtcggagctcctctctcatcggcgcacccatacgggtgagcgtccctacgcctgtggggaatgcggtaaaccattcagccaccgttgcaacctgaacgagcaccagaagagacacggggggcgagccgccccttag

SEQ ID NO: 14283 - DNA, 678 bp, Artificial Sequence
  Description of Artificial Sequence: Synthetic coding sequence
cactctggcgagaagccctatgcatgtcgcgagtgcgggaaggcctttagggcccattcccagctcatccatcatcaagagacgcactcaggtctcaaaccattccggtgccctgattgtggtaagagttttggaagatccactacattggtgcagcacaggaggacacataccggggaaaaaccctacgagtgcccggagtgcggcaaagcatttgtcagggtagccggactgcggcagcatagacgcacccactctagtgagaagccgttcccatgcgctgagtgtggcaaagcattccgcgaatctagccagctgctacaacaccaaagaacccacaccggcgagcggccattcgagtgcgctgaatgtggacaggcctttgtgatggggtcttacctggccgagcacaggagagtacatactggcgagaaacctcacgcctgtgcacaatgtgggaaagcattctcccaacgtagtaacctcctctcccaccgcagaacccacagcggagccaaaccattcgcttgcgctgactgtggcaaggcctttagaggcagcagcgggctcgcccaccacaggctgtctcatactggagagcgcccctttgcctgtgcggagtgtggcaaagcttttcggggctctagcgaactacgacaacatcaacgactgcattag

SEQ ID NO: 14284 - DNA, 1497 bp, Artificial Sequence
  Description of Artificial Sequence: Synthetic coding sequence
atggaatcaccgagaggttggaccctacaggtcgccccagaagagggacaagtgctgtgcaacgtcaagacagcaactaggggattgagtgagggcgcagtctctggaggctggggggcttgggaaaattctactgaagttccacgggaagcaggcgacggacaacgccaacaagccaccctcggggcagccgatgaacagggcggtccggggagggagctgggccctgctgatggagggagggacggtgcgggacctcgcagtgagcccgcagaccgtgctctgcgcccatctcccctgcccgaagagccgggctgccgctgcggcgagtgtgggaaggccttctcacagggctcctatctactgcagcacagacgcgtgcataccggggagaagccatatacatgccctgagtgcggtaaagctttcgcctggagctccaatctaagtcaacaccagagaatccacagcggcgagaagccttacgcttgtcgggaatgcgggaaagccttccgcgcccattcccagctgatccaccatcaggagacacattcgggtctcaagccgttccgctgccccgactgcggcaagagcttcgggaggagcactaccttagtccagcacaggcgaacacatacgggcgagaaaccttatgagtgtcccgagtgcggtaaggcgttttcctggaactccaacttcttggagcataggcgcgtccacacaggagcacggcctcatgcatgtagagattgtgggaaggctttctcacagagttctaacctggcggaacatttgaagatccatgccggcgctaggccacatgcttgtccggactgcggcaaagcgtttgtgagggttgctggtttgcggcagcatcgacgcacacactctagtgaaaaacctttcccttgcgctgaatgtggcaaggcctttagagagagcagccagctgctgcagcaccaacgcacccacactggagagagacccttcgagtgtgcagagtgcggacaagcattcgtcatggggtcctatctggcggaacacagacgtgtgcacactggggagaaaccacacgcgtgcgcccaatgtggtaaggctttcagtcaaagaagcaatctcctctcacaccggcggacgcactccggcgctaaaccatttgcatgcgccgattgtggcaaagcattccgcggtagttctggcctcgctcatcacagattatcgcacactggagaacgcccctttgcatgcgctgaatgtggaaaagcgttccgggggtcctcagagctcaggcaacaccagcggctgcacagcggagagagacctttcgtgtgcgcgcactgttccaaagcattcgtgagaaagtcggaactcttgagtcataggagaactcatactggcgaacggccgtacgcgtgtggcgaatgcggcaagcctttctcgcacagatgcaatctgaacgaacaccagaagagacacgggggtcgcgccgccccttag

SEQ ID NO: 14285 - DNA, 1419 bp, Artificial Sequence
  Description of Artificial Sequence: Synthetic coding sequence
atgctgaaggagcatccagagatggcggaagccccccagcagcaactcggcattcccgtggtcaaactggaaaaggaattgccctggggtcggggccgagaagacccatcccccgaaacattccgcctgcgatttaggcagtttcggtatcaggaggctgccggacctcaggaagccctaagagaactccaagaactgtgtagaagatggctaaggcctgaattacacacgaaggagcagattttagagctgctagttctcgagcagtttctaactatcttgccaagagaattttatgcctggatcagagagcacggaccagaaagcggaaaggccctggccgccatggtggaggatcttaccgaaagagccctcgaggcaaaagccgtcccatgtcacagacagggggagcaggaagagacagccttgtgtcgcggggcttgggagcctggcatacaactcggcccggtcgaagtgaagcccgagtgggggatgcctccaggagagggagtgcaaggacctgaccctggaaccgaggaacagttgtcacaggatcccggagacgaaacccgtgcctttcaggaacaaggagggggaagcaaggagaaggaggcaaagcccccccaggaagatctcaaaggcgctctcgtagccctgactagcgagagattcggcgaagctagcttacaaggaccaggactcggccgcgtgtgcgagcaagagcccggcgggcccgcgggtagtgcccccggcttgccccctccacagcacggtgccatcccactccctgatgaggtgaaaactcactcatcattctggaagcccttccagtgcccagagtgcggcaaaggtttttcgcgcagctccaacttggttcgtcaccaaagaactcacgaagagaagtcttatggttgtgtcgagtgcggcaaggggttcacactccgcgaatacctgatgaagcatcagagaacacacctcggtaaaaggccttatgtgtgtagcgagtgctggaaaacttttagccagcgacaccacctcgaagtacaccagaggtcccacactggggaaaagccctataaatgtggcgattgctggaagagtttctccagaaggcaacacctgcaggtgcaccgtcgcacacacactggagagaagccatatacttgtgaatgcggcaaatcattttccaggaacgccaacttagctgtgcatcgtcgcgcccacacaggagagaagccctacgggtgtcaggtctgtgggaaacgctttagtaagggggagcggttggttaggcatcagcgaatccacacaggggagaaaccctatcactgcccagcttgtggacggtccttcaaccagagaagcattttgaaccggcaccagaaaacccagcaccgtcaggagcctttggtgcaatag

SEQ ID NO: 14286 - DNA, 1635 bp, Artificial Sequence
  Description of Artificial Sequence: Synthetic coding sequence
atgctgaaagagcacccagaaatggcagaagctccccagcagcaattggggatccctgtggtgaagttagagaaagagctgccctgggggcgaggaagagaggatccctctcccgaaacatttcggctgaggtttcgacagtttagatatcaggaggccgccggccctcaggaggcccttagggagctacaggagttatgtcgccgttggttgcgtcctgagttacacacaaaagagcaaatactggagcttctggtgctggagcagtttttgaccatcttgcccagggaattctatgcctggatacgagagcatggcccggagtccgggaaggcactggcagccatggtagaagacctcacagagagggcactggaggcaaaagccgtgccttgtcacagacagggcgaacaggaagagaccgcactctgtaggggggcatgggaaccagggatccagctgggaccagttgaggtgaaaccggagtgggggatgccccctggggagggcgtccagggccccgatcccgggactgaagagcagctctcgcaggatccaggtgacgaaacccgggctttccaagaacaagctttgcccgtccttcaggcgggacctggacttccggccgtgaacccaagggaccaggaaatggccgccggcttctttacggccgggtcccagggcctcggtcctttcaaagacatggccctcgcctttcccgaagaggagtggagacacgtcacacccgctcagatcgactgcttcggggagtatgtcgagccccaagattgtcgggtgtcacctggggggggaagtaaagagaaggaagcgaaacccccccaggaggatctgaagggggctttggtcgccctgacctcagagcggtttggcgaggcctcactacaggggcctggtctggggcgcgtgtgcgaacaggagcctgggggaccagccggcagcgcccccggtctgccccccccacagcatggcgccattccattgcccgacgaggtcaaaacccattcttcattctggaaaccgtttcaatgcccggaatgtggaaaaggctttagtaggagcagcaatttagtgcgccatcaacgcacgcatgaagaaaagtcttacggatgcgtagaatgcgggaaggggttcaccctgagggaatacttaatgaagcaccagaggactcacctcgggaaacgaccctacgtctgttccgaatgttggaagacttttagtcagagacatcatctggaagtacaccagcgcagccatacaggagaaaagccgtataagtgtggcgactgttggaagtcctttagcagaagacagcacctccaagtccaccgccggacacataccggagagaagccatatacatgtgagtgtggtaaatcatttagtcgaaatgctaatctagcagtgcatcgaagagcacatacaggggaaaaaccgtacggctgtcaggtctgtgggaaacggttttcaaaaggtgaaaggctggtgagacaccagagaatccatacaggcgagaagccttaccactgccctgcctgtggcagatcatttaaccagcgctctatccttaaccgacatcagaaaactcagcacaggcaggaacccctggtccagtag

SEQ ID NO: 14287 - DNA, 1635 bp, Artificial Sequence
  Description of Artificial Sequence: Synthetic coding sequence
atgctgaaagagcaccctgagatggccgaggcaccgcaacaacagctgggcatcccagtcgtgaagctggaaaaggagctaccctggggacgcggccgcgaagatccctcgccagagaccttccgcctcaggttccgccagttccggtaccaggaagccgcgggtccccaggaagctttgagagaattgcaggaactgtgcaggcggtggctcaggccagaactgcataccaaagagcagatactcgaacttctcgtcctggaacagttcctgacaattctgccacgggagttttatgcctggattagggagcatggacccgagtccgggaaggccctggccgcaatggtggaagacttgaccgagcgggccctggaagcaaaggccgtgccctgccataggcagggggaacaggaggagacagcattatgtcggggggcatgggaacccggaatccagttgggtccagtggaagtcaagccggagtgggggatgccacctggcgagggtgtgcagggtcccgatcctgggaccgaggagcagttatcccaggatccaggggacgaaacacgcgcctttcaggagcaggccctgcccgtgctgcaggccggcccgggcctcccagcagtgaacccaagagatcaggaaatggccgccggcttcttcacagcaggcagccagggattgggcccgttcaaagatatggctctggccttccccgaagaggagtggagacacgttacgcccgctcagatcgactgcttcggcgaatacgtggaaccccaagactgtcgcgtttctcccggcggaggttctaaagagaaagaggctaaacccccgcaagaggatctcaagggcgccctggtggcgctgacaagcgagcggtttggtgaagcgagcctgcagggccctgggcttgggcgtgtatgcgagcaagaacctgggggacctgccgggagtgcacctgggttgccacccccccagcacggggccatcccactgcccgatgaagttaaaactcatagctctttttggaaaccctttcagtgtccagaatgcgggaagggcttctccagatcctccaatctggtgcgacaccagagaacccatgaggagaaatcttatggctgcgtggagtgtggcaaggggttcacactgcgggagtacctgatgaaacaccagcgtacccacctggggaagcggccttacgtgtgctccgagtgttggaaaactttcagtcagcggcatcacctggaagtgcaccagcgctcacataccggggagaaaccttacaagtgtggcgattgttggaagtccttcagcaggcggcagcatctgcaggtccaccgccgcacccacactggagagaaaccatacacatgtgaatgcgggaagagtttcagccgaaacgccaacctcgccgtgcatcgccgggcacacacaggggaaaagccctacggctgccaggtttgcgggaagagattttccaaaggggagagactggttcggcaccaaagaatccacacaggtgagaagccttaccactgccctgcttgcgggcggtcttttaaccaacgatcaatccttaaccgacaccagaaaacacagcataggcaggagccactggttcagtag

SEQ ID NO: 14288 - DNA, 213 bp, Artificial Sequence
  Description of Artificial Sequence: Synthetic coding sequence
atgctgaaggagcaccctgagatggccgaggctccacagcagcagctaggtatccccgttgtcaaacttgaaaaagagttgccctggggaaggggcagagaggacccgagtccagagacattccgactgcgtttccgacaattccggtatcaggaggcagccggtcctcaggaggccctgagagaactgcaggagctatgcaggcgctggtag

SEQ ID NO: 14289 - DNA, 5424 bp, Artificial Sequence
  Description of Artificial Sequence: Synthetic coding sequence
atggcaaaacctacttctaaagatagcggactgaaggagaagttcaaaatcctcctgggattgggcacgccgcgccctaatccacgtagcgccgaaggcaagcaaacagagttcatcatcaccgcggaaatcttgcgggagttgagcatggaatgcggccttaacaaccgtattaggatgatagggcagatttgtgaggtagcaaaaaccaagaagttcgaagagcacgccgtggaagctctgtggaaagccgtcgccgatttgctgcaaccagaacgacccctcgaggctagacacgctgttctcgctctgttgaaagctatcgttcaggggcagggcgaacggctcggggtgctaagagctctcttttttaaggtgataaaggattatccttcaaacgaagatctgcacgaaagactggaagtgttcaaggcacttactgataacggccgtcacattacatatctggaagaagagttggccgattttgtgctgcagtggatggatgttggactgtcaagcgaattcttactggtcctcgttaatcttgtgaagtttaactcatgttatctggatgagtatattgcgcgaatggtccagatgatatgcctgctgtgtgtgaggaccgcaagcagtgtcgatatcgaggtgtcattgcaggtgctcgacgcagtggtctgttataactgtctgcccgctgagtcactcccactgtttatcgtgacactctgcagaaccatcaatgttaaagagctctgtgagccatgctggaaactgatgcgcaaccttttggggacacatctgggacatagtgctatctacaatatgtgtcatctgatggaggaccgggcctatatggaagacgcccccctactgcgcggtgctgttttctttgtgggaatggccctctggggagcccatagactgtacagcttaaggaattcccccactagtgtcctgccctccttctatcaggccatggcttgccccaatgaagtggtttcttacgagatcgtgctgtctatcaccaggttgatcaagaagtacaggaaagaacttcaagttgtcgcatgggatatcttactcaatattatcgagaggttactccagcagctgcaaactctggacagtccagaactccgaaccattgtccacgacttactgacaacggtggaggagctctgcgatcaaaacgagtttcatggcagccaggaacggtattttgaattggtggaaagatgcgctgatcaaagacctgaaagttcattgcttaacctcatcagttatagagcccagagcatccatcccgcaaaggatggttggatacagaatctgcaggctctgatggaaagattctttagatccgagtcacgaggcgccgtaaggatcaaggtgctcgacgttctgagtttcgtcctgctgattaatcgacagttctatgaggaagagctgataaattcagtcgtcatctcccagctgtctcacatcccggaggataaggaccatcaggtgcgaaaactggctactcaactactggttgacctcgcagaaggttgccatacccatcacttcaatagccttctggacattatcgagaaggttatggccagatctctatcgccaccacccgagttagaagaaagggatgtggccgcctacagcgcaagtctcgaagacgtgaaaaccgctgtgctggggttattggtgatcctgcagacgaagctctacaccttgccagcatctcacgctaccagagtctatgagatgctggtctcacacatccagctacactataagcacagctataccctacccatcgctagctccattcgtcttcaagccttcgatttcctgctgttattgcgcgcagatagtttgcaccgactcggcctgcccaacaaagacggcgtcgtgaggttttctccctactgcgtgtgcgattatatggaaccagaaagaggtagcgaaaaaaaaactagcggtcccttatctcctccgaccgggcctcccggccctgcccccgccgggcccgctgtgagattgggtagtgtcccgtactcccttctcttccgagtgctgctgcagtgcctcaagcaggaatctgactggaaggtgcttaagttggtcctcggtcggctgcctgagagcctaagatacaaggtcttgatattcacatccccctgcagcgtcgaccaattatgtagcgctctctgttcaatgctgtcgggtcccaaaacgctagaacgcctgcgcggagccccagaagggttcagccggaccgaccttcatctggccgtggtgccagtgttgactgccttgattagctaccacaattatttggataagaccaaacaacgagaaatggtgtactgcctcgaacagggactcatccacaggtgcgcttcccagtgcgttgtcgcactgtccatatgctctgtggagatgccagacattatcatcaaggcactacccgtgttagtcgttaaactcacacacatttcagccaccgcgtctatggctgtccctctcctggagtttctaagtacactagcaagactgccccacctttaccggaacttcgctgccgaacagtatgcatcagtgtttgccataagcctaccttacaccaatccaagcaagttcaaccagtatatagtttgcctcgcccatcacgtcattgctatgtggttcataagatgcaggttgccttttcgcaaggattttgttccctttataaccaagggcctgagaagtaacgtcctcctttcttttgacgacacacccgagaaagatagctttcgggcccggagcacaagcttgaacgagagacccaagtctctgagaatcgctcgcccgcctaaacaaggcctgaataatagccctcccgtgaaagagttcaaagagagctctgcagccgaggccttccgctgcagaagtataagtgtatctgaacatgttgttagaagcaggatacagacttccttgacatctgcatccctggggtcagcagacgaaaatagtgtggcccaggctgatgacagcttaaagaatctgcatctggagttaacagagacttgtctcgacatgatggcccggtatgtgttctcaaacttcaccgcagtccccaagcgctctcccgtgggagagtttctgctggccgggggcaggaccaagacctggcttgtgggaaataagctggtgaccgttaccacaagcgtaggaaccggtactcgcagcctactcgggctggattccggagagttgcagagtgggccagagtcatccagctcaccaggagtgcacgtgcgacaaaccaaagaagccccagccaaactcgagtctcaggcgggacagcaggttagccgcggcgcccgggacagagttaggtccatgagtggaggtcacggcctccgtgtcggtgctctggatgttccagctagccagtttttaggctcggccacgagccccggaccaagaacagcgcctgccgccaagccagagaaagcgagcgccgggactcgtgttccagtccaggaaaaaacgaatcttgccgcatatgttccactccttactcagggatgggccgaaattctggttaggcggcctacaggcaacactagctggctgatgtcattagagaatccccttagtccatttagcagtgatatcaataacatgccattgcaggagctcagcaatgccctgatggccgcggaaaggtttaaagaacaccgtgatactgccctctacaagagccttagtgtgcccgccgcctctaccgctaagccccccccactgcctagatctaataccgtggcctcattttcctccctctaccaatccagctgccagggacagctccatcgctctgtgagctgggccgactccgccgtggtcatggaggagggtagtcccggcgaggtgcccgtactggttgaacctcccggactagaagatgtggaagcagccctgggtatggaccggaggacagacgcttattcacgcagcagcagcgtgagctcacaagaggagaaatccctacatgccgaagagttggtgggtagaggcattccaattgaaagggtagtgtcctctgagggcggcagaccctcagtcgacctatcctttcagccctctcagccactttctaagtcctccagttctcctgagctgcagaccctccaggatattttgggcgatccaggagacaaagccgacgtcggcagactctcacccgaagtcaaggcacgctctcaatccggcacactagatggcgagtccgcagcctggtctgcgtctggcgaagatagccgtggccagccagaagggcctctcccatcaagctcaccacggtccccatccggcctgagacccagagggtacacaatctccgactcagcaccttccagacgaggcaaaagagtggagcgcgatgcgctgaagagtcgagcgaccgcctcgaatgcggaaaaagtgcctggaattaatcctagcttcgtttttctgcagctctaccacagtccattctttggggatgagtcgaataagccgattcttctccccaacgagtctcaaagctttgagcgctcagttcaacttctagatcagattccttcttacgacacccataagattgccgtcttatatgtgggggagggacagtcaaacagcgaactggccatcctcagcaacgaacacggcagctatcgctatactgaattccttaccggcctgggaagacttatcgaactaaaagattgccagccggataaggtctatctcggcggacttgacgtttgcggcgaggatggacaatttacgtactgttggcatgacgacattatgcaggcagtgtttcatatagctaccttgatgcccaccaaagacgtggacaagcaccggtgcgacaagaaacgtcacctgggaaacgacttcgtttctatcgtttataatgattctggggaggatttcaagctcggcactattaaagggcagtttaatttcgtccacgtcatcgttacacctctagattatgagtgcaatctggttagcctccagtgcagaaaagatatggagggactagtagatacttcagtggcaaaaatcgtttcagatcggaatctgccgttcgttgccaggcaaatggccctacacgccaacatggccagtcaggtgcaccactcacgttccaaccctactgacatctatcctagcaaatggatagctaggctgaggcatatcaaacgtctccgccagaggatctgtgaggaagccgcatatagtaatcctagcttgcccctggtgcaccctccatcccacagcaaggctcctgcccagaccccggctgaacctactcccggctacgaggttggccagcggaagaggctgataagttccgtagaagacttcacagaatttgtgtag

SEQ ID NO: 14290 - DNA, 1326 bp, Artificial Sequence
  Description of Artificial Sequence: Synthetic coding sequence
atggccaccgttccaggattgcagccactccctaccctcgagcaggacctggagcaggaggaaattctgatcgttaaggtggaggaagatttctgcttggaggaggaaccatccgtcgaaacagaggatcctagccccgaaacattcagacagttattcaggttgttctgttatcaagaggtggctggacccagggaagccttgagccggttgtgggagttgtgctgtagatggctccggccagagctgaggactaaggaacagattctggagctgctggtgttagagcagttcttgacagtcctgcccggcgagatccaggcccgggtgcgcgaacagcagccggaatctggagaagaggccgtggttctcgtggagggcctgcaaagaaaaccacgcaaacaccggcaaaggggtagtgagctgctgtcggatgacgaagtcccccttggtattggggggcagtttcttaaacatcaggccgaggctcagccggaagatttgagtttagaggaggaggcacgcttctccagtcagcagccccccgcccagctgtcccataggcctcagcggggaccccttctgtggccagaaagagggccccctgcccctcggcaccaggagatggcatccgccagtcccttcctgtccgcgtggtcgcaagtccccgtgaacctggaagacgttgccgtctatctgagtggcgaagagcccagatgcatggaccccgctcagcgcgatgctcctttggagaacgaagggcctggaatacagctggaggacgggggagacggaagagaggacgcgccactcaggatggagtggtaccgtgttctgtccgctcggtgtcaggggcctgggcaccctttaccaggccaaagacctgctccggtgcgaggtctggttcggccagatcagcctaggggcggtcctccacctggccggcgtgccagccacggtgcagataaaccctacacctgccccgagtgtggcaagggattctcaaaaacgagtcatctcacaaaacatcaacgaacccatactggcgaaagaccctataaatgtcttgtttgcggaaaagggttctccgaccgaagcaatttctcgacccaccagcgtgtgcacactggcgaaaagccctacccctgtccggagtgcggaaagcgtttcagtcaaagcagctcattagtgatacaccgacgcactcacagcggtgagaggccttacgcctgtactcagtgtggcaagaggtttaataacagttcacacttctccgctcacaggcggacccataccggccacattctgcgtagcgggtgtacttag

SEQ ID NO: 14291 - DNA, 648 bp, Artificial Sequence
  Description of Artificial Sequence: Synthetic coding sequence
atgaattcttcacaaatttccctcaggatgaagcatggaagggtcaatatgcagaaaaagccttcaaagtgctcggaatgcggcaagtttttcacccaacgcagtagtttgacgcagcatcagaggatccaccgcggtgaaaaaccctacgtttgttcagagtgcggtagttgcttccggaagcaatcgaacctgacacaacacctgaggattcacacaggcgaaaaaccgtacaaatgcaacgaatgcgaaaaggcctttcagaccaaggccatcctggtgcagcatctacgcatccacacaggggaaaaaccgtataagtgcaacgagtgcggaaaggccttctgtcagagtccttcactgataaagcaccagaggatacacacaggggagaaaccctatacctgcacagagtgtggaaaagcattcacacagaacagcagtctggtggagcatgagcgtacccatactggagagaagctttacaagtgctcggaatgtgagaaaacattcagaaaacaggctcatctaagcgaacactaccgtatccataccggagagaaaccgtacgagtgtgttggctgtggaaagtcttttcggcactcctctgccctgctgaggcaccaaaggttgcacgccggagagtag

SEQ ID NO: 14292 - DNA, 816 bp, Artificial Sequence
  Description of Artificial Sequence: Synthetic coding sequence
atgaattccagccagatcagccttcgaatgaagcacggcagggttaatatgcaaaagaagccaagtaaatgtagcgagtgcgggaagttcttcactcaacggtcttccctaactcagcaccaacgcatccaccgcggggagaagccatacgtttgcagcgaatgtggctcgtgctttaggaagcagagcaatttgacacagcacttaaggattcatacaggtgagaagccttacaagtgcaatgagtgcgagaaggcgttccagactaaggccattttggtccagcacctgaggattcacacaggagagaaaccatataagtgcaatgagtgtgggaaggccttttgtcagagcccatcacttataaagcaccagcgaattcacacaggtgagaagccatataagtgtacagagtgtgggaaagcttttagccagtctatctgtctgactcgccatcagagatcccattctggggataagccattcaagtgtaacgaatgtggtaaggctttcaatcagagtgcctgtctgatgcagcatcagcgcatccattcaggggagaaaccatatacctgcactgagtgcgggaaagctttcacccagaatagctccctagtcgagcacgagcgcacacatacaggggaaaaactctacaagtgctcggaatgtgagaagaccttccgaaagcaggcccacctctctgagcactacaggattcatactggggagaagccatatgaatgcgtaggctgtggcaaaagtttccggcatagttccgccttgcttaggcatcaacgattacatgctggcgaatag

SEQ ID NO: 14293 - DNA, 1635 bp, Artificial Sequence
  Description of Artificial Sequence: Synthetic coding sequence
atgttaaatatgcaaggggcagaggagagagatattaggcgcgagacgtgtcccggctgggtgaacaagaacaagcccgctttggaacaggacgtgtgtaaaatcgattcctctggaatcgttgttaaacgctttcaggaggacgaatatcaagatagcacctttgaagagaaatatgcatgtgaaggtatgaaagagaactctccgcgcgaaattgcggaatcctgtcttttccaggagggagggtttggacgcattacttttattcataaagaggcccctcctgagattatctcccaaggctacaattttgaaaaaagcctgctcttaacatctagcctcgtaaccagactgagagttagtaccgaagaatccctgcaccagtgggagacttccaatattcagacaaacgacattagcgaccaatcaaagtgcccaactttatgtactcagaagaagtcctggaaatgtaatgagtgcggaaaaacattcactcagagttcttcccttacccagcatcagcgtacccataccggcgagcggccatatacttgtgaggaatgcgggaaggccttcagtaggagctcatttctggtgcaacaccagagaatacacacaggcgtaaagccttacgggtgtgagcagtgcggaaaaacttttcggtgcaggagtttcctgacccagcaccagcgaattcacacgggcgaaaagccctataaatgtaatgaatgcgggaattctttcagaaaccatagtcacttaaccgaacatcagcgcatccacactggcgagaaaccctacaagtgtaatcgctgtggtaaggccttcaaccaaaacacccatctcatccatcaccagcggatccatactggagagaagccgtatatttgttccgaatgtggatcatccttccgtaaacactcgaatctcacacagcatcagcggatacacaccggagagaaacctcacaaatgcgacgagtgcgggaaaaccttccagacgaaagcaaatctaagccaacaccaacgcatccacagtggggaaaagccctataaatgtaaagagtgcggcaaagccttttgccagtctccctccctcatcaagcatcagcgtatccacaccggggagaaaccttataaatgcaaggagtgtggaaaggccttcacacagagtacccctctaaccaaacaccagcgcatccataccggagaaaggccttataagtgtagcgagtgtgggaaagcattcatccaatccatttgtcttatccggcaccagcgcagtcatacaggagaaaaaccctacaagtgtaatgagtgcggaaaggggtttaatcaaaacacttgcctaacacagcacatgcgtatccatacgggagagaagccatacaaatgtaaagagtgcggtaaggcctttgcccactcaagcagcttgaccgagcatcacagaacccacaccggggagaaactgtacaagtgtagcgagtgtgagaagactttcaggaaatacgctcatctaagcgagcattataggattcatactggagagaagccgtatgagtgcattgagtgtggaaaattctttcgacattctagcgtgctgtttcgccatcagaagttgcactcaggcgactag

SEQ ID NO: 14294 - DNA, 468 bp, Artificial Sequence
  Description of Artificial Sequence: Synthetic coding sequence
atgctgaacatgcaaggcgctgaggagagagatatccggagagagacttgtcccgggtgggtgaacaagaataagcctgcactcgagcaggacgtgtgtaagattgattcatcagggattgtggttaagagatttcaggaggatgagtatcaggattccacttttgaggaaaaatacgcatgtgagggcatgaaggagaacagtccacgggaaattgcagagagctgtctgttccaagagggcggttttggccgcatcactttcatccacaaagaagcacccccagagattatcagccaagggtataatttcgaaaaatcactgctgctgacttcatctttggtgaccagactgagagtttctacagaggagagcctgcatcagtgggagacatcaaatatccagactaacgatatctccgatcagagcaaatgtcctaccctctgcacacagaagaagtcctggtag

SEQ ID NO: 14295 - DNA, 1362 bp, Artificial Sequence
  Description of Artificial Sequence: Synthetic coding sequence
atgctaaacatgcagggcgcagaggagcgagacatcagacgggagacctgcccaggatgggttaataagaataagcccgccctggaacaggacgtgtgtaaaatcgattcctccgggattgtagttaagcgattccaggaagacgagtaccaggactctactttcgaagagaaatatgcttgcgagggtatgaaagaaaatagcccgcgggagattgcggagtcttgtctctttcaggaaggtgggtttggccgtatcaccttcatccacaaagaagcaccccctgaaataatctcccaaggctacaatttcgagaaatctctcctgttgacatcatctctagttacacgcttgcgcgttagcacggaggagtcgttgcaccagtgggagactagcaacatacaaacgaacgatatctctgaccagagtaaatgtccaacactctgtacccagaaaaaatcctggaagtgcaatgaatgcggcaagactttcacacaaagcagttccctcacccagcatcagcgaacccatactggggaacgcccctacacttgtgaggaatgcggcaaggccttttcacgatcgtccttcctcgttcagcaccagcgaatccacacaggagtgaaaccatacggctgcgagcagtgtggcaaacacttcgacgtagatcatttcctgctgagcatcaaggagttcaccctcgagaggaatctgatcaacgcaatgaacgtcggcatcccctctgctatcacccacattagcttaaatacaagggagtttacactggagagaaacctaataaacgcaattggcgtggggagacatagcattcgcatccatactttgttcatcattcgcgaatttaccctagtccgatctttgacctacgctgtcaacgtcgcgttgctatttgaaaatacccagattcttcgaaacatccgggaattcacactaggcaaaaaccctataaacgttacgaacgtcggaaaactgtcaaagcagcggcagactagcctttccatccgggaattcatcgtggagagaaatccgataaatgtgaaaaatgtggccaagcccttcgtgcgagcccatttattactaaacacaagcgagttcattctggagaagaatcatatctctgtgaagaacgtcgctaaacgacttcttcgggcaccccacagcctcaacattagagagtatatccaaggacgcgacccaaccaacgccgtgaacgtagttaagccttcttttcgcgcttttgccttgtttggcacccgtgaagttacactggagaaaaacccaatcaatgccatgaatgtggagcgggctctgatcagaacacccgcgtccctgtcgatctag

SEQ ID NO: 14296 - DNA, 1635 bp, Artificial Sequence
  Description of Artificial Sequence: Synthetic coding sequence
atgctgaacatgcaaggtgctgaagagcgcgacatccggagagaaacttgtcctggatgggttaataaaaataagccggctctggagcaggacgtgtgtaagatagattcatctggaatcgtggttaagcgatttcaggaggatgagtaccaggattcgaccttcgaggagaagtacgcttgcgagggcatgaaagagaattcccctagagagattgctgagagttgccttttccaggaaggcggcttcgggcgaattacattcattcacaaggaagctccacccgaaattatcagccagggctataatttcgagaaatccttgttgctcacctcctccctggtgactaggctgcgggtgtctaccgaagagagtctccaccagtgggagacatcaaatattcagaccaacgacatatcagaccaatctaagtgccctaccctgtgcacccagaagaagagttggaagtgcaatgaatgtggaaagacattcacacagtctagctcgctaacacagcatcaacggacacatacaggtgaacggccctatacatgcgaggagtgcgggaaagccttttcccggtccagcttcctggtccaacaccaaagaatccacactggcgtgaagccgtacgggtgcgaacagtgtgggaaaactttcagatgtcgttctttcctcacccagcaccagcggattcacactggggaaaaaccttacaagtgtaatgagtgcgggaacagctttcggaaccacagccatttgaccgaacaccagcgtattcataccggagagaaaccatataaatgcaaccgctgcggcaaagcctttaaccagaacacccatttaatacaccatcagcggatccacaccggagagaagccctatatctgttcagagtgcggttcatcctttaggaagcatagcaacttaacccagcaccagaggattcacactggggaaaagccacacaaatgtgacgaatgcggtaaaacatttcaaacaaaagctaacctgagccagcaccagagaattcacagtggcgaaaagccctacaaatgtaaagaatgtgggaaagcattctgtcaatctccctccctgataaagcatcagaggattcataccggcgagaagccctacaagtgcaaagaatgtgggaaagcttttacgcagagcaccccactgaccaagcaccagaggattcataccggtgagcgcccatataagtgcagcgaatgcggaaaggctttcattcaatccatctgtctgatcagacaccaacgttcacacactggagaaaaaccctacaagtgtaacgaatgtggaaaagggttcaaccagaacacctgtttaacacagcacatgagaatccatacgggcgaaaaaccttacaaatgtaaagaatgtggaaaagcctttgcccatagctcaagcctcactgagcaccataggacccacaccggtgagaagctatataagtgctccgaatgcgagaaaacctttcggaagtatgcccatctcagtgaacattatagaatccacacaggagagaaaccctacgagtgtattgagtgcgggaagttctttagacattccagcgtgctttttaggcaccagaagctgcattctggagactag

SEQ ID NO: 14297 - DNA, 1635 bp, Artificial Sequence
  Description of Artificial Sequence: Synthetic coding sequence
atgctcaacatgcagggtgccgaagagagggacatacgtcgagaaacttgcccaggttgggtgaacaaaaacaagcccgcactcgaacaagatgtttgcaaaatagacagcagtggcatcgtcgtgaaaaggttccaagaggacgagtaccaggacagcactttcgaggaaaaatacgcttgcgaggggatgaaggagaactcaccaagggaaatcgcagagagctgtctctttcaagaaggcgggtttggacggattactttcatccacaaggaagctcctcccgagattattagccaggggtataactttgagaagtctcttctgcttactagctcacttgtgactaggctgcgggtcagtactgaagagagtcttcaccagtgggaaacatccaatattcagacgaatgatatttcagaccaaagcaagtgtcctacgctctgtacccagaaaaaaagttggaagtgcaacgagtgtggtaagacctttacacagtccagcagccttactcagcatcagcgcacccacaccggcgagaggccgtacacatgcgaagaatgtggcaaggctttcagccgctcaagtttccttgtgcagcatcagaggattcataccggggttaaaccatacggctgcgaacagtgcggaaaaacatttaggtgtcgcagcttcctgacccagcatcagagaattcacacaggggagaaaccatataagtgcaatgaatgtgggaattctttccgcaaccattcacatctgaccgagcatcaacgaattcatacaggtgagaaaccttacaaatgtaaccgttgtggaaaggcctttaatcaaaatacccaccttatacaccatcagagaatccacaccggggagaaaccttatatctgctctgaatgtggctcttctttcagaaagcactctaacctgacccagcaccagcgaatacacaccggggaaaaacctcataaatgtgacgagtgcgggaagacctttcagacaaaggccaacctctcgcagcaccagaggattcattctggggaaaaaccctacaaatgtaaggaatgcgggaaggcattctgtcagtctccttcgctgataaaacaccagcggatccacaccggagaaaaaccttacaaatgtaaggagtgtggaaaagcctttactcaatctaccccccttacaaagcaccagagaatccacacaggcgagaggccatacaaatgcagcgaatgcggaaaagccttcattcagtctatttgtctcatccgtcatcagcggtcccatacgggcgagaagccctataaatgcaacgagtgtggaaaggggtttaatcaaaatacatgcctcacccagcatatgaggatacatactggcgaaaagccatacaagtgcaaagaatgcggcaaagcctttgcccacagctcctctctcaccgagcaccaccggactcacacaggagaaaaactgtacaagtgttctgaatgtgaaaaaacatttcgcaagtacgcccatctgtcagaacactaccgcattcataccggggaaaaaccttatgaatgcattgagtgtggaaaattctttcgacatagtagtgtcctcttcagacatcagaagcttcactccggagactag

SEQ ID NO: 14298 - DNA, 1335 bp, Artificial Sequence
  Description of Artificial Sequence: Synthetic coding sequence
atgggcccactccagttccgagacgtcgctatcgaattctcattggaagaatggcattgcttggacgctgcacagaggaatttatacagagatgtgatgctggaaaattacaggaacttgatctttttagggatcgtagtcagcaagccaaatttaatcacctgcctggaacagggtaagaagcccctgaccatgaaacggcatgagatgatcgctaaacctccagttatgtatagccattttgcacaggacttgtggtctgaacagtctatcaaagattccttccagaaggtgatcctccggaggtacgagaagtgccgccacgataatcttcagctgaaaaaaggctgcgagtctgttgacgagtgcccagtgcacaagcgtggttacaatgggctgaagcaatgtctggcaacaactcagcgaaaaattttccagtgtgatgaatatgtcaaatttttgcacaaattcagtaactccaacaagcacaagattagggacactggaaagaagtcattcaaatgtatcgagtacggtaaaacgtttaaccaatcttcaaccaggaccacttacaagaaaatcgacgctggagagaaaaggtacaagtgtgaagaatgcgggaaggcatacaaacagtccagtcatctcactacgcacaagaagatccatacaggcgaaaagccctataagtgcgaggagtgcgggaaagcatataagcagtcctgcaacttaactacccacaagattattcacacgggagaaaagccttaccgttgccgagaatgtggcaaagctttcaatcaccccgccacgctgttcagtcataaaaagattcacactggggagaagccttacaagtgcgacaagtgtggcaaggccttcatttctagttcgaccctgactaagcacgagattattcacactggtgaaaaaccctataaatgtgaagaatgcggaaaggcctttaatagaagcagcaatctgacaaagcataagaggatccacacgggcgatgtgccttataaatgtgacgaatgcgggaagacctttacttggtattccagcctcagcaagcataaacgcgcgcacactggagagaaaccttacaagtgcgaggagtgtggaaaggcttttaccgcctttagtacactgaccgagcacaaaattatacacactggggagaaaccatacaaatgcgaggagtgtggtaaggcgttcaattggtccagcgccctcaataaacataaaaagatccacattagacagaagccatgcatagtaaaaaacgtggagaatctcttgaatgtcccacaaccactcatcagtatcaggtag

SEQ ID NO: 14299 - DNA, 1239 bp, Artificial Sequence
  Description of Artificial Sequence: Synthetic coding sequence
atggggcctttgcaattccgagatgtggctattgagttctcacttgaggagtggcattgcctggacgcagctcaacgaaacctgtatagagatgttatgctcgagaattatcggaacctgatcttcctcgtaatgtacagccacttcgcccaagacctttggtccgaacagtctatcaaggactcattccaaaaggtaatccttaggcgttacgaaaagtgccggcatgataatctccagctgaagaaaggctgcgagtcggtggacgaatgccccgttcacaaacgggggtacaatggcctgaagcagtgtttggctaccactcaacggaagattttccagtgcgatgagtacgtaaagtttctgcataagttctccaacagtaacaagcacaaaattcgcgacactggcaagaaatccttcaagtgtatcgagtatggaaaaacatttaaccagtcaagcacccggaccacctataaaaagatagatgctggcgaaaaacgctacaaatgcgaggaatgcgggaaagcatacaaacaatcatcccacctgacaacacacaaaaaaattcatacgggggagaaaccctataagtgcgaggaatgcggcaaagcgtacaaacagtcatgtaacctgactacccataagattattcacaccggagagaaaccttacagatgccgggagtgcggcaaagcattcaaccatcccgccacattgttttcacacaaaaaaatacacacaggggagaagccttacaaatgtgacaaatgcggaaaagcattcatttcctctagtactctgactaaacatgagatcattcatactggcgaaaagccttataaatgcgaagaatgcggcaaagccttcaatcgctcgagcaatctcacaaaacacaaacggatccacaccggggacgtgccgtataaatgcgacgaatgcggcaaaaccttcacctggtattcctccttgtctaaacataaacgggcccacacaggcgagaaaccatacaagtgcgaggagtgcggaaaagctttcaccgccttttccacgttgacagagcacaaaatcatacacacaggcgagaaaccttataagtgcgaggagtgtgggaaagctttcaactggagcagcgccctgaataagcataagaagattcacattagacagaagccatgtattgttaagaatgtcgagaatctgctcaacgttccacaacccctgataagtatacgttag

SEQ ID NO: 14300 - DNA, 1335 bp, Artificial Sequence
  Description of Artificial Sequence: Synthetic coding sequence
atgggccccctgcagtttcgcgatgtggcaatcgaattctctcttgaagaatggcactgcctggatgctgcacagcgcaatctgtatcgcgatgtgatgctggagaactatagaaacctgatctttttgggcatcgtggtttctaagccgaatctcatcacttgcttggagcaggggaaaaaacctttgaccatgaagagacatgagatgattgctaagccacctgttatgtatagtcactttgctcaagacctgtggagtgagcagagtattaaagattctttccagaaagtgatcttacggcgatacgagaaatgtcgccacgacaatcttcagctgaaaaaaggctgcgagtcagtggacgagtgcccagtacacaaaagaggctataacggtctgaaacagtgcctcgccactacacaaagaaaaattttccaatgtgacgaatatgttaagttcctccataaattttctaattccaacaagcacaaaattcgtgataccgggaaaaagagttttaaatgtattgagtacggcaaaaccttcaaccagagtagtactaggactacctacaagaagattgatgcaggcgagaaacgctataaatgcgaagaatgtggaaaggcttataaacaaagcagccatctgacgacccataagaaaattcacacaggtgagaagccctataaatgtgaagagtgtggcaaggcttacaagcagtcctgcaacctcaccacacacaaaattattcacacgggcgaaaagccgtataggtgtcgcgaatgcgggaaagcattcaaccatccggcgaccctgtttagtcataagaagattcatacaggggagaagccctataaatgcgacaagtgcggcaaagcattcatttcctcatccacgcttaccaagcacgaaatcattcacaccggggagaaaccctacaagtgtgaggagtgtggtaaggcatttaataggtccagtaacctcacgaaacacaagcgcattcatactggagatgtgccctacaagtgtgacgaatgcggtaaaacattcacatggtatagcagcctgagcaagcacaagagagcccatactggggaaaaaccctataagtgtgaagagtgtggaaaagcctttacagcattcagcaccttaaccgagcacaaaatcatccacactggcgaaaaaccgtataagtgtgaggaatgtggcaaggcgttcaactggtcttccgcactgaacaagcacaaaaaaattcacataaggcagaagccatgcattgtcaagaacgtcgagaatttgctcaacgtcccccagcccctgatctctattcggtag

SEQ ID NO: 14301 - DNA, 237 bp, Artificial Sequence
  Description of Artificial Sequence: Synthetic coding sequence
atgggacccctgcagttcagagatgtcgcaattgagttcagccttgaggagtggcattgtctagatgcagcccaacgaaacctctaccgagacgtgatgctggaaaattaccggaatctcatcttcttgggaatagtggtgtctaagcccaacttgatcacctgcctggagcaagggaaaaaacccctcacgatgaagaggcatgaaatgatagctaaaccacctggggggttatag

SEQ ID NO: 14302 - DNA, 2862 bp, Artificial Sequence
  Description of Artificial Sequence: Synthetic coding sequence
atggaggagtcctcctcagtggcaatgctggtacctgatattggcgaacaggaggccattctcacggccgaatccatcattagtccaagcctggaaattgacgagcaaagaaagactaagccagatcccttgatacatgtcatccagaagcttagtaaaattgttgaaaacgagaagtcccagaaatgccttcttattggaaagaagaggccccgcagttccgcagcaacacattctctcgaaacgcaggaactctgtgagattcccgccaaagtcatccagtcccctgccgcggacacccgacgggctgaaatgtcccaaacaaactttactcctgacaccttggcccaaaatgaagggaaggcaatgtcctaccagtgtagcctctgtaagttcctgtccagttcattttccgttctcaaagatcacataaaacagcacggacagcagaacgaagtgattttaatgtgcagcgagtgtcacataacgtcccggtctcaggaggagctcgaagcacacgtggtgaatgatcatgacaatgacgcgaatatccacactcaatccaaagctcagcagtgcgtgtccccatcctcctcactgtgtagaaagacaactgagagaaatgaaacaatccctgatatccccgtgtccgtcgataatttgcaaactcataccgtgcaaacagcttcagttgcagagatgggacggaggaagtggtacgcttacgagcagtatggaatgtacaggtgtctgttctgcagctacacttgcggacaacagcgcatgctgaagacacacgcttggaaacacgcaggagaagtggactgctcctacccaatatttgaaaatgagaacgagccccttggacttttggattcttccgccgccgccgccccggggggggtcgacgccgtggtgattgccattggcgagagcgagctgtctattcacaacggtcctagtgtgcaagtacagatctgctcctccgagcagctgtcaagttccagccccctggagcagagtgcggagcggggcgtgcacctgtctcaaagtgttactctggaccctaacgaagaggaaatgttggaagtgatatctgacgctgaagagaacctcattcccgactccttactgacctctgcgcaaaagataatttcttcttcgcctaacaaaaagggccacgtgaacgtcattgttgagcgattgcccagtgcagaggagacgctcagccaaaaacggtttttgatgaacacagagatggaggaagggaaagatctgtcactcacagaagctcagataggccgggaaggaatggatgacgtgtaccgagccgataaatgtaccgtggatataggggggctcataatcggctggtcctcgtccgagaagaaggatgagctcatgaataagggactggcaaccgacgaaaacgcccctcctggacgacgaaggacaaacagtgagagtcttcggttacattccttagccgcagaagctctagtcacgatgccgatccgtgcggctgagctcacgagagcaaacctggggcactatggtgacattaacctcctggaccctgacacctctcagcgccaggttgacagtactctagctgcttattctaagatgatgtcgcctctcaagaactcttctgatggccttacatctctcaatcagagcaactctactttggtcgccctccccgagggcaggcaggagttatccgatggacaggtcaagactggtatcagcatgtctcttcttacagtgatagagaaattacgcgaacggacggaccagaatgccagcgatgatgacatactgaaggagttgcaggataacgcccagtgccaaccaaattccgatacctctctgtctggtaataatgttgtagaatacatcccaaacgccgagaggccatacaggtgccggctgtgtcactacaccagcggtaataaggggtatatcaagcagcatctgcgagtacaccgccagaggcagccttaccaatgtcccatttgtgaacacattgccgacaactctaaggacctagaaagtcacatgattcaccattgcaagacccgcatctaccagtgtaagcaatgtgaagaaagcttccactataaatctcaactgcgcaaccatgaacgagagcaacactccttgcctgacaccctgtctattgcaacaagcaatgagccgaggataagtagtgacactgccgatggaaaatgtgttcaggaaggaaacaagtccagcgtgcagaagcagtaccggtgcgatgtctgcgactatacgagtaccacgtacgtaggcgtccgcaatcaccgacgcatccacaatagcgacaaaccgtatagatgctcgctgtgcggctacgtgtgctctcacccccccagccttaagtctcatatgtggaagcacgctagcgatcagaattacaattacgaacaagttaataaggcaatcaacgatgccatttcccagtctggaagagtcctcggcaagtctcccggcaagacccagctgaagtcatcagaggaatccgctgacccggtgaccggatcctctgaaaatgctgttagctccagcgaactgatgtctcaaacgccatcagaagtgctggggaccaacgagaatgaaaagctgagccccacaagtaacacttcttattccctggaaaagattagcagtctggctcctccttccatggagtactgcgtgctgctcttttgctgctgtatttgcggctttgaatcaaccagtaaggaaaatctgctggaccacatgaaagagcacgagggagagatagtgaacattattcttaacaaagaccataatactgccctgaacactaactag

SEQ ID NO: 14303 - DNA, 2862 bp, Artificial Sequence
  Description of Artificial Sequence: Synthetic coding sequence
atggaagaatccagttcagtcgccatgcttgtgcccgatattggcgaacaggaggcaattctcacagctgagagcatcatttcccccagtctggaaatcgatgagcagcgaaagaccaagcccgatcctctgatccacgtgattcagaagttaagtaagattgttgagaatgagaaatcgcaaaaatgtttgttgatcgggaaaaagcgcccccgctcttccgctgccacacatagcctcgaaactcaggagctgtgcgaaattccagctaaagtgatccagtcacctgccgccgacacacggagggcagaaatgtcccagacaaactttacaccagacaccttagcccagaatgaggggaaggctatgagctaccagtgctccctctgcaagttcctgtcctctagcttttcggtgctgaaggatcatattaaacagcacggacaacagaacgaggttattctcatgtgtagtgagtgccacataacctcaagatctcaggaggagctggaagctcacgtggtgaacgaccacgacaatgacgctaatattcatacacagtccaaagcgcagcagtgcgtgagcccctcatcctccttgtgtcgaaaaactaccgaacggaacgagactatacctgacatccccgtgtctgtcgacaatttacagacccatacagtgcaaaccgcgtctgtagccgaaatgggacgtagaaagtggtacgcatacgaacagtacggcatgtatcggtgtctgttctgcagctacacttgcggccagcagagaatgctgaagacacacgcctggaagcacgccggtgaggtggactgtagttaccctatctttgaaaacgaaaacgagccactggggctgctagacagctcagctgctgccgctccagggggcgttgatgctgtggtcattgccataggggagagtgaactgagcatccacaacggaccatccgtacaggtgcaaatctgcagttcagagcaactcagctcttcctccccgctggagcagtcagcagaaaggggagtgcatctgagccaatctgtgaccctggaccctaatgaagaagaaatgctggaggtgatctctgacgctgaagagaacttgatccccgatagtttgctgacaagcgcacaaaagataatctctagctccccaaataagaaaggtcatgtaaacgttatagtggaacggctgccttctgcagaggagacactctcacagaagcgctttctgatgaacacagagatggaggagggcaaggacctctcgcttacagaagctcagattgggagggagggcatggacgatgtttaccgtgccgacaaatgcactgtggatattggtggcttaatcatcgggtggtccagctccgaaaagaaggatgaactgatgaataaggggcttgccactgacgaaaacgctccccctggtcgaaggagaaccaatagcgaatctctccgactccatagtctcgccgccgaagcgctggtaaccatgcctattagggctgctgagttgacgcgggccaacctcggtcattatggagacatcaacctgctagatccagacacatcacagcggcaggttgatagtactctggctgcttatagcaagatgatgagccccctgaagaattcatccgatggcctgacatccctcaatcagtcgaactcaacccttgtggccttgccagaaggcaggcaggagctgtccgacggtcaggtcaagactggaatttctatgtctttgttgaccgtaatcgagaagctgagagagcgcaccgaccaaaatgccagcgacgatgatatcctgaaggaactccaggacaacgctcagtgccagcctaactccgacacatcattgtcggggaataatgtagttgagtacatccctaatgcagaaagaccctatagatgtcggctatgccattacaccagcggaaataaaggctacataaaacagcacctgcgggtgcaccggcagaggcagccataccaatgtcccatttgcgagcatatagccgacaatagcaaagacctggagtcccatatgatacaccattgcaagaccaggatctatcaatgtaagcagtgtgaggagtcatttcactacaagagtcagctgaggaaccacgagagggaacaacacagcctgcctgatacactgtcaatcgcaacatcaaacgagccccgtatctcaagtgatacagccgacgggaagtgtgtgcaggaagggaacaaatcctccgtgcaaaaacagtacagatgcgacgtgtgtgactacacgagtacaacttatgtcggagtacgcaaccacaggcggatccataattcagataaaccatataggtgctctctgtgtgggtacgtctgttcccatccacctagcctgaaatcccacatgtggaaacacgctagcgatcagaactacaactacgaacaagtgaataaagcaattaatgatgcgatttcacagtccggacgagttctaggtaagtcacccggtaaaactcagttaaagtcatctgaagaaagcgccgaccccgtgacgggctcaagtgaaaatgctgtttcatcatccgaactcatgtcacagacacccagtgaagttttaggtactaatgaaaacgagaagttatcgccaacatcaaatacttcctactcactcgagaagatcagttctttggcgcccccctctatggaatactgcgtgttgttgttctgctgctgtatctgcggcttcgagtcaacctctaaggagaatcttttagatcacatgaaggaacacgagggggagatcgtgaacattatcctgaataaggaccataacacggccctgaacactaactag

SEQ ID NO: 14304 - DNA, 2874 bp, Artificial Sequence
  Description of Artificial Sequence: Synthetic coding sequence
atggaagagtcttctagtgtagcaatgctggtacccgacattggcgagcaggaggctatccttactgccgagtccattattagccccagcctggaaattgacgagcagcgaaagactaagcccgaccctctcattcacgtcattcaaaagttgtccaaaatagtcgagaatgaaaaatcacagaagtgtcttctcatcggcaaaaaaagacctcgttctagtgctgccactcacagtctcgaaacacaggagttgtgtgagatcccggctaaggttatacagtctccagccgcggacactcgcagggctgagatgtcccagaccaacttcacacccgacacattagcccagaatgagggcaaggccatgagctatcaatgcagcctgtgtaaatttttgtcctcctccttctctgttctgaaggatcatattaagcagcatggacagcagaatgaagtcattctgatgtgttcagaatgccatattacatcaaggtcccaagaggaactggaagcccacgtcgttaacgatcatgacaacgacgcgaatattcatacacaatcaaaggctcagcaatgcgtaagtccatctagctctctctgcaggaagaccacggagcgcaacgagaccatccccgacattcctgtgagcgtcgacaatctccagacgcatacggtgcagacggcctctgtggcagaaatgggaagacgtaaatggtacgcctatgaacagtacggcatgtacaggtgcctgttctgcagctacacgtgcggccaacaacgtatgctaaagacccacgcctggaaacatgccggcgaggtggattgcagttatccgatcttcgaaaacgagaatgaacccctgggtttgttggacagcagtgccgcagccgcccccggtggggtagatgctgtggttatagccatcggcgaaagcgagctttctattcacaatggaccttctgttcaagtacagatctgctcctcagagcaactgagctccagtagccccctggaacaaagcgcagaacggggagtgcacttgtctcaatctgtaaccctcgatcccaatgaggaggaaatgctggaggtcatttcagacgccgaggagaacctaatacccgattcactccttacatccgcacaaaaaatcatatcttccagccctaataagaaagggcacgtgaatgtgattgtagaacgactgcccagtgccgaagagacattgtctcagaaacgcttcctgatgaatactgagatggaggagggcaaggatcttagcctgacggaggcccaaattggcagggagggcatggacgatgtgtaccgagctgataaatgcaccgtggacatcggtggcctcataatcggttggtcttcatcggaaaaaaaggatgagcttatgaacaaaggcctggcaaccgacgagaacgcccctcctggcaggcggagaaccaacagcgagtcattgcgcctgcattctctggccgcagaagccctagtaaccatgcctattagggctgccgagctgacccgcgccaatctcgggcactacggtgacatcaatctacttgaccccgatacctcacagcggcaagtggactcaactctggcagcctatagtaagatgatgagccctctcaaaaacagttctgacgggctgacctccctgaatcaaagtaactccacactagtcgctttgcccgagggccggcaggagctgtccgacggccaggtaaagacaggcattagtatgtcattgctgacagtgatagagaaactacgcgagagaacagatcaaaatgcctccgatgacgatattctgaaagagctccaggacaatgctcaatgccaaccgaactcggatacatctcttagtggtaataacgtcgttgagtacatacctaatgcggaacgaccttaccgatgtcgcctatgccactacacgtccggtaataaaggatatatcaagcagcatctgagggtacacagacaacggcaaccgtatcaatgccccatctgcgaacatatagctgacaactctaaagacctggaatctcacatgatccaccactgcaagacgagaatttaccagtgtaagcagtgcgaagaaagtttccattataagagtcagttaaggaaccacgagagggaacaacactccctgcccgataccctatcaatcgctacatcaaacgaacctagaatctcttccgacactgccgatggaaagtgtgtgcaggagggaaacaaatcctctgtacagaaacagtacaggtgcgatgtctgcgactacacttcgaccacatacgtcggggttagaaatcatagacgaattcacaatagcgataagccctatagaaaagagttcaggtgctccctgtgcgggtacgtgtgctcccacccccccagtctaaaatctcacatgtggaagcacgctagcgatcagaactacaactacgagcaggtaaacaaggccatcaacgacgctatcagccagtccggccgtgttctgggcaagtctcctggaaaaactcagctcaagtcgtccgaggagagcgcggacccggtaactggtagcagcgaaaacgctgttagcagttccgaactcatgtcacagaccccatcggaggtgctggggactaacgagaatgagaaactgagccccacctcaaacacttcttattctctggagaaaataagcagccttgctcctccttctatggagtattgtgtgctcctgttttgttgttgtatttgcgggttcgagtcaacgtcaaaagagaatctgctcgaccacatgaaggaacatgaaggggagatcgttaacattatcttgaacaaagatcataacactgccttaaacactaactag

SEQ ID NO: 14305 - DNA, 1689 bp, Artificial Sequence
  Description of Artificial Sequence: Synthetic coding sequence
atgagcagatccctccttctctggtttctcttgtttttactcctgcttccccccctgcccgtacttctggcagatcccggggcccccacgcctgtgaacccctgttgctactatccctgtcagcaccagggaatatgtgtccgattcggtcttgacagataccaatgcgattgtacacgaacaggctatagcggtccaaactgtactatccccgggttgtggacttggctacggaactctctaaggccgtccccttcttttacacacttcttgcttacccacgggagatggttttgggaattcgtgaatgctacttttattcgtgagatgctgatgcgcttggtgctcaccgtgcggtcaaacctcattccctcacctccaacctataactctgcacatgactacattagctgggaaagcttctccaacgtgtcctactatacaaggattctgccatccgtaccaaaagactgcccaacccccatgggcaccaaaggcaagaagcaattgcccgatgcccagctcctggctcgccggtttctgctccgccggaagttcattcccgatccccaaggcacaaacctgatgttcgcttttttcgcacagcattttacccatcagtttttcaaaacgtctggtaaaatgggccctggcttcactaaggccctgggccatggggttgacctgggacatatctatggggataatttggagaggcagtaccagctgcggctatttaaagatgggaaactcaaatatcaagtgttagacggcgaaatgtatcctccttccgtggaggaagctcctgtgcttatgcactatcccaggggcatacctccccagtcccagatggcagttggccaagaagtatttggcctacttccaggactgatgttgtacgctactctgtggctgagagaacacaacagggtatgtgacctgctgaaagctgaacaccctacttggggcgatgaacagctcttccaaactaccaggctgatcctgattggcgagaccattaagattgttatcgaggagtacgtgcaacagctctccgggtactttctccagctcaagttcgaccctgaactgttatttggagtacagttccagtatcgaaacaggatcgctatggaatttaaccacctttatcattggcatccactcatgcctgactcttttaagattggcggcggaagaaacatggatcaccacattctgcacgtggctgttgatgtgatcagggaaagtcgggagatgcgtcttcagccatttaatgagtataggaagagattcgggatgaaaccctacacatctttccaggagctggttggcgaaaaagagatggcagccgaactggaggagctgtacggggacattgacgctctggagttttacccagggctcctgctggaaaaatgtcatccgaactctatttttggggaatcaatgatcgagatcggtgcgcccttttccttgaaaggcctcctaggcaatcctatctgttcacctgagtactggaaacccagcacattcggtggcgaagttggatttaacatagtgaaaactgccacattgaagaagctggtgtgcctgaacaccaaaacctgcccttatgtgagttttagggtaccagatgcgtctcaggacgatggacccgcagtggagagaccgtcgactgagctctag

SEQ ID NO: 14306 - DNA, 405 bp, Artificial Sequence
  Description of Artificial Sequence: Synthetic coding sequence
atgagcccccaccctgaggcgattacagactgtgtgactcttaacaccgtggggcagctggccgaaggcggataccccctgcgctttagcactctgttccaggaacagcagaaaatgaatatctcccaagcatccgtctcatttaaagatgtaaccatcgaattcacacaagaggaatggcagcagatggcccccgtccaaaaaaacctttacagggacgtgatgttggagaactactccaatctcgtgtccgtagggtattgctgttttaagcctgaagtgattttcaagttggaacagggcgaggagccgtggttcagcgaagaggaattctctaaccaatctcacccatctgagctgctgtctagtagccgacacaattccgccggcgttgtgcgcctttag

SEQ ID NO: 14307 - DNA, 2052 bp, Artificial Sequence
  Description of Artificial Sequence: Synthetic coding sequence
atgtcccctcatcctgaggccataaccgattgcgtcacactgaacactgtggggcagctcgcagaggggggatatcccctccgctttagtaccctgttccaggaacagcagaaaatgaatataagccaggctagcgtgtccttcaaggatgtaaccatcgagttcacccaggaagagtggcagcaaatggctcccgtccagaagaatctgtaccgggatgtgatgctggaaaactactctaatctggtcagtgttggatactgctgcttcaagcccgaagtgatcttcaagttggagcagggcgaagagccatggttctcagaagaggagttctccaaccagagtcatcccaaagattatcggggggacgatttgatcaagcagaataaaaagatcaaagacaagcacctggaacaggctatatgtattaacaacaaaactctaactactgaagaggaaaaagtgttggggaaacccttcaccctgcacgtcgctgccgtggcctctactaagatgagttgtaagtgcaacagttgggaagtcaatctgcagtccattagcgagtttattatcaataacaggaactactccaccaaaaagatcggatgtgggaacgtgtgtgaaaatagtccattcaagattaatttcgaaaaaacacagactggtgagaagttctatgagcacaataagaacatgaaggccttgaactacaatgagaatctacctaagcaccctaagtttcagacccttgagcaggcctttgagtgcaacaagattggaaaggccttcaatgataaggccaactgcgtgaagcacaattcttctcacacaggtgagacctcctcaaaagacgatgaatttcgcaagaactgcgataaaaaaactctgtttgatcacagaaggaccggcacaggtaaaaaacacctgcatctgaatcagtgcggaaaatccttcgagaaatccaccgtggaggaatataacaaactcaacatggggattaagcattacgagctcaatccctcagggaacaactttaatcggaaggcccacttgaccgacccccagaccgcagtgatcgaggaaaacccactggtctctaacgaccgtacccagacttgggtcaaatccagcgaatatcacgagaacaaaaaatcctatcagacttccgtgcatcgcgtgcgacggagatcacactccatgatgaagccatataagtgcaacgaatgtggtaagtccttctgccagaagggccacttaattcagcaccagaggacgcatactggcgagaaacccttcgagtgttccgagtgtggcaagactttttcccagaaatctcacctgagcacccatcaacggatccacaccgccgagaagccctacaaatgcaatgagtgcggtaaaacattcgtccaaaagtcaaccctcagagggcaccagcgaatccataccggcgagaagccatatgaatgctccgagtgcggaaaaacgttcgtgcagaagagcacactacgggaccaccatcgcatccatactggggagaaatccttccagtgcaatcaatgtgggaaaaccttcgggcaaaaatcaaacctgaggatccatcagcgtactcacactggcgagaagacctaccagtgcaacgaatgcgagaaatcattttggcgcaaagatcatctgatccaacatcagaagacacataccggggagaaacccttcaagtgtaacgagtgcggaaagacattcgctagaacaagtactctgcgagtccatcagagaatccacactggcgagaaaccatttaaatgcaacgagtgcggcaagaagttcgttagaaaggccatactgtcagaccatcaaaggatccacaccggggaaaagcccttccaatgcaacaaatgtggaaagacttttggtcagaagtcgaacctacggatccaccaaaggacacatagtggcgaaaagtcctatgagtgtaatgagtacgggaaactctgtaagaaatccaccttgtccctgtaccagaagatccagggtgaaggcaacccctattag

SEQ ID NO: 14308 - DNA, 789 bp, Artificial Sequence
  Description of Artificial Sequence: Synthetic coding sequence
atgcaactacctcctgccttgtgcgcaagactcgcagcaggtcccggcgcagccgaaccactccctgtagaacgcgaccccgcagcgggcgccgcgcctttccgctttgtagcccgacctgtccggtttccgagggaacaccaattcttcgaggacggagatgtgcagcgtcatttataccttcaggatgttattatgcaggtggccgatgtcccagagaagccgcgcgtgccagcctttgcctgtcaggtcgccggctgttgtcaagtgttcgatgcactcgacgactacgaacaccactatcacaccctgcacggaaatgtgtgctccttctgcaagcgggcctttccaagcggccatctccttgatgctcatatactggagtggcacgatagcttgttccagattctgagtgagcgccaagacatgtatcagtgcctggtagagggctgtacggaaaagtttaagacttcaagagaccggaaagaccacatggtgcgcatgcacctgtatcccgctgattttcggttcgataaacctaagaaatcccgttcgcccgctagcgccgaagctcccggggactcgggcgagcgcagcgagggtgaggctatggagatctgctcagagcccgttgccgcctcacctgcccctgctggcgaacggaggatctacagacaccggagtgtgagcgaactgttccttaagcctgtgctgaacatgtgttctgtgctccggattcttggatgcacatgggccgctgcgctgctgattctgaacagcgagcggtag

SEQ ID NO: 14309 - DNA, 759 bp, Artificial Sequence
  Description of Artificial Sequence: Synthetic coding sequence
atgcagctgccaccagcgctgtgcgctcggttagcggcaggtcctggtgccgcggaaccgctgcccgtggagagggacccagccgccggcgcggccccctttaggtttgtggcgcgccctgtgagattccccagagagcaccagttctttgaggatggcgacgtgcagcggcatctgtatctccaagacgtcataatgcaagttgctgacgttccagagaaaccacgagtgcctgccttcgcatgccaggtggccggctgctgtcaggtgttcgacgctctggatgattacgagcaccactaccacacattgcatggcaatgtttgtagcttctgcaagagggcctttccgtctgggcatctactggacgcccatatcctggagtggcacgactccttgtttcagatactgtctgagaggcaggacatgtatcaatgcctagtggaaggctgcacagaaaaatttaagacttcaagagaccggaaagaccacatggttcgcatgcacctttaccctgctgacttcagattcgataaacccaaaaagtcacgaagccccgctagtgccgaggcccccggagacagtggggagcgctccgaaggcgaagctatggagatctgctcagagcctgtggccgcatcacccgcccccgctggagagcgacggatctacaggcacaggatcccaagcactatttgttttggtcagggagcagctcgaggattcaaatccaataagaagaagacaaagcagtgctag

SEQ ID NO: 14310 - DNA, 933 bp, Artificial Sequence
  Description of Artificial Sequence: Synthetic coding sequence
atgcaggtggcagacgtgcccgagaagcctcgggtccccgcgtttgcatgccaggtcgcgggatgttgccaagtttttgacgcactagatgactacgagcaccactaccataccctacatggaaatgtatgctccttttgtaaacgtgcctttccttctggccatctgctcgatgctcacatcttggaatggcacgattctttatttcagatcctctccgaacgtcaagatatgtaccagtgtctagtggagggctgtacagaaaagtttaaaacttcgagggatagaaaagatcacatggtaaggatgcatctgtacccagcagattttcgcttcgataagccaaaaaaatcaaggagtccggcctctgcagaagcccccggagactctggtgagagatcggaaggtgaagccatggagatctgctcagaacccgtcgctgccagtccagcccccgctggagagcgccggatttaccgccacagattgctattggtgacaagtctggttgtcgtgctgctgtgggaggcgggagccgtgcctgccccaaaagttccgatcaagatgcaggtgaaacactggcctagcgagcaggacccagagaaggcttggggtgcaagggtagtggagccccccgagaaggatgatcaacttgtggtgctctttccagtccaaaagccaaaactcctaacaaccgaagagaagccccgcggccagggaagaggcccaatcctgcccgggacaaaggcctggatggaaactgaagataccctggggcacgtcctcagccccgaacctgatcacgattctctgtatcacccgcccccggaggaagatcagggtgaggagagacctagactttgggtcatgcctaaccaccaggtgctcctgggccctgaggaggaccaggaccacatttaccacccccaatag

SEQ ID NO: 14311 - DNA, 1704 bp, Artificial Sequence
  Description of Artificial Sequence: Synthetic coding sequence
atgtcttcccgcctcggcgcagtccctgccacatccggcccaacgactttcaaacagcaaaggagcactcggatcgtcggtgccaagaacagccgaacccagtgcagcatcaaggataattctttccaatacaccatcccacacgatgactctctctcagggagctcctccgcctcaagttgcgaacctgtctcagactttcctgcctcttttcggaagtctacttattggatgaagatgcgtagaatcaaaccggcagctacttctcatgtcgaaggctccggcggggtgtcggccaaaggcaagcgcaagccaaggcaggaggaggacgaggattatcgcgagtttcctcaaaagaaacataaactgtacgggcggaaacagcgcccgaaaacccagccaaatcctaagagtcaagcaaggcgcataaggaaggagcctcctgtgtatgcggcgggcagcctggaggagcagtggtatctcgaaatcgtggacaaagggagcgttagctgtccgacgtgccaagctgtgggcagaaagacaatcgagggactgaagaaacatatggagaactgcaagcaggaaatgtttacctgtcaccattgtggcaagcaactacgctctctcgccggtatgaaataccacgttatggcaaaccacaactcactacctattctgaaggcgggggacgagattgatgaaccaagcgaacgcgagcgacttagaacagttctaaaaaggctaggcaagctcagatgcatgcgcgaatcttgctcctcctcttttacttccatcatgggttatctgtaccacgtaaggaaatgtgggaagggcgctgctgagctcgagaagatgactctgaagtgccatcattgcggtaaaccctaccgctcaaaggccggcttggcctatcacctcaggtccgaacacggcccaatttcttttttccctgagagcgggcaacccgaatgcctgaaggaaatgaatctcgagtcaaagtccggcgggcgagtgcaacgcagatctgccaaaattgccgtgtatcatctgcaggaactcgcttccgccgaactggcaaaggaatggcccaaacgaaaggtcttacaggatcttgttcccgatgaccgcaagctgaaatacacgcggccaggcctccctacattctctcaggaagtgctgcacaaatggaagactgacattaaaaagtatcatcggattcaatgtcccaatcagggatgcgaggctgtgtattcatcagtctcagggttgaaggcacatttagggtcatgtacactcggtaactttgtcgccggtaagtacaagtgtctgctgtgccagaaggagtttgtgtctgaaagtggagtcaagtatcacataaactcggtgcacgcagaggactggttcgtggtgaatcctaccacaactaagagcttcgaaaagctcatgaagattaagcagagacagcaagaggaagagaaaagaaggcagcagcatcgatctaggcggtcacttcggcgacgccagcagcctggcattgagctgcccgaaacagagctgtcactcagggtggggaaggatcagcggagaaataatgaggagttggtggtgagcgcgagttgtaaggaaccagaacaggaacctgttcccgcccagttccagaaggtcaaaccgcccaagacaaaccataagcgcggacggaaatag

SEQ ID NO: 14312 - DNA, 1701 bp, Artificial Sequence
  Description of Artificial Sequence: Synthetic coding sequence
atgtcatcccggttgggcgcagtgccagctacttctggaccaaccacctttaagcagcaacgatctacccggatcgtgggcgccaaaaatcgaacgcagtgtagcatcaaggacaatagttttcagtacaccattcctcacgacgactccctgtccggcagtagcagtgctagctcttgtgagccggtctcagatttccccgccagtttcaggaagtccacgtactggatgaagatgcggagaattaaaccagctgccacaagtcacgtggaggggtctgggggagtctctgccaagggcaagcgaaagcctcggcaggaggaagacgaggactatagagagttcccccagaagaagcacaaactgtacgggaggaagcagcgaccgaagacccagcccaatccgaagagtcaggcccgtcggatccggaaagagccaccggtgtatgccgccggttctttggaagagcagtggtatctggagatcgtcgacaaaggctctgtgtcttgtcctacttgtcaggccgtgggcaggaaaactattgagggcctcaaaaaacatatggaaaattgcaaacaggagatgtttacttgtcaccattgcgggaaacagctgagatcccttgccggtatgaaataccacgtgatggctaaccacaacagcctcccaatcctgaaggccggggatgagatcgacgagccaagtgaaagagagcgtctgaggaccgttctgaagagactcgggaagcttaggtgtatgcgtgaaagttgttccagctcatttacatccataatgggttacttgtaccacgtgagaaaatgcggaaaaggggccgctgagctggagaagatgactttaaagtgccaccactgcggcaaaccgtacagatctaaggccggtctggcctatcacctgagatccgagcacggccccatctcattctttcccgagtccggtcagcccgagtgcttaaaggagatgaacctggaatctaaatcaggtggaagagtccagcgcaggagtgcgaaaattgctgtatatcatctgcaagagctagccagcgccgagctggcaaaggaatggcccaaaaggaaggtcctgcaggacctggtaccagatgatcggaagctcaagtatacacgcccagggctccccacattctcacaggaggtgctccacaagtggaaaacagatataaaaaaataccaccgaatacaatgccctaaccagggctgtgaggctgtgtactctagtgtgagcggactcaaggctcatctgggatcgtgcacactcggaaattttgtagcaggaaaatacaagtgtctgctgtgccagaaagaattcgtgtctgagtctggagtcaagtaccatataaactccgtccatgcagaagattggttcgtggtaaatccaaccaccactaagtctttcgagaagctgatgaaaattaagcagcggcaacaagaggaagagaagaggcggcagcagcaccggagtaggcgtagcctgagaagaagacagcagcctggcatagagttgcctgaaacagagttatcccttagagtggggaaggatcagagacggaacaatgaagaactggtagtctctgcctcgtgcaaggagccagaacaggagcccgttccagcacagtttcagaaggttaaaccccccaaaaccaatcataaacgggggagaaagtag

SEQ ID NO: 14313 - DNA, 1473 bp, Artificial Sequence
  Description of Artificial Sequence: Synthetic coding sequence
atgaaaatgaggcgcatcaaacccgcggctacctcccatgtcgaagggagtgggggagtgtccgctaaggggaagcgaaaaccccgacaagaggaagacgaagattaccgcgagtttccacagaagaaacacaaattgtatggtaggaaacaacgtccaaagacacagcccaaccctaaatcgcaagccaggcgtattcgaaaagaaccacccgtttatgcagccggatccctggaggaacaatggtatctagaaattgtggataagggttccgtctcttgtcccacatgtcaagctgtgggcagaaagaccatagaaggcctgaaaaagcatatggaaaattgtaagcaggagatgttcacatgtcaccactgcggcaaacaacttaggtcactggctggaatgaagtaccatgttatggcaaatcataactccctcccaatcttgaaagccggtgatgagattgatgagcctagtgagagagaacggttgagaactgtattgaaaaggctcggcaaattacgatgtatgcgcgaatcatgcagtagtagctttacttccataatggggtacctgtatcatgtccgtaaatgcggaaagggggccgccgaattggagaaaatgacactgaaatgtcatcactgcgggaaaccctacaggagtaaggctgggctggcgtaccatcttcggagtgagcatggaccaatttcattttttcccgagtctggacagccggagtgtcttaaggagatgaacctggagagcaagagcggcggccgggttcaaaggcgatccgctaaaatcgccgtttaccacctgcaagagctagcctctgcggagttggccaaagagtggcccaagagaaaggtgttgcaggacctagttccagatgacagaaagctgaagtatacccggcctggactaccaactttcagtcaagaggtcctacataaatggaagacagatatcaagaagtaccatagaatccagtgtcccaatcaggggtgcgaggccgtgtacagcagtgtgtcgggacttaaggcccacctgggatcctgcacactggggaacttcgtggccggtaaatataaatgccttctttgtcagaaggaattcgtctcagaatccggagttaagtaccacattaactcagtccacgccgaggattggttcgtggtgaatccaaccacgactaagtcgtttgagaaactgatgaagatcaaacagcgccagcaggaggaagagaaacggcggcagcagcacaggtcaaggagatccctgcgacgtaggcagcagcctgggattgaactgcccgaaaccgagctttccctcagagtgggaaaggatcaaaggcgcaataacgaagagctggtagtatcggcatcttgcaaagagcctgaacaggaaccagtgccagcccagttccagaaagtcaagcctccaaagactaaccacaagagggggcgcaagtag

SEQ ID NO: 14314 - DNA, 1617 bp, Artificial Sequence
  Description of Artificial Sequence: Synthetic coding sequence
atgtcatccaggctaggagcggtgcccgcaaccagcgggcccacaaccttcaagcaacagcggagcactcgtatcgttggtgctaagaaccgtactcaatgctctataaaggacaattcgttccagtacaccataccacacgatgattccttgagcggctcatcttccgcctccagttgcgagcctgtaagtgatttcccagcctcattcaggaaaagtacatattggatgaaaatgagaaggatcaaacccgctgccacctctcatgtggagggttcaggcggagtcagtgctaaaggcaagcgcaagccacgtcaggaagaggatgaggattatcgggagtttccccagaagaagcacaaactgtatggttccttggaagaacagtggtacctggagatcgtggacaaaggctccgtgtcctgcccgacctgccaggcagtgggccgcaagacaattgagggtctgaagaaacacatggaaaattgcaaacaagagatgttcacctgccaccattgtggcaaacagttgcgcagtctcgccgggatgaagtatcacgtgatggctaatcataactctctgccgatcttgaaagctggagatgagatcgatgaacccagcgagagggaacgactccgaacggttcttaaacgattgggcaagctgcgatgcatgcgcgaaagctgcagctcatccttcacaagtatcatgggttatctctaccacgtacggaagtgcggaaagggcgccgccgagctggagaagatgactttgaaatgccatcactgtggaaagccttacaggtcgaaagctggtcttgcttatcacttgagatcagagcacgggccgattagtttctttccagaatcaggacagcccgagtgtcttaaggaaatgaatctggaaagtaagtctggaggtcgagtgcagagacgttcagctaagatcgccgtctatcacttgcaggaactagcaagcgccgagctggctaaggagtggcccaagagaaaagtgctgcaagacttggttccagacgaccgcaagctgaagtataccaggccaggactcccgactttttcccaggaggtgctgcacaaatggaagacagacattaaaaaatatcatcggatccaatgcccgaatcagggatgtgaggcggtgtactcttcagtgagtggactcaaagctcatcttgggtcttgcaccttgggcaatttcgtcgcaggaaaatacaagtgtctgctctgtcagaaggagttcgtcagcgagagcggcgtgaagtaccacattaactctgtgcacgccgaagattggtttgtcgttaatccaacaactacaaagagtttcgagaaactcatgaagattaagcaaagacagcaggaagaggaaaaacgacggcaacagcataggtcacgccgctctctgaggagacggcagcagccagggatcgagcttccagagacagagctgagcttgcgtgtgggcaaggatcaacggcgaaacaatgaagaactagtagttagcgccagctgcaaagagcccgaacaggaaccagttccagcccagtttcagaaagtaaaaccccctaagactaaccataaacgaggacgcaagtag

SEQ ID NO: 14315 - DNA, 1158 bp, Artificial Sequence
  Description of Artificial Sequence: Synthetic coding sequence
atgtctaaaggacaggttgagtaccagcctcgcggcaagggcaaccccgggcgaaagaaaatgaagactattgagaattttctgcgcagatctatctctttcatgggcggaagcaacggactcaagctttctccgattcctaaccctcgtcccgtagtgtttggccgcaatcatcaatttatgcagcaggagatgtttacctgtcaccactgcggaaaacagctgcggagtctggccgggatgaaataccacgttatggctaatcacaactcccttcccatactcaaggctggagacgaaatcgatgaaccttccgaaagagaacgactgcgcactgtgcttaagcgcctcgggaagttgcgttgtatgagggaatcctgttcgagttcctttacatccattatgggttatttgtaccacgtcaggaagtgtggcaagggagccgctgagctggaaaagatgactctcaaatgtcatcactgcggaaagccctacaggagtaaggccggtctggcttatcatctccgctcggagcatgggccgatcagcttctttccagagtcaggccaacctgaatgtttgaaagaaatgaatcttgaatcaaagtcagggggacgcgtccagaggagatcagccaaaattgccgtgtatcacctgcaggaactcgcctcagccgagctcgcaaaagagtggcctaaaagaaaagtgctccaggatctggtgccagacgacagaaagctgaagtatacccggcccggcctgcccacttttagccaggaggtcctgcacaagtggaagacagatatcaaaaaataccaccgcatacaatgcccaaaccagggatgcgaagctgtgtacagtagcgtgagcggtctaaaagcacatcttgggtcttgcaccctgggcaatttcgttgcaggaaagtacaagtgtctcttgtgtcagaaggagttcgtcagcgagtctggagtgaagtatcatataaactccgtccacgccgaggactggtttgtggtaaatccaacaaccaccaaatcttttgaaaagctgatgaaaataaagcagaggcagcaggaagaagagaagcggcggcagcagcatcgcagcagaagaggatctcaggacacctgtatgcccaaggctctgcatcgcatgtag

SEQ ID NO: 14316 - DNA, 690 bp, Artificial Sequence
  Description of Artificial Sequence: Synthetic coding sequence
atggattctgcaggtcaagatatcaatctcaactcccctaacaagggcctgctctcagattcgatgacagatgttccggtggatactggagtggcagcccggacgcccgctgttgaagggttgaccgaagctgaagaagaagagctgcgagccgagctgacaaaggtggaagaggagatcgtgaccctccggcaggtcctcgcggccaaggaacgccattgcggcgagctgaaacgacgcctgggtctatccacattgggagagctgaagcagaatctcagccgatcctggcatgatgtccaggtgagtagtgcctatgtgaagactagcgagaagctcggcgagtggaatgagaaggtcacgcaatctgatctatacaagaagacgcaggagaccttgtcccaggcagggcagaagaccagtgccgcactgagcactgtaggaagtgctatttcccggaagcttggggatatgcgagcccatccattctctcatagtttttcatcctacagtatccggcactccatatccatgccagcaatgagaaattcggcaactttcaagtccttcgaagacagggtcggcacaattaagagtaaggtcgttggcgaccgtgagaatggttccgacaacctgccttcaagcgctggctccggggataaacctctgtccgatcctgcccccttctag

SEQ ID NO: 14317 - DNA, 2679 bp, Artificial Sequence
  Description of Artificial Sequence: Synthetic coding sequence
atgacggatccattctgcgtcggaggccgaaggctgccaggtagtagtaagagcggcccaggcaaagacgggtcaaggaaggaagtccgtctgccaatgctgcacgaccctccgaaaatgggcatgcctgtggtgcgaggaggccagaccgtgcccggccaagcacccctctgtttcgatcccggctcccctgcatccgataagactgaagggaagaagaaaggaagacctaaagctgaaaaccaggctctcagggacattccgctgtctctgatgaacgattggaaggatgagttcaaggctcattcgcgagtaaaatgcccaaacagcgggtgttggcttgaatttccctccatctacggcctgaaatatcactaccagagatgtcaggggggagccatttccgaccggctggcatttccctgtccattttgtgaagccgccttcacgagcaagacacagctagagaagcatagaatctggaaccacatggacagaccactgcctgccagcaagccaggtcccatcagccgcccagtcacaattagcagacccgtcggcgtaagtaaacccatcggcgtctctaagcctgtcaccatcggaaagccggtcggggtgtcaaaacccatcggcatttctaagccggtgagcgtagggcggcccatgccggtgacaaaagcaatccccgtcactagacctgtgccagtgaccaagcctgtaacagtgagcagaccaatgcccgtgacaaaggcgatgcctgtgacaaaacccattacagtaacaaagagcgtcccggttacaaaaccagtgcccgtcacaaaaccgattacggtcacaaagcttgtcacagtgacaaaacccgtcccagtaaccaaaccagtcactgtgtccagacccattgtagtttcgaagcccgtcaccgtcagtagacctattgccatttccaggcacaccccaccatgtaagatggtgcttctgactcgctccgagaataaagcccccagagccacaggtcgcaatagtggcaaaaagcgcgccgcagactccctggatacgtgtcccattcctccaaagcaagctcgtccggagaatggcgagtacggaccgtcttcaatgggacaatccagtgcttttcagctgtcagcggacactagttcaggaagcttatcgcccgggtccagaccgtccggcgggatggaagctctaaaggccgctggtcctgcaagcccgccagaggaggatcccgagcgtactaagcatcgtagaaaacagaaaacacctaagaaatttacaggggagcagccaagtatcagtggtacattcggcctgaagggcctggtcaaagccgaagataaggctcgggtgcatagatctaagaagcaagaaggacccggtcctgaggacgccaggaagaaagtgccagctgcgcctattactgtaagcaaagaagcacccgcccccgtagcccaccccgcaccaggcggccccgaagagcaatggcagagggctatccacgagagaggcgaagcggtatgtccaacctgcaatgtggtgacacgaaaaacgctcgtaggtcttaagaagcacatggaagtttgccagaaactccaggacgcacttaagtgccagcactgtagaaaacaatttaagtcgaaggctggtctcaattatcacactatggcagaacactccgcaaaaccatcagacgccgaggcttccgagggaggcgagcaagaagaacgggaacggctgcgcaaggtcctcaaacagatgggcaggctgcggtgtccccaagagggctgcggcgccgctttctctagcctcatggggtaccaatatcatcagcgaagatgtggcaagccgccttgcgaggttgattctccttccttcccgtgcacccactgtggcaagacttatcgaagcaaagcagggcatgattaccatgtccgtagcgagcacaccgccccacctcccgaagagcctacagataagagtccagaagccgaagatcccttgggcgttgaaagaaccccatccgggcgcgtccggaggacaagcgctcaggtcgccgtgtttcacctgcaggagatcgcagaagacgaactggccagagattggaccaagcgcaggatgaaggatgacctggtgccagagactgccagactcaactacacccgaccagggcttccgacactgaatccacagctgttggaggcctggaaaaacgaggtaaaagaaaagggccacgtgaactgtccaaatgattgttgtgaagccatctactcgtctgtgtccggactgaaggcacatctggcctcatgcagcaaaggcgcacaccttgctggcaaataccgctgtcttttgtgtccaaaggagttcagctcagagtccggagtgaaataccacattttaaaaacacacgccgagaactggttcaggacctctgctgatccccccccaaagcatagaagtcaagacagcctcgtgcctaaaaaagagaagaaaaaaaacctggcagggggtaagaaaagaggaaggaaacccaaagaacgcacacccgaagagccagtagctaaactccccccacgcagggacgattggccccccggctgcagggataagggagccagaggctctaccggccggaaagtgggggtaagtaaagcaccggagaaatag

SEQ ID NO: 14318 - DNA, 2679 bp, Artificial Sequence
  Description of Artificial Sequence: Synthetic coding sequence
atgaccgatcctttctgcgtcgggggaaggcggttaccaggttcatccaagtcaggaccagggaaggacggctcccggaaggaggtgcgcctgcccatgctccatgatccaccaaaaatgggcatgcctgtggtaagggggggccaaactgtgccaggacaagccccgctgtgcttcgacccaggatctcctgcctccgacaagacagagggaaagaaaaaaggtcggcctaaagccgagaatcaagcgcttcgggacattcccctgtcactaatgaatgactggaaggacgagttcaaggctcactcacgagtgaaatgccctaattcagggtgctggttggagtttccctccatctatggcctgaagtaccattaccagcggtgccaggggggagccatttcagaccggctggcttttccatgccccttctgtgaagctgccttcacttcaaaaactcaactggagaagcatcggatttggaatcatatggaccggcctttgcccgcgagcaagcctggccccatctctcgcccagttacgatcagccgccctgtgggggtatctaagccgattggggtcagtaagcctgtcactataggcaagcctgtgggagtctcgaagccaataggtatttcaaagcccgtctcagtgggaagacccatgccggtgacaaaagctatcccagtaacccgacccgtgcccgttaccaagccggtgacagtcagcaggccaatgcccgtgacaaaagctatgcctgtgacgaagcctattaccgtaacaaaatccgtaccagttacaaaaccggtgccagtcacaaaacccatcactgttaccaagctcgttacggtgaccaagccggtccctgtcaccaagccagtgacggtttcaaggcccattgtggtttctaaacccgtcacagtgtcacgccctatcgccatctctcggcacacaccaccgtgcaagatggtgctgctcacccgctcggaaaacaaggctccgagggctacaggccgtaatagcgggaaaaagcgtgccgctgactccttagacacgtgccccattccaccaaaacaggcccgcccggaaaacggggaatacggcccctccagtatggggcaaagttcagcatttcagctgtccgccgatactagcagtggatcactgtctccagggagtaggccctcaggcggtatggaggccttgaaggcagctggtccagcaagtcctccagaagaagatcctgagagaacaaagcataggcggaagcagaagacccctaaaaagtttacaggcgagcagccttctatcagcggtaccttcgggctcaaaggactggtaaaggcagaggacaaagccagggttcatcgatcaaaaaaacaggaaggaccagggcctgaagatgccaggaagaaagtgcccgcggcccccattaccgtttctaaagaggcacctgcccccgtggctcatccagccccaggaggcccagaggagcaatggcagcgcgccattcatgaacgcggtgaggccgtttgcccaacatgcaacgtggtgactcgcaagacacttgttggacttaagaaacacatggaggtgtgtcaaaaactccaggatgcactgaaatgtcagcattgtaggaaacagttcaagtctaaggccggcctgaattaccacactatggctgagcacagcgctaagccttctgatgccgaagccagcgaaggcggcgagcaggaagagagagagagactccgcaaagtacttaagcagatggggagactgagatgcccgcaggaggggtgtggagctgccttttcgtctctaatgggctatcaatatcatcaacgcaggtgtggcaaaccaccctgtgaggttgattcgccttctttcccttgcactcactgcgggaagacataccgatcaaaggccggtcacgactaccacgtgagaagtgaacacaccgcacccccacccgaggagccaaccgataagtcaccagaggctgaagacccgctcggcgtggaacgcactccaagtggtagggtccggcgcacatctgcgcaggtggcagtgttccacctgcaagagatcgctgaggatgagttggcacgggattggaccaagcggcggatgaaggatgatctggtgccagagactgccagattgaactatacccggcccggcttacccacgctgaaccctcaactgttggaggcctggaaaaatgaagtgaaggaaaagggtcatgttaattgtccgaatgattgctgtgaggcgatctactcgagcgtttctgggctaaaggcccatcttgcttcatgctcaaaaggcgctcacctagctggaaaatatcggtgcctgttgtgtcccaaggagtttagcagtgaaagcggggtcaagtatcatatactcaagacgcacgctgagaattggttcagaactagtgccgatcccccacccaagcacagaagccaggacagcctagttccaaagaaggagaagaagaagaatctcgccggaggcaagaagcggggaaggaagccaaaggagcggacgccagaggagcctgtcgcgaaacttccacctcggcgggacgactggccacccggctgcagagacaagggcgccagaggcagcaccggcaggaaagtcggcgtgtcgaaagcccccgagaagtag

SEQ ID NO: 14319 - DNA, 1203 bp, Artificial Sequence
  Description of Artificial Sequence: Synthetic coding sequence
atgactttcgaagatgtggcggtcgagtttagtcagtgggagtggggccaactgaatccggcccagaaagacctctaccgagaagtaatgctggaaaactttagaaatctggcgatccttggattactagtcagtaagccttatgtgatctgtcagctcgaggaaggaggcgagcccttcatggtggaaagagaaatctctacaggtgcacactcagactggaaacggaggagcaagtccaaggagtcaatgccatcttggggtatcagcaaggaggagttattccaggtggtcagcgtggagaaacacattcaggatgtactccaatttagcaagctgaaggctgcctgtgggtgcgacggtcagcttgagatgcagcaaataaagcaagagaggcacctgaaacaaatgtctacaattcataagagtgcgacgaccctaagtcgagattacaagtggaatggcttcgggcgctccctggggcttcgatcagtactggtgaaccagcacagtattcttatgggggagggctcatacaaatgcgacactgaatttcgtcagacactcggtggcaacaactctcaaaggacacaccctgaaaaaaaaagttgtaagtgcaatgagtgcggaaagtcattccatttccaatcagaactgagaagacaccagcgctgccacaccggagaaaagccatatgagtgttcagattgtggacgcgcatttgggcacatatcatccttgataaaacaccagcggactcataccggcgagaagccctatgagtgttcggagtgcggccgggccttttcccagtcctcatctctagtgctacactataggtttcatacgggagagaaaccatacaagtgcaacgaatgtgggcgagccttcggccatacatcttccctgataaaacaccagcgcactcatactggagaaaaaccctatgagtgtagggagtgtggaagaacattcagccaaagcagcagcttaattgtccactatcggttccacactggggagaaaccctacaagtgtaataaatgcggacgagcgttctcacaatcctcctccctgacccagcactaccggtttcacacaggtgaaaaaccctacaaatgcaacgaatgtggacgagcctttgcccatactgcctccctgataaagcatcagagaagtcacgcaggcaagaaaaccctttag

SEQ ID NO: 14320 - DNA, 1203 bp, Artificial Sequence
  Description of Artificial Sequence: Synthetic coding sequence
atgacattcgaggatgtggccgtggaattctcgcagtgggagtggggccagctcaatcctgcccaaaaagacctttaccgggaggtcatgctggaaaactttaggaatctggcgattctcggtctgctggtctctaagccatacgtgatttgtcagctcgaggaaggaggtgaaccattcatggtggagcgtgaaatctccaccggggctcatagtgactggaaaagacggtctaaaagcaaagaatccatgccatcttggggcattagtaaagaagagctgtttcaggtagtgagcgtggaaaagcatattcaggatgttctgcagtttagcaaactgaaagccgcgtgcggatgcgacgggcaacttgaaatgcagcagatcaaacaagaaagacaccttaagcagatgtccaccatacacaaatcagccacaacgctgagcagggattataaatggaacggcttcggtaggtctttaggtctcagaagcgtactggttaatcagcacagtattttgatgggcgagggcagctacaagtgcgacacagaatttcgccagaccctaggaggtaacaattcacagcgtacacaccctgagaagaaatcctgtaagtgcaacgaatgcgggaagtccttccactttcaaagcgagttacggcgccaccaaaggtgtcatacaggcgaaaaaccatacgagtgctctgactgtggaagagcttttggccatatctcatccctgatcaagcaccagagaacgcatactggcgagaaaccttatgagtgctctgaatgtggtcgcgccttttctcagagcagctccctcgtccttcactaccgatttcacacaggggagaaaccctacaagtgtaatgagtgcggcagggcattcggccacacctcaagtctgattaaacaccagaggacacacacgggagaaaagccctatgaatgccgcgagtgtggcagaactttctcccagtcttcttcattaattgtgcattaccgttttcacactggagaaaagccatacaaatgtaacaaatgtgggcgtgcctttagccagagctcctctctgactcagcactaccgattccacaccggagaaaagccgtacaagtgcaacgagtgtgggagggccttcgcacacacagctagcctgataaagcatcagcgaagtcacgctggaaagaagacattatag

SEQ ID NO: 14321 - DNA, 162 bp, Artificial Sequence
  Description of Artificial Sequence: Synthetic coding sequence
cagtcggaactgaggcgccatcaacgatgtcatacaggggagaagccgtacgagtgcagcgattgtggcagagcgttcggacacatctcctcacttatcaagcaccaattgatattggagaagtcacccatgaatgctgttaacgtgggagaaccctcctag

SEQ ID NO: 14322 - DNA, 3492 bp, Artificial Sequence
  Description of Artificial Sequence: Synthetic coding sequence
atggacaggaacagggaagctgagatggagctgcgccgtgggccttccccaacccgcgccggacgtgggcacgaagtggatggcgataaggctacttgtcatacatgctgcatttgtggcaaatccttccctttccagagctctctgtctcagcacatgcgcaagcacaccggagagaaaccctataaatgtccctactgcgaccatagagctagtcagaaagggaacctaaagatccatattcggtcccatcggaccggaacccttatccagggccacgaaccagaagccggcgaagccccattaggggaaatgagagctagcgagggcctggatgcctgtgcatctccaactaagagtgctagcgcttgcaatcggctcctcaatggggccagtcaagccgatggagccagagtgctgaatggagccagccaagcagattccggcagagtcttactgcgctcatcaaaaaagggggccgagggatccgcttgcgctccaggcgaggccaaggccgccgtgcaatgttccttctgcaaatcacagtttgaaaggaagaaggacctggaacttcatgtccaccaggcacacaaaccgttcaaatgtcgactctgtagctatgccaccctcagagaagagtccttgctgtctcatatcgagcgcgatcatatcacggcccaggggcccggcagtggagaagcctgtgtggagaacggaaaacccgagctgagtcctggagagtttccttgtgaggtgtgcggccaggcattttcacagacctggttcttgaaggcccatatgaaaaagcatcgcggctcctttgatcatggctgtcacatctgtgggagacgatttaaggagccctggttcctgaaaaatcatatgaaggctcacgggcccaagacaggctccaaaaatcgccccaaatcagagcttgacccaatcgctacaattaacaacgtggtgcaagaggaagtcatcgtggccgggctgtcgctctatgaagtgtgcgccaaatgcggtaacctcttcacgaatctggatagcctcaacgcccacaacgctattcaccggagagtggaagcatccaggacccgagcccccgctgaggagggtgcagagggcccatctgataccaaacagttcttcctgcaatgtctgaatcttcgtccctcagccgccggagattcttgtcccggaacccaggcgggccggagggtggccgagctcgatcccgtgaatagctatcaagcatggcagctcgctacacggggaaaggttgcggagcccgccgaatatcttaaatatggagcatgggatgaggctctggcaggcgacgtggcctttgacaaagacagaagagagtacgtcttggtgagccaggagaaacgaaagagggaacaagacgcgcctgctgctcagggacctccccggaaacgtgcgtcaggcccaggggaccccgctcccgccgggcaccttgatccgaggtcagcggcccgaccaaacagaagagcagcagctaccacagggcaaggtaagagttctgagtgcttcgaatgcggcaagatcttcaggacttaccatcagatggtgctacacagtagagtgcatagaagagccagaagagagcgcgattccgatggggatcgcgccgcgagggctaggtgcggttcactgtccgaaggggactctgcttctcagccctccagtccgggctcagcttgtgcagcagcggattccccaggatcgggactggctgatgaagccgctgaggattcgggcgaagagggagcccccgaacccgctcccggcgggcagccacgacggtgttgcttttccgaagaagtgacatcaaccgaactgagctctggggatcagtcacataagatgggagataacgcctctgagagggacaccggcgaatctaaagccgggatcgcagcttctgtttctattcttgaaaactctagtagagaaaccagcaggagacaggagcagcataggttcagtatggacctgaagatgccagcgtttcacccgaagcaggaggtaccggtgcccggtgacggcgtcgagttccccagtagcaccggcgcggaagggcagaccggtcaccctgccgagaagctgagtgatctccataataaggagcactctggaggtgggaaaagggctctggcacctgatttgatgcccttagacttgtcagcccgtagtacccgcgacgatccttccaataaggagacagccagcagtctgcaggccgccctggtagtgcatccatgtccttactgctctcacaagacttactatccagaggttctctggatgcacaaaagaatatggcatagagtgagttgtaactccgtggctccaccatggatccagccaaatggatataaaagtattcgatcgaacctggtcttcctgagtagatctggaagaacagggccgccaccggcattgggggggaaagaatgccaacccctcctgctggcacgcttcacgaggacgcaggtgccaggcggtatgcccggttctaaatccggaagtagtcctctgggggttgttacaaaggcagcctcgatgcctaagaacaaggagagccattcgggtggaccctgcgctctgtgggcaccaggaccagacgggtatcgtcagactaagccatgccatgggcaggaaccccacggtgcagcgacacagggccccctggccaaaccccgacaggaggcctctagcaagccagtcccagcgcccgggggaggcggcttctctcggagcgctactcccacaccaactgtcatcgcccgggccggcgctcaaccatccgcgaactctaaaccagtggagaagttcggggtgcccccagccggtgcaggttttgcaccaaccaacaaacattcagctccggacagcctaaaagcgaaattctcggcccagccccaggggccccctccagctaagggtgaggggggcgcccccccattaccaccaagggaacctcccagtaaggccgcacaggaattaagaaccctcgctacttgtgccgcaggttctcgaggagatgccgccctccaggctcagcctggcgtggctggcgctccccccgtgctgcattctattaagcaggagccagtggccgagggccacgagaagagactcgacattctgaacatatttaaaacttatataccaaaggactttgccactctgtaccaagggtggggtgtctcggggccaggtttggagcatcgaggcaccttgagaacccaggcccgtcctggggaatttgtttgcatcgaatgtggcaaatcttttcaccaacctggtcacctgagagctcacatgagagctcattctgtggtgttcgaatcagacgggcctaggggcagcgaggtccacactacatccgccgatgccccgaaacagggacgggaccactccaacaccggcacagttcagaccgtgcccctgcggaaaggtacttag

SEQ ID NO: 14323 - DNA, 228 bp, Artificial Sequence
  Description of Artificial Sequence: Synthetic coding sequence
atggacaggaacagagaagcagaaatggaattaaggcggggtcctagtcctacaagagcaggccgcgggcatgaagtggatggcgacaaagccacttgccacacgtgctgcatctgcggcaaatcattccccttccagagttcgctctcgcagcatatgcggaaacatacgggagagaaaccatacaaatgcccctattgcgatcatcgtgcctcccagaagggttag

SEQ ID NO: 14324 - DNA, 1479 bp, Artificial Sequence
  Description of Artificial Sequence: Synthetic coding sequence
atggcaatggccctgcctatgccgggaccccaggaggcggtggtattcgaggatgttgctgtatacttcaccaggattgagtggagctgcctcgctcccgatcaacaagccctctatagagacgtgatgctcgaaaattatggcaaccttgcttccctgggctttttggtagctaaacctgcccttatttctctgctcgaacagggtgaagagccaggggcacttatccttcaggtggcggagcagtcagtggctaaagcgagtctgtgtacagattcaaggatggaagccggaataatggaatccccactccaacgaaagctaagccggcaagctggactgcccggaactgtgtgggggtgtttgccatggggacaccccgtggggggtcatcccgcacctcctcacccccatggaggccccgaggatggctctgacaaacccactcatccgagagcccgggagcacagtgccagtccacgggtcctgcaggaagatctgggaaggcccgtcggcagttcagcacccagatatcgttgtgtgtgcggaaaggcatttcgctataactccctgctgctgaggcaccaaattattcacacaggtgccaagccttttcagtgcaccgagtgtggcaaagcatttaaacagtcctcgattctactgcgccaccagctaatccacactgaggagaagccttttcagtgtggtgagtgcggtaaagcatttaggcagtcaacacagcttgctgcccaccaccgcgtgcacacccgggaacgcccttatgcctgcggagaatgcggcaaggccttttcaagaagctcaagactgctccagcaccagaagtttcacaccggagagaagccatttgcctgtaccgaatgcggaaaagccttttgtcggcggttcactctgaacgagcatgggcgcatccactccggcgagcggccctatcgctgcctgagatgcgggcaaagatttataagaggctctagcctcttgaagcatcaccgtctccacgctcaggagggcgcacaagatggaggggttggtcagggagcactcttgggcgctgcacagcggccacaggctggagacccaccacatgagtgtcccgtgtgcggccgcccttttcgtcacaattctcttctcctgcttcacttgcgtcttcatacgggggaaaagccattcgaatgcgccgagtgtggaaaggccttcggccggaaaagtaacctgactctgcaccagaaaattcacaccaaagagaagccttttgcttgtaccgaatgtgggaaagctttcaggcgtagttacaccctgaacgagcactatcgcctgcactcaggcgagagaccgtatcgttgtcgagcctgtgggcgggcatgctccaggctgagcacactgatacagcatcagaaggtgcacggtagagaacccggcgaggacaccgagggtcggcgtgcaccgtgttgggcttcctag

SEQ ID NO: 14325 - DNA, 1479 bp, Artificial Sequence
  Description of Artificial Sequence: Synthetic coding sequence
atggcgatggccctgcctatgccagggccccaggaagccgtggtgttcgaggatgtggcggtttacttcacccgcatagaatggtcttgtctggcccccgatcaacaggccctgtacagagatgtaatgcttgagaattacggcaacctcgcttcattgggcttcctggttgccaagcccgccctgattagcctgctggaacaaggggaggaacccggcgctctcatcctgcaggtcgctgaacaatcggttgcgaaggccagtctttgtacagacagcaggatggaggccggaatcatggaatctccccttcaaaggaaactgtccagacaggctggactccctgggaccgtgtggggctgcctcccttggggccatcccgtgggaggacatcctgccccgcctcatccccatggagggcctgaagatggaagcgataagcccactcatcctagagcaagagagcactccgcttccccacgcgtgctgcaggaggacctggggcgccctgtgggatcgtctgccccaagataccggtgcgtgtgcggaaaggcattccgttacaactcattacttctccgacaccagatcatccataccggggctaagcccttccagtgcacagaatgcgggaaggcatttaagcagagctcgatcctgctgagacaccagctaatccatacagaagagaagccttttcagtgcggggagtgtgggaaagcttttaggcaatccacacaactggctgcccatcatcgcgtgcacacacgggagagaccatacgcctgtggagagtgcggcaaagcattctccagatctagccggcttctgcagcatcagaagtttcacacaggagagaagccgttcgcctgcaccgaatgcggcaaagccttctgccgaagatttaccttaaatgagcatggcagaattcacagtggcgaaagaccatatcgctgtctgcgatgtggccagcggttcattagggggtcgtcactgctgaagcaccaccgtctgcatgctcaggaaggagcccaagacgggggcgtaggccagggcgcattactgggggcagcccagagaccccaggcaggcgacccaccacacgagtgtccagtttgcggcagaccttttcgccacaactcgctgctattactgcacctaaggctgcatacaggggagaagccttttgagtgtgccgagtgcggaaaggcttttggtcgaaaatccaacctgacccttcaccaaaaaattcataccaaggaaaaacctttcgcttgtaccgagtgtggcaaggcctttagacggagctacactctgaatgagcactataggttgcactctggggagagaccttacaggtgtcgggcatgtgggcgcgcctgttctcgcctcagcaccctaattcagcaccagaaggttcacggccgggagccaggcgaagatacggagggccggcgtgcgccctgctgggcatcttag

SEQ ID NO: 14326 - DNA, 1479 bp, Artificial Sequence
  Description of Artificial Sequence: Synthetic coding sequence
atggctatggccctgcccatgcctggaccacaggaagctgtggtgtttgaagatgtggcagtctatttcacaagaatagagtggagctgccttgctcctgatcagcaggctttatatagagacgtgatgttagaaaattacggaaacctcgctagcttgggatttctcgtcgccaagcctgccctaatatcactactcgaacagggagaggagcctggcgccttgatcctgcaggtggctgagcagagtgtggctaaggcctccttatgcactgatagccgcatggaggcgggcataatggaaagcccattacagaggaaactgtctaggcaggctggtctgccgggaacggtgtggggctgcctgccatggggccacccagtggggggacaccccgccccgcctcacccccacggcggaccagaagacggcagcgacaagcctacacacccccgcgcaagggaacattccgcttccccccgtgtgcttcaggaagacctgggacggcctgtggggtcatcagcccctcgataccggtgcgtgtgtggaaaggccttcaggtacaactcactgctgttaaggcaccagattatccacaccggtgccaagcctttccagtgtacagaatgtggcaaggccttcaagcaatctagtatcctcctccgtcaccagttgattcacactgaggaaaagccattccagtgtggagaatgcggcaaagccttcaggcagtccactcaacttgccgcccatcacagagtccacacccgtgagcggccttatgcttgtggggaatgtgggaaggcatttagtcggtcctctcggctcttgcagcatcagaagttccacacaggcgaaaaaccatttgcatgtacagaatgtggcaaggctttctgcaggaggtttactctgaacgagcatgggaggatacattcaggggagaggccgtatcggtgtctccgctgcggccaaagattcattcgaggtagttcactgctcaaacatcatcgactgcatgctcaggaaggtgcccaggacggcggagtgggccagggcgccctcctgggtgccgcccagcgaccacaggcaggggatcccccacatgagtgccccgtgtgtggcagaccttttcgccataacagtctgttgcttctgcacctgaggttgcacacaggagaaaagcccttcgagtgtgcagaatgtgggaaagcctttggcaggaaatcaaaccttacattacaccaaaagatccatactaaagagaaaccattcgcttgcacggaatgcggcaaagccttcaggcggtcttacaccctgaatgagcactaccgtcttcatagtggagagaggccctacaggtgtcgtgcctgcggtagggcctgctcacgcctgtcaacactgatccagcaccagaaggttcatggtcgcgaaccaggcgaggataccgaaggcagaagagcgccatgttgggctagttag

SEQ ID NO: 14327 - DNA, 3225 bp, Artificial Sequence
  Description of Artificial Sequence: Synthetic coding sequence
atgaaagatatcggacagcagctttatacaacacatctgaacggcggacataattcgttgactatgagtccaaaacaaccagacgccaacggtgcgccacgcccaaataggcaggaagcccagaccctgttatatcaaggcagcgaggccgaggccgcaatgatgacgattgccacttgcgccaagtgcaagagcgtgcacaaaataagcctccaggacctgcaaaaagggacgggtaaagatggcatgtatgtctgcttccagtgttcactgggagccgcgccccctaattttcatttcgtatccaacaactcctctgccacccacgttggcaataagaccgaaaattttagcagcagcgtgaattcaaaattcaaggttaggaatttcaaaccaggcaagtattattgtgataagtgcaggttcagcaccaaggacccgctgcagtataagaaacatacgcttcaacatgaggaaatcaaattcatctgtagccactgcagctatatttcatacaccaaaggagagtttcagagacatctggtgaaacacaccgggatctttccctatcagtgcgagtattgtgactatggagctattcgcaacgactatatcgtcaagcacacaaaacgcgtccacgaacgtgcgggcgccaaacggcctgtgaaagccgttgctaaactcgagcctaagaggaccgggacatctaaacagaatccagaactgctcaaagcgtctaatcctcgcaccacattccaaaataaatggtcagaccagctgtcgggcttttcccttcatgccaataaggacaagatgcataacataatgctgctccctgagccaaaagagtaccaaaaggacgtcgtgtgtatcccaaataagatgactttaagcgaacctaacgaagtcaatttgttcgagaataaaaacgtcgaggtcgaggttctaagcccggcaaaagagcccgttcagcccgggatgccactgactgtggttgcacccgccgagctcgttgttccagctaactgtcttgcacagttgatcgacgtcaaggtggtaaacggaactcagcaactggtgctcaaactgttccctctggaagagaacaattgcctggaggcggggcgggacaacgggggaaatagcgagaggatggttaaggaaaagggctcgaacgagcaggagaaagttttaagtgctgagaaaactaagtccttgacagtagatggcaacgtgggaaagttggttggcatcgattcttttcagcctagcgttcagaaacagctgaaaaatgtgaaatgggtccgatcatacgacttcatcatgcccaacagctcagtacataataacggaaagtctttcataaattccgagactatcgaagatttccagaagaaaaacaacctctacccacatagaaccgcatttccctctgtggctctcaaagggcacagtcttgcgagcgtctttaaaaatagcgtattgagatccctgggggctgcgagcaatccctttccctataaggctgccgtttgtttcgccgaaagcggacgaaacttacactcatcctcacagcagctgttaccttttgcagcttcccctgcaacatgtagttttagtggtgaaaaagggttgttgcccgtgtccgagaacgatctcgagtctacttcaaaagtaaacattccagtgaaggtggtaagctcaaacagaaaacaagaagataaccagacagaagaacataaggccgtgtctactgtggggcagatcagttctcagcacaagagtgaatacctccacattaatattacgggcgaggaccgaagccagcagccaggagacaagcccctggaacttaaaaactctgagcgcaccaataatacgaatgacggaccagtcatctccagtgtcttttccctgtcctctggatctgagaatgttccggaaggaattaaatggaattcgagcaccagtaaaattaaaagtattgagctgctcaggcggaaaatcgcccagctcattgaatcctgtgggaagccttcttctttggcaagcaatagtgcgcaccggaggtccgtgggacaagcgagtaaagggacatctaaggccacgagcgaaggtattcaggagattaatgtcagcctaactgggctcggccattccacaggaacattacagaagcctcccaacgacgggggaataaccggtaaccggcagcttacccatcagcagatatatccccactttgcagacgggtcaaacagaaaaaccaaaagccgggtggcccgcaaagcacacgttgctacccctgtgctgatacctaaaggtgcggtccttagagtactcaactccagtgaaaacgcgcacattattgaagccacctgcgaagcgcctgttagcattccatgtagtgagaggcaattgatcaagcccgtcccgttttgccccgtgcgccaggccgactctgatttgcagcccctccgtagtgagcggggtccaatagacatgagtcccaacatagaaacgcccctgcgccccaagttgcgcaaagaatccgctgtctgctccaccatccatagaaagacgggcctgctttacggacagcagggctcatccgaactgaacaaacaggggaggctgttgtcccgtagcttatccatcagcagaaataaaaccaagcaggtgcatctctcccgcaagaagaacaaaatccaggcagagccatcacgttgtctaaaagacccatccattttccaagtggccagacagctgcgcctgatcgcagcaaaaccagaccagctcattaaatgtccacggaggaaccagcctgttatcgtattgaaccacccagacgtcgattcacccgaagttaccaatgtgatgaaagtgataaacaaatacaaaggcaacgtcctgaaagttgtcctttccgaaaggacacgatgccaattgggcatccggaggcatcacgtgagattaacgtaccagaatgccgaggaagcatctcaaattaaacggcagatgatgcttaagatgaagctgaagaaggtacacaaaaataattatcaggttgtggacagcttacctgatgacagcagtcagtgcgtgttcaaatgttggttttgtggacggctgtatgaggaccaggaggaatggatgtcccacggacagcggcatcttatagaggctactcgcgactgggacgtcctgagtagtaaggggaagtag

SEQ ID NO: 14328 - DNA, 228 bp, Artificial Sequence
  Description of Artificial Sequence: Synthetic coding sequence
atgaaagatattggccagcagctttataccacccatctcaacgggggtcataactcattgacgatgtcacctaagcagcccgacgcaaacggagcaccccggcctaaccggcaagaagctcagacgttgctctaccagggatccgaggctgaggcagcaatgatgacaatcgctacttgcgctaagtgtaagtctgtccacaaaatcagtttgcaggacctacagtag

SEQ ID NO: 14329 - DNA, 1623 bp, Artificial Sequence
  Description of Artificial Sequence: Synthetic coding sequence
atggagctgttaacattccgtgacgtcgctatcgagttttctcctgaagaatggaagtgcctcgatcccgctcagcagaatctctaccgggatgtgatgctcgagaactataggaaccttgtctcactggctgtgtactcctactacaaccagggcatcctcccagaacagggaattcaggactcattcaaaaaagccaccctgggacgatacggttcatgtggactggagaatatttgtctgtggaaaaactgggaaagtataggggagggcgaaggacagaaagagtgctacaacttgtgttcacagtatctgaccacatctcacaacaaacacctgaccgttaagggggataaggagtacaggatttttcagaaaaagccccagttcctgagtgccgctcccaccgagccctgtatccccatgaataagtatcaacacaagttcctgaaatccgtcttctgcaacaagaatcagatcaactttaaccatgacagcaacatcagtaaacaccatagtacccactttctggagaactactacaattgcaacgaatgcgaaaaggtgttctatcaatcatctaaactcatttttccagagaacatccatatccagaaaaaaccttataattctaatgagtgtggcgaaaccagcgatcctttcagtaaattgacgcagcaccagaggatatatatcggagagagtagtcagaggtgtaataaaaaatgcatcattgttttttcgcagagtcacctgaaggggcacaaaattattaacacaggcgaaaagtccgtgaagtacaaagagagaggcaaggcctttactcgaggcctgcaccttggccaccagaaaatccatactggagaaaaaccttacaagtgtaagaaatgcgacaaggcctttaataagagctcccacctggctcagcaccagagaatacatacaggggaaaagcccttcaagtgtaaggaatgcggcaaagcattcaatcgtggctcgtatttgacccagcaccaaaggatccacactggggagcgggcatttaaatgcgaggagtgcgggaaggccttcaataggggatcctacttaacccaacaccagcggatacatactggggagaaaccattccggtgtaaagagtgcggcaaggcgttcaaccgaagctcttatgttactcaacatcaacggatgcacaccggtgagaaacccttcaagtgcaaagaatgcggaaaggccttcaacagggcttcgcatctcacacagcaccaaagaattcacactggcgagaaacatttcaaatgtaaagagtgtggcaaagcgtttaatcggggcagccaccttacacgccaccagcgaatccataccggcgaaaagagctttaagtgcgaagagtgtggaaaagccttcatttggggaagccacttgacccagcatcagagagtgcataccggggagaagttctttaaatgtaaggaatgtggtaaagcctttactcgatccagtcatctcacgcagcaccagagaatccacaccggggaaaagccgtttaagtgtaaggaatgcggcaaggcgttcaataggcgctcaactttgacccagcatcagattattcatacgagatag

SEQ ID NO: 14330 - DNA, 1623 bp, Artificial Sequence
  Description of Artificial Sequence: Synthetic coding sequence
atggaactgttgaccttcagggacgtggctattgagttctctccggaggaatggaagtgccttgaccccgcccagcagaatctgtaccgagatgttatgttggagaattaccggaatttagtcagtctcgctgtctactcctactacaatcaggggatcctgcccgagcaggggatccaggacagctttaaaaaggctacactgggccgttatgggtcctgtggtctggagaacatttgcttgtggaaaaactgggaatctattggcgagggcgaaggtcagaaagaatgttacaacctttgcagtcagtaccttacgacatcccacaacaaacatctcaccgtgaagggagataaagaatacagaatctttcagaagaagccccaattcctgagtgctgcacccacggagccttgcatcccaatgaataaataccagcacaaatttctgaagtccgtgttctgtaacaaaaatcagattaacttcaaccacgactcgaatatatcaaaacaccacagtacccactttctagagaactattacaactgtaacgaatgcgagaaggtgttctatcagagtagcaaactcatttttcccgaaaatattcacatccaaaagaagccctacaactctaatgaatgtggcgagacctccgatcccttttcaaagctcactcaacaccagagaatatatattggtgaatctagccaaaggtgtaataagaagtgcatcattgtcttctcccagagccacttgaaaggccacaaaattatcaacactggagagaagagcgtcaaatacaaagagcgcggcaaggcctttactcgggggctccacttgggccatcagaagattcacaccggtgagaagccgtacaaatgcaaaaaatgtgataaagccttcaacaagtccagccatcttgctcaacaccagagaatccatactggggagaaaccctttaagtgcaaggagtgcggcaaggccttcaaccgagggtcatacctgactcaacatcagcggatacacactggcgagagagcatttaagtgtgaggaatgtggtaaggcctttaataggggctcctacctgactcaacaccagcgcattcatacaggagaaaagcctttccgatgtaaagagtgcggtaaagcctttaacagatccagctatgtgacccaacaccagcgaatgcacacaggagagaagcccttcaagtgcaaggagtgtgggaaagccttcaaccgcgccagccatttaacacaacaccagaggatccatacaggcgagaagcacttcaagtgtaaagaatgcggcaaggcatttaacagaggctcccacctgactcggcaccaacgcatacatactggcgagaaatcctttaagtgtgaggagtgcgggaaagcttttatttggggttctcacctcacccagcaccagcgagtccacactggcgaaaaattcttcaagtgcaaggaatgcggaaaggcatttacacgttcctcacatctgacgcaacatcagcgtatccacacgggggaaaaacctttcaagtgtaaagagtgcggcaaggccttcaatcgccggtcaacactcacccagcaccagattatccacacaagatag

SEQ ID NO: 14331 - DNA, 795 bp, Artificial Sequence
  Description of Artificial Sequence: Synthetic coding sequence
atggatactcctagccccgatcccctgcccagtcccttacccggcgaagaggaaaaacctctggccctgtcacccccggttccccgtggccgtcgcgggcggagacccggcggtgctaccagttccaaccgcactctgaaagcctcattgccccgcaagagagggcgtcccccaaaatctggacaggaaccccccctggttcaggtgcaaggcgtgacggccccagtgggatcttccggaggaagtgacctcctcctgattgacgatcagggggtgccttacactgtgtccgaggggagcgctgcggggcccgagggcagcggtccacgcaaggccccccacttttgccctgtgtgtttgagggccttcccatatttgtctgacttggaaagacactccatctctcattctgagctcaaaccccaccagtgcaaagtatgcggcaagacctttaaacgatcgtcacacctaaggagacattgcaatatccacgctggccttcgccccttcaggtgccctttgtgtcccagaagatttcgtgaagctggagaattggcacatcaccatcgtgtgcattcaggcgaacgtccttatcagtgtccaatctgcagactccgctttaccgaggccaacactttgcgtcggcacgctaagagaaaacatcccgaagccatgggggtacctttgtgcgccccggaccccggctctgaaccgccatgggacgaggagggtatccccgctacggcaggcgcagaggaagaagaagagacagaaggtaaaggggaacctgcatag

SEQ ID NO: 14332 - DNA, 594 bp, Artificial Sequence
  Description of Artificial Sequence: Synthetic coding sequence
atgtcaagtctgacataccatcatcgactccacaccggtgaaaaaccatataaatgtgaagagtgtgataaggcctttcgtcataactcagccttgcaacgtcatcgcaggatccacaccggtgaaaagccccacaagtgtaatgaatgcgggaagacctttagtcagaagtcttatctggcttgtcaccgaagtattcacacaggcaaaaagccttacgaatgcgaggagtgcgacaaggcattttcgtttaagagcaacctcgagagccatcggattactcatacaggcgagaaaccctacaaatgcaacgactgtgggaaaactttttctcacatgagcacattgacgtgccatcggcggctgcatactggagaaaagccatataagtgtgaggagtgcgatgaggccttccggttcaagagctcactagaacggcatcggcggatccataacggagagaagctctacaagtgcaacgagtgtggcaagaccttctcacaagaattatccttgacgtgccattgccggctgcattctggagagaagccttgcaaatgcggcgagtgcgacaaggcttactcctttaaatag

SEQ ID NO: 14333 - DNA, 1332 bp, Artificial Sequence
  Description of Artificial Sequence: Synthetic coding sequence
atgctggagaattaccgcaacctggtgtcattggggattagcagcaaatgtactatgaaagaattctcttccacggctcagggaaatacagaagttatacacacaggtaccctacagcgacatgagcgtcatcatatcggagatttttcctttcaagagatagagaaagatatacacaattttgagttccaatggcaggaagacgaaaggaatggtcacgaggcacctatgacaaaaattaagaagctgatggggagcaccgagcagtacgatcataggcacgctggaaacaagcctattaaataccagttggggagcagttttcatagtcacctaagcgagctccacatttttcaaccgaaaggtaagatcaataatcaggtagagaagtcgataaacgatgcgagctcggtgagtactgcccagaggattagttgcaggccgaagacacacatttccaataattatggagacaattttcttaactactctctccttacccagagacaggaggtgagaatgcgggagaaatcattccagtgtattgaaagcggcaaggcctttaactacagttctctccttcgtaaacatcagatcattcacctgggcgagaagcagtataaatgtgacgtgtgcgacaaagtgttcatccgcaagcggtacctagccaggcaccggagatgccacactggggagaagccttataagtgcaacgagtgcggtaaaagcttcagccagatgagtagcctcacttatcatcaccgtctgcacacaggggagaagccatataagtgcgaggaatgtgacaaggccttcagacacaacagtgcacttcagcgtcatcgtcgtattcacaccggggagaaaccccataagtgtaatgaatgcggtaagacattcagccagaagagctacttggcatgccaccggtccattcacactggaaagaagccatacgagtgtgaggagtgcgataaagccttctccttcaaatctaatctggagagccatcgaattacccataccggcgagaaaccctataaatgcaatgattgcggtaagactttcagtcatatgagcactctgacttgtcacaggcgactccacaccggagaaaagccctataagtgcgaagagtgtgatgaggctttccgcttcaagtcttcattagaacggcatagacggatccataatggcgagaaactgtacaagtgtaacgagtgtgggaaaacattcagtcaagaacttagccttacctgtcactgtcgactgcatagcggagagaagccgtgtaaatgtggcgagtgtgataaggcctactcctttaagtag

SEQ ID NO: 14334 - DNA, 1440 bp, Artificial Sequence
  Description of Artificial Sequence: Synthetic coding sequence
atggccctgccccagggccttctcacattccgagatgtggcaattgaattttctcaagaagaatggaagtgcctcgatcctgcccagcggacattgtaccgtgacgtgatgcttgagaactatcgaaatcttgtgtctctggggatttccagcaaatgtacaatgaaggaattttctagtaccgctcaaggtaacacagaggtgatccacactggtaccctgcagcgtcacgaacggcatcacatcggcgactttagcttccaggagatcgagaaggatattcacaatttcgagttccagtggcaggaagacgaacgcaatggccacgaggctccgatgactaaaatcaagaaactgatggggtcaacagagcagtacgatcataggcacgccggaaataaacccattaaatatcaactcggatcatcttttcattctcatctctccgagctgcacatttttcaacccaaaggaaagataaacaaccaggtcgaaaaatccatcaatgacgccagcagtgttagcactgcccagcgaattagttgccgcccgaagacacacatttctaacaattatggagacaatttcttgaactacagcttgcttacacagcgacaggaggttcgcatgagggagaaatcgtttcagtgtatcgagagcggaaaggctttcaactacagctctctgctcagaaagcaccaaattatacatctcggtgagaaacagtacaaatgcgatgtgtgcgataaagtgttcattcgcaagagataccttgcccgacacaggagatgccacactggcgagaagccctataaatgtaatgaatgtggtaaatccttctcacagatgtcctcccttacctaccaccatagactgcatactggggaaaagccgtacaagtgcgaggaatgcgacaaagcttttcgtcataacagcgccttgcagagacatcgacggatccacactggagaaaaaccccacaaatgcaatgagtgtggcaagacttttagccagaaaagctatcttgcttgccaccgcagcatccacaccggtaaaaagccctacgaatgtgaagagtgtgataaagctttttcatttaaaagtaacctggagtctcaccgaataacacacaccggagagaagccttacaagtgcaatgattgtggtaagaccttctcgcatatgagtacactaacctgccacagacggctgcacaccggcgagaagccctataaatgcgaggagtgtgacgaagcgttccgttttaagtcctctcttgaaaggcataggcggatacacaatggggagaaactctataaatgtaatgagtgcgggaagaccttcagtcaggagcttagcttgacctgccattgccgtctacactccggcgaaaaaccctgtaaatgtggcgaatgcgacaaggcatacagctttaagtag

SEQ ID NO: 14335 - DNA, 153 bp, Artificial Sequence
  Description of Artificial Sequence: Synthetic coding sequence
atggcgctgccccaaggattgctaacttttagggacgtggctatagaatttagtcaggaagagtggaaatgcctcgaccccgcacagaggaccttgtacagggacgttatgctggaaaattaccgtaatctggtttcactgggctttctgtag

SEQ ID NO: 14336 - DNA, 1887 bp, Artificial Sequence
  Description of Artificial Sequence: Synthetic coding sequence
atggccttgactcaaggcccgctgaagtttatggatgtggctatcgaattctcacaggaagaatggaagtgcctggacccggctcaacgaaccctgtatcgggatgttatgcttgaaaactataggaatctggtgagcctcggtatctgtctgcccgatctgagtgttacctccatgctcgagcagaaaagagacccatggacactccaatccgaagagaagattgcgaacgatccagatgggagagaatgtattaaaggcgtgaacacggaacgctcctccaagctgggaagcaatgctggtaacaaaccctgcaaaaaccagctaggctttacattccagctgcacttgtccgacttgcagctgtttcaggctgaacgtaaaataagtggctgcaagcactttgaaaaacctgtgagtgacaactcttcggtgagtcccctggaaaagattagtagttctgttaaatcccacctgctgaacaagtacaggaacaattttgatcacgccccattgctcccccaggaacagaaggctcacatccgggaaaaggcttacaagtgtaacgagcacggccaagtgtttcgcgcgtctgcctcgctgaccaatcaggtcatccataatgccgacaacccttacaaatgttccgagtgtggcaaggtcttctcttgcagcagcaaactcgtcattcacaggcggatgcacaccggggaaaagccctataaatgtcacgagtgcggtaaacttttctcaagtaattccaatctgtcacaacaccagaggatccataccggcgaaaagccgtacaagtgccatgagtgtgataaagtgttccggagtagttctaagttggcgcaacatcagaggatccacaccggagaaaagccctataaatgtcatgaatgcgacaaagtgtttaaccagatcgcacacctggttcggcaccagaagatacacactggcgagaagccctattcatgcaataagtgtggaaaagtgtttagccgccactcctatctcgcagagcatcagactgtccacactggggagaagccttataaatgcgaggagtgtggaaaagcttttagcgtgcgttcatccctgattacacaccagcttatccacaccggcagaaagccatacaaatgcaaggagtgcgataaagtattcgggcgcaagtgttttcttacaagtcaccagaggattcacactcgtgagaggccatacggatgttctcaatgcggaaagatattttcacagaagtcagatctgatccgtcatcggaagacacacacagacgagaagccatacaaatgcaataagtgtgggaccgcttttagagaatttagcgacctgacagcacactttttgattcactccggagagaaaccctatgagtgtaaggagtgcggcaaggtgttcaggtacaaaagctccctgacatcccatcaccggattcacacgggcgagaagccctataaatgcaacagatgtggaaaagtttttagtagatcgagtaatcttgtgtgtcatcaaaagattcatactggcgagaagccatataaatgtaaccagtgtggcaaggtgttcaatcaagcttcttatctcacaaggcaccagattattcatacaggggaacgcccttatcgctgctccaagtgtggcaaggctttccgcggttgtagcgggctgacagcccacctggcgattcatacggagaaaaaatcacatgaatgtaaggagtgtggcaagatcttcacccagaagtcttccctgactaatcaccaccgtatacatattggagagaagccctataagtgcacgctgtgttcgaaggtgttttcccataattctgatctcgcgcagcatcagcgcgtccactcatag

SEQ ID NO: 14337 - DNA, 246 bp, Artificial Sequence
  Description of Artificial Sequence: Synthetic coding sequence
atggctctaactcagggccctcttaaatttatggacgtggcaatcgaattcagtcaggaagagtggaaatgtttagatcctgcgcagagaactttatacagggacgtgatgctggagaactacaggaatctcgtttcgcttggcatttgtttgccggatctgtcagtcacatctatgctggaacaaaagcgggacccttggactcttcagagtgaagaaaagatcgcgaacgacccggacggctag

SEQ ID NO: 14338 - DNA, 45 bp, Artificial Sequence
  Description of Artificial Sequence: Synthetic coding sequence
atggcgcttacccagggcccactgaagtttatggatgtggcctag

SEQ ID NO: 14339 - DNA, 1800 bp, Artificial Sequence
  Description of Artificial Sequence: Synthetic coding sequence
atggccgccgctctgagggcgcctacacagcaagtctttgtggctttcgaggacgtagccatctacttttcacaggaagagtgggagctgctcgacgaaatgcagcgcttgctgtaccgagacgttatgttagagaactttgcagtgatggcatcattgggctgttggtgcggggccgttgatgagggcactcctagcgcagaatcagtgtccgttgaggaattgtctcagggccggacccctaaagctgacacatccactgacaaaagccatccttgtgagatttgcacccctgttttgagagacatcctgcagatgatcgaacttcacgccagcccatgtggacagaaactctatctgggaggcgcctcaagagatttctggatgtccagcaatctgcaccagctgcagaaactcgacaatggtgaaaagctcttcaaagtcgacggggatcaggcttcattcatgatgaattgcagatttcatgtcagcggaaaaccatttacatttggtgaagtcgggagagatttctctgcgacctccggactgttacagcaccaggtaacacctacaattgagcgacctcatagcaggattaggcacctgagagtacctactggtcgtaagcctttaaagtacaccgaatctagaaagagctttcgcgagaaaagcgtgttcatccaacatcaaagagcagacagtggcgagagaccttataaatgtagcgagtgcggcaagagcttttcacagagtagcggattcctacgccaccgcaaggctcacggacggactcggacacatgagtgttcagaatgtggaaaaagtttcagcaggaagacacacctgacgcaacaccagagagtccacacgggtgagagaccgtatgactgttcagagtgcggcaagagcttccgtcaggtgtccgttctgatccagcatcaacgcgttcataccggggagagaccctacgagtgttccgaatgcggtaagagtttctcacactctactaacttatatcgtcacaggtctgcgcataccagcaccaggccctatgaatgcagtgaatgcggcaaaagcttctcacactcgacaaacctgttccggcactggcgtgtgcacacaggcgtcagaccttacgaatgttctgagtgcggcaaggcattcagctgcaatatttacttgattcatcaccagagattccacaccggcgaacgaccctacgtctgctctgagtgtggcaagagtttcggacagaagagtgtccttattcagcaccagcgggtgcatacaggcgaacgtccatacgagtgcagcgagtgcggaaaagtattttcccaatcaagtgggctatttaggcacagacgcgcccataccaagactaagccatacgaatgctctgagtgcgagaagagtttctcatgcaagacagatctcattaggcatcagaccgtgcacactggtgagcggccgtatgaatgcagcgtgtgcgggaagtcgttcattcgcaagactcacctgatcaggcatcaaaccgtgcatacgaatgagaggccttacgagtgtgatgaatgcgggaagtcctattcacagtcctctgccctgctgcaacataggagagttcacactggtgaacgaccgtatgagtgccgcgaatgcgggaagtcatttactaggaagaatcacctgattcagcacaaaacggtccacactggtgaacggccttacgaatgctccgagtgtggcaagagcttctctcagtcatctggacttctgcgtcatcgtagagtgcacgtgcaatag

SEQ ID NO: 14340 - DNA, 3906 bp, Artificial Sequence
  Description of Artificial Sequence: Synthetic coding sequence
atgaccatgggcgatatgaagacgcccgatttcgacgacctcctcgccgccttcgacatcccggatatggttgatcccaaggctgccatagagagtggacacgatgaccacgaatctcatatgaaacagaacgcccacggggaggacgacagccacgctccttcttcctcagacgtaggggtcagcgttattgttaagaacgtgcgaaatattgacagttctgaggggggcgagaaggacggacataatccaacaggaaatggcctgcataatgggtttctcaccgcatcgtccctcgatagctattccaaagatggcgcgaagagtcttaagggagatgtgccagcttccgaggttactttgaaggatagtaccttttctcaattctcacccatctccagcgccgaagaattcgatgacgacgagaaaatcgaggttgacgatccaccagataaagaggatatgcggtcttctttcaggtcaaacgtacttacgggatctgccccccagcaggattatgacaagctcaaagccctgggtggggaaaactctagcaagaccggattgagcacatccggcaacgtggagaagaataaagccgttaagcgagagactgaggcgagtagtataaacctttctgtctatgagcctttcaaggttcgcaaggctgaggataagctgaaggaaagcagtgacaaagtcctcgagaaccgagtccttgatggcaaacttagttccgaaaagaacgatacgtccctgcctagtgtagcgcccagcaaaactaagtcatcatccaagctcagttcctgtatcgcagccatagccgccctgagcgccaaaaaggccgccagcgattcttgtaaagaaccagtggccaactccagagagtcaagccctcttcccaaagaggtgaacgattccccgagagcggcggataaatctccagaatctcagaacctcattgacggtacaaagaagccgtcgttgaagcagccagattctccccgctccatctctagtgaaaactcatctaaagggagtccctcatctccagcaggcagcactccagcaatccctaaagttcgtattaaaactatcaagactagcagcggagaaatcaagaggactgttacacgcgtgctcccagaggtagatctcgactccggaaaaaagccgtcagagcagaccgcatcagtcatggcaagtgtcacctcccttctgtcctcgcctgcatccgcggccgtgcttagcagtccaccacgggcgccactgcagagcgccgtcgtgacaaacgctgtgtccccagcagagctaaccccaaaacaggtgacaattaagccggtcgccactgcattcctacctgtctcagcagttaagaccgccgggtctcaggtgataaatctgaaactcgccaacaacacgactgtgaaagccaccgtgatttctgccgcaagtgttcagtcagcctcttcagccatcatcaaggccgccaacgccatacagcaacagacagtggtggtgcccgcttccagcctagctaatgccaagctggtcccaaagaccgtacacctcgctaatttgaatctcctcccacaaggtgcccaggctacgagcgagctccgccaagttctgacaaagccccaacaacagataaagcaagcgattatcaacgctgcggcaagccagccaccaaagaaggtgagccgcgtgcaggtggtgtctagtctccagagttccgtggtcgaggcctttaacaaagttctgagctccgtcaatccagtgcctgtctacatccccaacttgagccctccggccaacgccgggataacacttccaacacgaggctataaatgtctggagtgcggcgattcttttgctctcgaaaaatcattaacacagcattacgatcggagatccgtgaggatcgaggtcacctgcaatcattgtacaaagaacctggtgttttataataagtgcagtcttctgtcccatgcccggggccacaaagagaaaggggttgtgatgcagtgctcacaccttatcttgaaaccagtccctgccgatcaaatgatcgtgtccccatctagcaacacaagtacaagtacaagtactttgcaatcccccgtcggcgcagggacccacaccgtcacgaagatacagtccgggatcacaggcacggtgatcagcgccccctccagcacccctattactccggcgatgcccttggatgaggacccctctaagctctgcagacacagtctgaaatgtttggaatgtaatgaggtcttccaggacgagaccagtctggccactcactttcagcaggcggctgatacctcaggccaaaaaacgtgcactatctgccagatgctgctgccaaaccaatgtagctatgctagtcaccagagaattcatcagcacaagagcccttacacatgccccgaatgtggagccatctgtcgaagtgtacactttcagactcacgtcactaaaaactgtcttcattacacaagaagggtgggttttcgatgtgtgcactgtaacgtggtatacagcgacgtcgcagccctgaagtctcacatccagggatctcattgcgaagtgttctacaaatgccctatctgccccatggccttcaaatcagcgccatcaacccactcccatgcttatactcagcatcccggaatcaaaatcggagagcccaagatcatctacaagtgttccatgtgtgacactgtgtttactctgcaaacactcctctatcggcattttgatcagcatattgagaatcagaaagtgtccgtgtttaaatgcccagactgttctcttctgtacgcacagaagcagctgatgatggatcacattaaaagcatgcatggtacacttaagtctatagaaggaccacccaacctcggcattaatctgcctctgtcaattaagcccgctactcagaattcggcaaaccagaataaggaagatactaagtctatgaatggtaaagagaaacttgagaaaaagagtcccagtcctgtgaagaagtctatggagacaaaaaaggtcgcatcgccaggctggacatgttgggagtgtgactgtctcttcatgcagcgagatgtctacatctcccacgtgcgaaaggagcatggaaagcagatgaaaaaacacccctgccggcagtgcgacaagtcattttcctctagtcattctctttgccggcacaacaggatcaaacacaaagggattagaaaggtgtacgcgtgctcacattgtcccgactcaagaaggacttttacaaagaggcttatgctcgagaaacatgtgcagttgatgcatggaatcaaggacccggacctgaaggaaatgaccgacgctacgaatgaagaagagacagagatcaaggaggacactaaggttccctcccctaagaggaaattagaagagcccgttctggagttccgccctcccaggggcgcaataacccagcccttgaagaagttaaaaatcaacgtctttaaggtgcacaagtgcgcagtctgcggattcacaactgagaatctgctgcaattccacgaacacatcccgcagcacaaatctgacggttcatcctatcagtgcagggagtgcgggctgtgttacactagccatgtctccctgagtaggcatctgtttatcgtccacaagctcaaggagcctcagccagtcagcaaacagaatggagcgggagaagacaaccagcaggaaaataaacctagccatgaggacgaatctcctgatggagccgtttccgaccgcaaatgtaaggtctgtgcaaaaacctttgaaaccgaagctgcgctgaacactcacatgcgaacccacggtatggcctttatcaaaagcaagagaatgagttctgcagaaaagtag

SEQ ID NO: 14341 - DNA, 582 bp, Artificial Sequence
  Description of Artificial Sequence: Synthetic coding sequence
atggcgttaacacaagggcagctaagcttcagtgatgttgccattgagttcagtcaggaagagtggaaatgtctggacccagggcaaaaggctctgtatagggatgtcatgttggaaaattaccgaaacctggtttccttaggtatatgcctcccagatctgtcagtgacctccatgcttgagcagaaaagagacccctggaccctgcaatctgaagtcaagattattaataacccagacggcagggaatgtataaaaggagtgaacacagacttcagtctgctagcttgggatgccagagtgttcagggtggaggcctggcgtgcttctggaggggccgaggagccaaccggccctaattttgttggaaacgactctccactgccttctcctctggccctgctgccttttccaagcgtgtccgctagtctcggcgatgccaagagagcgcgccttaccgccgagggtcgtgggcatggcacccttagagccggccccgcccccaggcccagaagcgcagcgccccacgcacctgatgccgtgcagagatggccgcctgaacagcggctgcctcgcagttag

SEQ ID NO: 14342 - DNA, 2025 bp, Artificial Sequence
  Description of Artificial Sequence: Synthetic coding sequence
atggccttgacccagggccagctctcattttctgatgtcgccatagagttctctcaggaggaatggaaatgcttggatcctggacagaaagctttatatagggatgtgatgctcgagaattatagaaacttagtttccctcggggaggataacgtgaggccagaagcttgtatctgtagtgggatctgcttgccagacctgtcagtgacctctatgctggagcaaaagagggacccctggaccctccagtcagaagtgaaaattattaataaccccgatggacgggagtgcatcaagggggttaacaccgaaaaaagttcgaagctgggcagcagtgctggaaacaagagcttgaagaatcaacacggcctgacactgcagttgcacctgaccgagtggcagccatttcaggccgtcagaaatatctatggctgtaagcatgtggagaagagcatatcagacaacagcagcgtctccccagtccagatcagcttcttctccgttaagacccatatttttaacaactaccgaaacgacttcctcttctcaactctgctgcctcaagagcagaaagtccatatcagagagaagccatatggatgtaatgagcatggaaaggtgttccgtgtctcttcgtccctaacgaaccgccaggtgatccacatagccgacaaaacttataagtgtagcgactgtggagagatctttagctccaacagcaactttgcccagcaccagcgcatacacacaggggaaaaaccttacaaatacaatgaatgcggaaaagtctttaatcagaattcccacctggcccagcatcaaaagatccacacaggacagaagccctacaataacaaggaatgcggaaaagtcttttcccatcatgcttacctagcccagcatagaaaaatccacacaggcgaaaagccttataagtgctctgagtgtggaaaagcattctcagtctgctcgtcactgaccgcccacctggtcatacataccggtgagaaaccttacgattgcaaggaatgtggcaaggtgttcaggcacaaatctagcttaacaactcaccagacagtccacactggcgaacggccgtacaagtgtaatgaatgtggcaagggtttctcccggattgctttcctggctcggcatcgcaaggtgcacaccggggagaaaccttacaagtgcaatgaatgtggaaaagttttcatcggtaattcacggcttgcacgccatcgtaaaatccacacgggcggacgtagatacaagtgcaacgaatgtggaaaagcctttaggacgtgctctgatctgactgctcacctgctgatccacactggcgagaagccttacgaatgtatcgactgtggcaaagtattccgtcataagtcctctttgacataccactgtagaattcatacaggggagaaaccctacaagtgcaacgagtgcgggaaggtgttttcgcagaacagtaacctccaacgccaccgaaaaattcacaccggggagaaactgtataaatgtaacgagtgtggtaaggtattccgacagaactctcacctggcccaacatcgcgacatacacacaggcgaaaaaccctattcatgtaatgaatgtggaaaggtatttagaagaaactctcacctcgtcagacacagaaacgtgcacaccggtgagaagccgtattcatgcaatgaatgtggaaaagtattctcccgaaatagtcatctggcacggcatcgcaatatacacacaggcgagaagccacactcctgtaatgagtgtggcaaagtgttctcgcgaaattctcacttggcacggcatagaaaaatccacactggcgaaaagctgtacaagtgcaacgagtgctcaaaagtgttctcccggaacagtcgactggcccagcataggaacattcacactggagttaagccttacagctgcaacgagtgcggtaaggtgttctctaagaactccatcctcgttcagcactgcagtatccacaccagagaaaaaccctag

SEQ ID NO: 14343 - DNA, 2022 bp, Artificial Sequence
  Description of Artificial Sequence: Synthetic coding sequence
gtcttgaccactggccagctatcattctcagacgttgcgatagagtttagccaagaggagtggaaatgccttgaccctgggcagaaagctctatacagagacgtgatgctagagaattaccgcaacctcgtgtcactgggagaggacaacgttcggcccgaagcctgcatctgtagcggcatctgcctcccagatctctctgtgactagcatgttagagcagaagcgggacccctggaccttacagagtgaggtgaaaattatcaacaatccggatggtcgcgagtgtattaagggcgtgaatacagaaaagtcctctaagctgggatcatcagcaggaaacaaatcacttaagaaccagcatggtctcaccctgcaactgcatctgaccgagtggcagccattccaggctgtccgcaacatctacggatgcaagcacgtggagaagtccatcagcgataacagtagcgtgtccccggtgcagatctcttttttttccgttaaaactcacatattcaataattatcgcaatgatttcctcttcagtacattgctgccacaagaacaaaaggtgcatattagggagaagccttacggctgtaacgagcatggaaaggtgtttagggtctcctctagtctgaccaaccggcaggtcatacacattgcggacaagacatacaaatgtagcgactgcggagaaatattctcatcaaatagcaacttcgcccagcatcagaggatccacaccggagagaaaccgtacaaatacaacgagtgcggtaaggtttttaaccagaacagccacctcgctcagcatcagaaaatccatacaggccaaaagccttacaacaataaggaatgcggcaaggtgttcagccaccacgcatacctcgcccaacatagaaagattcatactggggagaagccttacaaatgttcagagtgcggcaaggcattctctgtgtgttcttctctaaccgctcacctggttattcataccggcgagaaaccatacgactgcaaggagtgtggaaaggtgttccgacacaagagcagtttgacaacacatcagacagtgcacactggcgagcgaccctataagtgcaacgaatgtggcaagggattctcccgcattgctttcttagcaaggcaccgtaaagtgcacaccggtgagaagccctataaatgtaacgaatgcgggaaagtgttcatcggtaattctcgccttgcgcgccaccggaaaatccacacgggcggacgcaggtacaaatgcaacgagtgtggcaaggcttttcgcacatgctccgacctaaccgctcacctccttattcacaccggagagaagccctatgagtgcattgactgtggaaaggtattcagacacaaatcctctctgacgtatcattgtagaattcacaccggtgagaagccatataagtgtaacgagtgtgggaaagtattttcgcagaacagtaacctgcaaaggcacagaaagatccatacgggagaaaagttatacaagtgtaacgagtgcgggaaagtatttaggcagaactcccatctcgcacagcaccgggacatacataccggcgagaagccctatagctgtaatgagtgcgggaaagtgtttcgacgaaatagtcatttggttcgacacaggaatgtgcacacaggtgagaagccatacagttgtaacgagtgtggaaaagtcttctcacgcaattcccatctcgcgcgccaccgtaatatccacaccggtgagaagccccattcctgcaatgagtgtggcaaggtgttcagccgaaattctcacctggcgcgccaccgcaaaatccacactggcgaaaagctgtataagtgcaatgagtgcagcaaagtgttctcaagaaattcacgtctggcgcagcatcgcaacatccacaccggagtgaagccatactcttgcaatgagtgtggaaaagtgttttcgaagaacagcatacttgtgcagcactgcagcatccatacccgcgaaaagccttag

SEQ ID NO: 14344 - DNA, 453 bp, Artificial Sequence
  Description of Artificial Sequence: Synthetic coding sequence
atggctctgacacaaggacagttatcattttctgatgtagccatcgagtttagccaagaggaatggaaatgcctcgacccaggacaaaaggctctttaccgagatgtgatgcttgaaaattatcgtaatctggtctccctcgacttctctctgctggcctgggatgcacgcgtgttcagggtggaggcctggagggcaagtggtggggctgaggaaccaaccggcccgaacttcgtggggaatgattctcccctgccctcccccctagcactgctgcccttcccctcggtgagtgcctccttgggtgatgcaaagcgagcgcgactgacggctgaaggaaggggccacggaaccctgcgagcgggaccagctcctaggccccggtcagcggctccacacgcccctgacgctgtccagagatggcccccagagcaacggctccctagatcctag

SEQ ID NO: 14345 - DNA, 1986 bp, Artificial Sequence
  Description of Artificial Sequence: Synthetic coding sequence
atggcactgactcaaggccagctgtcattctcggatgtcgctattgagttttctcaagaagagtggaaatgccttgatccgggacagaaggcactgtacagggatgtgatgcttgagaactataggaaccttgtttcattaggtatctgtcttccagatctgagcgtcacctccatgctggaacagaagcgagacccttggacacttcagtctgaggtcaagattattaataatccggacgggcgtgagtgcattaagggtgtgaatacagaaaagagtagcaaacttgggtctagtgccggaaacaagagcctcaaaaaccaacacggtctcaccctacagcttcatctgactgaatggcagccattccaagcggtgagaaacatttatggctgtaaacatgtggaaaagagtatatctgataacagctctgttagccccgtccaaatcagtttctttagcgtaaaaacacacatctttaataactaccggaacgacttcctgttttccactctcttgccccaggaacaaaaggtgcacataagggaaaaaccatatggctgtaacgagcacgggaaggtatttcgggtttccagttcgttgaccaatcgacaggtgattcacatagccgacaaaacctacaagtgttctgactgcggtgagatatttagctccaatagtaactttgctcaacatcagaggatccacaccggagagaaaccttataaatacaatgagtgtgggaaggtcttcaaccagaattctcatctggcacagcatcagaagatccacacaggacagaagccctacaacaataaagagtgcggtaaggtgttctctcaccatgcctacctggcccagcatagaaaaatccacaccggggagaagccatataaatgttccgagtgcgggaaggccttttccgtgtgctcaagtcttacagcacatctcgtgatccatacgggagaaaagccctatgactgtaaggaatgtggtaaagtcttccgacacaaaagctctctcaccacacaccagacagtacacaccggagaacggccatacaagtgcaacgaatgtggaaaaggattcagccggatcgcttttctcgccaggcacagaaaagtccacactggggagaaaccctataaatgtaacgagtgtggcaaggtgttcattgggaacagtcggctggctaggcaccgaaaaattcacacagggggccgtagatataagtgcaacgagtgcggcaaagcttttcgtacttgcagcgacctcacggcccacctgttgatacacaccggtgaaaagccctacgaatgtatagactgcgggaaggtctttcggcacaagtcgtccctcacttatcattgccggatacacacaggagagaaaccttacaagtgtaacgagtgcggaaaggttttttcccaaaatagcaatctgcagcgacacaggaaaattcatactggagagaagctatataaatgtaacgagtgcggcaaggtatttagacagaatagccatctggcccaacacagggacatccatacaggagagaaaccctacagctgcaacgaatgtggaaaggtgttccggcgcaactctcaccttgtgagacatcgaaacgtgcataccggggagaagccgtattcctgtaatgagtgcggtaaggttttcagtagaaattcccacctggctagacataggaacattcacactggcgaaaaaccccactcttgcaatgaatgcggtaaagtgttctcccggaactcccacctcgcacggcaccggaaaatccacactggcgaaaaactgtacaaatgtaacgaatgctccaaagtattttcaaggaactcccgcctggcacagcacaggaatatccacaccggagtgaagccttattcttgtaatgagtgcggaaaagtgttcagcaaaaactccattctcgtacaacattgttcaatacacaccagagagaagccatag

SEQ ID NO: 14346 - DNA, 3903 bp, Artificial Sequence
  Description of Artificial Sequence: Synthetic coding sequence
atggaggaggctagtttgtgccttggggtgagctctgccgagcccgaagccgaaccgcacctgtccggaccagtgctcaatggacagtatgctatgagccaaaaactccaccaaatcacctcccagctctcgcatgccttccccgaactccatcctcgaccaaatccagaggaaaagcctcccgcctcgcttgaagaaaaagcccatgtccctatgtctggacagcctatgggatctcagatggctctactggccaatcagctcggcagggaggtggacaccagcctgaacggtcgcgtggacctccagcagtttctaaacgggcagaaccttggaatcatgtcccagatgagcgacatcgaagacgatgccagaaagaacaggaagtacccttgccctctttgtggaaagcggttcaggtttaactctattctgagcttacatatgagaacacacaccggcgaaaaaccattcaagtgtccatactgcgaccatcgcgctgcacaaaaagggaacttaaaaatccacctgcggacacacaagctgggcaacttgggcaaaggtcggggacgggtgcgggaggagaaccggctgcttcacgaactagaagaaagggcaattctacgcgataaacaactgaagggttcccttcttcagccaagaccagatctgaaacccccgcctcatgcgcaacaggcaccactggccgcatgcacattggctttgcaagcaaatcactccgtgccagatgtggcacatcctgtgcctagccctaaacctgccagtgtccaggaggacgccgtggcgccggcggcgggatttagatgtacattctgcaagggaaagtttaaaaagagagaagagctggaccgtcacataagaattttacacaagccttacaagtgtacactgtgcgatttcgccgctagtcaggaggaggagttgatcagtcacgttgagaaagctcacatcacggcagaatctgctcaaggccagggacccaacggaggcggagaacaatcagcgaatgagttccgttgtgaagtgtgcggtcaggtgtttagtcaggcctggttcttgaaaggacacatgcggaaacacaaagattccttcgaacactgttgccagatctgcggccggcgctttaaagaaccctggttcctgaaaaaccacatgaaagtccatctgaataaactttctgtgaagaataagtctccgtccgatccggaagtgccagtccccatgggcgggatgagccaggaggcgcatgctaacctttactcacggtacctaagttgtctccagtctgggtttatgacacctgataaggcgggattgagcgaacccagccagttatacggcaagggcgagttaccgatgaaggaaaaagaggccttgggtaagttgctgtctcccatctcctctatggctcatggcgttccagagggggacaagcatagtttactcgggtgtctgaatctggtgccaccactgaagtccagctgtatcgaaaggcttcaggccgctgcgaaagccgcggagatggaccccgtcaatagttaccaggcgtggcagctgatggcccgtggcatggcgatggagcacggttttttgtcaaaagagcaccctctccagcggaaccacgaagatacgctagccaatgctggagtgctattcgataaggagaagagggagtacgtgctcgtcggggctgacgggtcaaaacaaaaaatgcctgccgatcttgttcactctacaaaagtaggaagccagcgcgatctgccatcaaagctggatcctctcgagtcttctcgggattttctgagccacggcctcaaccagaccctagagtacaacttgcagggacccgggaacatgaaagaaaaacctaccgaatgtccagactgtggcagggtttttcggacctaccatcaggtggtggtacatagcagagtgcacaagagggaccgaaagggcgaagaagatgggctgcacgtgggcctcgacgagcgacgtggtagtggttctgaccaggaatcccaatctgtgtcccgtagtaccactccaggctcttctaatgttaccgaggagagcggggtgggcggcggactgagccagactgggtccgctcaggaggactcacctcatccttcaagcccatcttcttcggatatcggtgaagaagcgggtcgttcagccggggtgcagcagccggccctgctcagagacaggtccctgggctctgccatgaaggactgtccctactgcggaaagacttttcggacatcgcatcatctcaaggtgcacttgaggatacataccggggagaagccctacaaatgcccccattgtgactacgctggtacccagagcgcctctttgaaatatcacctagaacgccatcatcgtgagcgtcagaacggagccgggcctctgtctgggcagccccctaaccaagatcacaaggatgagatgtcctctaaagcatcacttttcatccggccagatattctcaggggagcttttaagggactgcccggcattgacttccgaggcggcccggcctcccagcagtggacatccggagtgctaagctccggggatcactctggccaggccacaggcatgagttcagaggtaccctccgacgcgctcaaaggaaccgaccttccgtcaaagtccacccatttcagcgagattggacgtgcctaccagagcatcgtgagcaacggcgtgaacttccaaggatcattacaggcattcatggattccttcgtgctgagttcactgaagaaagaaaaagatatgaaggacaaggccctggccgatcccccatctatgaaggtccatggtgtggatgggggagaggagaaaccatcaggcaagagcagtcagcgcaagtccgagaaatcccaatacgagcctttggatttaagcgtcaggcctgatgccgccagccttcccgggtcgtctgtcacggtgcaggactcaattgcctggcatggatgtcttttctgcgcgtttaccacctcttcaatggaacttatggcactccacttgcaggctaaccatctggggaaggctaagcgcaaagacaatacaatcggagtgaccgtgaactgtaaggatcaggctagagaagcgtctaaaatggccctcctgccatctctgcaatccaataaagacttaggcctgtctaatatgatatcctctctggatagtgccagtgaaaaaatggcccagggtcagctcaaagagacactgggagagcagaagtctggcgcttggacaggccacgtggacccagcattctgtaatttcccgagcgatttctataaacagttcggcgtctaccccggaatggtggggtccggcgcctcatcaagctgccctaacaaggagccagacggaaaggcacattcagaggaagacgttccgattctgatccccgagaccaccagcaagaacacaaccgatgacctttctgacattgctagttccgaagatatggactcaagtaaaggcgaaaacaacgacgaggaagatgtggagactgaaccagaaatgatgaccaagcccctctctgcactgtccaaagactcatcaagcgatggaggagacagtctgcagcctacaggcacctctcagcctgtccaggggctcgtctctccactgtctcaggctccagagaagcagtggcattcccagggtctcctgcaggcccaggatccgttggcaggcctgccaaagcctgagcgggggcctcagtccctggataagccgatgaacatgctctctgtcttaagagcttattccagcgatggattagccgcattcaatggtcttgcttcatcaactgcaaatagcggatgtatcaagcgacctgacctttgcgggaagtag

SEQ ID NO: 14347 - DNA, 4098 bp, Artificial Sequence
  Description of Artificial Sequence: Synthetic coding sequence
atggaccagtattccttgggagacgagggagccttgcccagcgagatgcacctgccatcattctcagagagtcaaggcctgaattgcagtgacacactgaatagagacttaggccccaacacaaggggttttttgtatgcagggctaagtggcctcgatcccgacccttctctgccaacacctgatatgagcagcgaggtgttggaggataatttagataccctgtccctgtactcaggcaaggactcagactccgttaagctcttagaagagtatgccgactccgaaagccaagcctccttgcaggatctcgggttgggcgtcctgaaggccaaggaagcggacgagggcggccgggccaccagcggatctgcacggaagggaaagagacagcacagttctccccaaaatccactgctggactgctccctttgtggaaaggttttctccagtgcctcaagcctgtctaaacattatctcacccactcacaagagagaaagcacgtatgcaagatatgctcgaaagcgtttaagagacaggaccacctaactggccatatgttaacacaccagaaaaccaagcctttcgtgtgtattgagcagggctgcagcaaatcatactgcgattaccgttccttgcgtaggcactatgaggtgcatcacggtttatgtattttgaaggaagcaccgcccgaggaggaagcgtgtggggactcccctcacgctcacgagtccgcaggccagcccccacccagtagcctccggagtttggtcccccccgaagctagaagtcccggttccttacttccacatagagatctgctacgacgcatagtgtcatccatagtacaccaaaagaccccctctccaggcccagctccggctggggcaagtgacagtgagggtaggaataccgcctgcccgtgtcccgcatcctccggaagcagcagctgcacaccagcgggaccacatgctgctcctgcagctctggacaccgaacttcctgaggagccctgcctgccccagaaagaacccgcgaccgacgtattcacagccccaaattcccgggcggccgagaacggcgctccagatccacccgaacctgagccagacacggccctgttgcaggcccgctccacagccgagtgctggcccgaagggggcagcgttcctgcttgcctgcccctgtttcggggtcagacagttcctgcatcttcgcagccttcaagtcactccttccaatggctgaggaacctccccggttgcccaaaatctaaggggaataacgtcttcgtagtgcacaagccctccgccgtgcctagtagagaaggctccgaatctggccccggaccatcttcaggctcgccatcagaggagagtccgccgggaccgggggggggacttgaggacgcacttccattccctgctgccctcctgcgagtaccagcagaggcccccagcgatccccgtagtgctagcggcgaggacgacccctgcgcacctaagaaggtgaaagtagactgtgactccttcctctgccagaaccctggagaaccggggctgcaagaagcccagaaggcggggggtttaccagccgacgcatccccattgtttcggcagttgttccttaagtcacaggaacctctggtaagccacgagcagatgcaggttttccagatgatcaccaaaagtcagaggatctttagtcacgctcaagtggctgccgtctcatcccagctcccagcacctgagggcaagccggctgccctccgtccattgcagggtccctggccacagcaacctccgcccctagcacccgccgtggactcccttcacgctggaccaggaaatcccgaagcggagggcagccctgcaagacggcggaaaacaacacctggcgtccctagggaagccagtcccggtagtacccggagagatgcaaagggagggttgaaggttgccgcagttccgaccccgctggcggccccaagcctggacccttcgcgtaaccctgacattagttccttggccaaacagctccgcagttctaaaggaactctggatctcgaggacatttttccttcaaccgggcagcggcagacccagctgggcggcgaagaacctcccggcgctagcttgccagggaagcaggccccagcagagaacggagccgcctcacgcatcacaaagggagaaaagggcccggcctgttcaaggggcggcggctacagactgctcggcaatccccgtgcaccccggttctctggctttcgcaaggagaaggcgaagatggacatgtgctgcgccgcgtctccatctcaagtggccatggcgagcttctcatctgccggtcctcccgctgatccttccaaatccaaactgacaatcttctcacggatccagggaggcaatatctatagactcccacacccggttaaggaagagaatgtggccgggcgtgggaaccagcagaacggaagtcctactgactggacgaaacctcggagtaccttcgtctgcaagaattgttctcagatgttctacaccgaaaagggcctctctagtcacatgtgcttccactctgatcagtggcctagccctagaggaaagcaggagccacaggtgtttggcacagaattttgtaaacccctcaggcaagtactgcgccctgaaggggatagacacagccctcccgggaccaagaagccactggatccaacagcagccgctcctctcgtggtgcctcaatcaatcccagtggtccctgtgacacgccatataggctccatggcgatgatggaatggtgtagtcgatggttacaggctaccacctgtggttccaaacttctgcaaggccaggagaaggatggcgaggagagagactcaaaggagagttcacagcagaggaaacgaaaaaagcggccgcctcccagcacagctggtgaacctggtcctgccggctgtcaccagagtagactgaggagcccgatgtttcttgttgattgcttgttgaaaggtttgtttcaatgttccccgtataccccgcctcctatgctgtcccctattcgggagggctcaggggtgtactttaatacactgtgctccacctcgactcaggcatctcccgatcagctaatttcgtccatgctggatcaggtcgacggatccttcgggatatgtgttgtgaaagatgacacgaagattagcattgaacctcacatcaacattggtagtaggtttcaagccgagattcccgagctgcaggaaagatccctggcgggaacagacgagcacgtggctagcctcgtttggaaaccctggggggacatgatgatctcgagcgaaacccaggatcgggtgacagaactctgtaacgtggcgtgcagctcagtgatgcctggaggcggcaccaacctggaattagctttacattgcctccacgaagcgcaggggaatgtccaggtggcactggaaactctgctgctgagaggcccccataagccgcggacacatctcctggctgactacagatacacagggtccgacgtgtggacgcctattgagaaaagactgttcaaaaaggcattttatgcccataaaaaagatttttacttgatccataagatgattcagaccaagacagtcgctcagtgtgtggagtactactacatttggaagaaaatgattaagtttgattgcggaagggcccccggcctggaaaagagagtaaaaagagaacctgaagaggtcgagcggacggaggaaaaggttccctgctcccctagagagaggccctcgcaccatcccacccccaaactaaagaccaagagctataggagagaatccatcctgtctagctctccaaacgctggatccaaaaggacccctgagttgttaggtagcgctgaatcacagggcatctttccatgccgagagtgcgagcgtgtgtttgacaagataaagagccggaacgctcatatgaagcgtcacaggctgcaggatcacgttgaacccattatccgggtgaagtggcctgtgaaaccttttcagctgaaagaagaggaacttggagcagacatcggacccctgcagtggtag

SEQ ID NO: 14348 - DNA, 3267 bp, Artificial Sequence
  Description of Artificial Sequence: Synthetic coding sequence
atggatcagtacagtctgggagacgaaggcgccttgccctccgagatgcatctcccgagctttagcgaatctcagggactgaattgctcggatacactgaacagagaccttggaccgaatactcgcggattcctctacgcgggcctcagtggactggatcccgacccctcccttccgacccctgatatgagctccgaggtgctcgaggacaatcttgacaccctgagtttatattctgggaaagattctgactcggtgaagttattggaggagtatgcggacagtgaatctcaggccagcttacaggatcttggactgggagtgctgaaggctaaggaagccgatgagggtggcagagccacaagcgggtccgcccgtaaaggaaaacgacagcactctagccctcagaatccattgctcgactgctccctgtgtggcaaagttttttcctctgcctcaagcctttctaagcactaccttacacactcccaggaacgtaagcatgtctgtaagatttgcagcaaagcttttaaacggcaagatcacctcacagggcatatgctgacacaccagaaaactaaacctttcgtctgcattgaacagggctgctcaaagtcctactgcgattaccggagtctacgtaggcattacgaagtgcaccatggtctgtgcattctgaaggaggcacctccagaagaagaagcgtgcggtgactcgcctcacgctcacgaatccgcaggacagcccccgccctcgtccctgagatctctcgtgccacctgaagcaagaagtcccggatccctgctgcctcaccgagacctccttcgacggattgtttcatctatcgttcatcaaaaaacaccttcccccggccctgcacctgctggcgcctcagacagcgaaggccgtaacaccgcttgcccatgcccagcgagttcaggttcctcttcttgcaccccggccggcccccacgcagctcccgccgctttggatacggaattgcctgaagagccttgtctgccgcaaaaagaacctgccacggatgtcttcacagccccaaattcccgtgccgctgagaacggcgcgcccgatcctccagagccggaaccagatactgccctactccaagcacgcagcactgctgaatgctggcccgagggtgggtccgttcctgcctgcctgccactgttccgagggcagaccgtgccagcttctagccaacctagctcgcactcattccaatggctgcggaacctgcctggatgtccgaagtcaaaaggcaacaacgtatttgttgttcataaacctagcgcggtcccctctcgggaaggaagtgagagcggccccgggcctagcagcggatcaccctccgaagagtcccctcctggccctggagggggacttgaagacgccttacccttccccgcggccttgctgagagtgcctgccgaagcaccatcagatccgaggagtgcatcaggtgaggatgatccttgcgcccctaagaaagtcaaggtggactgtgactcctttctctgccagaacccaggcgagcctggcttgcaagaggcccagaaggccggcggattgccagccgatgcaagtcccctgtttaggcagctatttttgaagtcacaggagccattggtttcccacgagcagatgcaggtgttccagatgattacaaagtcacagcgcatattcagtcatgcccaggttgcggcagtctcctcgcagctcccagcccctgaaggcaaaccagctgccctgaggccattacagggcccatggccccagcagcctcctccgctcgcaccagccgtcgacagtttacacgccggcccaggcaatcccgaggccgaaggttcgcctgcgagaaggaggaaaaccactccgggagtgcctagggaagctagcccggggtcaaccagaagagacgctaaaggcgggctcaaggtagcggcagtgcccacacccctggccgccccatcccttgacccatccagaaatcccgatattagctctctcgccaaacaattgcggagtagcaaaggaacactagatctggaagatattttccccagcaccgggcagcgccagacgcagcttggaggtgaagagcccccaggggccagcctaccgggaaaacaggcacccgccgagaacggagccgcttcaagaatcaccaagggcgagaaaggaccggcttgttctcgcggcgggggttacaggctgctgggaaacccccgggcaccgcgcttcagcgggttcaggaaggagaaggccaagatggacatgtgctgcgccgccagcccttcccaggtggccatggcttctttctcctcggcagggcctccggccgacccaagcaagagcaagctgacaatcttctcgcggattcagggtggaaacatctatcgactgccccaccccgtgaaggaggagaatgtcgccgggagaggtaatcagcaaaatggctcccccaccgattggacgaaacctaggagtacgtttgtctgcaagaactgcagtcaaatgttttatacggagaaaggcctgtcaagtcatatgtgtttccactccgatcagtggccatcaccgcgagggaaacaggaaccccaggtgttcggaacagagttttgtaagcctctgaggcaagtgctacgcccagaaggcgatcggcattcacccccaggaactaaaaagcctctagatccaacagctgcagcccctctagtcgtgccgcagagtattcctgtagtgcctgtgacaaggcatatcggttccatggctatgatccagacaaaaacggttgcccagtgtgtggagtactactacatctggaagaaaatgatcaagtttgattgtggtcgcgcccccggcctagaaaaaagagtgaagcgggaacctgaggaggttgagaggacagaggagaaggttccctgcagcccccgagagcgcccctctcaccaccccaccccaaaactgaaaacaaagtcctatcggcgtgaaagcattttgtctagctctccgaacgccgggagcaagcgcacccctgagcttctcgggtcagctgagagtcaaggcatcttcccctgccgggagtgcgaacgggtgttcgataaaatcaagagtcggaacgcgcatatgaagagacacagactgcaggaccacgttgagcccattattcgtgtgaagtggcccgtcaagcccttccagctgaaggaggaagagctgggtgcagacatcggaccattgcagtggtag

SEQ ID NO: 14349 - DNA, 1803 bp, Artificial Sequence
  Description of Artificial Sequence: Synthetic coding sequence
atggcagcctccgcccaggtcagtgtgactttcgaggatgtcgccgttaccttcacgcaggaagagtggggccagctagatgccgcccagcggactctgtatcaggaggtcatgctggagacctgtggattgctgatgtctctgggatgtccgttgttcaagcctgaattaatctatcagctggaccacagacaagaactctggatggcaaccaaagacctgagccaatcgtcttatcccggagataataccaagcccaaaacaaccgagccaaccttcagccatctcgccctccccgaggaagttttactccaagagcagttgactcaaggtgccagtaaaaatagccagctagggcagagtaaggatcaggatggcccttctgagatgcaggaggtccacttaaagatcggaattggtccccaacgcgggaaattgctggaaaagatgtcaagcgagcgagacgggctgggatctgacgatggcgtgtgcaccaaaataacccagaagcaggtatcaaccgaaggtgacctgtacgagtgtgactctcacggtcctgtgaccgacgctctgattcgcgaagaaaaaaatagctacaaatgtgaggagtgcggtaaagtgtttaaaaagaacgccctgctggtccagcacgagcgtatccatacgcaggtcaaaccttatgaatgcaccgagtgtggcaagaccttctcaaagagtacacacctgcttcagcaccttattattcacactggggagaaaccgtataagtgcatggaatgtggcaaagctttcaatcggcgctcacacttaaccagacatcagcggattcatagcggcgaaaagccctataagtgtagcgaatgtgggaaggcattcacccacagaagcactttcgtcctgcatcaccgatctcacacaggcgaaaaaccctttgtgtgtaaagagtgtggcaaagccttcagagatcggcccggattcatcagacactatataatccacaccggtgagaaaccctatgaatgtatcgagtgcgggaaggcatttaatcggcgtagctatttgacctggcaccagcagatccacaccggggtcaaaccatttgaatgcaacgaatgcggtaaggccttttgcgagtcggctgatttgatccagcactatattatccacactggcgagaagccatacaagtgcatggaatgtggcaaggcatttaatagacgctcacatctcaaacagcaccagcgcatccacactggggaaaaaccatacgagtgttctgaatgcgggaaagcgtttactcactgttccaccttcgtgctgcataaacgcactcacactggcgagaaaccctatgaatgcaaagaatgcgggaaggcgttttctgatcgcgcagatcttattagacacttctctatacataccggagagaaaccctatgaatgcgtcgagtgcggcaaagccttcaatcgcagctcccatctgacccgacaccagcagattcatactggtgagaagccatatgaatgcattcaatgtggcaaagccttctgccgctcagccaaccttatccggcattcaatcattcacacaggggagaagccatacgagtgctcagagtgtgggaaggcttttaacaggggttccagcttgactcatcaccagcgaatacacaccggaaggaacccgacgattgtgactgatgtgggccgcccgtttatgacggcccagactagcgtgaacatacaggagctgctgctgggaaaggaattcctgaacatcacgaccgaggaaaacctgtggtag

SEQ ID NO: 14350 - DNA, 2148 bp, Artificial Sequence
  Description of Artificial Sequence: Synthetic coding sequence
atggaggctagaagcatgctcgttccacctcaagccagtgtatgcttcgaggacgttgcaatggctttcactcaagaagaatgggagcaattagatctggcgcagcgtacgttatatagagaggttaccttggagacttgggagcacatagtatccctaggcctgttcctctcgaagtcagacgtgatctctcagctcgaacaagaggaggacctgtgcagggccgagcaggaggcccctagagactggaaagctacactggaggagaatagactgaactcagagaaagatagagcaagggaggagctctcccaccatgtcgaagtgtataggagcggccccgaagaacctccatctctcgtcctggggaaggtacaggaccaaagcaaccagctgcgcgagcatcaggagaattctctaagattcatggtattaactagcgaacggctttttgcacagcgtgagcactgtgagctggaactcgggggcggatactccttgccttcgactttgagtctgcttcctactactctgcctacgagtaccggctttcccaaaccaaatagtcaggttaaggaactgaaacagaattcagcatttattaatcacgaaaagaacggggccgacggcaaacattgtgagagccaccagtgtgctcgcgctttttgccagtctatatacttatctaaactgggaaatgtcgagaccggaaaaaaaaatccctacgagtacatcgtttcgggcgattcactgaattatggttcctcgttatgcttccatggaaggacattctccgtaaagaaaagtgacgattgtaaagactatggtaacctctttagtcattcagtgtcactgaacgaacagaagcctgtgcacttcggcaagtctcaatatgaatgcgatgagtgcagagaaacctgttcagaaagcctgtgtctggtacaaaccgagcgttccgggcctggagagacacctttccgctgcgaagaaaggtgcgctgcttttcccatggctagtagtttttcagactgcaatattatccagacaactgagaagccgtccgtgtgcaatcagtgtggcaagagcttctcatgctgcaagctcatccaccagaggacgcacacgggtgaaaagccattcgaatgcacccagtgtggcaaaagcttctcccagtcatatgatctggttatccaccagcggacccataccggggaaaagccgtacgagtgtgacctgtgtggcaagtccttcactcagaggagcaagctgatcacccaccagcgaattcatacaggggaaaagccctatcagtgtatcgaatgcaggaaatctttccggtggaatagcaacctgatcgtgcatcagaggattcatacaggagagaaaccttacgagtgtactcactgcgggaagtccttcagccagtcatacgaattggtcacacacaagcgcacccacaccggcgagaagccattcaaatgtacccagtgcgggaagtcattctcacagaagtacgatctagtggtgcaccaacggactcacactggcgaaaaaccatatgaatgcaacctgtgcgggaaaagcttcagccagagttccaagctgattacgcaccagcggattcataccggcgaaaaaccttatcagtgcatagagtgtggaaaaagtttcaggtggaactctaacctggtgatccatcagcgaatccataccggcgagaaaccttacgactgcacccactgcgggaaatcgttctctcaatcttatcagctggttgcccacaagcgtactcacaccggtgaaaaaccctacgaatgcaacgagtgcggcaaggcattcaatcgaagcacacaattgatacgacacttacagatccatactggtgaaaagccttacaaatgcaaccagtgtaataaagcctttgcaagaagcagttacttagtgatgcatcaacggacgcacacgggcgagaagcccttcgaatgtagccagtgtggtaaggccttctccggatcgagtaacttattgagccaccaccgaattcactctggggagaaaccttacgaatgctctgactgtggcaaaagctttagacaacagagccagttagtcgtgcatagacgaactcataccggcgagaagccctag

SEQ ID NO: 14351 - DNA, 321 bp, Artificial Sequence
  Description of Artificial Sequence: Synthetic coding sequence
atggaggccaggagcatgctggtgccaccacaggcgtcagtgtgcttcgaagatgtcgccatggccttcacccaagaggaatgggaacagctggatttggcacaaagaaccttgtacagggaggtcaccttggaaacctgggagcacattgtgtccctaggattgttcttgtccaagtcagacgttattagtcagctggagcaggaggaggacctgtgtagagcagagcaagaagctcccagggggacttccggcttatcccaggttaccggcgtggtagcagacgggagtttccgatttccggtttgggacttcacctag

SEQ ID NO: 14352 - DNA, 2064 bp, Artificial Sequence
  Description of Artificial Sequence: Synthetic coding sequence
atggaggctcgtagtatgctcgtcccgccacaggcatctgtgtgcttcgaggatgttgcaatggcttttacccaagaggaatgggaacagctggacttagcacagcgcactctctacagagaagtcacccttgaaacatgggaacacatcgtctccctcgactggaaagccactctcgaggagaacagactgaactcggagaaagacagagcccgggaggaactgagccaccatgtcgaagtgtatcgtagcggacccgaagagcccccctctttagtgcttggaaaggttcaggatcagtctaaccagttacgcgagcatcaggagaattccttacgattcatggttctcactagcgagaggctcttcgcccagcgcgagcactgtgagctagagctgggaggggggtattctctcccatcgacgttatctctgttgcccaccacactgcccaccagtacaggcttcccaaagcctaactcacaagtgaaagagttaaagcagaactcggcctttatcaatcacgaaaagaacggcgcagatggtaagcactgcgagtcacaccagtgcgcaagagccttttgccagtccatctacctcagtaaattaggcaatgtagagaccggcaagaaaaacccttacgaatacatcgtgtccggagatagtctcaattacggatcttccttgtgttttcacgggcgcaccttctccgtgaagaaatctgatgattgcaaagattacggaaacctcttctcacatagtgtgtctctcaatgaacaaaaacccgtccatttcggcaagtctcaatatgaatgcgatgaatgcagagagacttgcagcgaatctctgtgcctagtgcagacagagagaagtgggcctggagaaacacctttccggtgcgaagaaaggtgcgccgcatttcccatggcttcctctttctccgactgtaacataatccagactaccgaaaagccatccgtctgcaaccagtgcggtaagtcttttagttgttgcaaattaatccaccagcgtacccacacgggggaaaaacctttcgaatgcactcagtgtgggaagagtttttcacaaagctacgacttggtgatccatcagaggactcataccggcgaaaaaccttatgagtgcgacctctgcgggaaatcctttacacaacggtccaagctgatcacccatcagaggattcacacaggtgagaaaccctatcaatgcattgagtgtagaaagtcctttcggtggaattcaaacctcatcgtccaccagagaatccataccggcgagaaaccttacgagtgcacccactgcggaaaaagtttctcccagtcttatgagctggtgacccataagcgcactcatacaggcgaaaaaccattcaagtgtacacagtgcggaaagagcttcagtcagaaatacgatctggtggtacaccaaaggacgcatactggcgagaaaccatatgagtgcaatttgtgcggcaaatcattctcacagagtagcaagttgatcactcatcagagaattcacaccggcgagaaaccttatcaatgcatagagtgtggcaagagcttccgatggaattccaacttggtcatccatcagcgcattcatacaggagagaagccgtacgattgtactcactgcgggaaatccttttcgcagtcctaccagctggttgcccacaaacgaacgcacaccggcgagaaaccctacgagtgcaacgaatgtggaaaagcctttaaccgctcgactcaacttataagacaccttcagatccacacaggagagaaaccctacaaatgcaaccagtgcaacaaggcttttgctagaagcagctatttagtgatgcaccaacggacacataccggggaaaagcccttcgagtgttcccagtgtggcaaggcattcagcggaagttctaatctgctgagccaccatcggatccactcaggagaaaaaccctatgaatgtagtgactgtggtaaaagctttcggcagcaatcacagcttgtggtacaccgccgaactcacaccggggagaagccatag

SEQ ID NO: 14353 - DNA, 804 bp, Artificial Sequence
  Description of Artificial Sequence: Synthetic coding sequence
atggcttctagcttctcggactgtaacattattcaaacaacagaaaaacctagtgtgtgcaaccaatgtggaaagagtttctcttgttgcaagttgattcatcagaggacccatactggagaaaagccctttgaatgcactcagtgcggcaaaagtttctctcagtcctatgacctcgtaatccaccagaggacccacacgggtgagaagccctatgaatgcgacctgtgtggtaagtctttcacccagaggagcaagctaatcacccaccagaggattcatactggagagaaaccctaccagtgtatcgaatgccgcaagagctttcggtggaacagcaatctgatcgtgcatcagaggattcacacgggagaaaagccatacgaatgtactcactgtggcaagagctttagccaatcctatgaactcgtggcccataagagaacacacaccggcgagaaaccttacgagtgtaatgaatgcggaaaagcttttaacaggtcaacacagctcatcaggcatttgcagatccacacaggggaaaaaccctacaaatgcaaccaatgtaacaaggcttttgccagatcatcttacctggtgatgcatcagcgcacgcataccggcgagaagccatttgagtgtagtcaatgcggtaaggcttttagtggcagcagcaatctgctgtcccatcatcggattcactccggggagaaaccctacgaatgttccgactgcggcaaaagctttcggcaacagtcccagttggtggtgcatcgacggactcacactggggaaaagccttag

SEQ ID NO: 14354 - DNA, 2511 bp, Artificial Sequence
  Description of Artificial Sequence: Synthetic coding sequence
atgcaggttgacccgcccctgcatggccctccaaacgactttctgatattccagatcattccactgcactctctaagcataatgcccagatttttgtggatactgtgtttttccatggaggaaacgcagggtgagttaacctcatcttgcggcagcaagaccatggccaatgtttctctcgcgtttcgggacgtgtcaatcgatctttctcaggaggagtgggaatgtctggatgcagttcagcgcgacttgtataaggacgtaatgctggagaactactctaatctggtgagccttggctacaccatacccaagcccgacgtgattacactgctggaacaggaaaaggagccgtggatagtcatgagggagggcacccgcaactggtttacagatctggaatacaaatatattacaaaaaacctcctctccgagaagaacgtctgcaaaatctacctttcacagttgcagaccggcgagaagagtaagaatactatccacgaagacacaatcttcaggaacgggctccagtgcaaacatgagttcgagcgtcaggaaaggcatcagatggggtgcgtcagccagatgctgatacaaaagcagattagtcacccacttcaccctaaaatccatgccagggaaaaatcctacgaatgtaaagagtgccggaaggcatttagacagcagtcctacctcattcagcatctcagaatccacactggagagcgaccctacaagtgcatggaatgtggaaaagctttctgtcgggtgggggacctaagagtgcaccatacaatccacgcgggggaacggccttacgagtgtaaagaatgcgggaaagcgtttcgtctgcactatcatctgactgagcatcagcgtatccacagcggcgtaaaaccatatgaatgcaaggagtgtggaaaggccttttctcgggtgcgagatctgcgagtacaccagactattcatgcaggggagagaccatatgagtgtaaagaatgcgggaaggctttccgcttgcactaccagctgacagagcaccagcgcattcatactggtgaacgaccatacgagtgcaaggtgtgcgggaagacattcagagtccagagacatatctcacaacaccagaagatccataccggggtgaaaccttacaagtgtaacgagtgtgggaaggccttcagccacgggagttacctcgttcagcatcagaagattcatacaggggagaagccctatgagtgtaaggaatgtggtaagagtttctctttccacgctgaactggctcgtcatagacggatccacactggggaaaagccgtatgaatgtcgggaatgcggaaaggcattccgactccagactgagctcactaggcatcatcgcacccacacaggagaaaaaccctacgagtgcaaggagtgcgggaaagctttcatctgtggctaccaactgaccttgcacttacgtacacacaccggagagatcccgtatgaatgtaaagagtgcggcaaaaccttcagttccagatatcatctaacacaacattatcgcattcacacaggcgagaaaccatacatatgcaacgagtgtggcaaggctttcagactgcagggggaactgacacggcatcatagaattcacacctgcgagaagccatacgaatgtaaagagtgcgggaaggcgtttattcactctaatcagttcatttcccatcagcgcatccacacttcagagtcaacctatatctgtaaggagtgcggcaaaatattcagtcgcagatataatttgacacagcatttcaagatccacacgggagagaaaccctacatctgcaacgagtgtggcaaagcttttcgattccagaccgagctgacccagcaccaccggatacatacaggagaaaaaccttataagtgtaccgaatgtgggaaggcctttatcaggagtacgcacttgactcagcaccatcgaatccacaccggtgagaagccgtacgagtgcacagagtgcggaaagaccttttcacgacactatcatctgacccagcatcacagggggcacactggggagaagccttacatttgtaacgagtgcggcaacgctttcatatgttcatacaggctcacgctgcatcagaggatccataccggcgagctgccttacgaatgcaaggagtgcggtaagactttctcccggcgctatcatttaacgcaacatttcagacttcataccggagagaaaccatattcctgtaaagagtgcggcaatgccttcagactacaggcggagctgacaagacaccacattgtgcatacaggagagaaaccatataagtgcaaggagtgcgggaaagcattcagcgtgaactcagaactcacaaggcaccatcggatacacacaggcgaaaagccctaccaatgcaaggaatgtggaaaggctttcatcagatctgaccagctgacactgcaccaaaggaaccacattagtgaggaggtcctgtgtatcatgtag

SEQ ID NO: 14355 - DNA, 1344 bp, Artificial Sequence
  Description of Artificial Sequence: Synthetic coding sequence
aagaccttcagagtacagcgacatatttcccagcatcagaagatacatacaggtgtgaaaccttacaagtgcaacgaatgtgggaaggcttttagccatgggtcatatcttgtgcagcatcagaaaatacatactggagaaaaaccctacgaatgcaaggaatgtgggaagtcgtttagtttccacgctgagttggcgcgacatcgaagaatccacacaggcgaaaaaccatatgaatgccgggagtgtggcaaggctttccgcctgcagaccgagctgactcgacatcataggacacatacgggtgaaaagccatacgaatgtaaagagtgcggtaaggctttcatttgcggataccagctgactctgcatttacggacccacaccggagaaatcccgtatgaatgtaaagagtgcggcaagaccttttcttccagataccacctcacccagcactataggattcacactggcgagaagccgtacgagtgcaaggaatgcggcaaagcattcatccactcaaaccagtttataagtcaccagcgcattcacacaagtgaaagtacctatatttgtaaggaatgtgggaaaatattctctcggagatataacctcacacagcattttaaaattcacacaggcgagaaaccctacatctgtaacgagtgcggaaaagccttccggttccaaacagagttgactcagcatcacagaatccatactggagaaaagccctacaaatgtacagagtgtgggaaagcctttattcgcagcacccacctgacccagcatcatagaatacacacgggtgagaagccatacgagtgtactgaatgtgggaagactttctctcggcattaccacctcacacaacaccaccggggacatactggtgaaaagccctacatatgtaacgaatgtgggaacgcgtttatatgctcgtatagactgacccttcaccagcgtatccacaccggcgagttaccctacgagtgtaaggaatgcgggaagacatttagccgcagataccatcttacgcagcacttcagactccacactggagagaaaccatactcctgcaaggaatgtgggaacgccttccgacttcaggctgaactcacgagacaccacattgtccataccggggagaagccctataaatgtaaggaatgtggcaaagctttctctgtgaactcagaactgacacggcaccacaggatccataccggggagaaaccctaccagtgcaaggaatgtggtaaggctttcatcagatcggaccagctaacgctccaccaaaggaatcacatatctgatagggagttcgtgatttgtaaagagtag

SEQ ID NO: 14356 - DNA, 1209 bp, Artificial Sequence
  Description of Artificial Sequence: Synthetic coding sequence
atggccgaaatgaaccctgcccagggccatgtagtatttgaggatgtcgcaatctatttctcccaggaagaatggggtcaccttgacgaagcacagagactactctaccgtgacgtcatgttggaaaacttagcgctcttatctagtttgggctgttgccatggggccgaggacgaagaggcgcccttagagcctggggtgagcgtgggagtatctcaagtgatggccccaaagccatgcctttctacacagaacacacagccctgcgagacatgcagctccctgcttaaagatattctgaggctggcggagcatgatggcactcatccagagcaaggtctatatacgtgcccggctcacctgcaccagcatcagaaggaacagattagagagaaactgtcccgtggagatgggggaaggccgacgttcgtgaaaaaccaccgcgtccacatggcaggcaagacgttcctgtgttccgagtgcggcaaggccttcagccacaagcataagctgtctgaccatcaaaaaatccacacaggcgaacgcacctacaaatgctctaagtgcggtatactctttatggaaagatccacgctaaaccgtcatcaaagaacccatactggggaacggccttacgagtgcaacgagtgcggaaaggcatttctctgtaaatcacatctggtccgccaccagaccatccatagcggcgagcgtccatatgaatgtagcgagtgcggtaagttattcatgtggtcgtccaccctgattacacaccaacgggtgcataccggcaagcggccttatggctgctctgagtgtggaaagttcttcaagtgcaactctaatctgttcagacactacagaatacataccggtaaacggtcctacggctgtagcgaatgcggaaagttctttatggaaagaagtactctcagccgtcaccagagagtgcatactggggaaaggccatatgaatgtaacgaatgcggcaaatttttctctctgaaaagcgtgctaatccaacaccagcgtgtgcacaccggagagaggccctacgagtgtagcgaatgtggaaaagcttttcttactaagagccacctgatctgccatcagacggtgcacactgcagctaagcaatgcagcgaatgcgggaaattctttcggtataactccaccctcctcaggcatcagaaagtgcacactgggtag

SEQ ID NO: 14357 - DNA, 1065 bp, Artificial Sequence
  Description of Artificial Sequence: Synthetic coding sequence
atggccgagatgaatccagctcaagggcacgtggtttttgaagacgtcgctatctattttagccaggaagaatggggccaccttgatgaggcacagcgcttgctctaccgcgatgtcatgttggaaaaccttgccttgctgtcttcactgggctgctgccatggggccgaggacgaagaagccccgctggagcctggtgtaagcgtgggcgtctctcaagtaatggcacccaagccttgcctgtctacccaaaatacacaaccctgcgagacttgttcctctctgctcaaggacattctccgtctcgccgaacatgacggcacacaccccgaacaggggctgtatacctgtcccgcccacctgcaccagcatcagaaggagcaaattagagaaaaactcagcagaggggatggaggccgaccgaccttcgtcaagaatcacagagtgcatatggccggcaaaaccttcctgtgctctgaatgtgggaaggcctttagtcataagcacaagctttctgatcatcagaagattcacactggcgagcgaacttataagtgcagcaagtgtggcatcctgtttatggagcgctccacactgaatcgccaccagcggacccatacaggcgaaagaccttacgagtgtaatgagtgcggaaaagcctttctgtgtaaatcccacctcgtgcgtcaccagacaatccactccggcgagagaccttatgagtgttctgaatgcggcaaactctttatgtggtcaagcactcttatcacacaccaaagagtccacacaggcaagcgcccatatggatgtagcgagtgtgggaagtttttcaaatgtaattcaaacctgtttaggcactaccggattcacactggaaaacgatcctacggatgctccgagtgcggcaaattctttatggagaggagcacgctgtcacggcaccagcgcgtccatacaggcgagcggccttacgagtgtaacgagtgcggaaagttcttctctctaaagagtgtgctgattcagcaccagagacgtgtctataccgaggaagaatccttccaatag

SEQ ID NO: 14358 - DNA, 1638 bp, Artificial Sequence
  Description of Artificial Sequence: Synthetic coding sequence
atgaatctgaccgaggggccactggcaatggcggaaatggatccaacccaggggagggtcgtgtttgaggacgtggcgatttactttagccaggaagagtggggacatctggatgaggcccagcggctcctgtacagggatgtgatgctcgaaaatctcgctctgctgtctagcctaggatcttggcatggagcagaggacgaagaagcccctagccagcagggatttagcgtaggtgtatctgaggttaccgccagcaagccttgtctgagctcccaaaaagtccacccgagcgaaacctgtggcccccctctgaaggacattctgtgcctcgtggagcacaatggaatccaccccgagcagcatatttatatctgtgaagcagagctgtttcaacatcccaagcagcagattggtgagaacctttcccggggcgacgattggatacctagctttgggaaaaatcatagggttcacatggcagaggagatcttcacttgcatggaaggatggaaggatctgcccgcaacttcctgtctgctacagcaccaaggccctcaaagcgaatggaagccatatcgggacacagaggacagagaagctttccagaccgggcagaacgactacaagtgttccgaatgcggcaaaacttttacttgttcttactccttcgtggagcaccagaaaatccataccggggaacgcagctacgagtgtaacaagtgcggcaaattctttaagtactccgctaacttcatgaaacatcagactgttcatacttccgagcgcacatacgaatgccgtgagtgtggcaagtcctttatgtataactatagacttatgcggcacaagagggtccataccggcgagcgtccctatgaatgtaatacctgtggcaagttcttcagatacagcagtacattcgtccgccatcaaagggtacatactggggaaagaccatatgaatgcagggaatgcggaaagttctttatggatagcagtaccctgattaaacatcaacgagttcacactggggagagaccctataagtgtaatgactgtgggaaatttttcagatacataagcaccctgattaggcaccagcgcattcatacaggggagcgcccatacgagtgtagtgtgtgcggcgagctctttcgctataactcaagtcttgtaaagcattggcgcaatcacactggagagaggccttacaagtgctctgagtgcgggaaatcatttaggtaccactgcaggctcatcagacatcagcgagtgcacactggggaacgcccctacgagtgtagtgagtgtggcaaattcttcagatataattctaacttaattaagcattggagaaaccacaccggcgagaggccctatgagtgccgtgaatgcggtaaggcattttcccataaacacatcctagtggagcaccagaagattcactccggggaacgtccatacgagtgcagtgaatgccagaaggcgtttatccgtaaaagtcatctggtgcaccatcagaagattcactcagaggagcgcttagtgtgcagcatgaatgtcggcaactctctcgctaagactcctacctccctgaatattcgcgacttcacaatggaaaaggtttatcattag

SEQ ID NO: 14359 - DNA, 1602 bp, Artificial Sequence
  Description of Artificial Sequence: Synthetic coding sequence
atgaacctaactgagggcagagtcgtgttcgaggatgtggccatctacttttctcaggaagagtgggggcatctggatgaagctcaacgcctcctctaccgagacgttatgttggagaatctcgcactcctttcttctctcgggagctggcacggtgctgaggacgaagaagccccgtctcagcaggggttctccgttggggtgtcagaggtgacagcttcaaaaccatgtctttccagccagaaggtgcatccatccgagacctgtggtccgcctttaaaggacatactgtgcctggtggagcacaatggcatccaccctgaacagcatatctacatctgtgaagccgaactctttcagcatcctaagcaacaaatcggggagaatctgtccaggggagacgactggattcccagctttggcaagaaccatagagtacatatggccgaggagatattcacgtgcatggagggctggaaagacctacccgccacctcttgccttctgcagcaccaggggcctcagtccgagtggaagccctaccgggacacggaggaccgggaggctttccagactggacagaatgactacaagtgcagtgagtgcggaaaaaccttcacatgttcttactccttcgtggagcatcagaaaattcacactggagagcgcagttacgagtgtaacaagtgtggaaaattttttaagtatagtgcaaatttcatgaagcatcaaacagtccacacgagcgaaagaacttatgagtgtagggaatgcggaaagtcctttatgtacaattatagacttatgcggcacaagcgggtccacacaggtgagagaccatacgagtgtaatacctgcgggaagttcttccgttattcttccaccttcgtgcgccaccagcgagttcatactggtgagcgcccttacgagtgccgggagtgcggaaagttttttatggacagtagcactctgatcaaacaccaaagggtgcatacaggcgaaagaccctacaaatgcaatgactgcggcaagttcttcaggtatatctcaaccctaatccgtcaccagagaatccataccggcgaacgtccatacgagtgttccgtctgcggcgagctgttccggtataattctagcctggtgaagcactggaggaatcacaccggggagcgcccatataagtgtagtgaatgtggcaagtccttccgctaccattgccgactgatccgtcaccagagagtgcacacgggtgaaagaccctatgagtgtagcgagtgcgggaagtttttcaggtataatagcaacctcatcaaacactggcgaaatcataccggggagagaccatatgagtgccgcgaatgtggaaaagcttttagtcacaagcacatcttagttgaacaccagaaaattcatagcggagaacggccatatgagtgcagcgagtgccagaaggcattcatcagaaagtctcatctggtgcaccaccagaagatccactccgaggaacggctggtgtgcagcatgaatgtggggaactccctggcaaaaaccccgaccagcctcaatatccgtgattttaccatggagaaggtctatcattag

SEQ ID NO: 14360 - DNA, 1884 bp, Artificial Sequence
  Description of Artificial Sequence: Synthetic coding sequence
atggctgaagccgccttggtgattactccccaaggccacgttacgttcgaggatatcgctgtgtacttcagtcaggaagaatggggccttctcgatgaagcgcagcggtgtctttatcacgatgtgatgttagaaaatttttctctgatggcctccgtggggtgtcttcacggaattgaggccgaagaggcacctagtgagcagaccttgtcagctcagggggttagccaagcgcgaaccccaaagctggggcccagcatccctaatgcccacagctgtgaaatgtgcattctggtgatgaaggacatcctatacctcagcgagcaccaaggtactctaccttggcagaaaccttacacatctgtcgcaagcggcaaatggttcagcttcgggtcaaacctgcagcaacaccagaatcaggattccggtgagaagcacattagaaaggaggagagctccgctctattgcttaatagctgcaagataccactgtcagacaatctgttcccctgcaaggacgtggagaaagattttcccacgatccttgggctgttacaacaccagactacccactcgaggcaggagtacgcccataggtcccgcgaaaccttccagcaacggaggtacaaatgtgagcaagttttcaatgagaaggtgcatgtcacggaacatcagagagtgcacacaggggaaaaggcttataagcgcagagagtacggcaagtccctaaacagcaaatacctgttcgttgagcatcagaggactcacaacgccgagaagccatatgtctgcaatatctgtggtaagtcctttcttcacaagcagaccctggtgggccatcagcagagaatccacacaagggagcggtcctacgtttgcattgaatgcgggaaatcgctgagcagtaaatactccttggtagagcaccagcggacacataatggcgagaaaccgtacgtctgcaatgtctgtggaaaatcctttaggcacaaacaaacttttgtcggccaccagcagcggatccacaccggagagagaccttatgtctgcatggaatgcggtaagtccttcatccactcatacgaccggatccggcatcagagagtccatacaggtgaaggggcttatcagtgctcggagtgtggaaagagcttcatctataagcagagtctgctagaccaccacagaatacacactggtgagcggccctatgagtgtaaggaatgtggcaaagcctttatacacaagaagcgcttgctcgagcaccagagaattcataccggggagaaaccttatgtctgcataatttgtggcaagagcttcatacggtcatccgactacatgcggcatcagagaattcacacaggggaaagagcctatgaatgcagcgattgcggaaaagcgttcattagcaaacaaaccctacttaagcatcataagattcatacacgtgagaggccatacgagtgcagtgagtgcggaaaaggattctatttggaggtgaagctgcttcaacaccaaaggattcacacaagggagcagttgtgtgagtgtaatgaatgcgggaaggtattctcccatcagaagcgcctgctggaacatcagaaagtccacactggggagaagccatgtgagtgctccgaatgtggcaaatgttttagacatcgtactagtttaatccagcaccaaaaagtgcactctggggaaagaccctacaattgtaccgcctgcgagaaagccttcatatacaaaaacaaacttgtcgaacatcaacggatacacactggtgagaagccatatgagtgtggcaagtgcggcaaagcattcaataaaagatatagcctagttagacatcagaaagtacatattacagaagagccctag

SEQ ID NO: 14361 - DNA, 1923 bp, Artificial Sequence
  Description of Artificial Sequence: Synthetic coding sequence
atggccgaggcagctcttgtaatcactccacaaatccctatggtgacggaggaatttgttaaaccttcccagggccacgtcacctttgaggatatcgctgtctatttcagccaagaggagtgggggctcctcgacgaggcgcagagatgtctttatcacgatgtgatgctggaaaacttcagcttgatggcttccgtcggttgcctgcatgggattgaggccgaggaggccccctcagaacagactttatctgcccagggggtgtcacaggcacggactccaaagttggggccatccatccccaacgcgcacagttgtgaaatgtgcatactcgtgatgaaggacattttgtatctgagcgagcatcaaggtactttaccctggcagaagccatacacaagtgtggcgtctggcaagtggttttcttttggctctaacttacaacagcatcaaaatcaggactccggtgagaagcacattcgcaaggaagagtctagtgcactgctcctgaattcatgtaaaatccctctatccgacaatctgttcccctgcaaagatgtcgagaaggatttccccacaattctgggactgctgcagcatcagacaacacatagccggcaggagtatgcccaccgcagtcgcgagacctttcagcaaaggcgatataagtgtgagcaggtgttcaacgaaaaagtccacgtgactgagcaccagagagtccatactggtgaaaaagcatataaaagaagagagtatgggaagtccttaaacagtaaatatctgttcgtcgagcaccagcggactcataacgccgagaaaccgtacgtgtgcaatatttgcgggaagtcttttctccataaacaaactttggtcgggcaccagcaaaggatccataccagggagcgctcttacgtgtgtattgagtgtggcaaaagtctgtcatcgaaatactcactggtggaacatcagcggacacataacggagagaaaccatatgtgtgtaacgtgtgtggtaagagcttccggcacaagcaaacatttgtgggacatcaacagcggatacatactggggaacggccatacgtgtgtatggaatgcgggaaatcatttattcactcatatgatagaattcgacatcaaagagtccacaccggcgagggggcctatcaatgctctgaatgtggcaagtccttcatatataagcagagcctcctggaccatcaccgcatacatacaggcgaaaggccatatgaatgtaaagaatgcggtaaggcctttattcacaaaaaaaggttgctggagcaccagcgaatccacacaggcgaaaagccatacgtgtgcattatctgcggtaagtcattcataaggtcctctgattacatgcgccatcagcgaatccacaccggcgaaagggcgtacgagtgcagcgattgcggaaaagcttttatatctaaacagacattactcaaacaccacaaaatccatacccgggaacgcccgtacgaatgttccgagtgtggtaagggcttctatctcgaagtgaagctcctccagcaccagcgcattcataccagggaacaactctgcgagtgtaacgaatgtggtaaagtttttagtcatcagaaacgcctgctggagcatcagaaagtgcacaccggcgagaagccctgcgagtgcagcgagtgcgggaagtgctttagacaccggacaagtctcattcagcaccaaaaggtacatagtggtgagcgaccctacaactgtactgcctgtgaaaaggcgttcatctacaagaacaagctcgtcgagcatcagcggattcacacgggcgagaagccatacgaatgcggaaaatgcggcaaagcttttaacaaaaggtacagtttggtcaggcatcaaaaagttcacattaccgaagagccatag

SEQ ID NO: 14362 - DNA, 1173 bp, Artificial Sequence
  Description of Artificial Sequence: Synthetic coding sequence
atggcagagactaaggacgcagcacaaatgctcgtcacattcaaggatgtcgctgtaactttcaccagggaagaatggaggcaactggacctcgcgcagcgcacgctgtaccgggaggtcatgctggaaacctgtggccttttggtgtccctaggtgatcgtgcccaggtgcacactcgcgaaccgacaacttacccacctgtgctctctgagcgggcattcctgagagggtccctgactctggagtcttccacctcctccgacagtagactgggccgcgctagagatgaggagggccttctggagatgcaaaaaggcaaggtaaccccagagactgacctccataaggagactcacctgggaaaggttagtcttgaaggggagggcctcggaaccgatgatggcctccattcaagagccttacaggagtggctgtctgccgatgttctgcatgagtgcgattcacaacagcccggaaaagacgcactgatccatgctggcacaaatccatacaagtgcaagcagtgcggaaaaggcttcaacagaaaatggtacttggtccgacatcagagggtccacacggggatgaagccctacgagtgtaatgcctgtggcaaggccttttcccagtcctccaccctcatccgacactacctcattcatacaggggagaagccctacaaatgcctggagtgtgggaaagcctttaagagacggagttatctcatgcagcatcaccccatacacaccggggaaaagccttatgagtgttctcagtgcagaaaagccttcacacacagaagtacatttatcagacacaatagaacacacaccggcgaaaaaccatttgagtgtaaagaatgcgaaaaagccttcagtaatcgcgcacacctcatccagcactatatcatccatacgggcgaaaaaccttatgactgtatggcctgcggcaaggcctttagatgttctagcgagcttattcagcatcagcgcatccacacaggcgagaaaccctacgagtgcacccaatgtggcaaggccttccaccgtagtacctacctcatccagcattctgttattcacactggcgaaatgccatacaagtgtatcgagtgtggcaaggcattcaagagacggtcacatcttcttcaacaccaaagagtccatacctag

SEQ ID NO: 14363 - DNA, 1269 bp, Artificial Sequence
  Description of Artificial Sequence: Synthetic coding sequence
atggccgaaaccaaggacgctgcccagatgctggtcacctttaaggatgtggcggtgacattcactcgcgaagagtggcgacaacttgaccttgcacagaggaccctctatcgcgaggtgatgctggagacttgtgggctcttagtgtccctgggccaccgtgtgccaaagcctgaactggtgcaccttttagagcacgggcaggagctatggatcgtgaaacgagggttgtctcacgccacgtgtgccggagatagggcgcaggtacataccagggaaccaaccacatatccaccggttttaagcgagagggcatttttacgaggaagcctcactctggagagttctacttcctcagacagtcgcctgggccgggctcgggatgaggaaggactcctggagatgcagaagggtaaagtcaccccagagaccgacctgcataaggagacccacctcggtaaggtgtccctcgagggggaaggcctggggaccgatgatgggctccacagccgggccctccaggagtggctctctgccgacgtgttgcatgaatgcgattctcagcaacccggcaaggacgccttgatccacgcaggcaccaacccatataaatgcaagcaatgcggtaaaggtttcaatcggaagtggtacctcgttcgccatcagcgtgtccatactggcatgaagccatacgagtgcaatgcctgtggcaaagctttctcgcagtcatctactctgatccgtcattacctcattcacaccggcgagaagccatacaaatgcctcgagtgcggtaaagcctttaaaaggcgctcatatctaatgcagcaccaccccatccacacaggcgagaaaccatacgaatgcagtcagtgcagaaaagcgtttacccataggtctaccttcatccgccataacaggactcatacgggcgaaaagccatttgagtgcaaggaatgcgagaaagcattctccaaccgggcacacctcattcaacactacattatccacaccggagagaagccctatgactgcatggcctgcggcaaggcatttcggtgttccagcgagttgatccagcatcagagaatacacacaggtgagaagccttacgagtgtacgcagtgcggtaaagccttccatcggagtacctacttgatccagcacagcgtgatccataccggcgaaatgccgtataagtgtatcgagtgcggaaaagcttttaagaggcgctcccatctcctccaacaccagcgcgtgcatacctag

SEQ ID NO: 14364 - DNA, 1146 bp, Artificial Sequence
  Description of Artificial Sequence: Synthetic coding sequence
atgttggttacctttaaagacgtagcggtgactttcaccagggaggaatggcggcagctggacctcgcgcagagaacgctgtacagagaagtcatgctcgagacctgcggactgctggtcagcctgggcgatagagctcaggtgcatactagggaaccgacgacataccctcccgttctttctgagcgggcctttctccgcggttcactgacgctggagtcgtcaaccagctccgatagcagactgggacgcgcccgagatgaagagggtttgctcgaaatgcaaaagggaaaagttactccggagactgatttacacaaggaaacccacctaggcaaggtcagcctggagggagaagggctgggcaccgatgatggcctgcactcccgggccctgcaggaatggctcagtgctgacgtgctgcacgaatgtgattcccagcagcctgggaaagatgctcttatccatgcaggcactaatccatacaagtgtaaacagtgcgggaagggatttaatcgcaaatggtatttggtgcgtcaccagcgcgtccacaccggtatgaaaccttacgaatgcaatgcctgcggtaaggcctttagccagagctcaacactaattcgacactacttaatccacacaggtgaaaaaccttacaagtgcctggaatgtggaaaggcttttaaacgacgtagttatttaatgcaacaccatccaattcacacaggtgagaagccttacgagtgctcacagtgtcgtaaagcctttacccatcggtctacattcatccgccataatcggacccacaccggtgagaaaccgtttgagtgcaaggagtgcgagaaagccttctcaaatcgggctcatctcatccagcactatataattcacactggtgaaaagccatacgattgtatggcgtgtggcaaggcattccggtgttcatctgaactcatccagcaccagcgcatccataccggcgagaaaccgtacgagtgcactcagtgcggcaaagcatttcataggtcgacatacctgatccagcacagcgtgatccatacgggggaaatgccctataagtgtatcgaatgtggtaaggctttcaaacgtcgatcacaccttctgcagcaccagcgggtccacacttag

SEQ ID NO: 14365 - DNA, 1965 bp, Artificial Sequence
  Description of Artificial Sequence: Synthetic coding sequence
atggctgcagtggccctccgggactccgcacaggggatgacttttgaggacgtcgcgatttacttcagtcaggaggagtgggaactcttggacgagagtcagcgcttcctgtactgtgacgttatgctggaaaacttcgctcatgtcacaagcctggggtattgccatggcatggaaaacgaggctatcgcgagtgagcagtctgtatcaattcaagtccgtacctcgaagggaaatacccccactcagaagacacacttgtcagagatcaaaatgtgcgtaccggtcctcaaagacatcctaccagctgctgagcaccaaaccacatcacccgtccagaaatcatatttgggctccacctccatgagaggtttctgtttctcggccgacctccaccagcatcagaaacactacaacgaagaagagccttggaagcggaaagttgatgaggccaccttcgtgacaggttgccggttccacgtcttgaattattttacttgtggcgaagcttttcccgcacctaccgacctccttcaacacgaagcaacaccgtcaggcgaggaacctcactcctcctcttccaagcacatccaggcctttttcaacgccaagtcgtattataagtggggcgagtatcgaaaagctagttcccacaagcacacgctagttcagcaccagagtgtgtgcagcgaaggaggcctgtatgaatgctcaaagtgtgagaaagccttcacttgcaaaaataccctcgtgcagcatcagcagattcataccgggcaaaagatgtttgaatgctctgagtgcgaagaatctttttccaagaagtgtcatctgattctgcacaagatcatccatacaggggaaaggccttacgaatgctcagaccgtgagaaggccttcatccacaagtccgaattcatacatcatcagcggcgacataccggaggggtaagacatgagtgcggagaatgtcgcaaaaccttcagctacaagtcaaacctcatagagcaccagcgcgtccatacgggcgagcgtccctatgagtgcggcgaatgcggtaagagcttccggcagtcttcaagcctctttagacaccaacgggttcatagcggcgagagaccgtaccagtgctgcgagtgcggcaagagcttccgtcagatttttaacttgatccggcatcgacgggtgcatacgggggagatgccttatcagtgtagcgattgtggaaagagtttcagttgcaaatccgagcttatccaacatcaacggatccacagtggcgaaagaccatatgagtgtcgagagtgcggcaagtccttcagacagtttagcaatctcattcgccaccgaagcattcatactggcgacagaccctacgaatgttccgagtgcgagaaaagcttctccaggaaattcatactaatccagcaccaaagagtccacactggcgagcgtccctatgagtgctctgaatgcggaaagtcctttactaggaaaagtgacctgattcagcaccgccgcatacacactggtactcgaccgtatgagtgctccgagtgtgggaagagcttccgacagaggagcggactgattcagcaccgtcgactgcacaccggagaacgtccctacgagtgctctgagtgtggtaagagcttctcgcagtccgcttccctgattcaacaccagcgcgtgcacacaggagaacggccctatgagtgctccgagtgcggcaagtccttttctcagtcctccagcttaatccagcaccaacgtggtcatacaggcgaaagaccctacgagtgttcacagtgtggaaaaccgttcactcacaagtctgacctgattcagcaccagcgcgtgcacaccggcgagaggccctacgagtgctcagaatgtggcaaaagtttttcgcgcaaatcaaatttgatcagacatagacgcgtccataccgaagagcgtccctag

SEQ ID NO: 14366 - DNA, 2013 bp, Artificial Sequence
  Description of Artificial Sequence: Synthetic coding sequence
atgcccgcgccggtcggcagacgctctccgccttcccctagatcgtcaatggcagccgtggcattgagagattccgcacagggcatgacctttgaagacgtcgccatttacttctcccaggaggagtgggaactcctggatgagtctcagagatttctttactgtgatgtaatgctggaaaattttgcgcacgttacaagtctaggttattgtcatggtatggagaatgaggccattgcatccgagcaatccgtatctatacaggtcagaacctccaaaggaaatacccccactcagaaaacccacctatcagaaatcaaaatgtgcgtgccagtcttaaaggacatactgcccgccgctgagcaccaaaccacatcacctgtccaaaaaagttacctgggcagtacctcgatgcgcggcttttgcttcagtgctgacctgcaccagcatcagaagcattataacgaggaggagccatggaaaaggaaagtcgatgaagccacctttgtgaccggttgccgcttccacgtcctgaactatttcacttgcggggaggctttccccgcacctactgacttgctgcagcacgaagccaccccgtccggcgaagagccccattcctcctcctctaaacacatccaggcatttttcaacgccaaatcctactacaagtggggagagtatcgtaaggcatcgtctcataaacacacactggtccaacaccagtccgtgtgtagtgaaggagggttgtatgaatgctcaaagtgcgagaaggccttcacttgtaaaaacactttagtgcaacaccaacagattcatacgggtcagaagatgtttgagtgcagcgagtgcgaagaatccttttccaagaaatgtcacctcattctgcacaagattattcacactggtgagcggccttatgagtgtagcgacagggagaaagcatttattcataaaagcgaattcatccaccaccagcggcggcacactgggggggtgagacatgaatgcggtgaatgcaggaagactttttcgtataagtcaaacttgatagagcaccagagggtacacaccggggaacggccctacgagtgtggtgaatgcgggaagagcttcagacagtccagcagtctgtttaggcaccagcgcgtgcactcaggggagcgtccttaccaatgttgtgagtgtggtaaatccttccgccagatcttcaacctcattagacatagaagggttcataccggagaaatgccctaccagtgttctgactgcgggaagtctttcagctgtaagtccgagctcattcagcatcagagaatccattcaggcgaaagaccatacgaatgtagagagtgcggcaaatccttcagacaattctccaatctaattagacatcgctccatacacacaggcgatagaccatatgaatgttctgagtgcgaaaagtcattttccagaaaatttattctgatccagcaccagagagtgcacaccggcgagcggccatacgagtgctctgaatgtggaaaaagttttacgaggaaaagcgacttgatccagcataggcggattcataccggtactcgtccgtacgagtgtagtgagtgtgggaagagctttagacagaggtcaggtctgatccaacaccgaaggctccacaccggtgaacgcccatatgagtgctccgaatgtggaaagtcattttctcagagcgcctccctgatccagcatcagcgagtgcacaccggcgagagaccttacgagtgctccgagtgcggaaaatccttctcccaaagctccagtctcatacaacaccagcggggtcacaccggcgaaagaccttatgaatgctctcagtgtggtaagccctttacacataaatctgatttgattcaacaccagcgggtccacaccggcgaaagaccatacgaatgctccgagtgcggtaaatcattctctcgcaaatctaatttgatccggcacaggagagtgcacactgaagagagaccctag

SEQ ID NO: 14367 - DNA, 1269 bp, Artificial Sequence
  Description of Artificial Sequence: Synthetic coding sequence
atgacatttgaggacgttgccatctattttagccaagaggagtgggaactcctggatgagtcccagcgtttcctgtattgcgatgtgatgcttgaaaatttcgcccatgtgacttccctggtgaccagtcaccagaagcactacaacgaggaggaaccctggaagcggaaggtcgatgaggcaacctttgtgacagggtgtcggttccatgtattgaattatttcacttgtggggaagcatttccagccccaactgacctactgcagcacgaggctacaccgtccggagaggagcctcatagcagcagcagcaagcatattcaggcctttttcaacgccaagtcctattataagtggggggaataccgcaaggcgtcctcccataagcataccctggtccagcatcagtcgagggtgcataccggagaacggccatacgaatgtggagagtgtggcaaaagcttccgccagtccagcagcctctttcggcaccagcgggtgcatagcggggagagaccttaccagtgctgtgaatgcggcaagtccttccgccagatctttaatttgatcagacaccgcagagtacacaccggtgaaatgccttaccaatgctccgattgtggaaagtcatttagctgcaagtccgagctgatccagcaccaacggattcattccggagagagaccatatgaatgccgggagtgcggtaagagtttccgacagttcagtaacctgattagacatcgctctatacatacaggggaccgtccatacgaatgcagcgaatgcgagaagtctttctcaagaaagtttatcctcatccaacatcagcgggtgcatacaggcgaacgtccgtatgagtgttcggaatgtggtaagtctttcactcggaagagcgatctgattcagcatcgtagaattcacaccggcactcgtccttacgagtgctctgaatgcgggaaatccttccgacagaggtcaggacttattcagcaccgcagactgcatactggcgagcgaccatatgaatgcagtgagtgcggtaaaagcttctcacagtcggcgagcctcattcagcaccagcgggtccatacaggagagcggccgtatgagtgctccgagtgcggaaagagtttttcccagtcgtcatcactgatccagcatcagagaggacacacaggggagagaccatacgagtgcagtcagtgcgggaagcctttcacacacaaaagcgatctgatccagcatcagagggtgcacaccgggtag

SEQ ID NO: 14368 - DNA, 1224 bp, Artificial Sequence
  Description of Artificial Sequence: Synthetic coding sequence
atggcagccgccgccttacggtttccagtccaggggaccgtgacatttgaagacgtggccgtgaagtttacacaggaggagtggaatcttctatccgaggctcagagatgcctttaccgagacgttacacttgagaatctcgccctgatgtcatcgctcggatgttggtgtggagtcgaagatgaggctgccccatccaagcaatcgatctacattcagagggaaactcaggtgcgaacccctatggcaggtgttagtcctaaaaaggcccacccatgtgaaatgtgcgggccaatcctgggggacatcctgcacgtggcagaccatcaaggtactcatcacaagcaaaagctacatcggtgcgaggcttggggcaacaaactttacgactccggaaattttcatcagcaccagaatgagcatattggggaaaaaccgtataggggatctgtggaggaggccctgtttgccaaacgatgcaaactgcatgtgtctggggagtccagtgttttttcagagagcggtaaagactttctgctccgatcgggcttgctgcaacaggaagctactcacaccggaaagtcgaacagcaagactgagtgcgtctcgttattccatggcgggaagtctcattattcctgtggaggctgcatgaagcatttttctacaaaggacatactgagccagcacgagaggctacttcctacggaggagccatcagtctggtgcgagtgcggcaaaagttcctccaagtatgatagttttagcaatcatcagggagttcacaccagagagaagccatacacctgcgggatttgtgggaaactgttcaacagcaaaagtcacctcctggtgcaccagcgcatccatacaggtgagaagccctatgagtgcgaagtctgccaaaagttctttagacacaagtatcacttaatcgcacaccagagggtacatacaggagagcgtccctatgagtgcagcgactgcggcaaaagctttacccacagctcgaccttccgggtacacaaaagagttcataccggccagaagccctatgaatgcagcgagtgtggaaagagcttcgccgagtcttccagcctcacaaaacatcgcagggtgcatactggcgaaaaaccatacggatgcagcgagtgtgaaaaaaagtttaggcagattagctctctgcggcatcatcagagagtgcataagagaaaaggtctctag

SEQ ID NO: 14369 - DNA, 1617 bp, Artificial Sequence
  Description of Artificial Sequence: Synthetic coding sequence
atggttacctgcgcccatctcggccgacgcgcgcgcttgcctgcagctcaaccgagcgcctgtccaggcacctgctttagccaggaggaacgaatggccgcgggctatctgccacgatggtcacaggagcttgttacattcgaagacgtgtccatggactttagtcaagaggagtgggagctgttggaacctgcacagaagaatctctacagagaggtgatgctggaaaattaccgcaacgtggtgagtctggaggccctaaagaaccaatgcaccgacgtagggataaaggaaggacctctctctccggcacagacgtcacaggtgacaagccttagctcctggaccggatatctcctgttccaaccagtcgcctccagtcacttggagcagcgtgaagcgctctggatcgaagaaaaaggcactccacaggctagttgctcagactggatgaccgttttaagaaatcaggactccacctacaagaaagttgccttgcaagaggaacccgcatctggaattaacatgattaagctgataagagaggacggcgggtggaagcagctggaggatagccacgaggatccacagggtctgctgtcccaaaaagcttccctgcatgttgtggccgtcccacaggagaaagctacagcctggcacggctttggcgagaacgggaatctatctcccgcactggtgctgtcacagggttctagcaagggaaatcacctttgtgggtctgaacttgacattacatcactggcgtccgactctgttctaaaccaccaccagctcggttatgccgatcggagaccatgtgaaagcaacgagtgtggcaatgccatccgccagaattcacatttcatccaacatggcggtaaaatgttcgtatacttggagaatggtcagtcgttaaaccacggaatggctctaacgatccataacaagataaatactgccgaaaagccgttcgagtgccaccagtgtggcaaagtattcaatagaaggcactccttgtctgaacatcagagaattcatacaggcgaaaaaccttacgagtgtcaggagtgcgggcgtgcttttacccactcatcaaccctcacccggcatctcaggacacacaccggtgagaagccctacggctgtggcgagtgtggaaaggctttcaacagaattagctccctgacccagcaccaacgtatacataccggtgaaaagccgtataaatgtgaggactgcggcaaatcattttgccagtctagttacctgatattgcataaacgtacccacaccggagaaaaaccctacgaatgttctgaatgtgggaaggctttcagtgatcgctcttcccttaatcagcacgagagaacccacacgggcgagaacccatatgaatgtaaacagtgtggccgtgctttctctcagcgcagtagtctcgtcaggcacgagcggacacatacaggcgagaagccttaccgctgtcaggagtgcggtaaagctttttctcagtcctcaagtctggtaactcaccagaagacccactctagtcagaagacatacaagataatcgactgcggaaaggctttttatcaaaataggcatctgattggatactag

SEQ ID NO: 14370 - DNA, 1887 bp, Artificial Sequence
  Description of Artificial Sequence: Synthetic coding sequence
atggacagtgtcgtgttcgaggacgttgcggtggatttcactttagaggagtgggccctgttagattctgcacagcgcgacctctaccgagatgtcatgctggagacattccaaaacctggccagcgtagacgatgagacacagttcaaagcaagtgggagtgtgtcccagcaggacatatatggcgagaagattcccaaggaatccaaaatcgccaccttcacgcgcaacgtgtcatgggccagtgttctcggcaaaatttgggactcactcagcatagaagaccagaccaccaaccagggaagaaacttatcacggaatcacggcctcgagaggttgtgtgagagtaacgatcaatgcggggaggcactgtctcaaatcccccacctgaatctgtataagaaaatcccgccaggggtcaaacaatacgaatataatacgtatgggaaggtttttatgcatcgccggaccagcctgaaatccccaatcaccgtgcacacgggtcacaaaccttatcagtgtcaggagtgtggccaggcatactcttgtaggagccatttgaggatgcacgtgaggactcacaacggtgagagaccgtacgtgtgtaagttatgtggcaaaacttttccccgcacctcctcactgaaccggcacgtgcggatacacacagcggagaagacatatgagtgcaagcaatgtggtaaagcctttattgacttcagtagtctcacgagtcatctacggtcacacacaggagagaaaccatataaatgtaaagaatgcgggaaggcgttttcatacagctccacatttagaaggcacaccatcacgcacaccggggagaagccttacaagtgcaaggagtgtgctgaagcattctcttactctagtacttttagacggcacatgatcagtcatacaggcgagaagccacacaagtgtaaagagtgcggcgaggcattcagttattcttctgcattcagaagacacatgattacccacacaggagagaaaccatatgagtgtaagcagtgcggcaaaacatttatttatctacagagtttcaggagacatgaaaggatacacactggagaaaaaccttacgaatgcaaacagtgtggcaagaccttcatttatccacagagctttcgaagacacgaaaggactcacggaggcgaaaagccctacgaatgtaatcagtgcggcaaggctttcagtcacccctcatcttttcggggtcacatgagagtgcataccggcgaaaagccttatgagtgcaagcagtgcggcaaaacattcaattggcccatcagtctgagaaagcacatgcgcacccacactagggaaaagccatatgagtgcaagcagtgcgggaaggccttctcattgtccgcctgctttcgagagcacgtacgcatgcaccccgaggataaaagctatgagtgcaaactgtgcggcaaggccttctattgccatatctcccttcagaagcacatgcggcgccatacagccgagaagctatacaaatgcaaacaatgcggcaaggctttttcatggccagagttactccagcaacatgtgcgcacgcatactgttgagaagccctacgagtgcaaggagtgtggcaaggttttcaagtggcctagttcattgcctatccacatgagactgcacaccggcgaaaagccttaccagtgcaagcattgtggcaaggcatttaactgttcttcatctctgcggcgacatgtgcgcattcacaccactgaaaaacagtacaagtgcaatgtagggcacccacccgctaacgagttcatgtgtagcgcttctgagaaaagccaccaggagagggatctgatcaaagtggtcaacatggtgctgcccctgtag

SEQ ID NO: 14371 - DNA, 1632 bp, Artificial Sequence
  Description of Artificial Sequence: Synthetic coding sequence
atggacagtgtagtcttcgaagatgtggccgtcgatttcacacttgaagagtgggccctcctggatagtgcccagcgggatctataccgagacgtgatgctcgaaacattccagaacctcgcttccgtagatgatgaaacacagtttaaggcgtctggtagcgtctcacagcaggacatttatggcgagaagatacctaaggagtccaaaattgcaactttcactaggaatgtctcgtgggcttccgtactcgggaaaatatgggacagcctatctattgaggaccaaactaccaaccagggtcgcaacctgaggaaccacgggcttgagcggttatgtgagtcgaacgatcagtgtggagaagccctctcacagatacctcatttgaacctgtataaaaaaatcccacccggtgtgaagcagtatgagtataacacatacggcaaagtgtttatgcataggaggacaagcttgaaatcgcccatcactgtacacaccggccacaagccttaccaatgccaggagtgtggccaagcctatagttgccgttcgcacctgagaatgcatgttcgcacgcacaacggcgaaaggccctatgtgtgcaagctgtgcggtaagacctttccaaggactagctcacttaacagacacgtccgaatacacactgccgagaagacctacgagtgcaaacaatgtggcaaggcctttatcgacttttctagccttacctcccacctgcgaagccatactggcgagaagccatacaaatgtaaagaatgtggtaaagctttctcatattcatctacatttcggaggcataccatcacacacaccggcgagaagccatataagtgtaaagaatgtgccgaggcatttagctactcctccaccttccggaggcacatgatctcccacacaggggagaagcctcacaaatgcaaggagtgcggggaggcctttagctattcatctgcctttagacggcacatgattacgcacactggcgaaaaaccatatgagtgcaagcaatgcggaaagacattcatctatcttcagagtttcagacggcacgaacgaatacatacaggcgagaagccatacgaatgtaaacagtgtggaaagacgttcatctatccccagagcttcagacggcatgagcgtacacatggcggagaaaagccttacgagtgtaaccagtgcggaaaggcgttctcacacccctcttcattccgtggccacatgagggtgcataccggcgagaagccttacgaatgtaaacaatgtggtaaaacgttcaattggccgatatctctccgtaaacacatgaggacacacacccgcgaaaagccttatgaatgcaaagagtgcggcaaggtttttaaatggccttcaagtctccccatccatatgaggctgcatacgggcgagaaaccctaccagtgcaaacactgcgggaaggccttcaattgtagttcttcactgcggcggcatgtgcgcatacacaccaccgagaagcagtacaaatgcaatgtgggccacccccccgcgaatgaattcatgtgcagcgcctctgaaaagagtcaccaggagagagacctgataaaggtcgtcaacatggtcctgcctctttag

SEQ ID NO: 14372 - DNA, 1371 bp, Artificial Sequence
  Description of Artificial Sequence: Synthetic coding sequence
atggataccgtagtcttcgaggacgtagtcgtcgactttactctggaggagtgggctctcctaaaccccgcgcagagaaaactttatagggatgtgatgttagagacattcaaacacctggcttccgtggacaacgaagctcaactcaaggccagtggcagcatctctcagcaggacaccagtggagagaagttgtctttaaagcagaaaatcgaaaagttcactcgtaaaaatatttgggcatccctgcttggtaagaattgggaagagcacagtgtaaaggacaagcataacactaaggagcgacatctaagccgaaatccaagagtggaaaggccctgcaaaagttcaaaaggtaataaacgcggccgtacgttccggaaaacccggaactgcaatcgtcacttaagaaaaaactgttgcacgagcgtaaggcgttatgagtgctcacaatgtggcaagctcttcactcacagcagctcactgatcaggcacaagcgcgcacattctggccagaaattgtataagtgcaaagagtgtggaaaggcattctctagacctagttatctccagacacacgagaagacccactctggcgagaaaccttatgcttgccagtcgtgcggcaagacatttttacggtcccatagcctgactgagcatgtacgcacgcataccggtgagaagccctacgagtgtgggcagtgtgggaaggggttctcttgccctaagtcttttagggcacatgtcatgatgcatgcaggtgggagaccttacgagtgtaaacactgtggaaaggccttccgctgccagaagagctttagggtccatatgatcatgcatgcaggtgggcgtccctacgagtgtaagcaatgcggaaaagcatactgctgggccacatccttccagaggcatgtgcgtatacacaacggggaaaagccttacaaatgcggcaaatgtggaaaagctttcggatggccttcctctctgcacaagcatgctaggacccacgccaagaagaagcccgtgtctggggggagcgtgggcaaatctagcgctcggcccaggcccagcactgatgtgaagtcccagactcgcgagaaggtgtacaagtgcgaaacctgcgggaagacatacggctggtcctcttctctccataagcatgaacgtaagcataccggagaaaagccggtaaacgctgctagcgtcggcaagccatcgggcggcctatgttcctcgaaaaacgtgcgtacccaaatcggacagaagccctccaagtgtgagaagtgtggcaaagcattcagctgtccaaaagcattccagggccatgtacgctctcacactggaaaaaagtcttgcacttcgaagtag

SEQ ID NO: 14373 - DNA, 1293 bp, Artificial Sequence
  Description of Artificial Sequence: Synthetic coding sequence
atggcggctgtggtactcccccctacggcagctctaagctccctgttccctgcaagccagagggagggccacaccgaagggggggagctcgtcaatgagttgcttaagtcctggttgaagggcctggttacctttgaggatgtcgctgtggagttcacccaggaagaatgggctttgctggacccagcccaacgcacattatatcgggatgtaatgcttgaaaattgtcgaaaccttgcaagtctggggaaccaagtagataaaccccgtctgatctcccagctagaacaggaagacaaggtcatgactgaagagcgcggcatcctgtccggcacctgtcctgatgtggagaatccatttaaggcaaaaggcttaaccccaaagctgcatgttttccggaaagagcaaagcagaaatatgaaaatggagcggaaccacctcggggccacattaaacgaatgcaaccaatgtttcaaggtgttttccactaagagcagcctcactcgacacaggaaaattcacactggggagagaccctacgggtgctcagaatgcgggaaaagctactcatctcgaagctatctcgctgtgcataagaggattcataacggggagaagccatatgaatgcaatgactgtggaaagacatttagctcccgctcctacctgacagttcacaagcggatccacaacggcgagaaaccatacgagtgttcggattgcgggaagaccttcagcaactcaagctacctgcgccctcacctccgcatccacaccggagaaaagccctataaatgcaatcagtgcttcagggaatttaggacacagagtattttcacaaggcacaagcgcgtacataccggggaggggcattatgtgtgcaatcagtgtgggaaagctttcggaacaaggtcatctctaagttctcactacagcattcacactggagagtacccttacgagtgtcacgactgtggacgcacatttagacgccgttctaacctcactcagcacatccgaacacatactggggaaaagccctatacatgcaatgaatgcgggaagtcattcaccaactcattctcgctgactatccatcgacgaattcacaacggcgagaagtcctatgagtgtagtgattgcggaaagagttttaacgttttgagcagtgttaagaagcatatgcgtacacatacaggcaagaagccttatgaatgcaattattgcgggaagagcttcacaagcaacagttacctttctgttcatacaagaatgcataatcgccagatgtag

SEQ ID NO: 14374 - DNA, 1293 bp, Artificial Sequence
  Description of Artificial Sequence: Synthetic coding sequence
atggcagcagtggtgctgccgcccacggcagccttaagctcactttttccagcatcccaaagagagggccacactgaaggcggggaattagtgaatgagttgcttaaatcctggttaaaaggattagtcaccttcgaggacgttgccgttgagttcacgcaggaggaatgggctctgctggatccggctcagcgcaccctgtatcgggatgtgatgctggaaaactgtcgaaatctagcttctctcggaaatcaggtcgacaagcctcggttgatctcacagctcgaacaagaagacaaggtcatgactgaggaacggggcattctgtcggggacttgtcccgacgttgaaaaccccttcaaagccaagggattgactccaaaactgcacgttttcagaaaagaacagtcacgaaacatgaagatggaaagaaaccacttaggggccacactaaatgagtgtaatcagtgttttaaggttttctccaccaagagttctctgactagacaccgaaagatccacacaggggagagaccatacggctgtagtgagtgtggcaagagttacagcagccgttcttatttagcggttcataagagaatacacaatggtgagaagccgtatgagtgtaatgactgtggaaaaacttttagctcaagatcctatctcactgtgcataagcgcattcacaacggcgagaaaccttacgagtgcagcgactgcggcaagactttcagcaattcctcctatcttaggcctcatcttaggatccataccggagagaaaccttacaagtgtaaccagtgcttccgcgagtttaggactcagtccatattcacacgccataagcgcgtacatacgggtgagggtcattatgtgtgcaaccaatgcggaaaagcctttggcaccaggtcctcactcagcagccattactcaatccataccggcgaatacccatatgaatgtcatgattgtggacgcacttttcggcgcaggagtaatctgacccagcacatacgtacccatactggagagaaaccgtatacatgcaatgagtgcggcaaatccttcactaactcattctccttgactatccataggcggatccacaatggcgagaaaagctacgagtgcagtgactgcgggaagtcattcaacgtcctctcctcagtcaagaagcacatgagaactcacaccgggaaaaagccatacgagtgtaattattgtggcaaatcatttaccagtaatagttacttatcggtccatacccggatgcacaaccgccaaatgtag

SEQ ID NO: 14375 - DNA, 1272 bp, Artificial Sequence
  Description of Artificial Sequence: Synthetic coding sequence
atggcggctgtcgttttgcccccaaccgcagctagccaaagggaaggacacaccgagggaggcgagctggtgaatgaattactgaagagttggctgaagggtcttgtgacctttgaagatgtggccgtagaatttacacaagaggagtgggccctcctggaccccgctcaacgtacactataccgagacgtgatgttagagaactgccggaatttagctagcctgggaaaccaggttgacaaaccgaggctgatcagtcaactggagcaggaggataaggtaatgacagaggagcggggaattctttcaggaacatgtccggacgtggagaacccatttaaggctaagggcctaactcccaaattgcacgtgtttagaaaggagcagagccgtaacatgaagatggaacgcaatcatctgggagctactctgaacgagtgcaaccaatgcttcaaggtgtttagcacaaaatcctctctgacaagacataggaagattcacacgggagaacgaccctacggctgctctgagtgtggaaaatcttattcatcaaggtcatatttggctgtccataaaagaattcacaatggcgaaaagccatacgaatgtaatgactgcgggaagaccttcagctcacgtagctatctgaccgtgcataagagaattcataatggagagaagccatatgagtgttcggattgcggaaaaaccttttccaattcttcgtatctgcgaccccatctgaggattcacaccggggaaaagccgtataagtgcaaccagtgctttcgagaatttcgaacacagtccatatttacgaggcacaagcgggtacatacaggcgaggggcactacgtctgcaatcaatgtggcaaggcctttggaacacgctcctcactgagcagtcactacagcattcacaccggggaatacccatacgaatgtcatgactgcggtcgcacatttcgaagaaggtcaaatctgacacagcacatccggacacacactggcgaaaaaccgtacacctgcaatgagtgtggaaaatcctttacaaattccttttcattgaccatacacaggagaatccataacggagagaaaagctacgaatgtagcgattgcggcaagtcttttaacgtactgtcctcagtgaagaagcacatgaggacccacactggaaagaagccatacgaatgcaattattgtggaaaatcatttacgagcaattcatacctgagcgtccacacaaggatgcacaaccggcagatgtag

SEQ ID NO: 14376 - DNA, 1209 bp, Artificial Sequence
  Description of Artificial Sequence: Synthetic coding sequence
atggcagccgtgatacttccctccaccgctgcaccatcctcattatttccagcttcacagcagaaagggcacactcaaggaggggagctggtcaatgagctgctaacctcttggttaagaggactcgttacctttgaagatgtcgccgtggagttcacacaagaagaatgggccctgctggacccagcacagaggaccctttatcgcgatgtgatgctcgagaattgccggaatctcgcatcactaggatgtagggtgaacaagccaagtttaataagtcagctggaacaggacaagaaggtagtgactgaagaacgcggcatcctgcctagcacttgcccggacctggagaccctcctgaaggcaaagtggttgacaccgaaaaagaacgtgttcagaaaagaacagtcaaaaggagtgaagacagagcgctctcaccggggcgttaagctaaacgaatgcaatcagtgtttcaaggttttctcgacaaaatctaacctaacccagcacaaacgcatccacaccggggagaagccatacgattgctcacagtgtgggaagtcattttcctcccgctcttatctgacaatccataagaggattcacaatggcgagaagccatacgagtgcaaccactgcggcaaggcattttcagaccccagctcactgcggctccatcttaggattcatacaggggagaaaccatacgaatgcaaccagtgcttccatgttttccggacgtcctgtaatctgaagtctcataaacgcatccataccggagaaaatcatcatgaatgtaaccagtgcggcaaagcttttagcactcgatccagtctgaccgggcacaattccattcacactggagagaagccctacgagtgtcatgattgcggtaaaacctttagaaagagctcttatctgactcaacacgtgcggactcataccggagaaaaaccctatgagtgcaatgaatgtggcaaatccttttcaagttcgtttagcctcaccgtgcataaacggattcataccggcgagaaaccgtatgaatgctcggattgtgggaaggcctttaacaatctgagcgctgtgaagaaacatttgcgcacccacactggcgagaaaccgtacgaatgcaaccactgcgggaagtcgttcactagcaatagttacctgtcggtccacaaacggattcacaaccggtggatttag

SEQ ID NO: 14377 - DNA, 996 bp, Artificial Sequence
  Description of Artificial Sequence: Synthetic coding sequence
atgctggaaaactgcaggaatctggcttcactcggttgccgcgttaataagccttccctgatcagccagttagaacaggataagaaggtcgtgacggaggagcgcggcattctgcctagcacttgtccagatttggagacgctcctcaaggccaaatggctaacaccgaaaaagaatgtgtttcgcaaggaacagagcaaaggagtgaaaactgagcgttcacacagaggggtgaaattgaacgagtgcaaccaatgttttaaggtattcagtactaagtctaatctcactcagcacaaaaggattcacactggggaaaagccgtatgattgctcccaatgcggcaaaagcttttcgtcgaggtcctacctgactatccataagagaatacacaacggcgaaaaaccatacgaatgtaatcactgcggaaaagcctttagcgaccctagttcactgcgactgcacctgaggattcatacaggcgaaaagccgtacgagtgcaatcagtgcttccatgtttttaggacttcctgcaacctcaagagtcataaacgcatccacacaggtgaaaatcatcatgaatgcaaccagtgtgggaaggcattttccaccaggtcaagccttaccggacacaacagcattcatacgggcgagaagccatacgaatgccatgattgcgggaaaacattcagaaaaagttcttacctaacacagcacgtccggacccacacgggggagaagccctacgaatgcaacgagtgcggaaagtccttctcaagtagcttctcattaacggtccataagcgcattcatactggtgagaagccttacgagtgtagcgattgcggtaaagcttttaataatctgtcagctgtgaaaaagcatctgcgaactcacacgggagaaaaaccttatgaatgtaaccactgtggaaagtcattcacatcaaattcatacttaagcgtccacaagcgtatccacaacaggtggatctag

SEQ ID NO: 14378 - DNA, 1617 bp, Artificial Sequence
  Description of Artificial Sequence: Synthetic coding sequence
atggtcgcaggatggctcacaaattattcacaagattcagtcacatttgaggatgtggccgttgactttacccaggaggagtggactttgctcgaccagactcagcgtaacctgtatcgcgatgtcatgttggaaaattacaaaaacttagtcgcagttgactgggaatcgcatatcaatacaaaatggtcggcaccccagcaaaactttctccagggtaaaacatcctcggtagtggagatggagaggaatcattttggtgaagaactattcgattttaaccagtgcgaaaaggcgctgtcagaacactcttgtctgaagactcaccggcgcacttactttcgaaaaaaaacttgtgaatgcaaccagtgtgaaaaagcattcagaaagcccagtatttttacactacacaaaaaaaccgatataggcgaggagctgccgaactgcaatcagtgcgagacagccttctcacagcacctgcacctcgtgtgtaagaagacaagtcaaaatttacacctggtgtgcaaaaagacccacactcaggagaagccatacaaatgctcagattgtgaaaagggactgccctcatccagccacctacgcgagtgcgtcaggatatatgggggggaacggccttatacccacaaggaatatgtcgagactttcagccatagcacggcactctttgtccacatgcaaacccaagacggtgagaagttttatgagtgcaaagcatgtggcaagcccttcaccgagtcctcctacttgacccaacatctgcggactcactctcgggtacttcctattgagcacaaaaaattcggtaaggccttcgcctttagccctgacttggcaaaacacattaggctcagaacaaggggtaaacactacgtctgcaatgaatgtggcaaggagtttacgtgctttagtaagttaaacatccacataagggttcacacgggagagaagccctacgagtgcaacaaatgcggcaaggcctttactgattcgagtgggctgattaaacatcgccggacccacacaggtgagaaaccctacgagtgtaaggagtgcggtaaggcatttgctaacagctcccatctgacagtgcatatgcggactcatacaggtgagaagccctaccagtgtaaggagtgtgggaaggcttttatcaatagctcaagctttaagagccacatgcagacccatccaggtgtaaagccctacgattgtcagcagtgcggcaaagctttcatccggagcagtttcttgattcgacatctgcgttcccatagcgctgagaggccttttgaatgcgaggaatgcggcaaggcatttcgatattcctcccacttgtctcaacacaaaagaattcacacaggagagaggccctacaagtgtcagaagtgtggtcaggcattctctatttccagcgggctcacggtccacatgagaacacatacgggtgagcgtccttttgaatgtcaggaatgcggtaaagcatttacacggagcacatacctcattcgccatctccgatctcacagcgtcgagaaaccatataaggagtgcggccagacattcagcaacagtagttgtcttaccgaatgcgtctag

SEQ ID NO: 14379 - DNA, 1617 bp, Artificial Sequence
  Description of Artificial Sequence: Synthetic coding sequence
atggtcgccggttggttaactaactacagccaggacagtgtcacttttgaggatgtagccgtagactttacccaggaagagtggacattgttggaccagactcaacgaaacctctacagagacgttatgttggagaactacaagaacctggtagcagtggactgggaatcacatattaacaccaagtggtccgcaccgcagcaaaactttttgcagggtaagacctctagcgtcgtggagatggaaagaaaccattttggagaagagctcttcgatttcaatcagtgcgaaaaggcgttatcagagcattcctgcctcaaaacgcacaggcgcacctacttcagaaaaaagacctgcgagtgtaatcagtgcgagaaagcattcagaaagccttctatttttactttgcataagaagaccgacatcggagaggaacttcccaactgtaatcaatgtgagacggccttttcccagcaccttcacttggtctgtaagaaaacgtcccaaaacttgcacctggtatgcaagaagacacacacccaagagaaaccttataaatgttccgattgtgagaaagggctgccaagctcatcacaccttcgagaatgtgtcagaatttacggcggcgaaagaccctacactcacaaggaatatgtggagaccttttcacacagcacagctctttttgtgcacatgcagacccaggacggagagaagttctatgagtgcaaagcctgtggaaaaccctttactgagtcctcttacttaacccagcatctccgaacccactcgcgggtcttgcctatagagcacaagaaatttggaaaggcattcgccttctcacctgacctcgcgaagcacatacggcttcgcacaagaggcaagcattacgtgtgtaatgagtgcggaaaagaattcacctgtttcagtaagctgaacatccatatccgggttcatacgggagaaaaaccatacgagtgcaacaagtgtggcaaggccttcaccgattcgtccggcctgatcaaacatcggaggacacataccggggaaaagccatatgaatgtaaggaatgtggtaaggcctttgccaactcctctcatctgactgtgcacatgcggacacacaccggtgaaaaaccataccagtgtaaagagtgcggaaaagcattcattaacagctccagttttaagagtcacatgcaaactcatccaggggttaagccttacgattgccagcaatgtgggaaggcatttatcagaagtagttttctgattcgccacctgcgctctcactccgctgaacggccttttgagtgcgaagaatgcgggaaagcctttaggtacagctcccacctttctcagcacaaaagaatccacacgggcgaacgcccctacaagtgccaaaagtgcgggcaagccttcagcatctcgagtggcctgactgtgcatatgcgaacacacacgggtgagagacctttcgaatgtcaggaatgtggcaaggcttttactcgaagcacatatctgatccgccatctgaggtcccatagcgtggagaagccctacaaggagtgtggccagacattctccaattcttcttgcctcaccgagtgcgtgtag

SEQ ID NO: 14380 - DNA, 1377 bp, Artificial Sequence
  Description of Artificial Sequence: Synthetic coding sequence
atggagagaaatcacttcggagaagagctttttgacttcaaccaatgtgagaaggccctatcagaacactcctgcctgaaaacacaccgcagaacctactttaggaagaagacatgtgaatgcaatcaatgtgaaaaggcttttcgcaaaccaagcatcttcacacttcacaagaagaccgacattggagaggagctaccaaattgtaaccaatgcgagacggctttttcacagcacctccatcttgtatgcaagaagactagccagaacctgcacttggtgtgcaagaaaacacacacacaagagaaaccctataaatgctccgactgcgagaaggggttaccatctagttcccatctgagggaatgcgtaaggatctatggcggcgagagaccatatacccacaaagaatacgtggagacgttcagtcattccacagccctgttcgtgcatatgcaaacccaggacggagagaagttctatgagtgtaaagcctgtggaaagccgtttaccgagagtagctatctgacacagcacctgagaacccacagcagagttttgcccattgagcacaagaagttcgggaaggcctttgctttttcgcccgacctggcaaagcacataaggctgagaacccgcggtaaacattatgtttgcaacgaatgtggcaaggaatttacttgcttctcaaagctgaacatccacatcagagtccacaccggggagaagccttacgaatgcaataaatgtggcaaggcctttacagacagctctggtctcatcaagcacagaaggacccacacaggagagaaaccttatgaatgcaaggaatgcggcaaggctttcgccaacagcagccacctcactgtgcacatgcgcacccacactggcgaaaaaccttatcagtgcaaggagtgcgggaaagcgttcataaatagtagctctttcaagagtcacatgcagactcaccctggcgtgaagccctacgattgccaacagtgtggtaaagcatttatacgtagcagttttctgatcagacatcttagatcccacagtgctgaaagaccattcgaatgcgaagaatgtgggaaggcctttaggtactcctcgcacctttcacagcacaaacgaattcataccggtgaacggccatataaatgtcaaaagtgtggccaggcattctcaatctcctccggacttacagtccatatgcgtacccacacgggggaacgcccctttgaatgtcaggagtgtggaaaagccttcacaaggtccacatatcttattcggcacctccgtagccacagcgtggaaaaaccttataaggaatgtggacagactttctctaactcgtcatgcctgaccgagtgtgtctag

SEQ ID NO: 14381 - DNA, 1617 bp, Artificial Sequence
  Description of Artificial Sequence: Synthetic coding sequence
atggtggcaggttggctaacaaattactcacaggactccgtgacgttcgaagacgtcgcagtcgactttacccaggaagagtggacacttcttgatcagacccagagaaacctgtatagggatgtcatgctggaaaattataaaaacttagtggccgtggattgggagtcccacattaacacgaagtggtcagccccccaacagaattttttgcagggtaaaacttcttctgtggttgagatggagaggaaccattttggagaggaattatttgacttcaatcagtgtgagaaagccctctctgagcatagctgtctgaaaactcaccggcgcacttacttcaggaagaagacttgtgagtgtaaccagtgtgaaaaagcttttcgtaagccttcaattttcactctgcacaagaagactgatattggtgaggaactgcccaattgtaaccagtgcgagactgccttctctcagcatctgcaccttgtttgtaaaaagacctcacagaacctccacctggtctgcaaaaaaacgcacacccaagaaaagccatataagtgttctgactgcgagaaaggattgccctcatcatcccacctccgggagtgtgtgcggatatacggaggggaaagaccttacacgcataaggagtacgtggagacgttctcccactccacggctctgttcgtccatatgcaaacccaggacggcgagaagttctacgagtgcaaggcctgtggtaagccctttacagagtcctcctatctgacacagcaccttcgaacacactcaagagtgctgcccatcgagcacaagaaatttggaaaagcgttcgcattttcacccgacctcgccaaacacattcgtctgaggaccagaggaaagcactacgtgtgtaacgaatgcggcaaggagttcacatgctttagcaagcttaatatccatatccgggtgcacactggtgagaagccctacgaatgcaacaaatgcggcaaagcctttacagactccagcggcctgatcaagcatcggcggactcacaccggtgagaagccgtacgagtgcaaagagtgcgggaaggcattcgcaaactcatctcacctcaccgttcacatgagaacacacacaggagagaaaccgtaccagtgcaaggaatgtggaaaggcttttataaatagctcgtcattcaaaagtcacatgcagacccaccccggcgtgaaaccctatgattgtcagcaatgcgggaaggctttcattagatcttctttcctgatcagacacctgagatcgcatagtgcagagagacctttcgagtgcgaagaatgcgggaaagcgtttcgctatagctcccaccttagtcagcacaagagaatacatacaggggagagaccatacaaatgccaaaaatgtggccaggcattctctatttcttcagggctgactgtccacatgcgtacgcacaccggggagaggccatttgagtgccaagagtgcggcaaagcttttacccgctcaacctacctgatacggcacctacgctctcactctgtggaaaagccgtacaaggagtgcggacagactttcagcaattcttcatgtctgaccgagtgcgtgtag

SEQ ID NO: 14382 - DNA, 2373 bp, Artificial Sequence
  Description of Artificial Sequence: Synthetic coding sequence
atggcctactgtctcacaaattgttatcaatattcagtgacgtttgaagacacagctgttgattttactcaagaggaatggatcctgcttgacccggtccagagaaatctctatcgcgatgtgatgctggagaactatgagaacgtggcaaaggtgggatttcagctgtttaagccaagcgtcatctcttggctggaggaagaggaactccgcacgttacaacaaggtgtcctccaggactgggccatcaaacaccagacctccgtctccgccctccaacaggagttctggaaaattcagaccagcaatgggattcagatggacctggtgacttttgatagcgtggcggtggagtttactcaggaagagtggactctgttagacccggcccagcgaaatctctacagcgatgtcatgctggaaaactacaagaacttaagctcggtgggttaccagttgttcaagccctctcttattagctggctggaggaggaggaagagcttagcaccctgcctcgagtcctgcaagaatggaagatgtgcctgaagacgaaggggccagcactatggcaggacaacttttgcctaaaaaccttgaacgggatccaattggcaagaaatcagaacggggaggagctctatgactgtaagcagtgcgaggacgtgttctgtaagcacccatgcctaaaaacgaacatgtcaacacaaaatagaggcaacacttctgaatgcattcaatacgcgaaggacctgttaagcctatataacaagactagcaccattcgcaaggtgagcgttttttcaaaacacggcaaaagttttagactgatcctgaatgtgcaggtccaaaggaagtgtacccaagataaaagtttcgagggaaccgattatggcaaagccttcatttaccaatcttatcttgaagctcacaggaaaactcagtctggggaaaagctgaatgaatggaagcagtgtggtgaagcttttacccattcaacctcgcacgctgttaacgtggagacccatattatcaagaacccttatgagtgcaaggagtgcggtaaggattttagatatcccacgcatctcaataaccacatgcagacacatattggaattaaaccgtataagtgtaaacattgcggaaagacctttactgtgcccagtggattcctggagcacgtgcgcacccatactggggagaagccgtacggatgcaaggaatgtggcaaagctttcggcacatcagccggcctcattgagcacatccgctgtcatgctagagaaaagaccttcaaatgcgatcattgtggtaaagccttcataagttaccccagcctgtttgggcacctgcgggttcacaacggcgagaaaccatacgaacacaaggagtatgggaaagctttcggaacatcctcaggcgtgatcgaggaccgccggtcaaacaccggacagaaaagatttgattgcgaccagtgcggaaaagtttttgtgagttttagttcattattcgcccatttacggactcatacaggcgagaaacctttcaagtgttataaatgcgggaagccgtttacctcctccgcctgtctccggatccatatgcggacgcataccgaagagcgactttatcaatgcaaaaaatgtgggaaagccttcaccaagtgctcgtaccttacaaagcacttgcgcacccatgcaggggagaagccctacgagtgcatgaaatgtggaaaggcattcacagaaagatcttatttgaccaagcatctgcgtcgccactctggcgaaaagccttacgagtgcaagaaatgcggcaaggcctttactgaaagatctgatttaaccaagcaccttcggagacacaccggagacaaaccatatgagtacaaagattgtggaaaggcgttcgtcgtcagttcctctctcgtggatcacctccggacgcacacaggttacaagccatataaatgcaacgcatgcgaaaaggcttacagtagatcttgcgtgctgacccagcatctgaagactcatgccgccgagaaaacgtctgagtgcaacgcttgcggcaactccttccgcaattccatgtgctttcatgacaggctcaagaccctgaccaaaataaagccctacaaatgcaaagattgtggcaaggcctttacatgccactctgatctcacaaatcacgtccgcatccatacgggcgagaagccttacaagtgtaaggagtgtgggaaggcattccggacgtcttcaggacggattcaacatttgcgtacccacatgggagagaagcccttcgagtgcgaccaatgcggaaaagcattcgcgagcttttccgctagaattgcccatctcaagacgcattag

SEQ ID NO: 14383 - DNA, 1461 bp, Artificial Sequence
  Description of Artificial Sequence: Synthetic coding sequence
atggcagctatctaccttagcaggggcttcttcagtcgggagccgatctgtccattcgaagaaaagacaaaggtggaaaggatggtagaggattacctagccagcggctatcaggactcggtgaccttcgacgatgtggccgtggatttcactcctgaggaatgggccctgctggataccaccgaaaagtacctgtaccgagatgttatgcttgaaaactacatgaacctggcctcagtcgaatgggaaatccagccccggacaaagcgctctagtcttcagcagggattcctgaaaaatcagattttctccggtatccagatgacccggggttacagcggatggaagttatgcgactgtaagaactgtggcgaggttttccgggagcagttttgcctgaaaacccacatgagggtgcagaacggtggcaacacctctgagggaaactgctatggaaaagatactctcagcgttcataaggaagccagcacaggtcaagaactgtctaaattcaatccctgcggtaaggtgtttaccctgaccccagggctggccgtgcacctagaggtgctcaacgcccgacaaccctacaagtgcaaggagtgcggaaaagggtttaaatatttcgcttcgcttgataaccatatgggaatccatacagacgagaagctctgcgaatttcaggaatatggccgcgctgtgacagccagctcccatctgaagcagtgtgtagccgtccatacaggcaagaaaagcaaaaagaccaagaagtgtgggaagtctttcacaaacttttcccagttgtatgcccctgtgaagacgcacaagggcgagaagagcttcgaatgtaaggagtgtggaagatcatttcggaactcctcttgtctcaacgatcacatccagattcataccggaatcaaaccacacaaatgtacatactgcgggaaggccttcacccgcagcacccagctcacggagcacgtcagaacccacacaggcatcaagccctacgaatgcaaagagtgtgggcaagccttcgcccaatacagcggcctatcaatccacattagaagtcatagcgggaaaaaaccataccaatgtaaagaatgcggcaaggcatttactacttctacctcgctaattcagcatacaaggatccatactggggaaaagccatatgaatgcgttgagtgcggcaagacatttataaccagttctcgaagatctaagcacctaaagacacattccggagagaagcccttcgtgtgtaagatatgcggcaaggccttcctttatagctctcgactcaatgttcacctccgaactcatactggggagaaacccttcgtctgcaaggaatgcggtaaagccttcgccgtttcctctagactgtctcgccatgagcggatccacactggcgaaaagccatatgagtgtaaagacatgtccgtcactatctag

SEQ ID NO: 14384 - DNA, 1053 bp, Artificial Sequence
  Description of Artificial Sequence: Synthetic coding sequence
atgcgcgtccagaatggcggcaacacgtcggaaggtaattgttacggcaaggataccctctccgtgcacaaggaggcttccaccgggcaggaattgtccaaattcaacccctgcgggaaagtcttcactctgactcccgggttagctgttcatttagaagtgctgaacgcccgccagccttataaatgtaaggagtgcggcaagggcttcaaatatttcgcctcactcgacaaccatatgggcatccacaccgatgagaagctgtgcgaattccaggagtatgggagggcagtgacagctagcagtcatcttaaacagtgcgttgcggtccacacaggcaagaagtcaaagaagacaaagaagtgcggcaagtccttcactaacttctctcagctctacgccccagttaaaactcacaagggggagaaatccttcgagtgcaaggagtgtggtaggtctttcagaaattcttcttgcctcaacgaccacattcaaatacacacgggcatcaagccacataaatgtacttactgcggtaaagcatttacccgctctacccagctcaccgaacatgtccggacccataccggtatcaagccatatgaatgtaaggagtgtgggcaagcttttgctcagtactcaggtctgagcatacacatacggtcacattccggaaagaagccatatcaatgtaaggaatgtggaaaggcttttacaacctctactagccttattcaacacacccgtatacacacaggcgagaagccctacgaatgcgtcgaatgcggaaagacttttattaccagcagccgccgctccaaacatctgaaaacacattccggtgaaaagccgtttgtgtgcaagatctgcggaaaggcctttctctattcatcacgcctgaacgttcatctgaggacgcacacaggcgagaagccattcgtgtgtaaggaatgtggcaaggctttcgccgtctccagcagactgtcccgacatgaacgcatccataccggagagaagccttatgagtgcaaagatatgtctgtgacaatctag

SEQ ID NO: 14385 - DNA, 231 bp, Artificial Sequence
  Description of Artificial Sequence: Synthetic coding sequence
atggccgccatctatctctcaagggggtttttttctcgcgagccaatttgtccatttgaagaaaagaccaaagttgagcgcatggtggaggactatcttgccagcggttaccaggatagtgtgacattcgatgacgtcgccgtcgattttacccccgaggagtgggcacttttagataccactgaaaaatacctctaccgcgatgtaatgctggagaactatatgaactag

SEQ ID NO: 14386 - DNA, 1254 bp, Artificial Sequence
  Description of Artificial Sequence: Synthetic coding sequence
atgctggagaactacatgaatctggcctcagtcgagtgggagattcagcctagaaccaagcgttcgagtctacagcagggatttttaaagaaccagattttcagcggaatccagatgacaagagggtacagcggctggaagctgtgcgattgcaagaactgcggagaggtgtttagagaacagttctgcctcaagacacatatgagagtgcaaaatggcggtaatacaagtgagggtaactgttatggcaaggacactttaagtgttcacaaggaagcatcgaccggccaggaattgtcaaaattcaacccctgtggaaaagtgtttaccctgacgcccggactggccgtccacttggaggtccttaacgcccgccaaccttacaaatgtaaagagtgcggaaagggtttcaagtattttgccagccttgataaccatatggggattcataccgacgagaaactctgcgagtttcaagaatatgggcgagcagtgaccgccagcagtcacttgaagcagtgtgtggccgtgcatacgggtaagaaatcaaaaaaaacaaaaaagtgcggaaagtcatttaccaacttcagccaactgtacgccccggtcaaaactcacaagggagaaaagagcttcgagtgcaaggagtgtggtcgatcctttcgaaatagctcctgtctgaacgaccacatccaaattcatacaggaatcaagcctcacaagtgcacttactgtggtaaggctttcacccgcagcacacaactaaccgagcacgtacgcactcatactggcattaaaccctacgaatgcaaagaatgcgggcaagccttcgcacagtattccgggctgagcatccatattaggagccacagtggcaagaagccataccaatgcaaggagtgtgggaaggccttcaccaccagtaccagcttgattcagcacacacgtatacatactggcgaaaaaccatatgagtgtgtcgagtgtgggaagaccttcatcacaagtagccgtcgcagcaaacacctcaaaacacatagcggcgagaaaccctttgtatgcaagatctgtggaaaagctttcctgtatagctccaggctcaatgtccacctgagaacccacactggcgaaaaacctttcgtgtgtaaggagtgtggcaaagctttcgctgtgtcctcacggctttctcgccacgaacggatccataccggtgaaaagccttatgaatgcaaggacatgagcgtcactatatag

SEQ ID NO: 14387 - DNA, 126 bp, Artificial Sequence
  Description of Artificial Sequence: Synthetic coding sequence
atggctgccatatacctctctagaggttttttctcacgggaaccgatatgcccgttcgaagaaaagacaaaggtggaacgcatggtggaagactatttggcaagtggataccaggactcagtatag

SEQ ID NO: 14388 - DNA, 1065 bp, Artificial Sequence
  Description of Artificial Sequence: Synthetic coding sequence
atgtctgcctttgatatgtcacatgatttttttttttgcctgacgtcagagtgggagatccagcctagaactaagcggagcagtctgcagcagggctttcttaagaaccagatctttaccggcatacaaatgcagacccgaagctactcaggctggaagctgtgcgaaaactgcggggaggtatttagtgagcaattttgtcttaagactcatatgcgcgctcagaatgggggaaacacatttgaaggcaattgctacggtaaagatagcatctctgttcataaggaagcaagcatcggccaagaactttcgaaattcaacccctgcggtaaagttttcaccctgactcctggtctcgcagttcacctggagatcctgaatggtcggcagccatacaagtgcaaggaatgtggtaagggcttcaagtacttcgcctccctggataaccatatggggattcatatcggtgagaagttgtgtgaatttcaggagtgcgaaagagccattactacaagttctcacctgaagcagtgtgtcgcggttcacaccgggaagaagtctgagaaaaccaaaaattgtggtaagtccttcactaacttttctcagctgagcgctcatgctaaaacacacaagggcgagaagtccttcgaatgtaaagagtgtggacggagctttcggaactcctcttctttcaacgttcatatacagattcacaccggtattaagcctcacaagtgtactgaatgcgggaaggcattcaccagaagcacgcacttgacacaacacgttagaacacatactggcattaagccatatgagtgtaaagagtgtggccaggcctttactcagtacaccgggttagccattcatatcaggaaccacaccggagaaaaaccataccagtgtaaggagtgtggcaaggcattcaaccgctcatctaccctgacacaacaccggcgcatccatacaggcgagaagccatatgagtgtgtcgaatgtggcaaaactttcatcacctccagccatcggtctaagcacctgaagacgcacagtggcgaaaggtag

SEQ ID NO: 14389 - DNA, 1281 bp, Artificial Sequence
  Description of Artificial Sequence: Synthetic coding sequence
atgagcgcgttcgatatgtctcatggctttttcccacgcgaaccaatttgccctttcgaggagaaaaccaaaatcggtaccatggtggaggaccaccggtccaactcctaccaggacagcgtgacattcgacgacgtcgcagtggaattcacaccagaagaatgggccttgctggatacaacccagaagtacttatatcgcgacgtgatgctcgagaattatatgaacctggccagcgttgactttttcttctgtctcacgtccgagtgggaaatacaaccacggaccaagcggtcctcactgcagcaggggttcctcaagaatcagatctttaccgggatccaaatgcagactaggagctactcaggctggaagctgtgcgagaattgcggggaggtgttcagtgaacaattttgcctgaaaacccacatgcgagcgcagaatggaggaaataccttcgagggcaactgctatggtaaggactccatcagcgtgcacaaggaagcctcaattgggcaggagctgtctaagttcaatccatgcgggaaagtctttactctcacaccggggctcgcggtacacctagagatcctgaatggccgccagccttacaagtgtaaggaatgcgggaaaggctttaagtatttcgcctccctcgacaaccacatgggcatccacatcggagaaaaactctgcgagtttcaagaatgcgagcgggctataaccacaagctctcatctcaagcagtgcgtggcagtacacacgggtaagaaaagcgaaaaaaccaagaactgcgggaaatcattcaccaacttttcccagctgtctgctcacgcaaagacccacaagggcgagaagagtttcgaatgcaaggagtgtggacggagtttccgtaacagcagttcttttaatgtgcatatccaaatccatacaggcatcaaaccccacaaatgtactgaatgcgggaaagccttcacaagatctacccacctcactcaacacgttagaactcacacagggatcaaaccctatgaatgtaaggagtgtggccaggcgttcacccagtatacagggctggccattcatataaggaatcacaccggggaaaaaccttaccagtgtaaggagtgcgggaaagctttcaaccgcagctccactctgactcaacatagaaggatccacacgggtgaaaagccgtatgagtgtgtcgagtgtggtaaaacattcattaccagtagccataggtccaaacatctcaaaacccatagcggggagaggtag

SEQ ID NO: 14390 - DNA, 1281 bp, Artificial Sequence
  Description of Artificial Sequence: Synthetic coding sequence
atgtctgccttcgatatgtcccatgggtttttcccacgggaacctatctgcccattcgaggagaaaaccaaaatagggacgatggtcgaggaccacaggagtaacagttaccaagactctgtgaccttcgatgacgtggcagtcgaatttacaccggaagaatgggcgctgctggacacaacccaaaagtacctttaccgggatgtcatgctggaaaactatatgaacctggccagtgtcgacttctttttttgcctaacctcagagtgggaaatccagccccgaaccaaacggtcaagcctacagcaaggcttccttaaaaaccaaatttttaccggcattcagatgcagacgagatcttacagcggttggaagttgtgtgagaactgtggggaagtgttcagcgagcaattttgcctgaaaacccacatgcgtgctcagaacggtggtaacacatttgaagggaactgttacggcaaggattcaatctccgtacacaaggaggcgtccattggacaggagcttagcaagttcaatccatgcggcaaggtgttcactctgacccctggcttggctgtgcatctcgagatcctgaacggtcgacagccatacaaatgtaaagagtgtgggaaaggcttcaaatacttcgcaagtctggacaaccatatggggatacacattggcgaaaaactttgcgagtttcaagaatgtgaacgggccattaccacctcgtcacacctaaagcagtgcgtcgctgtgcacaccggcaaaaagtcagagaagacgaaaaattgtggtaagtcctttaccaatttctctcagcttagcgctcatgcaaaaactcataagggcgagaagtcgtttgagtgtaaagaatgcggccggtcattcaggaactcaagtagcttcaacgtacacatccagattcataccggcatcaagccccacaagtgcaccgagtgtggcaaggcgttcacccgtagtacacacctcacccaacatgttagaactcatacggggatcaagccatatgagtgcaaggagtgcggtcaagcattcacccagtatacggggctggctatccatatccggaatcatacaggcgaaaaaccataccagtgtaaagaatgtggaaaagcttttaaccgctccagcaccttaacccagcaccgccgaatacacaccggcgaaaaaccttacgagtgtgtggagtgtggtaagacttttataacaagtagtcacaggagtaaacatctgaagacacacagtggcgagcgatag

SEQ ID NO: 14391 - DNA, 1074 bp, Artificial Sequence
  Description of Artificial Sequence: Synthetic coding sequence
atgctcgaaaactacatgaatctcgcatcagtggacttctttttctgcctgacttccgagtgggagatccagcctcgaaccaaacgatctagcctacagcaaggctttctgaaaaatcaaattttcacggggattcaaatgcagacacgatcatattccggctggaagttatgtgagaattgcggggaggtcttctccgagcagttctgcctaaaaactcatatgcgggcccagaatggaggtaatacattcgaaggtaattgctatggcaaagactcgatttcagtgcacaaggaagcaagcatcggtcaggaactgagtaaatttaacccgtgtggtaaggtcttcacattaactcccggcctagccgtgcatcttgagatcctcaacgggcgccagccctataagtgcaaagagtgcggtaaaggattcaagtactttgcgagtctggataaccatatggggatccacatcggtgaaaagctgtgcgagtttcaagaatgcgaacgcgcaatcaccacaagctcacatctcaagcagtgcgtggccgtccatacaggtaaaaagtctgagaagactaagaactgtggcaaatcttttactaatttcagtcagctatccgctcatgctaagacccacaaaggcgaaaaatcattcgagtgtaaagaatgtggacggtcctttcgcaacagcagttcttttaacgtgcatatccaaattcacaccggcatcaagcctcacaaatgtactgagtgtggaaaagccttcacgcgcagcacgcacctgactcagcatgtccgaactcacactggaataaaaccgtatgagtgcaaggagtgcggacaagctttcacacaatatacaggcctggccatacatatccgcaaccataccggcgaaaaaccctatcagtgcaaagagtgtgggaaggccttcaatcggtcatcaaccttgacccagcatagacggatccacacaggagagaaaccatatgaatgcgtggagtgcggtaagacctttattacatcttcccacagaagtaagcacttgaaaacccattccggagagagatag

SEQ ID NO: 14392 - DNA, 933 bp, Artificial Sequence
  Description of Artificial Sequence: Synthetic coding sequence
atgacgagatcatatagcggctggaaactttgtgagaactgtggggaggttttctcggagcaattttgtctaaagacacatatgcgggcccaaaacgggggtaacacctttgagggcaactgttatggaaaagattccatctccgttcataaagaagccagcataggtcaggaactgtccaaatttaatccttgtgggaaggtgttcaccctgacacctggactggccgtacaccttgagatcctgaacggccgacagccatacaagtgtaaagagtgtggcaaagggttcaaatactttgccagtctggacaatcacatgggaatccacatcggggagaaactatgtgagtttcaagagtgcgaaagagcgattaccacgagttctcacctgaaacagtgcgtcgcagtacacaccggcaaaaagtcagagaaaactaagaactgcggcaagagttttacaaatttctcccagctgtccgcacatgccaaaactcacaagggcgaaaagtccttcgagtgtaaggagtgcggtcgctcatttaggaattcaagcagcttcaacgtgcatatacagatacacaccggtatcaagcctcacaagtgtactgagtgcgggaaagcatttacccgtagcacccatctgactcagcacgtccgaacacataccggaattaaaccctatgagtgtaaggagtgcggccaggcattcacacagtatacagggctagctattcacatcaggaaccacacaggagagaagccctatcaatgtaaggagtgcgggaaagcatttaacaggtcctccaccctgacccagcatcggcgcatccacacaggtgagaaaccttatgagtgcgtagagtgtggaaagacattcatcacttcctcccaccgaagcaagcacctgaagacacattccggagagagatag

SEQ ID NO: 14393 - DNA, 1170 bp, Artificial Sequence
  Description of Artificial Sequence: Synthetic coding sequence
atggactctgtgaccttcgacgacgtggctgtggaatttacccccgaggagtgggcactgttagacaccacgcaaaagtacctctaccgcgatgtgatgttggaaaattatatgaatttagcctcagttgattttttcttttgtctcaccagtgaatgggaaattcaacctcgaacaaaaaggtcatccctccaacaaggatttctgaagaatcagatcttcaccggcatccaaatgcagaccagaagttactccggctggaagttatgcgagaattgcggagaagttttcagtgaacagttttgcctgaagacgcacatgagggcccagaacggcggaaacacattcgagggaaactgttacggaaaggacagcattagcgtgcacaaggaggcatcaatcggacaggagctgtctaagtttaacccctgtggaaaagtcttcactttaacccctggactggccgtgcacctggaaatcctcaatggacgtcagccatataaatgcaaggagtgtggaaagggcttcaagtatttcgcatcattggacaatcatatggggattcacattggcgagaaactgtgtgaatttcaggaatgtgagagggccatcacgacgagctcacacctcaaacaatgtgtggcagtgcacaccggcaagaaaagcgaaaagacaaaaaattgcgggaagtcattcactaatttcagtcagctctctgcgcatgccaagactcataagggggaaaaatctttcgagtgcaaggagtgtggacgaagctttagaaacagtagcagttttaacgtccatatccaaattcacaccggtatcaagcctcacaaatgtactgagtgcggaaaagctttcactcgctccacccatcttacccagcatgtaaggacccacacaggaattaagccttacgagtgcaaggagtgcggtcaggcctttacccagtacaccgggcttgccatacatattaggaaccatacaggcgagaagccataccagtgtaaggaatgcgggaaggcgttcaatcggagctcaactctgacgcagcatagacggatccacacaggggaaaagccatacgaatgtgtcgaatgtggcaagactttcatcacatcctcccatagaagtaagcatctcaaaacccactcaggcgagagatag

SEQ ID NO: 14394 - DNA, 1431 bp, Artificial Sequence
  Description of Artificial Sequence: Synthetic coding sequence
atggacgccgtggcctttgaggatgtggcggtgaattttacacaggaggaatgggctctattaggcccaagccagaagaatctttatcggtacgtgatgcaggagactattcggaatctggactgtattcgaatgatttgggaagagcagaacactgaagatcagtacaaaaatccaagaaggaatctgagatgccacatggttgagaggttcagcgagtcaaaggactcctctcaatgtggcgaaacttttagccttatacgagactctatcgtgaacaactccatttgcccgggagaagacccttgccagagcgccgagtgtgaggaagtaattatgggccatctcagccttaattcgcacatccgcgttgactcaggccacaagcctcacgaataccaggagtatggggagaaacctcatacacacaagcagcgaggcaaagccttctcctatcaccacagctttcagagtcgcggcagacctcacacaggaaagaagcgctacgagtgcaaggagtgcggaaaaacattttcaagcagaaggaaccttagaagacacatggtcgtacaggggggaaatagaccttacaagtgcaaactatgcggaaaagcatttttttggcctagcctgctgagaatgcacgagcggacccacaccggcgaaaagccctatgaatgtaaacagtgcagcaaggcgttccccttttactcctcttatcggcgccatgagaggatgcacacaggagagaagccttacgaatgtaaacagtgctctaaggctctccccgactcctcatcctacataagacacgagagaacgcataccggagagaaaccttatacctgtaagcagtgcgggaaagctttctctgttagctcatctctgagaagacacgagaccacccacagcgcggagaagccatatgagtgcaaacagtgcggcaagacatttcaccacctaggatcattccagattcacatgaagcggcacaccggagataggccccataagtgcaaaatctgcggcaagggatttgaccgtccatctttagtgcgttatcacgagagaatccacactggcgagaaaccatacgagtgcaaacagtgcggtaaaaccctcagccactcctcctccttccgccgccacatgataatgcataccgggggtggacctcacaagtgtaaaatttgtggcaaggcattcgtctacccatccgtctgccagcgccatgagaaatcacatagcggtgagaagccttacgaatgcaaacagtgtggtaaggcgctctcacattcttcaagcttcagacgtcatatggtcatgcacaccggtgacggaccgaataagtgtaaagtatgcggtaaagccttcgtgtatccctccgtttgccagcggcacgaaaagacccactggcgtgagacaatttag

SEQ ID NO: 14395 - DNA, 690 bp, Artificial Sequence
  Description of Artificial Sequence: Synthetic coding sequence
atggatgccgtcgccttcgaagacgtggccgtgaacttcacccaggaagagtgggccttgctaggtccctcacagaagaacttgtacagatacgtaatgcaggaaacaataagaaacttggactgtataagaatgatttgggaagagcagaacacggaggatcaatacaaaaaccccagacggaatcttcggtgtcacatggtcgaacgcttctcagagagcaaggactcctctcagtgtggtgaaaccttcagtctgatccgagattccatagtcaacaattctatctgcccaggtgaagatccatgtcagagcgcagagtgtgaagaggtgatcatgggacatttgtccctgaacagccatattagagttgactccggccacaaaccacacgaataccaagagtatggagagaaaccacacacccacaaacagagagggaaagctttcagctaccatcactcctttcagagcagaggccgacctcacacagggaagaaaagatacgagtgtaaagagtgcggtaaaactttttcttctcgcagaaacctgagacggcatatggtagtgcagggcggaaacagaccatataaattccctatcgaagatatgagagagtgcacactgggccgtaaccggatgaatgtgagcagcgtactgaagccctgtcttatccctgtccctatctag

SEQ ID NO: 14396 - DNA, 1662 bp, Artificial Sequence
  Description of Artificial Sequence: Synthetic coding sequence
atggactcggtggcatccgaagatgtcgccgtgaattttacactggaggaatgggctttactggatccctcccaaaaaaagctgtatagggatgtgatgagggagacattcagaaatctcgcttgtgttggtaaaaagtgggaagaccagagtattgaggattggtacaaaaaccaaggacgcatcctgaggaaccatatggaggaaggcctgtccgagtcgaaagagtacgatcaatgcggtgaggccttctcacagattctaaaccttaatctgaataagaagattcccacgatcgtgagaccctgcgagtgctcactgtgtgggaaagtcttcatgcaccattcttcattatccagacacatcagatcccacttgggccataagccttacgattatcaggaatatggcgagaagccatacaagtgcaagcagtgtgggaaggccttttcaagttgtcagtccttccgccggcatgaacggacacacacaggtgagaagccctacgcttgtccagagtgcgggaaggcatttatatcactgccaagtgtgagaagacatatgattaaacatacgggagacggtccatacaaatgccaggaatgcgggaaggccttcgatcgacccagtctctttcagatacacgagcggacacacacaggggaaaagccctacgagtgtcaggagtgcgccaaggcctttatttccctgccaagctttcagaggcatatgatccggcacaccggggacggcccttacaagtgccaggaatgcggtaaggcctttgaccgtcctagtctattccgaatacatgagagaacacacacgggtgaaaaaccccatgaatgcaaacagtgtggcaaggccttcatttcctttaccaattttcaatcccacatgattcgacacacaggcgacggaccttacaaatgcaaagtatgtggcagagcattcattttccccagctacgtcaggaagcacgagcggacccatactggggagaaaccgtacgaatgtaacaagtgcggtaaaacattttcctcaagctctaatgtccgcactcacgagagaacgcatactggcgagaagccttacgaatgcaaggaatgtggcaaggcctttatatccttgccttctgtgaggcgccatatgataaaacacactggagatggcccatacaaatgccaggtgtgtggtagagcattcgattgtcccagcagcttccagatacatgaacggacccacaccggagaaaagccctacgagtgccaggtgtgtggcaaggcgtttataagtctgaagcgcatccgtaagcatatgattctccacaccggcgatggcccttacaaatgtcaggtttgtgggaaagcctttgactgccccagcagcgtgcgtacccacgaacgcactcacactggagaaaaaccatacgagtgtaaggagtgtggtaaggcattcaattatgcatctagcatccgtatccatgagagaacacatacaggagaaaaaccttatgagtgcaaacagtgtggtaagaccttttcctacagtagctctttccaacggcatgagagggctcataatggtgacaagccttacgtgaagaacgtcggcaagctctccttcataacacagccctctaacacatgtgagaatgaatag

SEQ ID NO: 14397 - DNA, 1260 bp, Artificial Sequence
  Description of Artificial Sequence: Synthetic coding sequence
atggcacaggagagcgtgatgttctccgacgtctccgtggatttcagtcaagaagagtgggaatgtctgaatgacgaccagagggatctctacagagatgtgatgctggaaaactattctaatctggtgagtatggctgggcactctattagcaagccgaatgtgattagctacctggagcaaggtaaagaaccctggctggccgacagagaactgacgcggggacaatggccggtcctagaatcgcgctgtgagaccaagaagctgtttctcaagaaagagatctatgaaatagaatccacccagtgggaaattatggaaaaacttaccaggcgagacttccaatgtagcagctttcgcgatgactgggaatgcaatagacaattcaaaaaggagctgggtagtcagggtggccatttcaatcaattggtgtttacacacgaggacctgcctaccctcagccaccacccctcctttacattgcagcaaatcatcaactccaaaaaaaaattctgcgcttcgaaagagtaccgcaagacattcagacacggcagccagtttgccactcatgagattatccatactatagagaaaccgtatgagtgcaaggagtgtggcaagtcattcagacatccaagtcgcttgacccatcaccaaaaaatccataccgggaaaaagccattcgagtgtaaggagtgtggtaagacattcatatgcggaagtgatttgacgcgccatcaccggatccataccggcgagaagccctatgagtgtaaagaatgtgggaaagcgttctcatccggcagtaattttactcgacaccagaggattcacactggcgaaaagccttatgagtgcaaggagtgtggcaaagcatttagctccggttcgaactttacccaacatcagcgcattcatacaggggagaaaccctacgaatgtaaggaatgcggcaatgccttctctcagtcctctcaactgataaagcatcagcgcattcacaccggcgagaaaccttatgagtgcaaagagtgtgaaaaagcctttagatctggctctgacctgacacgacaccagagaattcataccggggagaaaccttatgaatgcaagatatgcggaaaggcatattcccagtcaagtcagctgatatcccaccaccggatacacacttccgagaaaccttatgagtacagggaatgcggcaaaaacttcaattacgatccccagctgattcaacaccagaacctctattggtag

SEQ ID NO: 14398 - DNA, 1257 bp, Artificial Sequence
  Description of Artificial Sequence: Synthetic coding sequence
atggcacaggaatcagtaatgttttcagatgtatccgtggacttttcccaagaggaatgggagtgcctgaatgatgaccagcgagacctgtacagggacgtgatgctcgagaactactctaacctcgtgagcatggggcacagcatctctaaacccaatgttatctcttacctcgaacagggaaaggagccatggctggctgaccgcgagctaacgagggggcaatggcctgtgctcgaaagcaggtgtgagacaaaaaagctgttccttaagaaggagatctatgagatcgagagcacacagtgggaaataatggagaagcttaccaggcgggacttccaatgtagttcctttagggatgactgggaatgtaacagacagttcaaaaaggagctgggctcgcaaggcgggcatttcaatcagctggtattcacacacgaggatctcccgacgctcagccaccaccccagcttcacgttgcaacagataatcaacagcaagaaaaaattctgtgcttctaaggaatatcggaaaacttttcggcacggaagtcaattcgcgacgcatgaaatcatacacaccattgagaagccctatgaatgcaaggaatgtgggaagtcgttcaggcatccaagtaggttaacacatcaccagaagattcataccgggaagaaaccttttgagtgtaaggaatgtggaaagacttttatttgtggttcagacttaacacgtcaccaccgcatccacacgggggagaagccctatgaatgcaaagaatgtggcaaagcgttctccagcggcagtaacttcacacgccaccagagaattcacacaggcgagaaaccatatgagtgcaaagagtgcggtaaagcattcagctcaggcagcaactttacccagcaccagagaatacacacaggggaaaaaccatacgagtgtaaagagtgtggtaacgccttttcacagagtagtcaactgattaagcaccaacgcatccataccggtgaaaaaccttacgagtgcaaggagtgcgagaaagcattcagatctggcagtgacctgacacgacaccaacggatccataccggggaaaagccttacgagtgcaaaatctgtggaaaggcttacagccagtcatcgcagctcattagccaccatcggattcatacatctgaaaagccgtacgagtaccgcgaatgcggaaagaatttcaactatgatccccagctgatacaacaccagaatttgtattggtag

SEQ ID NO: 14399 - DNA, 477 bp, Artificial Sequence
  Description of Artificial Sequence: Synthetic coding sequence
atggcacaggaaagcgtgatgttcagtgatgtttctgtggacttctcacaggaggaatgggagtgtttgaacgatgatcagcgtgacctctatagagatgtgatgttggagaattacagcaacctcgtgagcatggcaggtcatagcatcagcaaacctaacgtgatttcatacctggagcagggcaaggagccctggttggccgaccgggaactcacgagaggacagtggccggtgctggagtcccgctgcgagaccaagaaactcttcctcaaaaaggagatttacgagatcgaatcaacccagtgggaaatcatggaaaaactgacccgcagggattttcagtgttccagttttagggacgattgggaatgtaacaggcagttcaaaaaggaattgggaagtcagggcggccactttaaccagctggtgtttacgcacgaagatttacccacacttagccaccatccatcctag

SEQ ID NO: 14400 - DNA, 1257 bp, Artificial Sequence
  Description of Artificial Sequence: Synthetic coding sequence
atggcacaggagagtgtcatgttcagtgacgtgtctgtggattttagccaggaggaatgggaatgcctgaacgatgatcagcgagacctgtacagagatgtaatgctcgaaaactactccaatcttgtcagtatgggacacagcattagcaagcctaatgtgatttcctatctggagcagggcaaagagccctggttggccgacagggagctcacccgcggtcagtggccagtcttggagtcacggtgtgaaactaagaaactttttctcaaaaaagagatttatgagattgagtctacccagtgggaaattatggagaagctgactcgtcgggatttccagtgttcttcctttcgggacgactgggagtgtaaccggcagtttaaaaaggagctgggaagtcaaggaggacattttaaccagctggtgtttacccatgaggacctgcctactctctctcaccatccgtccttcactttacagcagatcataaacagcaaaaaaaaattctgcgcctccaaagagtacagaaaaacttttcgccacgggtcgcagttcgccacacatgagattatccatactatcgagaaaccttatgagtgcaaggaatgtggaaagagtttcaggcacccatctcgcctcactcatcatcaaaagatacacacaggcaaaaaaccattcgaatgcaaggaatgcggcaagacgtttatatgtggttcggacctgactcgacatcaccgtatccacaccggagagaaaccatacgaatgcaaggagtgcggcaaggccttcagttctggcagcaatttcacaagacatcaaagaatccacactggggagaaaccgtacgagtgcaaggagtgcggtaaagcatttagcagcggctcaaactttacgcagcatcagcggattcacaccggtgaaaagccctacgagtgtaaagaatgcggcaacgccttttctcagagtagtcagctcatcaagcatcagcgcatccacacaggtgaaaaaccgtatgaatgtaaagagtgcgagaaagcctttcgaagtggctcagacctgactcgtcatcagcgcatccacactggggaaaaaccctatgaatgcaaaatctgtggtaaggcttattcacagtcctcccagcttatctcgcaccacaggattcacacaagcgagaagccatacgaataccgggaatgcggaaagaattttaattatgatccccagctgatccagcaccagaatctgtattggtag

SEQ ID NO: 14401 - DNA, 1260 bp, Artificial Sequence
  Description of Artificial Sequence: Synthetic coding sequence
atggcacaggagagcgtcatgttctcagatgtatccgtggacttcagtcaagaagaatgggaatgcctgaatgatgaccagcgggacctgtacagagacgtaatgcttgagaactactcaaatttggtgagcatggccggacactctatatcgaagcccaacgtcattagctacctcgaacaagggaaggagccgtggctcgccgaccgggagttaactcgtggacagtggcccgtcctggagtcgcgatgcgagacaaaaaaattattcctgaaaaaggaaatttacgaaattgaatccacccagtgggaaataatggagaagctaacccggcgggacttccaatgctcgtcttttcgggacgactgggaatgtaatcggcaatttaaaaaggagctgggctcacagggcgggcactttaaccagctcgttttcacgcacgaggacttgccaaccctgtctcaccaccccagtttcaccctccagcaaataatcaacagcaaaaagaagttttgtgccagtaaagaataccgaaaaaccttcaggcatggctcccaatttgcaacacatgaaatcatccacacgatagagaaaccttacgaatgcaaggagtgcgggaaaagcttcagacacccgagccgtctgacccatcaccagaagatccacaccggcaagaagcctttcgaatgtaaagaatgcggcaagacttttatttgcggatctgacctcacacggcatcacagaatccatacaggagagaagccctatgagtgtaaggagtgtggaaaagccttttcatccggctcaaattttacccggcatcagcgaattcacactggcgagaaaccatacgagtgcaaggagtgcggcaaggcgtttagcagcggatccaactttacacaacaccaacgcattcatactggcgaaaagccttacgaatgcaaagagtgcggaaatgctttttcccaatctagtcagctcataaagcaccagaggatccatacaggagaaaaaccttatgagtgtaaggagtgcgagaaagcctttcggtcaggctcggacttaacacgacatcagaggatccatacaggcgagaagccttacgagtgcaaaatctgcggcaaagcttattcccaaagtagccagctcatttcccatcaccgcatccatacttcagagaaaccctatgagtaccgagagtgcggtaaaaattttaactacgatccgcagttaatccaacatcagaacctgtattggtag

SEQ ID NO: 14402 - DNA, 1935 bp, Artificial Sequence
  Description of Artificial Sequence: Synthetic coding sequence
atgacttctcagtctagtgtaatctcaaattcctgcgtgacaatggaacggctttcacacatgatggaacggaaggcctggtgctcacaagaatccgctctgagtgaggaggaagaagacaccaccagacccctcgagaccgtgaccttcaaggacgtagcagttgacctgacacaggaggaatgggagcagatgaagcctgcccagcgaaacctctatcgggatgtgatgctggagaattactcaaatctcgtgacagtggggtgccaggtgaccaagcctgacgtcatcttcaagctggaacaagaggaagaaccttgggtgatggaggaagaaatgtttgggaggcactgtcctgaagtgtgggaggttgacgagcaaattaaaaagcagcaggagacacttgtgaggaaggtgacaagcatttcaaaaaaaatcttgattaaggagaaggtcatagagtgcaagaaggtggcgaagatttttccactgagttcggatatcgtgacttctcggcagtctttctacgactgcgattcccttgataaagggttggagcacaatcttgacctcctgcgctatgagaaaggctgcgtccgcgaaaagcagtcaaacgagttcggcaagcccttttaccattgcgcgagctacgtcgtgacaccttttaagtgtaaccagtgtgggcaggatttttcccataagtttgacttgatccgtcacgaacgcattcacgcgggcgaaaagccgtacgagtgcaaggagtgcggcaaggccttcagccggaaggaaaatttgattacacatcagaaaatccacactggcgagaaaccatacaagtgcaatgaatgtggcaaggcttttatccagatgagtaatttaatacggcatcatcgcatccacacaggagagaaaccatatgcctgcaaggattgttggaaggcatttagtcagaaaagtaacctgatcgagcatgagcggattcacaccggggagaagccttacgagtgtaaagaatgtggcaaaagcttctctcaaaagcagaatctcatagagcatgagaaaatccacactggagagaagccgtatgcctgtaatgaatgcgggcgagctttctcacgaatgtcctccgtgactctccatatgcgtagccatactggggagaaaccatacaaatgcaacaagtgtggaaaagcgttctcacagtgttccgtgttcattatccacatgaggtcgcataccggcgagaaaccctacgtttgctccgagtgtggaaaagcattttctcagtcctcatctcttaccgtgcacatgagaaatcacacagccgaaaagccttatgaatgtaaagagtgtggcaaagccttctccaggaaagagaatctcattacacatcagaaaatccacaccggagaaaaaccatacgaatgcagtgagtgcggaaaggcatttattcagatgagcaacctcatccgccaccagcggattcatacaggcgagaagccatacgcatgtaccgtctgcggcaaagcatttagtcagaagagtaatttgaccgaacacgagaagattcacaccggcgagaagccgtatcactgcaatcagtgtgggaaagccttcagccaacgacagaatttgctggagcatgagaaaatacacacgggtgagaagccatttaaatgcaatgagtgtggcaaagcattttcccgcatctcaagccttaccctgcacgtgaggtcccacaccggggagaagccatacgaatgtaataagtgtggtaaggctttctcgcagtgctcactgctcataattcatatgaggtcccacacaggcgagaaacctttcgagtgcaacgaatgtggcaaggctttcagtcagagagcttctctgtcgatccataaacgaggccacactggtgagaggcatcaagtgtattag

SEQ ID NO: 14403 - DNA, 1743 bp, Artificial Sequence
  Description of Artificial Sequence: Synthetic coding sequence
atgaaaccggcacagcggaatctttaccgggatgtcatgctggagaattacagtaacttggtgacagtcggatgccaggttacaaagcccgacgtgatttttaagctcgagcaggaggaggagccttgggtgatggaagaggagatgtttggaaggcattgccccgaagtatgggaagttgatgagcagatcaaaaaacaacaggagactctagttcgcaaagtcaccagtatcagtaagaagatcctgatcaaggaaaaggtcatcgagtgtaaaaaggtcgcaaagattttcccactttcctccgacattgttactagccgccagagcttctacgactgcgattccctggacaaaggattggaacataacctggacctgctgcgctacgaaaagggatgcgtcagggaaaagcagtccaatgaattcggtaagccattctatcactgtgcatcctatgttgtcaccccgttcaaatgtaatcagtgcggacaggactttagccacaagttcgacctgatccggcatgaacggatacatgctggcgagaaaccatacgagtgtaaggaatgcggcaaagcctttagccggaaggagaacctgatcacccaccagaagatccacactggggaaaagccctacaaatgtaatgaatgtggcaaagctttcatccagatgagtaatctgattaggcatcatcgcattcatacaggtgaaaagccttacgcctgcaaagattgctggaaagctttcagtcagaaatccaatcttattgaacacgagcgcattcataccggggagaagccctacgaatgtaaggagtgcgggaagtcttttagccagaaacagaatctgatagaacatgagaaaatccacactggggaaaagccctacgcgtgcaacgaatgcgggcgtgcattttcacgaatgagttccgttacgcttcatatgcgcagccacactggagagaagccatacaagtgtaataagtgcggtaaggcatttagccaatgtagcgttttcatcattcacatgagatcccacactggggaaaaaccatacgtgtgcagcgaatgtggaaaagcctttagccagagcagcagcctgacggtgcacatgaggaaccatacagccgagaaaccatatgaatgtaaggagtgcggtaaggcgttcagccggaaagagaatttgattacccatcaaaaaattcacacgggggagaaaccgtatgagtgctcagagtgcgggaaggcttttatacagatgtcaaatttgatccggcaccagcgtattcatacgggagagaaaccttacgcctgcaccgtgtgcggtaaggcctttagtcagaaatccaacctgacagagcatgagaaaatccacactggggaaaagccataccactgtaatcagtgcggaaaggcttttagccagaggcagaacctccttgaacacgagaaaattcatacaggcgagaaacctttcaagtgcaatgagtgcggaaaggccttcagcaggataagttctctgacactccacgttcggtctcacaccggcgagaagccttacgagtgcaacaaatgtggaaaagcttttagccagtgcagcctgcttattatccacatgcggagtcacaccggtgaaaagcccttcgaatgtaatgaatgtggaaaggccttttcccagcgcgcatctttatctattcataaaagaggacacacaggtgaaaggcaccaggtgtattag

SEQ ID NO: 14404 - DNA, 1716 bp, Artificial Sequence
  Description of Artificial Sequence: Synthetic coding sequence
atgaaacccgcccagcgcaacttgtaccgcgacgtgatgctggagaactattccaacctggtcacggtagggtgccaagtaaccaagcccgatgtgatcttcaagcttgaacaagaggaagagccttgggttatggaggaggagatgtttggccggcactgtccagagccaagaaggggagaaaattgctgcgcttctgaagtcatggcggagggcctcaagtttaaggatgtcgtgatatacttcagtcaaaaagagtgggagtgcctccatagtgctcagaaggacttgtaccgcgacgtgatgctggagaattacggaaatctagtccttctgggattatctgacaccaagcccaacgtcatatctctgctggagcagaaaaaagaaccctggatggtcaagagaaaggagaccaaggaatggtgccccgactgggagtttggaagagagaccaagaatttgtcccccaaggagaatatctatgagatccggagcccacagcaagaaaaggccagagtgatccgcgagattcggtgccaggttgagcgccaacagggacatcaggaaggacactttcgacctgcagtgatcccctttacgagcatgcagtgtacagcacaccgagaataccagtggctgcacacaggtgaaaagtcgtgcgaatgtcgaaagtgtaaaaatgcttttagataccagtcctgccctatacagcacgagattattcacaacaaagagaaagagccggaatgcggtgagtgcagaaaaattttcaacagcggcagcgatctcataaaacaccaaacattgcacgaatctaaaaagcactccgagaacaataaatgcgcttttaatcatgactctggcatcactcagcctcaatccatcaacaccggggaaaagccgcataagtgtaaagaatgcgggaaagcttttcgatcctctagccaaatatcgcagcaccagagaatgcatctgggcgagaaaccttacaagtgtcgggagtgtggcaaagcatttccgtctactgcacaacttaacctccaccaaaggattcacaccgacgagaaatactacgagagcaaggcttgtggaaaagcgttcacgagacctagccacttattccgccaccagcgcatacatacaggcgagaaacctcataagtgcaaggagtgcggcaaagcctttcgctacgacactcagctgtctctacatcagattattcacactggcgaacgacgatatgagtgccgagaatgtgggaaggtatattcttgcgctagtcagctttccttgcatcagcgaatccatacaggggagaagccccacgagtgtaaggaatgtggcaaagcttttatctcggatagccatctaattaggcatcagtctgttcatactggggagaagccctgtaaatgcaaggagtgtggcaaaagtttcagacgaggaagcgagcttacacggcaccaaagggcacatactggagagaagccatacgaatgtaaggagtgcgaaaaggccttcacttgctctacagagctagtccgccaccagaaagtgcataccggtgagagaccacacaagtgcaaagagtgcgggaaggctttcatccggcgtagcgaactgacccaccacgagcgctcccacacgggagagaagccctacgaatgtaaagagtgtgggaaaccgttcggcggagggtcagagctgagttag

SEQ ID NO: 14405 - DNA, 1752 bp, Artificial Sequence
  Description of Artificial Sequence: Synthetic coding sequence
atgacctcccaatcaagcgttattagcaattcatgcgtgaccatggagaggctgtcccacatgatggaaaggaaagcctggtgctcacaagaatctgcgctgtctgaagaggaagaagacactacgcggccactagagacagtcaccttcaaagatgtggctgtggatttaacacaggaggagtgggagcagatgaagcctgcccagagaaatctgtacagagatgtgatgttagaaaattatagtaacctggtgaccgtgggctgtcaggtaactaaacccgatgtaatattcaagctggaacaggaggaagagccctgggtcatggaggaggaaatgtttggacgacattgtcctgaaccacgtaggggcgagaattgctgtgcgtccgaagtgatggctgaaggcctgaaatttaaggacgtggtaatttatttctcccaaaaggaatgggaatgcctgcacagtgctcaaaaggacttgtatcgcgacgtgatgctggagaattatggtaatttagtgctgctgggcctgtctgataccaagccaaacgttattagtctgctggaacagaaaaaagaaccctggatggtgaagcgaaaagaaacaaaggagtggtgcccagattgggaattcggtagagagaccaaaaacctgtcccctaaagagaatatctacgaaatcagaagtcctcagcaggaaaaagcacgcgtgatcagagagatccggtgtcaagtcgaacggcagcagggtcaccaggagggtcatttccgcccagccgtcataccattcacctcaatgcagtgtactgcacatagagaataccagtggctgcacaccggagagaaaagctgtgaatgccgaaagtgcaagaacgccttcaggtaccagtcctgtccaattcagcacgagatcatccacaacaaggaaaaagaacccgaatgcggagaatgtagaaaaatcttcaactcagggtccgacctgattaaacaccagaccctgcatgaaagtaagaagcacagcgagaataacaagtgtgccttcaaccatgacagtgggatcactcagccccagtcaataaacacgggtgagaaacctcacaagtgtaaagaatgcggcaaagcatttagaagttcatcccaaatctctcagcaccagagaatgcacctgggggagaaaccatacaaatgtcgtgagtgcggcaaggctttccctagcactgcccagttaaacctgcatcagaggatacatacagacgaaaagtattatgagagcaaagcctgtggaaaagctttcactcggccttctcacctcttcagacaccagagaatccatacaggggagaaacctcataaatgcaaggagtgtggcaaagcgttccgttacgatacccagcttagtctgcatcaaatcatccatactggtgaacgacgatatgagtgtcgagagtgcggaaaggtgtacagctgtgcttctcagctgtccctgcaccagagaattcatacgggtgaaaaaccacatgaatgtaaggagtgcggcaaggcctttatttctgactcccaccttatccgtcatcaatctgtccacactggggaaaagccgtgtaagtgtaaagagtgcggcaagtcgttccgacgtggatctgagctgactcgccaccaacgggcccacactggggagaagccgtacgagtgcaaggaatgtgaaaaggccttcacttgttcaactgagctggtgcgacatcaaaagtag

SEQ ID NO: 14406 - DNA, 1668 bp, Artificial Sequence
  Description of Artificial Sequence: Synthetic coding sequence
atggatagtgtggtcttcgaggacgtggccgtggattttacattagaagagtgggccttactggatagtgctcagagggatctgtaccgggacgttatgctcgaaacattccggaacctcgccagtgtggacgatggaactcagtttaaagccaacggcagcgtgagtctgcaggatatgtacgggcaggagaagagtaaggaacagaccattcctaacttcacaggcaacaatagttgcgcctatactctggaaaagaattgcgagggctacgggacagaagaccaccacaagaacctgagaaatcatatggtggacaggttctgcactcacaacgagggcaaccaatatggagaggccatccaccaaatgccagatctgactctccacaagaaagtaagtgccggagaaaagccgtatgagtgcaccaagtgtagaacagttttcactcacttatctagccttaaacgccatgtcaagtctcattgcggaaggaaggcacccccaggcgaggagtgcaagcaggcatgcatatgcccatcccacctacacagccatggtcggacagatacagaggagaaaccttataagtgccaggcatgcgggcagaccttccaacacccaaggtacttatcacaccacgtaaagacccacacagccgaaaagacctacaagtgcgagcagtgtagaatggcattcaacggctttgctagctttactcggcacgtgcggactcatacgaaggatcgcccatacaagtgtcaagagtgtggacgcgcatttatttatcccagcactttccaacgccacatgacaacccacaccggcgagaaaccttacaaatgtcagcattgcggaaaagctttcacctatccccaggctttccagcgccacgaaaagacccacaccggggagaaaccgtacgagtgtaagcagtgtggcaaaactttctcctggtcggaaacactgcgggttcacatgcgcatccataccggcgacaagctctacaagtgtgagcattgcggaaaggcattcacttcttcccgcagcttccagggtcacctccgcacccatacaggggagaagccatacgaatgcaaacagtgtggaaaggctttcacatggtcctccaccttccgagaacatgtgcggatccacacccaggaacaactgtacaagtgtgagcagtgtgggaaggccttcacatcctcacggtccttcagaggacacttacgcactcacaccggagaaaagccttatgaatgcaagcagtgcggaaaaacttttacttggagtagcacctttagagaacacgtgcggatccatacccaggaacagttgcataagtgcgagcattgcggcaaagcttttacaagcagtcgagcattccagggccatttgcgcatgcacactggagagaagccatatgaatgcaagcagtgcgggaagacttttacgtggtcttccaccctccataaccacgttaggatgcacactggagagaaacctcataagtgtaagcagtgtggcatgtccttcaaatggcattctagcttcagaaaccatctgcgcatgcacaccggccagaagtcccatgagtgccaaagctactccaaagccttttcctgtcaggtcattttatctaagacttcggagtccacccactag

SEQ ID NO: 14407 - DNA, 1674 bp, Artificial Sequence
  Description of Artificial Sequence: Synthetic coding sequence
atggacagcgtcgtgttcgaagacgtcgcggtagactttactttggaggaatgggcccttctcgattctgcacagagagacctctaccgggatgtaatgctggaaacattcagaaatctggcctcagtgggctgcgagatgtgggagcgaacaaacggcagcgtgtctctgcaggatatgtatggtcaggaaaagtcgaaagagcagaccatccccaacttcactgggaacaattcctgcgcatacaccctggaaaagaaacggattacacggtccggcgaccagtctcaattacccgtgcggcgacgcaaccacatggtggataggttctgcacccacaacgaaggaaaccagtatggcgaagcaatccatcagatgcctgacttgaccctccacaagaaagtgagcgccggagaaaagccctatgagtgtactaagtgccggaccgtgttcacacacctgtcttctcttaagagacacgttaagtcccactgcggcagaaaagctccacctggcgaggaatgtaagcaggcctgcatttgtccgtctcaccttcattctcacgggagaaccgataccgaggagaaaccatacaagtgtcaagcctgcggccagaccttccagcacccccgctatctgtcccaccatgtgaagacccataccgccgaaaagacctataaatgcgaacagtgcagaatggcattcaacgggttcgccagttttacccgccatgttagaacacacaccaaggaccgaccatataagtgccaagagtgtgggcgagccttcatatacccatctacgttccagagacatatgactactcacactggagagaaaccctataaatgccagcactgcggcaaagcattcacatacccccaagcgttccagcgacacgaaaagacccacacaggtgaaaaaccttatgagtgtaaacagtgtggaaaaacatttagctggagtgaaacactgagggtccacatgagaatccacacaggagacaagctgtataagtgtgaacactgtggaaaggccttcacgagttcccgcagctttcagggacacttgcgcacccatacaggcgagaagccctatgagtgtaagcagtgcgggaaagccttcacttggtccagcacattccgggaacacgtacgcattcatacacaagagcagttatacaaatgcgagcagtgtgggaaagcctttaccagttctcggagttttcgaggccatttgcggacgcacacgggcgagaagccttatgagtgtaagcagtgtggtaaaacctttacctggtccagcacctttagggagcatgtgcgtatccatacccaggagcagctccataaatgtgagcactgcgggaaagccttcacatccagtcgcgcctttcagggacatcttcgcatgcataccggtgaaaaaccctatgagtgcaagcagtgcggtaaaactttcacatggagctcgactctgcataaccatgtgcggatgcatacaggagaaaagccccacaagtgcaaacaatgtggcatgagttttaagtggcattcttccttccgcaatcacctgcggatgcataccggccagaaatcacatgagtgccagtcctactccaaagcgtttagctgccaggtcatcctgtctaagacctcagaatcaactcactag

SEQ ID NO: 14408 - DNA, 1611 bp, Artificial Sequence
  Description of Artificial Sequence: Synthetic coding sequence
atggcagtgggcttgctcaaagccatgtaccaggaactcgttaccttccgggacgttgccgtcgacttctctcaggaagagtgggattgcctggacagtagccagcgacacctatattccaatgtgatgctcgaaaattaccgcattctggttagcctggggctgtgcttctccaagccctctgttatcctgttactggagcagggtaaggcgccatggatggtaaagagggaacttacaaagggcctgtgctcaggatgggaacctatctgtgaaactgaagagctcaccccaaaacaggacttctatgaggaacatcagtcccagaaaattatagaaactcttacttcgtataacctggagtacagttccctgcgggaagaatggaaatgcgagggctacttcgagaggcagccaggaaaccagaaagcctgtttcaaagaggaaatcataacgcatgaggagcctctcttcgatgaaagagagcaggaatataaaagttggggaagctttcaccaaaaccctctgctgtgtacacagaaaatcattcctaaggaagaaaaggtgcacaagcacgacacacagaaaagatccttcaaaaagaatctgatggccattaagcccaagagcgtctgtgccgaaaaaaagctcctgaaatgtaacgactgtgagaaagtgttcagccaatccagttcgctgacactgcaccagcggatacacactggtgagaagccctataagtgcatagagtgcggcaaggcctttagtcagagatcgaacctcgtccagcaccaaaggattcacactggagagaaaccctatgaatgcaaagagtgtagaaaggcgttcagtcaaaatgcacacctggttcagcacctgcgagtccacaccggggaaaagccctacgaatgcaaagtgtgccgcaaggcatttagccagttcgcctacctagctcagcatcagagggtccatactggagagaagccatacgagtgcatcgagtgtggtaaggcgttcagcaaccggagctctatagcccagcatcagcgtgtccatactggcgagaaaccatacgagtgcaacgtatgtggtaaggcattcagcctgcgagcctacctcaccgtccatcagagaattcataccggggagagaccttatgagtgtaaggaatgcgggaaggcattctcacagaacagccatcttgctcagcaccagcgaattcacacaggagagaagccatacaagtgtcaggagtgcagaaaagctttttcccagattgcctacctggcacagcaccagcgcgtgcatactggagagaaaccctacgagtgtatcgaatgtggaaaggcttttagcaacgactcttctttgacacagcaccagcgcgtgcacaccggcgagaagccatatgagtgtacagtctgtggcaaggctttctcctactgtggcagcctagcacagcatcagagaatccacacgggtgaacggccttatgagtgcaaggagtgcaaaaagacctttagacaacatgcccatctagctcatcaccaaaggattcacatcggagaaagcttaagcccccccaaccctgtaaatcatcaggtcctatag

SEQ ID NO: 14409 - DNA, 1002 bp, Artificial Sequence
  Description of Artificial Sequence: Synthetic coding sequence
atggcgattaaaccgaaaagtgtgtgtgctgaaaaaaaactccttaagtgtaacgattgcgagaaagtcttctctcagtcttcaagccttactttgcatcagcggatccacacaggggagaaaccctacaagtgcatcgaatgcgggaaagcttttagccagaggtctaacttggttcaacaccagagaattcacactggcgaaaaaccttacgaatgcaaggagtgcagaaaagcctttagtcaaaatgcccatcttgtgcagcatctgagggtccataccggcgagaaaccatacgagtgcaaggtgtgccgcaaagcttttagtcaattcgcctacctggctcaacaccagcgggtacataccggcgaaaagccatatgagtgcatcgaatgtgggaaagccttttccaacaggtcctctatcgcacagcaccaaagggtccataccggtgaaaagccgtatgaatgcaacgtttgtggcaaggcgttctcgctgagggcttatcttacagtgcaccagagaatccacactggggagcggccttacgagtgcaaggaatgtgggaaagcgttcagccagaatagtcatctggcccaacatcagcgcatccacacaggtgagaagccctataagtgccaggaatgccgcaaggccttttcacagatcgcctatctggcgcaacaccaacgagttcacactggagaaaaaccttatgagtgtatcgaatgcggaaaggccttcagcaatgactccagcttgacacagcaccagcgcgtccatactggggagaaaccatacgaatgcacggtctgtggcaaagccttcagctattgcggatcactggcgcagcaccagcgtatccacaccggcgagcgaccgtacgaatgtaaagagtgtaagaagacattcagacagcatgcacacctcgcccatcatcagagaatacacataggagagagtctcagcccaccgaaccctgttaatcatcaggttctctag

SEQ ID NO: 14410 - DNA, 1830 bp, Artificial Sequence
  Description of Artificial Sequence: Synthetic coding sequence
atgccccatctcctggtgacattcagggatgttgcaatcgatttttcacaggaagagtgggaatgtctcgaccctgcccaacgtgacctgtatcgcgacgtgatgcttgagaattattccaacctgattagtcttgatcttgagtcttcttgtgtaacaaagaagctttcacccgaaaaggagatttacgagatggaatccctccagtgggagaacatgggcaaacgaataaaccaccatcttcagtataacggactcggagacaatatggaatgcaaaggcaaccttgagggccaggaagcgtcacaggaagggctgtatatgtgtgtgaagataacatgcgaagagaaagcgaccgagtctcacagtacctctagcactttccacagaatcattccaaccaaagaaaagctatataagtgcaaggagtgccgacagggattctcttacctgagttgcctgatacagcatgaggagaaccataatattgaaaaatgctccgaagtcaaaaaacatagaaatacattcagcaagaaaccttcctatatacagcaccagagaattcaaacaggggagaaaccatatgagtgtatggagtgcgggaaagcattcggacggacttccgaccttatacagcatcagaagatccacacgaatgaaaaaccatatcagtgtaatgcctgtgggaaggcatttatcaggggatctcagctgactgagcaccagagggtgcacacaggggagaagccttacgagtgcaaaaagtgcggaaaagctttttcatattgttcgcagtacacactgcatcaacgtatccattcgggcgaaaaaccctacgaatgtaaggactgtgggaaggcctttattctcgggagccaattgacgtaccaccagcgcatccactctggcgagaagccctatgaatgtaaagagtgcggaaaggcattcatcctcggatcacacttaacgtatcaccagcgtgtgcataccggcgagaagccctacatctgcaaggagtgcggcaaggctttcttatgcgccagccagctgaatgaacatcaaaggattcataccggggagaagccatatgaatgcaaggagtgtggcaagacattttttagaggatcacagttgacctatcacctgagagtgcatagcggcgagcgcccgtataagtgcaaagagtgcggcaaggccttcatttcgaacagcaatctgatccagcaccaacggatacacactggagaaaagccatataagtgtaaagagtgtgggaaagcatttatatgtggtaaacagctgagtgaacatcaaagaatacacacaggtgagaagcccttcgaatgtaaagaatgtggtaaagcctttatccgcgtggcctacctgacgcagcatgagaagatccacggagagaagcattacgagtgtaaggagtgtgggaagacttttgtacgggccacccagctgacttaccatcagcgcatccacactggagaaaagccttataaatgcaaggagtgcgataaagcctttatatacgggtcacaattgtctgaacaccagcggatccatcgcggggagaaaccatacgagtgcaaacagtgcggaaaagcctttattcgtggtagtcaccttaccgagcacctgcgtacacacactggggagaaaccctatgaatgcaaggaatgcggacgggcctttagtagaggaagtgagctaactctgcaccagaggatacacactggtgaaaaaccctacacctgcgtccagtgtggcaaggattttcggtgccccagtcaactgactcaacatacccggcttcacaactag

SEQ ID NO: 14411 - DNA, 1830 bp, Artificial Sequence
  Description of Artificial Sequence: Synthetic coding sequence
atgcctcatctgctcgtgacctttcgggacgttgccattgacttttcccaggaggaatgggagtgtctggaccccgcccagagggacctataccgggacgttatgctcgagaattactctaatcttatctctctggatctggagagtagctgcgtgacaaaaaagctaagccccgagaaggaaatctacgagatggagtctttgcagtgggagaacatgggcaagcgcatcaaccaccacctgcagtacaacggactgggcgataacatggagtgcaagggtaacctggagggacaagaggctagtcaggagggtctgtatatgtgtgttaagatcacctgcgaggagaaggcaacggagagccatagtacctctagcaccttccaccgtatcatcccaacaaaggagaagctatacaagtgtaaggagtgccgccagggcttttcctacctgagctgcctgatccaacatgaggaaaaccacaacatcgagaaatgtagcgaggtgaaaaagcatcgtaatactttttccaaaaaaccatcgtatatccagcatcagcgaattcagactggagaaaagccatacgaatgcatggaatgcggcaaggcgttcggacggacctcggacctgattcaacaccagaagatccacacaaatgagaagccgtatcaatgcaacgcgtgtggcaaggccttcatccggggttcccagctcactgaacaccaaagagtccataccggtgagaagccttatgaatgtaaaaagtgtggcaaagcctttagttactgcagccagtacacgttgcaccagagaatacattcgggcgagaagccttacgagtgcaaggactgcggcaaagcttttattctgggctctcaactgacgtaccaccagcgcattcactctggagaaaagccttacgagtgtaaagagtgcggcaaagcctttattctcggctcccatttgacatatcatcaaagggttcacacgggagagaagccctatatctgcaaggagtgcgggaaagccttcctgtgtgccagccagttgaatgaacatcagagaattcacactggggaaaaaccctacgagtgcaaggagtgcggcaagacttttttccgtgggagtcagttaacctaccacctgcgagtacacagtggggagagaccctacaagtgcaaggaatgtggcaaagccttcatcagcaattccaacctgatccagcaccagcgtatccacactggagaaaaaccgtataagtgtaaagagtgcggaaaggcattcatatgcggaaagcagctgtccgagcatcagaggatacataccggcgaaaagccattcgagtgcaaggagtgcggtaaagccttcattcgagtcgcttatctgacacagcacgaaaagattcatggagagaagcactacgagtgtaaagaatgtggcaagacattcgtgagggccacacaactgacgtaccaccaacggatacataccggagaaaagccttacaagtgcaaagagtgcgacaaagcgtttatatacgggtctcagttgtccgagcaccagagaatacatagaggggaaaagccctatgaatgtaaacaatgcggtaaggcgtttattagaggtagccatcttacggagcatctccgcacacacacgggggaaaagccatacgaatgtaaagagtgcgggagggcattttctagagggagtgagcttacactccatcagcggatacatacaggggagaagccctacacatgcgttcagtgtggaaaagatttccgttgtcctagccagcttacccagcatacacgcctccacaattag

SEQ ID NO: 14412 - DNA, 1830 bp, Artificial Sequence
  Description of Artificial Sequence: Synthetic coding sequence
atgccccacctattggttacgtttcgagacgtggcgattgatttttctcaggaggagtgggagtgcctcgaccccgctcagagggacctctaccgagacgtcatgctcgagaactacagtaacttaatcagccttgatctggaatctagctgtgttaccaagaagctgtccccagaaaaggaaatctatgaaatggaaagccttcagtgggagaacatggggaaacgtattaaccaccatctgcaatacaacggtttgggcgacaacatggagtgtaaaggtaacctagaaggccaagaagcatctcaagaaggactgtacatgtgcgttaagatcacctgtgaagagaaagcaacagagagccatagcacctcttctactttccataggatcatacctacaaaagaaaagctgtacaaatgtaaggagtgtcggcaggggttctcatatctctcttgcctaattcagcacgaagagaaccacaatatagagaagtgttccgaggtaaagaagcatagaaatacatttagcaaaaaacccagttacattcaacaccagcgaatccaaacaggtgagaagccatatgagtgcatggagtgcggaaaagctttcgggcgaacctcagacctcattcaacaccagaagatccacacgaacgagaagccatatcagtgcaatgcttgcggaaaagccttcattcgcggaagccaactgacagaacaccagagagtccataccggagagaaaccctacgagtgtaagaaatgcggtaaggcattctcttattgctctcagtatactctccaccaaagaattcatagtggagaaaagccgtacgagtgtaaggactgtggcaaagcttttattttgggatcacaattgacataccaccagcgcattcacagtggtgagaaaccttatgaatgcaaggagtgcggtaaggcatttatcctgggatcccatctgacgtatcaccaacgggtgcatacaggcgagaagccatatatctgcaaggaatgtgggaaagccttcctgtgcgcttcgcaactcaacgaacatcaacgtatccacactggcgagaagccatatgaatgcaaagagtgtggcaaaacctttttccgcgggagtcagctcacataccacctgcgcgtccattccggggagcgcccttacaagtgcaaggagtgcggtaaggcctttataagcaattcgaacctcatccaacaccaacgaatccacaccggggagaagccatacaagtgcaaggaatgtggtaaagcattcatctgtggtaagcagctttccgagcaccagaggattcatacaggagagaagcccttcgagtgtaaagaatgtgggaaggctttcataagggtggcatacttaacgcagcatgagaaaatacatggcgagaagcactatgaatgcaaagaatgcggcaagaccttcgtgagggccacccaactgacctaccatcaacgcatccataccggcgaaaaaccttacaaatgcaaggagtgtgataaggccttcatttacggcagtcagctctctgagcaccagcgtattcatcggggcgaaaaaccctatgagtgcaagcaatgcggcaaggctttcattcgagggtcccacctaaccgagcacctgcggactcacacgggcgaaaagccctatgagtgcaaggaatgtggtagagcattttcccgcggttctgagctcacactgcatcagagaattcacacaggcgagaaaccttatacatgtgtacagtgtggcaaggatttccggtgcccaagccaactaacacagcacacacgcttgcataattag

SEQ ID NO: 14413 - DNA, 1590 bp, Artificial Sequence
  Description of Artificial Sequence: Synthetic coding sequence
atggagcaggaaaaaaagctgctcgtgtcagacagtaacagtttcatggaacgtgagtcgctgaagtccccctttaccggagacacgtccatgaacaatttggaaactgtgcaccataataacagcaaggccgacaaattaaaagaaaagcccagtgaatggtctaagaggcatagacctcagcactacaagcacgaggatgctaaggagatgcctctcacttgggtgcaagacgaaatttggtgccacgattcgtatgaatccgatggcaaaagcgagaattgggggaactttattgctaaggaggaagaaaagccaaatcaccaagagtgggatagcggggaacacaccaacgcctgtgtgcaacagaatagcagctttgtagacaggccatataagtgcagtgagtgttggaaatcatttagtaattcatcccatttgagaacgcaccagaggacccattctggcgaaaaaccgtataagtgctcagagtgtgctaagtgtttttgtaattcttcccatctaatacaacatcttagaatgcacactggggagaaaccttaccagtgcggggaatgtggaaagtcattcagcaacactagtcatctgattatccacgagagaactcatacaggtgagaaaccttacaagtgccctgagtgtggaaaacggttctcaagtagtagtcacctcatacagcaccacaggtcccataccggggagaaaccatatgagtgcagcgtatgtggaaaaggcttcagtcactcatacgtgctaatcgaacaccagaggacccatactggtgagaagccgtataaatgtcccgattgtggaaaatccttttcacagtcctcgagcttgattagacaccagcgcacacacactggtgaaaagccctataagtgtctcgaatgcgagaaatcctttggatgtaatagcacccttattaagcaccaaaggattcacactggtgagaagccgtaccaatgtccagagtgtgggaagaattttagcagatcttctaatttgattacccatcagaagatgcacaccggtgagaagtcatatgagagctctgaatatgaagagtctctgggacagaattgcaacgtgatcgaggaatgcagaattcagttgggagagaaaccgtaccgctgttgtgaatgcggcaaatccttcggtctgtcctcacacctcataaggcaccagcgtacccataccggagaaaagccttaccgttgttctgagtgttggaagacattttcgcaatctagcacgcttgtcattcaccagcggacccacaccggggaaaaaccctacaaatgtcctgactgtggtgagtcgttttcacagtctttcaacttaatccgccacagaagaacccacattggtgaaaagccttataagtgtacctcctgtgaaaaatgttttagccgctccgcctacctgagtcagcataggaagatccacgtagaaaagccctttgagtcacctgatgtgggcgattttccccatgagtggacttggaagaactgttccggtgaaatgccttttattagctccttctcggtgagtaactctagcagctag

SEQ ID NO: 14414 - DNA, 1824 bp, Artificial Sequence
  Description of Artificial Sequence: Synthetic coding sequence
atggagtcttgcagcgttgcccaagctggagtccagtggcccgatctttcatccctgcagccaccacccccccgcttcaaacagtttagctgccactcactccaggtggctggaatcaccgatcttgacctccagtgcgagataatttcttacatcgaggtgcctacttacgagaccgatatttcatccactcagctacagtccatctataaacgcgagaaactgtatgagtgcaaaaaatgtcaaaagaagttctctagcggttatcagctaatccttcatcatcggtttcacgtgatcgagcgaccatacgaatgtaaagagtgcgggaagaattttcggtccggttaccagctgacccttcaccaaaggtttcacacaggtgaaaaaccctacgagtgtaccgaatgtggcaagaactttagaagcggctatcagttgaccgtgcaccaaaggtttcacactggggagaagacctatgaatgtcgacagtgtggaaaggcctttatttatgcatctcatatcgtccagcacgagagaattcacaccggtgggaaaccatatgagtgtcaggagtgtgggagggcctttagccaggggggccacctgagaattcaccagcgggtgcatacaggcgagaagccttataagtgtaaggagtgcgggaagactttctcaagaaggagcaatctggtggaacacgggcagtttcacacggacgaaaaaccatatatctgtgagaaatgtggcaaagccttccggaggggacaccaactgactgttcaccagcgggtgcacactggtaaaaaaccgtacgaatgcaaagaatgtggaaagggttacacgacagcatcatactttctcctccaccagcgaatccacaagggagggaagccctatgagtgtaaagaatgcaagaaaaccttcactttgtaccggaatctaacaaggcaccaaaatattcacacaggcgagaaactcttcgaatgcaagcagtgcgggaagacctacaccactgggagcaagcttttccagcaccagaaaacacacacaggagaaaagccatatgagtgcaaagaatgcggcaaggcattttctctttatggatacctgaagcagcaccagaagatccacactgggatgaaacacttcgagtgtaaggaatgtaagaaaacctttactctctacagaaatcttacccgccaccagaacatccataccggtaagaagctctttgagtgtcaagagtgcggtaaagcttacagtacggggtctaacctcatccagcaccgcaagactcatactggagagaagccttataaatgtaaggagtgtggcaagaccttctctttgcacgggtatctgaaccagcaccagaaaatccacacagggatgaagccatacgagtgtaaggtctgtagaaagaccttcactttttacaggaacctgacactgcaccagtcgatccatacagacgaaaagcctttcgagtgcaaggagtgcggaaagacatttagaaggtcctcgcacctgaccgcccaccaatccatccatgccgacaaaaagccatacgagtgcaaagagtgcggaaaagcgttcaagatgtacggctacctgacccagcatcagaaaatccacacaggagggaaaccatatgaatgtaaagagtgtggcaaagctttttcccgagcttcgaatctagtgcaacacgaacggattcatacaggcgagaaaccgtatgtctgcaaacagtgcggcaaaaccttccggtacggctccgcgctaaaggcccaccaacgcatacatcgctccatcaaggtgtag

SEQ ID NO: 14415 - DNA, 1734 bp, Artificial Sequence
  Description of Artificial Sequence: Synthetic coding sequence
atgatcctgagagaggagacacaatttaccgacctagacttgcagtgtgagatcatctcctacatcgaggtgcctacttacgagacagatatttcatcaacccaactccagtcaatatacaaaagggagaagctgtatgagtgtaaaaaatgccaaaaaaagttcagcagtggatatcagttaattctgcatcatcgcttccacgtcattgaaagaccttacgagtgtaaggaatgtgggaagaatttccgatccggttatcagctgaccctccaccagcgatttcataccggagaaaagccctacgagtgcaccgaatgtggaaagaacttccgttcaggctatcagctgacagtgcatcagaggtttcacaccggcgagaagacgtatgaatgccgccagtgcggaaaggcgttcatctatgcaagccacatcgtccagcacgagagaattcacacgggtggcaagccctatgaatgtcaggaatgcggaagggctttcagtcaaggtgggcatctgaggattcatcagagagttcatactggcgagaagccttacaagtgcaaagagtgcgggaaaaccttctctcgtagatccaacctcgtggaacatggccagtttcacacagatgagaaaccctacatttgtgaaaagtgtggaaaggcctttcgacgtggtcatcagctcactgtccaccagagggttcataccggcaaaaagccttacgaatgcaaagaatgcggcaagggttacactacagcatcctactttctcttacaccagcggatacataagggtgggaaaccttacgagtgcaaagagtgtaagaagacttttactctgtacaggaatttgacccgccaccagaatatacacactggcgaaaagctgttcgagtgtaagcagtgcggcaaaacctataccacgggttccaaactgttccaacaccagaagacccatactggtgagaaaccctatgaatgcaaggaatgcggaaaagcattctccctgtacggctacctgaaacaacaccagaaaattcatactggcatgaaacacttcgaatgcaaggaatgtaaaaagactttcaccttatacagaaatctgacccgacatcagaatatccacactggaaaaaagctgttcgagtgccaagaatgcgggaaagcctattccacgggatccaatctgatacagcaccggaagacccatacaggggagaagccctataagtgcaaggaatgcgggaagactttttctctgcacggatacctcaaccagcaccaaaagattcacacaggaatgaagccatacgagtgcaaggtgtgcagaaagacttttaccttctatcgcaatctgacactgcatcagtccattcacacggacgaaaagccttttgaatgtaaggagtgcggtaagaccttccggcggagttctcatctgactgcacatcagtccattcacgctgacaagaagccttacgagtgtaaggaatgtggaaaagctttcaaaatgtacggctacctgacacagcaccagaagatccatacaggcggcaaaccttacgagtgtaaagaatgcggaaaggccttctcccgggcatcaaaccttgttcagcacgaaagaattcatacaggagaaaaaccttatgtctgcaaacaatgtggaaaaacctttcgatacggcagcgcactgaaggcacaccagagaattcatagatccatcaaagtgtag

SEQ ID NO: 14416 - DNA, 129 bp, Artificial Sequence
  Description of Artificial Sequence: Synthetic coding sequence
atgttggagaactaccgcaacctggtgagcctaggcggacattcaatcagcaaacccgtcgtggtggatctgctggaaaggggcaaggagccttggatgatcctacgcgaggagacccagttcacctag

SEQ ID NO: 14417 - DNA, 1737 bp, Artificial Sequence
  Description of Artificial Sequence: Synthetic coding sequence
atgctggagaactataggaaccttgtgtctttagatctggacctccaatgtgaaataatctcctatatcgaagtgcctacgtatgaaacagacatctcttctacccagctgcagtctatttataagcgtgaaaaactgtatgaatgcaagaagtgccagaagaaattctcatctggctaccaattgattttacatcaccgttttcatgttatagagagaccttatgaatgtaaggaatgtggaaagaactttcgttctggttaccaactgaccctgcatcaaaggtttcacaccggggaaaagccctacgagtgcacagagtgtgggaaaaacttcaggagcggttatcagcttaccgttcaccagaggttccacaccggggaaaaaacctatgagtgtcgacagtgcggcaaggcctttatctacgccagtcacatcgtccaacacgagagaatccataccggaggcaaaccatacgagtgccaggagtgtggccgcgcattcagtcagggggggcacctgagaattcatcaaagggtgcatactggcgagaaaccatataaatgcaaggagtgcggaaaaactttctctaggcggtccaatctggttgaacacggccagtttcatacagatgaaaagccttacatctgcgagaagtgtgggaaagcattccgccgtggtcatcaacttactgtgcaccaaagagtccacaccggcaagaagccttatgagtgtaaggagtgcggcaagggatacactaccgcgagttactttcttctgcaccagcgcattcataagggcggcaagccctacgagtgcaaagagtgcaaaaagaccttcactctgtaccggaatctgactcgccatcagaacatccatactggagagaaactttttgagtgcaaacaatgcggaaaaacctacactacagggagcaagctattccagcaccaaaagacacacaccggagagaaaccttatgaatgcaaggagtgtggaaaagccttctccttgtatgggtacttgaaacagcaccagaaaatccacaccggcatgaaacacttcgagtgtaaagagtgtaagaagacgttcacgttatacaggaatctaacacggcaccaaaatatccacaccggtaaaaaactttttgagtgccaagagtgtggcaaagcatacagtaccggatccaacctgatccagcacaggaagacacataccggagagaagccttacaagtgtaaagagtgtggtaagactttctccctccacggatacctgaaccagcatcaaaaaattcacacaggcatgaagccctatgagtgtaaagtctgtcgcaagacttttactttctaccggaacctaacgttacatcagtcgatccatacagacgagaaacctttcgaatgcaaagaatgtggcaaaacgtttcggcggtcatctcatttgacagcacaccaatccatacacgccgacaagaagccatatgaatgtaaggaatgtggcaaggcctttaaaatgtatggttatctgactcagcaccagaagattcataccggaggtaagccatacgaatgcaaggagtgtggcaaggctttcagcagggccagcaacctcgtccagcacgaacgaattcacaccggggaaaaaccatacgtgtgcaaacagtgcgggaagacttttaggtacggctcggctctcaaggctcaccagcgaatccacaggagcataaaggtctag

SEQ ID NO: 14418 - DNA, 1734 bp, Artificial Sequence
  Description of Artificial Sequence: Synthetic coding sequence
ttcatactaaggacctcgtcctttgtttctgacttggacctgcaatgcgaaatcataagttacatagaagttccaacatacgagaccgatatttccagtacacagctgcaatccatctataaacgggagaaactatacgagtgcaaaaagtgtcaaaaaaagtttagttccgggtatcagttgattctgcaccatcggttccacgtgatagagagaccttacgagtgtaaagagtgtggcaaaaactttcgatcaggataccagttgacacttcatcagagatttcatacaggggaaaagccttacgaatgtaccgaatgtggtaaaaactttaggagtggataccaattaactgtgcaccaacgcttccataccggcgaaaaaacctatgaatgccgtcagtgtggtaaggctttcatttacgcaagtcacatagtccaacatgagaggattcacaccggaggcaaaccatacgaatgtcaggagtgcggccgggctttttcacagggaggccatctgcgaattcaccagagggtgcatactggcgagaaaccctacaagtgcaaggagtgcggtaagacctttagtaggcgaagcaacctcgtcgaacacggccagtttcacactgacgagaaaccttatatctgtgaaaaatgtgggaaggcgttcaggcgtggccatcaactgactgtccaccaacgggtgcacactggaaagaaaccttatgagtgcaaggagtgcggaaaaggttacactaccgctagctattttcttctgcaccagaggatccacaagggaggaaagccttacgagtgtaaggaatgcaaaaagactttcacattatacagaaacctcacccggcatcaaaatatccataccggagagaaactgtttgagtgtaagcaatgtggaaagacctatactaccggctctaagctctttcagcaccagaagacccacacaggtgaaaagccttatgagtgcaaagagtgcggaaaagctttcagtctgtatgggtacctgaagcagcatcagaagatccacactggtatgaaacattttgagtgcaaagagtgtaagaagacatttactctttacagaaacttgacaagacatcagaatatacatactggcaaaaagctgttcgaatgtcaggagtgcgggaaggcttactctaccgggagtaaccttattcagcaccgaaaaacccacacaggggaaaagccgtacaaatgcaaggagtgtgggaaaaccttcagcctacatggatacctgaaccagcatcagaagatccacacaggaatgaagccgtatgaatgtaaagtgtgccgcaagaccttcaccttctatcgcaatcttacattgcaccagtccatccacacagatgagaaaccatttgaatgtaaggaatgtggaaagacttttcgcaggtcttcgcacctgactgcgcatcagagtatccacgccgataaaaagccatacgaatgtaaggaatgcggtaaagcattcaaaatgtacgggtacctcactcagcaccagaaaatacataccggggggaaaccttatgagtgcaaagaatgcgggaaggccttctctcgtgctagcaatttagtacagcatgagagaatccacactggcgaaaaaccgtacgtttgtaagcaatgcgggaagacattcagatacggctccgccttgaaggcacatcagagaatccatagatctatcaaggtatag

SEQ ID NO: 14419 - DNA, 1734 bp, Artificial Sequence
  Description of Artificial Sequence: Synthetic coding sequence
atgatcctccgcgaggagacacaatttaccgacttagacttacagtgcgaaatcatcagctatatcgaggttcccacatatgagacagacatctctagcacccagctccagagcatttacaagcgcgaaaagctgtacgaatgtaaaaaatgccagaagaagttctccagtggttatcagctgatcctgcaccatcggttccacgtgattgaacggccttatgagtgcaaggaatgtgggaaaaactttcggtctgggtaccagcttacgctacaccagagattccacacgggagaaaaaccttacgagtgtaccgagtgcggcaagaactttaggtcgggctaccagctgaccgtacatcaaaggtttcacaccggtgagaagacctacgaatgccgtcagtgcggcaaagcctttatctacgcctcccatattgtgcaacatgaacggatacacactggaggaaagccttatgagtgccaggagtgcggacgcgccttttcccaaggcggacacttaagaatacaccagagggttcacactggggagaaaccctacaagtgtaaggaatgcggtaaaacattcagcaggcgcagcaatctagtcgagcacgggcagttccataccgacgagaaaccctacatctgcgagaaatgtggtaaagcctttcgtaggggccatcaactcactgtgcaccaaagggttcacacaggcaaaaagccctatgagtgtaaggagtgcgggaaggggtacactacggcctcctatttcttactgcaccaaagaattcacaagggtgggaaaccatacgagtgtaaggagtgcaagaagacatttacactatatcgcaatcttactcgccaccagaacatacacacaggggagaagctctttgaatgtaagcagtgtggtaaaacatacaccactggctcaaagctttttcagcaccagaaaacacacaccggagaaaaaccctacgagtgtaaggagtgcggcaaggcattttccctgtatgggtatctcaaacagcaccagaagatccacaccggcatgaaacatttcgaatgtaaggaatgtaaaaagacctttacgttgtacaggaatctcactcggcatcagaacatccatactggcaaaaaactctttgaatgtcaagagtgtggcaaggcctacagcactggttccaatctgatccagcaccggaaaacccatactggggagaagccatataaatgtaaggaatgcggaaaaactttctctctgcatggatacttgaatcaacatcagaagattcacactgggatgaagccctacgagtgcaaggtctgcaggaagacatttactttctatcgtaatctaacattacaccagtccatccatacagatgagaagccctttgaatgtaaggaatgtgggaaaacattccgacggtcctcccatttgactgcccatcagtccattcatgctgataaaaagccttacgaatgtaaagagtgtggcaaagccttcaaaatgtatggctacctgacccagcaccagaaaatacacaccggtgggaaaccatatgagtgcaaagaatgtggcaaagcttttagtcgagccagcaatctggttcagcacgaacggattcataccggggagaagccgtacgtctgcaaacaatgcgggaaaaccttcagatatggatccgcactgaaagcacaccagagaatccacagatcaattaaggtgtag

SEQ ID NO: 14420 - DNA, 1998 bp, Artificial Sequence
  Description of Artificial Sequence: Synthetic coding sequence
atgttccccgtactagaaccacaccaggtcggcctgatcaggtcctataatagcaagacaatgacctgtttccaggagctggtgacattccgtgatgtggcaatcgatttcagccgccaggaatgggagtacctcgaccctaatcagagggatctgtaccgcgatgtcatgctcgaaaactatcggaatctggttagccttggaggacactccatcagcaagcccgttgtcgtggacctgttggagcgcggaaaggaaccttggatgatcctcagggaagagacccaattcaccgatctggatctgcaatgcgaaattatctcatatattgaggtgcccacgtatgagacagatattagttcaactcagttgcagtcaatatataagcgtgaaaagttatacgaatgtaagaaatgccagaagaagttctcctccgggtaccagctgattctgcatcataggttccacgtgatagaaaggccttatgagtgtaaagaatgtggaaagaattttagatcagggtatcagctgaccttgcatcagagattccatacaggagagaagccctacgaatgtactgaatgcggtaagaactttcggtcaggctaccaactgaccgtgcatcagagatttcatactggagaaaagacctacgagtgccgccagtgtgggaaagcgtttatttacgccagccatatagtgcagcatgaacggatccacacaggggggaaaccctacgagtgtcaggaatgtggaagggctttctcacaggggggacatttgcggatccaccagcgcgtccatacaggagagaaaccttataaatgtaaggaatgcggaaaaaccttttccaggagatcaaacttggtagaacatggacagtttcacacagacgagaagccttacatctgcgagaagtgtggtaaagcctttcgcagaggtcaccagctgaccgttcaccagcgggttcacacaggcaagaagccctacgaatgcaaggaatgcggcaagggttacacaactgccagctacttcctgttgcatcagcggattcacaagggcggaaagccctatgagtgcaaggaatgcaaaaaaacctttaccctctatcgcaacctgacacgacaccagaacattcataccggcgagaaactgtttgagtgtaagcagtgcggtaaaacatataccaccggatcaaagctgttccagcatcagaaaacccatactggggagaaaccctacgaatgtaaagaatgcggcaaagctttcagcctgtacggatatctgaagcaacaccagaaaatccacactggcatgaagcacttcgaatgtaaggaatgtaagaagactttcactttgtaccggaacctcacaaggcaccagaatattcacaccggcaagaaactgttcgaatgccaagagtgtgggaaggcatactccacgggatcgaaccttatccagcacagaaagacacacacaggagagaaaccttataaatgcaaagaatgcggaaaaaccttctctttacatggatacctaaaccagcaccagaagattcacaccgggatgaagccctacgagtgtaaggtatgccgaaagacatttaccttctaccggaacctgactctccatcagtccatccacactgatgaaaaaccattcgagtgcaaggaatgcggcaagacgtttcggagatcgagtcacctgaccgcacaccaaagtatacacgccgacaagaagccctatgagtgcaaggagtgcgggaaagcgtttaagatgtacggctacctcacccagcatcaaaagattcatacaggaggcaaaccgtatgaatgtaaagagtgtggtaaagctttctccagggcatccaaccttgtccagcacgagcgcattcatactggcgagaaaccttatgtctgcaagcaatgcggtaaaacattccgatatggctcggctctgaaggcccatcagcggattcatcgatccataaaagtctag

SEQ ID NO: 14421 - DNA, 1452 bp, Artificial Sequence
  Description of Artificial Sequence: Synthetic coding sequence
atgagcggcggagggccatccggcggagggcccggcggatccggtagggccagaaccagttccttcgctgaacctggtggtggtggtggtgggggcggcggtgggcccggagggtctgcctcagggccaggcggaacaggcggcggaaaggcatccgtaggggctatggggggaggcgtaggcgcctcatcgtcaggaggaggaccaggcgggtctgggggtggggggagcggcggccctggcgccggaaccagcttccctcctccgggggttaaactcgggcgggattctgggaaggtgacaaccgtagtggccaccttaggccaaggccccgaacgtagccaagaggtggcctacactgacatcaaagtgattggaaacgggtccttcggcgtcgtttaccaggcacgcttagccgagactagggagctggtggccatcaagaaggtcctgcaagacaagcgctttaaaaatagagagctacagatcatgcgaaaactggatcactgtaacatagtgagattgaggtactttttttacagctcaggagaaaagaaggacgagctgtacctaaacttggtgctggaatatgtacccgaaaccgtgtaccgcgtcgctcggcactttacaaaagctaagctgacgataccaattctctacgtgaaggtgtatatgtaccagctgtttaggtcattagcctacattcatagccagggcgtctgccaccgcgatataaagccccagaacctgttggtcgatccagacacggcagttttaaagctatgtgattttggctccgcgaagcaattagtgcgtggcgaacccaacgtgtcatatatttgctccaggtattacagagccccagaactcattttcggcgctacggattacaccagcagcatcgatgtgtggtccgccgggtgcgtgctggctgagttgctcctcggtcaacctattttccccggggatagcggcgttgatcagctcgtagaaatcattaaggtactgggcactcctacgagggagcaaatcagagagatgaacccaaactacaccgagtttaagtttcctcagattaaggcgcacccatggaccaaagtgttcaagagcagaacgcctcctgaggctattgccctgtgcagcagtctcctagagtatactcctagtagtcggctctccccactagaggcatgcgctcattcgttttttgacgagctgcggtgcttaggcactcagctgcccaacaacaggccgttgcccccactattcaacttttccgccggagaactgtctatccagcccagtttaaatgctattctgattcctcctcaccttaggtctcccgcaggcactaccacacttacaccatcttcacaggccctgaccgaaacgccaacctctagcgattggcaatcaactgatgccacacctacacttacaaattcgtcgtag

SEQ ID NO: 14422 - DNA, 2691 bp, Artificial Sequence
  Description of Artificial Sequence: Synthetic coding sequence
atgaccgaggagtcggaagagaccgtgctttacatcgagcatcgctacgtctgctccgaatgtaaccagctgtatggctccttagaggaggtgttgatgcaccagaatagccacgtgccgcagcaacactttgagctcgtgggagtggcagatccgggcgtgaccgtggccacggatacagctagcggaaccggcctgtaccaaactcttgtgcaagagagtcaatatcagtgcctcgagtgcggccaacttttaatgtcccccagtcagttactcgagcatcaggagttgcacctgaagatgatggctccacaggaagccgttccagcagaaccttccccaaaggcacctccactttcctcatccacaatccactacgagtgcgttgattgtaaggcactttttgcatctcaggaactttggttgaaccacaggcagacacaccttcgagccacccccactaaagcacctgccccagtggtactcggatcccccgtggtgctcggacccccagtcgggcaggcaagggtcgctgtggagcactcttatcgaaaagccgaggagggaggtgaaggcgcaaccgttccaagcgccgcagccacaaccaccgaagtcgtgaccgaggtggagctgctcctgtataagtgttccgaatgctctcagctattccaactgccagcagattttcttgagcaccaggccactcacttccccgcaccggtgccggagtctcaggaaccggcactgcagcaggaggtccaggcatcatccccagcagaagtgcccgtcagccaacccgacccccttcccgcctccgaccacagctacgaacttcgaaacggggaggccataggacgcgaccgacggggtaggagagctagaaggaataactcaggcgaagccggcggtgccgcaacccaggaattgttttgtagcgcctgtgatcagctgttcctgagtccccatcagcttcagcagcaccttcggtcacatcgagaaggcgtcttcaaatgcccgctgtgctccagggtgttcccaagcccctcgtcacttgaccaacacctgggagatcacagctccgaatctcacttcttgtgtgttgactgtggtttagccttcggcacagaagcgttgttactcgctcacagaagagcgcacactccaaatccattgcacagttgcccatgtggaaagaccttcgttaatctgacaaaattcttatatcaccggagaacacatggcgttggcggggtacccctacctacaacacccgtccccccagaagaacccgttattgggttccctgaaccagccccggctgagacaggcgaaccagaggcaccggaaccaccagtgtctgaggagacctcggcgggccctgctgcacctgggacttaccggtgcctgctgtgctctcgggagtttggaaaggctctgcaactgactcggcaccagcgctttgtacatagactggagcgacgacacaagtgttccatctgcggaaaaatgtttaaaaagaagtcacacgttagaaaccatctgcgcacacacaccggcgaacggccctttccctgtcccgactgttccaaaccattcaactcccccgctaatctggcacggcacaggctcacccacacaggggagaggccttatcggtgcggagactgtggtaaggccttcacccagagcagcactctccgccagcaccgactcgtgcacgctcagcactttccatatagatgtcaggaatgcggagtccggtttcatagaccatatcgcctgctcatgcatcggtaccatcacactggagaatatccatacaaatgccgggagtgtccccgcagttttctgctccggagactattggaggtgcaccaactggtggtgcatgctggtaggcagccccaccgatgcccaagctgtggcgccgccttcccctctagcctccgcctccgagagcacagatgtgcagccgccgctgcccaggccccccggcgattcgaatgtggtacatgcggcaagaaggtcggctccgcagcccggctccaagcccatgaagcagcccatgccgctgccggccccggagaagtgctggcaaaggagccgcctgcaccacgggcgcctcgcgcaactcgtgctccggtggcaagcccagctgctcttgggagcaccgccacagcctcccctgctgctcctgcaaggagacggggactagagtgctctgaatgtaaaaagctcttttccacggagacttctctgcaggtgcacaggcgcatacacaccggcgagaggccctacccctgccccgactgtggcaaggcatttaggcaaagcactcacctgaaagatcaccgaagacttcacaccggggaacggcccttcgcctgcgaggtctgcggaaaggcattcgctatctctatgcgtctggccgaacacagaaggatccacactggcgagcgcccctactcctgtcctgattgtggcaagagttatagatctttctcgaatctatggaagcatcgtaagacacaccagcagcagcatcaggctgccgtgagacaacagctggctgaagcggaggccgccgtgggccttgcggtgatggagacagctgttgaagcgctcccccttgtggaagccatagaaatttaccccctggccgaggcagagggggtgcaaatctcaggatag

SEQ ID NO: 14423 - DNA, 1635 bp, Artificial Sequence
  Description of Artificial Sequence: Synthetic coding sequence
atgtctatgtgggaggatttatgccagccttaccaggttccactgagcccggcttatagctggggcaggggttgtccactacctacaactccagttcccccggaggaacccgtgataggatttcccgaaccggccccagcggaaacaggggaaccagaagcccctgagccaccagtgtcagaggagacctccgcggggcctgcagctcccgggacctatcggtgtctgctgtgttcaagggaattcggcaaggccttacagctgacacgccaccagcgcttcgtgcatcggctggaacggcgtcacaagtgcagcatctgtggcaaaatgttcaagaagaagagccatgtgcggaatcatctgaggacccacactggggaacgaccattcccctgcccagactgtagcaagccattcaactcacccgcaaacctcgcgagacatcggttgactcatacaggggagcggccctacagatgtggtgattgtgggaaagccttcacgcaaagttcaaccctcagacagcatcggttagtgcatgctcaacactttccttaccggtgccaggagtgcggtgttaggtttcatcgtccataccggttattgatgcatcgataccaccatacaggagagtacccgtataagtgtcgagagtgtcctaggagctttttgttgaggcgcctgctggaagtccaccagctagtggtacacgcaggtagacagcctcaccggtgtccatcttgcggagccgcattcccttcctcgctacggctgcgggagcacagatgcgcagccgccgccgctcaggcacctagacgcttcgagtgtgggacatgcggcaagaaagtcgggtccgcagcccgcctgcaggctcacgaagctgcacacgcagctgccggaccaggagaggtgctcgctaaggaaccccccgcccctagagctccccgggcaacaagagcccctgtggcttctcccgccgcactgggtagcacagctactgcctctcctgcagctcccgctagacggaggggtctggagtgttcagagtgtaaaaagcttttttcaactgaaacgtcattgcaagtacatcgccgtattcatacaggcgagcgcccatacccgtgtccagactgtggaaaggccttcagacaatccacgcatctgaaagacactggagcctgcacccaggtttcaggccccctgcctgtgaaatgcgtagcaaggccactgccgagcccttgtgcctggcaaaatatcgccgcttccacacaggctaatgatcctactcctgcgctaacagtagcccgtgcgacagctccatctccaacttccggctctactgcacggccgatttctagcagcattaggcagttgtgcggatcatcctggcagcggcgaagacttcctctcgcttggcctagttggcgtctcctctggcgaaggtatccctggtggaagccactgaggtcaactctgtggccccgtttgaggggatcccggtctgtcgctgactctgcaagactccctctttggcatcttcatagtttgctgctcaaggccttgcaacacccactcaagcatctgtatatactgtgtcctttcttgttcccctctcctccgccttgcaagttctag

SEQ ID NO: 14424 - DNA, 2691 bp, Artificial Sequence
  Description of Artificial Sequence: Synthetic coding sequence
atgaccgaggaatctgaggagactgttctgtatatcgagcatcggtacgtgtgctctgagtgcaaccagctctatggttcactcgaagaggtattaatgcaccagaactctcatgtgccccagcaacactttgaactagtaggcgtggcagatcccggtgtgaccgtggcaaccgacacagcttcaggaacaggactgtaccagacactcgtgcaggaatcgcagtatcagtgtctcgaatgtgggcaactgctgatgagtccaagccaactcctagagcaccaggaactgcatcttaaaatgatggccccacaggaggcagtgccagccgagcccagccctaaagccccacccctgagtagtagtaccattcactatgagtgtgtggattgtaaggcactcttcgcttcccaggagttgtggttgaaccaccggcagactcacctgcgggctacacccaccaaagcaccagctcccgtggtgctggggtctcccgtcgtgctaggccccccagtcggccaggcacgcgtggcggtagagcattcctatcgcaaagctgaagagggcggagagggcgcaacggtgccttctgctgccgcaacaactactgaggttgtgaccgaagtcgaactgttattatacaagtgcagcgagtgctctcagctgtttcaactgcccgccgattttttagagcaccaggccacccactttccggccccagtgcctgagtctcaggagcctgccttacagcaggaggtgcaagcttcctcacccgccgaagttcccgtgagtcagccagacccactgccggcatcggatcattcttatgagctccggaacggagaggcgataggcagagaccggcgcgggagaagggccaggagaaacaattctggggaagcgggcggcgctgcaactcaggagctgttttgctctgcctgcgatcagttatttctaagccctcaccagcttcagcagcatcttcggtctcacagagaaggggtcttcaagtgtccgctgtgtagcagggtgtttccctcgccgtcctcgctggatcaacacctcggcgatcactcgtctgaatcacatttcctgtgtgttgattgcgggctagcattcggcaccgaggcactcctcctggcgcacagaagggcccacacacccaaccctctacatagctgcccctgtgggaaaacgttcgttaacctgacaaagtttctttatcatagaagaactcacggcgtgggaggcgtacctcttcccactacacctgtccctcccgaagagcctgtgattggctttccggagcctgcccccgccgagaccggggagccagaagcacctgagccacccgtcagcgaggagaccagtgcgggtcctgcggctcctgggacatacaggtgtctcttatgttctagggagtttggcaaggcactacaactgactaggcaccaaagattcgtacaccgcttggaaagaaggcacaagtgttccatctgtggtaagatgttcaaaaagaagtctcacgtgcgtaatcatctccgtacacatacaggcgagcggccctttccttgccctgactgctctaaaccatttaacagcccagctaatcttgctaggcatcggcttactcacaccggagaaagaccataccggtgcggcgactgcggcaaggccttcacccagtcctcgacgctcagacagcacaggctcgttcatgcacagcacttcccgtataggtgtcaggaatgcggggtgcgatttcataggccatatcgcttacttatgcatcggtaccatcacaccggggagtatccatacaaatgtcgcgaatgtcccaggtcatttcttttacggaggctgctggaagtccaccagctggtggtgcacgcaggtcggcagcctcaccggtgtccttcttgcggggccgcctttcccagttcgctcaggcttcgtgagcatcgctgcgcagcagccgcggcccaagctccacgtagattcgagtgcggaacatgcggaaaaaaggtggggagcgcggcgcgactgcaggcgcacgaagcagctcatgctgctgcaggtcctggggaggtgctggcaaaggagcctcctgccccacgtgcccccagggcaaccagggcccccgtcgcttccccagccgccctggggtcaacagctaccgcgagtcctgcagcaccagcccggcgtagggggctagagtgttcagaatgtaagaagctgttttctacagagacgtctctgcaggtacatcgcaggatacacactggcgagcgtccctatccgtgcccagactgtggaaaagctttcagacagagtacccacctcaaagatcatcggaggctgcacacgggtgagcgtccttttgcgtgcgaggtgtgcggtaaagcctttgccatatccatgagactggccgaacataggcgaatccacactggcgagagaccttatagctgccctgactgtggtaagagttaccgcagcttcagcaacctttggaaacacagaaaaacccatcaacagcagcaccaggcagcagtcagacagcagcttgctgaagcagaggccgcggtcggacttgcagttatggaaacagctgtggaagccctccccctggtcgaagctattgagatatatcctctcgctgaggccgagggtgtgcagatttcaggatag

SEQ ID NO: 14425 - DNA, 738 bp, Artificial Sequence
  Description of Artificial Sequence: Synthetic coding sequence
atgctggaacggggcgctgaatctgccgccggcgcgacagatccaagcccaaccggcaaggagccggttacaaaggaggctccacaccagggccccccacagaagcctagccaatcggctccgggccccacagcgtccgcagggtcacccccaagaccacggcgtcgacctccaccacaaagacctcatagatgccctgactgcgacaaagcattctcttatcctagtaaacttgctactcacagacttgcccatggcggcgcaagacctcacccgtgccctgactgtcctaaagcattcagctaccctagtaagctggcagcccaccggcttacccatagcggtgcgaggccacacccctgtcctcactgccccaagagcttcggtcaccggagtaagcttgcggcacatctatggacacacgcaccgacccgtccatatccctgtccggattgtccaaaaagcttctgctacccgtccaagctggcagcacataggcacactcatcacgcaactgacgcccggccctacccctgtccgcattgccctaaggcattcagcttcccgtccaaactggccgctcatcgcctttgtcacgaccctccaaccgctccgggatcgcaagcaactgcctggcaccgttgttcaagttgcggccaggcctttggccagcgccgcctcttattgctgcaccaaagatcccaccatcaggtggaacacaagggggaacgcgactag

SEQ ID NO: 14426 - DNA, 1035 bp, Artificial Sequence
  Description of Artificial Sequence: Synthetic coding sequence
atgtccttggtgcctggcctgacctccatcgagcagcctcaacctcagctgttagatcagctcggcatacctaggcggtgcttccaggattgggtggaccagaatgggctgcccggtctatcagtgacacaacaaatcagaggcattacactcctaaggagacttgaatgttctaacaccatcattgcccattgccgacacgaactactcggcccacccactctgtctccgagcgcctggtcctcccctgctagtccccccccaagggccctcccactgggatcctgtgcaagcaagatgctggagaggggcgctgagtctgctgccggagccacagacccaagtccaaccggtaaagagcctgtgacaaaagaagctccccatcagggaccaccacagaagccctcccagagcgctcccggccctaccgctagcgctggctcgcccccccggcctaggcggcggccacctcctcagcgtcctcaccggtgccctgactgcgacaaagccttttcatatccctctaagcttgcgacacacaggctagcgcacggaggggctcgaccccacccatgcccagattgtcccaaggctttcagttacccatcgaagttggcagcccatcgcctcacacactcaggcgcccggccacacccatgcccccattgccccaaaagcttcggccataggtctaaactcgctgctcatctgtggacccacgcacctactcgaccctatccttgtccagattgcccaaagtccttttgttatcctagtaagcttgccgctcaccgtcatacgcaccatgccaccgatgccagaccatatccatgtccccattgcccgaaggcattctctttccctagcaaactcgcagctcaccgcttatgtcatgaccctccgactgcacccggatcccaagctactgcttggcacagatgcagtagttgtggccaggcctttggacagcgacgccttctactgctgcaccagcggtcccatcaccaggttgaacacaaaggggaacgagactag

SEQ ID NO: 14427 - DNA, 513 bp, Artificial Sequence
  Description of Artificial Sequence: Synthetic coding sequence
atggaggaccctaaccccgaagagaatatgaagcagcaggacagccctaaggagcgaagcccgcagagccccggcggaaacatttgccacctgggcgccccgaaatgtacgagatgcctcataacgttcgccgacagcaagtttcaggaacggcacatgaaacgcgaacaccctgctgacttcgtggcccagaagctgcaaggcgtcctattcatttgtttcacctgcgcaaggtccttcccaagtagcaaagctttgatcacccaccagagatcacatggccccgccgctaaacctactctccccgtggccaccacaactgcacagcctaccttcccctgtccagactgtggaaaaacatttggccaagcagtttccctgcgccgccacagacagatgcacgaggtccgtgccccccctggcacatttgcttgcacagagtgtgggcaggacttcgcgcaggaggccggacttcatcaacactatatccggcatgcccgaggtgaactctag

SEQ ID NO: 14428 - DNA, 513 bp, Artificial Sequence
  Description of Artificial Sequence: Synthetic coding sequence
atggaggatccgaaccccgaggaaaatatgaagcagcaggacagtcccaaggaaagatctccacagagtcccggaggcaatatctgtcatttaggggcccctaaatgtacccgttgcttgatcactttcgccgacagcaaatttcaagaaagacatatgaagagagaacatccagcagatttcgttgcacagaaattacagggagttttgttcatctgttttacctgcgctcgatctttcccatcgtccaaagctctaatcacccatcagcgctcccacggccctgcggctaagcccactctccccgtagccaccacaacagcccagccaaccttcccctgccctgattgcggtaagacttttggtcaagccgtctctctccgacgtcacagacagatgcacgaggtgagggccccccctggcacctttgcctgtacagagtgtggccaggattttgcccaggaagctggcctccatcagcattacattcgacacgctaggggagaactgtag

SEQ ID NO: 14429 - DNA, 513 bp, Artificial Sequence
  Description of Artificial Sequence: Synthetic coding sequence
atggaagaccctaatcccgaggagaatatgaaacagcaggactcgcccaaagagagaagccctcagtctcctgggggtaatatttgtcacctgggagcccctaagtgcacgagatgcctgattactttcgccgacagtaaatttcaggagaggcacatgaagagagaacacccggctgacttcgtggctcagaaactgcagggcgtcctgttcatttgttttacgtgtgcgcgtagtttccccagttcaaaggccctgataactcatcagcgcagtcacggtcccgccgcaaaaccaacgctacccgtggctactacaacagcgcagccaacgtttccatgtccagactgcgggaaaacgttcggacaagcagtcagtctacggagacacagacagatgcacgaagtacgcgcgccaccaggtacctttgcttgtacggagtgtggtcaggatttcgcccaggaggccgggttgcaccagcactatatcagacatgctaggggggaactttag

SEQ ID NO: 14430 - DNA, 513 bp, Artificial Sequence
  Description of Artificial Sequence: Synthetic coding sequence
atggaggacccaaaccctgaagagaacatgaagcagcaggactccccaaaggagaggtccccacagagcccaggaggcaacatttgccacctgggcgcacccaagtgcacgcgctgcctaataactttcgcagatagtaaatttcaggaacgacatatgaagagagagcacccagccgatttcgtggcccaaaagctccagggggtgctcttcatttgtttcacatgcgctcgaagctttcctagctctaaagcccttatcacccatcagcgcagtcatggacctgccgccaaacctactctccctgtggccaccaccacagcccagcctaccttcccttgtcccgattgcggaaaaacattcggtcaagcagtatctctccgacggcacaggcagatgcacgaagtgagagctcctccgggaacatttgcctgcaccgagtgcggccaagacttcgcgcaggaagccggcctccatcaacactacatacgtcacgcccggggggagctatag

SEQ ID NO: 14431 - DNA, 513 bp, Artificial Sequence
  Description of Artificial Sequence: Synthetic coding sequence
atggaggaccccaaccccgaggagaatatgaagcagcaggactcgccaaaagaacgctccccgcaaagtcctgggggcaacatttgccatctcggagcccccaaatgtacccggtgcctgatcaccttcgcggactcaaagttccaagagaggcacatgaaacgagagcatcccgccgacttcgtcgcccagaaactgcagggtgttctgttcatctgtttcacttgtgctagaagcttcccaagtagtaaagctcttattacccaccagagatctcacggaccagctgctaaaccaaccctcccagtggcgaccaccaccgctcagcccacgtttccctgtccagactgcgggaaaacattcgggcaggctgtctccctgcgtagacaccgccagatgcacgaagtgcgagccccacccggcactttcgcctgcactgagtgtggccaggattttgcccaagaagccgggctgcatcagcactacattcgacacgctcgtggcgagctgtag

SEQ ID NO: 14432 - DNA, 513 bp, Artificial Sequence
  Description of Artificial Sequence: Synthetic coding sequence
atggaagatccaaatcctgaggagaacatgaaacagcaggacagccctaaggaacgcagcccacaatcacccggaggcaatatttgtcatctgggcgcacccaaatgtacacggtgcctgattacattcgcggattcgaaattccaagagcgccatatgaaaagagagcatcctgctgactttgtcgcccaaaaactgcaaggcgtgctttttatatgcttcacttgtgctaggtctttccccagttccaaagctctgataactcaccaacggtcccacggacccgccgccaaaccaaccttacccgtggcaacgaccactgcacagccaacttttccctgccctgactgtggtaaaacttttggccaggctgtgagtttaaggcgccaccggcagatgcacgaggtgcgtgctccgcctgggacatttgcgtgcaccgaatgcggacaggacttcgcacaggaagcaggactgcaccagcattacattcggcacgctcgcggcgaactgtag

SEQ ID NO: 14433 - DNA, 1458 bp, Artificial Sequence
  Description of Artificial Sequence: Synthetic coding sequence
atgaaaaacgccactattgtcatgtccgtcaggagggagcagggatcttcctctggcgagggttcactctctttcgaggatgtagccgttggctttacccgtgaggaatggcagttcctggaccagagccaaaaagtcctgtataaggaagttatgctcgagaattatattaatctcgtctccattggctatcggggcacaaagccggactctctttttaagctcgagcagggcgagccccccgggattgccgagggggccgcccattctcagatttgccccgggttcgtaatccaaagccgacgctacgccggaaaggattctgacgcgttcggagggtacggtagatcttgcctgcacataaagcgggacaagacactgaccggggtgaagtaccaccggtgcgtgaagccatctagccccaagtctcaactcaacgacctccagaagatttgcgccggcggaaagccacacgaatgtagtgtgtgtggcagagcttttagtaggaaggctcagctgatccagcaccagcggactgaacgcggcgaaaagcctcacggatgcggcgagtgtggaaagacctttatgaggaagattcaattgaccgagcaccagcgtacacacaccggcgaaaaacctcacgaatgttccgagtgcggcaaggccttcagtcgcaagagccaattgatggtacatcagcgtacccacactggcgagaaaccttatcgctgttccaagtgtggcaaagcgttttccaggaagtgtagactgaaccggcatcagcgatcccatacaggcgagaaactgtatggctgcagcgtttgcggcaaagcgttctcccaaaaggcctaccttacagctcaccagcgacttcatacgggcgataagccttataaatgtagcgactgtggacgcactttttattttaagagcgacctgacgcgacatcagcggatccacacaggagaaaagccctacgaatgttctgaatgcgagaaggctttccgcagcaagagcaaactcatccagcatcagaggactcacaccggcgagcggccgtacagctgccgagaatgtggcaaggcctttgcacatatgtccgtgctgattaaacatgagaagacacatatccgcgagaccgccattaactctttgactgtggaaaagccttctagcaggagccacacatccctgtacatgagtgaacttattcaggagcagaagacagtcaataccgtaccaattgagatgccgagcagtggcacaccaccgcttctgaacaagtcggagcgtcttgtgggacgaaacgtggttattgtggagcagcctttccctcgcaatcaggccttcgtggtgaatcaggagttcgagcagaggatatccttgactaatgaggttaacgtggctccctccgtaattaactatatcctgtatcttaccgatattgtgagtgagtag

SEQ ID NO: 14434 - DNA, 135 bp, Artificial Sequence
  Description of Artificial Sequence: Synthetic coding sequence
atgaagaacgccacgatagtcatgagcgtccggcgggagcaaggaagctctagcggcgaaggctctttgagtttcgaggacgtcgcggtcggcttcaccagagaggaatggcagtttctggatcagtcacagtag

SEQ ID NO: 14435 - DNA, 177 bp, Artificial Sequence
  Description of Artificial Sequence: Synthetic coding sequence
atgaaaaacgcgaccatcgtcatgtctgtgaggcgagagcagggcagctctagtggagagggctctctttcattcgaagatgtcgctgtgggctttactcgcgaggagtggcaattcctcgaccagagtcaaaaagtcctctacaaggaggttatgttagagaactacatcaattag

SEQ ID NO: 14436 - DNA, 189 bp, Artificial Sequence
  Description of Artificial Sequence: Synthetic coding sequence
atgaaaaatgctacgattgttatgagtgtccgccgcgaacaggggtcctcctcaggggagggctctctgagcttcgaagatgtggcagtgggtttcacgcgtgaagaatggcagttccttgaccagtctcagaaggtgctgtataaggaggtcatgttggagaattatattaacctggtatccatctag

SEQ ID NO: 14437 - DNA, 1443 bp, Artificial Sequence
  Description of Artificial Sequence: Synthetic coding sequence
atgaagaacgcgacaatcgtgatgtccgtgagacgcgaacaggggagcagtagtggcgaaggttcattaagtttcgaagatgtggccgtgggcttcactagagaagagtggcagttcctggatcagtcacagaaagttttgtataaagaagtaatgctcgagaactatataaatctagtaagcatcggataccgagggacaaagccagacagtttattcaagctcgagcaaggcgagcccccaggaatcgccgagggcgctgcacactcacaaatttgtcccggattcgtcattcaatcccggcgctacgccgggaaggactcagacgctttcggtgggtacggcaggagttgcctacatatcaaacgggataaaactctgaccggtgtgaaatatcatcgatgcgttaaacccagttcccccaagagccaactcaacgacctgcagaaaatctgtgccggcggtaagcctcacgaatgttctgtttgcggacgcgccttctctcggaaagcccaactcatacagcaccagcggaccgagaggggggagaagcctcacggctgtggtgaatgtggcaagacttttatgcgaaagattcagttaaccgagcatcagcgaacccacactggcgaaaaacctcacgaatgttctgagtgcggcaaggccttctcacgcaagagccaactgatggtacaccagagaacacatacgggtgaaaagccttataggtgctcaaagtgtggaaaggccttttcaaggaaatgccgcctcaatcgccaccagcgctctcatactggcgaaaaactgtatgggtgctcagtgtgtggcaaagcctttagccagaaagcctatctgaccgcgcaccagagactgcacactggagacaaaccttataaatgcagtgactgcggccggaccttttacttcaagtctgatctcactagacatcagcgaatacatacaggagaaaagccctacgagtgcagcgaatgtgaaaaggcatttaggagtaagagtaaactgatccagcaccagcgaactcacacaggggaacggccctatagctgccgggaatgtggcaaggcatttgcccatatgtccgtcctcatcaagcacgaaaagacacatatacgcgagaccgccattaactccctcactgtcgagaagccatcatcaagaagtcacacctctctctacatgtccgagctcatacaagagcagaaaacagtgaatacagtacccatcgaaatgccctcatctggtacacctcccctgttgaacaaatcagagaggctcgtcggacgcaacgtagtgattgtcgaacagccgtttcctcggaaccaggctttcgtggtgaaccaggaatttgaacagaggattagcctgaccaacgaagttaacgttgcaccatctgtgataaactatatcctctacctcacatag

SEQ ID NO: 14438 - DNA, 1689 bp, Artificial Sequence
  Description of Artificial Sequence: Synthetic coding sequence
atggacccccagccacctccccccgctcaaggatcccccccccataggggaaggggccgggggagaggcagagggaggggccgcggtcgaggacgggggcgcggaggagcaggagctccacgggccccactcccatgcccaacctgtggccgcctcttcagattcccatactacttatctcgccataggctctcccactccggcctgagaccgcacgcctgtcctctatgtccgaaagcatttcgcaggcctgctcatctgagccggcacctccgaggccacggacctcagcctccgctgaggtgcgcagcctgcccccgaactttccctgaaccagcccaactacggcggcatttggcccaggagcacgccggaggcgaagtcgagctggccatcgagagggtagccaaagagaccgccgaacctagctggggtccgcaggacgaagggagtgagcccccgactacagcggccgcaggcgcaacagaggaggaggcagttgctgcatggcctgagacgtggcctgccggcgaaccttcgactctcgccgccccgaccagcgccgctgagccaagggagtctgaatccgaggaggctgaggccggagccgccgagctccgcgctgaattagccctggctgctggccggcaggaggaaaaacaggttctgctgcaggccgactggacactgctgtgccttcggtgtagagaggccttcgccaccaaaggagagctgaaagctcacccttgtctgcggccagaaggcgagcaggagggggaaggcggaccgcctcctcgccccaagagacaccaatgcagcatctgtttgaaggcttttgcccgtccatggagcctcagccggcaccgtttagtgcactccacagatcgcccctttgtgtgtcccgactgcgggctggctttccgtctggcctcctacctccggcagcacaggcgagtccacgggcctctctccctactggctcctctgcccgcagctgggaagaaggatgataaggcttctggggcccgaaatagcgcaaagggcccagagggaggagagggagcagagtgcggcggtgcctctgagggaggcgagggtcagaacggaggagacgccgcccctgcccgacctcctgcaggagaaccccgcttctggtgcccagagtgcggaaaaggtttcaggcgcagggctcatctccgccagcacggagtgacacactcgggggccaggccctttcagtgcgtacggtgccaacgagaattcaagcgcctggccgacctggctcggcacgcccaggtccatgctggcggccccgcgccgcacccctgtcctaggtgcccgcggagattcagtcgggcctacagcctcctccgtcaccagcggtgccaccgcgctgaactggagagagcagccgctttacaagctctgcaggctcaagccccaacaagccccccgccaccacccccacccttgaaggctgagcaggaggaggaaggattgcctctacccttggccaatataaaggaggagccgccctcccccggaaccccccctcaatcccccccagcaccaccagtgttcctgtccgcaagctgctttgacagtcaagatcactctgcttttgaaatggaagaggaagaggtggacagcaaggctcacctaaggggtcttggaggtctagcatcatag

SEQ ID NO: 14439 - DNA, 519 bp, Artificial Sequence
  Description of Artificial Sequence: Synthetic coding sequence
atgctcttactgcccccacgaccgccgcacccccgttcctcatccccggaagcgatggaccctcccccgcctaaagctccgcctttcccaaaggcggagggcccatcatctaccccctcgtccgccgcaggccctagaccgccaaggctcggccgtcaccttttaattgacgctaatggtgtgccttacacctacaccgtgcagctagaagaagaaccgcgaggtccaccccagcgagaagcccctccaggagagcccggcccgcggaagggttactcctgccccgagtgcgctcgcgttttcgcctcccccctccgactccaaagtcaccgggtgtcacattccgatctcaaacctttcacctgtggagcctgcgggaaggcctttaaaagatcctctcacttaagcagacatcgcgcgacacacagagcgagggctggccctcctcacacctgccccctctgcccaagacgttttcaggacgcagcagagctggcccagcacgtgcgcctgcattag

SEQ ID NO: 14440 - DNA, 519 bp, Artificial Sequence
  Description of Artificial Sequence: Synthetic coding sequence
atgcttcttttgccccccaggccccctcacccccggtcatcctctcctgaggcaatggatccaccacctcctaaggcccctcccttcccaaaagcggaggggccaagcagcactcctagtagtgcagccggtcccaggccccctcgtttgggccggcacctgctgatcgacgccaacggggttccgtacacatatacggttcaactggaggaggaaccccggggccctccccagagggaggcccctcccggcgaacccgggccaagaaaagggtactcctgtccggagtgtgcacgcgtgtttgcttcaccgttgcggctacaaagccacagggtaagccattcggacctcaagcctttcacatgtggagcgtgcgggaaagcttttaagaggagttcacacttgtcaaggcatcgcgccactcacagagccagagctggcccaccacatacctgcccattatgtccacgcagatttcaggacgcagcggagctagcccaacacgtgaggctgcactag

SEQ ID NO: 14441 - DNA, 519 bp, Artificial Sequence
  Description of Artificial Sequence: Synthetic coding sequence
atgctgttgctgccgccaaggcccccacatcctagaagctcatcccctgaggccatggacccccccccacctaaggcgcctcctttcccgaaggccgagggcccgagttctacaccctctagcgccgccgggcctaggcccccaaggttaggccggcaccttctgatcgatgcaaacggcgttccctacacatatacagttcaactggaggaggagccccgcggccccccccagcgggaagccccacccggcgagccaggaccacggaaaggctactcttgtcctgaatgtgcccgcgtctttgcaagtcctctaaggctacagtctcacagagtgtcccactctgacctgaagccatttacttgcggcgcctgcggaaaagccttcaagcggtcctcccacttatcaaggcatagagctacccaccgagcgcgcgcaggacctccacatacatgcccactgtgtccgaggaggttccaggatgcagcggagctggcacagcacgtcaggctccactag

SEQ ID NO: 14442 - DNA, 594 bp, Artificial Sequence
  Description of Artificial Sequence: Synthetic coding sequence
atgctggtgctaccatccccttgtccccagcctctggctttctcctccgttgagaccatggaaggacctccaagacgcacttgccggtcacctgagccaggtccatcatcttctattggctcaccccaggcgagctcaccacctcgacctaaccattacttgctgattgacactcagggggtaccatacaccgtgctggtggatgaggaaagccagagagaacccggtgcctctggggccccagggcaaaaaaagtgctattcctgtccagtctgttcacgggtgttcgagtatatgagctatttgcagcgccacagtattacccacagtgaagtgaaacctttcgaatgcgacatttgtggcaaggctttcaagagagcatcacatttagctcgtcatcattctatccatctcgcaggtgggggccggccgcacgggtgtcctctgtgccctcgccgctttcgggacgcgggcgaattggcccaacattcccgagtgcattctggagaaaggccatttcaatgtccccattgtccccgccgcttcatggagcaaaacaccctccagaagcacacacgctggaaacacccttag

SEQ ID NO: 14443 - DNA, 1554 bp, Artificial Sequence
  Description of Artificial Sequence: Synthetic coding sequence
atgtctctggggtccgagttatttcgagacgttgcaatcgtgttctcccaggaggagtggcagtggctggcccctgctcagagggacctgtatcgcgatgttatgctggaaacttactccaacctcgtgtccctcgggttggcagtatcaaaaccggatgtcatctcgtttctggagcaggggaaggagccctggatggttgagagggtggtcagcggcgggttgtgtccagtgcttgagagtaggtatgatacaaaggaactttttccaaaacagcacgtgtatgaggtcgaatctccacagtgggaaatcatggaatctctgacctcatacgggctggaatgctcctccttccaggatgattgggaatgccggaaccaattcgatagacaacagggcaatcccgaccggcactttcaccaaatgatcattagacacgaggagatgccaacattcgaccaacacgcttcgctgaccttctaccagaagattcacacacgtgaaaagcctttcgggtataataagtgtaggaaagatttctggcagaaagagctattgataaatcaccaggggatttataccaatgagaaaccttacaagtgcaaagaatgcggcaaggcattcaaatacggttccagactgattcagcacgaaaatattcactctggaaagaagccctatgagtgtaaggaatgcggcaaagcattcaacagcggatctaatttcattcagcaccagcgcgtgcacacaggggagaagccctacgagtgcaaagattgcgagaaggctttttctcggagttcccagctgatagagcatcagaggacgcacaccggtgagaagccatatcagtgcaaggagtgcggcaaagcttttaatcgtattagtcacttaaaggtccactatagaatccataccggtgaaaagccgtacgcctgcaaagagtgtggaaaaaccttcagccatcgctctcagcttatccagcaccagacagtccacacaggaaggaagctgtacgagtgtaaggagtgcgggaaagcttttaaccagggctctactctgattcgtcatcagcgaattcacactggcgagaagccttacgaatgtaaggtctgtggtaaagcttttagggtgtcaagccagctgaagcagcaccagcgtatccataccggggagaaaccctaccagtgcaaagtttgcggtcgagccttcaagcgggtgtcgcacttgaccgtccactacaggatccacactggagagaaaccttatgagtgcaaggaatgtgggaaagccttttcccactgttcccagttgatccatcaccaggtgatacacacagaaaagaagccttatgagtacaaggaatgtgaaaaaaccctgtcacacgatagcacaacggtgcagccccagagaatgcataatcgcgagactcacgtaaacatcatcaatgtggaaaaacccagtatttccagctaccccctcctgatcatccgcgaattcatgctggccagtaaccacatgaacggttctaatggcgagtccccgctggcatag

SEQ ID NO: 14444 - DNA, 1710 bp, Artificial Sequence
  Description of Artificial Sequence: Synthetic coding sequence
atgtcgaaagacctggtgacatttggagacgtcgcagtgaatttttcccaggaagaatgggagtggcttaacccagcacagcgtaatctctaccggaaggtgatgctggagaattaccgcagtttggtgtcgctgggggtctcagtgtctaaaccagacgtgatctccctattagaacaaggcaaagagccttggatggtgaagaaggagggcacgagagggccatgtccagactgggagtacgttttcaaaaatagtgagttctcgagtaaacaagaaacatacgaagagtccagtaaagtggtgacagtaggagcaagacatctctcctatagcctggattacccgtcgcttcgagaggattgccagtccgaagactggtataagaaccaactcgggtcccaagaggtacacctgagtcagttgatcatcacccataaggaaattctcccagaggtgcagaataaggaatacaataaatcatggcagacatttcatcaggatacaatttttgacatccagcagagctttcctaccaaagagaaggcacataagcacgagccacagaaaaagagctatcggaaaaaaagcgtggaaatgaaacacaggaaagtgtacgttgaaaaaaaattgctaaaatgcaatgattgtgaaaaggttttcaatcaatcttctagcttgactctccatcagaggatccacacgggtgaaaagccctatgcttgtgtagagtgtggtaagacattttctcagagtgccaaccttgctcagcacaagcgcatacatacaggcgagaagccatatgaatgcaaggagtgcagaaaggctttttcccagaatgctcacttggcccaacatcaacgcgtgcacacaggggagaagccataccagtgtaaggagtgtaagaaggctttttcccagatagcgcatctgacacagcaccaacgggtacacactggcgaacgcccctttgagtgcatagagtgtgggaaagcgttttccaatggctcattcttggcccagcaccaacgaatacacaccggcgagaaaccttacgtctgtaatgtctgcggaaaagccttcagtcatcgcggctacctgatcgtgcaccagcgaatccacactggcgagaggccttatgaatgcaaagaatgtcgaaaggctttctcccagtacgcccatctcgctcaacaccagagggttcataccggcgaaaaaccctacgaatgtaaggtctgccgcaaagcgttcagccagatcgcttacttagaccaacaccagagggttcatactggggagaagccatatgagtgtattgaatgtggcaaggccttctccaattcttcaagcctggcccagcatcagagaagtcacaccggagagaagccttacatgtgcaaagagtgtcgcaagacattttcccagaatgcaggattagctcagcaccagcggatccacaccggcgagaagccctatgaatgcaatgtctgtggcaaggctttcagttactctggaagcttgaccctccatcagagaatccacactggggagaggccctatgaatgcaaggactgccggaaatcttttcgccagcgagcccacctggcccatcatgagcgaatccacaccatggaatccttcctcaccctgtcctcacccagcccctcaacctctaaccagttgccaaggccggttgggttcatttcctag

SEQ ID NO: 14445 - DNA, 1710 bp, Artificial Sequence
  Description of Artificial Sequence: Synthetic coding sequence
atgtccaaggacctcgtgactttcggggatgttgcggtgaacttctctcaagaagaatgggagtggttaaaccctgcgcagcgcaacctctatcggaaagtgatgcttgagaactatcggagcctcgtgtccctgggcgtgagtgtgtcgaagcccgatgttatcagtttactggagcaaggaaaggagccttggatggtgaagaaagaaggcacccgtgggccatgcccagattgggagtacgtcttcaaaaatagcgaattctcctctaagcaggaaacatatgaagaaagcagtaaggtggtgaccgttggggccaggcatctgagctatagtctagattatccatccttgagggaagattgccaaagcgaggactggtataagaatcaactcggctctcaagaggtccacctgtcacagctgatcattacgcacaaagagatcctgcctgaagtccagaacaaggaatacaacaagagctggcagacattccaccaggataccatcttcgatatccagcaatccttccccactaaagagaaagcccataaacacgagcctcaaaaaaagtcatatcgaaagaagtccgtcgaaatgaaacacaggaaggtttacgtggagaagaagctgctcaaatgcaacgactgtgagaaagtgtttaaccaaagttcctcactgacactgcaccagaggattcacacaggagagaagccctatgcctgcgttgagtgcgggaaaacgttctcccagtccgccaatcttgctcagcacaaaaggattcacactggagagaagccctacgaatgtaaagaatgccgcaaggctttttcccagaatgcccatctggctcaacatcagagggtgcacaccggagaaaagccatatcagtgcaaagagtgtaagaaggctttcagccaaatagcccacctcacccaacatcaacgggtccacaccggcgaacgccccttcgagtgtattgaatgtgggaaggcattttcaaatggtagcttcctggcacaacaccaaagaatccatacaggagagaagccttatgtgtgcaatgtttgcggtaaagctttctctcatcggggctatctgattgtgcaccagcgcatccacaccggcgagaggccttatgaatgcaaggagtgccgaaaggcctttagccagtacgctcatctggcacagcatcagcgtgtccacactggagaaaaaccctacgagtgcaaagtttgtcgaaaagctttttcacagattgcctatctggatcaacaccagcgagtccataccggggaaaaaccttatgaatgcatagagtgtgggaaggctttcagcaactcttcttctttggcacagcaccaaaggagccacaccggcgagaagccatacatgtgtaaggaatgtcgaaagaccttttcgcagaacgctggattagcccagcatcagcgaattcataccggcgaaaaaccctacgaatgcaatgtatgcggtaaggctttttcctattcaggctccctgacactccaccagcggatccacactggagaacgtccctatgaatgcaaagactgccggaagagttttaggcagcgggcgcacctggcccaccatgaacggattcatactatggagagctttttgactctaagttcaccatcaccatccacctcaaatcagctgccacggcctgtaggattcatctcttag

SEQ ID NO: 14446 - DNA, 414 bp, Artificial Sequence
  Description of Artificial Sequence: Synthetic coding sequence
atgtcaaaagatctagtgacgttcggagatgtggctgtaaacttttcccaggaagaatgggagtggctaaaccctgctcagcgtaacctctatagaaaggtgatgctggagaactaccgaagcctcgtgtcgctgggtgtgagtgttagtaagcccgacgtaatcagcctattggaacagggcaaggagccctggatggttaaaaaggaaggaactagagggccatgtccagattgggagtacgtgtttaagaactctgaattctcatctaagcaagagacctacgaggaatcaagtaaggtggtaacagtgggagctcgtcacctgtcctattcgctggactacccatcactgagggaggattgccagtcagaggactggtacaagaaccagctgggcagccaagaagtctag

SEQ ID NO: 14447 - DNA, 390 bp, Artificial Sequence
  Description of Artificial Sequence: Synthetic coding sequence
atgtcgaaggatctggttacctttggggatgttgccgtgaactttagccaagaagagtgggaatggctaaaccctgcacagcgaaatctgtatcgcaaggtaatgctggagaactatcgctcccttgtgtcattgggagtttccgtgagtaagcccgatgtaatcagcctacttgaacagggcaaggaaccatggatggtgaagaaagaagggacacgcggcccctgtccagattgggaatacgtattcaagaattctgagttcagctccaaacaagagacttatgaggagagttctaaggtcgtgactgtaggagcccgccatctgtcttacagcctagattatccttcactccgagaagattgtcagtccgaggactggtacaagtag

SEQ ID NO: 14448 - DNA, 1266 bp, Artificial Sequence
  Description of Artificial Sequence: Synthetic coding sequence
atggccggagaggcagaggcccagctagatccttcccttcaagggctggtgatgtttgaagatgtgaccgtgtacttttcaagggaggaatgggggctgttgaacgtcacacaaaaggggctctatcgcgatgttatgctcgagaatttcgccctcgtaagcagcctcggacttgcgccatctaggagccccgtgtttacccagctggaggatgacgagcagagttgggttccatcttgggtcgacgttacccccgtgagccgggctgaggcaagacgcgggtttgggctcgacggtctctgtagagtggaggacgagcgagcacacccagagcacctgaagagttaccgggtgatccaacatcaggatacacactcggaggggaaacctcggagacacactgagcacggcgctgctttccccccaggtagcagctgtggacaacagcaggaggtgcatgtagctgagaagctattcaagtgcagtgactgcggcaaggtattcctcaaagcctttgccctgctcgatcatctcataacccactccgaggagcgtcccttcagatgtcctaccggccgatctgcatttaaaaagtctgcccatatcaatccgcgtaaaatccatacaggagagaccgcccacgtttgtaacgagtgcgggaaagccttttcctaccccagcaagctgagaaaacatcaaaaagtgcataccggaatcaagccctttaaatgttccgattgcggcaaaacgtttaataggaaggacgctctcgtcctgcaccagcgaatacacacaggagaaaggccctacgaatgctccaagtgtggcaaaacctttagcgtcttgtcaactctcattaggcatcggaaggtacacattggcgagcggccatacgagtgcacggagtgtggtaagttttttaagtataataatagttttattctccaccaaagggtccacacgggtgagaggccgtttgaatgcaagcagtgcggaaagggctacgtcacacgaagtggactgtaccagcactggaaggtccatactggcgaacgaccttatgaatgttctctgtgcggaaaaacctttaccacgcggtcataccggaacagacatcagcaattccatacagaggagcggtcttatgaatgtacagaatgtggcaaggctttcaagcattcgagcactcttttgcagcacaaaaaagtgcacaccccggagcgtcgccaggaggatcgcgcgcacgggaaagttgtgtcctgctag

SEQ ID NO: 14449 - DNA, 438 bp, Artificial Sequence
  Description of Artificial Sequence: Synthetic coding sequence
atggctggggaggctgaggggctggtgatgttcgaagatgtgaccgtctacttctctagagaggagtggggtctgttgaacgtgacgcagaaaggcctgtacagggacgtcatgcttgagaacttcgcgcttgtctctagcctgggcctggcccctagtcggtccccagttttcacacagctcgaagatgatgagcagtcgtgggtgccctcatgggtggacgttacccccgtatcccgcgccgaggcccgacgcgggtttggtctcggccctgcctgcagctgcttaagtggcctgcggcttttgattgctctcctttgcatctgcgctgagcttagcacggtcggtgatagcgtgcgggtgttaaaatgtgcccatatcctcaagcaaatggtgtgtgtggaatggaggatgagggagcctatcttatctatttag

SEQ ID NO: 14450 - DNA, 924 bp, Artificial Sequence
  Description of Artificial Sequence: Synthetic coding sequence
cccgggagttcctgtggtcaacagcaagaggttcatgtcgcagaaaagttgtttaagtgctcagactgcggaaaggtgtttctgaaggcatttgccctcctggatcacctgataacgcacagcgaggaaagaccttttcggtgccccaccggaagatctgccttcaagaagtctgcccatattaacccgaggaagattcacaccggagaaaccgcacacgtgtgcaacgagtgcgggaaggcattctcctatccttctaagctcagaaagcaccaaaaagtccacaccgggatcaagccgtttaaatgtagcgattgcgggaagacttttaaccgcaaagacgccctcgttctgcatcaaagaatccatactggagaaaggccctatgagtgttcaaaatgtgggaaaacattttccgtgctctcgactcttattcggcaccgaaaagtgcatattggcgagagaccttacgagtgtacagagtgcggcaagttcttcaagtacaataatagtttcatactccatcagagggtgcacacgggcgagaggccctttgaatgtaaacaatgtggcaagggctacgtgacacggtctgggctgtatcagcactggaaggttcatacaggggagcggccatatgagtgttcgttgtgtggcaagacgtttactactcgaagttatcgaaaccggcatcagcaatttcatactgaagagagaagctatgagtgcaccgaatgcggcaaagcattcaagcactctagtacattgctccagcataaaaaggtacatactccagaaagaccctttatttgtttcaattgcgggaagaactttaatatgagctcttgtcttgcctggcaccaaaaacttcaccccggagaaaagccgttcgactactctaagtgccggaaggtctttacctag

SEQ ID NO: 14451 - DNA, 2145 bp, Artificial Sequence
  Description of Artificial Sequence: Synthetic coding sequence
atgttggagacttactcccaccttctgagtgtcggctaccaggtgcccgaggctgaagtggtgatgcttgaacagggaaaggaaccctgggctcttcagggcgagcggccccgccaatcttgtccaggagagaaactgtgggaccataaccagtgccgcaagatcctatcgtacaagcaagtctccagtcagccacagaaaatgtacccgggggaaaaagcttacgaatgcgctaagttcgagaagatttttactcagaagagccaactgaaggtgcacctcaaggtcctggccggcgaaaagctttatgtgtgtatagagtgtggtaaagcatttgtccagaaacccgagttcattatccaccaaaagacccatatgagggagaagccattcaaatgcaacgagtgtgggaaaagcttcttccaggttagcagtctcttcaggcaccagagaatccataccggagaaaagctctatgagtgtagtcagtgcggaaaaggctttagctataactctgacctgtcgatccacgaaaaaatacataccggcgagaggcatcatgaatgcacagactgtggtaaggcctttacacaaaagtctacccttaaaatgcaccaaaagattcacacgggcgaaaggtcttacatttgcattgaatgtggtcaggccttcatccaaaaaacccacctcatagcccataggaggatccacaccggtgaaaagccttatgaatgttctaactgtggcaagtccttcatctctaagtcacagctgcaggtacaccagcgggtgcacactagagtgaagccgtatatctgtactgagtacggtaaggtgttctctaataattcaaacctagttacacataagaaagtccagagccgggagaagtccagcatttgtacagagtgtggtaaggcttttacctacagaagcgagctgattattcatcagcgcatacatacaggggagaagccatatgagtgcagcgactgtggtaaggcattcacgcagaaatcagccctcacagtacaccagcgtattcacacgggtgagaagtcttacatatgtatgaaatgcggacttgcctttatacagaaagcccacctgattgctcaccagatcattcacactggtgaaaagccacacaagtgcggacactgcggtaaactgtttaccagtaagtcacagctgcatgttcataagcgcatccacacaggcgagaaaccatacatgtgtaacaagtgtggcaaggcattcacaaatcggagtaacttaataacacaccagaaaacacataccggggaaaaatcctacatatgtagtaagtgtggcaaggcttttacgcaaaggtcggatttgattactcatcagcggatccacactggagaaaaaccttatgagtgcaatacttgtgggaaagcttttacgcaaaagtcacacctcaatatccaccaaaaaatccatacgggcgagagacaatatgaatgccacgagtgcggcaaggccttcaatcagaagagcattttaatagtgcaccaaaaaatccatacaggtgaaaagccctatgtctgcaccgagtgcggacgcgctttcattaggaaatctaattttataacccaccaacgcatccatacaggagagaagccgtatgaatgcagtgattgcgggaaaagctttacttccaagagtcagcttctggtgcaccaacctgttcacactggagaaaaaccttatgtttgtgccgagtgcggaaaggccttttctgggcgtagcaatcttagcaaacaccagaagacccacacgggcgagaagccgtatatctgttctgaatgcgggaaaacgttcaggcaaaagtccgagcttatcacacaccataggatacacacaggcgaaaagccgtacgaatgctctgactgtggcaagtcttttacgaaaaaaagccagctgcaggtgcaccagagaattcacacgggggaaaagccctacgtgtgtgccgaatgtggcaaagcttttacggatcgaagcaacctgaataagcaccaaacgacccacaccggcgataagccctacaagtgcggcatctgtggaaaagggtttgtgcagaagtcagtcttctccgtccaccaatcatcccacgcctag

SEQ ID NO: 14452 - DNA, 1221 bp, Artificial Sequence
  Description of Artificial Sequence: Synthetic coding sequence
atgctagaaacatactcacacctcctgagtgtcggttaccaggtgccagaggccgaagttgttatgcttgagcaggggaaggaaccttgggccctccagggggaacgtccaagacaaagctgtcctggtgaaaagctgtgggatcataaccagtgtagaaaaatccttagttataagcaggtgagctcccagccacagaaaatgtacccaggggagaaggcttacgaatgtgcaaaattcgagaagatcttcacacagaagtcccaactgaaagtccacctgaaggtgctcgctggagagaagttgtacgtatgcattgagtgtggaaaggccttcgtacaaaaacctgaatttattatccatcagaaaactcacatgagagaaaaacccttcaaatgcaacgaatgtggcaaatcattttttcaggtgtcatctctgtttagacatcaaaggattcacaccggagagaagctttacgagtgttcccagtgcgggaagggcttttcatataattcggacctgtccattcacgaaaaaatccatacaggcgagcggcatcacgagtgcactgactgcgggaaggcttttacccaaaaaagcacactgaagatgcaccagaaaatccataccggtgaaaggagttacatctgcatagagtgcggacaggctttcatccagaagacacatttaattgcacatcgccgtattcacaccggggagaaaccttacgagtgtagcaattgtggcaagagcttcattagcaaaagtcagctccaggttcaccaacgggtccacactcgtgtcaaaccctacatctgcaccgaatatggcaaagtgttttctaacaactctaacctagtgacacacaaaaaagtacagagccgagaaaagagttcgatttgcaccgagtgcgggaaggcgtttacgtaccggtccgatctgatcactcaccacagaatccacacgggcgagaagccatacgaatgctccgattgtgggaagtcattcaccaaaaagagccagctacaggttcaccagagaattcatacgggagagaaaccttacgtctgtgccgagtgtggcaaggcgtttactgatagatcgaacctgaataaacatcagactacccatactggggataaaccatataagtgtggaatctgtggcaagggttttgtgcagaaatccgtgttttccgtccatcaatcttcccatgcttag

SEQ ID NO: 14453 - DNA, 2310 bp, Artificial Sequence
  Description of Artificial Sequence: Synthetic coding sequence
atgccagctaattggacaagcccacagaaatcctcagccttggcaccagaggatcacggctcaagctacgagggctcagttagcttcagggatgtagctattgacttcagtagggaagagtggcgccacctcgatccaagccaacgtaacttatacagggacgttatgttagagacatactcccaccttctgagtgtgggatatcaggtcccagaggcagaggttgtcatgctcgagcaagggaaggaaccctgggctctgcagggggaaagacctcgacagtcatgtcccggagaaaaactctgggatcataatcaatgtcggaaaatcctgtcgtataaacaggttagcagccaaccacagaaaatgtatcctggcgagaaggcatacgagtgcgctaaatttgaaaaaatatttacccagaagagccagctcaaagtgcacctcaaggtcctggcgggtgaaaaactatatgtgtgtattgaatgcggtaaagcctttgtgcagaaaccagagttcattattcaccagaaaacacatatgcgcgaaaagcccttcaaatgcaatgagtgtgggaagagctttttccaagtgtcctccctctttcggcatcagagaatacatacgggggagaaactgtatgagtgtagtcagtgcggcaagggtttcagctacaactctgacctgagtatccatgagaagatccatacgggcgagcggcatcatgaatgcactgactgtgggaaagcttttacccaaaagagcacccttaagatgcaccagaaaatccataccggagaaaggtcctacatctgcatcgagtgcggtcaggcattcatccagaaaacccacctgatagctcatcgccggattcataccggcgaaaagccttacgagtgcagcaactgtggtaaatcttttatttctaagtcccaacttcaggtgcaccagcgcgtgcacactcgcgtgaaaccttatatttgcacggagtacggtaaggtcttttcaaataactccaacctggtcacgcacaaaaaagtacagtctagagagaaaagttcaatctgtacagaatgcggaaaagcgtttacttataggtcagagctaattatccaccagcgaatccacaccggtgagaagccctacgaatgctcggattgtgggaaagccttcacgcagaagtccgccctgacagtccaccaacgaatccataccggcgagaagtcatatatctgtatgaaatgtggactcgcctttattcaaaaagcccacctgatcgcgcaccagatcattcacacaggagagaaacctcacaaatgcggtcactgtggtaaattgtttacctcaaagtctcaactccacgtgcacaaaaggatccacaccggagaaaagccttatatgtgcaataaatgcggaaaggcctttaccaatcggtctaatctcatcacacaccagaagacacacactggggaaaagtcctacatatgttccaagtgtggcaaggcattcacacaaaggtccgatcttatcactcatcagcggattcatacgggggagaaaccctacgagtgcaatacttgcgggaaagcttttacccagaaatctcacctgaacatccaccagaagatccacacaggagaaagacagtatgagtgccatgaatgcggcaaggcctttaatcaaaagtctatactgatcgtccatcagaaaatccacacgggggagaagccctacgtttgcacagagtgtggcagagcattcatacggaagagcaactttattacgcaccagcgcatacataccggcgaaaaaccgtacgaatgctctgattgtggcaagagcttcacatcgaagtcccagctcttggtgcaccaacccgtgcataccggagagaagccttatgtttgtgctgaatgtggcaaggctttctccggaaggagtaatcttagtaaacaccagaagacccacaccggtgaaaagccatacatctgcagtgagtgcggtaagactttcaggcaaaagtccgagttgatcacccaccaccgaattcacaccggcgagaagccttacgaatgttccgactgtggtaagagtttcactaaaaagtcccaacttcaggtacatcaacggatacatactggtgagaagccatacgtgtgcgcagaatgtggcaaagccttcacagaccggtccaacctgaacaagcaccagaccactcacactggggacaagccttacaagtgcggcatttgcggcaaggggttcgtccagaaatccgtattttcagtgcaccagagcagccacgcctag

SEQ ID NO: 14454 - DNA, 2145 bp, Artificial Sequence
  Description of Artificial Sequence: Synthetic coding sequence
atgctggaaacttattcccatctgctgtccgtcggctaccaggtccctgaagctgaggtggtgatgctggagcagggaaaggagccttgggcgctgcagggcgagcgccctcgccaaagttgcccgggtgagaagctttgggaccataaccaatgtcggaaaatactgagttataaacaggtttcatcacagccccagaagatgtaccctggcgagaaggcttacgagtgcgctaaattcgagaagatatttacgcagaagtcccagctgaaagtccatctgaaggtactggcaggcgaaaaattgtacgtctgcatcgaatgtggaaaagctttcgtgcaaaagcctgagttcattatacaccagaagacccatatgagagagaagcctttcaaatgtaatgaatgcggaaagtccttcttccaggtgtcttccctgttccgtcatcagcggatccatacaggagaaaaactctacgaatgttctcagtgtggaaaggggttttcctacaactctgatctctctattcacgaaaagattcacactggggagagacaccacgagtgtacggactgtgggaaggcttttactcaaaagtccacacttaaaatgcatcaaaagatccatactggagaaaggagctacatttgtatagagtgcggccaagccttcatccagaagacccacctgatcgcacatcgacggatccacactggagagaagccgtacgaatgtagtaactgtgggaaatcttttatatccaagtcgcagctgcaggttcaccagagagtacacaccagggtgaagccttacatttgcaccgaatatggcaaggtgttcagcaacaatagcaacttggtgacccataagaaggtccagagtcgggagaaatccagcatatgcacggagtgcggaaaggccttcacatacaggtccgaattaatcatccatcagcgcatccataccggggaaaagccatatgaatgttcagactgtgggaaggccttcacccaaaagagcgccctcacagtccaccaacgaatccataccggggaaaaatcatacatatgtatgaagtgtgggctggcattcatccagaaagctcatttgatcgcccaccagataatacataccggggaaaagccccacaaatgtggccactgcggaaagttgtttaccagtaagagccagctccacgttcacaaaagaattcatactggggagaaaccatatatgtgcaataagtgcggcaaagcttttaccaacagatctaacctgattacccatcagaagacccacactggcgaaaagtcatacatctgctccaagtgcggaaaagccttcacccagcgaagcgatcttataacgcaccagagaattcacacaggagaaaaaccctacgaatgtaatacctgtggtaaagctttcacccagaaatcacacctgaatatccaccagaaaatccatacaggggagcgccaatatgagtgtcatgagtgtggaaaggcttttaaccagaagtccatattgatcgtgcaccagaagatccacaccggcgagaagccatacgtgtgtactgagtgcggcagagccttcataagaaaaagcaacttcattacacaccagcggatccacacaggagagaagccctacgagtgcagcgattgtggcaagtcatttacatctaagtctcagctacttgtgcaccagccagttcacactggtgagaagccatatgtatgtgccgaatgcgggaaagctttttccggtaggagcaatttaagtaagcaccagaaaacccataccggcgagaagccatatatctgtagtgagtgcgggaagacctttcggcagaaatccgaactgattactcaccaccgaatccatacgggcgagaaaccgtatgaatgttctgactgtggcaagagtttcacgaagaagtcccaactccaagtgcaccaaagaatccacacaggtgagaaaccatacgtatgcgcagaatgtgggaaggcatttaccgacaggtctaatctcaataagcaccaaactacccatactggcgataagccatacaagtgtggcatttgtggaaaaggtttcgtacagaagagcgtcttttccgtccaccagtcctcccatgcttag

SEQ ID NO: 14455 - DNA, 1074 bp, Artificial Sequence
  Description of Artificial Sequence: Synthetic coding sequence
atgaagtgcggcctggcgttcattcggaaagctcatttaattacgcatcagatcatccacaccggcgagaagccctacaagtgcggtcactgcggaaaactgttcaccagcaaatctcagctgcacgtccacaagcggatccataccggggaaaaaccatatgtgtgcaacaagtgtggaaaggctttcactaacagatcgaatttgatcactcaccagaagacacacacaggagaaaagagctatatctgttccaaatgcggcaaagcatttacgcagcgctccgacctgatcacacatcagcgaattcataccggcgaaaagccttacgaatgcaatacatgtggtaaggcctttactcagaagtccaatctgaatatacaccagaagattcacaccggggaacgccaatatgagtgccacgagtgcggcaaggcctttaaccaaaagtctatattgatcgtccaccaaaagattcataccggagaaaaaccgtacgtctgtactgagtgcggtcgagcatttataagaaaaagcaatttcattacccatcaaaggatccacaccggagagaagccctatgaatgctccgactgcgggaaatcttttacttcaaaatcccagttgttagtccaccagccagtgcatactggagagaaaccttacgtctgcgcagaatgcggaaaagccttctccggaaggtcaaacctgtcaaagcaccagaagacccatactggagagaaaccttatatctgttccgaatgcggaaaaacattccgacagaaaagtgaactcattacgcaccataggattcacaccggagaaaagccttacgagtgctccgattgcggaaaaagcttcacaaagaaatcacaactgcaggtgcatcagaggattcatactggggaaaagccctacgtgtgtgcagagtgcggcaaggcgtttagtaacaggagtaacctcaacaagcatcagactacccacaccggcgacaagccctacaagtgtgggatttgcggcaaaggcttcgtccagaagagcgtgttttcagtccatcaatcgagccatgcctag

SEQ ID NO: 14456 - DNA, 2145 bp, Artificial Sequence
  Description of Artificial Sequence: Synthetic coding sequence
atgctcgagacttattcccacctcctctctgtgggctaccaggtcccaaagccagaggtggtgatgctggagcagggaaaagagccttgggctttacaaggagaaaggccgcgccactcctgtcctggtgagaaactatgggaccacaaccaacataggaagatcataggttataagcctgcctcaagccaggaccagaaaatttacagcggcgagaagtcttatgagtgtgctgaattcggtaagtccttcacctggaagagtcaattcaaagtgcaccttaaggtgcctaccggggaaaagttatatgtgtgcattgagtgtggacgcgcattcgtgcaaaagccagaatttatcacacaccagaagacccatatgagagaaaagccgtataagtgcaatgagtgtggcaaatctttctttcaggtgtcctcactgtttaggcatcacagaattcataccggggagaagctgtatgagtgcagtgagtgtggcaaggggttcccatacaacagcgacctcagtattcacgaaaagattcacaccggtgagaggcaccacgagtgcaccgattgtggaaaagcattcacccagaaaagcactctcaagattcatcagaagatccacacaggcgagcgcagctatatctgcatcgaatgtgggcaggcatttatccagaagacgcaactgattgctcatagaaggattcactccggagaaaaaccctacgagtgcaataactgcgggaaatcgttcatttctaaatcacagcttcaggttcaccagcgtgtgcatactcgggttaagccatacatctgcactgaatacggtaaggtgttctctaataatagcaatctgatcacccacgagaaaatccaatcacgggagaaatcttcaatatgtactgaatgcggaaaagcctttacttatcgttcagagctgattatccatcagcgtattcacacaggtgaaaagccatacgagtgcagtgattgcggcagggcattcacccaaaagtccgcactcacagtgcaccagagaattcacacaggcgagaaatcttacatctgcatgaagtgcggcctggcatttatacgaaaggcccacttaataacacatcagattatccacaccggagagaaaccttataaatgcggacattgtggcaagctgttcaccagcaagagccagttacatgtccataagagaatccatactggtgaaaagccgtacgtctgcaacaaatgtggcaaagcctttacaaatagatctaacctgatcacacatcaaaaaacccacactggggagaagagctacatttgttccaagtgtggaaaagcatttacacagcggtctgatctcattacacaccagcggattcacacaggcgaaaaaccttatgaatgtaacacctgcggaaaggcattcacgcagaagtccaacctaaacatccaccagaaaatccataccggcgaaaggcagtatgaatgccatgagtgtgggaaggcttttaaccagaaatctattctgatcgtgcaccagaagattcacactggagagaagccttacgtttgtactgagtgtggacgcgcgttcataaggaagtccaatttcattacgcaccagcggatccatacaggagagaaaccttatgagtgtagcgactgcgggaagagtttcacttctaagagccagctgttagtccatcagcctgtccatacaggtgaaaagccttacgtgtgtgcggaatgtggtaaagcattctccggcagaagcaacctatctaagcaccagaagacccatactggagaaaaaccttatatttgctccgaatgtgggaagacttttcggcagaagtcagaactgatcacccaccaccgcatccatacgggagagaaaccctatgaatgcagtgactgcggaaagtcgttcaccaagaagtcccagctgcaagtccaccagagaattcacacaggtgaaaaaccctacgtgtgtgcagaatgcggcaaagcatttagtaaccgatctaacctaaacaagcatcagactacacacacaggggacaaaccctataaatgcgggatctgcgggaagggcttcgtccagaaatcagtatttagtgtgcatcagtccagtcacgcctag

SEQ ID NO: 14457 - DNA, 2310 bp, Artificial Sequence
  Description of Artificial Sequence: Synthetic coding sequence
atgcctgcctcctggacaagcccacagaaaagctctgcgctggcaccagaggaccatggaagcagttacgagggatccgtctctttcagagatgtggccatagacttcagccgcgaagagtggcgtcacctcgacctgtcgcagcggaatctttatcgagatgtaatgttggagacttacagtcacctcctgagtgtgggataccaggtcccaaaacccgaggttgtcatgcttgagcaaggcaaagagccatgggccttacaaggcgagaggccccgccatagttgtcccggggaaaaactctgggatcacaaccagcatcgcaagatcatcgggtacaagcctgctagctcccaggatcagaagatttactcaggagagaaaagctatgagtgcgccgaattcggaaagtcttttacatggaagtcacagttcaaggtgcacttgaaagtgccaacaggagagaagttgtacgtttgcatcgagtgtggcagggcctttgtgcagaaaccagaatttattactcatcagaagacacacatgcgggaaaagccctacaaatgcaacgaatgtggcaaatcttttttccaggtgagctcccttttccgccaccaccggattcacactggggaaaaactttacgagtgctcagagtgcggtaaaggtttcccttacaatagcgacctaagcattcatgagaaaatccataccggtgaacggcatcacgagtgcacggactgcgggaaggccttcactcagaaatcaaccctgaagatacatcagaaaatacatactggcgagcggtcatacatctgtattgaatgtgggcaggcctttattcaaaagacgcagctgatagcacatcgaaggatacatagcggtgaaaagccctacgagtgcaataactgtggcaaatcatttatctctaagagtcagctacaagtccaccagcgagtgcacaccagagtgaaaccctatatatgcacggagtatgggaaagtttttagcaataattccaatctgattacgcacgagaaaattcagagtagagagaaatcaagcatttgcacagaatgtggcaaggccttcacctacaggagcgaattaatcatccaccagcgaatccataccggggaaaaaccctacgaatgttctgactgcggacgggccttcacacaaaaatcagccctcactgtacatcagaggatacacacaggtgaaaagtcctacatttgtatgaagtgtggcctggctttcatccggaaggctcatctcatcacacatcaaattattcatacgggtgaaaaaccgtacaaatgtggacactgtgggaaactctttacctccaagagccagctccatgtacataaacgcatccacacgggcgaaaaaccttacgtgtgcaataaatgtggaaaggcattcacaaatcggtctaatctgataactcaccagaaaacacatacaggagagaagtcctacatttgctccaaatgtggaaaggcattcactcagcgctctgatctcatcactcaccaacgcatccataccggtgaaaaaccttatgagtgtaacacatgcgggaaagcttttactcagaagtcgaatctgaatatccatcagaaaattcacaccggcgaaagacaatacgaatgccatgagtgcggtaaggccttcaatcagaaaagcatcctaatcgtccatcagaaaatccatactggagagaagccatacgtgtgcactgagtgtgggagggcgttcatccggaaaagtaatttcatcacccatcagcggatacatacaggggagaagccctatgagtgtagcgactgcgggaagtccttcacatctaaatctcaactgctggtgcatcagccagtccacacaggggagaaaccatatgtttgcgctgagtgcgggaaggcgttcagtggacgctccaacctaagtaagcaccagaagacccacactggtgaaaagccatacatttgctccgagtgcggcaaaaccttcagacagaaatcagagctgattactcaccaccggatccacaccggcgagaagccctacgagtgttctgattgcggaaaatctttcaccaagaagtcccaactccaggtccaccagcgcatccacactggcgaaaagccatatgtgtgcgccgagtgcggaaaagcctttagcaatcgttcgaatctgaacaagcaccagacaacacataccggtgacaagccatacaagtgcggaatctgtggaaaggggttcgtccaaaagtctgtgttttccgtgcaccaatcatctcacgcctag

SEQ ID NO: 14458 - DNA, 195 bp, Artificial Sequence
  Description of Artificial Sequence: Synthetic coding sequence
atggcggctgccgcagctttgcgtgcacccgcgcagagcagcgttactttcgaggacgttgccgttaacttcagccttgaagaatggtcactactgaatgaggcccagggatgcctttaccacgacgttatgctcgagacccttacattgattagctctctcggttgctggctgcaagtcgaagatggtgcctag

SEQ ID NO: 14459 - DNA, 1080 bp, Artificial Sequence
  Description of Artificial Sequence: Synthetic coding sequence
atgctggagacgctgaccctgatctcgagtctagggtgctggcacggcggggaagacgaagcggctccctcaaagcagtcaacctgcattcacatctacaaggaccaggggggacattccggagagagaccttatgaatgtggcgaataccggaaactgtttaaaaataagtcctgcctgacagagccaaggcgggaccacaaacatagaaacgtgaggacgggggaaaggccatatgagtgctcaaaatatggcaagttattccatcaaaagcccaccctacatatacatgagagattccataccggacaaaagacctatgaatgttctgagtgtggcaaaagctttcatcagtcctcttcgttgctacagcgacagacactgcatactagggaaaggccatacgaatgcatcgagtgtgggaaagctttcgccgagaagtcatcacttattaaccacagaaaagtacacagcggagccaagaggtacgagtgcaacgagtgcggcaaatccttcgcgtacacctcttctctcattaagcaccggcgaattcacaccggcgaaagaccatacgagtgctcagaatgcggtaggtctttcgctgagaattcaagcttaatcaaacatcttagggttcatactggtgagaggccctatgaatgtgtggagtgcggcaagtcattcaggcgaagcagttccctgctccaacatcagcgagtgcataccagggaacggccatacgagtgcagcgagtgcgggaagagcttcagtttgaggtctaacttaatccatcaccaaagggtccacacaggcgaaagacatgagtgtggccagtgcggaaaatcattctctcggaagagctccctcatcattcacctgagagtgcatacaggggaaagaccatacgaatgtagcgactgtggtaagtccttcgccgagaacagtagtctcattaagcacctccgggttcacacaggagagagaccctacgaatgcatcgattgcgggaagtccttcagacactcaagcagctttaggcgccatcaacgagtgcatactggaatgcgtccatacaagtag

SEQ ID NO: 14460 - DNA, 633 bp, Artificial Sequence
  Description of Artificial Sequence: Synthetic coding sequence
atggccgctgcagcagcactgcgggctccggcccaagttgtcggcatggagggcaaaatgaggcagcacttactatccagggccagagtttacatttataccaagacacgtgaggtgatcgtcgagaagggacttatgtcggttggcaacattggcaactacctgaggacctcccccgcatcccttaaccccgaagagattacaaacaccgggatgtttgccctcgagaagggattgatgagcgccgcaaacatgggaaactactttaccaaatctttgcatagtattttcatgcgagatttcatactgggtaaaaggccaatgtccgccgtcagtgttgaaaatcatttcacaaaggctctgcatagctgttcggttcgtcacttcactctggaaaagggcttaatgtcggtgctaaatgtcgggaagccactgttgaagtcccctgtttccctgacgaccggtaaatttaccctggaacagtctgtcatgaatgctatgaacgtgggctctccactgctgatccatcttgtgtcgcttaacactggtggctttacccttgagcgggggcttatgtcagcggtcaatgtcggcgaccccttgctgaaaaccccagtgttgctcaatacttag

SEQ ID NO: 14461 - DNA, 1209 bp, Artificial Sequence
  Description of Artificial Sequence: Synthetic coding sequence
atggccgccgccgccgcactacgcgcccccgcccagagttccgtcacttttgaggatgtggctgtcaacttctccctggaggaatggtcgctccttaatgaggcacagagatgcctttaccgcgacgtaatgctggagaccctaacattgatatcctctctggggtgctggcacgggggcgaagacgaagctgcacctagcaaacagagtacctgtattcatatatacaaagatcaaggcggacattccggagaacgcccgtatgagtgtggcgagtacaggaagctatttaagaacaaatcttgcttaaccgagccgcgccgcgaccataaacacaggaacgtacggacgggagagcgcccgtatgaatgctctaaatacgggaaactgtttcatcagaagcctacccttcatatccatgaacgatttcacacaggacagaaaacatacgagtgcagcgaatgcggaaaaagctttcatcagagcagcagcctcttgcaacgccagacccttcatactcgagagaggccctatgaatgcatcgaatgcggtaaagcttttgcggagaaatcatcccttattaatcaccggaaagtccactctggagccaaacggtacgagtgcaacgaatgtggcaagagcttcgcctacacatcctctctgatcaaacatcgaagaatccatacgggagaacgtccttacgagtgtagcgagtgtggccgttcctttgccgagaattcctcgctgattaaacatctcagggtccacaccggggagagaccctacgagtgcgtcgagtgtggcaagtcttttcgaagaagctcaagcctgcttcagcatcagcgggtccatacgagagagaggccttacgaatgcagtgagtgcggaaagtctttttcactgagaagtaatctgatacaccaccaaagagtccacactggcgagagacacgagtgcgggcagtgcgggaaaagcttctcacgaaagagtagcctcattatccacttgagagtgcataccggagaacgtccgtacgaatgttccgactgtggaaaatcatttgctgagaatagtagtcttataaagcacctgcgggttcacacaggagaacgcccatatgaatgcatcgattgtggcaagagcttcaggcactctagctctttccgtcggcatcagagggtccatacagggatgagaccgtacaagtag

SEQ ID NO: 14462 - DNA, 300 bp, Artificial Sequence
  Description of Artificial Sequence: Synthetic coding sequence
atggcagctgctgccgctcttcgcgcacccgcccagtcctcagttaccttcgaagatgttgctgttaacttctctctggaagagtggtcactgctgaatgaggctcaaggatgcctttatcatgacgttatgctggaaactctgactctgatcagtagtctaaaagggtgtacaagacagcagttctgcaaccggtccactcttaataaggaagaccgggtcatctacaatttacgcaggtctcccagttgccgctttccactgcctggtactggacctcacatcctatacgtttcttag

SEQ ID NO: 14463 - DNA, 1209 bp, Artificial Sequence
  Description of Artificial Sequence: Synthetic coding sequence
atggcagcagctgctgccctgcgggctccagcgcaatcctctgtgaccttcgaagatgtggcagttaatttttctctggaagagtggtcactgctcaatgaggcccagcgttgtctgtacagagatgtcatgctggagactctcaccctgatctccagtttgggatgctggcacggaggtgaggatgaggcagcacccagtaaacaatctacgtgcattcatatttacaaagaccagggaggacactccggtgaaagaccctacgagtgcggagagtataggaagttgtttaagaacaaaagttgccttactgaaccaaggcgggatcacaagcaccgtaacgttaggacgggagagcgtccctatgagtgtagtaagtatggcaagctctttcatcagaagcccacacttcatatccacgaaaggttccacactggccagaagacctatgagtgtagcgagtgcggcaagagcttccaccaaagttcatcacttttgcaacggcagacattacacacgcgtgaacgcccgtacgagtgtatagagtgcggaaaggctttcgcagaaaaatcttctcttatcaatcacaggaaagtgcattctggcgctaagcggtacgagtgtaatgaatgcggtaagagttttgcttatacaagctcactaatcaagcacagaaggatccacacaggggagcgcccttatgagtgcagtgagtgcggaagaagtttcgcagagaacagctcgctcattaagcatttacgcgtgcacacaggcgaacggccctacgaatgtgtagaatgtggaaagagctttcgacgctccagctctttactacagcatcagagggtgcacacacgcgagaggccctatgagtgctcagaatgcggcaagtccttctctctgcgttcaaatctgatacaccatcagcgagtgcataccggtgagaggcatgaatgcggtcagtgcggcaagtcattcagtagaaaatcctcactgataatccacctgcgcgttcatacaggcgagcggccgtacgagtgctcagattgcgggaaatcgttcgcagagaattcctcgttgatcaagcatctgcgggtgcacactggagaacgcccatatgagtgtattgattgcggcaagagcttccgtcactcaagctcattcagaagacaccaaagagttcatacaggaatgcgaccatacaagtag

SEQ ID NO: 14464 - DNA, 498 bp, Artificial Sequence
  Description of Artificial Sequence: Synthetic coding sequence
atggcagccgccgcaccccgacggcctacccaagggactgttacattcgaggacgttgccgtgaaatttacacaggaggaatggaacctattgagcgaggcccagcgctgtttgtacagggatgttacccttgagaatctggctctcatgagcagcctgggttgctggtgcggggtagaagacgaagccgcgccctccaagcagtccatctacatacagcgggagactcaggttcgaaccccagtcacaggggtgagtcctaagaaggcgcacccatgcgaaatgtgcgggcccatcctcggtgatatactacacgtggcggaccatcagggtactcaccacaaacagaagttacaccgctgtgaagcatggggaaataagctctacgattccggaaacttccatcagcatcaaaacgaacatataggggaaaagccttaccgcgggtctgtggaagaagctctctttgtgaagcgcagcgggcactgtgatctgtag

SEQ ID NO: 14465 - DNA, 1728 bp, Artificial Sequence
  Description of Artificial Sequence: Synthetic coding sequence
atggctgcagcggtgccacgcagaccgactcaacagggcacggtgacgttcgaagacgtggccgtcaacttctcacaggaagagtggtgtctgctcagtgaggcccagagatgtctataccgcgacgtcatgcttgaaaacctcgccctgattagctccctggggtgctggtgtggtagtaaagatgaggaggcgccttgtaagcagaggatatctgtacagcgcgaatctcagtccagaactcccagggccggtgtgtcacccaaaaaagctcatccttgtgaaatgtgcggcctgattctagaagatgttttccattttgctgaccaccaggaaacccatcacaaacagaagttgaacaggtctggcgcctgcggcaagaacctcgacgacactgcctatcttcaccagcaccagaagcagcacatcggggaaaagttctatcgtaaatctgttcgggaggcaagctttgtgaagaagcggaaattgagagtcagccaagagccttttgtgttcagggaatttggaaaggacgtcctgcctagtagtgggctgtgccaggaggaggccgctgtggagaaaacagactcggaaaccatgcacggcccacccttccaggaagggaagacaaattactcctgcggcaaacgtaccaaggcattttctactaagcacagcgttatcccacaccagaagctcttcactagagacggatgctatgtttgttcggactgcggcaagtcattttctcgctatgtgtcatttagtaatcatcagcgcgatcacactgccaagggcccctatgactgtggagaatgtggaaagtcttatagcaggaagtcttcactcatccagcatcagagagtgcataccgggcagactgcatacccctgtgaagaatgcggtaaatcttttagtcagaagggctcccttatctcccatcagctggtccacacaggggaagggccttacgagtgtcgtgagtgcggcaaatcctttggtcagaaggggaacctgattcagcaccagcagggtcataccggagaacgcgcctaccactgcggagaatgtggaaaatcttttaggcagaagttctgttttataaatcaccaaagagtccacactggagagcgcccatataaatgcggcgagtgtggcaagagttttggacaaaagggaaatctcgtgcatcatcagaggggccacaccggagaaagaccatatgagtgcaaggaatgtgggaagtcgttccgatatagaagccacctgactgaacatcagcgccttcataccggcgagcgtccgtacaactgccgcgaatgcggtaagctgttcaatcggaaataccacctgttagtccacgagcgggtccatacgggggagcgcccttacgcttgtgaagtgtgtggaaagctctttggaaataaacactccgtgactatccaccagcgcattcacactggggagagaccatatgagtgctcagaatgtgggaagtcattcttaagtagctcagcgctgcatgtgcacaagcgcgtgcactctggccaaaagccctataaatgctccgagtgcgggaagagcttctccgagtgcagtagtttaattaagcacagacggatccacaccggcgagaggccttatgagtgcacaaaatgcgggaaaacattccaaaggtcttctacactgcttcatcaccagtctagtcaccgacggaaggcactctag

SEQ ID NO: 14466 - DNA, 1599 bp, Artificial Sequence
  Description of Artificial Sequence: Synthetic coding sequence
atgctcgagaacctggcccttatctcatctctgggctgctggtgtggctccaaagacgaagaggccccatgtaagcagcgtatctccgtccaaagagaaagtcagagtaggacccctcgggcaggagtgagcccaaaaaaagcccacccatgtgagatgtgcggcctaatcctagaagacgtgttccacttcgctgaccaccaggagacccaccacaaacagaaattgaacagatcaggggcgtgtggtaagaacctggatgacaccgcctacctgcatcaacatcaaaaacagcacatcggagaaaagttttaccggaagagcgtccgggaagcgtcttttgtgaaaaagcgcaagcttcgcgtgagccaggaaccttttgtgtttcgagaatttggaaaagacgtcctgccctcgtccgggctttgccaggaggaagctgcagttgagaagaccgacagcgaaactatgcacggccctcccttccaagaaggcaagacaaactactcctgcggtaagagaacaaaggcgttcagcaccaagcactcagtgatcccacaccaaaagttattcactcgggatggatgctatgtgtgcagcgattgcgggaaatctttttccaggtacgtttctttctccaatcaccagcgcgaccacaccgccaaaggtccttatgattgtggcgagtgtggcaaaagttacagtcggaaatccagcctcatccaacaccaacgcgtccacactgggcaaactgcttacccatgcgaagaatgtgggaagtccttcagtcagaaaggctcgctgatcagtcatcagcttgtccatacaggtgaaggcccttacgaatgccgcgagtgtggaaaatcttttggccaaaagggaaatcttatccagcatcagcagggccacaccggcgagcgggcttatcactgtggagagtgtgggaaaagctttcgccaaaaattttgtttcatcaaccatcagagagtgcataccggcgagcgaccctacaagtgcggcgagtgcgggaaatctttcggccagaagggcaatctggtgcaccatcagcgtggacacactggtgagcgcccttatgagtgcaaggaatgcgggaaaagttttagatacagaagccatcttaccgaacaccaaagactccacaccggcgagagaccttataattgtagggagtgtggcaaactgttcaatcggaaatatcacttactggtgcatgagcgggttcacacaggcgagagaccgtatgcctgcgaagtgtgcggcaagctatttggcaacaagcatagtgtgactatccatcagcggattcataccggcgagagaccttatgagtgttccgaatgtggaaagtcgttcctctctagctcggcccttcacgttcacaaacgtgttcacagtggacaaaaaccgtataagtgctctgagtgcggcaaatccttcagtgagtgttcatcccttatcaaacatcggcgcattcacacgggcgagaggccttacgagtgcacaaaatgcgggaagacgtttcaacgtagctccacactcctccaccaccagtcttcacaccgccgtaaagccctgtag

SEQ ID NO: 14467 - DNA, 1209 bp, Artificial Sequence
  Description of Artificial Sequence: Synthetic coding sequence
atggctgtggtggctactttgcgcctgtccgctcaaggaaccgtgacatttgaggatgttgctgtcaagtttactcaagaggaatggaacctgctctccgaagcccagaggtgtctgtacagagacgtgacgcttgaaaacctagccctgatgagcagcctcggatgctggtgtggtgttgaagatgaagcagccccctctaagcaaagtatctatatccagcgagagacccaggttaggacacccgtgaccggagtttcaccaaagaaggcccatccctgtgagatgtgtggacctatcttgggcgatatactgcacgtagctgatcaccaggggacacaccacaaacagaaattacaccggtgcgaggcatggggcaacaaattatatgatagcggtaacttccaccagcaccagaacgagcatatcggtgaaaaaccttaccggggttctgttgaagaggctttattcgtgaaaaggtgcaagctgcacgtatccggagagtcctccgtcttctctgagtccggcaaagactttttaccgcggagtggtctactgcagcaggaagcttctcatacaggagaaaagagcaattctaagacagaatgcgtgtcccctttccagtgcggaggagcccactattctcacggcgattccatgaagcatttttcaacaaagcacatcttgtcccagcatcagcgcctgctgccgcgggaagagtgttatgtgtgctgtgaatgcggaaagtccttcagtaaatatgtatccttcagcaatcatcaacgggtgcactcaggtaaacgcccttacgagtgcggggaatgtgagaaatcctttagccagaagtcttctctcatccagcaccaacaattccatacaggaggcaaaccctacggctgcgaagagtgtggcaaatatttttctctggaaggatatctgagacggcaccagaaggtgcacgccggcaaaggtccctatgagtgtggagaatgcgggaaaagtttcagtagtaatgtgaatcttaaatctcaccagagaatccatacgggcgagcggccctataagtgcggggagtgcgaaaagtctttttcccgcaagcctagcctttcttaccatcagcggtttggaagacccagatgggttgaccataaagacaggaaagagtttaagacaagtctcggcaacatagttaagtcatgtctgttttag

SEQ ID NO: 14468 - DNA, 1860 bp, Artificial Sequence
  Description of Artificial Sequence: Synthetic coding sequence
atggctgcagcagtgccgaggcgacctacccagcaaggcaccgtgaccttcgaagacgtcgcagtcaacttcagtcaagaggagtggtgtctcctgtccgaagcgcagagatgcctgtacagagacgtgatgttagaaaaccttgccctgatcagctctctcggatgctggtgcgggagtaaggatgaggaagctccatgtaagcagaggatctctgtacagcgagagtctcagagtcgtacgcctcgcgccggtgtgagcccgaagaaggcccacccgtgtgaaatgtgcgggctcattctggaggatgttttccactttgccgatcaccaggagacacaccacaagcaaaagttgaaccgctccggagcctgtggcaaaaacctcgatgacaccgcttacctccaccagcaccagaagcaacacatcggggaaaagttttatagaaaaagtgtcagagaggcatcattcgtcaaaaaacgcaagctcagagtttcacaagaaccattcgtctttagggagttcggtaaagacgttttaccaagctctggattgtgccaagaagaggccgccgtggagaaaacagacagcgagacaatgcatggtccaccattccaggaggggaagacaaattactcctgcgggaaacgaaccaaagcctttagtaccaagcacagtgtcatcccacaccagaagttgttcacacgcgacggctgctatgtttgttccgactgtggaaagagtttcagccggtatgtttcctttagcaaccatcagcgagaccacactgcaaaaggtccgtacgattgcggcgaatgcggtaagtcctattctcgaaagtctagtctgattcaacaccaacgggtccatactgggcaaactgcttacccatgtgaagaatgcggaaaaagctttagtcagaagggcagtctcatctcccaccaattagttcacaccggagaaggtccttatgagtgtcgagagtgcggtaaatcgtttggtcagaaagggaacttaatccaacatcagcaaggacacacgggagaacgagcatatcactgtggagagtgcggcaagtccttccgtcaaaagttctgttttatcaatcaccagagagtccacacgggagaaaggccctacaaatgcggggaatgtggcaagagctttggacagaagggcaacctcgtgcaccaccaacgtgggcatacaggcgagcggccttacgaatgcaaggaatgtgggaaaagtttcagataccggagccacctcacggagcaccagcgtctgcataccggggagcgtccatataactgtcgagaatgcgggaagctgtttaaccggaagtaccacttgctcgtgcacgaacgggttcatacaggagaaaggccctacgcatgtgaagtctgcggtaagctatttggcaataagcattccgttactatccaccagcgtatccatacgggggaacgtccctacgagtgctcggagtgcgggaagtctttcctgagttctagcgcactgcatgtgcacaaacgggttcactctggccagaagccttacaagtgttcggagtgcgggaaatctttcagcgagtgttcttcacttataaagcatagacggatccacaccggggagcggccttacgagtgtaccaagtgcggtaaaacttttcagcgctcgtctaccttgctccatcaccgggttcacaccggagagcgaccatacgaatgttcagagtacggtaagagttttgccgaggcgagcaggctcgtgaagcacaggcgtgtacataccggcgagaggccttatgagtgttgtcagtgtgggaaacatcagaacgtctgttgtccgcgcagctag

SEQ ID NO: 14469 - DNA, 1269 bp, Artificial Sequence
  Description of Artificial Sequence: Synthetic coding sequence
atgatcgattttcaaatgctaaatcagctttgtaggactattatcaatccttccgtgattccttgcctcaagtactgtggtgaccagatcggccccgtaactttcgaggacgtcgcagtgttgttcactgaggctgaatggaagcgcttatcactggagcagagaaacctttacaaagaggtgatgctcgagaatcttcgcaacctggtctcactagaatccaagcccgaggttcacacttgtccatcctgtccgttggcctttggaagtcaacagtttctctcccaggacgaactgcataatcaccccatccccggctttcatgccggcaatcagctccatcctggcaatccgtgtccggaagaccagccccagagccaacatcccagtgacaagaatcatcgaggcgctgaagcggaagaccagcgagtggagggaggggtgcggcctctgttttggtcaaccaacgagcggggcgcgctcgtcggattctccagcctctttcagagaccacccattagtagttgggggggtaatcgcattctggaaattcagctcagcccagctcagaatgcatcgtcggaggaagtcgacagaatatccaagcgtgcagagactcctggctttggggcagtgacatttggagagtgcgccctcgctttcaatcagaaatcgaatctgttccgccagaaagccgtgaccgcagaaaaaagtagtgacaaaaggcagagccaggtctgccgggagtgcggtagaggttttagccgcaagtcacaactgatcattcaccagcgtacacatacaggagagaagccatacgtctgcggggagtgcggacggggcttcatagttgagtccgttctgaggaatcatctgtctacccacagtggagagaagccatacgtatgctcgcattgtggaaggggcttttcttgtaaaccttacctgataaggcaccagcggacccacaccagggagaagtccttcatgtgcactgtatgcggaaggggctttcgtgagaaatcagagctgatcaagcaccaacagaggtgtcaggtgactgttccacttgaggagtggtctctgcacctgaccacttccttttgcaattgcgtgttgccattggcttccatgaccttgtcctgtttcatattcttttacattagctccctttgctgctttctgtcgtatccaacgttcaggttctactccgaattttcactgcagccttacaacctgcgggacacctttactcgcagcccgtcttag

SEQ ID NO: 14470 - DNA, 1095 bp, Artificial Sequence
  Description of Artificial Sequence: Synthetic coding sequence
atgtgggcacctagagaacagctgctgggatggaccgccgaggcactgcctgctaaagattctgcctggccatgggaggagaaaccaagatacctaggaccagtcacgttcgaagacgtcgccgttctatttactgaagccgagtggaaaagattgtcgctcgaacaacgcaacctttacaaagaagtcatgttagagaacctgcgcaatctggtctccctcgcggaatcaaaacccgaagtgcacacatgccccagctgtccattagcattcggtagccaacagtttctgagtcaggacgagctccataatcaccccattccaggcttccacgcaggtaatcaacttcatcccggtaatccttgccccgaggaccagcctcagtcccagcatccttctgacaagaaccatcgaggtgcggaggccgaagatcagcgagtagaggggggggttcggccattgttctggtccaccaatgagaggggggcactggtcggatttagctctctcttccaacgcccgcctatctcctcatgggggggaaataggatacttgagattcaattaagcccagcacagaacgctagctccgaggaggtggatagaatctcaaaacgggccgagacccctggctttggtgcagttacctttggggagtgcgccctggccttcaaccagaagagtaacctgtttaggcaaaaggctgtgactgcagagaagtcctccgacaagagacaatcgcaggtgtgcagagaatgcggacgcggcttttccagaaagtctcagctgattattcaccagaggacccacacaggagagaaaccatatgtgtgcggggaatgcggtcgggggttcatcgtggagagtgtgctgaggaaccatctgtccacccactccggtgaaaaaccttatgtttgcagccactgcggtcgggggttctcttgtaaaccttacctgatcagacatcagaggacgcacaccagggagaagtctttcatgtgtaccgtttgcggccggggattccgagagaaatcagaactgatcaagcatcagagaatccacactggcgacaagccttacgtatgccgagactag

SEQ ID NO: 14471 - DNA, 534 bp, Artificial Sequence
  Description of Artificial Sequence: Synthetic coding sequence
atgtgggcacctcgtgaacagctgttgggctggaccgccgaggcactgccagcaaaggacagtgcatggccgtgggaggagaagccacgctacctggggccagtgactttcgaggatgtggctgtgctgtttacagaggccgaatggaaacgcctgagcctggagcagcggaacctatataaggaggtgatgctggagaacttaagaaacctcgttagcctggagtcgaaacctgaggtccacacttgcccatcttgtccactcgccttcggatcccagcagttcctgagccaggacgaacttcataaccatcccatacccggcttccacgccggtaatcaattgcacccagggaatccttgtccagaggatcagccacagagccagcacccaagtgataagaatcatcgtggtgcagaggctgaagatcagagagtggagggtggtgttaggcctttgttttggatactcgagttagggagcccacgaagtggactgcttcccctggatctgaacttagatctgtggctatag

SEQ ID NO: 14472 - DNA, 1095 bp, Artificial Sequence
  Description of Artificial Sequence: Synthetic coding sequence
atgtgggcgcctcgcgagcaactgctgggctggaccgccgaagccttaccagccaaggactccgcctggccatgggaggagaaacctagatacttgggcccagttactttcgaagatgttgccgtcctgttcactgaagcggagtggaagcgcctgtcattagagcaacgcaacctttacaaggaggttatgctagaaaacttgagaaaccttgtgtctctggccgagagcaagcctgaggtccacacctgcccctcctgcccactcgcgttcggcagccagcaattcctgtcacaggatgaacttcacaatcatcccatccctggatttcatgcgggaaaccaattgcatcctggcaacccgtgccctgaagaccagccacagtcacaacacccctccgacaagaaccatagaggggcagaggcagaggaccagagagtggaggggggagtgcgacccctgttctggtcaacgaatgagcggggggctttggtaggtttctcctcactttttcaaagaccaccaattagtagttggggtggcaatagaatcctcgagattcagctcagccctgcccagaatgctagtagtgaggaggtagatcggatctctaagagggcagagacgcctggctttggggctgtgacttttggagagtgcgctctggccttcaaccagaagtctaacctcttcagacagaaggcagttaccgcagagaagagttctgacaaacgtcaatctcaagtttgtagggagtgtggcagagggtttagtcggaaaagccaactgatcattcatcagcggacgcatactggcgagaaaccatatgtgtgtggtgaatgcggccgcggatttatagtcgaaagcgtcttaaggaatcacctttctacacactcaggtgagaagccatacgtgtgtagccattgtggcagagggttttcctgtaagccgtacctcatcagacatcagagaacacacacaagagagaaaagttttatgtgcactgtgtgcggtcgcggcttccgggagaaaagtgagctgattaagcatcagagaatccacactggcgacaagccatatgtgtgccgcgattag

SEQ ID NO: 14473 - DNA, 471 bp, Artificial Sequence
  Description of Artificial Sequence: Synthetic coding sequence
atgggtcggtcacgacgtaccggggcgcacagagcacacagtttagcccgccagatgaaagcaaaacgtcgaagacccgacctggatgagattcacagagaacttcggcctcagggctccgcaagaccacagccggacccaaatgccgagttcgacccagacctgccaggcggcggcctacacagatgtctggcatgcgctagatactttattgactcaaccaaccttaaaacacacttcagatctaaagaccacaagaagcggtacgagggggtcagaagaggcctgatggatggctgctccgcagatcgggcgttaacctggagtgcgcccaatagttgtttcagcttttctcaggccgaagccgctgaacgaagagccctgcagtctgggagaggtggcgagggatctggctatggcattctctgcgcaccccaggctgccggcagcgcccatgggtcagtccactag

SEQ ID NO: 14474 - DNA, 405 bp, Artificial Sequence
  Description of Artificial Sequence: Synthetic coding sequence
atgggtcggagccgaaggacaggcgctcatcgcgcccactcgctggctcgtcaaatgaaagcgaaacgaaggaggcctgatttggatgagatacatcgtgagctgcgaccccagggtagcgcacgcccacagccagaccccaacgccgaatttgacccagatctgcctgggggtggacttcatcggtgcttagcctgcgcccgttactttattgattctactaacctgaagacccattttaggagcaaagaccataagaaaaggctgaaacaactctccgtagaaccttatagccaggaagaagccgagcgggcagcaggcatgggatcctacgtgccccctcgtcgattggctgtgccaacagaagtgagcacggaggtgccggagatggatacttcaacctag

SEQ ID NO: 14475 - DNA, 996 bp, Artificial Sequence
  Description of Artificial Sequence: Synthetic coding sequence
atgaacgtcaaaaacgtggggaaacttaatcaaagcagcgacctgctgcgtcaccaccgcattcactccggggaaaaaccttatgtttgtaacaagtgtggagagtcatttcgctcctcctcagaccttatcaaacaccaccgcgtacacactggagagaagccacacgagtgctccgagtgcggcaaagtttttagtcaacgctcacatctggtaactcatcaaaaaatccacaccggtgaaaaaccttaccagtgtacagagtgtgagaaagcctttcggagacggagcttgttaattcagcgtagacggatccacagcggcgaaaaaccatacgagtgtaaggagtgcgggaagctgtttatgtggcatacagctttccttaagcaccagcgcctgcacgcaggggaaaagcttgaagaacgggagaagaccttctctaaagacgaggaactgcggggagagcagaaaatacaccaggaagagaaagcctactggtgcaaccagtgtggacgtgctttccaaggtagttctgacctcattggacaccaagtgacacataccggagagaagccctatgaatgtaaggagtgcggaaaaactttcaaccagtcttccgacttgctcaggcatcaccgaatacacagcggagaaaagccgtacgtgtgcaataaatgtggaaaatcctttcgcggttcttcagacctgatcagacaccaccgcgtccataccggtgaaaaaccctatgagtgtcccgagtgctggaaagctttcagtcaaaattctcatctcgtttcgcaccaaaggattcatacaagggaaaagccattcgaatgttcaaactgtggcaaagccttttctggctggacagcctttttgaagcaccagaagctgcacatcggcaaggagtttgaggactgtaaaagcctccaaaccggtccaatcctgatcggctctagaaatctgatgaatgcagtcaaacttggaaaagtctag

SEQ ID NO: 14476 - DNA, 918 bp, Artificial Sequence
  Description of Artificial Sequence: Synthetic coding sequence
atgaacgtaaaaaacgttggaaagaaccagtcatcagacctcctgagacaccatcgtatccatagcggcgaaaaaccttgtgtttgcagtaaatgcggtaagtcatttcgcggcagctccgatctcattagacatcaccgcgtgcacacgggggaaaagccatacgaatgcagcgagtgtggaaaggcctttagccagcgctctcatctggttacccaccaaaagatccacaccggggagaagccctatcaatgcactgagtgtggaaaagcctttcgacgcaggtcattactaatacagcacagacgcatacattctggcgagaagccctatgagtgcaaagagtgtggaaagttattcatctggaggaccgcctttctgaagcaccagtcactgcacactggagagaaattagagtgtgaaaagacattttctcaggacgaagagttacggggcgagcagaaaatccaccaggaagcaaaagcttactggtgcaatcaatgtggacgcgctttccaaggatcttccgacctgattaggcaccaggtgacgcacactcgcgaaaaaccgtatgagtgtaaggagtgtggtaagacattcaaccagagctctgatctgctaaggcaccaccggatccactctggcgagaagccgtacgtctgcaataaatgcggcaagtcttttcgggggagctccgacctgattaagcatcatcgcattcatacaggcgagaagccatatgagtgcagtgagtgtggaaaggctttcagccagagaagccatctggccacccaccagaagatccatacgggggagaaaccttaccaatgtatggaatgcggaaagctgtttatgtggcacacagcttttctcaagcaccagagactccacgcaggcgaaaagttggaggagtgctag

SEQ ID NO: 14477 - DNA, 2424 bp, Artificial Sequence
  Description of Artificial Sequence: Synthetic coding sequence
atgaaggagtggaagtctaaaatggagatctctgaagaaaagaaaagcgctcgagccgcctcggagaagctccaacgtcaaatcactcaggagtgcgagctggtggagacatccaacagcgaagatagattgttgaaacactgggtttctcctctgaaggacgccatgcggcacctgccctcgcaggaaagtgggatccgtgagatgcacattatcccccagaaagctattgtcggtgagatcggtcacggctgcaatgagggtgagaaaatcctgagcgccggcgagagctcacaccggtacgaagtgtcaggtcagaactttaaacagaaatccggcctgaccgagcaccaaaagatccacaacattaacaagacgtacgagtgtaaagagtgtgaaaaaaccttcaaccggtcgagcaatctaattatccaccaaagaatccataccggcaataagccgtatgtatgtaacgaatgcgggaaggattccaatcagagcagtaatctaattattcaccagcggatacacacgggcaagaagccctacatctgtcacgagtgcggtaaagacttcaatcaatcatctaatctcgtgcggcataagcagatccacagcggcggaaatccatatgagtgcaaagaatgcggcaaagcttttaaaggaagttctaatctggtgctccaccagcgaatccattcccgcggcaagccctatctgtgcaacaaatgtgggaaagcctttagtcagtcgaccgacctgattatccaccaccgtattcatacaggcgagaagccctacgaatgctacgattgcggccagatgttttcccagtcttcgcacctggtaccccaccagcgcatccacaccggagagaagccgctaaaatgcaatgagtgtgagaaagccttccgtcagcactctcatcttacagaacatcagcgattacactccggtgagaaaccgtacgaatgccaccggtgtgggaaaacattttccggaaggactgcttttctgaaacatcagagactgcatgcaggcgaaaaaatagaagaatgtgaaaagacattttctaaggacgaagagttacgcgaagagcagcgaattcatcaggaagagaaggcatactggtgcaatcaatgtggacggaatttccagggtacaagcgatctaattcggcatcaagtgacccatacgggagaaaaaccatatgaatgtaaggaatgcggcaagaccttcaaccagtcgtccgacctcctgaggcatcatcgcatacacagcggggagaagccctgcgtgtgtagcaagtgcggcaaatcctttaggggtagttcagacttaatccgacaccacagagttcacactggtgagaagccatatgaatgcagcgagtgcgggaaggcgttcagccagagatcacacctggtaacccaccagaagatccacaccggcgagaagccataccagtgtactgaatgcgggaaggctttccggagacggtctcttctcattcagcaccgccgaatccacagtggagaaaagccttatgaatgtaaagagtgtgggaagctgttcatttggagaactgcctttctgaaacatcaaagcctgcataccggggaaaagctggaatgcgagaagaccttttcccaggatgaggagctcaggggagaacaaaagatccaccaggaggccaaagcgtattggtgtaaccagtgcggtcgggccttccaagggtcatctgatctaattcggcaccaggtgacccatacccgagagaaaccctacgaatgcaaagagtgcggaaagactttcaatcagtccagcgacttgctcagacatcatcgcatacactctggcgaaaaaccttacgtatgcaataagtgtggcaaatcatttcggggctcttccgatctaattaagcaccatcgcattcacaccggagaaaagccctacgagtgctccgaatgtggcaaagctttttctcaacgctctcacctagccacccatcagaaaatccacacaggggagaagccatatcaatgcagcgagtgcggcaacgctttcaggagaagatcattgctcatccagcaccggaggcttcacagtggtgagaaaccctacgagtgcaaggagtgtgggaagctgttcatgtggcacaccgcctttttgaaacaccagcgtttacacgcaggcgagaagcttgaggaatgtgagaaaacttttagtaaggacgaagaactgaggaaagaacagcggacacaccaggaaaagaaggtgtactggtgcaatcagtgttccaggacattccaggggtcttctgaccttatccgccatcaggttacacacactagagagaaaccatacgaatgcaaggagtgcggaaagacacagtccgaactgcggcccagcgagacctcctag

SEQ ID NO: 14478 - DNA, 1515 bp, Artificial Sequence
  Description of Artificial Sequence: Synthetic coding sequence
atgccctcgcccgatagtatgacattcgaggacattatcgttgattttactcaggaagagtgggccctcctggacaccagccagaggaaactttttcaggatgtgatgctcgagaatatatcgcatctcgtctcgattggaaagcagctgtgcaaaagtgttgtcttgtcgcagctggagcaggtggaaaagttgagcacacagaggatctcacttttgcagggccgcgaggtggggataaagcatcaggagataccgttcattcagcatatttatcagaaggggacatccactatctctacaatgcggtcacacactcaggaagatccatttctttgcaatgatctaggcgaagacttcacacagcatatcgcgctaacccagaatgtgatcacttacatgcggacaaagcactttgtgtcgaaaaagttcggtaagatcttttcagattggctctcttttaaccagcacaaggaaatccacaccaaatgcaaatcgtatggatcccacttatttgactacgcttttatacagaattccgcattgaggcctcattccgtgacccatacccgagaaataacccttgaatgccgcgtctgcggaaagaccttcagcaagaattcgaatctgcgtcggcacgaaatgattcataccggggaaaagccccatggctgtcatctttgtgggaaggcatttacgcactgcagtgacctgaggaagcatgaaaggacgcataccggcgaaaagccatatggctgtcatctctgcggaaaggcgttctctaagtccagcaaccttcgccgccacgagatgatacacacccgagaaaaggctcagatttgtcatttgtgcgggaaagccttcacacattgttctgatctgcggaaacatgagcgcactcatctcggagataagccgtacggatgtctgttgtgcggtaaagcatttagtaagtgttcttatctgcggcagcatgaaagaacccataacggcgagaagccctacgaatgtcatctctgtggaaaagcctttagccactgttcacatctgaggcagcacgaacggagccataacggagaaaaaccacatgggtgtcatctatgtgggaaggccttcaccgaatcttctgtcttgaaacggcacgagagaatacatacaggcgagaagccttatgagtgtcacgtgtgcggcaaggccttcacagaatcttccgatctgcgccgtcatgaacgtacccacaccggagagaagccttatgagtgtcacctttgcggaaaggctttcaaccattcctctgtcctgcgtaggcacgaacgcactcacactggcgagaagccatatgagtgcaacatttgtggcaaagctttcaatcggagctacaattttagacttcacagacgggtacacaccggggagaaaccgtatgtgtgtccactgtgcggtaaggctttctcaaagttcttcaatttgaggcagcacgaacgaacgcataccaaaaaagccatgaacatgtag

SEQ ID NO: 14479 - DNA, 1305 bp, Artificial Sequence
  Description of Artificial Sequence: Synthetic coding sequence
atgccttcaccggactccatgacattcgaagatattatcgtcgattttacccaggaggagtgggcactactggatacttctcaacggaagctgttccaggacgtgatgttagaaaatattagtcacctagtcagcattggcgaggacttcacacagcacattgctcttacccaaaacgttatcacatatatgagaaccaaacactttgtgtccaaaaagtttggtaagatcttctccgactggttgtcttttaaccagcacaaggaaatacacacaaagtgcaaaagctacgggtctcacttatttgactatgcgtttattcagaatagtgccctcagaccccacagcgtgacgcacacacgagagattacgcttgagtgccgggtgtgtggcaagacgttctccaagaactctaatctgcggcgccacgagatgattcacaccggggagaaaccgcacggctgtcatctgtgcgggaaggccttcacacactgttcagatctgcgtaagcacgaacgaacccacactggagaaaagccgtatggatgtcacctctgcgggaaggccttctcaaagagctccaatctgcggcggcacgagatgatacacacacgagaaaaggctcagatctgtcatctgtgcggaaaagcctttacacactgtagtgatctgaggaagcatgaacgcacacacctgggggacaaaccatacggatgcttgctgtgtggtaaagctttctctaaatgctcctaccttcggcagcacgaacggactcacaatggggagaagccctacgaatgtcacctgtgtggaaaggctttcagccattgtagccacctgcgacagcatgagaggagtcacaacggcgagaaaccccacggctgccacctctgtgggaaggctttcacagagagtagtgtcctcaagcgtcatgagcggatccatactggagaaaagccttacgagtgtcacgtttgcgggaaggcatttaccgagagtagcgacttaaggcgacacgaaaggacacataccggggagaagccgtacgaatgtcacctgtgcggtaaggccttcaatcacagttccgtgctcaggagacacgaacgaacacatactggagaaaagccctacgaatgcaacatatgtggtaaggcatttaaccgctcatacaacttccggctccaccgtagggtgcataccggtgaaaaaccctacgtttgtccgctgtgtggtaaggccttttctaagttctttaatttacggcagcatgaaagaacccataccaagaaggccatgaacatgtag

SEQ ID NO: 14480 - DNA, 1515 bp, Artificial Sequence
  Description of Artificial Sequence: Synthetic coding sequence
atgcccagcccggattcaatgaccttcgaagatattattgtagatttcacgcaggaggaatgggccctgttggacactagccagcgaaagctcttccaggacgtcatgctggagaatatttctcatctcgttagcatcggcaaacaactctgcaagtcagtagtgctatcacaacttgagcaggtggagaaactctctacccagcggataagtttattacagggacgtgaggtgggtatcaaacatcaggaaatcccttttatacaacatatttaccagaaggggacaagcactattagtaccatgaggagccacacccaggaggatccattcctgtgcaacgacttaggcgaagacttcacacagcatatagccctgacgcagaacgttattacatacatgaggacaaaacacttcgtgtcaaaaaagttcggaaagatctttagtgactggctctctttcaaccagcataaggagattcacacaaagtgcaagtcttacgggtcgcaccttttcgactacgcctttattcaaaactcggctcttcggccccacagcgtaactcatacacgtgagattacactcgagtgcagggtgtgcgggaaaaccttcagtaaaaacagcaatctgaggagacatgagatgattcacacgggtgagaaaccacacggttgccacctgtgtggaaaggccttcacccattgctccgatctgcggaagcacgagagaacgcacactggagaaaaaccttatggttgccatctgtgtggtaaagccttcagtaagtcgagtaatttgagaagacatgagatgatccatacacgggagaaggcacagatttgccacctgtgtggaaaagcatttacccactgctcagatctccgcaagcacgagcgaacgcacctcggagacaaaccctacgggtgcctgctgtgtgggaaggccttttctaagtgtagctacctccggcaacatgagaggacacacaacggagagaaaccctatgaatgtcatctttgcgggaaagcattttcccattgctcccacctccgacagcacgagcggtcccacaacggcgagaagccgcatggatgccatctgtgtggcaaggcgttcaccgagagttctgtccttaaacggcatgagcgtatacacacgggcgaaaaaccttatgaatgccatgtgtgtggaaaggccttcaccgaatcgtctgacctcaggcggcacgaaaggacacatactggggaaaaaccgtatgagtgtcatttgtgcggaaaggctttcaaccactccagtgtcctgcgtagacatgagcgaacacacacgggggagaagccctatgaatgtaatatttgcggaaaagctttcaatcgctcctacaactttcgtttgcacagaagggttcatacaggggaaaagccatacgtgtgccctctgtgtgggaaggccttttcaaaattcttcaacttgaggcaacatgagcggacccataccaaaaaagccatgaacatgtag

SEQ ID NO: 14481 - DNA, 1275 bp, Artificial Sequence
  Description of Artificial Sequence: Synthetic coding sequence
atggcctctatgcctcctacgccggaggctcaggggcctattctcttcgaggatcttgccgtatatttctcccaagaagaatgtgtgaccctgcaccctgcccagagatctctctcgaaggatggaacaaaggaatcattggaggacgccgcgctgatgggagaggagggtaagcccgagatcaaccaacagttatctctggaatccatggaattagacgagctagccctggaaaagtatcctattgcggctcccctggtcccttatcccgagaagtccagtgaggacggggtgggaaaccccgaggcgaaaatcctgtcagggacacctacctacaaacgcagggtaattagcctcctcgttacaatcgagaaccatacccccttggtcgaactgtctgagtatctaggaaccaacacactcagcgagattctggatagtccctgggaaggtgccaagaatgtctataagtgtcccgagtgtgaccaaaatttcagcgaccatagctacctcgtcctgcatcaaaagattcactcgggggaaaagaaacataaatgtggtgactgcgggaaaatcttcaatcaccgagctaacctcagaacccatcgccgaatccacaccggcgagaagccctacaagtgcgctaaatgctccgcctcttttcgccaacactcccacctgtccagacatatgaactcacatgtgaaagagaagccctacacatgcagcatatgcgggaggggctttatgtggttgcctggcctggcacaacatcagaaaagccacagcgccgaaaatacctatgaaagcaccaactgcgataagcatttcaatgagaagcccaatttggctctgcctgaggaaacatttgtgtcagggccgcaataccagcacacaaaatgcatgaaatccttccggcagagcttgtatccagcactgagcgagaagagccatgatgaggattccgagcggtgtagcgatgatggcgataactttttctcctttagtaaatttaagcccctgcagtgccccgactgcgatatgactttcccctgtttctctgagcttatcagccaccagaacatccacaccgaggagaggccccataagtgtaaaacatgtgaggaaagtttcgcgctggactccgagctcgcttgccaccagaaaagtcacatgttagcagaaccatttaaatgcacagtgtgtgggaagactttcaaaagcaatcttcacttgatcactcacaagcggacacacatcaagaatactacctag

SEQ ID NO: 14482 - DNA, 1767 bp, Artificial Sequence
  Description of Artificial Sequence: Synthetic coding sequence
atggccgctcccgctctggcattagtcagctttgaagacgttgtggtaactttcaccggggaagaatggggccatctggatctagcacagaggacactgtatcaagaagttatgctagagacgtgtagactgctcgtttccctgggccaccccgtgcccaagcctgaacttatctacctgcttgagcatgggcaagaactatggacagtgaaacgagggctgtcccaaagtacctgtgccggagagaaggcaaagcctaaaatcaccgaacccactgcctcccagcttgcgttttcagaagagtcgtccttccaggagctcttggcacagcggtcatcacgggattcacggctgggacaggcacgcgatgaagagaaactgatcaaaatacaggaaggcaatctcagacccgggaccaacccacataaggagatttgtcccgaaaagctcagctataagcatgatgacttggagcccgacgactctctcggcttgagggtgctccaggagcgggtgaccccccaggatgctctgcatgagtgcgactcccaggggccggggaaagatcctatgacggatgctagaaataacccatacacctgcaccgagtgcggcaagggatttagtaagaaatgggcgttagtgaggcaccagcagattcatgcgggagtaaagccctacgagtgcaacgaatgcggtaaggcctgtcgttacatggccgacgtaatcaggcacatgaggcttcacaccggcgagaagccgtacaaatgcatcgaatgcggaaaagcctttaagcggaggttccacctcaccgagcaccaaagaatccatacaggagacaagccgtatgagtgcaaggagtgtggtaaagccttcactcaccgatcctcattcatccagcataatatgacgcacacaagggaaaagccatttctctgcaaggaatgtggcaaagccttttattattccagcagcttcgcacaacacatgagaatccacaccggcaagaaactgtacgagtgtggagaatgtggcaaggcattcacccatagaagtacatttattcaacataacgttacgcataccggggagaagccgttcctgtgcaaggagtgcgggaagacattctgccttaattccagttttacacaacatatgcgaatacacaccggtgagaagccatacgagtgtggtgaatgcggcaaagcttttacccacagatcgacatttatccgacataagaggacacatactggcgagaaaccattcgaatgtaaggagtgcggaaaggccttttgcgattcatcaagcctcatccagcatatgagaattcataccggcgaaaagccctatgaatgcagcgaatgcggaaaggcttttacccaccattccgtgttcattcgtcataatagaactcacagcggccaaaagcctctggaatgcaaagaatgtgctaaggcgttttactattcctccagtttcacacggcatatgagaatccacaccggcgagaaaccttacgtgtgccgcgagtgtggcaaagcgtttactcagcctgctaattttgttagacataatcgaatccacaccggcgaaaaaccttttgagtgtaaggaatgtgaaaaggcattttgtgacaatttcgccctgacgcaacatatgaggacccatacgggcgaaaagccttttgaatgtaatgagtgcggcaagaccttcagccatagtagttccttcactcaccaccggaaaatccacactagagtctag

SEQ ID NO: 14483 - DNA, 270 bp, Artificial Sequence
  Description of Artificial Sequence: Synthetic coding sequence
gcactggtatcgttcgaggatgtcgttgtgacctttactggcgaggaatggggacatcttgacctcgcccagcgtacactatatcaggaggtgatgttagaaacctgtagattgcttgttagtctgggacaccctgttcccaaaccagaattgatttatctgctggaacatggccaggagctctggactgttaagagaggactgtcacagagcacttgtgcagcctcattcagtctgctctggaagagctaccacccaggacatggttag

SEQ ID NO: 14484 - DNA, 927 bp, Artificial Sequence
  Description of Artificial Sequence: Synthetic coding sequence
tatacctgtacagaatgtgggaaaggcttcagcaagaagtgggccctggtgagacatcagcaaatccacgccggtgtaaagccctacgaatgcaatgagtgtggcaaggcttgtaggtatatggccgacgtaatccggcatatgcggctccacacaggtgagaagccgtacaagtgcattgaatgcgggaaggcctttaaaaggagattccacctgaccgagcatcagcggatccatactggcgacaaaccctatgagtgtaaggaatgtgggaaggcgttcacgcatcgttccagcttcgctcaacacatgcggatccacacgggcaagaaactctatgaatgtggggaatgcggcaaagcattcacacatcgctcgaccttcatacagcataatgtgacccataccggggaaaagcccttcctttgtaaggagtgtgggaaaacattctgcttgaactcctctttcacccaacacatgcgtattcatacaggtgagaagccttatgagtgcggggagtgtggcaaggcatttacgcatagatcaaccttcatcaggcacaaacgcacacacacaggagaaaagcccttcgagtgcaaggaatgtggcaaggccttctgcgattcctctagcctcatccagcatatgcgaattcataccggagagaaaccatacgagtgttctgaatgcggaaaggctttcacacaccattccgttttcattagacataaccggacacactccggacagaaacccctggagtgtaaagaatgtgcaaaggctttctactatagttcttctttcacccgccatatgcgaattcacactggagagaaaccttacgtttgcagagagtgcgggaaggccttcacgcaacccgctaactttgtgagacataatcgcatacatacaggcgaaaaaccttag

SEQ ID NO: 14485 - DNA, 1764 bp, Artificial Sequence
  Description of Artificial Sequence: Synthetic coding sequence
aaggctcctgccagtgcccttgtgtccttcgaggacgtcgtggtcaccttcacaggcgaggaatggggtcatctggatttggcgcagcgcaccctctaccaggaagtcatgttagagacttgtaggcttctagtgagcctgggacacccagtaccgaagccagagctcatctatctgctcgagcatgggcaagaactctggactgttaagaggggtctgtcccaatccacatgcgccggggagaaagccaagcccaagattactgaacctaccgctagccagcttgccttctcagaagaatcctcattccaagagttgttagcccaacggagtagccgcgactctcggcttggacaggcgagagacgaagaaaagctcatcaaaatacaagaaggcaacctgagaccgggcactaaccctcacaaggagatatgtcccgagaaattgtcatacaagcacgacgaccttgaaccagatgactcgctggggctgcgtgtcctgcaagagcgcgtcactccccaggatgccctgcatgagtgcgattcacagggcccagggaaggacccgatgaccgatgcgaggaacaacccgtatacatgcacagagtgcggaaaaggcttcagtaagaagtgggccctggtgaggcatcagcaaattcatgccggagtcaagccctacgaatgtaatgagtgtggtaaagcgtgtcgctatatggcagacgtgattcgacacatgcgacttcataccggggagaagccctataaatgcattgagtgcgggaaggcattcaaacggagattccacctcacagagcaccagcgcatacatactggggataaaccttatgagtgcaaggagtgcggtaaggcatttacccacagatccagttttatccaacacaatatgacccacactagggaaaagccctttctgtgcaaggagtgtggaaaggccttttattattcttcctcattcgcccaacacatgcggattcacactgggaagaagctatacgagtgcggagagtgcgggaaagcatttactcataggtctacatttatccaacataacgtgactcataccggcgagaagccattcttgtgcaaagaatgtgggaaaaccttctgcctgaacagcagcttcacccagcacatgcgcatacacacaggcgaaaagccctatgaatgcggggagtgtggcaaggcttttactcacaggtccacgttcattcgtcataaacgtacacacaccggcgagaaaccctttgagtgtaaagaatgtgggaaagccttttgcgatagctcttcactcattcagcacatgcggatccacactggcgagaagccctatgaatgctccgagtgtggtaaggcctttacacatcatagcgtctttatacgacataatcgcacccactccggtcaaaaaccgctggaatgtaaagagtgcgctaaggctttctactacagttccagcttcactcgccacatgcgtatccatacaggagaaaaaccatatgtgtgtagggagtgcgggaaggcattcacgcagcccgcaaattttgttcgccataataggatccatacgggcgagaaacccttcgagtgtaaggaatgcgaaaaggcattttgtgacaattttgccttaacccagcacatgcggacacacaccggagagaagcctttcgaatgtaacgaatgtgggaagaccttttctcactccagcagcttcactcaccatcgcaagattcatacaagagtgtag

SEQ ID NO: 14486 - DNA, 2169 bp, Artificial Sequence
  Description of Artificial Sequence: Synthetic coding sequence
atgatgaaggaagttctcagcactggccagggcaatacagaggtaattcacaccggtactctacagagatatcagagttatcacatcggagacttttgtttccaggaaattgaaaaagaaatccatgacattgaattccagtgtcaggaagacgagagaaacggccacgaggcgcctatgacaaaaatcaagaaactgaccggttccaccgatcagcacgaccatcggcatgctggcaacaagccgatcaaagaccaattagggtcctctttctactcccatctgcccgaattgcatatcattcaaatcaaagggaagatcggaaaccaattcgagaagtctacatcagacgcaccctctgtttccacatcacagagaattagccccagaccccagatccacatatctaacaattacgggaataattctcctaactcgtctcttctcccccagaaacaggaggtgtacatgagagagaaaagtttccagtgtaacgagtccggaaaagcttttaattgcagttctctgttacgcaagcaccagatcccacacctaggcgataaacagtacaagtgtgatgtttgcggaaagctgttcaatcataaacaatacttaacgtgtcattgccggtgccataccggggaaaaaccgtacaagtgtaatgagtgcggcaaatcctttagtcaggtgagtagcctgacctgccataggcgacttcatacagccgttaagtcccacaagtgcaacgagtgcggtaaaatcttcggtcagaatagcgcactggtgatacacaaagccatccatacaggcgagaagccttataaatgtaatgagtgcgacaaagctttcaatcaacaatcaaacctggctcgccaccgccgtatccacacaggagagaaaccttacaaatgcgaggaatgcgacaaggtattctctcgaaagagtacattagaaagccacaagcgaatacatacaggcgagaagccctacaaatgcaaggtttgcgacacggcgttcacgtggaatagtcagcttgctcggcataaacggattcatacgggtgagaaaacttacaagtgcaacgagtgtggcaagactttctcccacaagtcttccctggtgtgccaccaccgactacacggtggcgaaaagtcgtacaaatgtaaggtatgcgacaaggcattcgcctggaactctcacctggtgcgccacacccggattcattcaggcggaaaaccctacaagtgtaacgagtgtggcaaaacatttggccagaattctgacctgttgatccacaagagcatacacactggtgagcaaccatacaaatatgaagaatgtgaaaaagtcttcagctgtggctcaacgctggagacacacaaaattatacacaccggggagaagccatacaagtgtaaggtgtgcgataaggcattcgcttgtcacagctacttggcaaagcatactagaatccactccggtgagaaaccctataagtgtaacgagtgtagtaagacttttaggctgcgctcttacttagcgtcccaccgcagggtccattccggcgagaaaccctacaagtgcaacgagtgctctaaaaccttctcccagcgaagttacctgcattgccatcggcggcttcatagtggggaaaagccttacaagtgcaatgaatgcgggaagactttctcccacaagccatcgttggttcaccacagacggctgcacactggggaaaagtcttataaatgtacagtgtgcgacaaggccttcgtcaggaacagctatttggcacggcacactaggatccacacagctgagaagccgtacaaatgcaacgagtgcgggaaagcattcaatcaacagagccagttgtccctgcaccatcggatccacgcgggcgaaaagttatataaatgtgagacctgcgacaaggtgttttcccgtaagtctcacttaaaaaggcaccggagaatccatcccggaaagaaaccctacaagtgtaaagtgtgcgataagacattcgggagcgattcgcacctaaaacaacatacgggcttacatacaggggagaaaccctacaaatgcaacgagtgtggcaaagcctttagcaagcagtctacactgatccaccatcaggctgtccatggcgtgggaaaactggattag

SEQ ID NO: 14487 - DNA, 1926 bp, Artificial Sequence
  Description of Artificial Sequence: Synthetic coding sequence
atgatccagagtcagatctctttcgaggacgtggcagtggatttcacactggaggaatggcagttattaaatcccacccagaaaaacctctatcgagatgtcatgctcgagaactatagcaatttggtctttctagaggtttggctggacaaccctaaaatgtggctcagggataatcaggacaatctgaagagcatggagcgtggacataagtatgatgtgttcggaaagatttttaactcatctatcaatattgtgcacgtgggcctacgttctcataagtgtggtaccggtgagaagtctctgaagtgtccttttgatttgctgatcccaaagaacaattgtgagcgcaagaaaattgatgagctgaataagaagctgctcttctgtatcaaaccaggcagaacccatggcggcatcaagtattgcgactgttccacctgccgcaaaagcagcaacgaggaaccctggctcactgcaaaccacataacacacacaggcgtatacctgtgtatggaatgtgggcggttctttaacaagaagtcccaactcgtcatccaccagcgcacccatactggggaaaagccttaccaatgctctgaatgcggtaaagccttcagccaaaaaagtctgttgactgtgcaccagagaacccactccggggagaagccccatgggtgttcggaatgccaaaaagccttctcacgcaaaagtctgctgatactgcatcaacgaatacacacaggggaaaaaccctacggctgcagcgagtgtggcaaagccttcagcaggaaaagccagttaaaaaggcaccagattacacacacgattgagaaaccctattcttgttctgaatgcggcaaagctttcagccagaagctgaagctaattacccaccagcgcgcccataccggcgaaaagccttacccctgctctcattgcggcaaagcattcttctggaagtcacagttgattactcatcagcgaacacacacggggaagaaaccttatggttgtggagagtgccaaaaagccttctcacggaacagcctccttatccgacatcagagaattcacactggcgaaaaaccttacgagtgcaatgaatgtggcgaagccttcatccgaaagcctcaactaatcaaacatcaaattacccacaccggggagaagaactaccgctgctccgactgcgaagaggctttctttaaaaagtctgaactcatcaggcatcaaaagatccacctgggcgagaaaccgtacggttgcattcagtgcggtaaaacattcttcgggaaatcccaactcctcactcatcatagaacgcacaccggggagaaaccctacgaatgctcggagtgtggcaaggcctttacgcagaagtcctcccttatcagtcatcagcgaacacacaccggcgagaaaccctacgagtgtagtgaatgccgaaagacctttagcgagaagagctctctgatccatcatcagcggacacacacaggagaaaagcccttcgaatgtagcgaatgccggaaagctttcgcctggaaacctcagctgctgcgccaccaacggatccatactggcgaaaagccctacgagtgttcagagtgcggaaaggcatttgtacaaaaggtgcagctgatcaaacatcaacggaatcacaccggggagaagacgtacggatgtagtgattgtgcaaaagcattttttgagaaggcccagctgattatccatcagagaatccataccggggaacgaccgtacaagtgtggggaatgcgggaaatcattcacgcgcaagtcccacctcatgcgacatcagcggattcatacaggcgataaatattatggctgtaatgaatgtgggaccacatttaataggaagtcacagctgatgatccaccagcgtaatcatattatttag

SEQ ID NO: 14488 - DNA, 2019 bp, Artificial Sequence
  Description of Artificial Sequence: Synthetic coding sequence
atgatccagtcacagatatcctttgaagacgtggccgtggactttaccctggaggagtggcagctcctcaacccgacacaaaagaacttatatcgggacgtaatgctcgaaaattatagcaacctcgtgtttttgggattccaaatcctgaaaccagacgccatgttcaagttggagcagcaggatccttggatcattggacaggaaatactgaatcagaatttctccgaggtgtggctggataatcctaagatgtggttgagagacaaccaggataaccttaagagcatggagagaggacacaaatacgatgtatttgggaaaatatttaactcaagcattaatatagtgcatgtgggcctgcggtcacataagtgcggcacgggggagaaatcccttaagtgtccctttgacttactgattcctaaaaacaactgtgagcggaagaaaatcgatgaactgaacaagaagctcctgttttgtatcaagcctggccggacccatggcgggatcaaatattgtgactgctccacgtgcagaaaatcctcaaacgaagagccttggctcaccgctaatcacattacccataccggtgtgtacctttgtatggagtgcggcagattctttaacaaaaaatcccagcttgtcatccatcagcgaactcatacaggagagaagccctatcagtgtagcgaatgcggtaaggccttttcccagaaaagcctgcttactgtccaccagaggactcatagcggtgaaaaacctcatggctgctcagagtgtcaaaaagcattttcccggaagtctctgctgattctgcaccaacgcatacatacgggggaaaaaccgtacggctgctcagagtgcggcaaggcctttagccggaaatcccaactgaagagacaccagattacacataccattgagaagccttacagctgctcagaatgtggcaaagccttttctcagaaactgaagttaatcactcatcagagggcccacaccggggaaaagccttatccctgcagtcactgcgggaaagcttttttttggaagagtcagctgattactcaccagcgcacacacacaggaaaaaagccatacggctgtggagaatgtcagaaggcttttagccggaattccttgctgatcaggcatcagcggatccacacaggagaaaaaccctacgaatgcaacgaatgtggggaagccttcattagaaagccccagctcataaaacaccagataacccatacaggtgagaagaactatagatgctccgactgcgaggaggccttcttcaaaaagagtgagctgattaggcaccagaaaattcacctcggggagaagccttatggctgtattcagtgtggtaaaaccttctttggtaaatcccagttactaacacatcatcgcactcacactggagagaaaccatacgagtgcagcgaatgcggaaaagcattcacacagaaatcctctcttatatcgcaccagcgaacacacaccggggagaagccatacgagtgttccgagtgtagaaaaacgtttagcgaaaagagttctcttatccatcaccagaggactcacaccggggaaaagccgttcgagtgttcagaatgtcgcaaagccttcgcctggaagccacagctgttgagacaccaaaggatccacaccggagagaaaccatacgaatgttctgagtgtgggaaggcatttgtccagaaggtgcaacttattaagcatcagcgtaaccataccggggagaaaacgtacggttgcagcgactgcgccaaggcattttttgaaaaagctcagcttatcatacaccaaaggattcacactggggaacgaccctacaaatgtggcgagtgtggtaagagttttaccaggaaatctcacctcatgaggcatcagaggattcacactggcgacaagtattatggatgcaatgagtgtggcacaacatttaaccggaaatctcaactaatgatccatcaacgcaaccatatcatctag

SEQ ID NO: 14489 - DNA, 2091 bp, Artificial Sequence
  Description of Artificial Sequence: Synthetic coding sequence
atgagttacggaagcattaccttcggagacgtggccatcgatttttcacaccaggaatgggagtatctgtctctggtgcaaaagaccctctaccaagaggtcatgatggaaaactatgataacctggtctctctcgccggtcacagcgtgtctaaacctgatctcattaccttgctggagcaggggaaggaaccgtggatgattgtgcgagaggagacgcggggggaatgtaccgatttggactcccgctgcgagatcatctccgacggcaaaatgcagctgtaccgtaagcactcctgcgtgaccctccaccaacgaattcataacgggcagaaaccctacgagtgcaaacaatgccaaaaatctttctcacatctcacagaactgatggtgcatcagactatccacacaagcgaggagccggatcagtgtgagaagttccggaaggcgttttctcatctcaccgatctccgcaagcatcaaaagattaatgcacgcgaaaagccctacgaatgtgaagaatgtggtaaggtcttcagctaccccgcgaacctggctcaacatgggaaggtgcacgtagaaaagccatatgaatgtaaggagtgcggtgaggctttcagaaccagtagacagctgacggtgcatcatcggtttcactatggggaaaagccttacgagtgcaaagaatgcggtaaggcttttagcgtgtacggcaggctgtcgcggcatcagtcaatccacactggagaaaaaccattcgagtgtaataaatgcggcaagtctttcagactcaaagccgggctgaaagtccaccagagtatccatactggagaaaagccccacgaatgcaaagagtgcggcaaggcctttagacagttcagccacctggtgggacataagagaatacatactggggagaagccgtacgagtgcaaggagtgtgggaagggctttacttgcagatatcagctgacaatgcaccagaggatttatagtggagaaaagcattacgagtgcaaagagaacggggaggcattctcaagtggccaccagctaacagcaccacatacctttgaatccgtggagaagccctacaagtgtgaagaatgtggcaaagctttcagtgtgcacggccgcctgacacggcaccaggggattcatagtgggaaaaagccttacgagtgcaataagtgtgggaagtccttccggcttaactctagcctcaagatacaccagaatatccatactggagagaaaccctacaagtgtaaagagtgtggtaaggccttctcccagagggcacacctggcccaccacaaccggatccataccggctacaagccttttgagtgcaaagagtgtggtaaatcttttagatgcgccagctatctcgtgatccacgaacgaattcacacaggagagaaaccttacgtctgccaggagtgtggtaaggggttcagttactcacacaagctaacgatacatcgcagagtgcacactggcgaaaaaccatatgagtgtaaggagtgcgggaaagcattctccgtaagcggccagctcacacaacacctgagtatccattccggcaagaaacccttcgagtgcaacaaatgtggcaaatcttttaggttcatttctgtgctgaaagcacaccaaaatattcactccgctgagaagccctatgaatgcaaggaatgtggcaaggccttcaggcatgccaccagcctcatctatcacgacaggactcatgcgggcgagaagagctacgagtgcaaggagtgcggggaaactttcagccacgccagtcatctgataatccatgagcgtatacacacatccgacaaaccttacgaatgtaagcggtgtggcaaagcgttccactgcgccagctatctggtaagacatgaatcagtgcatgctgatggcaacccatatatgtgcgaggaatgcggcaaagccttcaacagctcccacgagttgtccatccatcaccgagtccatacaggtgaaaaaccattcaaatgcaacaagtgccggagatccttcagactcagaagcattctggaagttcatcagagaattcatatatag

SEQ ID NO: 14490 - DNA, 2088 bp, Artificial Sequence
  Description of Artificial Sequence: Synthetic coding sequence
atgtcctacggtagtatcacctttggggatgtggctatcgatttttctcaccaggaatgggagtacttgagccttgtacagaagactctctaccaggaggtgatgatggagaattatgataatctggtctctctggggcactcagtgtcgaaacccgatctgataaccctactggagcagggaaaggagccctggatgatcgtgagagaagaaacacggggggaatgtacggacctcgatagccgatgtgagataatctccgatgggaaaatgcagctttatagaaagcacagctgcgtaacactgcatcaacgaatacacaatggccaaaaaccctacgagtgtaaacagtgccaaaagtcttttagccaccttacggagcttatggtgcaccaaacaatccacacctccgaagagcctgatcagtgcgagaagtttcggaaggccttctcacatctgacagatctgcggaaacaccaaaagatcaacgctcgggaaaaaccctacgagtgtgaggagtgcggcaaggtcttttcctatccagcgaacctggctcagcacgggaaggtgcacgtggaaaagccatacgagtgtaaggagtgtggagaggccttccgcacttctcgacagctgacagtgcatcaccggttccattacggagagaagccttatgaatgcaaagaatgtgggaaggcatttagtgtttacgggaggctgtccagacaccagtccatacacactggcgagaagcctttcgagtgcaacaagtgcggcaaatccttccgtctcaaggccggtctgaaagttcaccagtctatccacaccggagagaagccacacgaatgcaaagaatgcggaaaagcattccggcagttctcccatctggttgggcacaagcggattcacacaggcgaaaagccgtacgaatgcaaggaatgcgggaaaggcttcacttgccggtaccagttgacaatgcatcaacggatctatagtggagagaaacactatgagtgtaaagaaaacggtgaggcattctcttcagggcatcagctcactgccccacatacgtttgaatctgtggaaaagccttacaaatgtgaggagtgtgggaaggcctttagcgtacatggacgtctgaccaggcatcagggcatacacagcggcaagaagccctacgagtgcaacaaatgcggaaagtcttttcggttaaatagctcccttaagattcatcaaaatatccacacaggagagaaaccctataaatgcaaagaatgcggtaaggctttctcacagagggctcaccttgcccatcacaatcgcatccataccgggtataagccgttcgaatgcaaagaatgtggcaagtcgtttcgctgtgcatcttacctcgtgatccacgagagaatccacaccggcgagaaaccatatgtatgccaggaatgcgggaagggcttctcatacagtcacaagctcacaatccatcggagagtacacactggcgaaaagccttacgagtgcaaagagtgcgggaaagcattctctgtgtccgggcagctcacccaacacttgtccatccactctggtaagaagcccttcgaatgtaataagtgtggtaaatccttccggtttataagcgtgcttaaggcacatcagaacatacattcggcagaaaagccgtacgagtgcaaggagtgtggtaaggccttccggcatgccactagccttatctaccacgacaggacacacgccggagagaagagctatgagtgtaaggagtgcggagagacctttagtcatgcatctcacctgatcatccacgagagaattcatactagcgacaaaccctacgaatgcaaacgatgtgggaaagcctttcattgcgcctcttacctagtcaggcatgagtccgtacatgcggatggtaacccctatatgtgcgaagagtgcggcaaagcttttaatagctcacatgagctgtcaatccatcaccgggtgcataccggcgaaaagcctttcaagtgtaacaagtgtcgcaggtcttttagactccggagcattctcgaggtacatcagcggatccatatttag

SEQ ID NO: 14491 - DNA, 4236 bp, Artificial Sequence
  Description of Artificial Sequence: Synthetic coding sequence
atgtcgctcagttctggcgcgagtggagggaagggtgtggatgcgaatcctgtggagacctatgattcaggcgatgagtgggatatcggggttggaaacctgattattgacttagatgccgacttagaaaaagaccaacagaaattggagatgtccggaagcaaagaagtgggaatcccagctcccaatgctgtcgccaccctgcccgacaacatcaagttcgtgactccagttcctggtccccagggtaaggagggaaaatcaaaaagcaagcgcagtaagagtggtaaagatacaagcaagccgaccccggggacctccctgtttaccccgagtgagggggccgcaagcaagaaagaggtgcaaggcaggagcggcgacggcgcaaatgccggcggcctggtagccgctatagcacctaaaggtagcgagaaagcagccaaggcaagtagatcagtcgctggatcaaaaaaggagaaagaaaactcttcctctaagagcaagaaggagcgaagcgagggagttgggacgtgctctgaaaaggaccctggcgtgctgcagcccgttccactgggtggccggggcggccagtatgacgggtcagctggggtcgataccggcgccgtggagccactgggatccatagccatcgaacccggcgccgctctgaaccccctcggaacgaagccggagccagaggaaggcgagaacgaatgtcggctgctgaagaaggtgaagtctgagaaaatggagagtccagtctccaccccagccgtactacctatacacctgctggttcctgttgtgaacaatgatatatctagtccgtgcgaacagatcatggtgcgcacgcggtctgtgggcgtaaatacctgcgatgttgctttggctaccgagccagagtgtctgggcccgtgtgagccaggtaccagcgtaaacctggagggcatagtgtggcaggaaaccgaggatgggatgttggttgtaaacgtcacatggcgcaacaagacatatgtgggaaccttacttgactgcactcggcatgattgggctccccctcgcttctgtgactcccctacctcagaccttgaaatgagaaatggtaggggccgagggaagaggatgcggcccaactctaatacgcccgtcaatgagacggccactgcctctgattccaagggcacctccaatagctcaaagacccgtgccggggcaaactcaaaaggacgtaggggtagccagaactcctccgagcataggcctcccgctagctctacttctgaggacgtcaaggcctctccaagcagcgctaacaaaagaaagaataagcctctttcagacatggaactgaattcttcatccgaagatagcaagggctcaaaacgcgtgaggacaaattccatgggaagcgccaccggccctctgcctgggaccaaagtcgaaccaacagtccttgaccgaaattgcccatcccctgttttgatcgattgtccccaccctaattgtaataaaaagtataagcatattaatgggttgaagtatcatcaggctcacgctcacacggacgacgatagtaagccagaagcagatggggactccgagtatggggaggagccgatcttgcacgccgatctgggaagctgtaatggagcatctgtaagccagaaagggtctttgtccccggctaggtctgccactcccaaggtcaggttggtcgaacctcactctcccagtccatccagcaaattcagcacaaagggcctgtgcaaaaagaaactgagcggagaaggcgatacagatctgggggctctttccaacgatggctcagacgacggtccatctgtgatggatgaaacatctaatgatgcgttcgactcactcgagcgaaaatgcatggagaaagaaaagtgcaagaaaccgtcctccttaaagccggagaaaattccgagtaagtcgctgaaaagtgcgaggcccatcgctccagccataccaccacagcagatctacacgttccaaactgcgaccttcactgcagcatcacctggatcctcatcaggacttaccgcaacagtggcacaggccatgccgaactccccccaactcaagccgatccaacctaagccaacagttatgggggaacctttcacagtgaaccctgccctgacaccggccaaggataaaaagaagaaggacaaaaagaagaaggaatctagcaaagaactggagtctcctctgacgcctggcaaggtctgtcgagcggaggagggaaagtccccgttccgtgaaagtagcggggacggaatgaaaatggaaggactcctgaacggcagctcggatcctcaccagagtaggctggccagcattaaggccgaagccgataaaatctactcattcaccgataatgcgccatctccctcaatcggcggctcaagccggttggaaaataccactcccacacaaccgttaacccccctgcatgtcgtaacccagaacggagcagaagcgtcatctgtcaagaccaacagccctgcatattctgatatcagcgacgccggtgaggatggcgagggcaaggttgatagcgtaaagagtaaagacgcagaacaactggtgaaggagggggctaaaaagacactgtttccaccccaaccccagtctaaagattccccgtactatcagggcttcgaaagctattactcgccatcttacgcgcagtcatcccctggggctctcaatccctcctcccaggccggggttgagagtcaagcactcaaaactaaacgcgacgaggaacccgagagtattgaggggaaggtgaaaaacgacatttgtgaagagaagaagcccgagcttagttctagctcccagcagccatccgtgattcaacagcgtcccaacatgtacatgcaatctctgtactacaaccagtatgcctacgttcctccatatggttactcggaccaaagttaccatacccatttactgtcaacaaacacggcgtaccggcaacagtacgaagagcagcagaaaaggcagagcctcgagcagcagcagagaggcgtggataagaaggctgagatggggcttaaagaacgcgaggccgccctcaaagaagagtggaagcaaaagccctcaattcctcccacgttaactaaggcgcctagcctcacagacctagtgaagtccggacctggtaaggccaaagagcccggtgctgaccctgctaagtcagtgattatccctaaactggacgatagtagtaagttgcccggacaggccccagaggggctgaaagttaagttaagcgacgcaagccatctctcgaaagaggcatcggaggctaaaacaggcgcagagtgtggccggcaggcggaaatggaccctattctctggtacaggcaagaagctgaaccccgcatgtggacttatgtatatccagcaaagtattccgatattaaatccgaagatgagcggtggaaagaggagagggacagaaagctgaaggaggagcgttccagaagtaaagactctgttcctaaggaggacgggaaagagtccacatcctcagactgcaagctgccaaccagtgaggaaagcagattagggtctaaggagcctcgtccttctgtgcacgtgcctgtcagcagtcccctcacacagcaccagagctatatcccttatatgcacggatactcttatagtcagtcctatgatccgaatcacccgtcttacagatccatgcctgctgtgatgatgcaaaattaccctggatcttatctgcctagcagttatagcttttctccatacggatctaaggtatcaggcggggaggacgctgacaaggccagagcaagcccatctgttacttgcaagagtagtagcgagtctaaagccctagatatcctgcagcagcacgcttctcattacaaaagcaaatctccaacgatcagtgataagactagtcaagagagagatagaggtggttgcggagtggtagggggtggaggctcctgttccagcgtggggggggcatcaggcggagaaaggtcggtggacaggcctagaacttccccatctcagcggttgatgtcaacgcaccaccatcaccaccacctgggttacagtttgctacccgcgcaatataacctaccctatgccgctggcctcagctccacggctattgtagcatcccagcagggttctacgcctagcctgtaccccccaccacgccgttag

SEQ ID NO: 14492 - DNA, 1260 bp, Artificial Sequence
  Description of Artificial Sequence: Synthetic coding sequence
atgctgtgcgatgaagaggcgcagaaacgcaaggctaaggagtctgggatggcccttcctcagggccggctgactttcatggatgtagcgatagaattttctcaggaggaatggaaatctctcgacccaggacagcgggcgttatatagggacgtgatgctcgagaattaccggaatctcgtgttcctcgggaggtcatgcgtgctcggtagtaatgctgaaaataagcccattaaaaatcagctcggcctgactctcgaggcccatcttagcgagctgcagctctttcaggcgggtagaaaaatttaccgcagcaaccaggtggaaaaattcactaaccatcgaagctccgtgtcgccactccaaaagatatccagttcatttaccacgcatatctttaataaatacaggaacgatctcatcgatttcccactgctgcctcaggaagaaaaagcttacattagaggtaaaagctatgaatacgagtgctcggaagacggggaggtattcagagtcagggcgtctctgacaaatcatcaggtgattcacactgccgagaaaccttacaaatgcactgaatgtggtaaagtcttctcgagaaattcacaccttgttgagcattggagaatccatactggccagaaaccctacaagtgctccgaatgcgataaagtcttcaatagaaactcaaatctggctcggcatcagcgcatacacaccggagagaagcctcacaaatgtaatgaatgcggtaaggcgtttcgggagtgctcagggctcacaactcacttagtgattcatactggggaaaagccttacaaatgtaatgagtgtgggaagaacttcaggcacaaatttagtctgaccaaccatcagagaagccatacagccgagaaaccttacaagtgtaatgagtgcggaaaagtgtttagcttgttgagctatttagcacggcatcagataattcactctaccgaaaagccgtataaatgtaatgagtgcgggagggcattccataagaggcccgggttaatggcacatctgctgatccacacaggcgagaaaccctacaagtgtaacgagtgtgacaaggtctttgggaggaagttgtacctaacaaaccaccaaaggattcacaccggggaacggccttacaaatgcaatgcatgcggcaaggtttttaatcagaacccccacctgtcacggcacaggaaaatccacgccggcgaaaattccctacgtactcttcagatggagtag

SEQ ID NO: 14493 - DNA, 1389 bp, Artificial Sequence
  Description of Artificial Sequence: Synthetic coding sequence
atgttatgtgatgaggaggcccagaaaaggaaagctaaggaatctgggatggcacttccccaaggtaggctgacctttatggatgtagcaatagaattctcgcaagaggaatggaaaagcctcgaccctggacagcgagccttgtatcgtgatgtcatgctagagaattatcgtaacctagttttcctgggcatttgcctcccggacttatccataatcagcatgctgaagcagcgaagggaaccgctgattctgcagtctcaagttaagattgtgaagaacaccgatggacgcgagtgtgtgaggtctgtcaacactggcagatcttgtgtgctcggctcaaacgctgagaacaagcctatcaaaaaccaactgggtctgactcttgaagcgcatctgagcgaattgcagcttttccaggccggccgaaaaatctatcggagtaaccaggtagagaagttcactaaccacagatcaagtgtttcccctctgcaaaaaatttcaagcagcttcactactcatatttttaacaagtaccgcaacgacttgattgatttcccactactgccgcaggaggaaaaagcatacatcagaggcaagagttacgagtacgagtgcagcgaagacggcgaggtctttagggtgcgcgcaagtctgactaaccatcaggtaatccatacagccgagaaaccatataagtgcaccgagtgcgggaaggtgttctccaggaactctcatcttgtggaacattggagaatccataccggtcaaaaaccttataaatgcagcgagtgtgataaagtgtttaatcggaactcaaacttggccagacaccagcgcatccacacaggcgagaagcctcacaagtgcaacgagtgtgggaaggcattccgggaatgttctggcctcaccacacatctcgttattcatactggggaaaagccatacaaatgtaatgaatgtggtaagaacttccggcacaagttttccctaaccaatcatcaacgatcccacactgcagagaagccatataagtgcaacgagtgcgggaaagttttctcactgctgtcttatcttgcacggcaccagatcatacacagcacagagaagccctacaagtgtaacgaatgcggtagagcttttcataagaggccaggactaatggctcacctgctgatccacacaggagagaaaccctataaatgtaacgagtgcgacaaggtgttcggccgcaagttgtatctcacaaatcaccagagaatccacaccggagagcgcccttataaatgtaacgcttgtggcaaggtcttcaatcaaaaccctcacttgtcccggcacaggaagatccatgctggtgaaaattcactacgcacactgcaaatggagtag

SEQ ID NO: 14494 - DNA, 1389 bp, Artificial Sequence
  Description of Artificial Sequence: Synthetic coding sequence
atgctctgcgacgaagaggcccagaaacgaaaggctaaagagagtggaatggcgctgccccaaggcagactgacgtttatggatgttgcgattgagttctctcaggaagaatggaagtccctagatccaggccagcgcgctctgtaccgcgacgtcatgctggagaactatcgcaacctggtattcctcggaatctgcttaccggacctctctataattagtatgctcaaacagagacgggaaccactgatccttcaaagccaggtgaagatcgtcaagaacacggacggcagggaatgcgtgagaagtgtgaacacaggccgatcttgtgtactgggctctaatgctgagaataaacctatcaagaaccagctgggcttaaccctggaggcgcatctgagcgagctccagctcttccaagcagggaggaagatttatcgctctaatcaggtcgaaaaattcacaaaccacagatcttctgtatctccactgcagaagatttcgtccagctttaccactcacattttcaacaaatacagaaatgatctgatcgactttcccctgctccctcaagaagagaaagcttacattagaggcaagagttacgagtatgaatgttccgaagacggggaggtttttagagtccgtgcttccctaactaaccaccaggtcattcatacagccgagaaaccatataaatgcacagaatgtggtaaagtgtttagcaggaactctcacctggtcgagcattggagaatccatacgggtcagaaaccatataagtgctcagaatgcgacaaggtctttaaccggaactcaaacctggcccgccatcaaaggatccacaccggggagaaaccacacaagtgtaacgaatgcggcaaagcctttagagagtgttcgggacttacgacgcacctagtcatccacacaggcgaaaagccctacaagtgcaacgagtgcgggaaaaactttaggcataaattttcactaaccaaccatcagcgaagccacacagccgagaaaccttataaatgtaacgagtgtggtaaggtcttttctctactgagctatctcgcccgacatcagatcattcattctactgagaaaccctataagtgcaatgaatgtggcagggccttccacaaaagaccaggactcatggcgcacttgctaattcacaccggcgaaaaaccttataaatgtaacgaatgtgataaggtcttcggccggaagctatacctgacgaatcatcagcgtatccacacaggtgagagaccctacaagtgcaatgcttgcgggaaagtgtttaatcagaaccctcacctcagccgccacaggaaaatacacgctggtgagaactccttgaggacactgcagatggagtag

SEQ ID NO: 14495 - DNA, 1260 bp, Artificial Sequence
  Description of Artificial Sequence: Synthetic coding sequence
atgttgtgcgacgaagaggcacaaaaaagaaaggctaaagagtcaggtatggctcttcctcagggtcggctcaccttcatggatgttgcgattgagttcagtcaagaagagtggaaatcccttgatcccgggcagagggccctgtaccgggacgtcatgttagagaactatcggaatcttgtgttcctgggccgtagctgtgtcctgggatcaaacgctgagaacaagcccatcaaaaaccagctgggtctgaccttagaggcacacctgtctgaactgcagctgtttcaagcaggcaggaaaatataccgctcaaaccaggtcgaaaagttcactaaccataggtcctctgtttccccactgcagaagatctcatcatcgttcacaacccacatattcaataaataccgaaatgacttgatcgactttccactcctaccccaggaagagaaagcctacattcgcgggaaatcatatgaatatgaatgttcagaggacggagaagtttttcgggttagggcatcactgactaaccaccaggtgatccacaccgcagaaaaaccatacaagtgcacagagtgcggcaaagtgttttcacgaaattcccatctggtcgagcattggcggattcacacaggtcagaagccatacaagtgcagcgaatgtgataaggtctttaatcgcaactcaaatctagctcggcaccaaagaattcatacaggagaaaaaccacacaaatgcaatgagtgcgggaaggcatttcgtgagtgtagtggattgaccacccacctcgttattcacacaggcgagaagccatacaaatgcaacgaatgcgggaagaattttcgacataaattctctttgacgaatcaccagagatctcacaccgctgaaaagccctataaatgtaatgagtgtgggaaggtatttagcttgttgtcttacctggcccggcaccagattattcacagtacagaaaaaccctacaaatgtaacgagtgcgggcgagcattccacaaacggccgggactcatggcccatctgctcattcacaccggagagaagccatacaagtgcaatgagtgcgacaaagtttttggtcggaaactgtacctgacgaatcaccaacggattcatactggtgagaggccctataaatgcaacgcttgcggaaaggtcttcaaccagaacccccatcttagtcgtcatagaaagatccacgctggcgagaacagcctgagaacattgcagatggagtag

SEQ ID NO: 14496 - DNA, 2118 bp, Artificial Sequence
  Description of Artificial Sequence: Synthetic coding sequence
atgctgcgagaagaggcggcccagaaacggaaggggaaggagcctggcatggctctgccacagggacgcctgaccttcagagatgtggccatcgagttttctctggctgaatggaagtgtctaaatccatcacaacgtgcattgtatagagaagtcatgctggaaaactatagaaatcttgaagccgttgacataagtagcaagtgtatgatgaaggaagttttaagtaccgggcagggcaatacggaagtgattcacactggaactttacagagacacgagagccaccatatcggggatttctgcttccaagagattgaaaaggaaatccacgacatcgagtttcaatgtcaggaagatgaaaggaacggactggaggctcctatgaccaagatcaaaaagctcaccggctccacagatcagcatgaccacaggcacgcgggaaataagccaataaaggatcagctggggtcttcattttattcacatctgcctgagttgcatatttttcagatcaaaggggagatcgggaaccagttggagaaatctacaaacgatgctccctcagtgtccacttttcagcgcatctcatgtcgcccccagactcaaattagtaacaactacggaaataacccactgaactcatccctcctcccacaaaagcaggaggtacacatgcgagagaaaagctttcagtgcaacaagtctggaaaggccttcaactgctcctccctgctgcgcaagcaccagattccgcatctgggcgataaacaatacaaatgtgacgtgtgcggtaagcttttcaaccacgagcaatacctcgcctgccatgatcggtgccataccgttgagaagccttacaagtgcaaggagtgtggtaaaacgttttcacaagagagcagcttgacctgccacaggagattacatacgggtgttaaacgatacaactgtaacgagtgcggaaaaattttcggacagaactcagccttgctgattgacaaggccattgacacaggggagaatccctataagtgtaacgaatgcgataaggcttttaatcagcagtctcagctgtcacaccatagaatacataccggggaaaaaccatacaaatgcgaggaatgtgacaaggttttctcgaggaaaagtactattgagacccacaaaagaatccacacgggcgaaaagccttaccggtgcaaagtttgcgatactgcatttacttggcacagtcaattagcacgacatagacggattcataccgccaagaaaacatacaagtgtaacgaatgtggcaagactttctcgcacaagtcttcactcgtgtgccaccatcggctccatggtggggaaaaatcttacaaatgcaaggtgtgtgacaaggccttcgtctggtcttcccagttggctaaacacacccgaatagactgtggggaaaaaccttacaagtgtaatgaatgcggcaaaactttcgggcagaattccgatttgcttatccacaagtcaatacatactggagaacagccctacaaatgcgacgaatgcgagaaggtgtttagtcgaaaatcgagtctagagactcacaagataggccatacaggcgagaaaccttataagtgtaaggtgtgcgataaagcattcgcgtgccactcctatcttgcaaagcatacacgcatccacagcggggagaaaccatacaaatgtaatgagtgcagtaagacctttagccatcggtcctatttagtgtgccaccaccgtgtacactctggcgagaagccatacaaatgtaacgagtgttctaagacttttagccgcagaagttctttgcactgccacaggaggttgcacagcggtgagaaaccctataagtgcaatgagtgcggcaacaccttccgacactgtagcagcttgatctatcatcggcgtctacataccggggagaaaagttataagtgcaccatttgtgataaggcttttgtaagaaactcactcctgagccgacatacgaggatacacacggccgaaaaaccatacaaatgcaatgaatgtgggaaagccttcaaccagcagagccatctgtcccgccaccatcggattcataccggggagaaaccttag

SEQ ID NO: 14497 - DNA, 1911 bp, Artificial Sequence
  Description of Artificial Sequence: Synthetic coding sequence
atgatgaaggaggtcctttctactggccagggcaataccgaggtaatccacaccggtaccctgcagcgtcatgagagtcaccatatcggcgacttctgctttcaagagatcgaaaaggagattcacgatatcgagttccagtgccaggaggatgaaagaaacggcctggaagccccaatgacaaaaatcaaaaagctcaccggctcaactgatcagcatgaccatcgacacgcaggtaataagcctatcaaggaccagctgggatcatctttctattcccatcttcctgagctgcacatattccagattaaaggggagataggcaaccagctggagaagtcgaccaacgacgctccttctgttagcactttccagcggatctcttgcagacctcaaacccagatctcgaataactatggtaataatccacttaattcgtctttgcttccgcagaagcaggaggttcacatgcgggaaaagagctttcaatgcaacaaaagtggaaaagcgtttaactgctcatctcttttaaggaaacatcaaatcccacatcttggagacaagcagtataagtgtgatgtgtgcggaaagctgttcaaccacgagcagtacctggcttgtcatgacaggtgtcacacagtggagaagccatacaagtgcaaagaatgcggtaagacctttagtcaagaatcctccctcacgtgtcacagacggctgcacacaggagtcaagaggtataattgtaatgagtgtggaaagatttttggtcaaaacagcgccctcctgatcgataaggcgatcgataccggagagaacccttacaaatgcaacgagtgtgataaagcctttaaccagcagagccagctctcccatcatcgaatacacactggcgaaaaaccttataagtgcgaagagtgtgataaagtctttagtcggaaatccaccatcgagacccacaaacgcattcacaccggcgaaaagccatacagatgcaaggtatgcgataccgctttcacctggcacagtcagctcgctaggcaccggcgcatccacaccgcaaagaaaacgtataaatgcaatgagtgtgggaaaacatttagtcataaatcgtccctcgtctgtcaccaccgtctgcatggcggtgaaaaatcatacaagtgtaaggtgtgcgataaggccttcgtttggtctagtcagcttgctaagcacactaggatcgattgtggggagaagccctataagtgtaatgagtgtggaaaaacattcggccagaactcagatttgctcatccacaaatccattcatacaggggaacagccctacaaatgtgacgaatgcgaaaaggtattcagtcgcaaaagcagcctcgaaacgcataaaatcggccatactggagaaaagccatacaaatgtaaggtgtgcgataaggcattcgcctgtcattcatacctggccaaacatacgaggatccactccggcgaaaagccgtacaagtgtaatgagtgttcaaaaacgtttagccaccgttcttacctggtgtgtcaccaccgtgtccactccggcgagaagccgtacaaatgtaatgaatgtagtaaaacattttctcggcgaagtagtctacactgccaccgcagactccactcaggtgagaagccgtacaagtgcaacgagtgtggaaacactttccgtcattgctcatctttaatctatcaccgtagactccacacgggcgagaagtcctataagtgcacaatttgtgacaaagcgttcgtgcggaactccctgctttcccggcacacacgaattcatacggcagagaagccctataagtgcaatgaatgtggaaaggcgtttaaccagcagtcccacctgagccgtcatcatagaatccacaccggggagaagccctag

SEQ ID NO: 14498 - DNA, 2118 bp, Artificial Sequence
  Description of Artificial Sequence: Synthetic coding sequence
atgctgagggaggaggccgcccagaaaaggaaggggaaggaaccgggaatggcacttccgcagggccgcctgacctttcgggacgtggctatagagttctcccttgcggagtggaagtgcttgaatcccagccagcgggctctgtatcgtgaggtgatgctagaaaactaccgtaaccttgaggcggtagatatttccagcaagtgcatgatgaaggaggtgctgagtacaggacagggaaacacagaggttatccacacgggcacgctgcagagacacgagtcacaccatatcggtgacttttgcttccaggaaatcgaaaaggaaatccacgacatcgaattccagtgtcaggaggatgaaaggaacggtctggaagcacccatgactaagatcaaaaaacttactggaagtacagatcagcatgatcacagacatgccggcaacaaaccaatcaaggaccaactcggctcttctttttatagccacctgcctgaactgcatatcttccagattaaaggagagattggtaaccagctagagaaatctacaaatgacgccccttctgtatccacatttcagaggatttcttgtaggccccagacgcaaattagtaataattatggtaataacccacttaattcatccctcctcccgcagaagcaagaggtccacatgcgggagaagtctttccagtgtaacaagagcgggaaagcctttaactgcagttccctactgcgcaagcatcagattcctcatcttggcgacaagcaatataaatgcgacgtgtgtgggaagctgtttaaccatgagcagtacttagcctgtcacgaccgttgtcacacagtagagaagccctataagtgcaaggaatgcgggaagaccttctcacaagagtcctcactgacctgccacaggcggctgcacaccggagttaaacgctacaactgtaatgagtgcggcaaaatcttcggtcagaattctgccctgctgattgataaggccattgacacgggagagaatccgtacaaatgtaatgaatgtgataaagcatttaaccagcaaagccagctgtctcatcaccgaatccacacaggtgaaaaaccctacaaatgtgaagaatgcgataaagtcttctcgcggaagtcaaccatagagacgcataagaggattcacactggtgaaaagccctacaggtgcaaagtttgcgacacagcgtttacttggcacagtcaactcgcacggcatcgtcgtatccacacagcaaagaagacgtacaagtgcaatgagtgcggaaagaccttcagccataaatcaagccttgtgtgccaccatagactgcacggcggtgaaaagagctacaaatgcaaagtgtgtgacaaagcgttcgtctggtcaagccagttggccaagcacacccgcattgactgcggcgaaaagccgtacaagtgtaacgagtgtggaaaaactttcggccagaactcggacctgctcattcataagtccatacatacgggcgagcagccctacaagtgcgacgagtgcgagaaggtgttcagcaggaagtcaagcctggaaactcataagatcgggcatacaggtgaaaagccatataagtgtaaggtgtgtgacaaagcatttgcttgccacagctatctggcaaaacacacacgtattcactccggagagaagccatataagtgcaatgaatgttctaagacattttctcacagatcctacctggtgtgtcaccaccgtgtccactctggagagaagccgtataagtgcaacgagtgctccaagacgttctctcggcgttccagcttacactgtcacaggagacttcattccggggagaagccttataagtgtaacgaatgcgggaatacctttagacactgttccagtctcatataccacaggcggctgcatacaggtgaaaaaagctataagtgcacaatctgcgataaagctttcgtacgtaactcactgttgtctagacacacccggatacacactgccgaaaaaccatataaatgcaatgaatgcgggaaggcgtttaaccaacagagccacctgtctcggcatcacaggattcacactggtgaaaagccttag

SEQ ID NO: 14499 - DNA, 2118 bp, Artificial Sequence
  Description of Artificial Sequence: Synthetic coding sequence
atgctgcgcgaagaagcagcccagaagaggaaaggcaaagaaccaggtatggcacttccacagggacgactgaccttcagggacgtggccattgaatttagcctagcagagtggaagtgcctcaacccctcccagagagcactctatagagaggtaatgctggagaattatagaaaccttgaagctgtcgacatcagttctaagtgcatgatgaaagaagttctgagtacaggacagggtaacacagaagtgatccatactggaaccctacagagacacgagtcccaccatataggggatttctgcttccaggaaatcgaaaaggaaattcacgatattgagtttcagtgccaggaggacgagcggaacggattggaggctcccatgacaaagatcaaaaaactgacagggtctacggatcagcatgatcatcggcatgcgggaaataagccgatcaaggaccagttgggctctagtttttactctcacttgcctgagctgcatatctttcaaattaagggagagatcgggaatcagctggagaaaagtaccaatgacgccccgagtgttagcacgttccaacgcattagttgccgcccccagacccagatttccaataattacggaaacaaccccttaaattcgtccttgctaccgcagaaacaggaggtgcacatgagagaaaaatcattccagtgcaataaatctgggaaggctttcaattgttcttctttgcttcggaaacaccagatcccacaccttggggacaaacagtataaatgtgatgtgtgtgggaagctgtttaatcacgagcaatacctggcctgccatgaccgctgccacacagttgagaaaccatacaagtgcaaagaatgtggaaaaacatttagtcaagaatccagtctgacatgccatagacggctgcacactggtgttaagagatataactgtaacgagtgtggcaagatcttcgggcaaaatagtgccttgttaattgataaagcaatcgacacaggagaaaatccctacaagtgtaacgagtgcgacaaagccttcaaccagcagagccagctttcccatcatcgtatccataccggggagaagccatacaaatgcgaggagtgcgacaaggttttctcgcgaaaatccaccattgaaacccacaagcgcattcataccggagagaagccatatcgttgcaaggtgtgcgatacagccttcacctggcacagccaacttgcaaggcacagacgcatccataccgctaagaagacatacaaatgtaatgagtgcggtaagaccttttcacacaaaagcagtctcgtgtgtcaccacaggcttcatggaggggagaagagttacaagtgcaaagtgtgtgataaggcctttgtgtggtctagtcagttggcgaagcacacaagaatcgactgtggcgagaagccatataagtgtaacgaatgtggaaaaacctttggccaaaactcagacctcctcatccataaatcaatacacacaggggagcagccttataagtgtgacgaatgtgagaaagtgttcagcaggaaatctagcctggaaacccataaaattggccatactggcgagaagccctataaatgcaaagtgtgcgataaagcatttgcctgccactcttatttggcaaaacatacccgcatacactccggtgagaaaccatacaaatgcaatgagtgcagcaaaaccttcagccatcgctcttacctggtgtgccaccacagagtgcactcaggcgaaaaaccttacaaatgtaacgagtgcagcaagacctttagtagaaggtcctctttgcattgtcaccgccgactccactcaggggaaaagccgtacaaatgtaatgagtgtggaaatacattccgccactgtagttcccttatctatcaccggcgtctccacaccggcgaaaaatcctacaagtgcacaatttgcgataaggccttcgtgcggaactcactgctgtcaagacacaccagaattcacactgctgaaaagccatacaaatgcaatgagtgcggaaaagctttcaatcaacagtcacatctcagtcggcaccaccgaatccacaccggtgaaaagccctag

SEQ ID NO: 14500 - DNA, 1854 bp, Artificial Sequence
  Description of Artificial Sequence: Synthetic coding sequence
atgatcaaaagccaggaatctctgacactagaggatgtggcagtagagttcacctgggaggaatggcagttattaggcccagcccagaaagatctatatagagatgtgatgctggagaactatagtaatctggtttctgtaggttatcaggcaagtaagcctgacgcgctgttcaaactggagcagggcgagccatggacggtggaaaatgaaattcactcccagatatgccctgaaatcaaaaaggtcgacaaccacttgcagatgcacagccagaaacagcgctgcctgaaacgtgtggaacaatgtcataaacataatgcattcggtaacatcattcaccagaggaagtcagattttccacttagacagaatcacgatacgtttgatttacatggtaagattctcaagtctaacctcagtctggtgaatcagaataaaagatatgagattaaaaactccgtgggggtcaacggcgacgggaagtcctttttgcacgctaagcacgaacaattccacaatgagatgaatttccccgagggcggcaactccgtaaatactaattctcagtttatcaagcaccagcgcacccagaacatcgacaaacctcacgtgtgcactgaatgcggaaaagcgtttttgaaaaaatcaagattaatataccaccagagggtccatacaggagagaaaccgcatgggtgctcgatctgcggtaaggcattctctagaaagagcggcttgacagaacatcagcgtaaccacactggcgaaaagccttatgaatgcaccgaatgcgacaaagccttcagatggaagtctcagctcaatgcacatcagaaaatccacacaggggaaaagtcttacatctgcagtgactgcggcaaagggttcatcaagaagtctagacttatcaaccaccaacgcgtccacactggagagaaaccccacgggtgttctctctgtggaaaggctttttctaaaagatccagactgacagagcatcagcggacacacactggggagaaaccgtatgagtgcacggagtgtgacaaagccttccggtggaagtctcagcttaatgcccaccagaaggcccatacgggagaaaaaagctacatctgtcgagactgcggcaaggggtttatacagaagggcaatctaattgtacaccagcggattcatacaggcgaaaagccatatatctgtaacgaatgtgggaaaggattcatacagaaagggaacttactcattcacaggagaacccacacgggcgaaaaaccatacgtgtgcaacgagtgcggcaagggctttagtcaaaaaacttgtcttatcagtcaccagaggttccataccggaaagactcccttcgtttgtacagagtgtggcaaatcctgttctcataaaagtgggctcattaatcaccagagaattcacacaggggaaaagccctacacatgttccgactgcggaaaagctttccgtgataagagttgccttaataggcatcggcggacccacacaggtgaacggccatacgggtgctctgattgcggaaaggccttttcacacctgagttgcctggtttaccataaagggatgctacacgccagagagaagtgtgtggggtcagttaaactggagaacccgtgttcagagagtcattcattgagccacacaagggaccttattcaggacaaagactccgtgaatatggtgaccctgcagatgccatccgttgctgcacagacgtctcttacaaacagcgcattccaagctgagtccaaggtagcaatcgtgtcacagccagtcgcacggtcaagcgtgagtgctgattcaagaatctgcacagaatag

SEQ ID NO: 14501 - DNA, 1746 bp, Artificial Sequence
  Description of Artificial Sequence: Synthetic coding sequence
atgctggagaattacagcaatctggtgtctgtcggctaccaggctagtaagcctgacgctttatttaaactagaacaaggggaaccttggaccgttgaaaatgagattcatagtcaaatatgcccggagataaagaaggtcgacaaccatttacagatgcactcacagaaacagagatgtttgaagagggtggaacaatgtcataagcacaacgcatttggcaacataatacatcagagaaagtccgacttccctttgagacaaaaccatgacactttcgatttacatggcaagatcctgaagtctaatctgtctctcgttaaccagaataaaagatacgagattaaaaatagcgtaggagtcaatggtgatggcaaatcgttcctgcatgccaagcacgagcagttccataacgagatgaacttccccgaagggggaaacagtgttaacacaaattctcagtttattaagcaccagaggacccaaaatattgacaagccacacgtgtgtactgagtgcggaaaggcgtttctgaaaaagtccaggctcatttatcaccagagagtgcacaccggcgagaaaccccacggctgctcaatctgcggcaaggctttctctaggaagtctggcctgaccgagcaccaacgcaaccacacaggagaaaagccatatgagtgcacagaatgtgataaggcatttcgctggaagtctcagcttaatgctcatcagaaaatacacacgggagagaagtcatatatatgcagtgactgtggaaaagggttcataaaaaagtcaaggctgatcaaccaccagagggtccatactggcgagaaaccccacggttgctctctctgcggaaaagcgtttagcaaaagatcacgcttaaccgaacatcaaaggacccacaccggagaaaagccatacgagtgtaccgagtgtgataaagccttcagatggaaaagccaactcaacgcccaccagaaagcacatactggagaaaaaagctatatttgtagggactgtggcaagggatttatccaaaagggtaacttgatcgtacatcagaggattcatacaggagagaagccctacatctgtaatgaatgtggaaaaggatttattcagaaaggcaatttactcattcatcgaaggactcataccggcgaaaaaccatatgtctgcaacgaatgcggcaaggggttctcacaaaagacttgtctcatctcacatcagaggtttcacactggtaaaactccttttgtgtgtacggaatgcggaaagtcttgctcacacaagtctggactgatcaatcaccagagaatccacaccggcgagaaaccctatacatgtagtgactgcggcaaggcttttagagataaatcttgtctcaatcgccatcgccgtacccatactggcgagaggccatatggatgcagcgattgtggaaaagccttttcacatttatcttgtctggtgtaccacaaaggaatgttgcacgcaagagaaaaatgcgttggctctgtcaaactggagaacccttgctcggaaagccacagtttgagccatacacgcgatctcatccaggataaagattccgtgaacatggtgacgcttcaaatgccaagcgttgcggcgcaaacaagtctgacgaactcagccttccaggcagaaagcaaggtcgctattgtgtcccagccggtggctaggagttccgtgagcgccgactcgcggatctgcactgaatag

SEQ ID NO: 14502 - DNA, 933 bp, Artificial Sequence
  Description of Artificial Sequence: Synthetic coding sequence
aaaaggagtagattaacagaacatcagcgtacacataccggagagaaaccctatgaatgcaccgaatgtgataaagccttccggtggaaatctcaattgaacgcgcaccagaaggcacatacaggagagaagagttacatttgtagagattgtgggaaaggcttcatccagaaagggaacctgatcgtgcatcaaagaatccacacaggggagaagccctacatctgtaatgagtgtggcaaggggttcatccagaagggaaacctcttaatacatcgccgcacacatactggggaaaagccctacgtgtgcaacgagtgcggcaagggtttctctcagaagacttgcctgattagtcatcaacggttccacaccggcaagaccccatttgtttgcacggagtgcgggaagagttgcagtcataaatccggcctcatcaaccatcagaggatccacacgggagaaaaaccctatacttgcagtgactgtgggaaagcgttccgcgacaagtcctgtctcaaccggcatagaaggacacacactggcgagaggccttatggatgctcggactgcgggaaagctttttcccacctcagctgcctggtgtaccataaggggatgctgcacgcccgtgagaaatgtgtgggttccgttaagcttgaaaatccatgttctgagtctcactcgctgtcccataccagagatctgatccaagataaggatagtgtcaatatggtaactttgcagatgccgtcagtggcagcgcagacttctctcaccaattctgcttttcaggcggagtccaaagtggccatcgtgtctcaacccgtcgcccgttcatccgtgtcagccgacagtcgctttgctcagaacaaaaatcacatgaacgcggtcaacgtagtggtactcagcgtgattaactacatcatatag

SEQ ID NO: 14503 - DNA, 1758 bp, Artificial Sequence
  Description of Artificial Sequence: Synthetic coding sequence
atgataaagactcaggaatccttaaccttggaggatgtcgcggttgagtttagctgggaagaatggcagctgttagacactgcacaaaagaatctgtacagggatgtcatggtagaaaattacaaccatcttgtgtctttgggctaccagacttccaagccagacgtgttgtccaaactggcccatgggcaggaaccatggactaccgatgccaaaattcagaataaaaattgccccggcatcggaaaagtcgattcccacctccaggaacatagtccaaaccagcgcctgctgaaatctgttcagcaatgcaacgggcaaaatactctgcggaacattgtgcatttgtccaagacgcacttcccaattgtgcaaaatcacgatacgttcgacctgtacaggaagaatttaaagtctagcctgtctcttataaaccagaagcgtcgtcatggtatcaacaaccccgtggaattcattggaggcgaaaaaaccttgctgcatggtaaacacgagcgcacccatacgaaaactagatttagtgaaaacgccaagtgcattcatactaaatttcaggtttttaaacaccaaagaacccagaaaatcgaaaaacctcacgcctgtatcgagtgcgaacagaccttcctgcggaaaagccaattgatataccacgagaatatctgcatccaggagaacccaggtagcggacagtgtgaaaaactctccaggtcggtgttgtttacaaagcacctgaaaacaaatacgactgataaaatatgcatcccaaatgagtaccggaagggttccaccgttaagtcaagcttaattacacaccagcagacccacacggaagaaaagtcgtatatgtgctccgagtgcggcaagggatttacaatgaaacggtatctgatagcccaccaacggacgcattcaggggaaaaaccctacgtttgcaaagaatgtggcaaaggatttactgtaaagagcaacctcatagtgcaccagcgcacccacactggcgagaaaccttatatttgctccgagtgtggcaagggttttaccatgaagcgctacctggtcgtccaccagcgcacacacaccggcgagaagccgtatatgtgttccgaatgtgggaaaggattcaccgtaaagagtaacctcatagtacaccagcgttcccataccggtgaaaagtcatatatatgttcggagtgtggcaaaggattcacagttaagcgcacattagtgattcatcagcgcacccacaccggagaaaagagctacatctgtaatgaatgtggcaaaggatttacgactaagcggaccctgattatacaccaaagaacacacactggagaaaagccctatgaatgcaacgaatgcgggaaggcattttcacagaagatatgtctgatacagcacgaacgttgtcatactggcaaaacacccttcgtatgcactgagtgtggtaagagttactcacacaaatacggccttattacccatcagcgaatacacaccggtgagaaaccatacgaatgtaacgagtgcgggaaagcttttaccacaaagagcgtgctgaacgtgcaccagcggacacacacaggcgagaggccttatgggtgttctgattgtgagaaggcatttagccacttgtcaaacctggtcaagcacaaaaaaatgcatacaagggagatgggccgaatttcgcaggtggagaattcctgtaatggggagtcacaactgctcccctataaatag

SEQ ID NO: 14504 - DNA, 597 bp, Artificial Sequence
  Description of Artificial Sequence: Synthetic coding sequence
atgatcaagactcaagagtcgctcaccctcgaggatgtagcagtagagtttagctgggaggagtggcagctgctggatacggcccagaaaaatttatacagggacgttatggtggaaaactacaatcacctcgtctctctgggataccagactagcaaacccgacgtattgtctaagcttgcgcatggccaggaaccatggaccacagatgccaaaattcagaacaagaattgccccgggattggaaaggtggattctcacctacaggagcattctcccaatcagaggctgcttaagagcgtccagcagtgtaacggacagaatacattgaggaacatagtccaccttagcaaaacccattttccaattgttcagaatcacgacacctttgatctctataggaaaaacctaaaaagctcattgtcgcttattaatcagaagagacggcacggaattaacaacccagtcgaatttatcggagagacgggttctctggagcgccctagacaagctgatcacctccgttcagaggtccaggatcagcccggacaaaggggagagacactctgcttgctgaaaattcatacgaagaattag

SEQ ID NO: 14505 - DNA, 2226 bp, Artificial Sequence
  Description of Artificial Sequence: Synthetic coding sequence
atgacagctcaggagtccctcacgcttgaggacgtggccgtcgatttcacgtgggaggagtggcaatttctctctcccgcccaaaaggacttgtacagggacgtgatgctcgaaaactatagtaacctggtggccgttgggtatcaagcttccaagccggatgcactcagtaagcttgaaaggggtgaagagacctgcacaactgaggacgagatttactcgcgtatttgttctgatagtggaggcgcgtccgggggtgcttatgctgaaattcggaaaatagacgaccccctgcaacaccacctacagaatcaaagcatccagaaaagcgtcaagcagtgtcatgagcagaacatgttcggtaatattgtgaaccaaaataagggtcattttctactcaagcaggactgcgacacattcgacctccacgaaaagccactgaagagcaatctgagcttcgaaaaccagaaacggtcaagtgggctaaaaaactccgctgaatttaaccgggatggtaaatccctgttccatgccaatcataaacagttttacactgaaatgaaattccccgccatcgcgaaacctatcaataagtcgcagttcattaagcagcagcggacgcacaatatagagaatgcgcacgtgtgtagtgagtgcggaaaagccttcttgaaactcagtcaatttatcgatcaccaacgcgtacacacaggagagaagccacacgtgtgctccatgtgtggtaaggcgttctcaagaaagagcaggctgatggatcaccagagaacccacactgagctgaaacactacgagtgcaccgagtgtgataaaacttttctaaaaaagtcgcagctgaatattcaccagaagacacatatgggcggcaaaccttacacgtgcagccagtgtggaaaggcattcattaagaaatgtagactgatttatcatcagcgaacccataccggggaaaaaccacacgggtgtagcgtctgcggaaaggcattttctacaaaatttagtctgaccacacaccagaaaactcacaccggagagaagccttatatttgttcagaatgcgggaagggcttcattgaaaagaggaggctgactgcacaccaccgcacccacacaggagaaaaaccgttcatctgtaataagtgtgggaaaggcttcaccctgaagaactcactaattacccaccagcaaacgcataccggagagaagctttatacatgttcagagtgtggaaaggggttcagtatgaaacattgcctcatggtacatcagcgtacgcatacaggagaaaaaccatataagtgcaatgaatgtggtaaaggcttcgcactgaaatcgcctttaatccggcaccagcgcactcacacaggggagaaaccatacgtgtgcactgaatgtaggaagggttttaccatgaaatctgacctgattgtccaccagagaacccataccgcagagaagccctacatttgcaacgactgtgggaagggattcacagtcaagtcccggctgatcgtccatcagagaacacacaccggcgagaagccatacgtctgcggagagtgcggcaagggctttccagcaaaaattagactgatggggcatcagaggacacacacgggtgagaaaccttatatttgtaatgaatgtggaaagggatttacggaaaaatcccatctgaatgtgcatagaaggactcatacgggcgagaaaccatacgtttgctctgaatgcggtaagggtttgacaggcaaaagcatgctcatcgcccatcagcgaacccacaccggcgagaagccgtatatctgcaacgaatgtgggaaaggctttactatgaaaagtacactgtccatacaccagcagacccatacaggagagaagccttataagtgtaatgaatgtgacaagacattccgaaagaagacttgcctgatccaacatcagcgcttccacaccgggaagacaagcttcgcctgcactgaatgcggcaaattttccctccggaagaatgacctcataacacaccagcgcattcacactggagaaaagccctacaaatgctcggattgtgggaaggcgtttacgaccaagagcggacttaatgtgcaccagaggaagcacactggcgagcggccatatggctgcagtgactgcggaaaggctttcgctcatctaagtatcttggtaaagcatcggcggatccacagatag

SEQ ID NO: 14506 - DNA, 2196 bp, Artificial Sequence
  Description of Artificial Sequence: Synthetic coding sequence
atgatgcaggcccaggaatctctgactctggaagatgtggcagtcgatttcacctgggaggagtggcagttcctgtctccagctcagaaagatctctatagagacgttatgctggaaaactactctaacctggtggccgttgggtaccaggcgtctaagcccgatgcgctgagcaaacttgagaggggcgaggaaacctgtactacagaagatgagatctatagtaggatctgtagcgaaatcaggaaaattgacgaccctctgcagcaccatctccagaaccagagtattcagaagagtgtgaagcagtgccacgaacagaacatgttcggcaatattgttaaccagaacaagggccacttcttgttgaagcaggactgtgataccttcgaccttcatgagaaaccgctaaaaagcaacctctcctttgagaaccaaaagcggagttcaggattgaaaaactctgctgaattcaaccgagacggcaaaagcctgttccacgccaaccataagcagttctataccgagatgaaattcccagctattgctaaacccatcaataaatctcagttcattaaacagcagcggacccacaacattgagaacgcccacgtgtgttcagaatgtggtaaagccttcctcaaattaagccaatttattgatcatcagcgggtgcatacaggcgagaagccacacgtgtgttccatgtgtggcaaggctttctccaggaaatccaggctgatggaccaccagagaacccatactgaattaaaacactacgagtgcactgaatgtgataagacgtttctcaaaaagtctcagctgaatattcaccagaagactcacatgggaggaaagccttatacctgttcccagtgtggcaaggcctttattaagaagtgtcgcctcatttaccaccagagaacccataccggagaaaagccccacggctgctccgtttgcggaaaagcgttcagtactaaattctctctcacaacacatcagaagacacataccggagaaaaaccttatatttgctccgagtgcggaaaaggatttatagagaaacgtcgcctgactgcacatcaccgcacgcacactggcgagaagcctttcatttgtaacaaatgcggaaagggcttcaccttaaaaaactcgctaatcacccatcagcagacacacaccggagaaaagctctacacatgctccgagtgcggaaaaggattctcgatgaagcattgcctcatggtgcatcagagaacccataccggggaaaaaccctacaaatgtaacgaatgtgggaagggattcgcattgaagtcacctctgatacggcatcagagaactcacactggggagaagccttatgtgtgtaccgagtgtaggaaaggattcacaatgaagtccgatctgatcgtgcatcagcgcacccacactgctgaaaagccttacatctgtaatgactgtggaaagggcttcacagtgaaatctaggttaatcgtccaccagcgcacccataccggggagaagccgtacgtctgcggcgagtgcggtaagggcttcccagccaagattagactgatggggcaccaaagaacccatacgggagagaaaccgtacatctgtaatgaatgtggaaagggctttactgagaagtcgcatcttaacgtgcatagacggactcatacaggcgaaaaaccctacgtttgttcagagtgtggaaaagggctgactggaaagagcatgctaattgcccatcagcggacccacacaggggaaaaaccctacatctgtaatgagtgtgggaagggcttcaccatgaaatctacattgagcatccatcaacagacccacacgggagagaagccttataaatgcaacgagtgtgataaaacgttccggaagaagacttgtctgatccagcaccaacgattccatacaggcaagacaagtttcgcctgtactgaatgtggaaagtttagccttaggaaaaacgatcttattactcaccagcggatccacacgggcgagaagccttacaagtgtagcgattgtggcaaagcttttacaacaaagtctggcctcaacgtccaccagcgaaagcataccggtgagcgtccctacggttgttccgattgtggaaaagcctttgcacacttatctatcctagtcaaacaccgccgaattcacagatag

SEQ ID NO: 14507 - DNA, 2058 bp, Artificial Sequence
  Description of Artificial Sequence: Synthetic coding sequence
atgaccgcacaggaaagtctgaccctcgaggacgtcgcagttgacttcacgtgggaggaatggcagttcctgtccccagcacagaaggacctctatcgcgacgttatgttggagaattatagcaatctggtggcggtgggctatcaggcatctaaacctgatgccctttctaagcttgagaggggggaggagacttgcactaccgaggacgaaatttacagccgcatctgttccgacagtggcggcgcatccggcggcgcctatgccgaaattagaaaaatcgatgatccactgcagcatcacttgcaaaaccagagtattcagaaaagtgtgaaacagtgccatgaacagaatatgttcggcaacatcgtcaatcagaataagggacatttcctgttaaagcaggattgtgacacattcgatttgcatgagaaacctctgaagagtaatctttcttttgaaaaccagaagcggagctcaggcctgaagaacagcgccgaattcaatcgagacggcaaaagtctgtttcatgcaaaccacaagcaattttacactgaaatgaaatttcctgccattgccaagcccatcaataagtcccaattcatcaaacagcagcgcacgcacaacatcgagaatgctcacgtgtgcagcgagtgcggcaaggctttcctcaagctgtctcaattcatagaccaccagagagtccacacaggtgagaagccccacgtgtgctctatgtgcggcaaagccttttcacgaaagtccaggctgatggatcaccagcgcacacacactgagctgaagcattacgaatgcacagagtgtgacaaaacatttctgaaaaagagccagctgaacatacaccagaaaacccatatgggcggaaagccatacacatgcagccagtgtgggaaggcatttataaagaaatgccgacttatctaccaccagcggactcatacgggagaaaaaccacacggttgcagcgtgtgcggaaaggcctttagcaccaagttttccctgaccacccatcagaagacccatacaggagaaaagccgtacatttgcagtgagtgcgggaaggggttcatcgaaaagcgcaggctcaccgcacatcacaggacccacaccggggagaaacccttcatctgtaataagtgcggcaaaggcttcactctcaagaatagcctgatcacccaccagcagacccatacaggtgaaaagttgtacacctgcagtgagtgcgggaaaggctttagtatgaagcactgtctcatggtccaccagaggacccatacaggcgagaaaccgtacaaatgcaacgagtgcggaaaaggattcgctctgaaaagccctctgataagacatcagcgcactcataccggagagaagccctacgtatgtacagagtgtcggaaaggcttcacaatgaaatcagaccttattgtgcaccagagaactcatacagcggagaagccgtatatatgcaatgattgtggaaagggctttaccgtaaagagccgcctcatcgttcaccaaaggacccataccggtgaaaagccgtatgtctgtggcgagtgcggcaaaggatttcccgccaagattcgattaatgggccaccaacgcacccataccggcgagaaaccttacatttgtaatgaatgtgggaaggggttcacgatgaagagcaccttgtccatccatcagcagactcacacaggcgagaagccttataagtgtaatgagtgcgataaaactttccgcaagaaaacatgcctaatccagcaccagagatttcatactgggaagacgagctttgcctgcactgaatgtggaaaattttctctaaggaaaaatgatcttattacccatcagaggatccacacaggtgaaaagccttacaaatgttcagactgcggtaaagcatttaccacaaagtcaggactgaatgtacatcagagaaaacacacaggggagcgaccatacggttgctcagactgcgggaaggcattcgcccacctgtctatactcgtcaagcaccgtagaatacacaggtag

SEQ ID NO: 14508 - DNA, 2211 bp, Artificial Sequence
  Description of Artificial Sequence: Synthetic coding sequence
atgaggccagaacctaccaagttctgggaagagagcctgactttggaggatgtggccgtagactttacctgggaagagtggcagttcctcagtccagcccagaaggacctttatcgggatgtcatgctcgagaattattctaatctcgtggccgtcggatatcaagcatccaagccagacgcactttctaaacttgagcgtggcgaagaaacttgcaccactgaagatgaaatctactcccgtatttgttctgagatcagaaagattgacgaccccctgcagcatcacctgcaaaatcagtcaattcaaaagtccgtcaagcagtgtcatgaacagaacatgttcggcaacatagtaaatcaaaacaaggggcactttctcctgaagcaggattgcgatactttcgacttgcacgagaaacccctaaaatccaatctgtcctttgagaaccaaaagagatcatcagggctgaagaactcagcagagttcaatagggatgggaagagtctattccacgctaatcacaaacagttttacacggagatgaaattccccgcaatagcgaagcccattaacaagtcacagttcatcaagcagcagagaacccataacattgaaaatgctcacgtgtgtagcgaatgtggaaaagctttcctgaagctaagccagttcattgaccaccagagggtacacacaggcgagaagcctcacgtgtgctccatgtgcgggaaggctttctctcgaaaatctagattaatggatcatcaacggactcatacagagctcaagcactatgaatgtacggaatgtgacaagacattcctgaagaaatcccagcttaatatacaccagaagactcacatgggagggaagccatatacgtgttcccagtgtggtaaagcattcattaaaaagtgccgcctgatctatcaccaaaggacccataccggtgaaaaaccacatggctgttctgtgtgcggcaaggcattttccactaaattctctctcacgacgcaccagaagacacataccggggaaaaaccctatatttgcagcgaatgcggtaaaggcttcattgagaagcgcaggttaacagctcatcaccggacccatacaggcgagaagcccttcatttgcaacaaatgtggcaaggggttcacattgaaaaactcactaatcacccatcagcagacgcataccggtgagaagttgtacacctgcagcgaatgtggtaagggattttcgatgaagcattgcctcatggtgcatcagcgcacccataccggagagaagccttacaaatgcaatgaatgcggaaagggctttgccctcaaaagcccgctgatccgccaccagcgcactcacacaggggaaaaaccttatgtttgtactgaatgtcgcaagggatttacaatgaaaagtgacctgatagtgcaccagcggactcataccgccgaaaagccttacatctgcaatgactgtggtaagggctttaccgtcaagagtcgcctgatcgttcaccagcgaacgcataccggggaaaagccatatgtgtgtggggaatgcggaaagggcttccccgccaaaatccgcctgatgggtcatcagcgtacacacactggagaaaaaccttacatctgtaacgagtgtgggaaaggtttcacagagaaatcacacttaaacgttcatcggcgcacccacacaggagagaaaccctatgtttgttccgaatgcggaaaggggttgaccggaaagtccatgctgattgctcaccagagaacacatacaggggaaaagccctacatctgcaatgagtgcggtaaaggcttcacgatgaaaagcaccctttccatccatcagcagacccatacaggcgaaaaaccttacaagtgtaacgagtgtgataagacatttcgcaagaagacttgcctgatccagcaccagagatttcacacgggcaagaccagctttgcctgtacagagtgtgggaaatttagtctgcggaaaaacgacttgattacgcaccagagaattcatacgggtgaaaagccgtacaaatgctccgattgtggcaaggccttcaccactaaaagtggactgaatgtgcatcaaaggaagcacaccggagagcggccctacgggtgcagcgattgcggtaaggcattcgcgcaccttagtatcctggttaaacacaggcgcatccacaggtag

SEQ ID NO: 14509 - DNA, 2229 bp, Artificial Sequence
  Description of Artificial Sequence: Synthetic coding sequence
atgatgcaagcccaggaaagcctgacactcgaggatgtggcagttgacttcacctgggaagagtggcagttcctgagtcctgcgcaaaaagatctctaccgagacgttatgcttgagaactattctaacttggtggccgtcgggtaccaggctagtaagccagatgctctctccaagctggagaggggcgaagaaacatgtactactgaggatgagatctacagccgtatctgttctgacagcggtggggccagtggaggcgcctacgccgaaattagaaaaatcgatgaccctctgcagcaccatctgcagaaccaatctattcaaaaaagcgtcaaacagtgtcacgagcagaatatgttcggaaatatagtcaaccagaacaagggtcactttctgctgaaacaggattgtgatactttcgatctacatgagaagcctctaaaatcaaacctgtcttttgagaatcaaaagcggtcgtctggactcaaaaacagtgctgaattcaacagggacgggaagtctctgtttcacgctaatcacaaacagttttatacagaaatgaaattccccgcaatcgctaaaccaatcaacaaaagccagtttattaaacagcagcgcacccacaacatcgagaacgcccacgtgtgctcagaatgcggaaaggcattcctcaagttgtcccagtttattgatcaccaacgtgtacataccggagagaaaccgcatgtctgctccatgtgcgggaaagcattttctaggaagtcccgcctcatggaccatcagcgtactcacactgaactcaaacattacgagtgtacggagtgcgacaaaacatttctaaagaaatcacagctgaacatccaccagaagacccacatgggcgggaaaccatacacatgctctcagtgtggcaaagcattcattaaaaaatgtcgtcttatttatcatcaaagaacacatacgggtgaaaagccacatggctgtagcgtgtgcggaaaggcattcagcaccaaattttcgttaacaacccaccagaaaacacacacaggggaaaaaccatacatctgctcagagtgtggtaagggcttcatagagaaacgtcgacttaccgcccatcataggacacatacaggtgagaagccctttatctgcaacaaatgcgggaaaggcttcacactcaagaattcattgataacgcaccagcagacacacaccggtgagaaactgtatacttgttcagaatgcggcaagggattctcaatgaagcattgtttgatggtgcaccaacggacacacaccggggagaagccttataagtgtaacgagtgcggtaagggatttgctctgaaatctccactgattagacaccagcggacacacaccggcgagaaaccctatgtttgcacagaatgccgcaagggattcacaatgaaatcagacctgatcgtacatcagcgcactcacactgccgaaaagccttacatttgtaatgactgcggcaaagggttcacggtgaagtctcgactcattgttcaccaaaggacacacaccggtgaaaagccctatgtgtgcggcgagtgcggcaaggggttccctgctaagatccgcctgatgggacatcagaggactcacacaggggaaaagccatatatatgtaatgagtgtggaaaaggttttactgagaagagccatctcaatgtgcaccgcagaactcacactggtgagaaaccatacgtgtgcagcgaatgcggtaaagggctgacaggcaagagtatgctaatcgcccaccagcgtactcacactggcgagaagccttacatttgtaatgaatgcggtaaaggattcactatgaagtctacgctgtcgatccatcagcagacccacacaggggaaaagccttacaagtgtaacgaatgtgataaaacttttaggaagaagacttgtcttatccaacaccagcggttccacacgggcaagacttcatttgcctgcaccgagtgtgggaaattcagtctgcgcaaaaatgatttaatcactcatcaacggattcataccggcgagaaaccatataagtgtagtgactgtgggaaagcatttactactaagagcggattgaacgtgcaccagagaaagcatactggcgaacgcccttacggatgctcagactgcggtaaggcatttgcccatctcagcattctggtcaaacaccggcggattcaccgctag

SEQ ID NO: 14510 - DNA, 2346 bp, Artificial Sequence
  Description of Artificial Sequence: Synthetic coding sequence
atggcaacccaggggcacttgacatttaaagacgtagccatcgagttcagccaagaggaatggaaatgtctcgagccagtgcagaaggcactgtacaaggacgtaatgttggagaattaccgaaacttggttttcttgggaatcagtcctaagtgcgtcattaaagaactgcccccaaccgagaattctaacaccggggaacgattccagacagtggccttggaacgtcaccaaagctacgatattgagaacctgtatttccgggagatccagaagcatctgcacgatctggaatttcagtggaaggatggagagactaatgataaagaggttcctgttccccacgagaacaacctcacgggtaagcgagaccagcacagccagggagatgttgagaataatcacattgagaatcagctcacttcgaactttgaaagccggctcgccgaactgcagaaagtccagactgaagggcgcctctacgagtgcaacgaaactgaaaagaccggtaataatggctgcctcgtcagcccgcatattcgggagaaaacatatgtatgcaatgagtgcggaaaggcttttaaggcaagcagcagcttgattaatcaccagagaatccacacaacggagaagccctacaagtgtaatgagtgtggaaaagccttccaccgcgcctctcttctgactgtccacaaagtggttcacacacgaggaaagtcgtaccagtgcgacgtctgcgggaagatcttcagaaaaaattcctatttcgttcggcatcagcggagccacaccggccagaaaccttatatttgcaatgagtgcggcaaatccttttctaaatcttctcatctcgctgtccaccaacggatccacacaggggaaaaaccatataagtgtaatctctgtggaaaatcctttagccagcgggtccatctccggctgcatcaaactgtccacaccggcgaaagaccctttaagtgtaacgagtgcgggaagacatttaaacggagtagcaatctgactgtgcaccaagtgatacacgcagggaagaagccctacaaatgtgatgtgtgcggcaaggcttttcggcataggtcaaatctggtttgccataggcggattcatagcggagaaaagcagtacaagtgtaacgaatgtggcaaggtcttttctaagaggtccagtctggcagtacataggcgtatccacacagttgagaagccctgtaaatgcaatgaatgtggaaaagtgttttctaagagatctagtctggcggtacaccagcgcattcacactggtcagaaaacttacaagtgtaacaaatgcggcaaggtctactccaaacattcccacctggcggtgcactggcggatccacaccggcgaaaaggcttacaaatgcaacgagtgtggcaaagtcttttccatccactcaaggttagccgcgcatcagaggatccatacgggcgagaaaccctataaatgtaacgagtgcggcaaagtcttttcccagcattccagactggctgtgcatcgaaggattcacaccggggagaaaccctacaagtgtaaagaatgtgggaaagtgttctctgaccgaagcgcattcgccaggcacagacggatacatactggagagaagccatacaaatgtaaagagtgtggtaaggtcttcagccaatgctcccgcttaaccgtgcaccggcgaattcatagtggcgagaagccttacaagtgcaatgaatgcggcaaagtatactctcaatactctcacctggttggccaccgaagggtacatacgggtgaaaaaccgtacaagtgccacgagtgtggaaaggcttttaatcaaggctcaacattgaatcggcaccagcgaatacatacaggggaaaagccatacaagtgtaatcagtgtgggaacagctttagccaacgtgtacatctgaggctgcaccagaccgtgcacactggcgatagaccttacaagtgtaacgagtgtgggaaaacctttaagcggagctcaaacctcaccgcacatcagatcatccatgcaggcaaaaaaccctacaagtgcgatgagtgtgggaaggtgtttcggcatagttcccaccttgtctctcaccagagaatccatacaggggagaagagatataagtgtatcgagtgcggtaaagccttcggacgcctgttcagtctgtctaagcaccagcgaatccacagcgggaaaaagccgtataaatgtaacgaatgcggtaaatcgttcatttgcagatcagggttgaccaagcaccgcatcagacacacaggagagagcttgactaccaaactgaatgtgaccagaccctag

SEQ ID NO: 14511 - DNA, 2346 bp, Artificial Sequence
  Description of Artificial Sequence: Synthetic coding sequence
atggctacccaggggcaccttacattcaaagacgtcgcaatagagttttctcaggaagagtggaagtgtctcgagcctgtgcagaaggccctatacaaggacgtgatgctggaaaactatcggaacctggtgttcctgggcatatctcccaaatgcgtaatcaaggaactgccaccaaccgaaaactctaacacgggcgaacggttccagaccgttgcactcgagcggcaccagagttatgacatcgagaatctgtatttcagagagattcagaagcatctgcacgaccttgagtttcagtggaaggatggtgagactaatgataaagaggttccagtgccacacgaaaacaatctgactgggaagcgggatcagcacagtcagggagatgtagagaataaccacattgagaaccagctaacctccaattttgaaagtcgtcttgcggagctgcagaaggtccaaactgaggggcggttgtacgagtgcaacgagaccgagaagacaggaaataatggatgtctagtgtccccacatattcgcgagaagacctacgtgtgcaatgaatgtggtaaagcctttaaagcttcttcaagcctgatcaatcaccagcggatccacaccactgaaaagccatacaaatgtaacgagtgcggcaaggcatttcacagggcaagtctactcaccgtgcataaagttgtgcacacaagaggaaaatcttaccagtgcgacgtgtgcgggaagatctttcgtaaaaattcttactttgtcagacaccagagatcccacactggacaaaaaccttatatttgtaatgagtgcggcaagagcttttccaagtcatcgcatctcgctgtgcatcagaggattcacaccggagagaaaccatacaagtgtaacctgtgcgggaaatccttcagtcaaagggtacacctccgtcttcaccagaccgttcataccggcgagcgaccatttaaatgtaatgagtgtggaaagaccttcaaacggtcttccaatctgacagtgcaccaggtgattcacgccggtaagaaaccttacaaatgtgatgtgtgcggcaaagccttcagacacaggagcaatctggtctgccataggcgcattcacagtggcgaaaaacagtataagtgtaacgaatgcggtaaagtgttctccaagagatcttctctggctgtccacagacggatccacacggtggagaagccatgcaaatgcaacgaatgcggcaaagtcttcagcaaaaggtcaagcctggccgtccatcaaagaatccacactggccagaagacctacaaatgtaataagtgtgggaaagtgtattcaaaacactctcacctggccgtccattggagaatccacaccggagagaaggcatacaaatgtaacgaatgtggcaaggtattctcaatccactcaaggctcgcagcccatcagcggatccacactggagagaagccgtacaaatgcaacgagtgcggcaaggtcttctcccaacatagtaggctagccgtgcaccgtcgaattcacaccggggagaagccctataaatgtaaagagtgtgggaaggtgttttctgatcggtcagcctttgcaaggcacaggcgaattcacacaggagaaaaaccatacaaatgcaaggagtgtgggaaagtcttctctcagtgctcccggctaactgtccatcggcgcatccattctggcgagaaaccttataaatgcaacgaatgtggaaaagtctactctcagtatagccacctggtggggcaccggagagtgcacactggagagaagccatataaatgccatgaatgtggcaaggcatttaaccagggttctacattgaatcggcaccaacgcatccacacgggcgaaaaaccctacaagtgcaaccaatgcgggaatagttttagccaacgtgtgcatctgcgattgcaccagaccgtccatacgggcgaccggccctacaaatgtaacgaatgcggcaagactttcaaaaggagctccaatttgacagcacaccagatcattcacgccggtaagaagccttacaagtgcgacgaatgtggaaaggtgtttcgtcactcctcacacctggtgagtcaccagcggattcataccggcgaaaaaaggtataaatgtatagagtgcggaaaggcgttcgggcggctgtttagtctgtccaagcaccaaagaattcattccggaaaaaagccgtacaagtgcaacgagtgtgggaagtctttcatatgtagaagtggtctaaccaaacacaggatcagacacaccggagagtcgctgaccaccaaactgaacgtcacaagaccttag

SEQ ID NO: 14512 - DNA, 2586 bp, Artificial Sequence
  Description of Artificial Sequence: Synthetic coding sequence
atgaatcagcccgggggcgccgctgcgccccaggcagacggtgcctccgccgcaggtcggaagtccaccgcctctcgcgaaagactgaagcgttcccagaagtcaacaaaggtggagggtccagagccagtcccagccgaggcgagcctaagcgcagagcagggcacgatgactgaggtgaaagtgaaaactgagctgcccgatgactacatccaggaggtgatctggcagggcgaagctaaggaggagaagaaggcagttagtaaggacgggacctcggacgtgccagccgagatttgcgtcgtgattggcggagttagaaatcagcagaccctggggagctatgaatgtgggatatgtggtaagaagtataaatactacaattgtttccagacacacgtgcgcgctcatagggacaccgaggcgaccagcggggaaggtgcctcccagtccaataacttccgctacacctgtgatatctgtggcaaaaaatacaagtactacagttgctttcaggagcatagggatttacacgctgttgatgtcttttcggtggaaggcgcaccagagaaccgagccgatcctttcgaccagggtgtcgtggctacggacgaggtcaaggaagaacctcccgagccctttcagaaaatcggccctatgaataacataacatctgatatcttcaaaaaaaaggaggtgagacagtgccagaagagggagacaggcaactacacttgtgagttttgtggtaagcagtataaatattataccccctaccaggagcatgttgctctgcacgcccctattaagtcagcctttagccgtcgagtcgagggaaaggcgcagaatcatttcgaggagactaacagctcatcccagaactcaagcgaaccatatacgtgcggcgcttgcggcatccaatttcagttttacaacaacttgctggagcatatgcagagtcacgctgcagataacgagaacaacattgcctcaaatcagtccagatcgcccccggctgtggtggaggagaagtggaagccccaggcccaaagaaactctgctaacaacacgaccacttctggtctcaccccaaacagcatgataccggagaaggagagacagaacatagctgaaaggttgttaagggtcatgtgcgccgatctgggtgcactgtctgtcgtgtctgggaaggagtttttgaaactggcccagaccctggtggacagcggggcacgttacggcgcctttagcgtgactgagattctgggcaatttcaacactctggctctgaaacatctgccccgaatgtataaccaggtgaaggtgaaagtgacatgcgcactgggctctaatgcctgtctgggcattggggttacttgccatagtcagtccgtgggtccagacagttgttacatcttgaccgcttaccaggccgaggggaatcacattaaatcctacgtactgggcgttaagggcgcagacattagagactccggcgatcttgtacatcattgggtccaaaacgtacttagtgaatttgttatgtcagagatcagaacagtgtacgttaccgactgtagggtgtcaacatccgccttttcaaaggccggaatgtgtttacggtgcagtgcctgcgcgctcaattctgtggtacagagcgtactatccaaacggacattgcaggctagaagcatgcatgaggtcatcgaactactcaacgtgtgtgaagacctggccgggtctacaggacttgccaaagagaccttcggcagccttgaggaaacttccccaccaccctgctggaacagcgtaaccgactctttgctgctcgtgcacgagagatatgagcaaatatgcgagttttattcacgagcaaagaaaatgaaccttattcagagtctgaacaagcatctgctttctaacctagctgccattttaactccagtgaagcaggcagtaatcgaactgtccaatgaatctcaaccaacacttcagctggttctgccaacctatgtgcggctcgagaagctgtttaccgccaaggccaatgacgccggaaccgtgtctaagctctgtcacctatttctggaagctttaaaggaaaactttaaagtgcatcctgcacataaagttgcgatgatactggacccccaacaaaagctccgaccagtgccaccgtaccaacatgaagaaatcatcggaaaagtgtgtgaactgattaacgaggtcaaggagagctgggccgaagaggccgacttcgagccagcagccaaaaaaccacggagtgcggcagtggaaaatccagcagcccaggaggacgaccgcctgggtaaaaacgaggtttatgattacctacaggaaccgctttttcaggccacacccgacctgtttcaatactggagctgcgtgacacaaaaacacactaagctcgcaaaactggcattctggctcctggccgttcctgctgtcggcgccagaagcggttgtgtaaatatgtgcgagcaggccctgctgattaaaaggagaaggctgctctcaccagaggacatgaataagctgatgttcctgaaatctaacatgttatag

SEQ ID NO: 14513 - DNA, 1128 bp, Artificial Sequence
  Description of Artificial Sequence: Synthetic coding sequence
atgaatcagccgggcggagcagccgcaccccaggctgatggggcaagcgctgccggtaggaagagcaccgcctcccgcgaaaggctgaagaggtcccagaagagcaccaaagtagaggggccagaaccagtgccagccgaggcatctctctctgccgagcaggggactatgacagaggtgaaagtcaagacggagctgccagatgattatattcaggaagtgatctggcaaggcgaagcaaaggaggaaaagaaggctgtgtccaaggatggtaccagtgacgttcccgcagagatctgtgtagttatcggaggcgtgagaaaccagcagacccttgggagctatgaatgcggaatttgcggcaaaaaatacaaatattacaattgcttccagacccacgtgagagcccatagggataccgaggccacatctggggagggagcgtcgcagtctaataactttcgttacacatgtgatatctgtgggaagaaatataagtactactcttgctttcaggagcaccgagacctgcacgcagtagacgtgtttagcgtggaaggcgccccggagaaccgagctgacccatttgaccagggggtggtggcaaccgatgaggttaaagaggagccacccgagccattccagaaaataggcccaatgaacaacatcacgagtgatattttcaaaaaaaaggaagtgaggcaatgccaaaaaagggaaacaggaaactacacatgcgagttttgtggtaaacagtataaatactacaccccttatcaagaacacgtggcccttcacgctcctatctctactgcaccgggatgggaacctcctgacgacccagataccggctccgagtgctcccatcccgaagtaagcccctcgccgagatttgtggcagccaagacccagactaaccagtcagggaagaaggcaccggcatccgtagttcgatgcgccacactgttacatcgaacccctcctgccacacagacacagacctttcgcacacctaattctggatccccagccagcaaagctacagcggaaagcgccttctccagacgggtggagggcaaggcacaaaatcactttgaggaaaccaacagtagcagtcaaaacagctag

SEQ ID NO: 14514 - DNA, 2865 bp, Artificial Sequence
  Description of Artificial Sequence: Synthetic coding sequence
atgaaccagccaggaggcgcggccgccccccaagctgatggcgcaagcgcagcaggaagaaaaagcaccgcctcaagggagcggcttaaaaggagtcagaagagtactaaggtggagggaccggagcctgttcccgccgaagccagcctgagcgccgagcaggggaccatgaccgaagtcaaagtgaaaactgaactgccggatgattatattcaggaggtgatatggcagggagaggccaaggaagaaaaaaaggctgtgagcaaggacggtacaagcgacgtacccgcagagatctgcgtagtcattggaggtgtgaggaatcagcagacattggacggcaaggcccctgagggaagcccacatgggggctctgtcaggtctcgctacagtgggacttggatcttcgatcaggcactgcggtatgcttccggcagctacgagtgcggcatctgtgggaagaaatataagtactacaattgttttcaaactcacgtgagagcgcaccgggatactgaggcaaccagcggggaaggcgcttctcaatccaacaatttccggtacacgtgcgatatctgcggtaagaaatacaagtactattcctgttttcaggaacaccgagacttacacgctgttgacgtttttagcgtcgaaggtgctcctgagaaccgtgccgaccccttcgaccagggagtagttgcgacagatgaagtgaaagaggagccgcctgagccttttcagaaaatcggaccaaagactggcaattacacatgtgaattttgtggaaagcagtacaaatattacacaccctaccaagagcacgtggcactccatgctccgatcagcaccgcaccagggtgggagcctcccgatgacccggataccggttccgagtgcagccaccctgaagtctccccctctccaagatttgttgcggccaagacccagacaaatcagtctgggaagaaggcacctgcttcagtggttagatgcgctacactactccaccgaaccccccccgctacgcaaactcaaaccttccgaacccccaatagcggatccccggcctctaaggcaacagccgccgagagcgctttttctcgtagggtggagggaaaggcccaaaaccactttgaagagacaaactcaagctcccagaactcaagcgaaccctatacttgtggtgcatgcggaattcaattccagttttataataaccttctggagcatatgcagagccacgccgctgataacgagaacaacatcgcatccaatcagtcccgctccccacccgccgtggtggaagagaagtggaaaccacaggcgcagcgtaattccgccaataacactactacctcgggcctgactcccaacagcatgatcccagaaaaagagcgtcagaatattgccgaacggctgctgcgggtgatgtgcgcagatctaggggctcttagcgttgtgtcaggtaaggagttcctaaagctggcacagaccttggtagattccggtgctagatatggcgcattcagcgtcactgaaatcctcggtaactttaataccttggccttgaagcaccttccacggatgtacaatcaggtgaaagtgaaggtcacatgcgctctcgggagcaacgcctgtctgggcatcggagtcacctgtcacagtcaatctgttggacccgatagctgctatatcttaactgcgtaccaggcggagggcaatcatattaaatcatatgtactgggagtgaagggcgctgacatccgggactctggggaccttgttcaccattgggtacagaacgtgctgtctgaattcgtcatgtcggagatccggaccgtttatgtgactgactgtcgcgtctccacatccgccttctcgaaagctgggatgtgcctgaggtgctctgcatgtgctctcaacagcgttgtgcagagtgtcctcagcaagaggaccctccaagccaggtcgatgcacgaagttattgaactactgaacgtgtgcgaggatctcgccggctctacagggttggcaaaagagacctttggctcgttagaggagacatctccacccccatgctggaatagcgtgacagattcactccttctcgttcacgaaaggtatgaacaaatttgcgaattttactcaagggccaagaagatgaatctgattcaatcactcaacaagcacctgctgagtaacctcgcagcaatcttaactccagtaaaacaagccgtgattgagctctctaatgagtcacagcctacactgcagctagtgctcccgacatacgtgcgactcgagaagttgtttacagctaaagcgaatgatgccggaactgtctcaaagttatgtcatctgtttttggaggccctgaaggagaattttaaggtccatcctgcccataaggttgccatgattctggaccctcagcagaagctgcggccagtgcctccgtatcagcatgaggaaattattggaaaggtctgtgagctcataaacgaggtcaaagaatcttgggctgaggaggccgattttgaaccagctgccaagaaacctagatctgccgctgtggaaaaccctgcagcccaagaggacgaccgcttgggtaagaacgaggtgtacgactatctgcaggagccattgttccaggcaacacctgaccttttccagtactggtcgtgcgtaactcagaagcacacgaagctggctaagctcgctttctggcttcttgctgtccccgcagtaggggcgagatctggctgcgttaatatgtgtgaacaggccctacttatcaagaggagacgcctgctctccccagaggacatgaacaagctgatgtttttgaagagcaatatgctctag

SEQ ID NO: 14515 - DNA, 915 bp, Artificial Sequence
  Description of Artificial Sequence: Synthetic coding sequence
atgaatcagcctggtggcgcagccgctcctcaggcagacggagcctctgctgccggaagaaagtcaacagcatcgcgggaacgcctgaagcggagtcaaaagagtacaaaggtggaaggtccagagcctgtgcccgcagaggcatctctgagcgctgaacaggggactatgactgaagttaaggtgaagaccgaactgccggacgattacattcaggaggtcatctggcagggggaagctaaagaagagaagaaagcagtgtcaaaggacgggactagcgacgtccccgcagagatatgtgtagttatcggcggcgtccgcaatcagcagactttaggttcatacgagtgcggtatctgtggaaaaaagtacaaatattacaattgtttccaaacccacgtccgggctcatcgcgacacagaggctaccagcggggagggcgcatcacagagtaacaattttcgatacacatgtgacatctgtgggaaaaagtacaaatattactcatgtttccaggaacatcgggacctacacgcagtggacgacccattcgatcaaggagttgtagctacagacgaagtgaaggaggaaccccccgagccgtttcaaaaaattggacccatgaataatattacttccgatatatttaaaaaaaaggaggtgagacagtgccagaagcgtgagaccggaaactacacctgcgagttctgcggtaaacagtataagtactacactccgtaccaggaacatgtggcccttcatgccccaatcaccacacagacccagacctttagaaccccgaactccggctccccagcttctaaagctacggccgagagcgcattcagccgcagggttgaaggaaaggcacagaatcacttcgaggaaactaacagctcatcacagaatagctag

SEQ ID NO: 14516 - DNA, 1683 bp, Artificial Sequence
  Description of Artificial Sequence: Synthetic coding sequence
atggggcagccagcaccctatgccgagggacccatccagggcggcgacgccggcgaactgtgtaaatgcgacttcctggtgtctatttcgataccccaaacgcggtcggatattcccgctggggcacggaggagctctatgggcccccggtctttggatacgtgctggggacgcggtccggaacgacacgtccacaggcttgagtgtaatggagtgatcttcacccacaggaacctgtgcctcccgggagggaaaacaaagacagagaacgaagaaaagacggcacaacttaacattagcaaagagtctgaaagccataggctgatcgtggagggcctacttatggacgtacctcagcatccagactttaaagatcgcctggagaaaagccagctgcacgacactggtaacaagacaaaaatcggggattgtacagacctcactgtacaggatcacgagagttctaccactgagcgggaggaaatagcccgcaagcttgaggagtcttctgtctccacacacctcattactaaacaggggtttgccaaggaacaggtgttttacaagtgtggcgagtgcggaagttactacaatccacatagtgatttccacctgcatcagcgggtgcacacaaatgagaagccatacacctgtaaagaatgtggaaagacattccgctacaattctaagttgagtcgtcaccaaaaaattcacacaggggagaaaccttatagctgtgaggaatgcggacaagctttcagtcaaaattcccatctactccagcaccagaagttgcacggcggacaacggccatatgaatgtaccgactgtgggaagaccttcagctacaattcaaagctgattcgtcatcaacgcatccataccggcgagaaaccattcaaatgtaaggagtgcggcaaagccttctcatgtagctatgattgcataattcacgagagaatacacaacggcgaaaaaccttatgaatgcaaagagtgcgggaagagtttatcctcaaactctgttctcattcagcatcagcgcatccataccggcgaaaaaccttacgaatgcaaagaatgcggcaaggctttccacagatcctctgtattcctccaacatcagcgcttccatacgggcgaacagctgtacaaatgtaacgaatgctggaaaacattctcgtgtagttctcgcttcatcgttcatcaaaggatccacaatggggaaaaaccctatgagtgtcaggaatgtggcaagacgttctcacagaagattactctagttcagcatcagcgcgtgcacacaggagaaaagccctatgagtgcaaggagtgcggtaaagcatttcgttggaacgcaagctttatccagcaccagaagtggcacactcgtaaaaaactcattaatggaaccggactctccgcagtgaaaccatattgtccttgtgccattctgagccctttgcccccacagcacacttgctcagctctggccccacctggaccaccacttagcagttctcatgcagtcgtgttacccccctcggtaccttttttcctgctgttgccctccagcgagaaggccaacccttcacccgtccagatcgctcattttttccaggatctcgctttcccaggcaagagctccttacagtcacccaatcctctgtcacatagcctctag

SEQ ID NO: 14517 - DNA, 1731 bp, Artificial Sequence
  Description of Artificial Sequence: Synthetic coding sequence
atgctgcagaccgtctggtttcagggtctgggccggaatcttctgttccaagagcccgtcacatttgaagacgtcgcggtatattttacgcagaatgaatgggcttccctacatcctacgcagagagcgctgtaccgggaggtgatgctcgagaactatgccaatgttacctcgttaagcgcttttccatttcctaaaccagatctgatctttcagctcgagcagggcgaagcagcctggggacctgacccctggactttagccggcggcgaagcactccgggggatgtgtactggtgggaagacgaaaactgagaacgaagagaaaacagcccaactgaatatctccaaagaaagcgaatcccatcgcttgatcgtcgaaggactcctcatggatgtcccacaacaccctgatttcaaggacagattggaaaaatcccagctgcatgacacaggaaacaagacaaagataggtgactgtacagacctgacagtgcaggaccacgaaagttctacaacagaacgcgaggagatagccagaaaactggaggagtcgagtgtgtcaacccacctgattaccaagcagggattcgctaaggaacaggtgttttataaatgcggtgaatgtgggtcctattataatcctcattccgattttcacctgcaccagcgggttcacactaacgaaaagccatatacatgtaaggaatgtggaaaaacttttcggtataactctaaactctctcggcaccagaagatccatactggggaaaagccatatagttgcgaagagtgtggccaggcgttcagccaaaactcccatttgttgcagcaccagaagttacatggaggtcaaagaccttacgaatgcaccgactgtgggaagacctttagctataactctaagctgattcggcatcaaagaatccatacaggggaaaagccgttcaagtgcaaggaatgcggaaaggctttcagctgctcctacgattgtattattcatgaaaggattcacaatggtgagaagccatatgagtgcaaggagtgcggcaagagtctgagttccaattctgttctgatccagcaccaacgtatccacaccggcgaaaaaccgtacgaatgcaaagagtgtggcaaagcttttcacagatcttccgtcttcctccagcaccagcgcttccacactggggaacagctctacaagtgcaacgagtgttggaagaccttttcctgctcttcaagatttattgtgcaccaacgcattcataacggagagaaaccctacgagtgtcaggagtgcgggaagacctttagccagaaaataaccctagtgcagcatcaacgagtccacaccggcgagaaaccttatgagtgcaaggaatgcggtaaggcctttagatggaacgcaagctttatccagcatcaaaaatggcacactcggaagaaacttatcaatggcacaggactcagcgcggtcaaaccatattgcccgtgtgccattctatctccgcttccgccacagcatacctgctctgctttggccccacctggaccccccctttcatcctcgcacgcagtcgtgctacctccaagcgttccgttcttcctgttattgccttcatccgagaaggctaatccatccccagtgcaaatcgcccacttttttcaagatctggcttttccaggaaagagcagcttgcagtcaccaaacccactttctcactcattatag

SEQ ID NO: 14518 - DNA, 1731 bp, Artificial Sequence
  Description of Artificial Sequence: Synthetic coding sequence
atgttgcagacagtctggtttcaaggcctcggacgcaatctcttgtttcaggagcccgttacattcgaggacgtagcagtgtacttcacacaaaacgagtgggcctcactgcacccgacccagagggccctgtatagagaagttatgcttgagaattatgcaaacgtgacatcactttccgcctttcctttccccaagccagacttaattttccagcttgaacaaggagaggccgcctggggacctgacccctggactctggctggaggagaggccttgcgcggcatgtgtaccggaggtaagaccaagaccgagaacgaggaaaagaccgcccaattgaacattagcaaggaatctgaaagtcacagactcatcgtagagggtttgttgatggatgtcccccagcaccctgatttcaaagataggctcgagaagtcccaactgcacgacaccggaaacaagacgaagatcggcgattgcacagacctcacggtgcaagatcacgaatcttctaccaccgagcgagaagagatcgcaagaaagctagaagagtcttccgtgagtacccaccttattacaaagcaaggcttcgctaaggagcaagtattctacaagtgtggcgagtgcggctcttactacaatccacactccgacttccatttgcaccagagggtccacacaaacgagaaaccatatacctgcaaagagtgtggcaaaacctttcggtacaacagcaagctcagtcgccaccaaaaaattcataccggcgaaaagccatacagctgcgaggagtgcggccaggccttttcacaaaattcccacctattacagcaccaaaaactgcacggcggccaaagaccctacgagtgtactgattgtgggaagactttctcttacaactccaaattaattagacatcaaaggatccacaccggtgagaaaccatttaagtgtaaggaatgtggcaaggccttctcatgtagttacgactgcatcattcacgagagaattcacaacggcgagaaaccctacgagtgtaaggagtgtggtaagagcttaagcagtaactcagtcttgatccaacatcaaagaatacacacgggcgagaaaccctacgagtgcaaggagtgtggaaaggccttccaccggtcatcagtgtttctccagcaccaaagatttcacacaggagagcagctctataagtgcaacgagtgctggaagaccttctcctgcagcagccgctttattgtgcaccagcggatccacaacggggagaaaccgtatgagtgtcaagagtgcggaaagacattcagccagaaaattactctggtgcagcaccagcgggtgcatactggagagaagccatacgagtgcaaagagtgcggcaaggcgtttaggtggaacgcaagtttcattcagcaccagaaatggcacactcgcaaaaagctgataaacggaactggcttgagcgccgtgaaaccgtattgtccctgtgccatattgtcacccctgccgccacagcacacatgttcagccctggcccccccaggcccgccattgtcgagcagccacgctgttgttttgccgccatctgtacctttttttctgttgctcccatcctcagagaaggcaaatcctagccccgtgcaaatcgcacatttttttcaggatttggcgttcccagggaagtcgtctctccaaagtcctaaccccctctctcatagcctgtag

SEQ ID NO: 14519 - DNA, 594 bp, Artificial Sequence
  Description of Artificial Sequence: Synthetic coding sequence
atgggccagccagctccttacgcggaagggcccattcagggaggagacgccggcgagttgtgtaaatgtaacgaatgttggaagacattctcttgtagctcacgtttcatcgtccatcaaagaatccataacggggagaagccttatgaatgtcaagaatgtggcaagacattctcccagaagattaccctggtccagcatcagcgcgtgcataccggagagaagccatatgagtgcaaggagtgcggtaaggcatttcgatggaatgcctccttcatccaacaccaaaagtggcatactagaaagaaactcattaacggcacagggttgagtgcagttaagccctactgtccgtgcgcgatcttgtcaccgttacccccacaacatacttgctcagccctggccccacctggtccacccttgagctcgtctcacgctgtagttctgccaccctccgtgcccttcttcctgctgctcccaagctccgaaaaggctaaccccagccccgtgcagatcgcccatttttttcaggacttagccttcccaggaaaatcctccttgcagtccccgaaccctctgtctcactctttgtag

SEQ ID NO: 14520 - DNA, 1851 bp, Artificial Sequence
  Description of Artificial Sequence: Synthetic coding sequence
atgctacagactgtctggttccagggcctcggtcgtaacttgctatttcaagaacccgtcactttcgaagacgttgctgtctactttactcagaatgagtgggcttctttacacccaacccagagggccctttaccgcgaggtgatgttggagaattatgcaaatgtaacatcattatatccaaccgctggaggttttccactggacaccgagagaactgagaaagtgccaggagccttgagctccttcctcccctccagttcctctctggagctcatactagccctgctacccatgtccgcttttcccttccctaagccggacttgattttccagctggagcagggcgaggcggcttggggacccgatccctggacccttgctggaggtgaagccctgcggggtatgtgcaccggggggaaaaccaagacagaaaatgaggaaaagactgcacagttgaacatttctaaggagtccgagtctcaccggctgatagtggagggtctgttgatggatgtgccccagcacccagatttcaaggacaggctcgaaaagtcccagttgcacgatacaggcaataagactaagattggtgactgcacggacctcaccgtccaggatcatgagtccagcacgaccgagcgcgaggagatcgcgagaaagctggaagagtctagtgtcagcacccacctaattaccaagcaaggctttgctaaagagcaggttttttacaagtgtggcgagtgtggaagctattataaccctcacagcgatttccacctgcatcagagggtacatacaaacgagaaaccttatacctgcaaagagtgcggtaaaaccttccggtataatagtaagctttcaagacaccagaagattcacacaggagaaaaaccatattcttgtgaggaatgtggtcaggccttctcccagaactctcacctattacaacatcagaaactccatggaggccagagaccatacgagtgcaccgattgtggtaagacattttcatataattccaagttaatacgtcaccagcggattcatacgggagagaaaccattcaagtgcaaggaatgcggtaaggccttttcctgctcgtacgattgcatcattcacgaaaggatacataacggtgaaaagccctatgaatgcaaggagtgcggaaaaagtctgtcatctaattctgtcttgatccagcatcagaggattcacactggtgagaaaccctatgagtgcaaggagtgcgggaaagcctttcaccgttcttctgtgtttttacagcatcagcgcttccacactggagagcagctttacaagtgtaacgagtgctggaagactttctcatgcagtagcagatttattgtgcatcagcgaattcacaatggggagaaaccatacgaatgtcaggaatgcggcaagacttttagtcagaaaattaccctggttcaacaccagagagtgcacactggtgaaaaaccctacgaatgtaaagaatgcgggaaagcatttagatggaatgcatcttttatccaacaccagaagtggcatacccgcaaaaaacttatcaatggcacaggcctcagcgccgtgaagccctactgcccatgcgcaatattatctcccctgcccccgcagcacacttgcagcgccttagcacctccaggcccacccctctctagttcgcacgcggtggtgctcccgccctccgtgccattcttcctgcttcttccctccagcgagaaggctaacccaagtcctgttcagatcgcccacttctttcaggacctggcttttcctggcaaatcgtcattgcagagccccaatccactctcccactcactgtag

SEQ ID NO: 14521 - DNA, 1599 bp, Artificial Sequence
  Description of Artificial Sequence: Synthetic coding sequence
atgaagcccggtgtgatcagtcacgcacccgattctgttgtaccagcggcattcccatttcctaagcctgacctaatattccagttagagcaaggggaagccgcctggggaccagatccctggaccctcgcgggcggcgaggccctcaggggaatgtgcacaggcgggaagaccaagactgaaaatgaggagaaaacagcgcaactgaatatctctaaggaaagtgaatcgcaccggcttatagtggaaggcttactgatggacgtgccacaacaccccgactttaaggaccgtctggaaaagtctcagctccacgatacaggtaataaaacgaaaatcggagactgtaccgacctgaccgtacaggaccacgaatcctcaactaccgagcgggaggagatagccaggaaactggaggagagcagcgtgtccacacatctgattacaaagcaaggctttgctaaggaacaggtattttacaaatgcggcgagtgtggctcctactacaacccccattccgacttccatctgcatcagagggtccatacgaacgagaagccatatacctgcaaagaatgtggcaagaccttccgatacaatagcaagttgtcacgacaccaaaagatacataccggcgaaaagccttactcttgcgaggagtgcgggcaggccttcagccagaattctcacctgcttcagcaccaaaaattgcatggaggacagcggccgtatgaatgcaccgactgtggtaagactttctcctataactccaagcttattaggcaccagagaattcacacaggcgagaaacccttcaaatgcaaggaatgcggaaaagctttctcttgtagttacgactgtattattcacgagcggattcacaatggcgaaaaaccttacgaatgcaaggagtgtgggaagagtctgtcatctaactccgtgctgattcagcaccagcgaattcatactggcgaaaaaccttacgaatgcaaggaatgcggcaaggcatttcacaggtcttccgtgttcttgcagcaccagagatttcataccggtgagcagttatataagtgcaacgagtgctggaagacgttttcctgctcgtcaagattcattgtgcatcaacgcattcacaatggggagaaaccttacgagtgtcaggagtgcggcaaaaccttcagccagaagattacccttgtgcaacatcagagggtccacactggggaaaaaccctatgagtgcaaagagtgcggcaaggcatttcgctggaacgcctcattcattcaacaccagaaatggcacactcgtaagaagctaattaacggaaccggattaagcgctgttaaaccttactgcccctgcgccatcctgagtcccctccctccacagcatacatgctcagctctcgccccgccggggccgcccctatcctcctcacacgctgtagttcttcctccaagcgtaccattttttttgcttcttccatcctccgagaaggccaacccttcccctgttcagattgcacatttcttccaagatctggctttccctggtaagagttccttacagagtcctaatcccctgtcacatagcctgtag

SEQ ID NO: 14522 - DNA, 1851 bp, Artificial Sequence
  Description of Artificial Sequence: Synthetic coding sequence
atgctccaaacagtgtggttccagggattaggccggaacctgctgttccaggagccagtgacatttgaggatgtggctgtgtacttcacacagaatgaatgggcctcgctgcacccaacccaacgggccctttatagggaagtgatgctggagaactacgccaacgtgacaagcctgtaccctacagcgggtggcttcccgctcgacacagaacgcaccgagaaggtgcctggtgccctgagtagcttcctcccttcgtctagctccctggagcttatcctggctctgctgcctatgagtgccttcccctttcccaaaccggatctgatttttcagctcgagcaaggtgaagcagcttgggggcctgatccttggactcttgcaggaggggaggccctgagaggcatgtgtacaggcgggaaaactaagacggagaatgaagaaaaaactgcccagttaaacattagcaaggaatctgaatctcatcgcctgatagttgagggactgctcatggacgttccccaacaccctgacttcaaagatagattggagaagtcccagctgcacgacaccggtaacaaaaccaaaataggggactgtacagaccttacagtccaggaccacgagtccagcacaacagagcgggaagaaattgctaggaaactagaagagagctctgttagcactcatcttattactaagcagggcttcgccaaagaacaggtgttttacaagtgcggcgaatgtggaagctattataacccacactctgacttccatctgcaccagcgagtgcataccaatgaaaagccttatacctgcaaggaatgcgggaaaacattcagatataacagtaaactgagccgacaccaaaagattcacaccggtgaaaagccttattcatgtgaagaatgtggccaagcattctcacaaaactctcacctgttgcagcaccaaaaactgcacgggggccagaggccgtacgagtgtacggactgcggcaagacatttagctataacagcaaactgatacggcatcagagaatccacaccggagagaaaccttttaaatgtaaagaatgcggaaaagctttcagctgttcgtatgactgcatcattcacgaaagaatccacaatggggagaagccttatgagtgtaaggaatgtggtaagagcctgagctcaaattcagtgctgattcagcatcagaggatccacaccggagagaagccatatgaatgcaaggagtgcggaaaggctttccacagaagttccgtatttttgcagcaccagcgctttcacacaggtgaacaactttataaatgcaacgagtgctggaagacattcagttgttcgagtaggtttatcgtgcatcagaggatacacaacggggagaagccctacgagtgccaggagtgcgggaaaactttttcccagaagattacactcgtgcagcaccaacgcgtgcacaccggtgaaaagccctacgagtgcaaagagtgtggcaaggcgttccgttggaatgcttctttcattcagcatcaaaagtggcacacgcgaaaaaagcttattaacggcactgggctgagtgctgtcaaaccctactgcccctgcgcaatcctaagtccattgccaccccagcatacctgctctgctctggccccccccggccccccattgtcgtcaagtcatgccgtggtgctccccccctctgtgcccttctttttacttctgccttcatcagaaaaggccaatccctcccccgtgcagattgctcacttttttcaggacctggcctttccgggaaaaagctctctccagagtcccaacccgcttagtcattctctgtag

SEQ ID NO: 14523 - DNA, 1704 bp, Artificial Sequence
  Description of Artificial Sequence: Synthetic coding sequence
atgggacagcctgcaccttatgctgaaggcccgatccaaggtggagacgccggagagctgtgcaaatgtgactttctcgtgagcatctctataccacagacccgctcagacattccagccggcgccagacggtcgtcgatggggcctcgctccctggatacttgttggggcagagggcccgagagacacgtacaccgggtctctctgctgctcccccgcctggaatgcaatggcgtaatcttcacccatcgcaacctctgcctgccgggtggaaaaaccaagaccgaaaacgaagaaaaaacggcccagcttaacataagcaaggaaagtgagtctcaccgcctgatcgtggaggggctgttaatggatgtgccacaacatcccgactttaaggatcgcttggagaaatcgcaactgcatgacacaggaaacaagaccaaaattggtgattgtacagacttaacagtgcaggatcacgagtccagcaccactgagagagaagagatcgctaggaaactcgaggaatcttccgtgagcacccacctgatcaccaagcagggttttgccaaggaacaggtgttctacaaatgcggcgaatgtggttcttattacaatccccacagcgactttcacctgcaccagcgggtgcacacaaatgaaaaaccttatacttgtaaagagtgcggaaaaaccttccgctacaactctaaactgtcacgccatcaaaaaatccacaccggggaaaagccctacagctgtgaggaatgtggccaggccttttctcagaattcccatctgctgcagcatcaaaaactccacggcgggcagagaccatacgaatgtactgactgcgggaaaacgtttagctacaattccaagcttatccgtcatcagagaattcatacaggggagaaaccattcaaatgcaaagaatgtggaaaggccttttcatgtagctatgactgtataatccatgagcgcatccataacggcgagaaaccttacgaatgtaaggagtgtggcaagagcctgagcagcaattctgtgctcatccagcaccagcggattcacaccggagaaaagccctacgagtgcaaggaatgtggcaaagcattccaccggtcctcagtcttcctccagcatcagcgtttccacaccggtgagcaactgtataaatgcaatgaatgctggaaaacgttctcttgctccagccggtttatcgtccaccagagaatacataacggagagaaaccctatgaatgccaggaatgtggcaaaacatttagtcagaaaattaccctcgttcagcaccaacgcgtgcatactggcgagaaaccatacgagtgcaaggaatgcggcaaggctttccgctggaacgccagttttattcagcaccaaaagtggcatacccggaaaaaactgatcaacggcacaggactgagcgcggtaaaaccttattgcccatgcgccattttgtcccccttgcccccccagcatacatgctccgccctagccccacctggcccccccctctccagtagccatgcagtggtcctccccccttcggtacctttcttcctcctgctgccgagctccgagaaggctaatccctcacccgttcagatcgcacatttctttcaggacctagccttccctggaaagtcctccctgcagtctcctaaccctctgagccacagcctatag

SEQ ID NO: 14524 - DNA, 474 bp, Artificial Sequence
  Description of Artificial Sequence: Synthetic coding sequence
atgttgcagacaacatggccccaggagagcgttactttcgaagatgtggccgtgtatttcacgcaaaaccagtgggccagcttggatccagcacagcgggctttgtatggagaagtcatgctagaaaactacgcaaatgtagcatctctggttgcattcccctttcccaagccagcccttattagtcaccttgaacgtggcgaggctccttggggtcctgatccttgggacaccgagatcttaaggggcatcagccaaggaggtgaatcctggatcaagaatgaggggctagtgattaagcaggaagcctcagaggagactgagttgcacagaatgcctgtgggcggactgctgcggaatgtatcacagcactttgactttaaacggaaagcgctgaagcaaactttcaatctaaaccccaacttgattctgcgcggaggcagcgttgaagtcagatctctgaggccagcgtag

SEQ ID NO: 14525 - DNA, 1320 bp, Artificial Sequence
  Description of Artificial Sequence: Synthetic coding sequence
atgttgcagacaacgtggccccaggagagcgtcactttcgaagatgtagccgtgtacttcactcagaatcagtgggcatcattggaccctgctcagcgcgccctttacggggaggtcatgcttgaaaactacgccaacgtggcatccctggtggccttcccctttcctaaacccgcccttatctctcacctggaaagaggcgaagcaccctggggacccgatccctgggatacagagatcctgcgaggcatttctcagggtggagagtcatggatcaagaacgaagggctggtgataaagcaagaggcctcagaggagaccgaactgcaccgaatgcccgtcggaggcctcctgaggaacgtctctcagcactttgatttcaagcgaaaggcactgaaacagacattcaatctcaaccccaacctcatcctgagagggggaatgaaattttacgagtgtaaagagtgcggaaagatctttcgctataattctaagcttattcggcatcagatgtcccatacaggggaaaagcctttcaaatgcaaggagtgcggaaaggctttcaagagttcatacgactgtatcgtgcatgagaaaaatcatattggcgagggtccctacgaatgtaaagaatgcgggaaaggattatccagcaacacagctctcacccagcatcagcggatccacaccggggagaagccctacgaatgcaaggagtgcgggaaggcattcaggcgctctgccgcatacttgcaacaccagcggttgcacaccggagagaagctgtataagtgcaaagaatgttggaaggcatttggatgtaggtctttgtttatcgtacatcaacggattcataccggggaaaaaccctatcagtgcaaggaatgtggaaaggccttcacccagaaaatcgcgagcattcagcatcaacgcgttcacacaggggaaaaaccctacgaatgtaaagtgtgtggcaaggcctttaagtggtatgggtcattcgtccaacatcaaaagctgcatccagtcgaaaaaaaacctgtaaaggtgcttgggccatcgttggtgtcccctcagtgctcaagccctgctatcccccccgtattgctacagggttcatgcagtgcctcagccgtggcggtcccaagtcttacattcccacacgcagtgctgatccctacttctgggaatttttttatgctgctgccaactagcgggattccaagctcttccgcacaaatcgtccgggtgtttcaggggctcacccctacggttaagccatcgcctgtgattctgacacctagtagccacagtagttag

SEQ ID NO: 14526 - DNA, 1320 bp, Artificial Sequence
  Description of Artificial Sequence: Synthetic coding sequence
atgttgcagacaacctggcctcaggagtctgtcacatttgaagatgtggcagtgtattttactcagaaccagtgggcctccctggaccctgcccagcgcgcactgtatggggaggtgatgctggaaaattacgcaaatgttgccagcctggttgcattcccctttcccaagcccgccctgatttcacacctcgaaagaggagaggctccatggggtccagatccctgggataccgaaatcctgagaggcatttcacagggtggagagtcatggatcaaaaacgaagggcttgttattaaacaggaagctagtgaggaaaccgaactccaccggatgcctgttggtgggttactgcgtaatgtgagtcagcacttcgactttaaacgaaaagctcttaaacagaccttcaatctgaatcccaacctcatcctccgcggaggcatgaagttttacgaatgcaaggaatgcggaaagatctttaggtataattctaagctcatccgccaccaaatgagccatactggagaaaaaccgtttaagtgtaaggagtgtggtaaagccttcaagagcagctacgattgcatcgtgcacgagaaaaatcacatcggcgagggcccttacgagtgcaaagaatgcggcaagggtctgtcttcgaatactgccctcacgcagcatcaaaggatccataccggggaaaaaccttatgaatgcaaggagtgcggcaaggcatttagaagatctgcagcctacctgcagcaccagcgcctccacactggggagaaattgtacaagtgcaaggagtgttggaaggcgtttggctgcaggagcctgttcatcgtacatcaacgcatacacactggagaaaaaccataccagtgtaaggagtgtgggaaggccttcacccagaaaatagcatcgatccaacaccagcgtgtgcatactggcgaaaaaccctacgaatgcaaggtttgtggcaaagctttcaaatggtacggcagctttgtgcagcaccagaaactgcacccagtagaaaaaaagccagtgaaggtgctggggccatcccttgtgtccccacagtgttcatccccggccatcccgccagtgcttctgcagggatcttgtagtgcgtccgccgtggccgttccttctctgaccttcccccatgctgttctgatcccaacaagtggcaatttttttatgctacttcctacatctggaattccttcgagctccgcccagattgtacgtgtgttccaggggctgacccctacagtgaaacctagccctgtcatcctgacacccagtagtcactcttcctag

SEQ ID NO: 14527 - DNA, 459 bp, Artificial Sequence
  Description of Artificial Sequence: Synthetic coding sequence
atgctccagacaacatggcctcaggagagcgtcacctttgaggacgtggccgtgtactttactcaaaaccagtgggcttcccttgaccccgctcaacgcgctctgtatggcgaagtcatgctggaaaactatgcgaacgttgctagcttggtggccttccctttccctaagcctgcattgatcagccacctggagcgaggcgaagccccgtggggccccgatccttgggacaccgagattctgcgcggcatttctcaggggggggaatcttggataaagaacgaggggctggtcattaagcaagaagcatccgaggaaaccgaactccatcggatgcccgtgggcggactgttgagaaacgtgagtcagcatttcgactttaaaaggaaggctctgaagcagacgtttaatctcaatcctaacctcatcctccgcggcgggatgaaattctacgagtag

SEQ ID NO: 14528 - DNA, 1425 bp, Artificial Sequence
  Description of Artificial Sequence: Synthetic coding sequence
atggagctgcccagccctgaaagcgaagaggtgcacgagccccggttgggggagctcctaggcaaccccgagggccagtcactagggagctcgccatctcaggacagaggctgcaaacaggtgaccgtgacacattggaaaattcagacaggggagaccgcccaggtgtgtacgaaaagtggtcgaaaccatatcctcaatagcgatttactacttctgcagcgggaattgatcgaaggggaggccaacccttgcaacatttgcggaaagacattcacttttaactccgacttggtgcgccatcggatatcccacgcgggtgagaaaccttatacttgcgaccagtgtggtaaaggattcgggcagtcatcccacctaatggaacatcagagaatacataccggggagagattgtatgtctgtaacgtgtgcggaaaagatttcattcactactctgggctgatcgaacaccagagagttcactccggcgaaaaaccttttaagtgcgcccagtgtggtaaagccttctgccattcaagtgatctgatccggcaccaacgcgtgcacactagggaacgaccgttcgaatgcaaggaatgtggaaaaggattcagccagagtagcctcttaatccgacaccagcggatccacacaggcgaaagaccatacgagtgtaatgagtgtggaaaaagcttcatacgcagctcatctcttatcagacactaccagatccacactgaagtgaaacagtacgagtgcaaggaatgcggtaaggcctttaggcaccggtctgacctgattgagcatcaaagaatccacaccggcgagcggccctttgagtgtaacgaatgcggaaaggctttcattaggtcttccaaactaatacaacaccagaggatacacactggcgaacgcccatacgtgtgcaatgaatgcggcaagcgcttttctcagaccagcaacttcacccagcaccagaggattcacaccggagaaaaactatacgaatgtaacgagtgcggaaaagctttctttctaagctcttatctcatcaggcatcaaaagatacacaccggagaacgtgtctatgaatgtaaagaatgcggtaaggcgtttctgcaaaaggctcatttgaccgaacatcagaaaatacactccggggataggccctttgagtgtaaggactgcggaaaagcatttatacagtcaagtaaactgttgttgcaccagattatccacacaggcgagaaaccatacgtgtgttcttattgtggtaaagctctctttagaggccagacttcctttaacacaagaaaattcatcctgaaacgatcatctatgaatgtggtgagtatgggggagatcctcacacagctccagaccctgaaaatcatcaagggcttcaccaagagggactcaccatag

SEQ ID NO: 14529 - DNA, 1491 bp, Artificial Sequence
  Description of Artificial Sequence: Synthetic coding sequence
atggagctcccctctcccgagtctgaggaggtgcatgagcctaggctcggagaacttctgggtaaccctgagggccagtctctgggttcaagtccatcccaggatcgaggttgcaagcaggtcaccgttacacactggaaaatacagacaggagagaccgcccaggtgtgtacaaagagtgggcgaaatcacatcctgaattctgatctcctcttgttgcagcgggagttgatcgagggggaggctaatccctgcaacatctgcggaaagacattcacttttaatagtgatttggtccgacatcgcattagtcacgcgggagaaaaaccctacacatgcgaccagtgtggcaaagggtttggccagtcatcacatcttatggagcaccagcgaatccacaccggcgagcggctatatgtgtgtaacgtgtgcggtaaagatttcatccactatagtggcttgatcgagcatcagagggttcattcgggcgagaagcccttcaagtgtgcccagtgcggcaaagcattctgccattcaagtgatcttatcaggcatcagagagtccacactcgcgagaggccctttgagtgcaaggagtgtggaaagggatttagccagtcgagcttactcattcgacaccagcggatccacactggcgagcggccctacgaatgcaacgagtgcggaaagagctttatccgtagcagttcactcattaggcattaccaaatccatacagaagtgaaacagtatgaatgcaaggagtgtgggaaggcatttagacaccgctctgacctcattgagcatcagcgcatacacactggagagaggccctttgaatgtaacgagtgtggtaaggcatttattcggtcctccaagctgatccagcaccagagaatccacaccggagagcggccttatgtgtgtaatgaatgcgggaagagattttcgcagacctccaatttcacccagcaccagagaattcacacaggggagaagctgtatgaatgcaacgagtgcggaaaagcctttttcctctcctcatacttgatcaggcaccagaagatccacaccggagagcgcgtgtatgaatgtaaagagtgcggcaaggcctttctgcagaaggctcacctaaccgagcaccagaagattcactccggagacaggccatttgagtgtaaggattgcggaaaggcctttatacagagctccaaactgttactgcatcagatcatacacaccggtgaaaagccctacgtctgttcctattgtggcaaagggttcattcagagatcaaacttccttcagcaccaaaagatccatacggaggagaagctctatgagtgctcccaatacggacgcgacttcaactctaccactaatgtcaagaataaccaaagggtccaccaggaagggctgagtctgagcaaagcgccaatccatttgggtgagcgctctgtggataagggggagcatacggggaacttgtag

SEQ ID NO: 14530 - DNA, 1611 bp, Artificial Sequence
  Description of Artificial Sequence: Synthetic coding sequence
atgattttgctgtcttttgtgagcgactccaacgtgggaaccggggagaagaaagtgaccgaggcctggatcagcgaggatgagaattctcatcggacgacttcagatcgtctgacagtgatggagttgccatcacctgagtctgaggaggtccacgaaccacggttgggcgagctcctcgggaaccccgaaggacaatcgttaggcagcagcccttcgcaggatcggggatgcaagcaagtgaccgtgactcattggaaaatccagactggcgaaacggcgcaagtgtgtactaaatccggaagaaaccacattctgaactcggatctgctactcctgcagcgtgagcttattgagggagaggccaatccctgcaatatttgcggaaaaacctttacctttaattctgacctagtgcggcaccggattagtcacgccggcgaaaagccatacacgtgcgaccagtgtggtaaagggtttggtcagtcttcccatttgatggaacatcagcgaattcacactggagaaagattgtacgtgtgtaatgtgtgtgggaaggacttcatccactactccggcctgattgagcaccaacgcgtacatagcggggagaagccatttaaatgcgcccagtgcggcaaagccttttgtcattcctcagaccttatcaggcatcaacgagtgcacactagagaacgcccctttgagtgcaaagaatgtggaaaaggattcagccagtcttctcttttaatcaggcaccaaaggattcacactggcgagcgcccctatgaatgtaacgagtgtgggaagagttttattcgttcctcctctcttatcagacattatcaaatccacacagaggtaaagcagtacgagtgcaaggagtgtgggaaggcttttcgtcaccgtagcgacctcattgagcatcagagaatacacacaggtgagcggccatttgaatgtaacgaatgtggcaaagccttcattcgaagttccaagttaatacagcaccaacggatccataccggagagagaccatacgtttgcaatgaatgcggtaaacggttttcccagaccagcaatttcacccagcaccagcgaatacataccggtgagaagctgtacgaatgtaatgagtgcgggaaggccttctttctcagtagttatctaattaggcaccagaaaattcacaccggagagagagtatatgagtgcaaggagtgcggcaaagctttcctccagaaggctcacctgacggaacatcagaagattcattctggtgataggccgtttgaatgcaaagactgcggtaaggcgttcatccagagctccaagctactgctgcaccaaatcatacacacaggcgagaagccctacgtgtgttcctattgtggaaaaggtttcattcagagatctaacttcctgcaacaccagaagattcacacagaagaaaaactgtatgaatgctcacaatatgggagggactttaactctactaccaatgtgaagaataatcagagggtgcaccaggaaggactcagcttgtctaaagctccaattcacctgggtgagcgcagcgtcgataaaggggagcataccggaaacctgtag

SEQ ID NO: 14531 - DNA, 1491 bp, Artificial Sequence
  Description of Artificial Sequence: Synthetic coding sequence
atggagctcccttcccccgagtccgaagaagtgcatgagcccaggttaggtgagctcctgggcaacccagaaggtcagtcattaggcagttccccctcacaagatcggggttgtaaacaggtgacggtgacccactggaaaattcagaccggcgagacggcccaggtgtgcacgaagagcgggagaaaccacatactgaatagtgatcttctgttactgcaaagggagctaatcgagggcgaggctaacccatgtaacatatgtgggaagacctttacctttaactcagaccttgttaggcaccggattagtcatgcgggggagaagccttatacatgcgaccagtgtggcaagggatttggacagtcttcccatctgatggaacaccagcgaatacatactggtgagcgcttatacgtctgtaatgtgtgcggaaaagactttatccattactcggggctaatcgagcatcagagggtacattcaggggagaagccatttaaatgcgcccaatgtggcaaagcgttttgccatagttccgaccttatcaggcatcagcgtgtccatactagggagcgcccatttgagtgcaaagagtgcgggaaagggttctctcaaagcagccttcttatccgccatcagcgcattcacacaggggaaagaccatatgaatgtaatgagtgcggcaagagttttatccggagctcaagcctgataagacattaccagattcatacagaagtcaaacagtatgagtgcaaggagtgcggaaaggctttcaggcatagaagtgacctgattgaacaccagcgcattcacactggtgagcgcccctttgaatgcaatgaatgcgggaaggcctttatccggagttccaagctgatccagcaccagcgcatccacactggggaacggccatatgtgtgcaacgaatgcggtaagaggttcagtcagacgtccaattttacccagcatcagcggattcacactggagaaaagttgtacgagtgcaacgaatgtgggaaagcgttttttctttccagctatctgattagacaccagaaaatccatactggggaacgtgtctatgagtgcaaggaatgcgggaaggcatttctgcagaaggcacatctgacagagcatcagaagattcattctggcgacagaccgttcgagtgcaaagactgtggcaaggctttcattcagtcctctaaattacttctgcaccaaattattcatactggggagaagccttatgtttgctcttattgcggcaaaggctttatccagagaagcaattttttgcagcatcaaaaaatccatactgaagagaaattgtacgagtgttctcagtacggccgggactttaacagtaccaccaacgtaaaaaacaaccagagagtccatcaggaggggctttcacttagcaaggctccaatccatctgggagagagatccgtggataagggagagcatactggtaatctgtag

SEQ ID NO: 14532 - DNA, 1611 bp, Artificial Sequence
  Description of Artificial Sequence: Synthetic coding sequence
atgatcctgttgagcttcgtctcagactcaaatgttggtacgggagagaaaaaggttacagaggcctggatcagcgaggatgaaaatagtcatcggaccaccagcgatagactcactgtgatggaactacctagtcccgagagcgaggaagtgcacgagccccgcctcggggaactgctaggcaacccagagggacagtctttaggatcatccccttctcaagaccggggctgcaagcaagtgaccgtcactcattggaagatccagaccggcgaaactgcccaggtttgtacaaagagcggtcgaaatcatatcttgaattccgatctgctcctgcttcagagggagctaatcgagggggaggccaacccctgtaacatctgcggaaagacattcacattcaacagtgacctggtgcggcaccgtatcagccacgccggggaaaaaccatacacatgcgatcagtgtggtaaggggttcggacagtcgtcccacctgatggagcatcaacggatccatacgggagaaagactctacgtgtgtaatgtctgcgggaaggacttcatccactactctggactgatcgagcaccagagagttcattcaggagagaagccatttaaatgtgcccaatgcgggaaggctttctgccattcctctgacctgatccggcaccaaagggtgcacactagagagcggccatttgagtgtaaggaatgtggcaaaggctttagtcaatcaagtctgctgatccgccatcaacgtatccacaccggagagcggccctatgaatgcaacgagtgtggcaagtcctttatacggtcctcctctcttattcgccattaccaaatacacactgaggtaaagcagtacgagtgcaaggaatgcgggaaggcttttaggcatagatccgatcttatcgagcaccagcggattcacaccggagaacggccttttgagtgtaacgaatgcggaaaagcttttattcgaagctccaagctaatacagcaccagcgcattcacacgggcgagaggccttatgtctgtaacgaatgcggcaaacggttttcccaaacttctaattttacgcagcaccaaaggatacacacaggagaaaaattatatgaatgcaatgagtgcgggaaggcctttttcctgtcgtcatacttaatccggcatcagaaaattcataccggcgaaagggtgtatgaatgtaaggagtgtggcaaggccttccttcagaaggcccacctcacagagcatcaaaaaattcactcaggcgatcgacctttcgaatgcaaggattgcggcaaagccttcatacaatccagtaagctgttacttcaccagatcatccacactggcgaaaaaccatatgtttgtagctactgtgggaagggctttatccagcgaagcaactttcttcagcatcaaaagattcatacagaagagaagctgtacgagtgtagtcagtatggccgggactttaattctacaacgaatgtcaagaacaatcaacgtgtacatcaagaaggcctgagtttaagtaaagcgcccatacatctgggcgaacggtctgtcgataaaggcgagcacaccggcaacctgtag

SEQ ID NO: 14533 - DNA, 2598 bp, Artificial Sequence
  Description of Artificial Sequence: Synthetic coding sequence
atgtccctgcaggatagtactcttagccgcgaaggtaagccagagggggagattatggctgcggtcttcttcagcgtaggtcgcctatcaccagaggtcacccagccagatgaggacctacacttgcaggcggaggagacccaactggtgaaagagtccgtgaccttcaaggatgtagccatcgacttcacactggaggaatggcgcctgatggatccaacccagagaaacttgcacaaggatgtcatgctggaaaactaccgcaacctagtgtccctggggctggcggtctccaaaccagacatgatcagccatctagagaacgggaagggtccatgggtgacagtgagggagattagcagaattccatatccagatatggaacccaagcccgccaccaagaaagcaacacgtaccaaggccatctcagaggatctgagtcaagaagcgatattagaaaaactgacggaaaatggcttgtgggactccagaatggagggcctgtggaaatggaacgacaggatcctcaggctgcagaacaaccaggagaaccacctcagtcaacggataatccccctaaagaagacacccacaagccagcgtggattcaggtttgaatctattctgataccagagcctggtattgcaaccgaagagctgcacagtagatgtcaaactcaggaagaaaactttactgaaaatttaaatctcatcaccgacacgcatctgggcaaaattatttgtaaagagatgaaggggtctaaggcaattcggcaaacctctgagctgaccctgggtaaaaaaagcaacaataaggaaaagccctataagtgtagcacgtgcgagaaggcattccactaccgttcgctgctgatacagcaccagaggacacatacaaaggaaaagccttatgagtgcaacgaatgcggaaagacattttcgcagccgtcgtatctatcacagcacaagaagattcacacaggagaaaagccttacaaatgtaacgagtgcggaaaggccttcattgctagtagctctctgatggtccaccagcgaattcatactaaagaaaaaccctaccagtgcaatgtttgtggaaagtcctttagccagtgtgcacgtttgaatcagcaccagagaattcagacaggcgagaaaccttataagtgcagtgaatgtggcaaggcatttagtgataagtctaaactggcacgccatcaggagacccataacggggagaagccatacaaatgcgatgattgtggcaaagccttcagaaataagtcctatctgagtgtccatcagaaaacccataccgaggagaagccataccagtgtaatgaatgcggtaaaagctttaagaacacaaccatttttaacgtgcaccagagaatccataccggcgagaagccctttcgctgcaatgagtgtggcaaggcttatagaagcaactcaagcctgattgtccacattaggacacataccggggaaaaaccttacgaatgtaatgagtgcggcaaagccttcaatcgcattgccaatttcacagaacatcaaaggattcatacaggcgaaaagccatacaagtgcaatgagtgtggcaaggccttcatcaactactcttgtctgactgttcatcacaggatgcatactggcgagaagccatataagtgcaccgagtgtggcaaagcctttatgcggagctcaagtctgattatacaccagagaatccacacagaggaaaaaccttatctttgcaacgagtgcggcgaatcgtttcgcatcaaaagccacctaaccgtgcaccaacggatccacaccggcgaaaagccctataagtgtaccgattgtgagcgtgctttcacaaaaatggtcaatctcaaggagcaccaaaagatacacaccggcgttaaaccttacaagtgctatgattgcggtaaaagctttcgaacgaaaagctacctcatcgtccaccagcgcacccatactggcgaaaaaccttacaaatgcaacgagtgcgaaaaggccttcaccaacacttcacaactaacggttcaccaacgtcggcacaccggagaaaagccttataaatgcaatgagtgcgggaaggtgttcacaagtaacagcggcttcaatactcatcagagaactcacaccggtgagaaacccttcaaatgtaacgattgtggcaaggctttcagccagatggtccacgtcaccgaacaccagaagattcactctggggagaaaccctacaagtgcgacgtgtgtggaaaggcttttcggagaggaagctatctgaccgtacattggagaacacacactggagaaaaaccgtatacatgcaaagagtgtggaaagggctgcataacactaagtcagctcacgctgcatcaacgtatccataccggcgagagaccctataaatgtgaggaatgcggcaaggccttccgaactaatagcgatttcacagtgcacctgagaatgcatacaggggagaaaccatataagtgcaacgagtgcgggaaggctttcaggagctcctcatctctcacagttcaccagcgtatccaccaaagggaaacccaattgatttag

SEQ ID NO: 14534 - DNA, 336 bp, Artificial Sequence
  Description of Artificial Sequence: Synthetic coding sequence
atgtccctgcaggattccacactatcgagggaaggaaaaccagagggagagattatggctgcagtgttttttagcgtcgggcggttgtcacctgaagtgacccaacctgacgaagatctgcacctgcaagccgaagaaacgcagcttgtcaaagaaagcgtaacgttcaaagatgtggctattgattttactctggaggagtggagactgatggaccctacacaaagaaacctgcacaaagacgtgatgctggagaactatcgaaatttggtgagcctcggactggcagtgtcaaaacctgacatgatcagccacctcgagaatggcaaaggatag

SEQ ID NO: 14535 - DNA, 921 bp, Artificial Sequence
  Description of Artificial Sequence: Synthetic coding sequence
atgggagaaagactgctcgaatctaaaaaggaccaccagcacggagaaattttgacccaggtgcccgacgatatgctgaagaaaaagacaccacgcgtaaagtcgtgtggagaggtcagcgtcgggcacgccagcctcaaccgccaccaccgagccgacaccggacacaaaccctatgagtatcaggaatatggacagaaaccctacaaatgtacttactgcaagaaagccttcagtgacctcccatacttcagaacacatgaatgggcacatacagggggcaaaccctatgactgtgaggagtgcggaaagagttttattagtagatcgtcaatacggcggcaccgtatcatgcattccggcgacgggccatataagtgcaacttttgcggcaaggctttaatgtgcttaagcttatacctcattcacaaaaggacacacacaggagagaaaccatatgagtgcaaacaatgtggaaaggcgttctcccactctggttcacttcggatccacgaaagaacacatactggggaaaaaccttatgaatgttctgaatgtggcaaggcatttcactccagtacctgccttcacgcccacaaaattacccacaccggagaaaaaccgtacgaatgtaagcaatgcgggaaagccttcgtgtcgtttaactctgtgcggtatcatgaacggactcacactggagaaaagccctatgaatgcaagcaatgcggaaaagccttccgctccgcctcgcatcttcggacccatgggcggacacacactggggagaagccttatgagtgtaagcagtgcggtaaagccttcggctgcgctagcagtgtaaagattcatgagagaactcacactggagagaaaccttgctcgagcaatacatcgaaggggcagggggaaaaaattgcttag

SEQ ID NO: 14536 - DNA, 1119 bp, Artificial Sequence
  Description of Artificial Sequence: Synthetic coding sequence
atggactcagtggttttcgaggatgtggacgtgaacttcacacaggaagaatgggcgctgctggatccaagccaaaagaacttgtaccgggatgtcatgcaggagaccttcagaaatcttgctagtgtgggaaaaaaatggaaagatcagaaaatcgaagatgagtataagaatccgcgccgaaacctcagagggctgatgggcgagcgacttctggagtctaagaaagatcaccaacatggggagatactcacccaggttcctgacgacatgctgaagaaaaagacacctcgagtaaaatcatgtggtgaagtgtccgttgggcatgctagtctgaacaggcaccatcgagccgatactggccataagccatacgagtaccaagaatacggccagaagccatacaagtgcacatactgtaaaaaggccttctctgacctcccatactttagaacccatgaatgggctcacacaggggggaaaccttacgactgcgaagagtgtgggaagtctttcatatctaggagcagcattcgtcgccatcgcatcatgcactctggtgatggcccctataagtgcaacttttgcgggaaggctttgatgtgcctctccctctatctgattcacaaaagaacccacaccggagagaagccgtacgaatgcaaacaatgtggcaaagcctttagccattccggaagcctccgtatccacgaacgcacccacacaggcgaaaagccctacgaatgtagcgagtgcggcaaggcgtttcattcgagtacctgcctacacgcgcacaaaataactcatacaggtgagaagccatacgaatgcaaacaatgcggcaaggccttcgtcagcttcaactctgtgcgataccacgaacggacccacacaggagagaaaccttacgaatgcaaacaatgcggcaaggccttccggtcagccagtcaccttagaacccacgggcgaactcatacaggcgaaaagccgtacgagtgcaaacaatgcgggaaagccttcggatgcgcatcatccgtcaaaatccacgagcgaacacacaccggtgaaaaaccttgtagtagcaacacgtcaaaagggcagggagaaaagatcgcctag

SEQ ID NO: 14537 - DNA, 921 bp, Artificial Sequence
  Description of Artificial Sequence: Synthetic coding sequence
atgggcgagcgactactggagagtaagaaagaccatcaacacggggaaatcctcactcaggttccggacgatatgctaaagaaaaagaccccaagagtgaagtcgtgtggagaggtgtccgtgggacacgccagcctgaaccggcaccaccgagctgacacaggtcacaagccttacgagtatcaggagtatgggcagaaaccctataagtgcacctattgtaagaaagcctttagcgatctgccctacttcaggacccatgaatgggcgcacactgggggcaagccctacgactgtgaagagtgcggtaagtcattcatctctcgttcttctatcagacggcatcggataatgcattctggtgatggaccatataaatgcaatttctgcggtaaagccttaatgtgtctgtcattatacctgatccacaagcgcactcatactggagagaagccctatgaatgcaagcagtgtgggaaggcattttctcatagcggaagcttgcggattcacgaacggacccacacaggcgagaaaccctacgagtgttcagagtgcggcaaggctttccacagtagcacctgtctgcatgcccacaagatcacgcatacaggcgagaaaccctatgaatgtaaacagtgcggaaaggcctttgtgtccttcaattctgtgagatatcacgagagaactcacactggagaaaagccctacgaatgtaagcagtgcggcaaggcgttccgcagcgctagccatcttagaacccacgggcgaacccacactggggaaaaaccatacgaatgcaaacagtgcggcaaagctttcggatgtgcctcgtctgtaaaaattcacgaacgcactcatacaggggagaagccctgcagttccaacacttctaagggacagggcgaaaagattgcgtag

SEQ ID NO: 14538 - DNA, 279 bp, Artificial Sequence
  Description of Artificial Sequence: Synthetic coding sequence
atgggccctctacagttcagggatgtggccatcgagttttctctcgaggagtggcattgtcttgatactgctcagcgcaatctgtaccgtaacgttatgttggagaactactccaacttagtgtttttaggtattacagtctccaagccggacctcattacttgcctggaacaggggaggaagccattaaccatgaagcgcaacgagatgatcgccaagccctcagttagtttcctccaggtccattccgaatcacagtcccccctccacgatatctag

SEQ ID NO: 14539 - DNA, 1623 bp, Artificial Sequence
  Description of Artificial Sequence: Synthetic coding sequence
atgggtcctcttcagtttcgggacgtagcaatcgaatttagcctggaggagtggcactgcttagataccgcacaacgcaatctgtatcggaacgtaatgctagagaactatagcaatcttgtctttctgggcattactgtttcaaagcccgacctgataacgtgcctggaacaaggacgtaaaccactcacgatgaaacggaatgaaatgatcgccaagccttcggttatgtgttctcactttgcgcaggacctttggcccgaacaaagcatgaaggattcgtttcagaaggtggtgctcagacgctacgagaagtgtgagcacgataatttgcagctgaagaaagggtgcattagcgtcgacgagtgcaaggtacacaaggagggctataacgagctgaaccagtgtttaactaccaccccacgcaagatttgccagtgtgacaagtatgttaaggtacttcaccagttcccaaacagtaatggacagaagcgaggccatacaggaaagaagccctttaaatatatcgagtgcgggaaggcatttaagcaattttctacactgaccacacacaagaagattcacacaggggggaagccatacaagtgcgaggagtgcggcaaagcgttcaaccatagctgcagcctcacgcggcataagaaaattcacactggcgaaaaaccttacaagtgcgaagagtgcggcaaggcctttaagcattcctctactctgacaacacacaaacggaatcacactggcgagaagccttacaagtgcgacaagtgcggcaaagcatttatgagcagctcgacactgagcaaacacgaaatcatccatacagagaaaaaaccctacaaatgtgaggagtgcggaaaggcatttaaccggtcatccacactgactacacataagattatccacaccggggaaaaaccttataagtgtgaagaatgtgacaaggcattcaaatatagttatactctgactacccacaagcgtatccatacggaagataaaccatataagtgcgaagagtgcggcaaggcctttaagtattcaagcactttaaccacccacaaacggatccataccggcgaaaaaccatacaaatgcgaggaatgcggaaaagccttcaagaggtcaagcgacctgaccacccataaaattattcacacaggagagaagccctacaagtgcgaagagtgcgggaaagcattcaaatatagtagcaatttaacaacccataagaagattcatacaggggaacgaccctataagtgtgaagagtgcggtaaggccttcaatcagtcctctattcttaccacccacaggaggatccacaccggagaaaaattttacaaatgtgaagagtgtgggaaggcatttaaaaggtcttcacatttaactactcacaagataatccacacaggcgaaaagttctataagtgcgaagagtgtgataaggcgtttaagcatttcagtaatctcactactcacaaaaagatccatacgggcaagaaaccgtacaggtgcgaggagtgcggaaaagccttcaagcattctagtaagcttaccactcacaagaggtttcatacaggggaaaaaccatacagatgtgagtag

SEQ ID NO: 14540 - DNA, 1587 bp, Artificial Sequence
  Description of Artificial Sequence: Synthetic coding sequence
atgggaccactacagtttagggatgtagctattgagttctctctcgaggaatggcactgcctggataccgctcaacggaacctgtaccgaaatgtgatgcttgaaaattactcaaacctggttttcttggggattactgtgtccaagcccgatctgatcacgtgcctggagcagggaaggaaacctttgaccatgaaacgcaatgaaatgattgccaagccctcggtcatgtgtagccatttcgctcaggatctttggccagagcagtcaatgaaggattctttccaaaaggtggtgctcaggcggtacgagaaatgtgagcatgataacttgcaattaaagaagggctgcatctccgttgatgaatgtaaggtccacaaagaaggttataatgaacttaaccagtgccttactaccacgccccgtaaaatttgtcagtgcgataagtacgtgaaggtgttacaccagttccctaactccaacggtcaaaaaagagggcatactggaaagaagcctttcaaatacatcgaatgcggaaaggcgtttaagcagttttccaccttgacgactcacaagaaaattcatactggtgggaagccgtacaagtgtgaggagtgtggcaaagcatttaatcattcctgttccttgactcgacacaagaagatccataccggtgaaaagccgtacaagtgcgaggagtgtggaaaagccttcaagcactcctcaactctgactacccacaaacgaaatcatacaggggagaaaccgtataaatgtgacaagtgtggcaaggctttcatgagctcttccacactctccaagcatgagatcattcacaccgaaaaaaaaccctacaagtgtgaagaatgcggcaaagccttcaacagaagcagcactctgacaactcataaaattatacacacgggagaaaagccctacaagtgcgaagagtgcgataaagccttcaagtattcgtacaccctgacaacccacaaaaggatccacaccgaggataagccatacaaatgcgaggaatgcgggaaagcgttcaaatacagttccactctgactacgcacaaacggattcacaccggcgaaaaaccatacaagtgcgaagagtgcgggaaagcatttaaacgcagttccgatcttactacccacaaaatcatccacactggagagaaaccttacaagtgcgaggagtgcggcaaagcattcaaatacagcagcaatctcaccacacacaagaaaatccacacaggagagaggccctataaatgcgaggagtgcggcaaagctttcaaccagagctcaatactgactacacaccgccgcattcacactggggagaagttttacaagtgcgaggagtgcgggaaggcatttaagtgcagctctaacctgaccacacataaaaaaattcacacgggcgagagaccatacaagtgtgaggagtgcggtaaagcttttaaccagagtagtatcctgacgacacacgaacgtattatcctggaaaggaattctactaacgtgaagaatgttgctaagcctagctctgggccacatactttgttgcacatcagatag

SEQ ID NO: 14541 - DNA, 1359 bp, Artificial Sequence
  Description of Artificial Sequence: Synthetic coding sequence
atgtgcagccattttgctcaagatctttggccagaacagtccatgaaagattcatttcagaaggtggtgctgaggcggtatgagaaatgtgagcacgacaatctccagctcaaaaaaggttgtatctccgtcgacgagtgtaaagtccacaaggaagggtacaacgaactgaaccagtgcctgactaccacgccaagaaagatatgccagtgcgacaagtacgtcaaagtgctgcaccagtttcccaacagcaacgggcaaaagcgtggacatactggaaagaagccttttaaatacatagaatgcggaaaggcgttcaagcagttctccacactgacgacccacaaaaagatccatactggtgggaagccatataaatgcgaagagtgcggcaaggctttcaatcatagctgctcacttactcggcacaagaaaattcatacgggcgaaaagccctataagtgtgaggaatgcggcaaagcattcaagcactccagcacactgaccactcacaagagaaaccacactggcgaaaagccatataaatgtgataaatgtggaaaggcctttatgagttcgtccactcttagtaaacatgagatcatccataccgagaagaaaccttacaagtgcgaagaatgcggtaaagccttcaaccgttcgagcacacttaccacccataagatcattcacaccggtgaaaaaccctataaatgcgaagagtgcgacaaggcattcaaatattcttataccctgacgactcataagagaatacacaccgaggataagccttacaagtgcgaggagtgtggaaaagcatttaagtactcctctactctgactactcataaacgcatccataccggtgagaagccatataagtgcgaagagtgcggaaaggcatttaagcggtcgtccgatctgactacacataaaatcattcatacaggggagaagccctacaaatgcgaagaatgtggcaaggccttcaaatattctagtaatctaaccacacataaaaagattcatacaggggagcgaccttacaaatgcgaagagtgcggaaaagctttcaaccagtcatcaattcttacgacgcaccgtcgcatacataccggggaaaagttttacaaatgcgaggagtgcggcaaagcttttaagtgctcctcaaacttaaccacacataagaagatccatacaggtgaaagaccctacaagtgcgaggaatgcggcaaggcctttaaccagagctccatcctgaccacacatgaaaggattatcttggagcggaacagcactaatgtgaaaaatgtagccaaaccatcctcagggcctcatacgctgttacacatcaggtag

SEQ ID NO: 14542 - DNA, 1587 bp, Artificial Sequence
  Description of Artificial Sequence: Synthetic coding sequence
atgggtccactccagttccgcgacgttgcgattgagttctcgctggaagagtggcattgcctcgacaccgcgcagaggaatctgtatcgcaatgtgatgcttgaaaactactcaaatcttgtcttcctaggcatcaccgtaagcaaaccagacctgattacatgcctggagcagggacgaaaaccgctgacaatgaaacgcaatgagatgattgctaagccctctgtaatgtgctctcactttgctcaagatctttggcccgagcagtcaatgaaggactcatttcagaaagtggtgctgcgtcgatacgaaaaatgtgagcatgataacttgcagctcaaaaaaggttgtatcagcgtggacgagtgtaaggttcataaggagggctataacgaactcaaccaatgccttactaccaccccccggaagatatgccagtgcgataagtatgttaaagtgctacatcagtttccaaattccaacgggcagaagcgcgggcacacaggtaagaagcccttcaagtatattgaatgtggcaaggcgttcaaacagtttagtactttaacaacccacaagaaaatccatacaggtggaaagccatataagtgcgaagagtgtggcaaggcctttaaccactcttgttcactcaccagacacaaaaagatccatactggagaaaagccctataagtgtgaagagtgcggcaaggcgtttaaacacagctctaccctgacaacacataaacggaatcacacaggtgaaaaaccgtataagtgtgacaaatgtggcaaagcgttcatgtcttcatctacactgagcaagcacgaaattatacacactgaaaaaaaaccatataaatgcgaagagtgcggaaaggctttcaacaggtctagcaccctgactacacataagattatacataccggcgagaaaccttataaatgcgaagagtgtgataaggcattcaagtacagctacactctgaccacccataaaaggatccacaccgaggacaaaccgtataagtgcgaggagtgtggtaaagcatttaaatattcctcaacactgaccacccacaagcgcatccatacgggggaaaagccttacaagtgtgaagaatgtggtaaggctttcaaacgttcctctgatctgacaacccataaaattatacataccggcgaaaagccatacaagtgtgaggaatgcggcaaagcctttaagtactcaagcaatttgaccacccacaagaagattcacaccggagaacgcccttataagtgcgaggagtgtggcaaggcatttaatcaatcatctatactgaccacacaccgccggatacacacgggcgagaagttctacaagtgtgaagaatgcggcaaagcttttaagtgctcttctaacctgactacccataaaaagattcacactggcgagagaccttataagtgcgaggagtgtggcaaagcttttaatcaatcaagcatcctcacgactcatgagcgcattatccttgaaaggaactcgactaacgtgaagaacgtagccaagccttccagtggcccacatacattgttgcatatccggtag

SEQ ID NO: 14543 - DNA, 2610 bp, Artificial Sequence
  Description of Artificial Sequence: Synthetic coding sequence
atggagcccgagacggctctttggggccctgatctacagggcccagaacagtctccaaacgatgcccataggggcgcagaatccgagaatgaagaagagagtcccagacaggaaagcagcggggaggagatcatcatgggtgaccccgctcagagccctgagagtaaggatagtaccgagatgtctcttgaacgcagtagccaggaccctagtgtgcctcagaacccccctaccccactggggcattctaatcccctcgatcaccagattcccctcgaccccccggcacctgaagtggtgccaaccccctctgactggaccaaagcctgtgaagctagctggcaatggggagcccttacaacctggaatagtcccccggttgttccggccaacgaaccgtccctgagggagctagttcaggggaggcccgctggcgctgaaaagccatacatctgtaacgagtgcggaaaatccttctcccagtggagtaaacttctcagacatcagcgcatacatacgggtgaaagaccaaacacatgtagtgaatgcgggaaatcatttacccaatcaagccaccttgttcagcaccagaggactcacacaggtgagaagccttataaatgcccagattgcgggaaatgtttttcttggagctctaacttggtccagcaccagcggacccacacgggtgagaaaccatataaatgtactgagtgcgaaaaagccttcacccaatccaccaatctcattaagcaccagaggtcccacactggagagaaaccatacaaatgcggagagtgtaggagggccttctaccggtcttccgatctgattcaacaccaagcgacacatacgggggaaaaaccctacaaatgtccagaatgcggcaagagattcgggcagaaccacaatctcctcaaacatcaaaagatccacgccggagagaagccgtataggtgcaccgaatgtgggaagtcgttcatccagtctagtgagcttacccagcatcaacgcacccacactggcgaaaagccgtacgagtgcctagaatgcggcaagtcatttggccacagtagcacgctcataaaacatcaaagaacacatctgcgagaagaccccttcaaatgtcccgtttgtggcaaaacgttcactctgtcagccacccttctgaggcaccagagaactcatactggcgagcgcccctacaagtgtcccgaatgtggcaagagcttttctgtatccagtaatttgataaatcatcagcgaatacaccggggtgagcgcccttacatatgcgctgactgtggaaaatctttcataatgagtagcactctgattaggcaccagcgcattcatacaggtgagaaaccgtacaaatgtagcgattgtgggaaatcattcataagatcttcgcacctcatccagcacagacggacccacacaggggaaaagccatataagtgtccggagtgtggcaaatccttctcgcaaagtagtaacctgattacccatgtccggactcacatggatgagaacctctttgtgtgttctgattgcggcaaggcctttctcgaagctcacgagttggagcaacacagggtcattcatgagaggggaaagacccccgcccggcgggctcaaggggacagcctgcttggactgggagacccctcactgctgactccccccccaggcgcgaaacctcacaagtgtctggtgtgcgggaaaggctttaacgacgaaggcattttcatgcagcatcagcggattcacatcggggagaacccatataaaaacgcagacggtctgatagctcatgctgcacccaaacccccacaactcagaagccctaggctgccatttaggggtaacagttacccaggagccgccgaaggccgcgccgaggccccagggcagccactgaagccccccgaggggcaggagggtttttcccaacgcagagggctgctctcctccaagacctacatctgctcccactgcggtgagtccttcttagacagaagcgtgttgcttcagcatcagctaacccacgggaacgaaaagccgtttctcttcccggactacagaatcgggttgggagagggagccgggccttcaccatttctatccggtaagccatttaaatgccctgaatgtaaacagtcattcgggcttagtagtgagttgctcctccatcagaaagtgcacgccggaggcaagtcttcgcaaaagtctcccgagcttggcaagtcctccagtgtgcttctcgagcatttacggagcccactcggtgcccggccgtatcggtgctctgattgtcgagcttcttttctggatcgagtggcattgacacggcaccaggagactcatacgcaggagaagcctcccaaccccgaggatccaccacccgaggccgtgacattaagcacagaccaggaaggagagggggagaccccgacgcctaccgagagttcttcccatggcgagggccaaaatccaaagactttagttgaggagaagccatatctgtgcccagagtgtggggctggatttaccgaagttgccgccttgttgcttcaccggtcatgccatccgggggtgtctctgtag

SEQ ID NO: 14544 - DNA, 1458 bp, Artificial Sequence
  Description of Artificial Sequence: Synthetic coding sequence
atgaacgaatatcctaagaaacgtaaaaggaagacactccatccatcacgatatagtgactccagtggtatttcccggattgctgacgggtttaacggtatcttctcagatcactgttacagtgtctgttcaatgcgccaacctgacctgaaatatttcgacaacaaagatgacgacagtgacactgaaactagcaacgacctgcccaaatttgctgacggcatcaaggctaggaataggaatcagaattatttggtcccatcccctgtcctgcgaatcttagaccacaccgctttcagtactgagaaaagcgccgacatagttatatgcgacgaagagtgtgactctcccgaatctgtgaaccagcagacacaagaggaatctcctatcgaagtccacacagctgaagacgtgcccatagccgtggaggttcacgcaatctcagaggattatgatatagagaccgagaataattcctcagaatccctgcaggatcagacggacgaagaacctcccgctaaactatgcaagattctcgataaatcgcaggccctgaacgtgactgcgcagcagaagtggcccctgttacgggccaactctagcgggctctacaagtgtgagctctgcgaattcaattcaaaatattttagtgatctaaagcagcacatgatactgaaacacaaacggaccgatagcaatgtgtgcagggtatgcaaggagtcgttctccaccaatatgctactgattgagcatgcaaagctccatgaagaggatccatacatctgcaaatattgtgactataagacagttattttcgaaaacctgagtcagcacatcgcagatacgcacttcagtgatcacctctattggtgcgagcagtgtgacgtccaattctcgtcgtcctctgaactgtacctgcattttcaggaacatagctgcgacgagcagtacctttgccagttttgcgaacacgaaacaaatgaccctgaggacctgcatagccacgtagtgaacgaacatgcctgtaagctgatcgagctcagcgacaaatacaataatggggagcacggacaatacagcctgctttcaaaaattaccttcgacaaatgtaaaaacttttttgtctgccaagtgtgcggattccgcagcagactccacaccaacgtgaacaggcacgtggctatcgaacataccaagattttcccgcacgtgtgtgatgactgcggaaaggggttctcttcaatgctcgagtactgtaaacacctgaactcacatctctctgagggcatttacctgtgccagtattgtgaatacagcaccggacagatcgaggacctcaaaattcacctcgattttaagcactcggcagacctgccccataagtgtagtgactgtcttatgcgttttgggaacgagcgggagttgattagtcacctacccgtgcatgagaccacatag

SEQ ID NO: 14545 - DNA, 867 bp, Artificial Sequence
  Description of Artificial Sequence: Synthetic coding sequence
atgaacgagtaccccaaaaaaagaaaacgcaagacgctccaccccagtagatattccgattcttctgggatcagccggattgctgacggctttaacggcatattttccgaccattgctactccgtgtgctccatgagacagccagacttgaagtactttgataataaggatgacgactcagatacagagacttctaacgacctcccaaagttcgccgatggcattaaggctcgtaaccggaaccagaactacctcgtaccctcgccagtgttgcggatccttgatcatacagccttttctacggagaagagcgctgacatcgttatttgcgacgaagagtgtgactcaccggaatcagtgaaccagcagacccaagaagagtcccccattgaggtacacaccgctgaagatgtccctatcgctgttgaagtgcatgcgatttccgaagactatgacattgaaactgaaaacaattcctccgaaagcctgcaggaccagaccgacgaggagcccccagcaaagctgtgcaagattctggataaatcccaagctctcaatgtgactgcccagcaaaagtggcctttgctcagagctaattcttcaggactctacaagtgtgaattgtgcgaattcaatagcaagtatttctctgacctgaagcagcacatgattctgaagcataagaggacggacagtaacgtgtgtagggtgtgcaaggaatctttctctacaaacatgttgctgattgaacacgctaagctgcatgaagaggacccatacatatgcaagtactgcgattataagacggtcatcttcgagaatctgagccagcacatcgcagatacacatttcagtgatcacctctag

SEQ ID NO: 14546 - DNA, 414 bp, Artificial Sequence
  Description of Artificial Sequence: Synthetic coding sequence
atgaacgagtaccccaagaaacggaagcgcaaaaccctccatccgagtaggtatagtgactccagtggcatctcgcgtattgcagatggcttcaatggcattttctcagaccattgttactccgtgtgtagcatgcgccaaccagacctgaaatatttcgataataaagacgacgactctgatactgaaacaagtaacgatcttcctaaattcgccgacggaattaaggcccgcaaccggaatcaaaattatctagttccttcacccgtcttacgcattctcgaccacacagcattctctacagaaaagagcgccgatatcgtgatatgcgacgaggaatgcgacagtcccgagtccgtcaaccaacaaacgcaggaggagtctcctattgaagtgcacaccgctgaggactag

SEQ ID NO: 14547 - DNA, 1458 bp, Artificial Sequence
  Description of Artificial Sequence: Synthetic coding sequence
atgaatgagtatcccaagaaacgaaagcgaaagactttacatccatcaagatacagcgatagttccggtatcagtcgaatcgcagacggttttaacgggatattctctgatcattgctattctgtgtgctctatgaggcagcctgacctgaagtacttcgacaataaagatgacgatagcgatacagagacctcgaatgatttacccaaattcgccgacggcattaaagcccggaatagaaaccaaaactatctggtcccaagtccagttctccggatattggatcatacggctttcagtacggaaaaatccgcagatatcgtgatttgcgatgaagaatgtgatagtcctgagtccgtaaaccaacagacgcaagaagaatctcctattgaggttcacacagccgaagatgtaccgatcgctgttgaagtgcacgctatctcagaggattatgacatcgagacagaaaataacagcagtgaatcgctccaagatcagactgatgaggaaccccctgccaaactgtgtaagatcctagacaagtcacaggcgctgaatgtgactgctcaacagaagtggccgcttctcagggccaacagctcaggcctctataaatgcgaactgtgtgagttcaactctaagtacttctcagacctcaaacaacacatgatcctgaaacacaagaggactgactctaatgtgtgtagggtgtgcaaagaatccttctccactaacatgctgctcattgagcacgccaaactgcatgaggaggacccttatatctgtaagtactgcgattataaaactgttatcttcgaaaacctgagccagcacattgccgatacacactttagcgatcatttatattggtgcgagcaatgtgacgtgcagttttcctcttcaagtgagctttacctccattttcaagagcactcatgtgatgaacagtatttgtgccagttttgcgagcatgagacaaatgaccctgaagaccttcactcacacgtggtcaatgagcatgcttgcaagctgattgagctctccgataaatacaataatggagagcatggccagtattccctgttatccaagattacttttgacaaatgcaagaatttcttcgtgtgccaggtgtgtggattccgctctcgactgcataccaatgtcaacagacacgtcgccatagaacataccaagattttcccacacgtgtgtgacgactgcggaaaggggttctcttcaatgctggaatattgcaagcatctaaatagtcacctgagcgaaggtatctatctatgccagtactgcgagtacagtacaggccagatcgaagatctcaagatacacctagactttaaacacagtgccgacttaccccacaaatgttctgattgtctcatgagattcgggaacgagcgcgagctgatctcacacctgccagtccatgagacaacctag

SEQ ID NO: 14548 - DNA, 651 bp, Artificial Sequence
  Description of Artificial Sequence: Synthetic coding sequence
atgaatgagtaccccaaaaaacgtaagcgtaagacactgcatcccagcagatattcggattcatccggaatttcacgtattgcagacggattcaatggtatcttctccgaccactgttacagtgtatgttccatgcggcagcccgatctaaagtacttcgacaacaaagatgacgattcagataccgagactagtaacgaccttcctaaatttgccgacggaatcaaagcgagaaataggaaccagaattacctggtaccttcaccggtgctgaggattctggatcacaccgctttctctacggagaagtctgcagacattgtgatatgtgacgaggaatgcgactctcccgaaagcgtgaaccagcagactcaggaagagagtcccatcgaagtgcacaccgcagaggatgtgcccatagctgtcgaagtgcacgctatcagtgaggactacgatatagagacagaaaataattctagtgagtctctgcaggaccaaacagacgaggaaccaccggcaaaactgtgtaaaattctggataagtcacaagctcttaacgtaacagcccaacagaagtggccgttgctgcgtgccaattcctcaggcttgtataagtgtgagctgtgcgagtttaacagtaagtacttctag

SEQ ID NO: 14549 - DNA, 393 bp, Artificial Sequence
  Description of Artificial Sequence: Synthetic coding sequence
atgaacgaataccctaagaaaaggaagagaaaaactctgcacccttccaggtactcggactcatctgggatctcacgcatagctgacgggttcaacggcattttcagcgaccattgttatagtgtctgtagtatgcgtcagcccgatctgaagtactttgacaacaaggatgatgattctgatactgaaactagcaacgatctgccaaaatttgccgacggaatcaaggcacggaaccggaaccagaactacctggtgcctagtccagtcttacgtatcctggaccataccgccttcagcaccgagaagtctgccgacatcgtcatctgtgacgaggagtgtgattccccggaaagtgtgaaccaacagacacaggaggagtctcccatctag

SEQ ID NO: 14550 - DNA, 1458 bp, Artificial Sequence
  Description of Artificial Sequence: Synthetic coding sequence
atgaacgaatatccaaagaagaggaagcggaagacactccacccttctcgttactctgattcctcaggcatttctcgcatagccgatggcttcaatggcatattcagcgatcattgttacagcgtgtgctccatgcgccaaccagacctcaagtatttcgataataaggacgacgattccgacacagaaacgtcgaacgatttgccaaaatttgcagacggaatcaaagctcgaaatcggaaccagaattacctggtgccaagcccagtcttgaggatcctcgatcacaccgccttctcaactgagaagagtgcagatatcgttatctgcgatgaagagtgcgactcaccagaatcagtcaaccagcagacccaggaggagtcccctatcgaagtgcataccgctgaggatgtacccatagctgtcgaggtccatgcaatctctgaggactacgatatcgagactgaaaataactctagtgaatcacttcaggatcagactgatgaagaaccacccgcaaaactttgtaaaatcctcgataagtctcaagctcttaatgtaaccgctcagcagaaatggccgcttctaagagctaattctagtggactgtacaaatgcgagctgtgtgaattcaacagcaaatacttttccgatctgaagcaacacatgatccttaaacataagcgcacggatagtaacgtgtgccgggtgtgtaaagagtctttttccacaaatatgttgctgattgagcacgcgaaactacatgaagaggacccctatatttgtaaatattgcgattataagaccgtgatttttgagaatctttcacaacacatcgccgacacgcacttctcagaccacctgtactggtgtgaacagtgcgacgtgcaattttcttccagctcagagctgtacctgcattttcaggagcacagctgcgatgaacagtatctgtgccagttctgcgaacatgagaccaatgatcccgaggatcttcactcccacgtggtgaatgagcacgcttgtaaactgatcgagctcagcgacaagtataacaacggagaacatgggcaatactcactcctgtctaaaatcacgttcgacaaatgtaaaaatttctttgtttgccaggtgtgtggctttcggagccggctccacacaaacgtcaacagacatgtggccattgaacacaccaagatcttcccacacgtctgcgacgactgcggcaagggattttcttccatgctggagtattgcaagcatttaaattcacatctatccgagggtatttacctgtgtcaatattgtgagtactcgaccggacagattgaagatttaaagattcatttggacttcaagcactcagcggacctcccacacaaatgttcagattgcctgatgaggtttggcaacgaacgcgaactgatttcgcatctgccggttcacgagaccacctag

SEQ ID NO: 14551 - DNA, 1113 bp, Artificial Sequence
  Description of Artificial Sequence: Synthetic coding sequence
atggccgcagagcggcaagaagccctgagagagttcgtcgcagtgactggagcagaggaagacagggctagattttttctcgaatcagctgggtgggacttgcagatcgctttggcatcgttttatgaagacggaggcgatgaagatatagttactatctcacaggctaccccatcaagtgtgagccgggggacagccccttccgataaccgggttacctccttcagggatttgatccacgaccaggatgaagacgaggaagaggaagagggccagagattttacgcaggcgggagtgaaagaagtgggcagcagatcgtcgggccgccccggaagaaatctcccaatgagcttgtggatgacctgttcaaaggagcaaaggagcacggcgccgttgccgttgaacgggtcacaaagagtccaggcgaaacaagcaaacccagacccttcgcaggcggagggtatcggttgggagctgccccagaggaggagagtgcttatgtggccggtgaaaaaaggcagcactcgtctcaggatgtgcatgtggtcctaaagctctggaagtcagggttctcactcgacaacggagaacttcgttcctatcaggacccctctaatgctcaatttttagaaagtataagaagaggagaggttcctgccgagttaagaaggctggcgcacggtgggcaggtcaaccttgatatggaagaccacagggatgaagattttgtgaagccaaagggagctttcaaagcgttcacaggagagggccaaaagttgggttctactgccccccaggtgctgtctacttccagccccgctcaacaggctgagaatgaggccaaggcttcctcgagcatcctcatcgacgagtccgagccaaccactaacatccagataagattagcggacggcggtaggttggtgcagaagttcaatcattcgcaccgaatttctgatataaggctgtttatcgtagacgcacgcccagcaatggctgctacgagcttcatccttatgacaacttttcctaataaagagcttgcagatgaatcccaaacactcaaggaggccaatctgctgaacgccgtcatcgtacagagacttacgtag

SEQ ID NO: 14552 - DNA, 1884 bp, Artificial Sequence
  Description of Artificial Sequence: Synthetic coding sequence
atgaatgcatcttccgaaggggaaagctttgcagggagcgttcagataccggggggtactaccgtgctggttgagttgacacctgatattcatatttgcgggatctgtaagcagcagtttaataatctcgacgctttcgtggcccacaagcagtctggatgccaactgactggcacatctgctgccgcaccctctaccgtgcagtttgtaagcgaggaaaccgtcccagctactcagacgcagaccactacaaggactatcacgtccgagacacagacaatcactggctgtcagttcaagacagcgtatggcatgaaggatatggaaagacacctaaagattcacacaggcgataagcctcataaatgcgaagtctgcggcaagtgtttctcccggaaggataagttaaagacccatatgaggtgccacacgggtgtgaagccttacaagtgtaagacttgtgactacgccgcggctgatagtagttcactgaacaagcacctgcggatccattcagacgaaagacctttcaagtgccagatatgcccttacgcatctcggaacagttcacagctaaccgtccacctaagatcccacaccggggacgcaccctttcagtgttggctctgttccgcaaagttcaaaatttcatccgatctgaaaaggcacatgcgggttcactctggcgagaaaccgttcaagtgcgaattctgtaatgtgaggtgtactatgaaaggtaacctcaaatcacacatccggattaaacattcaggaaataacttcaagtgccctcactgcgattttctgggggactccaaggccactctcaggaaacattctagggtccatcaaagcgagcacccagagaagtgttctgagtgtagctatagctgttcgtccaaggcagctttgcgcattcacgagagaatacactgtacggatagaccattcaagtgtaactattgctccttcgacactaaacagccatctaatcttagtaaacacatgaagaaatttcacggcgacatggtaaagaccgaggccctggagcggaaggacaccggccgtcagagcagtagacaagtcgcgaagctggacgctaagaagtccttccactgtgacatttgcgacgcctcctttatgcgcgaggacagcttgcgctcacacaaacgtcaacattctgagtacagcgaatcaaaaaattcagatgtaaccgttctgcagtttcagatagacccttccaagcaacctgcaacccccttaacggtaggacatctgcaggttcccctccagccatctcaagtgccccaattcagtgagggaagagtgaaaattattgttggacaccaggtcccgcaggctaatactatcgtccaagccgcagctgcagctgtcaacatcgtgccacccgcactggttgcacagaaccccgaggaactgcctggtaattctcgcctccagattctccgccaagtgtcgctgattgcaccaccacagtcctctaggtgcccttctgaagcaggggctatgacacagccagcggtcctgctcaccacacatgagcagactgatggggccaccttacaccaaactctcattcctaccgcaagtgggggtccccaggaggggagcggcaatcaaacgttcattacatcctccggaatcacctgcacagatttcgaagggctgaacgctctgatccaggagggcaccgcggaggtgacagtggttagcgacggagggcagaatattgctgttgcgactaccgctccgccagtgttctcatcatctagccagcaggagctacccaagcagacatatagcattatccagggagccgcccatcctgccctgctgtgtcccgcagattcaatccctgattag

SEQ ID NO: 14553 - DNA, 1938 bp, Artificial Sequence
  Description of Artificial Sequence: Synthetic coding sequence
atgaacgcctcaagcgagggggaatcgtttgcggggtccgtgcaaatacccgggggcacaacagttctggttgaacttacccctgacatacatatctgtgggatttgcaaacaacagttcaataatctcgacgcttttgttgcccataagcagagtgggtgccaattaactggaacatctgccgccgctccatctacggttcagttcgtatcagaagagacagtgcctgcaactcagacgcagaccactactagaaccatcacttccgaaacacagactatcacagtttccgctccggaattcgtttttgagcatggctaccagacttatttgcccactgaaagcaatgaaaatcagaccgcaaccgttatctcacttcccgccaagtcccgaactaagaagcctacgaccccgcctgcacagaagagattaaattgctgttatcctggatgccagtttaagacggcctacggtatgaaggacatggagaggcacctgaagatccacaccggcgacaaaccccacaagtgcgaggtctgcgggaagtgtttcagtagaaaggacaagctgaagactcatatgcggtgtcacacaggcgtcaagccctacaaatgtaaaacttgtgattacgccgcggctgatagctcctcactcaacaaacatctccgcattcactccgacgaacgacctttcaagtgccagatctgcccgtacgcatccaggaatagctcccagctcactgtacatttacgtagccatacagcctcagagctggatgacgacgtgcccaaggccaactgtctgagtaccgaaagtacggacacaccgaaggcaccggtcattactttgcccagtgaggcccgggagcaaatggccactctgggggagcgcacattcaattgctgctatcccggctgtcatttcaaaaccgtacacggcatgaaagatctggacaggcatttacgcatacataccggtgataagccacacaaatgtgagttttgcgacaagtgctttagcagaaaggacaatctcactatgcacatgcggtgccatacctctgtgaaacctcataagtgccatctttgtgattatgcagccgttgactcttcaagtcttaaaaaacacctgagaatccacagtgacgagcggccatacaaatgtcagctctgtccctatgctagccgcaactcttctcaattgactgtacatttgcgatcgcatacaggggacacaccgtttcagtgctggttatgtagtgccaaattcaagattagttctgatcttaagcgacacatgattgttcatagcggggagaagcccttcaaatgcgaattttgtgatgtccggtgcactatgaaagcaaacttgaagtcccatattcggattaaacacacattcaagtgtcttcattgcgctttccagggacgggatcgggcagacctgctcgaacacagtcggctccatcaggcggatcatccagaaaaatgccctgaatgcagttactcttgcagttctgccgccgcactgcgcgttcactcacgcgtccactgcaaggatcgcccattcaagtgtgatttctgttcatttgataccaagaggccctcgtcactcgcaaagcacgtggacaaagtgcacagagacgaagccaaaaccgagaaccgcgccccgctggggaaagaggggctgcgggaggggagctcccaacacgtcgctaagattgtcacccagcgcgcattcagatgcgagacttgtggagcttctttcgtgcgcgacgattcgctgaggtgtcataaaaagcagcatagtgatcagtcagagaacaagaacagcgacctagtcacattcccccccgagagcggtgcaagcgggcagctgtctacactggtgtcggtgggacaactagaggcacccttagagccctcccaggacctctag

SEQ ID NO: 14554 - DNA, 2040 bp, Artificial Sequence
  Description of Artificial Sequence: Synthetic coding sequence
atgaacgcttcaagcgagggggagtcttttgccgggagtgttcagtcaggtacgaccgtgcttgtcgaactgactcccgacattcacatatgtggcatttgcaaacagcagtttaacaacctggacgcattcgtagcccacaaacaatccggatgtcaacttacaggtacctcagccgccgcccccagcacagtgcagttcgtgtctgaagagaccgtcccggctacccagactcagactaccacccgcacaatcactagcgagacacagaccatcactgtctctgctcccgagtttgtgtttgagcatggatatcaaacatacctacccacagagtcaaacgagaaccaaacagcaacagtgatctcgttgccagccaagtccaggaccaaaaagcctaccaccccccctgcccagaagcggttaaactgttgctacccaggctgtcagtttaaaactgcttatgggatgaaggatatggagaggcacttaaagatccacaccggagataaaccccataaatgtgaggtctgcggcaaatgctttagtcgaaaagataagctcaaaacacacatgcgctgtcacacgggcgtgaaaccctacaagtgcaagacgtgcgactacgcagcggccgatagctcaagcctgaataaacacctcaggattcacagcgacgagcgcccttttaaatgtcagatatgcccctacgccagcaggaactcgtcgcaattaactgtacatctgcgctctcacactggcgatgcaccatttcagtgctggctttgttcagccaagttcaaaatttcctccgatctgaagagacatatgcgagtgcattcgggcgaaaagccattcaaatgcgagttttgcaacgtgcgctgtactatgaaaggcaatcttaagtcgcacatccgtattaagcactccggtaataattttaaatgtcctcattgtgatttccttggagattcaaaggcaacactcagaaaacactctcgggtacatcagagcgagcacccagaaaaatgcagcgagtgcagctactcatgctccagcaaggcagctcttaggattcacgaaagaatacattgtacagatcggccattcaaatgcaactactgctccttcgacaccaagcagccttctaatctgtctaagcatatgaaaaaattccacggtgacatggtcaaaactgaggcgctggagaggaaggatacgggccgccagtctagtaggcaggtggcgaagctcgacgccaagaaaagtttccactgtgacatctgcgacgcctcatttatgagggaagactccctgagaagtcacaaaagacagcactcggagtattctgagtcaaaaaactcggatgtcactgtcctccagtttcagatcgatccaagtaagcagcccgcaacccctctaacagtcgggcatctgcaggtgcccttgcagcccagtcaggtgccccagttcagtgagggaagggttaagataatcgttggccaccaggtccctcaagcgaatactattgtccaggccgccgccgctgccgtaaatatcgtgccacctgccctagtagctcagaatcccgaggaactgcctgggaacagtcggctccagatactaaggcaggtgagcctgattgctccacctcaatcctccaggtgtccctctgaggccggggcaatgacacagccggcagtgctgctgacaacgcacgaacagactgacggagcaacacttcaccagactctgattcccaccgcgtcaggtggcccacaggaggggagcggaaatcagacgttcataacaagctctggaatcacatgcactgatttcgagggccttaacgctctgattcaggaaggtactgccgaggtcacagtcgtctcagatggcgggcagaatatcgcggtggctacaaccgctccgccggtgttttccagcagctcccagcaggaactccccaagcaaacctattccatcattcagggcgcagcccaccctgctttactttgccccgccgactccatccccgattag

SEQ ID NO: 14555 - DNA, 1932 bp, Artificial Sequence
  Description of Artificial Sequence: Synthetic coding sequence
atgaacgcaagtagtgaaggggaatcatttgcaggatcagttcagattcccggcgggacaacagtgcttgtagagttgactccagatattcatatctgcggtatttgcaagcagcagtttaacaacttggatgcctttgtggctcacaagcagtcggggtgccaattgactggaaccagcgccgcagcaccttcgacagtccagtttgtgagcgaagaaacggtacctgctacccagacacaaactacgacccggaccatcactagtgagacccagaccatcacagtgagcgcaccagaatttgtgtttgaacatgggtaccaaacttacctgcccaccgagtccaacgagaatcagaccgccaccgtcatctcactccctgcgaaatctaggaccaaaaagcctacaacaccccccgcccagaagcggcttaactgttgttaccctggcaaaggttcaattatgtcttatctgtgcagggggttgggacgttacccaagcgaaatcatctccgacgtccagaagtcatgcaagaattgcaccaagaagaactcgccaaacgtcacgattcttctctatttgctgtgtcacagcctgtatatttacaagctgctgcagtgcgtctttccaaagaaccagaatatcctgcttaacaaccaccgaaccatcatcaagtccgacttcgtgattaagtgccactttatgtccttcatctcctccaaccaggagcaactgtctatatatctttcctttaggttgtgctccttcggccgaaatcataagatgaccgtgtgtttctctcggtcgagccatatctttcctattactgtggtcctgacgcttgtgacgtggctccgtatgtttttgcctgtgttttcaatgctgaaactgtctttcttttttcttggatgccagtttaagaccgcttacggcatgaaagacatggagcgccacctgaaaatccatactggcgacaagccgcacaagtgtgaggtctgcggcaaatgtttctctcggaaagataaactgaaaacacatatgcgctgccacactggagttaagccatataagtgcaagacctgcgattacgctgcagctgactcttcctcgctaaacaagcacctcagaatccattcagacgaaagacccttcaaatgtcaaatctgtccctacgctagccggaattcatctcaactcacagtgcacttaaggtcacataccggcgatgccccgttccaatgctggttgtgtagtgccaaatttaagatctcaagcgatctaaaacggcatatgcgtgtccattcaggagaaaagccctttaaatgtgagttctgtaatgtgaggtgcacaatgaaagggaacctgaaaagccacatcagaattaagcactctggcaacaacttcaagtgcccgcactgtgacttcctcggggacagcaaagccactctgcgcaaacatagtagggtgcaccaaagcgagcaccccgaaaaatgttctgagtgctcatactcttgcagcagcaaggctgcactcaggatccatgagcggattcactgtacagatcgcccattcaagtgtaattattgcagctttgacacaaagcagccttccaacttgtctaaacatatgaaaaaatttcacggggatatggtcaaaaccgaggcactagagagaaaagacaccggcaggcagtccagtagacaggtcgcaaagctggacgcaaagaagtcgtttcactgtgacatttgtgatgcctccttcatgagggaggattccttgagaagccataagagacagcactccgagtacagtgaaagcaagaattccgatgtcacagttctgcagttccagatagaccctagcaagcagccagcaacacctctgactgtgggccatctacaggtcccgctgcagccctctcaggttccgtag

SEQ ID NO: 14556 - DNA, 1281 bp, Artificial Sequence
  Description of Artificial Sequence: Synthetic coding sequence
atgtccagaagaaagcaggccaagcctcagcacctgaacagcgaagagcctcgacctgcgaggagggagtgtgccgaagtggcaccccaggtcgctggggagcctgcgtccgagctggatgatgatgtgcctaaggccaattgtctctcaacggaatctacagacacccccaaagcccccgttataacacttcctagcgaggcccgggagcagatggctaccttgggcgagagaacttttaactgttgttaccccggatgtcattttaagacggtgcatgggatgaaggacctggaccggcacctgcgcatacacacgggcgacaagcctcacaaatgcgaattctgcgacaagtgtttctcgcggaaagacaaccttactatgcacatgcgttgccacaccagtgtgaagccccacaaatgccacttgtgcgattatgctgcagtggattcatctagtctgaagaagcatttacgtatccacagcgatgaacgcccctataaatgtcagctgtgtccttatgcgagcagaaatagctcccagctcacagtgcacctacgaagccacacaggcgatacaccattccagtgttggctgtgctccgccaaatttaaaatcagcagcgacctgaagaggcacatgattgtgcactccggagagaagccgttcaagtgtgagttctgtgacgtccgttgcacaatgaaggctaacctaaagagccacatccggatcaaacacaccttcaaatgcctgcactgtgcatttcagggcagagacagagccgatctgcttgagcactcaagactccaccaggccgatcatcccgagaaatgccccgaatgtagctatagctgttcatccgcagctgccctccgagtgcactcccgcgtccactgtaaggacaggccctttaagtgcgacttttgtagtttcgacaccaaacgaccttcaagcctcgccaagcatgtggataaagtccacagagatgaggctaagacagagaatcgagccccactgggcaaagaaggactcagggagggtagtagccagcatgttgcaaagattgtcacacagcgtgccttccgatgcgagacatgcggcgcttcctttgtaagggacgatagcctgagatgtcacaagaaacagcatagtgaccagtccgaaaataaaaatagtgatctggtgactttcccaccagagtcgggggcgtcgggacagcttagtactctggtgagcgtcggacagctggaggctcctctggaacctagccaggatctgtag

SEQ ID NO: 14557 - DNA, 396 bp, Artificial Sequence
  Description of Artificial Sequence: Synthetic coding sequence
atgagggggcaccccagccttaggccgccctggcactgggccagcgctgctagactcgagggagggtttctgccctgggggtatgtttcaaacgccctcagcagagaagggctgactgaggaacggacattcgaaaggcgtcccgaaggatgggaaggagcctcatgtgctgcttctgaactggacgacgatgtccccaaggcaaattgcttatccaccgagagcacagacactccaaaagccccagttatcacactcccgtctgaggcacgggaacaaatggctacactcggcgaaagaacttttaattgctgctatcctgggtgtcactttaagacagtacacggcatgaaggatctagaccgtcatctccggattcacacggcgagttgctag

SEQ ID NO: 14558 - DNA, 666 bp, Artificial Sequence
  Description of Artificial Sequence: Synthetic coding sequence
atgagagggcacccgagcctgagacccccgtggcactgggcatccgctgcaaggctggaaggcggctttctgccatgggggtatgtgtccaatgccctctcacgcgagggacttaccgaggaacgcacctttgagaggagacctgaaggttgggaaggagccagctgtgcagcgtcggagctggatgacgacgtgccaaaggccaactgtctctctaccgaatctaccgacacccctaaggccccggtgattaccctgccttctgaggcacgggaacagatggccacactcggggagcgaacctttaactgttgctatcccgggtgtcacttcaaaacggtccacggaatgaaagacctggaccgccacttgcgcatccacaccggggataagccgcacaagtgtgagttttgtgataagtgtttttccaggaaggataatttaacaatgcacatgcgctgtcacacgagcgtgaagccacataaatgtcacctctgcgactatgccgccgttgacagttcaagccttaaaaaacacctccgcatccacagcgatgaacgaccgtacaaatgtcagctttgtccatacgcttctaggaactcttcccagctcaccgtgcatctgcgcagtcacactggtgacaccccctttcagtgctggttatag

SEQ ID NO: 14559 - DNA, 363 bp, Artificial Sequence
  Description of Artificial Sequence: Synthetic coding sequence
taggagagaaccttcaactgctgttacccgggatgccatttcaaaaccgtgcacggaatgaaggaccttgatcgccatttgagaatccacaccggcgataagccccataaatgcgagttctgcgacaaatgtttcagcaggaaagacaatctgaccatgcatatgcggtgccacacctccgtgaagccacataagtgccacctctgcgattatgcagccgtggatagctccagtttgaagaagcatttaaggatccattctgacgaaagaccatacaagtgccagctctgcccatacgcatccaggaactctagtcagttgactgttcatctgcgatcacacacagggcctggtcccggctag

SEQ ID NO: 14560 - DNA, 1572 bp, Artificial Sequence
  Description of Artificial Sequence: Synthetic coding sequence
atgaaagatatggagcggcatctgaagatccatactggagataaacctcataagtgcgaagtgtgcggcaagtgcttctcaagaaaggataagctcaagactcacatgcgctgtcacactggagtcaagccctacaaatgtaagacatgcgattatgccgccgcggacagtagcagcctcaataagcatcttaggatccattcggacgagaggccattcaaatgtcaaatctgtccttacgcatctcgtaattcgagtcagttaacagtccatctacggtcccatacaggagatgcgcctttccaatgctggctgtgctcggctaagtttaagatctcttccgacttgaaacgccacatgcgagtccactcgggggaaaagcccttcaagtgcgaattctgtaacgtcagatgcacaatgaagggtaatctgaagtcccatattagaattaagcacagcggaaacaattttaagtgcccacactgtgactttctcggggatagtaaggcaaccctccggaaacactcgcgcgtccaccaaagtgaacatcccgaaaaatgttcagaatgctcttacagctgtagcagcaaggccgcccttaggattcacgagcgtattcactgcacagatagacccttcaaatgcaactactgtagcttcgacacaaagcagcccagcaatcttagtaaacacatgaagaaattccatggcgacatggttaagactgaggccctagaacgcaaggatactggtcgccagtccagcaggcaggtggcaaagctggatgccaagaagtcttttcattgcgacatctgtgatgcttccttcatgagagaagattcactcagatcacataagcgacaacacagcgagtatagcgagtcaaaaaactcggacgtgacagtccttcagtttcagatagatccttccaaacagccagccacacccctcacagtggggcatctgcaggtgccactgcaacccagccaggtcccacagttctctgagggccgcgtcaagataatcgtgggtcatcaagtccctcaggcgaacactattgttcaggcagccgctgcagcggtaaatatcgttcctcctgcccttgttgcacagaaccccgaggagctgcctggcaactcacgcctgcagattttacgccaggtgtccttgatcgctcccccccaatcgagtcgctgcccctctgaggctggggcaatgacccaacccgcggttttgctgaccacacatgagcagactgatggagccactctgcatcagacactaatccccacagccagtgggggcccccaagaaggctcaggaaatcagactttcataacatcatctggaatcacatgcaccgatttcgaaggtctgaatgcgctcatacaggaagggacggccgaagtaaccgttgtttccgacggcgggcagaacatagccgtggccacaacagccccccccgttttctcctcttcgtcccagcaggagttgccgaagcagacttattccattatccagggggctgcccatccagctctcctgtgccccgccgactcgatcccagattag

SEQ ID NO: 14561 - DNA, 1581 bp, Artificial Sequence
  Description of Artificial Sequence: Synthetic coding sequence
atgccacagcagcttctaataacgctgccaaccgaggcttcgacttgggtgaagctccagcatcccaaaaaggctgtcgaaggtgcgcccctgtgggaagacgtcaccaagatgtttgagggggaggctttgctatcgcaggatgcagaagatgtcaaaacccaaagggagtcacttgaggacgaggtcactccaggattgccgactgctgaatctcaggagctgctgacgtttaaggatatttcaattgactttacacaggaggagtggggtcaactggcaccagcccaccagaacctgtaccgagaggtaatgctcgagaactactccaacctggtgagcgtggggtatcagctgagcaagccatcagttatctcccagctggaaaaaggcgaagagccctggatggcagagaaagaaggaccaggggaccctagctcggatctgaagtccaagattgagaccattgagagtacagcaaagagtacgatttctcaggaaaggctgtaccacggaataatgatggagtccttcatgagggacgatatcatctactcgaccctgagaaaagtctctacttatgacgatgttctggaacgtcaccaggagacatgtatgcgagatgttcgccaagcaatcctgacacataaaaagcgggtgcaagaaaccaacaaatttggagagaacataatagtacactctaacgtgattatcgaacagcggcaccataaatacgacacgccaacaaaacggaacacgtacaagctggatcttatcaaccatcctacatcctatatcagaactaaaacctacgagtgcaacatttgcgagaagatctttaaacaacctatccatcttaccgaacacatgcgcattcacactggcgagaagccatttcgctgtaaggagtgcggaagggcctttagccagagcgcttccctgtccacgcaccaacggatccatacgggcgaaaaaccatttgaatgcgaggagtgtggaaaagctttccggcaccgatcgagtctgaaccagcatcataggacacacacaggagaaaagccatatgtctgtgacaagtgccagaaagccttttcacaaaacatttcactggtgcagcacctccgcacccacagcggcgaaaagccattcacgtgcaacgaatgcggcaagacatttagacagattcggcatctcagtgagcatattcggattcatactggggagaagccgtacgcctgcacggcttgttgtaagactttttctcacagagcttacctcactcatcatcagaggatccacacaggcgagcgcccttacaagtgtaaagaatgtggaaaggcctttaggcagcggatccacctgtccaaccataagacagtccataccggtgtcaaagcatatgaatgcaataggtgcggcaaagcctaccgtcacgatagctcattcaaaaaacaccaacggcaccacacgggggagaagccttatgaatgtaacgaatgtggaaaggcatttagctacaactcttccctaagtaggcaccacgagatccacagaaggaatgcgtttagaaataaagtgtag

SEQ ID NO: 14562 - DNA, 1581 bp, Artificial Sequence
  Description of Artificial Sequence: Synthetic coding sequence
atgcctcagcagctgctgattaccctgccaaccgaggcaagcacctgggttaagttgcagcatcctaagaaggccgttgagggggcccctctgtgggaggatgtgactaagatgttcgagggcgaggccctgttgagccaggatgccgaggatgtgaagacacagcgcgagtccttggaagatgaggtgaccccgggactccctaccgccgagtcccaggagctgctcacattcaaggacattagcatcgattttacccaggaggagtggggccaactggcaccggcccaccagaacctgtatagagaggtgatgttagagaactattccaacctcgtctccgtaggataccagctgtcaaagccttccgtcatttcccagctcgagaagggagaagagccatggatggccgagaaggaaggacccggagaccccagttcagatctaaagtcaaaaatagagactatcgagagcactgccaaatcgactatctcccaagaaagactgtaccacgggatcatgatggaaagctttatgcgggacgatataatatattccacactccgcaaagtaagtacatacgacgacgtgctggagcgccaccaggaaacttgtatgcgagacgtgaggcaggccatcctgacccataaaaagcgcgtgcaggagaccaacaagttcggcgaaaacataattgtgcatagcaacgtcattatcgaacaaagacaccacaagtatgacactcccacaaaacgcaatacatataagctggacctgattaaccaccctaccagttatatccgcactaagacctacgaatgtaacatctgtgagaaaatctttaagcaacctattcacctaaccgagcatatgaggatacatacaggggaaaaacccttcagatgtaaagagtgtggcagagccttctcccagtccgcttcactgagcacccaccagcgcatccacacaggggaaaagccttttgaatgcgaggagtgcggcaaggcattccggcacagaagctcgttaaatcagcaccatcgcacccataccggcgagaaaccatacgtgtgcgacaagtgccaaaaagcattttcccaaaacatctccttagtccaacatctgcgcactcacagtggtgagaagccctttacctgtaacgagtgtggaaagacctttagacaaatccgacatttgagtgagcatatccgaatccatacgggagaaaaaccgtacgcctgtaccgcctgttgtaagaccttctctcatagagcctatctcacacaccatcaaagaatccatactggggagagaccctacaagtgtaaggagtgtgggaaggctttccgacagcgtatccacctgtcgaaccacaaaaccgtgcacactggcgtaaaggcttacgaatgcaacagatgcggcaaagcatacagacatgattcctctttcaagaagcatcagcgccatcatacaggagagaaaccatatgagtgcaatgagtgcggcaaagccttttcatacaatagcagcctgtcaagacatcatgagatccatcggaggaatgcatttagaaataaggtgtag

SEQ ID NO: 14563 - DNA, 1299 bp, Artificial Sequence
  Description of Artificial Sequence: Synthetic coding sequence
atgctcgagaattacggcaacctagtgtcggtgggttgtcagttgagcaaacctggggtgatttctcagctcgaaaaaggggaagaaccgtggcttatggagcgtgacatcagtggggtaccttcttccgatctcaaaagcaaaactaagacgaaagaaagcgccctgcaaaatgatatcagctgggaggagttgcactgcggcctaatgatggagaggttcactaagggctcatctatgtacagcaccttgggcagaattagtaaatgtaataagctggaatcccagcaggaaaaccagagaatgggaaaaggccagatccccttgatgtgcaagaagacatttacacaggagagaggccaggagagcaacagatttgagaaaaggattaatgtcaagtcggaagtcatgccaggacccatcggtctgccccgaaaaagagatcgaaaatatgacactcccggcaaacggtctcgctacaatatcgatcttgtcaatcatagcaggagctacactaagatgaagacctttgaatgtaacatatgcgagaaaatttttaaacaactgattcacctgaccgaacatatgcgcattcatacgggcgagaaacctttccggtgtaaggaatgtggaaaggcgttctcacaatcctcttccctgattccacatcaacggatccatacaggagagaagccttacgagtgcaaagagtgcggcaagacctttagacatccttcctcattgacgcagcacgtgcgcatccacactggtgagaagccatatgagtgcagagtgtgcgagaaggcatttagccaaagcattgggctcatacaacatctcaggacgcacgtgcgagagaagcctttcacctgcaaggattgcggcaaagctttctttcagattcggcaccttcgtcagcacgagataatccatactggagtaaagccctatatctgcaacgtgtgttctaaaaccttttcacactccacatatctaacacaacaccagaggacccataccggcgagcggccgtacaaatgtaaagagtgtgggaaggctttctcccagcgtatccacctatcaatacaccagcgcgtgcacactggcgtgaagccctacgagtgttcacattgcgggaaggcctttagacacgactcttcttttgccaagcaccagagaattcacacgggggaaaaaccatacgattgtaatgagtgtggtaaagcgttttcctgttcatccagcctgattagacattgtaagactcatctcagaaacacattcagcaacgtcgtgtag

SEQ ID NO: 14564 - DNA, 1605 bp, Artificial Sequence
  Description of Artificial Sequence: Synthetic coding sequence
atgcttcagcagctactgataacgctgccaacagaagcatctacatgggtgaaattgcggcaccccaaggctgctacggaaagagtcgccctgtgggaggatgtgactaagatgttcaaagctgaagcactgctcagccaggacgctgatgaaacccagggggagagcctcgagtccagggttacattgggaagtctaaccgcggaatcacaggagctcctcaccttcaaagacgtgtccgtcgacttcacccaggaggagtggggccagctggcccccgcccaccggaatctgtatcgtgaagtgatgcttgagaattatgggaatctggtgagcgtaggatgccagttgagcaaacctggggtgatatcccagctcgaaaaaggagaagagccttggttaatggaaagggatatttcaggggtccctagcagcgacttgaaaagcaaaacgaagacaaaagaaagcgccctccagaacgacatcagctgggaagaactccattgcggcctgatgatggagcggttcaccaaaggcagctctatgtacagcactctagggcggatctccaaatgcaacaaattggagtcccagcaggaaaatcagaggatggggaagggccaaattcccctaatgtgcaaaaaaacttttacccaggaaagaggccaggagtctaaccgtttcgaaaagagaattaatgtaaagtcagaggttatgccagggccaatagggcttccccggaagagagatcgtaagtacgatacccctgggaagcgcagtagatataatatagacctggttaaccattccagaagctacaccaaaatgaaaacgttcgaatgtaacatttgcgaaaagattttcaaacagttgatacatctgaccgaacatatgagaatccataccggcgaaaaaccatttagatgcaaggagtgcgggaaggctttctctcagagctctagcttgataccacaccaacggatccacaccggggagaagccgtacgaatgtaaggagtgcgggaaaacattccggcatccctcctcactgactcagcacgtgaggatccataccggcgaaaagccttacgaatgccgtgtgtgcgagaaagctttctctcagagcatcggtctgattcaacacctgcgcactcatgtgcgcgagaaacctttcacatgcaaggactgcggcaaggccttctttcagatcagacatctgcgccaacacgagatcatccataccggcgtgaagccctacatctgcaatgtgtgtagcaagacttttagccattcaacatacctgacccagcaccagcggacccacacgggtgagcggccatacaagtgtaaagaatgtggtaaagcgttcagccagaggatccacttgtctatccaccagagggtgcacactggagtgaagccatacgagtgctctcactgcgggaaggccttcaggcacgattcctcattcgccaaacatcaaaggatacacactggggaaaagccttatgactgcaatgaatgcgggaaggctttctcgtgctcttcttcgctcattcgtcactgtaaaacacatttaaggaatacattttcaaacgtcgtgtag

SEQ ID NO: 14565 - DNA, 1398 bp, Artificial Sequence
  Description of Artificial Sequence: Synthetic coding sequence
atgcttttctctgcccttttttttctgctgtactctgccttttttcggcgtcccgagtaccagcgtacaatattcaaatttctgggttggctttgtgatctttctatatactcactattctttcctatttctaggatgtccgccttccagacatggcgcgatttccccgtcggagaaagaagaaggccctggctgatggaaagggatatttcaggagttccttcatccgatctgaaatctaaaacaaagacaaaagaatcggccctccagaacgatatctcttgggaagagttgcactgtggattgatgatggaaaggttcacaaagggctcctcaatgtatagcactctcggcaggatcagtaaatgtaataagctggagtctcaacaggaaaaccagaggatgggaaagggccagattccactgatgtgcaaaaagacttttacccaagaacgggggcaagaatccaatcgattcgaaaagagaattaacgtgaagagcgaagttatgcctggaccaattgggctgccgagaaaaagagatcgcaagtacgacacccctgggaaacgctctcggtacaatatcgaccttgtgaatcatagccgcagttatacaaagatgaagacgttcgaatgtaatatatgtgagaagatattcaagcaattgatccacctcactgagcacatgcgtattcatacaggcgagaaaccttttagatgtaaagagtgcgggaaggctttttcccagagctcctccctcattccgcatcagagaattcacaccggcgaaaaaccctacgagtgtaaggagtgcggaaagacctttagacacccctccagcttgacgcagcacgtcagaatacatactggggagaaaccatatgagtgccgcgtctgtgaaaaggccttcagtcaatctattggtctcattcaacatctccgcacacatgtgcgggagaagccctttacatgcaaagattgcgggaaggccttttttcaaattcgccacctgcgtcaacacgagatcatccataccggcgtcaagccatacatctgcaatgtctgcagcaagacattctcccactcaacctatctaacccagcaccagcgtacccataccggcgagagaccctacaagtgtaaagagtgcgggaaagctttctctcagcgcatacacctgagcatccatcagagggtccacaccggggtaaagccgtacgaatgctcacattgtggaaaggcgttcagacacgactcgagctttgcgaagcaccaaaggattcacactggcgagaagccatatgattgcaacgaatgcggtaaggctttctcatgctcaagctccctgatccgccactgcaagacacacctgcgcaacaccttcagcaacgttgtgtag

SEQ ID NO: 14566 - DNA, 5499 bp, Artificial Sequence
  Description of Artificial Sequence: Synthetic coding sequence
atggaggatactcccccctctctttcctgttctgattgccagcggcatttccccagcttgcccgagttatcacgccatagggaactcctgcatccctcaccaaatcaggactccgaagaagctgactccatcccacgcccttatagatgccagcaatgcggtcgggggtatcgacaccccggatcgttagtcaatcacaggcggacccatgaaacaggcctgttcccatgtacgacttgtggaaaggacttcagcaatccgatggccctcaaaagccacatgcgaacccatgcgcctgagggaagacgccggcatagaccaccgcggccaaaagaagccacaccacacctgcagggggaaacagtgtcaacagattcttgggggcaaaggctcggcagcagcgaaggttgggagaatcagactaagcacaccgaggaaactcccgactgtgaaagcgtacccgacccgcgcgctgcatccggaacctgggaggacttacccacacggcagcgggaggggttggcgagtcaccctggaccagaagacggcgctgacgggtgggggccaagcactaactccgcacgggctccgccactgcccatacctgcatctagcctactgtccaatctcgaacagtacttggccgaatcagtagtcaacttcacaggcggccaggaaccaacacaaagccctcccgctgaggaggagaggcgttataagtgcagccagtgcgggaagacctacaaacacgccggcagcctgacaaaccaccgacagagccacactctgggaatatatccctgcgccatttgctttaaagagttctcaaatttgatggctttaaagaatcatagtaggctgcatgcgcagtatcgaccctatcattgtccccactgtccacgtgtattcagattgcccagggagttgctggaacaccaacaatctcatgagggggagagacaagagcctcgatgggaagagaagggcatgcccacaactaatgggcacactgatgaaagcagtcaagaccagctcccgtcagcacagatgctgaacggctccgccgagctcagtacatcaggtgaactcgaagacagtggcctggaggagtatagaccgtttagatgcggagactgcggccgtacataccgccatgccggctccctgatcaaccaccgcaaaagccaccagactggggtatacccctgttccctgtgctccaagcagttgtttaacgcagctgctctgaagaatcatgtgagggcccaccacagaccccggcagggagtaggcgaaaatggccagcccagcgtcccccctgcacccctgctgcttgcagaaactacacacaaggaggaagaggatccaacaactactttagatcacagaccttacaaatgctccgagtgcgggagggcctatcgccataggggcagtctggttaaccaccgccattcacatcggaccggtgagtaccagtgctcactgtgtcctcggaagtatccaaatctaatggcactcagaaatcacgtaagggttcactgtaaagccgcccggcgctctgccgacatcggtgccgagggtgcaccatcacacctgaaagtcgaactgccccccgaccctgtggaggcagaagcagctcctcacacagatcaagaccacgtgtgcaagcacgaggaggaagccacagatattacaccggccgcagacaaaacagctgcccatatctgcagcatctgcggcttactattcgaagacgcagagagtctggagagacatggactgacccacggggccggcgaaaaagaaaacagccgaacagagacaactatgtcgcctccaagagccttcgcctgtagggactgcggtaagtcctataggcattctgggagtttgataaatcatagacagacgcaccagacaggcgacttctcatgtggggcatgtgccaagcactttcacacgatggccgcaatgaaaaaccacttgagaagacactcccggaggaggtcaaggcggcaccggaaacgagcggggggggccagtggaggccgggaggcaaaactccttgccgctgaatcatggacccgggaactggaagataatgagggactggagtcaccgcaagacccatcaggtgagtcaccccacggcgcagaggggaacttagagagcgatggcgactgtttacaagctgagagcgaaggggacaagtgtggactggagagggacgagactcacttccaaggggacaaagagtcagggggtactggagaagggctagagcggaaagatgcctccctgcttgataaccttgatatccccggggaggagggaggggggactcacttttgcgactctctgactggagttgatgaggaccagaaaccggctaccgggcagccaaattcatcttcccacagcgccaatgccgtaaccggctggcaagctggcgcagctcatacctgcagtgattgtgggcacagttttcctcatgccacagggctgctcagccaccgcccttgtcatccgcccggaatttatcagtgttcactgtgccctaaagagttcgatagtctgccagccctgcgcagccactttcagaaccaccgccccggtgaagccacttcggcccaacccttcctctgctgcctgtgtgggatgatttttcctgggagagccggataccgactgcatcgcaggcaggcccactcgagctccggaatgacagagggcagcgaggaagagggggaggaagaaggggtggcggaagctgctcccgctcgatcccccccactgcaactgtctgaggcagagctcctgaaccagctgcaacgcgaggtggaagctcttgattcagccggatacggacacatttgcgggtgctgcggtcagacctacgacgacttaggcagcttggagagacaccaccagtcccagtcgtctggaacaactgctgataaggccccatcccccctaggggttgcaggcgatgcaatggaaatggtggtcgactcagtcctcgaggatatcgtcaatagtgtgagtggcgaaggcggcgatgcgaagtcccaggaaggcgcaggcacccctctgggcgatagcctgtgtatccagggaggcgaatccctgttggaagcgcagcctaggccgtttcgatgtaaccagtgcggcaagacatacaggcacggagggagcctggtcaatcaccggaagattcaccagaccggcgatttcttgtgccctgtgtgcagtaggtgctatcccaaccttgctgcataccgtaaccatctcagaaaccatcctcggtgtaaggggtccgaaccacaggtagggcctattcccgaagctgccggttctagtgagctacaagtgggacccatccccgaggggggctcgaacaagccacagcacatggccgaggaaggtccagggcaggccgaagtggagaagctgcaagaggagcttaaggtcgaaccactcgaagaagtggcccgggtgaaggaagaagtgtgggaagaaactactgtgaagggcgaagaaattgaacccaggcttgagaccgccgagaagggatgccaaactgaggcttcgagcgaacggcctttttcctgcgaagtctgcggccgcagctacaagcatgctgggtccctaatcaaccatagacagtctcatcaaactggccacttcggctgccaggcttgtagtaagggatttagtaacctaatgtcccttaaaaaccatcggcgcatccacgcagacccacggcggttccgttgctctgagtgcggaaaggcatttcgcttaagaaaacagctcgctagccatcaacgcgtgcacatggagagaaggggtgggggtggcacccggaaagccacacgagaggaccggcctttcaggtgcggtcaatgcggtcgaacatataggcacgcgggaagtctcctgaaccaccggaggtcccacgagacaggacagtactcctgccccacctgcccaaaaacttactcgaatagaatggctctaaaagaccaccagagactgcattccgagaatagaagacgacgggcaggccgatcacgcaggacggccgtgcgctgtgccctctgtgggcggagtttccccggaaggggatcgctcgagagacaccttcgggaacacgaagaaacagagagggaaccagccaatggccaggggggactggatgggaccgccgcgtcagaagctaacttgaccggatcccaaggcctggagactcagctggggggagccgaacctgttccccaccttgaagatggggtcccccgccctggagagcggtcacagtcaccaatacgggcagcgagtagtgaggccccagagccattaagctggggagccgggaaggcaggcggatggccagtgggcgggggcctgggcaaccattcaggtggttgggtgcctcaattcctgacacggagtgaggagccggaggacagcgttcataggtctccctgccacgcgggagactgccagcttaatggcccaactctcagccacatggattcttgggataacagggataacagtagtcaattacaacctggaagccatagttcttgctcccaatgcgggaagacatattgtcagtcagggagtcttctgaatcacaatactaacaagaccgacagacactactgtctgctgtgttccaaagaatttcttaatccagtggccaccaaatcccactctcataatcacattgacgcacaaacctttgcgtgtcccgattgcggaaaagcctttgagtcccaccaggagctggccagtcatctgcaggcccatgcgaggggacacagccaggtccccgcccagatggaggaggctcgggatcccaaagcgggcacgggcgaggaccaagtggttttgccgggacagggaaaggcacaagaagccccgtctgaaacaccgaggggccccggagagtctgtggagcgagcacgaggaggtcaggctgtgacttcaatggctgctgaagacaaagaacggccatttcggtgcacccagtgcgggcggtcttacaggcatgctgggagcttgctgaaccaccagaaagcgcacaccacaggcctctacccatgttccctgtgccccaagctcctcccaaacctgctctcactgaagaatcactcccgcacacacaccgatcctaaacgccactgttgcagtatatgtggtaaagctttcaggaccgccgcaagactggagggccacggtagagtccacgccccccgggaaggaccatttacgtgtccgcattgtcctcgccatttcaggcgccggataagttttgttcagcatcaacaacagcatcaggaggaatggactgtcgcaggatcaggcgctcccgtagccccagtgactggacgtggtgatctgccgctcccaccgccccctaccccaacgactcccctgctggacccaagtccccaatggcccgcagatctttccttctcactgtag

SEQ ID NO: 14567 - DNA, 5490 bp, Artificial Sequence
  Description of Artificial Sequence: Synthetic coding sequence
atggaggacactccgccctcactgtcatgttccgactgccagaggcactttccttccttgcccgagttgtcgaggcatcgggagctgttgcaccctagccctaatcaggacagcgaggaagctgattcaatcccccgcccgtatcgttgtcagcagtgcgggcgcggctacagacaccccggctcattagtgaatcacaggagaacccatgagactggactttttccttgtacgacttgcggcaaggacttctccaaccccatggcattgaagtctcacatgcgcacccatgctcccgaagggcgaagaaggcaccggccaccccggcccaaagaagccacacctcatctgcagggcgaaaccgtgagcactgacagctggggccagcgattaggcagcagtgagggatgggaaaatcagacaaagcacacagaagagacccccgattgcgagtcagtcccggatccccgcgccgctagcgggacctgggaagaccttccaacccggcagcgggaaggactggcttctcacccaggtcccgaggatggggccgacgggtggggcccttctaccaactctgcaagagccccacccctccccatccccgccagcagtctgctgtccaacctcgaacagtaccttgcagaatcagtcgtaaattttacggggggacaggagcctacacagtctcctccagccgaggaagagcgccgttacaagtgctcccagtgtgggaagacatacaagcatgccgggtcacttaccaatcaccgtcagagtcatacgttggggatctatccctgcgcgatatgttttaaagagttctcaaacttgatggcccttaagaaccactccaggttgcacgcacagtatcgcccttatcactgcccccactgcccgcgtgtgtttagactacccagggagctattggaacatcagcagtcacacgagggggaacggcaggagcctcgctgggaggaaaagggcatgccaacaacaaatggacacaccgacgagagctcccaggatcaactgcctagcgcccagatgctgaacggctccgccgaattatccacgagtggtgagctggaggactcgggactcgaggaataccggccttttcgatgtggggattgtggcaggacatacaggcatgctggatccttaatcaaccacaggaaaagtcaccagacgggtgtgtacccttgtagcctgtgcagcaaacaattgttcaacgctgctgcattgaagaatcacgtccgcgcacaccacaggcctaggcagggggtaggtgaaaatggccagccgtctgtgccacctgctccactgttactggctgaaacgactcacaaggaagaagaggatcccaccaccacgctggatcacagaccatataagtgctctgaatgcggccgggcctataggcaccgggggtcgctcgtgaaccatagacactctcatagaactggagagtaccagtgtagtctatgcccccgcaagtaccctaatttgatggcacttcgtaaccatgtgcgtgtgcactgtaaagctgcgcgccgttcagccgacatcggggcggaaggtgcccctagccatctgaaagtggagctaccacccgatcccgtagaagccgaagccgcaccacataccgaccaggatcatgtgtgcaagcacgaagaagaagccaccgatatcactcccgctgccgataagaccgccgcccacatatgtagcatctgtggactcttgtttgaggatgctgagtccctggagcgacatggccttacgcatggagccggcgagaaggagaatagcaggactgagacaaccatgtcaccacccagggcttttgcgtgtagagactgtggcaagtcctataggcactccggtagcctgatcaaccatcgccagacacatcaaacaggggatttcagttgcggcgcttgcgccaaacatttccatactatggcagccatgaaaaatcacctgcgccgtcattcccggcgccggagtaggcgacatcggaagcgagccggaggagcgagcggtggtagagaagccaagctattggccgctgagtcttggacccgtgaactagaggacaacgaaggcctggagtccccccaggacccatcgggtgagagcccgcacggagctgagggcaacctggaatccgacggcgattgcctgcaggctgagagcgagggagataagtgcggacttgaaagggacgaaactcactttcagggcgacaaggaatcagggggaactggagagggactggagcggaaagatgcctcactgctcgataacctcgacattcccggagaggagggtggagggactcatttctgcgatagcctgaccggagtggacgaggatcaaaagcctgcaacagggcagcctaattcttccagccactctgccaacgcagttacgggctggcaggctggtgctgcacatacctgttcagattgcggccacagcttcccacatgccactgggttgttgagccacaggccttgccacccccccggaatttatcaatgttctttgtgccctaaggagttcgattctttgcctgctcttcgctcacattttcaaaatcatcgcccgggcgaagcaacatcagctcaaccctttctgtgctgtctgtgcgggatgatctttccaggtcgcgccggttaccggcttcacaggcgccaggcgcactcgtccagcggcatgaccgaagggtccgaggaggagggtgaagaggagggcgtggctgaggctgctcccgcacgcagtccaccactgcagctgagcgaggctgaattactgaaccagctacagcgcgaggtcgaggctctggactccgccgggtatgggcatatctgcggctgttgcggccagacgtatgatgacttgggctcactagagagacatcaccagagccagtcctctggcaccacagccgacaaggctccatcccccttaggagtggccggggatgctatggagatggttgtggacagcgtgctcgaagacatcgtaaacagcgtatcaggagagggaggagacgccaagtcccaggaaggagctggtaccccgctgggcgatagcctgtgcatacagggaggcgaaagcttgctcgaggcacaaccccgaccttttaggtgtaatcagtgcgggaaaacgtatagacacggcggctccctggtgaatcacaggaaaatccaccagacgggggacttcctctgccccgtgtgtagtcgatgctatccaaatttggcggcctataggaaccacctgcgaaaccaccccaggtgcaaaggcagtgagcctcaggtcggtcctattcccgaagccgccggcagctccgaactccaggtggggcctatcccagaagggggctcaaacaaaccccaacacatggccgaagaaggcccaggacaggctgaggtggaaaagctgcaggaggaactcaaagtcgagccactggaagaggtggccagagtgaaagaggaagtttgggaggaaactacggtgaagggtgaggagatcgagccaagactggagactgccgaaaaaggctgccagactgaggcatcttcagagaggccatttagctgcgaggtgtgcgggaggagttataagcacgcaggcagtctgatcaatcatcggcagtcccatcagactggtcacttcgggtgccaggcctgttccaagggcttctctaatcttatgagtcttaaaaatcataggagaattcatgcagacccaaggcgtttccggtgttccgagtgtgggaaggccttccgactgcggaaacagctggcatctcatcagcgggtgcatatggagcgtcggggggggggcggaactagaaaagcaaccagggaggataggccatttaggtgtggccagtgtggaaggacctatcgtcacgcagggtcactgcttaaccaccgacggtcacacgaaacagggcaatacagttgccctacatgccctaagacttacagcaatcggatggctctgaaagatcaccagaggcttcatagcgaaaacagaagaagaagagccggccgatcccgccgcactgcagtgagatgtgctctgtgcggccgcagcttccctgggaggggctccctggaacgtcaccttagggagcacgaggagaccgagcgcgagccggccaacggtcaaggcggactcgatggaacagcagcatctgaggccaacctgacagggagccaaggactcgaaacgcagctaggaggcgcagagcctgttccacacttggaggatggagtccctagacccggggaacggtctcaaagcccaattcgagccgcttcctcggaggctccagagccactgagctggggcgccggaaaagccggtggatggcccgtgggcgggggactcggaaatcattccggcggatgggtgccacaatttctcacaaggtctgaggagcccgaagacagcgtacatagaagtccttgccacgccggcgattgtcagttgaatggcccaacattgagtcacatggattcatgggataatagagacaattcttctcaattacagcccggcagccattcttcatgcagccagtgtggaaaaacctactgccagagtggctctctgcttaaccataatacgaacaagacagaccgtcactattgtctactctgctccaaagaattccttaatcctgtcgcaactaagtcacattcgcacaatcacatcgatgctcagacattcgcatgtcctgattgtgggaaagcatttgagtcccatcaggagctcgccagccacctccaggctcatgcccgcgggcattcccaggtacctgcccagatggaggaagcccgagatcccaaggccggaactggagaggatcaagtggtcctgcctggccaaggtaaggcccaggaagccccaagcgagacacctcgcggacctggcgaaagcgttgagagggcaaggggaggacaggccgttacttctatggcagcggaggacaaggaacggccattcaggtgtacacaatgcgggcggagttatcgccacgccggatccctactcaaccaccagaaagcacatactactggcctctacccttgtagcctgtgtccaaaactcctgcccaacctcctgagcctgaaaaatcactcccgaactcataccgatcctaagcgccactgttgctccatctgcggtaaagcattcagaaccgcggcccggctcgaaggacacggtcgagtacatgcgcctagagagggtccgtttacatgcccccattgccctcgacactttcggcggagaatcagttttgttcagcaccaacagcagcaccaggaggagtggaccgtggccgggtccggacgaggccatgaggggagccaagaggaagttggtactcaatggagggggaaatctagcccgaaagtagggggaggggctcggagtgaaagacgagaaccccgcggcttctag

SEQ ID NO: 14568 - DNA, 723 bp, Artificial Sequence
  Description of Artificial Sequence: Synthetic coding sequence
atggaggatacaccgccatccctttcctgtagtgactgtcagcgccacttcccttcacttccagaactcagccgccatcgtgaactcctccacccgagcccaaatcaggactcagaggaggcagactccatacctagaccttaccggtgtcagcagtgtggccgaggctatcgccatcctggaagtctagtcaatcacaggagaactcatgagactggcctgttcccctgtaccacctgcggaaaggatttctcgaatccaatggcgcttaaaagccatatgcgtactcatgctcctgagggccggcgtcgtcataggccacctaggcccaaggaggctacaccgcacctccagggggagaccgtgtctacagactcttgggggcagcgcctgggctcctccgagggctgggagaatcaaaccaagcacaccgaggaaactcctgattgtgagtctgtgccagacccaagagcggcgtccggcacttgggaggatcttcctaccagacagagagaggggctggcctcccaccctggtccagaggacggtgccgacggatgggggccatctacaaatagcgcccgggctcctcctcttcctatccccgcttccagtctgctgtctaatctagaacagtacctcgctgaatccgttgtgaactttacaggcgggcaggagcccacccagtctcctccggcggaagaagaacgaaggtacaagtag

SEQ ID NO: 14569 - DNA, 582 bp, Artificial Sequence
  Description of Artificial Sequence: Synthetic coding sequence
gaaagacggtacaaatgctcccagtgtggtaaaacctataagcacgcaggatctctcaccaatcaccggcagtcccacaccctgggtatttacccctgtgccatttgttttaaagaatttagtaatctgatggcgctcaaaaatcattcccgtctgcacgcccagtacagaccataccactgccctcactgtccacgcgttttcaggttgccccgtgagctgctcgagcaccagcagtcccacgaggcggcacggccctttagttgcgaggtgtgcggaagaagttataagcacgcaggttctcttatcaatcaccgacagtcccaccagactgggcatttcggatgtcaagcgtgcagcaaggggttcagtaatctcatgtctctaaaaaatcaccgacgtattcatgctgaccccagacgctttcgctgttccgagtgcgggaaggcctttcgactgcggaaacagctcgcatctcaccagcgtgtccacatggagaggcaccggccattcagatgtggacagtgcggccgcacctatcgacatgctggctccttgttgaatcaccggagatctcactag

SEQ ID NO: 14570 - DNA, 1707 bp, Artificial Sequence
  Description of Artificial Sequence: Synthetic coding sequence
atggctcaggtggactctcaggacagatggggcgaggcctccccgctcagctcactgactgaggaagcccacgatacccagatgctgagcatgaacctggaaagcgacgacgaggatggtggggaggctgaaaaggaagggactgctgatcccgttgcctgccccaggggcagtagccccgtgacccacgagaaccctgatctcccatggcctcacccgctggggaaggaggaagaaaaattttccgacagcagctctgccgggggtatgggtcagaagccggtagagatgtctggaaaagcgtcctggtcgagagacgtaactaagatcaacgaaacgcagggttctcccggcgccagccgagcccttggcagcctcccctcaggacttgcccacaaactgctcgggcagatgcagccactgggcgacaggctgccagccggagacgatggttatagcggagctaaccaggacgctgtgctcgatgtacccccaagcttcccgtccaatggcaagtacctatgtgcgcacaaaagcgttgacacaagcgcagggaatagttccctgctatgttttccaaggccaggctccaactgggacctgcctacccaggagacccatactccggcacaagcatctgctacgcctgcctcattagcagcagctgttctggcaaaagcaagaaactcccgaaaggttcagaaccaggcaggccgccgggagggtggggaagctgaagcacggccgtaccgctgtctacgcggaggtagggcctttcagaagccctctaagccgctgtccccagctgagactagaggaggagccgctaaacgctatgcctgcgagctgtgcggtaaggcatatagccacagagggactcttcaacaacaccgccgcctacacacaggggaaagaccttaccagtgcagcttctgcgacaaggcctacacatggtcctcggaccaccgaaagcacattaggacacacactggcgagaagccttatccttgccccgactgtggaaaagctttcgtgaggtcctcggatctccggaagcatcagaggaacatgcactctaacaataaaccctttccatgtagcgagtgcggcctaactttcaacaagcccctctccttgctgcggcaccagcggacccacctgggcgccaagccttttcgatgccccgcctgtgacagagagttcgccgtggcttcccgcatggtagagcaccagagagtgcactctggcgagcgaccatttccatgccctacctgtggtaaatgcttcaccaaatctagcaacctctctgaacaccagacattgcacaccggccagcgtcctttcaaatgcgcagactgtggtgtggccttcgcccagccgtcaagacttgtgaggcatcagaggatccacactggggaaaggccattcccttgcacccaatgcgggcaggcatttgctcggtcgagtacactgaaaaggcaccaacagattcactccggggagaagggctttttgtgcgcagaatgcgggcgggccttccggatcgcgagcgagctcgctcagcacattaggatgcataacggtgaacggccttaccagtgcgaagattgcgggcaggccttcacgcgaagtaatcacctgcagagacaccgcgcgaaacacggtacgtgcaagaaggagccgatcccatccagctcagacgagtag

SEQ ID NO: 14571 - DNA, 1821 bp, Artificial Sequence
  Description of Artificial Sequence: Synthetic coding sequence
atgtcccacaccgcttccagttgccaggagcttgtcgaaaattgcgccgtgcacgtggccgggatggcgcaggaggactcaagacgtggacaagtgccctctagtttttatcacggtgcaaatcaggagctggatctcagcaccaaagtctataagcgagaatcaggatctccttactccgtccttgtcgacacgaagatgtccaagccgcacctccatgaaactgaggaacagccatatttccgcgagaccagagcagtcagcgacgtccatgccgtgaaggaggatcgtgaaaacagtgacgatacggaggaagaagaagaagaggttagttataaaagagagcaaattattgtggaagtgaacctgaacaaccaaaccctcaatgttagtaaaggagagaagggcgtgagcagccagagcaaagaaactcccgttctcaagacttccagtgaagaggaggaggaagagagtgaagaagaggcaaccgacgacagcaatgattatggcgagaatgaaaagcagaagaagaaggaaaagattgtggagaaggtcagtgtgacccagcgccgcacacgcagagctgcttccgttgctgcagctactaccagcccaacccccagaaccacacgggggcggaggaaaagtgttgagcctccaaaacgcaaaaagagagcaacaaaagagccaaaggcgcctgtccaaaaagccaagtgcgaggaaaaggagaccctgacctgtgaaaaatgtccgagggttttcaacacacggtggtacctggagaagcacatgaacgtcacacatcgccgcatgcaaatttgcgacaagtgtggaaagaaattcgtgttggagtcggagctctcactgcaccagcagactgattgtgaaaaaaatatccagtgtgtctcatgtaacaagagtttcaaaaagctctggtccctgcacgagcacattaagattgtccacggctacgccgagaaaaagttctcctgcgaaatctgtgagaagaaattctacactatggctcacgtgcgcaaacacatggtggctcatactaaggatatgccatttacttgtgagacctgcggtaaatcatttaaacggagcatgtcacttaaagttcattctctgcagcacagtggcgaaaaaccatttcgctgtgaaaactgcgatgagagattccagtacaaatatcaattgaggagtcacatgtccatccacataggtcataagcaattcatgtgtcagtggtgtgggaaggacttcaatatgaaacagtatttcgatgaacacatgaagacccataccggtgagaagccttttatttgtgagatatgtgggaaaagcttcactagtaggcctaatatgaagaggcacaggcgcactcacaccggagaaaagccttacccctgcgacgtgtgcgggcaaaggttccgattttcgaacatgctgaaagcgcacaaagaaaagtgctttagggtcactagtccagtaaatgttccccccgctgtgcagattccgctgaccacgagcccagccacaccagtgccgtcggtggtgaatacagccaccacccctacccctcccattaatatgaatccggtcagcaccctgccacctagaccaatcccccatccctttagtcacctccatatccaccctcatccacaccaccctcatcaccttccgattcccccagtacctcatcttccccccccaccagcactattcaaatctgagcccctgaatcacagaggtcagtcggaagacaatttcttacggcatctggccgagaagaatagctccgctcaacatcattag

SEQ ID NO: 14572 - DNA, 1821 bp, Artificial Sequence
  Description of Artificial Sequence: Synthetic coding sequence
atgagtcacacagcctcctcatgccaggaattggttgaaaactgcgccgtccacgtggccgggatggcccaggaagactcgcgtcgcggccaagtgccaagctcattctaccacggcgcaaaccaggagctggacctgtcaaccaaggtgtacaaaagggaatctggctctccttatagcgtcctggttgatacgaagatgtctaagcctcacctgcacgaaacagaagaacaaccttattttcgagagactagggccgtgtccgatgttcacgccgtcaaggaggatcgcgaaaactcagatgatacggaagaagaggaagaagaagtaagctataagagggaacagatcatagttgaagtgaatctgaataatcagacgctaaacgttagcaagggcgagaagggggtctcatctcagagcaaggagacccccgttctgaagaccagctctgaggaagaggaggaggagtcagaagaggaggctaccgatgatagcaatgattacggagagaacgagaagcagaaaaaaaaagaaaaaatagtcgagaaggtctcagttacccaaagacggacccgtagagccgcatcagtcgccgctgctaccacctcccctacgccccgcactacgaggggacggagaaaatcagtggaaccccccaaaagaaagaaacgggcaacgaaagaacctaaagccccagtacagaaggcaaaatgcgaagaaaaagaaactctaacatgtgaaaagtgcccgagggtcttcaatactcggtggtatctggaaaagcacatgaacgtcacccaccgccgcatgcagatttgtgacaaatgtggtaagaaattcgtgctggagagtgagctttcactccatcagcagacagactgtgaaaaaaatatccaatgcgtctcctgtaataagtccttcaagaaactgtggtccttgcatgagcacattaaaatcgtccacggatatgccgagaagaaattcagctgcgagatatgtgagaagaaattttacactatggctcatgtccgcaaacacatggttgcccacactaaggacatgcctttcacatgcgaaacttgcgggaagtcttttaagagatcaatgtcattgaaggtccacagcctacaacacagcggcgagaaaccattcagatgtgaaaactgtgacgagcgattccagtacaagtatcagttgagaagccacatgagcattcacatagggcacaagcagttcatgtgccaatggtgcgggaaggactttaatatgaaacaatacttcgatgaacacatgaaaactcatacaggcgagaagcccttcatatgtgagatctgtggcaaatcttttacgagccgtcccaatatgaaaaggcataggcgcacgcacacgggtgagaagccctatccttgtgacgtatgtggacagcgttttaggtttagcaacatgctcaaggcgcacaaagagaagtgcttccgggtgaccagtcccgtaaatgtgccccccgccgtccagatccccttgaccactagtcccgcaacccctgtgccctcagtggtcaatacagcaactacgccgactccccccattaacatgaacccagtgtcgaccctaccaccccgccctatcccacaccctttctctcatctgcacatacaccctcatccgcaccacccacatcatctgcctatccctcctgtgcctcaccttccacctcctccagctcttttcaagtctgagccacttaatcatcggggccagtcggaagataatttcttacgacatttggccgaaaaaaatagctcagctcaacatcactag

SEQ ID NO: 14573 - DNA, 1281 bp, Artificial Sequence
  Description of Artificial Sequence: Synthetic coding sequence
atgagccataccgcctcttcttgtcaggagctggtggagaactgtgctgttcacgtggccggaatggcccaagaggacagcaggcggggccaggtccctagcagcttctaccatggagcgaatcaggaactggatctcagtaccaaagtttacaagagagaatccggatccccctatagcgtccttgtcgataccaagatgtccaaacctcatctgcacgagacggaagaacagccatactttcgggaaacaagagcagtgagcgacgtgcacgcagtgaaagaggacagagaaaacagtgacgacaccgaggaggaggaagaagaggtgtcctataaaagagaacagattatagtggagtgcgtctcttgtaataaaagcttcaagaagctgtggagcctccacgagcatatcaagatcgttcacggctacgctgaaaaaaagttcagttgtgaaatttgtgaaaaaaaattctacacaatggctcacgtaagaaaacacatggtcgctcataccaaggatatgccattcacctgcgaaacctgcggaaaatctttcaaaaggtccatgagtttaaaggtgcacagtttacagcactctggggagaaaccatttcgatgcgagaattgtgacgagcgattccaatacaagtaccagctgcgctcccatatgtctattcacatcggacataaacagtttatgtgtcagtggtgtggaaaggactttaatatgaagcagtattttgatgagcacatgaagactcacacaggcgagaaacctttcatttgcgagatctgcggaaagtcatttacttcacggcccaatatgaagcgacacaggaggacgcacaccggcgaaaaaccctacccgtgtgatgtctgtgggcaacgcttccggttctccaacatgctgaaagcccacaaggaaaaatgcttccgagtgactagcccagtcaatgttcctcctgcggtacagattcctctgacaacatccccggctactcccgttcctagtgtcgtgaacaccgccaccacccctactcccccaattaacatgaaccctgtgtctacactgccccccagaccaattccgcatcccttctcccacctgcacattcacccacaccctcaccacccacaccatctccccatacctccggttccgcaccttccccctcctcccgccctgtttaaaagtgagcccttgaatcacagagggcagtccgaggacaatttcctccggcatctggcagagaagaacagttcagctcagcaccattag

SEQ ID NO: 14574 - DNA, 1848 bp, Artificial Sequence
  Description of Artificial Sequence: Synthetic coding sequence
atggctgagcgggcactggaaccagaggccgaggccgaagctgaggctggagccggtggcgaggcagccgctgaagaaggagccgctggccgcaaggcaagaggtcgacctcgtctcacagagtccgaccgagcccgcaggaggctcgagtctaggaaaaaatacgacgttaggagggtgtacctgggcgaagcacacggaccttgggtcgatcttaggagacgttcaggatggtccgacgccaagctggccgcttacctaatctccctagaacgcgggcaacgctccgggaggcatggcaaaccttgggagcaggtccccaagaaacctaaaagaaaaaagcgaagacggcgaaacgtgaactgtttgaagaatgtggtgatttggtatgaggatcacaagcatcgttgcccttatgagccccatctggcagaactggatcccaccttcggattatatactacggccgtttggcagtgcgaggcaggccaccgatacttccaggaccttcactctcctctgaagcctctctccgactctgaccctgactctgacaaggtgggcaatggacttgtggccgggtccagcgactctagcagctctggctcagcaagcgattctgaagaaagccccgagggacaacctgtgaaggcagccgcagcagccgcggcggcaactccaacctcgccagtgggttcctcaggtctgattacacaggaaggtgttcacattccttttgacgtgcatcatgtggagtctcttgcagaacaggggacccctctctgttctaatccggcagggaacgggcctgaagcactggaaacagttgtgtgcgtgcctgttcctgtccaagttggcgctggtccctctgccctttttgaaaacgttccacaagaggcactgggggaggtggtggcaagttgtcctatgccgggtatggttccgggttcacaggtgatcattattgctggaccaggctacgacgccctgaccgctgaagggatccacctaaacatggctgctggatcgggggtgcctggctcaggcctgggcgaagaggtaccttgcgccatgatggagggggttgccgcttacacccagacagaacctgaggggtctcagccgtctactatggacgccactgctgtagcaggaatcgaaaccaaaaaggaaaaagaggatctatgcttgctgaaaaaagaagaaaaggaggagcctgtcgcacctgaactggctacaaccgtacctgaatccgccgagcctgaggccgaggccgacggcgaggaactggatggttccgacatgagcgccatcatatatgagatcccgaaggagccggaaaaacgaagacggtcaaagcgctcgcgggtgatggatgcggatggcctgcttgaaatgtttcactgcccatatgaaggctgcagccaggtatatgtcgctctgagtagcttccagaaccacgtgaacttggttcacaggaaaggtaagaccaaagtatgccctcaccctggctgcggtaagaagttctatctctctaaccacctcaggaggcacatgatcatccatagtggggtcagggagttcacatgtgagacctgcgggaagtctttcaagaggaagaaccatcttgaagttcacagaagaacacataccggggagacccctctgcagtgcgaaatatgcgggtaccagtgcaggcagagggcctctctcaattggcatatgaagaaacacacagccgaggtgcagtacaatttcacctgtgatcgatgcggcaagagattcgaaaagctggattctgttaaattccatacattgaaaagccaccccgaccacaaacctacttag

SEQ ID NO: 14575 - DNA, 1746 bp, Artificial Sequence
  Description of Artificial Sequence: Synthetic coding sequence
atgctgtgcaataaggagttccttggtgggcacatagtgagacacgcacaggcacatcagaaaaaagggtctttcgcctgcgtaatctgcggtcgaaaatttcggaaccggggtctaatgcaaaagcaccttaagaaccacgtaaagaagatccaaagacaacagattgccgccgcacagcaggatgatcaggaagtcacggctctggaggagattaactgctcgtcgagttctatttccttcgaaaacggcaatagcgattcaaaagatctagaggtggaaacactcactgctagcagtgaggggaacaaagaagtgataccagaacatgtggccgagttcattgaaattcctatctccgtgcccgaagatgtcattgagaatgtgattgagaacggctctccaaataatagtttgaacaatgtattcaagcctctcaccgaatgcggcgacgactatgaggaggaagaggatgaagaaggagactacgaagaggacgattatgacctaaaccaggaaacaagcgtcatccataagatcaatggtactgtctgtcaccccaaagatatttacgcaaccgaccaggagggaaactttaaatgtcccgccttgggttgtgttcgaatatttaagcgtattggatttctaaataagcatgcaatgacagtacatcctaccgatctgaatgttcgtcaaactgttatgaaatggtccaagggaaagtgtaaattttgtcagcggcagtttgaggattcgcagcacttcatcgaccaccttaacaggcatagctaccctaacgtttatttttgcttgcattttaactgcaacgaatccttcaaactccctttccagctggcgcaacacacaaaatcccatagaatttttcaggcacagtgttcattccctgaatgccacgagctgttcgaggatcttcctctgctctacgaacatgaggcacagcactacctctctaaaactcctgaatcctcagcacagcccagcgagactatactatgggatgtgcaaaccgatagcaaccccaaccaggaaaaggatagttccagcaacgagaagcaaacaatttcactgcctgtgtcgacgtcaaaatcccggaaggaatcaacggagcccaagacatgtatcgaatcaatggagaagaagaccgattcactggtgcaaaatggaaatgaacgatccgacgataccgtttcaaacatttcgttaatcgatcaaaaaatgcccgacatagaacccaactctgagaacaactgttccagctcagatattgtgaatggacatagcgaaattgaacagacccctttggtcagtagcgatccagctcttaagatagatacgaatagaatccgaaccgagaacggttcgatattgccgagtgtggtgccacaggagcataatacgctgcctgtttcacaggcaccgagcaagcccaatctgacaagcgaacatacttcttatggcctgattctgaccaaaccatacgttaggcctttgccgcctagttatctcgacgaacggtatctgagcatgcctaagcgcaggaagtttctgacagatagagtcgatgcgtgctctgaccaagacaacgtctacaagaaatcagtgaaacgcctgcggtgcggcaaatgtctgactacttactgtaacgctgaggctctggaggcccacttggcacagaagaagtgccagacgctatttggcttcgattctgatgacgagtccgcctag

SEQ ID NO: 14576 - DNA, 3180 bp, Artificial Sequence
  Description of Artificial Sequence: Synthetic coding sequence
atgaatatgtcccaggcatccgttagctttcaggatgtaaccgtggagttcacccgggaggaatggcaacacctggggcctgttgaaaggacactataccgcgacgtgatgctcgaaaactactcccaccttatcagcgtggggtattgcatcaccaaacctaaagtcatctcaaaattagaaaaaggagaggagccttggtctcttgaagacgaattcttaaaccagaggtaccccgggtacttcaaggtagatcacattaaaggcatacgagaaaaacaggagaaacccctctggcaggagattttcatttccgatgctgacaagacgctgagcaaggagggacagaaagtactcgagaagccgttcaacttggagatcgcacctgagctgtctgaaaaaatatcctgtaaatgtgactcacacagaatgaatctcccagtggctagtcagctgataatctccgagcgcaagtattcccgtaaaaaaacagaatatatgaacgtttgcgaaaagctccagctcgacatcaagcatgagaaagcacacgccgaggagaaaagttatgagcacggagaaaacgccaaagcctttagctataaaaaggaccagcactggaagtttcagacccttgaggaatcctttgaatgcgatggatcaggtcaaggtctttacgacaagacaatatgcattacaccgcagtcatttctaaccggggagaagagctgtaaagatgacgagtttcggaagaacttcgataagataaccctgttcaatcacatgcgaaccgatacacgcggcaaatgttctgacttgaatgaatacgggacatcctgtgataagacaactgccgttgagtataacaaggtgcacatggccatgacacattatgagtgcaacgaacggggtatcaatttctccagaaagagccccttgacccagtcacaaaggacgattacaggatggagcgccttcgaaagtaacaagtgcgaggagaactttagccagagctctgctcacatcgtgcaccaaaagacacaagcgggagataaattcggagaacacaacgaatgcacggatgctctgtatcagaagctcgattttaccgctcaccagcgcattcacaccgaggataaattttacctgagcgacgaacatggcaagtgtaggaaaagcttctaccgcaaggcacacctgatccagcatcagcgtccacattcgggcgagaaaacttatcagtacgaagaatgcgccaaaagcttttgttcttctagccacccgatccagcatcctggcacttatgtgggattcaaactgtacgagtgtaacgaatgtggcaaagcgttctgccagaattctaatctgtctaagcatttgagaattcacaccaaagaaaagccctgcgacaataatgggtgcggaaggtcatataagtcaccactaatcggccaccagaaaactgacgccgaaatggaactgtgtggaggatctgagtacggcaaaacatcccacctgaaggggcatcagcgcattctgatgggtgagaaaccctatgaatgtatcgaatgcggaaaaacgttttcaaagaccagccacctcagagcccaccagcgaatccatacaggcgagaagccctatgagtgtgtggagtgcgagaagacattcagccataagacccatctctccgttcatcagcgcgtccatacaggcgaaaaaccctacgagtgcaacgattgcggtaagagctttacatataatagtgcacttagggcgcaccagcggatccacactggcgagaagccctacgaatgctcagactgcgaaaagacgttcgcacacaactccgcactgcgcgcccatcatagaattcataccggggaaaagccgtacgagtgcaatgagtgtggtcgcagttttgcgcacattagtgtattaaaagctcaccagcggatccatacgggcgaaaagccatacgagtgcaatgagtgcgggcgctcattcacatataatagtgccctccgggcgcaccaacgtatccacacagggcgcaagccctacgagtgctcagattgtgagaagaccttcgctcacaacagtgccttaaaaattcaccaacggattcacacgggagagaagccttacgagtgtaatgagtgcgaaaaaacgtttgctcacaactctgccctgcgtgcccatcaaaatatccacactggtgagaagttgtatgagtgttcagagtgtggtaaaacgtttttccaaaagacccgcctgtccactcacaggcggattcacacaggggaaaaaccctacgagtgctccaagtgcggcaaaacattctctcagaagtcatatctgagcggccacgaaagaattcacactggagaaaaaccttacgagtgcaacgtatgtggaaagaccttcgtgtacaaagcggccctgatcgtccatcagcgcatccacactggagaaaagccctatgagtgcaaccaatgcggaaaaaccttcagtcaaagaacacatctgtgtgcccaccagcgcatccataccggcgagaaaccatacgagtgcaatgagtgtggcaaaacattcgctgataactctgccctgcgtgctcaccacagaatccacacgggggagaaaccttacgaatgtaacgactgcggaaaaaccttcagcaagactagccatttaagggctcatttaagaactagaagtggtgaaaagccctacgaatgttccgagtgtggtaaaacctttagtgaaaaatcctatgtatctgcacaccagcgggtccacacgggcgaaaaaccatacgagtgtaacgtgtgcggaaagcccttcgcacataacagtactctccgggtccaccaaagaatacatacaggtgagaaatcctatgagtgtaacgattgcggtaaaaccttcagtcagaaatcacacctgagtgcacatcaaagaatccacacaggcgagaagccatatgagtgtaatgagtgtggtaaggcctttgcacagaacagtaccctcagggtccatcagcggatccacacaggagagaaaccctacgaatgcgacgagtgcggaaaaaccttcgtccggaaagccgctctacgtgtccaccatacaaggatgcacaccagggaaaagaccttggcctgcaatggttttggaaaatcctag

SEQ ID NO: 14577 - DNA, 1848 bp, Artificial Sequence
  Description of Artificial Sequence: Synthetic coding sequence
atgagccaggctagcgtgtccttccaggacgtgactgtcgagtttacacgagaggaatggcagcacttaggtcctgtggagcgcacactgtaccgggatgtgatgcttgaaaactactcgcacctgatatccgtgggatattgtatcactaaacccaaggtcatcagcaagttggagaagggagaggaaccctggtcattagaagacgagtttttgaaccagcgttacccaggttacttcaaggtagaccacatcaaaggtattcgggagaaacaggaaaagcctctctggcaggagatcttcatcagcgacgccgataagaccttgagtaaagagggtcagaaggtgttagaaaagcccttcaacttggaaatcgcgccggagctgagcgaaaaaatcagctgtaagtgcgacagccaccgtatgaatctgccagtggcttcccaacttatcatatctgaaagaaagtacagccgcaagaagactgaatatatgaatgtgtgcgagaagctgcaactggacatcaagcacgagaaggcccatgctgaggagaaatcctacgagcacggagagaacgcgaaggcgttttcctacaagaaagatcaacactggaagtttcagacccttgaagagtcattcgaatgcgacggttccgggcagggcttgtacgacaagaccatatgcatcaccccccagagttttctcaccggagagaagtcatgcaaggacgacgaattccgaaaaaatttcgacaagatcactcttttcaatcacatgaggacagacacccgggggaagtgttccgatctgaatgaatatggaacatcttgtgacaagacaactgccgttgagtataacaaagttcatatggccatgactcattacgagtgcaatgaacgtggaattaacttctctaggaagtcaccactgacccaaagtcagagaacgatcacgggctggagtgcattcgagagcaacaagtgtgaggaaaacttctcacagtccagcgcccatattgttcaccagaaaacacaggcaggagacaaattcggcgaacacaacgagtgtacagatgccctgtatcaaaaactggactttacagctcaccaacgcatccacacagaggacaaattttacttgagcgatgaacatgggaagtgtcggaaatctttctatcggaaagcccacctcatccagcaccagcgccctcattccggagagaagacttatcaatacgaagagtgcgccaagtctttctgctcctcctctcacccgatacaacacccgggcacctacgttggctttaaactgtacgagtgcaacgaatgtggcaaagctttttgtcagaactccaatctgtcaaagcatctgaggatccatacaaaagaaaaaccttgtgataataacggctgtgggaggtcatacaagagtcctctgatcggtcaccagaagacagacgcagaaatggagctctgtgggggcagtgaatatgggaaaacttcacacttaaaagggcatcagcgcatccttatgggagagaagccttacgagtgcatcgagtgcgggaaaacgttttccaagactagccacctgagggctcaccagcggattcatacaggcgagaaaccttacgagtgcgttgaatgtgagaaaaccttttcacacaagacgcacctctccgttcaccagagagtacacaccggggaaaagccctatgagtgcaatgattgtgggaaatctttcacttataacagtgcccttagggcacatcagcggattcacacaggactggcagtttgtcacgtcggtattctgatggccactaaatctctgtttcaccagagctag

SEQ ID NO: 14578 - DNA, 996 bp, Artificial Sequence
  Description of Artificial Sequence: Synthetic coding sequence
atgcgccgcaagacccgcaacttcaagcacaaaacagtgaaagataacaaggtcctgacagaaggatcagatcaggagtccgaaaaggataatagccagtgctgcgaccctgcaactaatgagcgcgtgcaagccgaaaagagacagtacgtgtgtactgagtgcggtaaagccttttctcagtcagccaaccttacagtccatgaaagaatccatacgggagagaagccttacaagtgcaaagagtgtggcaaggcattctcccattcgagtaacctggtcgtgcacagacgtatccataccgggttgaaaccatacacctgcagcgaatgcggcaagtcctttagcgggaagtctcacctgattcgacaccaggggatccacagtggcgagaaaacatatgaatgtaaagagtgtgggaaggccttcagcagatccagtggactcatttcgcaccacagagtgcacaccggcgaaaagccttacagctgcatagagtgcggaaaggcattttcacgttcaagcaatcttacacagcatcagagaatgcatcggggtaagaaggtctacaaatgcaaagagtgcggcaagacttgcggttcaaatacaaaaattatggaccaccaacggatccatactggcgagaagccctacgaatgtgacgagtgcggaaagacttttatcttgcgaaagactttgaatgaacatcagcgcctgcaccggagagaaaaaccatataagtgcaatgagtgcggaaaagccttcaccagtaaccgtaaccttgtggatcatcagcgggtgcacaccggtgaaaaaccttacaaatgtaatgaatgtggaaaaacttttcgccagacatcgcaggtaatcctccacttaaggacccataccaaggaaaagccctataaatgctcagaatgtggaaaagcctatcgatactcatcacagctcatacagcatcagcggaaacacaacgaggagaaggaaacttcatag

SEQ ID NO: 14579 - DNA, 120 bp, Artificial Sequence
  Description of Artificial Sequence: Synthetic coding sequence
atgaggcggaagaccaggaacttcaagcacaagacagtgaaagataataaagtgttgaccgaaggttctgatcaggagagtgagaaagacaatagccagtgctgtgaccccgcgacctag

SEQ ID NO: 14580 - DNA, 105 bp, Artificial Sequence
  Description of Artificial Sequence: Synthetic coding sequence
atgcgccgtaaaacgcgtaatttcaagcacaagaccgttaaggataataaggttctgacagaaggaagtgatcaagagagcgaaaaggataactctcagtgttag

SEQ ID NO: 14581 - DNA, 1359 bp, Artificial Sequence
  Description of Artificial Sequence: Synthetic coding sequence
atggcggctgtggcgcttgcatccggaactcggctgggccttgtgctcgagctgctgcctggccagcccgccctgccacgcgctcgacgcgaatccgtcacatttgaagatgtagccgtatattttagcgaaaacgaatggatagggttagggcccgcccagcgcgccctgtaccgcgacgtaatgcttgagaactacggcgcagtggctagcctggcattccctttccccaaacccgccttgatttcccagctagaacggggagagaccccgtggtgttccgtgcctcgcggggcactagatggcgaagccccacgcggcatctcatcagaaggcgtgctgaaacgcaaaaaggaagatttcatcctcaaggaggagattatcgaagaggcccaggacctcatggtcttatcgtccggccctcagtggtgcggaagtcaggagttatggtttggaaagacctgcgaagaaaagtcaaggttggggcgctggcccggatatcttaacggtggcaggatggaaagcagcaccaacgatattattgaggtgatcgtgaaggatgagatgatttcggtggaggaaagttccggaaataccgacgtgaataacttactggggatccatcacaagatactcaatgaacagattttttacatatgcgaagaatgcggaaagtgcttcgatcaaaacgaagatttcgatcaacaccaaaagactcataacggtgaaaaagtttacgggtgcaaagaatgtggaaaggccttttcattccggagccactgcattgctcatcaacgtatccacagcggtgttaaaccctacgagtgccaggagtgtgctaaggccttcgtgtggaaatccaacctgataagacaccaaagaattcataccggcgagaagcccttcgaatgtaaggagtgcggaaagggattctctcagaacacatcccttacccaacaccagaggattcatactggtgagaagccttatacatgcaaagagtgtgggaaaagctttactagaaacccggccctcctgcgccaccaacggatgcacaccggggaaaaaccttatgagtgcaaggactgcggcaagggatttatgtggaattccgacctgagccagcatcaacgggtccatacgggcgataagccacatgaatgcaccgactgcggaaagagcttcttctgcaaagctcatctgatacgccaccaaagaatacacacaggcgagcgcccatataagtgtaatgactgtggcaaggcgttctcacagaactcagttttaattaagcatcagcgccgccacgctcgtgacaaaccctacaactgccaaataagccacctcctggagcactag

SEQ ID NO: 14582 - DNA, 1281 bp, Artificial Sequence
  Description of Artificial Sequence: Synthetic coding sequence
atgctagaaaattacggcgctgttgcctccctcgccgccttcccttttcccaaacccgccttaatctcacagctggagagaggagagaccccatggtgtagcgtgcccagaggcgccctggatggcgaagctccgcggggaatttcatctggctaccctttcctcaaacccgcagggataagccaccctgagcaagtggaggagcccttgaatttgaagcttcagggagagggtccaagccttatctgccctgaaggggtgctgaagcgcaagaaggaggatttcatcctcaaagaggagattatcgaggaagctcaggacctgatggtcctctcaagcggcccacagtggtgtggctctcaggagctgtggttcggcaagacctgcgaggaaaaaagcaggctcgggaggtggcctggctatctgaacggggggagaatggagtcatccaccaatgatatcattgaagtcatcgtaaaagacgaaatgatctctgtggaggaatcatcggggaataccgacgttaacaaccttctgggcattcatcataaaattcttaatgagcagatcttctatatctgcgaggaatgcgggaagtgcttcgaccagaatgaggactttgaccagcaccaaaagacccacaacggggaaaaggtctacgggtgtaaggagtgtgggaaagccttcagctttcggtctcattgcatcgcacatcagaggattcactcaggtgtcaaaccttatgagtgccaggaatgcgcaaaagccttcgtatggaagagtaatctgattcgacatcagcgaatccataccggagagaaaccattcgagtgtaaagagtgcggtaagggattctctcagaacacttccttgacgcagcaccagcggattcatacaggggagaaaccttatacatgcaaggagtgcgggaagtccttcaccaggaacccggccctgctaaggcatcagcgcatgcacactggagagaaaccatacgaatgcaaggattgtggtaagggcttcatgtggaattcagatctaagccagcaccaaagggtgcacacaggtgataagccgcacgaatgtacagactgcggtaaatcctttttctgtaaagcccacctgattcgccaccagagaatccacaccggtgagcgcccttacaaatgcaatgattgtggcaaagcattttcacagaattctgtgcttatcaaacatcagcgcaggcacgctagagataagccatacaattgccagattagccacttattggagcattag

SEQ ID NO: 14583 - DNA, 1281 bp, Artificial Sequence
  Description of Artificial Sequence: Synthetic coding sequence
atgctcgagaactacggggccgtggcttcactggccgcattccccttccccaaaccagcgctgatttctcagctggagcggggggaaactccttggtgctctgtcccccggggtgccctggacggcgaagctcctcgcggcattagctcagggtacccctttttgaagccagccgggattagtcaccctgaacaggtggaggaaccactgaatttaaagctccagggagagggcccttctctgatatgtcccgagggagtcctgaaaagaaagaaagaagactttattttgaaagaggagatcatagaggaggcacaggacctgatggtgttaagcagtggaccacagtggtgcggctctcaggaactctggttcggaaagacgtgcgaggagaagtctcggctcgggaggtggcccggttatttgaatggggggaggatggagagtagcacaaatgacatcatcgaagtaatagtcaaggacgagatgatcagtgtagaagagtccagtggtaataccgacgttaataacctactggggatccatcataagatcctcaacgaacagatcttttatatctgtgaagagtgcggcaagtgcttcgatcagaacgaagattttgatcagcatcagaagacacacaatggcgaaaaagtgtatggttgtaaagagtgcggtaaggcgttctcttttaggtcacactgtatcgctcaccagaggatccactctggtgtcaaaccttacgagtgtcaggagtgcgcaaaagctttcgtttggaaatcgaacttgattcgacaccagcgtatccacaccggggagaagcctttcgagtgcaaagagtgtgggaaaggctttagccaaaacactagtctgacacagcaccagagaatccatactggcgagaagccttacacctgcaaagagtgcgggaagagttttaccaggaatccagccctgcttagacaccaaaggatgcataccggcgagaaaccgtacgaatgtaaggactgcggcaaaggatttatgtggaatagcgatctgtcacagcaccagagggtccacaccggtgataagccccacgaatgtacggattgtggcaagagcttcttttgcaaagctcacctgataaggcatcagcggatccacaccggggagcgaccttacaaatgtaacgattgcggaaaagctttctcacagaacagcgtcctaatcaagcatcagcgcagacacgcacgggacaagccgtacaattgtcaaatcagtcacctcctggagcattag

SEQ ID NO: 14584 - DNA, 786 bp, Artificial Sequence
  Description of Artificial Sequence: Synthetic coding sequence
atgatttacaaatgccctatgtgtagagagttcttctccgagagggcagatttgttcatgcaccaaaaaatccacaccgccgagaaaccacataagtgtgacaaatgcgacaagggattcttccatattagcgaattgcatatccactggagggatcatactggagaaaaagtgtacaaatgcgacgattgcggaaaagattttagtactaccaccaagctgaatcggcataaaaaaatccacaccgtggagaagccctataagtgctacgaatgtggcaaggccttcaattggtcttcacatctccagatacatatgcgagttcataccggggaaaagccttatgtgtgcagtgaatgcggtcgggggttttctaattcctctaacctctgtatgcatcaacgagtccacacgggtgaaaagccgttcaaatgtgaggaatgcggcaaagcattccggcacacaagcagcctgtgcatgcatcagcgggtgcacacgggggagaagccttataaatgctatgagtgtggaaaggctttcagtcaatcatcctctctgtgtatacatcagcgcgttcatacaggcgagaaaccttacagatgttgcggatgcgggaaggccttctctcagtctagctcactatgcatccatcagcgtgtgcataccggcgagaagccattcaaatgtgacgaatgtggcaaggccttctcccagtccacatcactgtgtattcaccagcgggtgcacactaaggagagaaaccatctgaaaatctcggtgatctag

SEQ ID NO: 14585 - DNA, 786 bp, Artificial Sequence
  Description of Artificial Sequence: Synthetic coding sequence
atgatctataaatgcccaatgtgcagagaattcttcagcgagcgggccgatctgtttatgcaccagaagatccacaccgcagaaaaacctcacaaatgtgacaagtgtgacaaaggtttcttccacatcagcgaactgcatatccattggagggaccacactggtgagaaagtttataagtgtgatgattgcggaaaagacttcagtaccacaacaaagctgaatcggcacaagaagattcacacagtggagaagccctataaatgttatgagtgcggcaaggccttcaattggtctagccacttacagattcacatgcgcgttcatactggtgaaaagccatacgtgtgtagcgaatgcggacggggattcagcaactctagcaacctgtgcatgcaccaacgcgtgcatacgggggaaaagcctttcaaatgtgaggaatgtggtaaagcgtttaggcatacttcctccctctgcatgcaccagcgagtgcacaccggggagaagccttataagtgttacgagtgcggcaaggccttctcacagtccagctcactatgcattcaccagagagttcatactggcgaaaaaccgtatcgctgttgcgggtgtggaaaggctttcagtcagagtagttccctgtgtatacaccagcgggttcatactggggagaagcccttcaagtgcgacgagtgcgggaaagcatttagtcagagcacgtccctctgcattcaccagcgagtgcatacaaaggagcgtaaccacctgaaaatttccgtgatctag

SEQ ID NO: 14586 - DNA, 600 bp, Artificial Sequence
  Description of Artificial Sequence: Synthetic coding sequence
atgatcgtggtccgaatactggccttacaacagaacctgattgacatcaggaagtcaacccagtggagatcccctatcaacgttacttccggcaaagcgttcaactggtcctcacacttgcagatacacatgcgtgtccacactggtgagaaaccatatgtctgttccgaatgcggccggggcttctcgaatagcagcaacctttgcatgcaccagagggtgcacactggtgaaaagccctttaaatgtgaagagtgcggaaaggccttcagacatacgagcagcttgtgcatgcaccagagggtgcatactggggagaaaccctacaagtgttacgagtgcgggaaagcgttctctcagtcttccagtctctgcatccatcaaagggtccatactggggagaagccgtacaggtgttgcggatgtggcaaggcgttctcccagagcagctccctgtgcatacaccaaagggtccatacaggagagaagccctttaagtgcgatgaatgcggcaaggccttctcacagtccacctcgctctgcattcaccagagggttcatacaaaagaaaggaaccaccttaagatctccgtaatctag

SEQ ID NO: 14587 - DNA, 786 bp, Artificial Sequence
  Description of Artificial Sequence: Synthetic coding sequence
atgatctataaatgtccaatgtgccgggagtttttttctgagagggccgacctgtttatgcaccagaagattcacaccgccgagaagccgcacaagtgcgacaaatgcgacaagggctttttccatatcagcgagttacacattcactggcgagaccacacaggcgaaaaggtctataaatgtgacgactgcgggaaggacttctccaccaccactaagctcaaccgccataagaagatccacacagtagaaaagccttacaaatgttatgaatgcggaaaagcttttaattggtctagtcatctgcaaattcatatgcgcgtgcacacaggagagaaaccctatgtatgcagcgaatgtggacgcggtttcagtaactccagcaacctatgcatgcaccagagggttcacaccggggaaaagccttttaagtgtgaggaatgcggcaaggccttccgccacacctcgtctctgtgcatgcatcaaagagtccacacaggggagaagccatacaagtgttacgaatgtggcaaggccttcagtcagtcatcttccctgtgcattcaccagcgagtgcacactggagagaagccttacaggtgttgcgggtgcgggaaggctttttcccagtcaagttccttgtgcatccatcagcgggtccatactggcgagaaaccctttaaatgcgacgaatgtgggaaggcatttagccagagcacatcactctgtatacatcaaagggtccatactaaggagcgcaaccacctgaagataagtgtgatctag

SEQ ID NO: 14588 - DNA, 786 bp, Artificial Sequence
  Description of Artificial Sequence: Synthetic coding sequence
atgatctacaaatgccccatgtgccgcgagttttttagcgagcgggccgacctgttcatgcatcagaagattcacaccgcagaaaaaccacacaagtgcgacaagtgcgataaagggttctttcacatctctgaattgcacattcactggcgagaccacacaggcgaaaaagtatacaagtgtgatgattgcggcaaggattttagcactaccaccaagctgaaccgacacaagaaaatccacacggtggaaaagccctataagtgctacgagtgtggaaaggcctttaattggtctagccacttacaaattcatatgcgagtccacacgggagagaagccctatgtgtgctctgagtgcggacgcggattctccaacagctccaatttgtgcatgcaccagcgagtgcacacaggcgagaagccattcaagtgcgaggagtgcggaaaggcttttcgccacacatcttccctgtgtatgcaccagcgggtccacacgggcgaaaaaccatataagtgctatgagtgtggaaaggcgttctcccagagctcgagcttatgtatccatcaaagagtacacaccggtgagaagccttatcggtgctgcgggtgtggcaaggcctttagccagtcttcttctctttgtattcaccagcgtgtccatacaggtgaaaaacctttcaagtgcgacgagtgcgggaaggctttttctcaatccacatctctgtgcatacatcagcgagtgcataccaaggagcgaaatcacctgaaaatctcagtcatatag

SEQ ID NO: 14589 - DNA, 2037 bp, Artificial Sequence
  Description of Artificial Sequence: Synthetic coding sequence
atggctttgccccaggggcagctaacgtttaaagatgtggccatcgagttctcacaggaggaatggacatgcttagatcctgctcaaaagaccctgtatcgggacgtgatgctcgaaaattataggaatctggtgtctctagacatcagctgtaaatgtgtgaacaccgacctaccacccaaagggaaaaataacatgggcgaagctttctatactgtgaaactcgaaagacttgagtcgtgcgatactgtcggactctccttccaagaagtccagaaaaacacctatgatttcgagtgtcagtggaaagacgatgagggcaattataagacagtcctgatgctacagaaggaaaacctgcctgggaggcgcgcacagagggaccgccgagccgccggaaatcgacatatcgagaatcagctcggggtgtcgtttcaatctcacttaccggagctgcagcaatttcagcacgagggaaaaatctatgaatataatcaagttgagaagtctcccaataaccgggggaaacactataagtgcgatgaatgtggcaaagtatttagtcagaatagtcgacttacgagccataaacggattcacaccggagagaagccatatcagtgtaataaatgcgggaaagccttcacagtgcgctctaatttgacaatccatcaagtgatccacactggtgaaaagccatataaatgcaatgaatgtggcaaagtattttctcagccatcaaatctggcaggccaccagcggattcataccggcgagaagccatacaagtgcaacgaatgtggaaaggctttcagagcacattccaaacttacaacacaccaggttatacacacgggcgagaagccatacaagtgtaaggagtgcggtaaatgtttcactcagaatagtcacctggcttcacaccggcgcattcatacaggagaaaagccttataaatgtaatgagtgtggcaaagccttctccgttagatctagtctcacaacgcaccagacaatccacaccggggaaaagccatataaatgcaatgagtgcgggaaagtttttcgacacaattcctatttagccaagcacagacgcatacatacaggagagaaaccttataagtgcaatgaatgcggcaaggcatttagtatgcatagcaacctgactaaacatcaaatcattcataccggggaaaaaccgttcaagtgtaacgagtgtgtcaaggtattcacacagtattcacaccttgccaatcacaggagaatccacaccggagaaaaaccataccggtgcgacgagtgtgggaaggccttcagcgtgcgcagctctttaactacccatcaggccattcataccggcgagaagccctacaagtgcaatgattgcggaaaggtcttcacccagaacagccatcttgctagtcatcgcggaattcactcgggagagaaaccctacaagtgcgatgaatgcggaaaagcattctcacagacatcccagctggccaggcactggcgagtccatacaggcgagaaaccctacaagtgcaacgagtgcggaaaagcattttctgtgcatagcagcttgactattcaccaaaccattcatactggacagaagccctacaagtgcaacgattgtggaaaggtgttcagacacaatagttacctggccatccatcagcgcattcatacaggagaaaagccttacaaatgtaacgagtgcggaaaggctttttcggtgcactccaatctagccacccatcaggtgatacatactggcgaaaagccatataagtgcaatgagtgcggcaaggtcttcacacagaactcgcacctggccaatcaccggagaatccatacaggtgaaaagccatacaggtgtaacgaatgcggaaaagcattctccgttcgatccaccctaacaacccacatggctgtacatacaggggacaaaccttataaatgcaatcaatgtggaaaggtgtttactcagaattcgaacctggccaaacaccgtagaatccactctggatag

SEQ ID NO: 14590 - DNA, 1860 bp, Artificial Sequence
  Description of Artificial Sequence: Synthetic coding sequence
atggaagtggaagccgccgaagctagatctcccgcccctggctataagcgctctgggagacgttacaagtgtgtctcttgcaccaagacgtttcccaacgcccctagggccgcacgccacgcagcaacgcatgggccggccgattgttctgaagaagtggcagaggtgaagccgaagcccgagaccgaggccaaggccgaggaagcgtccggggagaaagtgtccggctcagcagctaagcccaggccttatgcgtgtcccctctgcccgaaggcatacaaaaccgcgccagagctcagatcacatggccgctctcataccggcgagaagcccttcccgtgccctgagtgcggtcgcaggttcatgcagccggtgtgcctccgcgtccatctggcctcacacgccggagagctgcccttccgctgcgctcactgccctaaagcctacggtgcgctcagcaagctgaaaattcaccagcgaggacacacaggagaacgcccatacgcttgtgctgactgtggaaaatcctttgccgatccgagcgttttcaggaaacaccggcggacacacgcaggcctgcgaccttactcatgcgagcgatgcggcaaggcatacgctgaactcaaagatcttcggaatcacgaaaggagccacacaggcgagagaccatttttgtgctctgagtgcgggaaaagcttctccaggtctagcagtttgacctgtcaccaacggatccacgccgcccaaaagccatatcgttgccctgcctgcgggaagggtttcacccaactgtcctcgtaccagagccacgaacgaacgcattcaggagaaaaaccatttctctgtccccgatgtggcagaatgttttccgatccctcatctttccgccgccatcaaagggcacacgaaggggtgaaaccataccactgtgagaaatgtggcaaagatttccggcagccggcggacctggcgatgcaccgccgggtgcatacaggggatcggccatttaagtgtctccagtgtgataagacctttgtagcatcttgggaccttaagcgtcatgccctggttcatagtggtcaaaggcctttccggtgtgaagagtgtggtcgggccttcgccgaacgcgcctccttaacaaagcacagcagagtgcacagtggcgaacggccttttcactgtaatgcttgcggcaaatcctttgtcgtctccagcagcctgcggaagcacgagagaacacacaggtccagcgaggccgccggcgttcctcccgcccaggagctagtagtaggcttagcccttcctgtgggggttgctggggagagttccgctgctcctgcggccggagcaggtcttggagaccctccagcagggctcttaggcttgccccccgaaagcggaggggtgatggccacccagtggcaggtagttgggatgacagtggagcatgtggagtgtcaggatgcaggcgtgcgggaagctccaggcccactggagggcgccggcgaagccggtggggaggaagccgacgaaaagcctccacagttcgtgtgtagagagtgcaaagagactttcagtactatgaccctcctcaggcggcatgaacggtcgcatcccgaattgcgcccctttccatgtactcagtgtgggaagagcttttctgatagagcaggcctgcgcaaacacagccgcactcacagcagcgttcgtccatacacctgcccacactgtcctaaagctttcttaagcgcgtcagacctgcgcaagcacgagagaacccaccccgtacccatgggtacacccacccctcttgagcccctcgttgcgcttctcggaatgccagaagaaggacccgcttag

SEQ ID NO: 14591 - DNA, 1860 bp, Artificial Sequence
  Description of Artificial Sequence: Synthetic coding sequence
atggaagttgaagctgcagaagccagaagtcctgctccaggttataagaggtctgggagacgatataagtgtgtttcctgcacaaaaactttcccgaacgccccccgagccgcccgtcacgctgctacccacgggcccgctgactgctctgaggaggtcgccgaagtgaagccaaagccggaaaccgaagctaaagccgaagaggctagcggagaaaaggtgagcggaagtgctgcgaaacctcggccctatgcctgccccctatgtccaaaggcatacaaaactgccccagagctgcgcagccacgggaggagtcacaccggcgaaaaaccctttccatgtcccgagtgcgggcgtagatttatgcaacctgtatgtcttagagtgcatttggctagccatgccggagagctcccatttcggtgcgctcattgcccaaaagcgtatggcgctctgtccaagctgaagatccaccaacgcgggcacacgggagaaagaccatatgcttgtgcggattgtggcaaaagctttgcagatccgtctgtcttcaggaagcaccgcagaactcatgcgggtctgcgcccttacagctgcgagcggtgtggaaaagcgtatgctgaactgaaggacctccgcaatcacgaacgcagccataccggtgaaaggccttttctttgtagcgaatgcggaaaaagcttcagccggagcagtagcctcacttgtcatcagagaatccacgccgcacagaagccatataggtgcccagcctgcgggaaagggttcacccagctgtccagttaccagagccacgaacgcacacactccggagagaaaccttttttgtgcccgagatgcggaaggatgtttagtgatccctcctcattcagacggcaccaaagggcgcacgagggggtgaaaccttatcactgcgaaaagtgcggaaaggacttcaggcagcctgccgatctcgcaatgcaccggcgagttcatactggcgataggccattcaagtgtttgcagtgcgacaaaacatttgttgccagctgggatctcaagcgtcacgccttggtgcacagtgggcaacgcccttttcggtgcgaggagtgtggcagagcattcgctgagcgggcgtccttgactaaacactcgagagtgcattcaggcgagaggcccttccactgcaacgcatgcggaaagtcttttgtcgtaagtagcagcctgcgcaaacatgagaggacccataggtctagtgaggccgcgggagttcccccagctcaggaactggttgtagggctagctctgcctgtcggagtggcaggcgagagctcagctgcccctgccgctggcgccggattgggcgacccacccgccggcctcctggggctgcctccagagagcggaggcgtgatggctacccaatggcaggtggtggggatgacggtcgaacacgtggaatgtcaggacgcgggcgtgcgggaagcccctggccccctcgagggggctggcgaagctgggggcgaggaagccgacgaaaagcctccccagttcgtatgccgggagtgtaaggagaccttttcgaccatgaccctcctcaggcggcatgaaagatcccaccccgaacttcgcccttttccatgtactcaatgcggcaagagcttctccgatcgcgccggcctgaggaagcatagccgaacccatagctcagtgcgaccatacacatgtcctcactgtcctaaagctttcctatctgcctccgacctgaggaagcatgagcggacacacccggtccccatggggacacctacacccctggagccgctcgtggccctcctcggcatgcctgaagaaggcccagcttag

SEQ ID NO: 14592 - DNA, 327 bp, Artificial Sequence
  Description of Artificial Sequence: Synthetic coding sequence
atggaagttgaagcggctgaggcacgctctccagctcccggttacaagagatccggccgccgttacaaatgcgtctcttgcactaagacattccccaacgctccccgggccgccagacacgcagcaactcacggccccgccgactgctctgaggaggtcgcagaggtgccccatcgacgcgcaccactccccctgctgcgtgtccgcgaagagctgttaccccttatcctggctcacgtgccgcctgcacacccacgaggaactgaggccctgcctctccctgggctgcgacaagggctgcacgccgcacaatttttacctgagtag

SEQ ID NO: 14593 - DNA, 279 bp, Artificial Sequence
  Description of Artificial Sequence: Synthetic coding sequence
atggaggtagaagccgccgaggcccgctcccctgctcccggctataaaagaagtggcagacgatacaagtgcgtgtcctgtacgaaaacctttccgaatgcaccaagagcagcccggcacgctgccactcacggtcctgccgactgttctgaagaggtagcagaagtgaagcccaaaccagaaacggaggcgaaagccgaggaggcctctggcgaaaaggtgtctggctcagccgcaaagcctaggccttatgcgtgtcccctctgccccaaggcatag

SEQ ID NO: 14594 - DNA, 231 bp, Artificial Sequence
  Description of Artificial Sequence: Synthetic coding sequence
atggaggtggaggccgcggaggctcggagccccgcgcccggttacaaacgctccggaagacgatacaagtgtgtttcttgtacaaaaacctttcccaacgccccaagggccgcacgccacgccgctacccatggtccagccgactgtagcgaggaggtagctgaggtcaagccaaagccagagactgaggcaaaggctgaggaggccagcggagaaaaagtgtcaggctag

SEQ ID NO: 14595 - DNA, 312 bp, Artificial Sequence
  Description of Artificial Sequence: Synthetic coding sequence
atggaagtagaagccgctgaggcgcggagtcccgcaccgggatacaaacgtagtggcagacgttataagtgtgtctcctgtacaaagacgttccccaacgcaccacgcgctgctcgccatgcagctacccatggccctgccgattgtagtgaagaggtggcagaggtcaagccgaaacctgagactgaagcaaaagctgaggaagccagtggagagaaagttagtggtagtgcagctaaacccagaccgtatgcctgccccctgtgtcccaaggcttacaagactgccccagagttaaggagtcatggatag

SEQ ID NO: 14596 - DNA, 1860 bp, Artificial Sequence
  Description of Artificial Sequence: Synthetic coding sequence
atggaagtggaggccgccgaggcacgctcacccgcccctgggtataagcggtcagggcgtagatataaatgcgtctcctgcactaagacctttcccaacgcgccgagggccgcaaggcacgctgcgacgcatgggcccgccgactgttcggaggaagtcgccgaggtaaagccaaagcccgagacagaggccaaggctgaagaggcatcaggagaaaaagtgtccggcagcgcggctaagccccgcccgtatgcatgtcctctctgcccaaaagcttacaaaactgctcctgaactgcggagtcacggtagaagccataccggggaaaagccttttccttgtccagaatgcggccggcgatttatgcagccggtgtgcctgagggttcatctggcatctcatgcaggagagttgccatttaggtgcgcccactgcccaaaggcatatggcgccctctccaagttaaagattcatcagagaggccacactggcgaaaggccttacgcctgtgctgactgcggaaagagttttgcagatcccagcgtgttccggaaacaccgaaggactcacgccggtctcaggccatactcctgtgaaaggtgtggcaaagcctacgccgagcttaaggacctccgaaaccacgaacgctcacataccggcgaacgcccatttctctgttcggaatgtgggaagtctttctcacggtcatcctccttgacttgccaccaacgaatccacgccgctcagaaaccatatagatgtccagcctgcggcaagggatttacgcaacttagctcttaccagtctcacgagcgcacacattccggggagaagcccttcctgtgtccccgctgcggaaggatgttctcagatccgtcctctttccgtcggcatcagagggcccatgagggagttaaaccataccattgcgagaagtgtggaaaggatttcaggcagccggccgatctcgctatgcacaggcgggtacataccggggatcggcccttcaagtgtctgcagtgcgataagacgtttgtggcttcatgggatctgaaacgccatgccctcgtgcattccggacagagaccatttagatgcgaggaatgcggccgggccttcgctgagcgcgccagccttacaaagcacagcagagtacactctggagaaaggcccttccactgcaacgcttgcgggaaatccttcgttgtatctagcagcttgcgaaagcatgagcgcactcatcggagcagcgaagcagcaggcgtccctcccgcccaggagttggtggtgggtctggcattacccgtgggtgttgccggcgagtcctccgctgctccggcggccggcgccgggctaggggacccccctgccggcctgctgggcttgccacctgagtcgggaggcgtgatggcaactcaatggcaagtggtaggcatgacggtcgagcacgttgagtgtcaggatgcaggggtacgcgaagcacctgggccactggagggtgctggggaggcggggggcgaggaggccgacgagaaaccaccacagttcgtgtgcagagagtgcaaagagactttctcaaccatgaccctccttaggcgccacgaacgtagccacccagagctgcgaccttttccatgtacacagtgcggaaaatcattttctgaccgcgccggactgcggaaacactcacggactcactcttccgttaggccatatacttgccctcactgccccaaggcctttttatcagcctctgatctgcgaaagcacgaacgcactcacccagtgcccatgggcacacccactcctctcgaaccattagttgcactgttaggtatgcctgaagaaggccctgcatag

SEQ ID NO: 14597 - DNA, 1860 bp, Artificial Sequence
  Description of Artificial Sequence: Synthetic coding sequence
atggaagtggaggcagcagaggcccggagccccgctcccggatacaagagatctggacgaagatataaatgcgtgagttgcacaaaaactttcccaaacgcaccccgtgcggctcgtcacgctgctactcatggaccagccgattgcagcgaggaggtggcggaagttaagcctaagcctgagaccgaggccaaagcggaggaggccagtggcgaaaaggtatctggatcagccgccaaaccccgtccttatgcttgtccactgtgccccaaagcgtacaagacggccccagagctacgcagccacggtcgatcacacaccggcgaaaagcccttcccttgtccggaatgcggcaggcggtttatgcagcctgtgtgtctcagagtgcaccttgcctcacatgctggcgagctgccattccgttgcgctcactgccccaaggcatatggcgctcttagtaagttaaaaatccatcagcggggtcatacaggtgaacgcccttatgcatgcgccgattgtggtaaaagctttgccgacccaagtgtgttccgcaaacatcggaggactcacgccgggttacgcccatactcttgcgagcggtgtgggaaagcttatgctgaactgaaggacttacgaaatcacgaaaggtcccacaccggggagagacccttcctgtgttccgagtgcggaaagagcttttctaggtcctcgtctctgacatgtcaccagcgcatacacgcagcccagaaaccataccgctgcccagcatgcggcaaaggctttacgcagctgtctagctaccagagtcacgagaggacacactctggagagaaaccgtttttgtgccctcgctgtggcaggatgtttagcgatcccagcagtttcaggagacaccagcgggcacatgaaggggtcaagccctatcactgtgagaagtgtggtaaagattttaggcagcccgctgacctggcaatgcataggagagtccacacaggcgatcgccctttcaaatgtctccagtgcgataagacattcgttgccagctgggacctgaaacgacacgctctcgttcattcagggcagcgtcctttccggtgcgaagaatgtgggcgtgccttcgccgaacgagcatcactcaccaagcacagccgggtacactctggcgaaagaccattccactgtaatgcatgcggcaagtcattcgtggtcagcagctcactgaggaagcatgaaaggacccatagaagcagcgaggctgccggtgtgcctcctgcacaggaattggtagttggcttggccctacccgtcggggtggccggcgagagttcagctgcacctgccgctggagctgggctgggcgatcccccggctggcctgctaggcctccctcccgagagcggtggcgttatggcaacacagtggcaggtggtgggaatgactgttgaacatgttgagtgtcaggacgctggagtacgggaggcccccgggccactagaaggtgctggggaagctggaggcgaagaagccgacgaaaaaccgccacagtttgtgtgccgagagtgtaaggaaacattctccaccatgaccctgctgagaaggcacgaaaggtctcaccccgagctgagaccatttccctgtacgcagtgtggcaaaagcttctccgatagagctgggctgcggaagcactccaggacccacagttctgtgcgcccatatacttgcccgcactgcccaaaagccttccttagcgcaagcgatctaaggaagcacgagaggactcaccccgtgccaatggggactccgactccactcgagcccctagtggccctcctcgggatgccagaagaaggacccgcctag

SEQ ID NO: 14598 - DNA, 1929 bp, Artificial Sequence
  Description of Artificial Sequence: Synthetic coding sequence
atgagcgagccaggaatgctcgggaggaaggacgtctgggttccacgagaaacgccatttactaaggccatggaggtcgaggccgctgaggctcgtagccccgccccagggtataagaggtccgggcgcagatataaatgtgttagttgtaccaaaactttccctaacgcccctagggctgcccggcacgccgcaactcatggacccgcagactgctcagaggaggtggctgaggtcaaacccaagcctgaaactgaggcgaaagccgaagaagccagtggggagaaggtgtcgggatcggccgccaaaccccggccgtacgcttgcccgctctgccccaaagcttacaaaaccgctccggaactgaggagccatggcaggtctcacactggagagaaacctttcccttgcccggaatgtggtaggcggtttatgcaaccagtgtgccttcgggtgcatttggcctctcatgccggcgaattgccttttaggtgtgcacattgccctaaggcctatggggccctctcaaagctcaaaatccatcagcgcgggcatacaggggaaagaccgtatgcctgtgccgactgcggcaaatcattcgcagaccccagcgtcttccgcaagcatagaagaacccacgccggcctgcggccctactcatgcgagagatgtggtaaagcgtatgcggagttgaaggaccttcgcaaccacgaaaggagtcacacaggcgaaagaccctttctgtgtagcgagtgcggcaaaagcttctcaaggtcgtccagtcttacctgccatcagcggattcacgccgcacagaaaccttacaggtgtcctgcgtgtggaaaaggcttcacccaactctcgagttaccagtctcatgaacggacacattcaggagaaaaaccatttctgtgtccacgctgtggccgcatgttctcggatccatcttcgtttagacggcaccaaagagcccatgagggcgtcaagccctaccactgcgaaaagtgcggcaaagatttccgacagccggctgatctggctatgcaccggagggtgcacaccggagaccgtccattcaaatgcctgcagtgcgataagacctttgtcgcttcttgggacctgaagagacacgctcttgtccattctgggcagcggccatttagatgcgaagaatgtggcagggccttcgcggaaagggctagcctcaccaagcactcaagggtgcacagcggcgagcggccgtttcattgtaacgcctgcggtaagtcttttgtggtaagttcttcacttcgaaaacacgagcggacacatcggtcatcagaagcagcaggagtccctcctgcacaggagctggttgtcggactcgcgctgccagtgggggtggcaggggagagctcggctgcacccgccgcgggcgctgggctgggagatccaccggctggactgttaggacttccccctgagagcggaggcgtgatggcaacgcagtggcaggtggtcggtatgaccgtggaacacgtggagtgccaggatgctggagttcgagaggctcctggaccgctggaaggggccggggaagcaggcggcgaggaggccgatgaaaagccgccccagtttgtgtgcagagagtgcaaagagaccttctcaacgatgacgttactgcgacgccacgagcgcagtcatcccgaacttagacctttcccatgcacccaatgtggtaagtccttctcggaccgtgcgggcttgcgcaagcactccaggacacattcatcagtcaggccgtatacctgccctcactgccctaaagcctttctttcagcctctgatctcagaaagcatgagagaacccaccccgtgcccatgggtacccccacgccactcgagccattggttgctctcctggggatgccagaagaaggtccagcatag

SEQ ID NO: 14599 - DNA, 1395 bp, Artificial Sequence
  Description of Artificial Sequence: Synthetic coding sequence
atggttagcggcctgcgcctggcaagtcggtctggcgaggaaggatggcttaaacctgctgtcgctcggctgggcccgcctaggcatcgactgcgcaacttgcgcaccgaatctccgtggaggagtcgaggctcagtgttgttttgctccgggcctggaagagcaggtagggcagccgaaccactgcatccggtatgcacgtgtggccgccactttcggagaccggagccgtgtcgtgagccccttgcgtctcctattcaggattccgtagcctttgaggacgtcgcggtcaacttcacgcaggaggagtgggcgttgctcgacagttcacagaaaaacctataccgggaggtcatgcaagagacttgccgaaacctagccagtgtaggctctcagtggaaggatcagaatattgaggatcacttcgagaaacctggcaaagacatccgaaatcacattgttcagaggctctgcgaatctaaagaggacggccagtacggcgaggtggtgagtcagatcccaaacctggaccttaacgagaacattagtactggcctgaaaccctgtgagtgtagcatctgcggcaaagtttttgtgcggcacagcctcctgaaccgtcacatcctggctcactccggctataagccatacggcgagaagcaatacaagtgcgaacaatgcgggaagtttttcgtttcagtccctggcgtgcggcgtcatatgattatgcactctggcaatccagcttacaagtgcacgatttgtgggaaagccttttatttcctgaattccgtggaacgccatcagagaacccacactggcgagaaaccatataaatgtaagcagtgtggcaaagcattcaccgtgagcggtagctgcctcatacatgagaggacgcacaccggcgagaagccctacgaatgtaaggagtgcggaaagactttccgcttctcttgttcctttaagacacacgagcgaactcacacaggggagaggccatataaatgcaccaaatgtgacaaggcattttcctgcagtacatccctgcgctatcatggctccatccatactggcgaaagaccatacgagtgcaagcaatgtggtaaggccttctcccgattaagcagcctgtgcaatcaccgttcaacccacactggggagaagccctacgaatgcaaacagtgtgatcaggctttttcacggctctccagtttgcacctacatgagagaatccacactggtgaaaaaccttacgaatgtaagaagtgtggtaaagcctatacacgtagttcccatcttacacggcacgagagatcacacgacatagaagccggatgttccgatagcgcttacaatccttcgaccctcgggggccaaggagtctggatcgcctag

SEQ ID NO: 14600 - DNA, 474 bp, Artificial Sequence
  Description of Artificial Sequence: Synthetic coding sequence
atggtctcgggattgaggctggccagtcggagcggagaagagggctggctcaaacctgccgtggctcgattagggcctccccgccaccgactaaggaatttgagaacggagtctccatggagaagtaggggatcggtcctgttctgctcgggcccagggcgggcaggccgagctgcggaaccccttcacccagtgtgcacgtgcgggcggcatttccgtcggcctgagccttgtagggaaccactggcaagccctatccaggactcagtggccttcgaggacgttgctgtgaacttcacacaagaagagtgggctttactggactcctcccaaaaaaatctctacagggaggtgatgcaggaaacatgcaggaacctggcctccgtggaaatcatttcatatcgcgattgtgtcaaagtgaaaaagatggtgagcatggagaagctctcagcaaaattccagatcttgatctag

SEQ ID NO: 14601 - DNA, 216 bp, Artificial Sequence
  Description of Artificial Sequence: Synthetic coding sequence
atggattctgtggcctttgaggacgtggccgtgaattttactcaagaggagtgggcgctgttagatagcagccaaaagaatctgtacagagaagtgatgcaggaaacatgtcgaaacttggcttccgtcgagattatttcttaccgggactgtgtcaaggtaaaaaagatggtctcaatggaaaagttgtcagcgaagtttcagattttaatctag

SEQ ID NO: 14602 - DNA, 186 bp, Artificial Sequence
  Description of Artificial Sequence: Synthetic coding sequence
atggattcagtggcctttgaggacgtagctgtcaacttcacccaggaggagtgggcactgctggacagttctcagaagaatttgtacagagaagtgatgcaggaaacatgccgaaatcttgcttctgaagcaaacgggaagaccagaatcctgaagatcaccagcaagaatcttgggaaaatatag

SEQ ID NO: 14603 - DNA, 1137 bp, Artificial Sequence
  Description of Artificial Sequence: Synthetic coding sequence
atggatagcgtcgcattcgaggatgtagccgtcaattttacccaggaggagtgggccttactggattcttcccagaaaaatctgtatcgtgaggtgatgcaggagacctgcagaaatctggcctccgtggggagccagtggaaagaccagaatattgaagaccactttgagaaacccgggaaggatattaggaaccacattgtgcagcgcctgtgcgaatctaaggaggacgggcagtatggcgaggttgtaagccaaatcccaaacctcgatctgaacgagaatatctcaaccgggttgaagccatgtgagtgcagcatctgcggaaaggtgttcgtccgccacagcctgctgaacaggcacatactggcacacagcgggtacaagccctacggtgagaagcagtacaagtgcgagcagtgtggcaaatttttcgtcagcgttcccggcgtgcggcggcatatgattatgcattccggaaaccccgcatataaatgtaccatttgtgggaaggccttctattttttgaacagtgtcgaaagacaccagcggactcacacaggagaaaaaccatacaagtgcaagcagtgcggtaaagcttttaccgttagcggttcgtgccttatacacgagcgcacccatacaggtgagaaaccgtacgagtgtaaagagtgtggaaagacattccggttttcttgtagcttcaagacccatgaaaggacgcacacaggcgagaggccctacaaatgcaccaaatgcgacaaggcatttagctgtagcacttctctgagatatcacggctccattcatactggggaaaggccgtatgaatgcaagcagtgtggaaaggctttcagtagactgtcttctctttgcaatcatagatccactcatacaggggagaagccatacgaatgtaagcagtgtgatcaagccttctcaaggctctcatccctgcaccttcatgaaaggatccacaccggggagaagccatacgagtgcaaaaagtgtgggaaagcctatacaaggtcctcccatcttaccagacacgagcgctcacatgacattgaagccggctgctctgattcagcctacaatccttctacgctcggaggacaaggagtgtggattgcctag

SEQ ID NO: 14604 - DNA, 1137 bp, Artificial Sequence
  Description of Artificial Sequence: Synthetic coding sequence
atggactcagtagcttttgaggacgtcgccgtgaatttcacccaagaagaatgggctttgttggatagctctcagaagaatttgtatagggaggtgatgcaggaaacgtgtcgaaatctagcgtcggtgggatcacagtggaaggaccagaatatcgaggatcattttgagaaacccggaaaggatatcaggaatcatatcgtgcagcgcttgtgtgagtctaaggaagacggccagtacggtgaagtggtttcgcagatacctaacctggatcttaatgagaacattagcactggattaaaaccatgtgaatgtagtatctgcgggaaagtgttcgtcagacattctcttttgaatcggcatatattagcacactcaggatataaaccttatggagaaaaacagtacaaatgtgagcagtgcggcaagtttttcgtgtcagtgcccggagtgagaagacatatgattatgcatagcggtaatcccgcatataaatgtacaatttgcggcaaggccttctatttcctgaatagcgtagagcggcatcagagaacacacactggcgagaaaccttacaagtgtaagcagtgcggcaaagcattcaccgtttccggttcttgcctcatacacgagcggacccataccggggaaaagccttatgagtgcaaggagtgtggtaagacgttccggttctcatgttcctttaaaacacacgagcggacgcacaccggagaacgaccatataagtgtactaagtgtgataaagcattttcttgtagcacttctttacggtatcacggatccatacataccggagaaagaccctacgagtgtaagcagtgtggaaaagcattttcccgcctctcctctctgtgtaatcacaggagtacacatacaggtgaaaagccttacgagtgcaagcagtgcgatcaggcattcagtcggctgtccagcctacacctgcacgagcgcattcacaccggagaaaagccctacgagtgcaagaaatgtgggaaggcctacactaggagtagtcaccttacaagacatgaaaggtcccatgatattgaagcaggatgctccgatagtgcctataatcccagtacactcggtgggcaaggggtgtggattgcttag

SEQ ID NO: 14605 - DNA, 1170 bp, Artificial Sequence
  Description of Artificial Sequence: Synthetic coding sequence
atggactccgtctcattcgaggatgttgcagtcgcctttacacaggaggagtgggccctgctcgatccatctcagaaaaatctatatagagacgtcatgcaggaaatttttcgtaatttagccagtgtgggcaacaagtcagaggaccagaatatccaggatgactttaagaatcctggaagaaacctgtcaagccacgtagtcgaacggctgttcgaaataaaggagggatcacagtatggcgagaccttctctcaagacagcaacttgaatctgaataaaaaggtgtccacaggcgtgaaaccatgtgaatgcagtgtgtgtggcaaggtcttcatttgccacagcgccttgcataggcacattctgagtcacatcggtaataaactgtttgaatgcgaagagtgcccagaaaagttgtatcactgcaagcagtgcggaaaggcattcatcagcctgacgtctgtggaccgccacatggttacgcatacttctaatgggccttacaagggacctgtctacgagaagcccttcgacttcccatcagtattccaaatgccacagagtacttacaccggcgaaaaaacttataaatgcaaacattgcgataaggcctttaactattcatcatacctaagggagcacgagaggacacatactggagagaagccttatgcatgcaagaagtgtggcaagagctttacgttcagctccagtctgcgacagcatgagcgatctcataccggcgagaaaccgtatgagtgcaaggagtgcgggaaggccttcagcaggagcacttacctcggcattcacgagcgcacgcacactggcgaaaaaccgtatgaatgcattaagtgcggcaaagccttccggtgcagccgcgttttaagagtgcacgagagaacacactccggcgaaaaaccatatgaatgtaagcagtgtggtaaagcgttcaaatattcctccaatctttgcgaacatgagcggactcacaccggtgtgaaaccctacggctgtaaggaatgcggcaaaagctttacatcttcctcggccctgaggagtcacgaaagaacccataccggcgagaaaccatatgaatgcaagaaatgcgggaaggcattctcgtgctcaagcagcctccggaagcatgagcgagcctatatgtggtag

SEQ ID NO: 14606 - DNA, 357 bp, Artificial Sequence
  Description of Artificial Sequence: Synthetic coding sequence
atgggccttctcgccttcagggatgtggctttggagttcagccctgaggagtgggaatgcctggacccagcccagcgttccctttatcgcgatgtgatgctggagaattatagaaatcttattagcctggggttggccatgagcaaaccagagctgataatttgtttggaggccaggaaggaaccgtggaacgtgaacactgaaaaaacagcccggcactccgtcgaaactaggttcaggcacgtcggacaggcaggactgaagcttctaacgtctggggatcctccagctctggcctcccagtccgccgggattacaggcaccggacaccactgccagcccatctgcgtcttttag

SEQ ID NO: 14607 - DNA, 1605 bp, Artificial Sequence
  Description of Artificial Sequence: Synthetic coding sequence
atgctgtctccagtgtcacgagatgctagcgatgctctccagggcaggaaatgcctgaggccacggtcaagacggctgccactgcccgcagccgtacgtgcacacgggcctatggccgagcttaccgacagcgcccgaggctgtgtggtgtttgaagacgtgtttgtgtatttcagccgggaagagtgggagctgctggatgatgctcaaagactgctgtatcatgacgtgatgcttgagaactttgcactcctggcttcgctggggattgcattctctcgatctagggcagtcatgaaactggagcgtggcgaagagccatgggtctacgatcaggtagatatgacttctgcaacagaaagagaagcacagcgggggttgcgaccaggatgttggcatggcgttgaggacgaggaagtgtcttcagagcagagcatattcgtcgcgggagtctctgaagtacgcacacttatggcggaattggaatctcacccatgcgatatctgcgggcctatactgaaagacactctccacctcgccaaatatcatgggggcaaggccagacagaagccatatctgtgcggggcctgtggaaagcagttctggttcagtacagacttcgatcagcaccagaatcagcctaatggaggtaaactgtttccaagaaaggaaggccgcgattcagtcaaatcatgtcgagtccatgtgccagagaaaaccttgacttgcggcaaagggagacgcgacttttctgccacaagcgggctgctccagcatcaggcatccctgagcagtatgaagcctcacaaatctacaaagctagtcagtggcttcctaatgggtcagaggtaccatagatgcggggaatgtggtaaggcctttacacggaaggatacactggcccggcaccaacggatccacacgggggagcgcccttatgagtgcaatgagtgtgggaagttcttcagtcagagttacgatctgttcaagcaccaaaccgttcacactggcgagcggccctacgagtgcagcgagtgcggcaagttctttagacaaataagcggtctgattgagcacagacgcgtacataccggagagcggctctatcagtgtgggaagtgtggcaaattctttagctctaaatccaacctgatcagacaccaggaggtacacaccggggcccggccttatgtgtgctcggaatgtggcaaggagttcagtagaaagcacacgctggtgctgcaccaacgaacccacaccggggagcgcccttacgaatgttccgaatgtggcaaggctttctctcagtcctctcatcttaatgtccactggaggattcacagcagcgattacgagtgttctaggtgtggcaaagcctttagctgtatctccaaactaatccagcaccagaaagtccactccggagagaagccttacgagtgcagcaaatgcggcaaggccttcactcagaggcccaacctgataaggcactggaaggttcacactggcgaacgcccatatgtgtgctctgagtgcggaagagagttcatcagaaagcagaccctcgtcctgcatcagcgggtgcatgccggcgaaaagctgtag

SEQ ID NO: 14608 - DNA, 1311 bp, Artificial Sequence
  Description of Artificial Sequence: Synthetic coding sequence
atgaagcttgagagaggtgaggaaccttgggtgtacgaccaggtggatatgacatctgcaacggagcgagaagctcagcgcggcctgaggccaggatgttggcacggcgtcgaagatgaagaagtgagctccgagcagagtattttcgtcgctggggtcagcgaagtgaggactctgatggccgaactcgaatcccacccctgtgatatctgcggtcctattctaaaagacacacttcacttagctaagtatcatggcgggaaggctcgacagaaaccttatctatgcggtgcctgtggcaaacagttttggttttcaaccgacttcgaccagcaccaaaatcaacccaatggggggaaattatttcctcgaaaggagggtagggactccgtgaagagttgtcgcgtgcacgttcccgagaaaacgctgacctgtgggaagggcaggcgggatttttctgctacatcaggtctgttgcagcaccaggcgagcctctccagtatgaagccgcataagtccaccaagcttgtatcggggtttcttatgggacagcgctatcatagatgcggtgaatgcggcaaggccttcactaggaaagacacactcgcaaggcatcagcggatacatacgggagaacggccttatgaatgtaatgagtgtggaaaattcttttctcagtcttatgacctctttaaacaccagaccgtgcacaccggcgagagaccgtatgaatgttccgaatgcggaaagtttttcaggcagatttccggtctgatcgagcaccgacgcgttcatacgggtgagcgtctgtatcagtgcggcaagtgtgggaaatttttttcaagcaagtctaacttaataaggcaccaggaggtgcatactggcgccaggccatacgtgtgctcagaatgcgggaaggagtttagtagaaagcataccctggtgctgcatcagcgtacccacactggcgaacgcccatatgaatgttccgagtgtggaaaggccttttctcaatcctctcatctgaacgttcattggagaatccactctagtgattacgaatgctctcgctgtgggaaggcgttttcgtgcatttccaagttaatccaacatcagaaagttcatagcggagaaaaaccttacgagtgttcaaagtgcggaaaggcatttacccagagaccaaacctgattcggcactggaaagtccacaccggggagcgaccgtacgtctgctccgagtgtggacgggaatttattaggaagcagactctggtactgcatcaacgtgtacacgctggcgagaagctgtag

SEQ ID NO: 14609 - DNA, 1359 bp, Artificial Sequence
  Description of Artificial Sequence: Synthetic coding sequence
atgttcgcaacttctggggccgtcgcagccgggaaaccctattcttgttccgaatgcggaaaatctttctgttactcatccgttctgctgaggcatgagcgcgcccacgggggagacgggcggttcaggtgtctcgagtgcggggagaggtgcgcaagagctgcagaccttcgggcgcatcgtcggactcatgccggccagaccctctacatctgcagcgagtgtgggcagtcgtttcgtcatagcggcaggctggatctgcacctgggtgcacaccggcagagatgccgcacgtgtccgtgccggacatgcggaaggcggtttccccacctgcctgcacttctgctccaccggcgtcgacaacacctgcctgagagaccccgcaggtgtcccctgtgcgcgcggacgttcagacagtctgcccttctgttccatcaggcccgggctcaccccttaggaactacctcagatcctgctgccccgcctcacaggtgcgcacagtgtccgcgagcattcagaagcggtgcggggttgagatcccatgcgcgcatccatgtgtcccgatctcccacccgcccccgggtgagcgacgcccatcagtgcggagtgtgcggtaaatgttttggcaagagctccaccctaacccggcacttgcaaactcatagtggcgaaaagcctttcaagtgtccagagtgtggtaagggctttttggagagtgctactctggtccggcaccagagaacccatactggggagaagccctacgcttgtggagattgcggccgctgtttttccgagtcttcgaccctactcaggcatcggagatcccaccagggagagagaccacacgcatgtgcaacctgcggtaaagggtttggtcagaggtcagatctcgtcgtgcatcagcgcatacatacaggtgagaaaccatttgcatgtcccgaatgcggcaggagattttcagatcggtctgaccttaccaaacaccggagaacacatacaggagagaaaccttatagatgcgagctctgcggcaagaggttcacctgcgtctcaaacctaaatgtacataggaggaaccacgccggccacaaaccccacaagtgcccagagtgctccaaggcctttagtgtcgcatctaaactggcgctgcaccgtaaaactcacctaggagagaggccagctgaatgcgcagagtgcggtaagtgtttttcacatagcaggtcactttcacagcatcaacgggcccacacacgcgcacgaacagctgccgccgtggctattcagagtgccgtgggaactgcgctcgtcttcgaagggccggctgagcaggagaagccaggattctccgtcagctag

SEQ ID NO: 14610 - DNA, 672 bp, Artificial Sequence
  Description of Artificial Sequence: Synthetic coding sequence
atgtttgcaaccagtggtgctgtcgcggcaggcaaaccttactcttgtagcgaatgcggtaaatctttttgttatagctctgtcctattgagacatgagcgcgcccacggcggggatggacgcttcaggtgcctggaatgcggggagagatgcgctcgggctgccgatctgagagcacaccgacgcacgcatgccggacagacactttatatctgttcggaatgtgggcagtctttcagacacagcggtcggctcgatttgcacctaggagcgcaccgccagcgatgcaggacctgtccttgtagaacctgcggccggagatttccacatctgcctgccctgctcctccatagaagacgccagcacctcccagaaagaccactcctgccttgctgccccagaatcacaagaattctgtcttctggggtgggagccgggagccaaggaacgctgagactaccctgcgtgcaggagccaagatgctggtgcgtaccactcatgttactgtgcagcctggtgtttctgattttcctcccgttgttttgcctgctgctgagttacttaattccggcacacatcttctctttccctgattatttctgctgcccggctagttccggaaacgggcaccgcttcgggtgtcgccacgtgacttctcctgtggcctcctag

SEQ ID NO: 14611 - DNA, 114 bp, Artificial Sequence
  Description of Artificial Sequence: Synthetic coding sequence
atgtttgctacaagcggcgccgtggcagcaggcaaaccgtactcttgctctgagtgtgggaagagcttctgttactcatccgttctccttcggcatgagagagcccatggttag

SEQ ID NO: 14612 - DNA, 210 bp, Artificial Sequence
  Description of Artificial Sequence: Synthetic coding sequence
atgttcgcgacctctggtgctgtggccgccggcaaaccttatagctgctcggagtgcgggaagtcattctgttactcaagcgtgctattgcgccacgaaagggctcacggcggcgatggccgcttccgctgtctggaatgcggcgaacgatgtgccagagccgctgatctcagagcgcaccgtcggactcatgcaggtcagacactgtag

SEQ ID NO: 14613 - DNA, 15 bp, Artificial Sequence
  Description of Artificial Sequence: Synthetic coding sequence
atgtttgctacatag

SEQ ID NO: 14614 - DNA, 1767 bp, Artificial Sequence
  Description of Artificial Sequence: Synthetic coding sequence
atgctggagaattatcgcaatttagtgtttctgggaattgccgccttcaaaccagacctgattatctttttggagcagggaaaggagccttggaatatgaagaggcacgagatggtggaggagccacctgtaatctgcagccatttttctcaggaattttggcctgagcaagggattgaggattccttccagaaaatgatcctcagacgttatgacaaatgcggacatgagaacctgcacctcaaaattagctgcactaacgtggacgagtgcaacgtgcacaaggagggctataataaactcaaccagagtctgactaccacccagagcaaagtcttccaatgtggaaaatacgccaacgtattccacaaatgtagcaattctaacaggcataagatcagacacacaggtgagaagggcttgaaatgtaaagagtacgtgcgttcattctgcatgcttagtcacctgtcccaacatgagcgcatctataccagagagaactcctacaagtgtgaagagaatggcaaggctttcaattggtcttctaccctgacctactacaaatcaatccacacgggcgagaaaccttataaatgcgaggagtgtgggaaagccttctcaaagttttcaattctcactaaacataaagttattcacactggagagaaaccctataaatgcgaggaatgtggtaaggccttcaacaggtcctctatcctgacaaagcacaaaatcattcacaccggggagaaaccatacaagtgtgaggaatgcgggaaagggttcagctccgttagcaccctcaacactcacaaggcaattcatgccgaagagaagccttacaaatgcgaggagtgcggaaaagcaagcaactctagttccaaactgatggaacataagcggattcatacgggagagaaaccctataagtgtgaggagtgtggtaaggcattctcttggtcttcatctcttaccgagcataagcgaatccacgccggggagaaaccctacaaatgcgaggagtgtgggaaagcttttaaccgatcttcgattctgaccaagcacaaaattatccacacaggtgagaaaccatacaagtgcgagggctgcgggaaagcttttagtaaggtgtcaaccctgaatacccataaagccattcacgccgaggagaaaccatataagtgtgaagagtgtggaaaggcgagcaacagctcaagcaaattgatggagcacaagcgaattcacacaggcgagaaaccttacaagtgcgaggagtgcgggaaagccttcagctggagcagctcattgactgaacacaagcgaatacatgccggcgaaaagccctataaatgtgaggagtgtgggaaggcattcacttggtctagctcatttacaaagcacaaacggatccacgctgctgaaaaaccttacaaatgtgaggagtgcggcaagggcttctctacctttagcattctgaccaagcataaaatcattcatacaggcgagaagaggtataaatgcgaggaatgcggaaaggccttctcttggtcctccattcttaccgaacataagattatccataccggtgaaaagccttacaagtgcgaagagtgcggtaaggcatttagtaggtcgtctagcctcacccgccacaagcgcatccacacaggagagaagccatataaatgcgaagaatgcgggaaggctttcaagtcttccagcaccgtgtcctaccataagaagattcacacgggagagaacccgtag

SEQ ID NO: 14615 - DNA, 1755 bp, Artificial Sequence
  Description of Artificial Sequence: Synthetic coding sequence
atggccctgtcacaggggttgtttacatttaaagacgtagctattgaatttagccaagaagagtgggaatgtctagacccagcccaaagagcactgtaccgcgacgtgatgctggagaactaccgaaacctcctctctcttgacgaggacaacatcccccccgaagacgacattagcgttggattcacctctaaaggcctgtctcctaaagagaacaataaagaggagctgtaccatctcgttattttggagcgcaaggagagccatggcataaataactttgacctcaaggaggtatgggagaatatgccaaagtttgacagcctttgggattacgacgttaaaaactataagggaatgccccttacttgcaataaaaacttaacccatcggaaggaccagcagcacaataaatctagcatccacttcagcctgaaacagtctgtcagcatcagagactctgctcatcaatattttattcatgataaaccttttattcggaatctactgaaactgaaaaataatatccgctatgctggaaacaaatacgtgaagtgtttcgagaataaaattggcctcagtttgcaggcacagctcgctgaactgcaacgcttccagaccggggagaagatgtatgagtgcaaccccgtggagaagagtatcaatagttctagcgtgagcccattgcccccttgcgtgaagaacatctgcaataagtatcggaagattcttaaataccctctcttgcacacacagtacggtcgaacacatatacgggagaaaagttataaatgcaacgactgcggcaaagcattctcgaagtcatccaatcttacaaatcatcaaaggatccacagtggacagcggccatataaatgtaatgaatgtggcaaggcattcaaccagtgttctaaccttacgagacaccagcgagtgcacaccggtgagaaaccgtaccagtgcaatatctgcggaaaagtctgctcccagaactccaacctggcctcccatcaacgaatgcatacgggcgaaaaaccttataagtgcaatgagtgcggaaaagcttttatccagcggtctcatctgtgggggcacgaacgcatccacaccggggagaagccctataagtgtaacgagtgtgacaaagcatttgctgagagatcatcactgacccaacacaagcggattcatacgggcgaaaagccttacatatgtaacgagtgcggcaaggcctttaaacaatgtagtcatcttacacgccaccagaatatacaccctggagaaaaaccccacaagtgtaacgtgtgtggtcgggcctttatacagagcagttcactcgtcgagcatcagaggattcacaccggcgaaaaaccctacaaatgtaacaagtgtgacaaggcctttataaaaagatctcacctctggggccatcagcgaacccacaccggcgagaaaccttataagtgcaccgagtgcggtaaggcctttactgaacggagcaacctgacacagcataaaaaaatccataccggggaaaagccatacaagtgtacagagtgtggaaaggcttttactcaatttgcaaaccttaccagacaccagaagattcacattgagaaaaaacattgtaagcacaatattcatgggaatgcattgtttcagtcgtctaatttaggagatcaccaaaaatcatataacagggaaaaacacattaaatacaacgagactaaaattaaatacagctcttgtacatag

SEQ ID NO: 14616 - DNA, 540 bp, Artificial Sequence
  Description of Artificial Sequence: Synthetic coding sequence
atggccctgtctcagggactgtttacttttaaagacgttgctatcgagttcagtcaggaggaatgggagtgcttagatccagcgcagcgagcgttatacagggacgtcatgctggagaactatagaaacctgctatcactggatgaagataatattccgcctgaggatgacatcagtgtcgggttcacatccaaaggtttgtcgcctaaggagaacaacaaggaggaattgtaccatctggttatcttggaacgcaaggagagccatggtatcaataatttcgacctgaaagaggtttgggaaaacatgcctaagttcgactctttgtgggactatgacgtgaaaaactataaaggtatgccccttacctgcaacaaaaacctgacccaccgtaaggaccagcagcacaacaaatcatctattcacttctctctgaagaagaaaaagaagaagaaaaagaagcagaacaagacaaaaccaaaggcaacaaaagagaagcgaagaaagaataagggaaaaaataagaccaacaccaaatag

SEQ ID NO: 14617 - DNA, 1578 bp, Artificial Sequence
  Description of Artificial Sequence: Synthetic coding sequence
atgggcaccatatcactttgtattggcgtgtgtgccttcgaaggcgctaatacaagcacctctttttataagctggtatacacggccattctgtcttactccatccaggaccttctgccggaacaggatatgaaggacctatgtcagaaggtaacgttaacccggcatcgctcatggggattggacaacctgcaccttgtgaaggattggcgcaccgtgaacgaagggaaggggcagaaagaatactgcaatcggctcacccagtgttcatccacgaagtccaagattttccaatgtatcgagtgcgggcggaacttctcttggagaagtatcctgacagagcacaaacggatacataccggcgaaaagccttataagtgtgaagaatgtggaaaagtcttcaaccgctgcagtaaccttaccaagcataaaaggatacataccggcgagaagccatataaatgcgatgagtgtggcaaggttttcaactggtggtcacagctcaccaaccataagaagattcacaccggagagaaaccatataagtgtgacgaatgcgacaaagtgtttaattggtggtctcagcttacttcccacaaaaagatacactcaggcgaaaagccatacccatgcgaagagtgtggtaaagcctttacccagttcagcaacctgacccagcataagaggattcacacgggagagaagccctacaaatgtaaagagtgctgtaaagcgtttaacaaattctctaatcttactcagcataagcggatccatacgggagagaagccgtacaagtgcgaagaatgcgggaatgtgttcaacgaatgcagtcatctgactcgccaccgaagaatccataccggcgaaaagccatacaagtgtgaagagtgcggcaaggccttcacacagttcgcttcactgacacgacataagaggatccacaccggtgagaagccttatcagtgcgaagaatgcggcaaaacatttaataggtgttctcacctgagtagccacaaacgcatccacaccggggagaaaccctataagtgtgaagagtgtgggcgcaccttcacccagttttccaacctcacacagcacaagcggattcatactggcgagaagccatacaagtgtaaagagtgcggcaaggcattcaacaaattttcttctctgacgcagcaccggcgcatacatacaggcgtgaaaccctataaatgtgaggagtgtggaaaagtcttcaaacaatgctctcatctcacatcacacaagcgcatccacactggagaaaagccttacaagtgcaaggagtgtggcaaagccttctaccagtcttctatcttaagcaagcacaagcgcattcacaccgaggagaaaccttataagtgcgaggaatgcggaaaggccttcaatcaattttcttcactaacccgacataagaggatccacacgggtgagaaaagatataagtgcaaagagtgcggtaaagggttctatcagtcaagcattcacagcaaatataaacgaatctacaccggggaagaacccgacaagtgcaagaaatgtgggtctctttag

SEQ ID NO: 14618 - DNA, 1743 bp, Artificial Sequence
  Description of Artificial Sequence: Synthetic coding sequence
atgcccgggcatcccgagtccagaaaaactaggagaattctcaccatgctgccgagactggtcctgaactctttccctcaagtgattttgctccctaacccgcccaaggtgctgcggcttcagggactcttggctttctctgacgttgtcatcgaattcagcccagaggagtgggcatgtttagatccagctcagagaaatctgtatagggacgtgatgtttgaaaactatagaaatctggtttccctggctatcttgagttattctattcaagacctgttgccagagcaagatatgaaggacctctgccagaaagtgacactgactaggcaccgatcttggggcctggataacctgcacttggtgaaagattggagaaccgtgaatgaggggaagggacagaaagagtactgcaaccgtctgacccaatgtagctcaacaaagtctaagatctttcagtgcatcgagtgcggacggaacttttcatggaggagtattctgactgagcataagaggatccatactggtgaaaagccttacaaatgcgaggaatgcggaaaggtgttcaatcggtgcagcaacctcactaagcataaacgcattcacactggcgaaaaaccgtacaaatgtgatgagtgtggcaaggtcttcaattggtggagccaacttacaaaccataaaaagatccacaccggagagaaaccgtataagtgcgacgaatgcgacaaggtgtttaattggtggtctcagctgacctcccacaagaagattcatagtggagaaaaaccatacccgtgcgaggaatgtggtaaggcatttacccaattctccaaccttacgcagcacaagcgcatccataccggggagaaaccctataagtgtaaggagtgttgtaaagcattcaacaagttttcgaatctaacccagcacaaacgcatccacacgggggagaagccttataagtgtgaggagtgcggaaacgtcttcaacgaatgctcccatctcacgaggcataggaggatccatactggcgaaaagccgtataagtgtgaagagtgtggaaaggctttcacccagttcgccagcctgacacgccacaagcgcattcatacgggcgaaaagccgtaccagtgcgaggagtgcggcaagaccttcaatagatgcagccatttgtccagccacaaaaggatccacaccggagaaaagccgtataaatgtgaggagtgcggacgaaccttcactcagttcagtaacctgacacaacacaaacgcattcataccggggagaaaccttacaaatgcaaggaatgtggcaaagccttcaataagttctctagcctgacccagcaccgtagaatacacactggtgtaaagccttataaatgcgaggagtgcggaaaagtctttaaacagtgttcacatctaacgtcccataaacgtattcatacgggcgagaaaccctacaaatgtaaggagtgcggaaaagccttttatcaaagtagtatcttaagcaaacataagcgcatccacaccgaagagaagccctacaagtgcgaggagtgcggaaaggcattcaaccagtttagctcactcactaggcacaagcggattcatactggtgaaaagaggtacaaatgtaaggagtgtggaaagggtttttaccaaagctctatccattccaagtataagaggatttacacaggcgaggaaccggacaagtgcaagaagtgcggtagcttgtag

SEQ ID NO: 14619 - DNA, 684 bp, Artificial Sequence
  Description of Artificial Sequence: Synthetic coding sequence
atgccggggcaccccgaatcacggaagactagaaggatactcacaatgcttcctagactggtcttgaactcgtttccacaagtcatcctcctgccgaatccgcccaaagtcctgaggctccagggcctgttagccttctctgacgttgttatagagttctctcccgaggaatgggcttgcctcgaccccgcacagaggaatctctatagggacgtcatgttcgagaactatcggaacctggtaagccttgcgatcttgtcttacagtatacaggacctcctgcccgagcaagacatgaaagacctatgccaaaaagtcactttgacacgtcacagatcatgggggctggacaacctacacttggtcaaagattggcgcactgtgaacgaaggcaaggggcagaaggagtattgtaatcgcctgacacagtgttcctctacaaagtccaaaattttccaatgcattgaatgcggccggaactttagctggaggtcgatccttaccgaacacaaacgcatccacaccggggagaaaccatacaagtgcgaagaatgtggcaaagtgttcaataggtgcagtaacctgacaaaacacaaacgaatccacactggggagaagccctataagtgcgatgagtgtgggaaggtcttcaattggtggtctcagttgactaaccataaatag

SEQ ID NO: 14620 - DNA, 1236 bp, Artificial Sequence
  Description of Artificial Sequence: Synthetic coding sequence
atggcaaaaaggccaggaagccctggaagccgagaaatggggcttctgaccttcagagacgtcgtcatcgaattctccctcgaagagtggcagtgtttggaccacgcccaacaaaacttgtatcgcgacgtgatgctggaaaactataggaacctggtcagtctaggcattgctgtgtccaaaccagatttgatcacctgcctcgaacagaataaagagccctggaacattaagaggaatgaaatggttacaaagcaccctgttatgtgcagccacttcacccaggacttgcctcctgaactcggaatcaaggactcgctgcagaaggtaattccccggaggtatggaaaaagcggccacgataatctgcaagtcaagacctgcaagtcgatgggtgaatgtgaggtacagaagggagggtgtaacgaagtaaatcagtgcctgtctaccactcagaacaaaatatttcagacccacaagtgcgtcaaggttttcggaaaattcagcaactctaacagacataaaaccagacacactggtaaaaaacacttcaagtgcaaaaaatacggcaagtccttttgtatggtgagccagctccaccaacatcaaattatacatacacgtgaaaattcttatcaatgtgaggaatgcggcaagccattcaattgttcctctaccctatccaaacataaacgaatacacacaggggagaagccttacaggtgtgaggagtgtggaaaggcatttacgtggtccagcaccctgaccaagcaccgtaggatccataccggagagaagccttatacctgcgaagagtgcggacaggcgttttcacgctcatctaccctcgcaaaccataagcggattcacacaggggagaaaccatacacttgcgaggaatgcggaaaggctttctctctcagtagttctttaacttaccataaaaggatacataccggcgaaaagccttacacttgcgaggaatgtgggaaggccttcaactgctcttcaactttgaagaaacataagatcattcataccggcgagaaaccctacaagtgcaaagagtgcggcaaagccttcgcctttagctcgacgctgaacacccataagcgcatccatacgggcgaggaaccttacaagtgcgaagagtgtgataaagccttcaagtggagtagttcattggcaaaccataaatctatgcacaccggcgaaaagccatataagtgcgaatag

SEQ ID NO: 14621 - DNA, 1236 bp, Artificial Sequence
  Description of Artificial Sequence: Synthetic coding sequence
atggcaaaacgacctggtagcccgggctcaagggagatggggctgctgacctttcgggatgtcgtgatagagttcagtctcgaggaatggcagtgcttggatcatgcccaacagaatttgtacagagatgtgatgttagaaaattaccggaatctggtttcgctgggaattgctgtgagtaaacccgacctgattacgtgtctggaacagaataaggaaccctggaatatcaagagaaacgagatggtgaccaagcatcctgtcatgtgcagccacttcacccaagacctgccaccggagctgggcatcaaggactcacttcagaaggtgatccctagacgctacggaaaaagcggacatgataaccttcaagtgaagacatgcaaaagcatgggcgagtgtgaggtgcagaaaggcggttgcaatgaggtcaaccagtgtctctccacaacccagaacaagatattccagacccacaaatgcgtgaaggtgttcggcaagttctcaaattccaaccggcataaaacccgccatactgggaaaaaacattttaaatgtaagaagtacgggaaaagcttctgcatggtcagtcagctccaccaacaccaaataattcatacgagggaaaatagttaccaatgcgaagagtgtggaaaaccattcaattgcagcagcaccctgtccaaacacaagagaattcatactggcgagaagccttatcggtgtgaagaatgtggcaaagcctttacctggtcaagcaccctgacaaagcatcggcgaattcataccggggagaaaccttacacctgtgaggaatgcggccaagccttctctagatcaagtactctcgcaaatcacaagcgaatccatactggtgaaaaaccatacacgtgcgaagaatgtggaaaagccttcagcctgtcatcttcactgacgtaccataaaaggatccacaccggcgagaagccctacacctgcgaagaatgcgggaaggcgttcaattgtagttcaacactcaaaaaacacaaaattatacacaccggggagaagccctataagtgtaaggagtgcgggaaggctttcgcattttcaagtacgctcaatacccacaaacggatccacactggggaggaaccttacaagtgcgaggaatgtgacaaagctttcaagtggtctagtagtcttgctaatcacaaatccatgcacactggagaaaagccatacaaatgtgagtag

SEQ ID NO: 14622 - DNA, 1593 bp, Artificial Sequence
  Description of Artificial Sequence: Synthetic coding sequence
atgcccggccctcccgggtctctggaaatgggccctctgacatttcgagacgtggccatcgagttctccctggaagaatggcagtgcctcgatactgcccagcggaatttgtacagaaaagtgatgtttgagaactatcggaatctggtgtttctgggcatcgcggtttcaaaaccacatcttatcacttgcctggagcagggcaaagaaccatggaataggaaacgccaggaaatggttgcgaaacctccagtgatttactctcatttcactgaggatctgtggcccgagcacagtattaaagactcctttcaaaaagtcattctgcgaggctacggcaagtgcggccacgagaatctgcagttacggatttcgtgcaaatctgtcgacgaaagcaaagtatttaaagagggatataatgaactaaatcagtgtctacggaccactcagagcaagatctttcaatgtgataagtacgtgaaggtgttccataagtttagcaactccaactctcacaaaaagcgtaatacgggcaagaaggtcttcaagtgcaaggagtgtggcaagagtttttgtatgctcagccacctgactcagcacatccggatccataccagggagaattcctacaagtgtgaggaatgtggtaaggtactaaactggttctctgagcttattaagcataaagggatccacatgggagaaaagccttacaagtgtgaagagtgtggcaaagcattcaatcagtcttcaacgctgattaaacataaaaagatacatatcgaagagaagccgttcaagtgcgaagagtgtggtaaggcattcagcttgttcagcattctgagcaagcataagataatccacacaggtgataagccatataaatgcgacgagtgccataaagcatttaattggtttgcaacattaaccaaccacaagagaatccacacaggggaaaagccctttaaatgcgaagagtgtggcaaggattttaatcagttcagcaacttgaccaagcacaagaagatccatacgggagagaaaccatacaaatgtgaggaatgcggcaaagccttcaatcagtttgccaaccttacaagacataagaaaatccacaccggtgagaagagttataagtgcgaggagtgcggcaaggcgttcatacaatctagcaatcttaccgaacacatgaggatccataccggggaaaagccttataagtgcgaggaatgcggcaaagcgtttaacgggtgcagttcgcttacacgccacaaacgcatccataccagggagaacacatataaatgcgaagaatgcggaaaaggcttcacgctcttctcaacactgaccaatcataaagtgattcatacaggcgagaagtcctacaaatgtgacgaatgcgggaacgtttttaactggcccgccactctcgcaaaccataagcggatccatgctagggagaagccctacaaatgcgaggagtgcggaaaagcgttcaatcgcagcagtcacctgacgagacataaaaaaattcacaccggcgaaaaactttacaaacccgagaaatgcgataacaatttcgataacacgtag

SEQ ID NO: 14623 - DNA, 372 bp, Artificial Sequence
  Description of Artificial Sequence: Synthetic coding sequence
atgcccggaccaccagggtcactggagatgggacccctgacattccgggatgtcgcaattgagttcagcctagaagaatggcagtgcctggacaccgcccagagaaatctgtacaggaaagtgatgttcgaaaattaccggaaccttgtgttcctcgggattgcggtgtcaaagccccatctgatcacatgcctagaacagggtaaggagccatggaacagaaagagacaggagatggtggccaagccacccgagagttattgtgtggcccaggcggatctggagctcttggttagctcctacttaaccgctctggcatccttgaagatgtgggattacaggaataatccactttgccaagccacaatgtag

SEQ ID NO: 14624 - DNA, 1731 bp, Artificial Sequence
  Description of Artificial Sequence: Synthetic coding sequence
atggtcgcagagcctcctgtgatttgtagccactttgctcaggactttagtcccgagcaaaacatcaaggattcattccagaaggtcacgcctaggaggtacggcaaatgcgagcacgaaaacctccaactgagcaagtctgttgacgagtgcaaggtgcagaaaggcgggtacaacgggcttaaccagtgtcttccaacaacccagtccaaaatttttcagtgtgataagtatatgaagattttccataagttctcaaaccttaacggtcataaggtgcgccatacaagaaagaagccattcaagtacaaggaattcgggaagtccttctgtattttcagtaatcttacacagcataaaatcatttgtactagagttaatttttataagtgcgaagattgcgggaaggctttcaatggctcgagtatttttacaaaacacaagcgaatacacattggtgagaagagctacatctgcgaggaatgcgggaaggcctgcaatcaattcactaacctaaccactcataaaattatttatacacgggataaactttataaacgtgaggagtgtagtaaagcattcaacctgtcctcccacattactacgcacaccataatccacacgggggaaaatccatacaaaagagaggagtgtgataaggcttttaatcagtcactgacactgaccactcacaaaatcatccatacaagggagaagttaaacgagtataaagaatgcggaaaggcatttaatcagagcagccaccttacgcggcataagatcattcacaccggcgagaagccgtacaagtgcgaagagtgcggcaaagcattcaaccagtctagccaccttactcgccataagatcattcacacgggggagaaaccttaccgctgcgaggagtgcggaaaggcttttagacagtctagccacttgaccactcacaagatcatccataccggggagaagccatataaatgcgaagaatgcgggaaagcatttaataaaagtagtcacctgacacggcataagtcaatccacaccggtgagaagccttaccaatgcgaaaagtgtggaaaagcctctaaccaatcctccaacctgacagaacacaaaaatatccataccgaggagaaaccctacaaatgcgaagagtgtggaaaggctttcaatcagttcagtaacctcactactcataagaggatccataccggagaaaagccatacaaatgcgaggaatgtggtaaggcattcaaccagtcatccatcttgacaacacacaagaggatccacactggtgaaaaatcctacaagtgcgaggagtgtggcaaggccttctatcggtcgagcaagttgacggagcacaaaaagattcataccggagagaagccctatacgtgcgaggagtgcggcaaggccttcaaccatagcagccatcttgcaactcataaggtgatacatactggggagaagccgtaccagtgtgaagagtgtggaaaggcattcaaccagagttctcacttgacgagacacaagcgaatccacacgggagaaaaaccataccaatgtgagaagtgcggtaaggcctttaatcagtcctctaacctgacaggtcataagaagatccacacaggcgaaaaactctataaacctaagagatgcaacagcgactttgaaaacaccagcaaatttagcaaacataagaggaattacgctggagagaagtcatag

SEQ ID NO: 14625 - DNA, 1938 bp, Artificial Sequence
  Description of Artificial Sequence: Synthetic coding sequence
atggaacccctcaaatttagggatgtagcgatagaattttctctggaggagtggcagtgcctcgacacaatccaacagaacctgtatagaaacgtgatgctagagaactacagaaacctggttttcctcggcattgtggtctctaagcccgacctcattacttgcctcgagcaggagaaggaaccatggactaggaagagacaccgcatggttgccgagcctccagtgatctgttctcatttcgctcaggactttagccccgagcaaaatatcaaggatagtttccagaaagtgacaccccgtcgatacggtaagtgtgagcacgaaaacctgcaactctcaaagtctgtggacgagtgtaaggtgcagaaagggggctacaatggacttaatcagtgccttccaaccactcaatcaaagatctttcaatgtgacaaatatatgaagatctttcataagtttagcaacctgaatggccacaaagttcggcatactcgtaaaaaaccttttaaatacaaggagttcggcaagtcattctgtatcttttcaaatctcacccaacacaaaattatatgtacccgggtgaatttttataagtgtgaggactgcgggaaagccttcaatggcagctcaatttttactaagcataagaggattcatatcggagagaagtcctacatatgtgaggaatgcggcaaagcctgtaatcagtttactaacctgaccacccataagatcatctatacccgggataaactgtataagagagaggagtgcagcaaggcgtttaatcttagctctcacatcactacccacaccatcatccacacaggagaaaacccctacaagagggaggagtgcgataaggcattcaaccagtcactgaccttaacgacacacaaaattatccatactagggagaaactcaatgagtataaagagtgcggaaaagctttcaatcaaagttctcacctgacgcgccacaaaatcatccatacaggcgagaaaccgtacaagtgcgaggaatgcggcaaggcatttaaccagagctcgcacctgaccaggcataaaattatccatactggcgagaaaccatacagatgtgaggagtgcggtaaagcattccggcagagctcccatctgacaacgcacaagatcatccatacaggggaaaagccttacaagtgcgaggaatgtggaaaggcctttaataaatcgagtcatcttactaggcataaatccatacacactggggagaagccataccagtgtgaaaaatgcggaaaggcttctaatcaaagtagtaacttgaccgaacataagaatattcataccgaggaaaagccttataagtgtgaagagtgcgggaaggcattcaaccaatttagcaacctcaccacacataaacggatccatacaggggaaaagccttacaaatgcgaggagtgcggcaaggcatttaaccagagtagcatcttaacaacccataaaagaattcacaccggggaaaagagttacaaatgtgaggagtgcggcaaagccttctacaggtctagcaagctgaccgagcacaagaagatccataccggagaaaagccctatacttgcgaagagtgcggcaaggcatttaaccatagctcgcatctggctacccataaggtgattcacaccggtgaaaaaccgtatcaatgcgaggagtgtggtaaggccttcaaccagtctagccacctgacgcgccataagaggattcatacaggcgagaaaccctaccaatgtgaaaagtgtggcaaagcctttaatcaatcctcaaacttgaccggtcataaaaaaatccacactggagaaaagctgtataaacctaaaagatgcaacagtgatttcgaaaacacctccaaattttctaagcacaagcgcaactacgccggggagaaaagctag

SEQ ID NO: 14626 - DNA, 504 bp, Artificial Sequence
  Description of Artificial Sequence: Synthetic coding sequence
atgaggacacacaccggtgaaaagccatataaatgtgaagaatgcggcaaggccttcaatagcagcagcatcctgactgaacacaaagtcattcattcaggggaaaagccctacaagtgtgagaagtgcgacaaggtgttcaaaaggttctcctacctgaccaagcacaaaagaatccacaccggagagaagccttataagtgtgaagaatgcggaaaggcattcaattggtctagtatactgaccgagcacaaaaggattcacactggcgagaaaccctacaactgtgaggaatgtggaaaagctttcaaccggtgtagccatctgacgcgccacaagaagatacacaccgctgtgaagaggtacaagtgcgaggagtgcggtaaagcatttaaacggtgcagtcatctgaacgagcataaacgggtgcagaggggcgaaaagagttgcaagtacaaaaagtgcggtgaagccttcaaccactgcagtaacctaacgacctag

SEQ ID NO: 14627 - DNA, 1401 bp, Artificial Sequence
  Description of Artificial Sequence: Synthetic coding sequence
atgctggaaaattaccggaatcttgtgagcctggggcttaccgtcagcaaacccgagctgattagccgactggagcaacgccaggagccctggaacgtgaaacgtcacgaaaccatcgcgaagccaccagccatgagtagccattacactgaggacctactgccagaacagtgtatgcaggacagctttcagaaggtgatcctgaggaggtatggatcttgcggcctggaagatttgcatcttagaaaggacggtgagaatgtcggcgaatgtaaggaccagaaggagatatacaacggtctcaatcaatgtctgtctaccctcccctctaagatcttcccctacaacaaatgcgttaaggtgttctcaaagagtagcaatttgaatcgtgagaacatccgtcacaccacagaaaaattgttcaaatgtatgcaatgcggaaaagtgttcaaaagtcacagcggcctctcatatcataaaattattcatacagaagagaagctctgtatttgcgaggagtgcgggaaaacatttaagtggttttcttatctgaccaagcataaaaggatccacaccggcgagaagccctacaagtgcgaagaatgcggcaaggcatttaattggtgctcgagtctgactaagcataagcgcatacacaccggtgagaaaccgtacaaatgtgaagaatgtggaaaggctttccattggtgttctcccttcgttcgccacaagaagattcacaccggcgagaaaccctacacctgtgaggactgcggacgcgcatttaacagacatagtcacctgacgaaacacaagacaatccacaccggtaagaaaccatacaagtgtaaagaatgcggaaaggctttcaatcattgtagtctactgacaatccacgagcgcactcataccggtgaaaaaccttacaagtgtgaggagtgcggcaaggcgttcaactctagcagtatcttgaccgagcataaagtgattcactcaggagagaagccgtacaagtgcgagaaatgtgacaaggttttcaagagatttagttacttaacgaagcacaaacgaatacatacaggagagaagccatacaagtgtgaggagtgcggcaaggccttcaactggagtagcatccttaccgagcataaacggatccatactggcgagaagccatataactgcgaggaatgcggaaaggcctttaataggtgctcccacttgacacgacataagaagatacatactgccgtgaagcggtacaagtgtgaggagtgcggcaaggcgttcaaacgttgctctcacctcaatgaacacaagcgcgttcaacgcggcgagaaatcctgcaagtacaagaagtgtggggaggcatttaaccactgtagcaacctaaccacgtag

SEQ ID NO: 14628 - DNA, 1401 bp, Artificial Sequence
  Description of Artificial Sequence: Synthetic coding sequence
atgctcgaaaattatagaaacctggtgagtctcggactgactgtttccaagccggagctgataagtaggttggagcagaggcaggaaccctggaacgtgaaaagacatgaaacgattgctaagcccccagctatgagttcacattacacagaggatctcctgcccgagcaatgcatgcaggatagttttcaaaaagttatcctgagaaggtatggaagctgcggtcttgaggacctgcatctgcgtaaagacggggaaaacgtgggggagtgcaaggaccagaaagagatctataacggactgaatcagtgtcttagtacccttcctagtaagatcttcccttacaacaagtgcgtgaaagtcttctccaaatcttctaaccttaatagggagaacatccgccacacgaccgagaaactcttcaagtgtatgcagtgcgggaaagtctttaagtctcacagtggattgtcctaccataagatcatacacacggaggagaagttatgtatatgcgaggaatgcgggaagacgttcaaatggttttcatatttgacgaaacacaaacggatccataccggtgaaaaaccttataaatgcgaggaatgcggaaaagctttcaactggtgttcgagcctgaccaagcacaagagaatccatactggggagaaaccctataagtgcgaggaatgcgggaaggccttccactggtgctctcccttcgtccgtcacaaaaagatacacacaggggagaaaccatacacttgcgaagactgcggacgcgcatttaataggcactcccaccttactaaacacaagaccattcatacggggaagaaaccatataagtgcaaggagtgtggcaaggcctttaaccattgcagtctgctcacgatccacgaaaggacccacaccggggagaaaccttacaagtgcgaggagtgtgggaaggcgttcaattcatcgagtatcctgacggaacacaaggttattcattctggggaaaaaccttacaagtgcgaaaagtgcgacaaagtgttcaagagattctcttacctaacgaaacacaaacgaattcataccggcgaaaagccatacaagtgcgaagaatgcggcaaggcttttaactggtccagcatcctaaccgagcacaaaagaattcacacaggcgagaaaccttacaattgtgaggagtgcggcaaggccttcaatcgctgctcgcacctgactcgccataaaaagatccacactgcagtaaaacgctacaagtgcgaggagtgtggcaaagctttcaagagatgttctcatttgaacgagcacaagagagtgcagcgtggtgagaagtcttgcaagtacaagaagtgtggagaagcatttaatcactgttccaacctgacaacctag

SEQ ID NO: 14629 - DNA, 1497 bp, Artificial Sequence
  Description of Artificial Sequence: Synthetic coding sequence
atggagctgttgacctttagagatgtgaccatcgaattcagccttgaagagtgggagttccttaatcctgcacagcagtctttgtacaggaaggtcatgctagagaattaccggaacctagtatctctgggattgacggtgagcaagccagaattaatctcacgactggagcaacgtcaggagccctggaatgtgaagcgccatgaaaccatagccaagccccccgcaatgtctagtcactatacagaggacctactgcctgaacagtgtatgcaggactcattccagaaggtgattctgcggcggtatgggtcatgcggacttgaggaccttcatctgagaaaggacggtgagaatgtgggcgagtgtaaagatcagaaggagatttacaacggactgaaccagtgcttgagcacactcccctctaaaatctttccttacaataagtgcgttaaggtcttctctaagtcgtctaatctaaacagggaaaacatcagacatacaactgaaaaactctttaagtgtatgcagtgcgggaaggtatttaaaagtcattcaggtctaagttaccacaagattatacacactgaggagaaactttgtatatgcgaagagtgcggcaaaacatttaaatggtttagctatcttaccaagcacaagcgcatccacaccggagaaaaaccctacaaatgcgaggaatgtgggaaagcattcaactggtgttccagcttgacaaagcataagcgaatccacacaggcgaaaagccttacaagtgcgaggagtgcggtaaggcctttcattggtgctcacccttcgttagacataaaaagatccacaccggcgagaagccttacacatgcgaagattgcggcagggccttcaatcgccactcccaccttaccaaacacaagactatccacaccggcaagaagccctacaagtgtaaggaatgcgggaaagcttttaaccattgctccctgctgacaattcacgagagaacacacaccggagagaaaccttacaagtgcgaggagtgcgggaaagcctttaattcaagttccatcctgactgaacacaaagtgattcattcaggagagaaaccctacaaatgcgaaaagtgtgacaaggtcttcaagcgattcagctatttgacaaaacacaagagaatccacactggcgaaaagccttacaagtgcgaggagtgcggtaaggcatttaattggtccagcatattgacagaacacaaaaggatccatacaggggaaaagccctataattgcgaggaatgcggcaaagcctttaataggtgttcgcacctcactcgccacaagaagatccacaccgccgttaaacgctacaagtgtgaagaatgcggcaaagcatttaaacgctgcagccatttgaacgaacataaaagggttcaaagaggggaaaagagttgcaaatataagaagtgcggggaagctttcaaccattgctccaatctcactacatag

SEQ ID NO: 14630 - DNA, 1515 bp, Artificial Sequence
  Description of Artificial Sequence: Synthetic coding sequence
atgaaggaggagagtgccgctcaattaggatgctgccaccggcccatggcattaggaggaactggcggtagtctgagtccatcgctcgactttcagctcttccgcggggatcaagttttcagcgcctgtcgtccactcccggacatggtggacgctcatggtccctcctgtgcctcctggctatgcccccttccactggccccagggaggtcggccttattggcatgcctgcaggatctcgacctcaacctgtgtactccccagcccgcccccctggggaccgacctacagggattgcaggaagatgcattgagtatgaagcatgaacctccagggctgcaagcttccagtactgacgataagaagtttacagtgaaatatccccaaaataaagataagttggggaagcagcccgagcgcgccggtgaaggcgcaccatgccctgccttttctagccacaatagttcatcacctcctcctttgcagaatcggaagtctccctcccccctagccttttgtccttgcccccccgtgaactctatctcaaaggaactcccatttttgcttcacgctttctatccgggctacccactgctgctcccgcctcctcacctttttacctatggagccctacccagcgaccaatgtcctcacctgctgatgctgcctcaggacccctcgtaccctaccatggccatgccgagcttactgatgatggtgaatgagctcggtcatcccagtgctaggtgggagacgctgctgccctaccccggagcattccaggcgagcggacaggctctgccgtcacaggcacggaacccaggggctggtgctgcccctaccgattcccccggcctcgaacgcggaggaatggcctccccagctaagagggttcctctgtcatcacagaccgggacagcggctttgccatatcctttgaaaaaaaaaaacggtaaaattctgtacgagtgcaatatttgcggcaaatcttttggccagctgtctaaccttaaggtgcacctgagggtgcactctggagagcggcccttccagtgtgccctctgccagaaaagctttacgcagctcgcccatctccagaagcatcatctcgtacataccggcgagagaccccacaagtgtagtgtctgtcacaaaaggtttagcagttccagtaatcttaagacgcatctcagactgcattcaggggctcggcccttccagtgttcagtttgccgtagcagattcacccagcatatacatttgaaactgcaccaccgactgcacgcaccccagccctgtggcctggtccacacccaactacccctcgcttctctagcttgcctagcacaatggcaccagggcgctctggacctaatggctgtggcgagcgagaaacacatggggtacgacatcgatgaagtaaaggttagcagcacgagtcaagggaaggccagagccgtctccttatcttccgctgggacaccactcgtaatgggccaggatcagaacaattag

SEQ ID NO: 14631 - DNA, 507 bp, Artificial Sequence
  Description of Artificial Sequence: Synthetic coding sequence
atgaaagaagagtcggccgcccagctcggctgttgtcatcgccccatggccctgggggggacaggcggatccttaagcccctctctagattttcagttgttccgaggtgatcagtccacgtcccaccaagggtgccggcccgccccacctatgacccggaacagtcagagcagcacccatcgaacgaggacatcttgggaaaactcccagaaagagctggcccgaggccctccagctcagccaagtcctctcattactgctctgcctcaccatcggtgcagaacagaaagggcccccgcaccttggctatctgctcctgttcctttaagtacaccctccccgaggtcgagtcatttcagtagcactcccagtaccctggatacacacttctcctgcttgcatccaacatgcagtcctatgggaccttacctcttgacgaacgtacccaccagctcctgttgccccaagacaccaccaaccccaccttggctttgtttagcttgttag

SEQ ID NO: 14632 - DNA, 1515 bp, Artificial Sequence
  Description of Artificial Sequence: Synthetic coding sequence
atgaaagaagaatcagccgcgcaactgggttgttgtcaccgaccaatggctctgggcggaaccggtggctcattatcacccagcctggactttcaattattccgtggtgaccaggtgttttctgcctgtagaccccttcccgatatggtggacgcccacggcccctcatgtgctagttggctctgcccactcccgctggcccccgggaggtccgccctgctggcctgcttacaggacctggatctgaatctgtgcactcctcagccggcccctctcggtactgatctgcagggactccaggaggacgcactgagcatgaaacatgaaccgcccggcttacaagcctcctccaccgacgataaaaagttcacagtcaagtatccgcagaataaagacaagttgggtaagcaacctgagcgagccggagagggcgctccctgtccagcatttagctcacataactcctcttctcctccaccactccagaatagaaagtcacctagccccttagctttttgtccttgcccaccagtgaacagcatctcaaaggagttacccttccttctgcacgccttttatcccggataccccctgctgttacccccacctcaccttttcacttacggagcgctacctagtgaccagtgcccccacctgctgatgctgccccaggacccctcctaccctactatggcaatgccttcacttctgatgatggtgaacgaattaggacacccaagcgcccggtgggaaacgctcctcccctatccaggtgcctttcaggcttccggccaggctctcccatctcaggcccggaatcctggtgctggagcagccccaaccgacagcccaggcctggaaaggggagggatggcttccccggccaaaagagtacctctgtcctcgcaaaccggaacggcagccctgccatatcccctgaagaaaaagaacggaaagatcctttacgagtgcaacatatgcggaaagtccttcggacagctgtcaaacctgaaagtccaccttagagtgcactctggtgagaggcccttccagtgcgcattgtgccagaagagctttactcagctcgcccacctgcaaaagcatcatttggttcatacaggtgaacggccacataaatgcagcgtgtgccataaaaggttcagttcgagtagcaacttaaagactcatctgcggttacattctggggcccggccattccagtgctctgtgtgtaggagtagatttacgcaacacattcacttgaagctgcaccataggctccatgctcctcaaccttgtgggctggtgcacacacagttaccgttagcatccctggcctgcctcgcgcagtggcaccagggggccctcgacctgatggctgttgcatcagaaaagcatatgggatatgacattgatgaagtgaaggtctcttccactagtcagggtaaggctagggcagtgagtctctctagcgccggaacacctctggtgatggggcaagaccagaataactag

SEQ ID NO: 14633 - DNA, 1575 bp, Artificial Sequence
  Description of Artificial Sequence: Synthetic coding sequence
atgaaggaagaatcagcggctcagctcggatgctgccatcgtccgatggcccttggagggactggcggcagtcttagcccaagcctggacttccagctgtttcgcggggatcaggtattttcagcctgcaggcccttgccagatatggtggatgcccacggtcctagctgcgccagttggctgtgccctctgccgctcgctcccggtaggtctgccctgctcgcttgcctgcaagatctagacctgaatctgtgcacgccgcagccagcacctctagggacagatttacagggactacaagaggacgctctgtccatgaagcacgaacctcctggactgcaggcctcctcaactgatgacaagaagttcacagtcaagtatccccagaacaaggacaagctcgggaaacagcctgagagagctggcgagggcgccccctgccctgcgtttagtagccacaactctagctcccccccacccctacagaatcgcaaatcccctagccctctggccttctgtccatgcccccctgtcaattctatctctaaagaacttccctttctgctgcacgccttttatccaggataccccctccttctgcccccgccacacctgtttacttatggggcccttccaagcgaccagtgtccacatttgcttatgcttcctcaagacccctcctacccgaccatggccatgcctagtctgcttatgatggtgaatgaattgggccatccctctgccagatgggagacccttctcccatatccaggggccttccaggcctcgggccaagccctgccctcccaagcccggaaccctggggcaggtgccgcccccacggactcccctggcctggaacgtggtggcatggccagtcccgcaaaaagggtcccactgtcctctcagactggaacagccgccctgccatatccgctgaagaagaagaacggaaagatcctgtatgaatgcaacatctgtggaaagagcttcggccaactgtcgaatttaaaagtgcacctgcgggtacacagcggtgagagaccctttcagtgtgctctctgtcagaagtcgttcacacagcttgcacacctccagaagcatcacctggtacatactggagaacgccctcacaaatgtagcattccatgggtgccgggacgcaatcattggaaatcattccaggcctggagggagcgagaagtatgccacaagcggtttagctcatcaagtaatcttaaaacacacctcaggcttcacagtggagccaggccattccagtgcagtgtgtgccgcagcagattcacacagcacatacacctcaaactgcatcatcggttacatgccccgcagccttgtggtctggtgcacacccaattacctctggcctctctggcatgtctggctcaatggcatcagggcgcactggacctcatggcagtggcgtccgaaaagcatatgggctatgacattgatgaggttaaagtatctagcacatcccagggaaaggcccgagcagttagtctgagttcagctgggactcctttggtgatgggccaggaccagaacaactag

SEQ ID NO: 14634 - DNA, 570 bp, Artificial Sequence
  Description of Artificial Sequence: Synthetic coding sequence
atgaaggaagaaagtgctgctcagttgggatgctgtcatcgtcctatggctctgggggggactggcggtagcctgtccccgtctcttgacttccaattgttcagaggagaccaggtgttttcagcctgccgacctttgccagatatggtcgacgcacatggaccttcatgcgcaagttggctgtgtccactgcctttagcgcctgggcggtccgctctgctggcttgcctccaggatctcgacctcaatttgtgcacacctcagccagcccccctgggaacggacttgcagggactgcaggaggatgcacttagtatgaagcacgagccaccgggcttacaagctagtagcacagacgacaagaagtttacagttaaatatccccagaataaggacaaattagggaagcagccagaaagggccggcgaaggagctccctgcccagctttttcatcgcacaattcaagcagtccaccaccactgcagaacagaaagagcccaagtcctttggctttctgcccctgtccccctgtgaatagcatttccaaggaactcccttttttgctgtag

SEQ ID NO: 14635 - DNA, 1575 bp, Artificial Sequence
  Description of Artificial Sequence: Synthetic coding sequence
atgaaagaggagagcgcggcccagcttggatgctgccaccgaccgatggcccttggggggactggaggatcgttgtcaccctcactagacttccagctgttcaggggggaccaggtattcagcgcgtgtcgccccttgccggacatggttgacgcacatgggccatcctgtgcatcttggctctgtccgttacccctagcacctggaagatcagctctgcttgcctgtctgcaagacctcgacctgaatctctgcacaccacagccggcccccttgggaacagacctccagggtctccaagaagatgctctgagcatgaaacacgagcctccagggctgcaggcctcctctacagatgacaagaaatttacggtgaaatatccacagaacaaggacaagctggggaaacagcccgaacgggcgggcgagggggcaccctgtccagccttctcatcccacaacagttcaagcccacctccactccagaataggaagtcccctagtcctcttgctttctgcccctgtccaccagtgaactccatttcgaaagagctgcccttccttctgcatgcgttttaccccggataccctctgctcctgccccccccacacctcttcacctacggagccttgccctccgatcagtgcccccaccttctgatgttaccacaggatccgtcatatcctacaatggccatgcccagcttgctcatgatggtgaacgagctaggacatccatccgccaggtgggaaaccctgttgccttaccctggggcattccaggcctccggtcaggccctgcccagccaagcccgaaatccaggtgcaggcgctgccccgacagattcaccgggcctcgaaaggggcggtatggccagtcccgccaagagggttcctctgtccagtcaaacaggaacagcggcactgccatatcccctcaagaagaagaatggtaaaatcctctacgaatgtaacatttgtggaaagtcttttggacaattaagcaatctcaaagtccatttgagagtgcattcaggagaaagacccttccaatgcgcgctttgtcagaagtcgtttacccagctcgcccatctccagaaacatcacctggtgcacacaggggagcgccctcataagtgctctatcccttgggttccaggcagaaaccactggaaatcctttcaggcctggcgcgaaagggaagtatgtcacaagcgctttagcagcagcagcaatctgaaaacacacctgcgtctccattccggggcccgtccattccagtgcagcgtgtgtaggtcccgctttactcagcatatccatctcaagctacaccatcgcctccatgctcctcagccctgcgggttggtgcacacacagctgcccctcgcctcacttgcgtgtctggctcaatggcaccagggggcgttggacctgatggccgtcgcctcagaaaagcacatggggtacgatattgacgaggttaaagtcagttccacaagccagggcaaggcacgggctgtctccttatcctccgccgggacacctctggttatgggtcaggatcagaacaattag

SEQ ID NO: 14636 - DNA, 810 bp, Artificial Sequence
  Description of Artificial Sequence: Synthetic coding sequence
atgaaggaggagagcgccgcccaactgggctgctgccacaggcctatggcccttggtgggactggtggatctctgtcaccctctcttgactttcagctcttccgcggagatcaagtcttcagcgcttgccggccactccctgacatggtagacgcacatggcccctcttgtgcctcctggttatgtcctctgcccctggcccctgggcgcagcgcccttctggcttgcctgcaggacctggacttgaacctgtgtacaccacagcccgcccccttgggcacagacctccagggcctgcaggaagatgcattgtctatgaagcacgaacccccaggcctgcaggcttcatccacggacgataaaaagttcaccgtcaaatatccccaaaataaggataagctgggaaaacaaccagaacgtgccggcgaaggtgccccctgcccagctttttctagccacaactcctcttccccccctcccctgcaaaataggaagagcccaagtcccctcgccttctgcccttgcccacctgtcaattccatttctaaagaacttccttttctcctccatgcattttatcccggctaccccctgttactgccacctccccacctttttacctatggagctttgccgagtgaccagtgccctcatttactgatgctgccccaagatccctcctaccccacgatggctatgccctcactgctgatgatggtcaacgagcttggccatccttccgcacgatgggagaccctgcttccatacccaggcgcttttcaggcatcagggcaggctttaccctcctag

SEQ ID NO: 14637 - DNA, 279 bp, Artificial Sequence
  Description of Artificial Sequence: Synthetic coding sequence
atgatatcctttcaggagagcgtcacttttcaagatgtcgccgtcgatttcaccgctgaggagtggcagctgctggactgtgcagaaagaaccctttattgggacgtgatgcttgagaattatcggaatctgatttctgtcggatgtcctattaccaagaccaaggtcatactcaaggttgagcaggggcaggagccatggatggtcgagggtgcaaacccacacgaatcaagccccgggtggtcagccgttgcccagagccaactggggttcaagtag

SEQ ID NO: 14638 - DNA, 360 bp, Artificial Sequence
  Description of Artificial Sequence: Synthetic coding sequence
atgatttcgttccaggagtctgtcacgttccaggatgtggctgtggattttacagctgaagagtggcaattgctggactgtgcagagcgaacgttgtactgggacgtcatgctcgagaactatagaaatctaatatccgttgggtgtccgatcactaaaaccaaggtaatcctcaaggtcgagcagggacaggaaccatggatggtcgaaggcgccaacccacacgaatccagcccggaaagcagatctgtggcccggcttgaatgcagcggtgctatctccgctcgagtgcaggtgatcctgcttccgcagcccccagaagaactggaacttcaggcgcctgctaccatgcccggatag

SEQ ID NO: 14639 - DNA, 1137 bp, Artificial Sequence
  Description of Artificial Sequence: Synthetic coding sequence
atgatctcttttcaggagagcgtgacatttcaggacgtcgcagtggatttcactgccgaagaatggcagttgctcgattgcgcagagaggaccctctattgggatgtaatgttggagaattaccgcaacctaatatcagtgggttgtcctattactaagactaaagtgattctgaaggttgaacaggggcaggagccgtggatggtggagggggctaatcctcacgaaagctcacccgaaagcgactaccctctggtggacgagcccggcaagcacagggagagcaaggataattttctgaaatcagtcttgctgaccttcaacaagatcctgactatggaaaggatccatcattataacatgagtacctctctgaatccaatgcgcaagaaatcttataagtcctttgaaaaatgtctgcctccaaatctggatctgctgaaatacaaccgctcttacactgttgagaatgcctacgagtgtagcgaatgtggaaaagcgtttaaaaaaaaattccattttatccggcatgagaagaatcatactcggaaaaaacctttcgaatgtaacgactgtggaaaggcttactcacgtaaggcacacctggctacacaccaaaagatccataacggcgagcgcccgttcgtgtgtaatgactgtggtaaggcgttcatgcacaaggctcagctcgtcgtacaccaacgcttgcatacaggggaaaagccctatgaatgctcacagtgcgggaagactttcacgtggaacagtagcttcaaccaacatgtcaagtctcataccctcgagaaaagcttcgaatgtaaggagtgcggcaagacctttcggtactccagttccctgtacaaacactcccggtttcacacaggcgagaaaccctatcagtgcataatatgtggaaaagcattcggcaatacgtcagtactggtgacccaccaacgtatccatacaggggagaagccctattcttgcatagaatgcggtaaagccttcataaagaagtcccatctgctgaggcaccagataacccatacaggcgagaaaccatacgagtgcaatagatgcgggaaggcgttctcacagaaatccaatttgatcgtgcaccagaagatccatacctag

SEQ ID NO: 14640 - DNA, 2052 bp, Artificial Sequence
  Description of Artificial Sequence: Synthetic coding sequence
atgagccctcaccccgaagcaattactgattgtgtcactctcaacaccgtgggccagctggctgaaggcggataccctttgcgttttagtaccctgttccaggagcagcagaagatgaacatcagccaagcatcggtgtcatttaaggatgtcacgatcgagtttacacaagaggagtggcaacaaatggcccctgtgcagaagaatttgtatcgtgatgtcatgttagagaactacagcaatttagtgtccgtgggctattgttgcttcaaacccgaggtaatcttcaaacttgagcagggcgaggagccatggttttcagaagaagaattctccaaccagagccacccaaaggactatcgaggagacgatctgattaaacaaaacaaaaaaattaaggacaagcacctcgaacaagccatctgtatcaacaataagactttaacaactgaagaggagaaggttctcgggaagccctttactctgcacgtagccgccgtggcctccaccaagatgagctgcaaatgcaacagttgggaggtcaacctccagtcaatttcagagttcataatcaataataggaattactctaccaaaaaaatcggatgcgggaacgtgtgcgagaactctccttttaaaattaattttgaaaaaacacagacaggcgaaaagttttatgaacacaataagaacatgaaggccctgaattataacgagaatctgccaaaacacccaaagtttcagaccctggaacaggcttttgagtgcaataaaatcggcaaagcctttaacgataaagccaactgcgtgaaacataattcatcacacaccggtgagacatcctctaaggatgacgagttcagaaagaattgtgataagaaaacattgttcgaccaccggaggactggcactggtaaaaagcacctgcacctgaaccagtgtggaaaaagcttcgagaaaagtactgtcgaagaatataacaagctcaatatgggtattaagcactacgagctcaatccatcaggaaataattttaaccggaaggctcacctcactgatccccagacagccgtcatagaggagaacccattggtttcaaatgatcgcacacaaacttgggtaaaatccagtgaataccatgaaaacaagaagtcataccagactagcgtgcatcgcgtgcgaagaagatcccattctatgatgaagccctacaagtgtaacgagtgcggcaagagtttttgtcagaagggccatctgatccaacaccagaggactcataccggagagaaaccgtttgaatgttctgagtgcggcaagacgttctcccagaagtcccatttatccacacaccagagaatccacaccgctgagaagccctacaagtgcaacgagtgtggcaaaaccttcgtccagaaatccactctccgtgggcaccagcgcattcataccggagaaaaaccctacgaatgctctgaatgcggcaagacctttgtacagaagagtaccctgagagaccaccacaggatacacaccggcgaaaaaagcttccaatgtaaccaatgcggtaagactttcggacaaaagagcaatctacgaatacaccaaaggacacataccggcgaaaagacctaccagtgcaatgaatgcgagaagtctttctggcgaaaagaccacctcatccaacaccagaagactcacaccggggagaaaccgttcaagtgcaatgaatgtggtaagactttcgcaagaacttctaccttgcgagtccaccagcgcattcatacaggcgaaaaaccttttaagtgtaacgaatgtggcaaaaagtttgtgcgcaaggccatattaagtgatcatcagcgcatccacaccggcgaaaaacctttccagtgtaacaagtgtggcaaaacctttgggcagaaatccaaccttcgcatccatcagaggacacactctggagagaaatcttacgaatgcaacgaatatgggaaactgtgtaaaaagtcgacgttaagcctgtaccagaagatacaaggcgaggggaacccctattag

SEQ ID NO: 14641 - DNA, 789 bp, Artificial Sequence
  Description of Artificial Sequence: Synthetic coding sequence
atgcccaggtcccccttgaggagttctcttagtactgaagcttcaggcccaaggggtccctttaagtgtcctgccagtcctagaccgatcacggcccagctgctacctgggtcaagcccgatcattgggaggtgtgtgttacgcgtacagcgcgggttcccaggaccaaagcctgccctgatatcttggatggaacaggaatccgaggcgtggagccccgctgcccaagacccagagaagggtgaaaggcttggaggagctcgtcgaggtgacgtccccaacaggaaagaagaagagcctgaagaggtgcccagggctaagggccctcgaaaggctccagtaaaggagagtccggaggtgctcgttgagaggaatcctgaccccgctatttccgttgccccggcaagagctcagccacccaaaaatgctgcctgggatccaaccaccggggcccaacctccagccccaatcccctctatggacgcacaagctggccaacggcggcacgtgtgcaccgattgcggtcgtaggtttacatatccttctttactggtgtctcatcgacgcatgcatagcggtgagcgccccttcccatgccctgaatgtggcatgaggttcaagcgtaagtttgctgttgaggcccatcagtggatccatcggtcttgcagcggtgggcggcgaggaaggcgacctggaatcagagctgtacctcgcgcccctgtaagaggagacagagatccgcccgtgttgttcaggcattatcccgatatcttcgaggaatgcgggtag

SEQ ID NO: 14642 - DNA, 1503 bp, Artificial Sequence
  Description of Artificial Sequence: Synthetic coding sequence
atggctcctccctctgcccctcttcctgcccaaggcccagggaaggctcggccttcacgcaaacgcggtagaaggcctagggcactcaaatttgtagacgtggctgtatatttctcccctgaggagtggggatgtttgcgcccagctcagagagccctgtacagggatgtgatgagagagacctatgggcacctcggggctctggggtgcgccgggcctaaacctgccctgatctcttggttagagcgcaatacggatgactgggagccagccgctctcgacccacaggagtaccccaggggtttgacagttcagagaaaatcccgaacccgcaagaagaacggagaaaaagaagtgttcccaccaaaggaagcccctaggaaaggcaaacggggcaggcgtcctagtaaacctcggctcatcccacggcagacatctggtggtccaatttgtcccgattgcggctgtacctttcccgaccaccaggccctagaatcccacaagtgcgctcagaatctgaagaaaccctacccttgcccagattgcggacgccgattttcctacccatccctcctggtttcgcaccgccgcgcccattccggcgagtgcccctatgtctgcgatcaatgcggcaagaggtttagccaacgcaaaaacttaagccagcaccaggtgattcatactggggagaaaccctaccactgcccagactgcggccgctgcttccgccgttcacgttcactcgctaaccacagaactacgcacaccggagagaaacctcaccagtgcccctcctgcgggcggcgatttgcatacccctctctgctagccatacaccaacggactcacacaggtgagaaaccctacacttgcctcgaatgtaatagacgctttcgccagaggacagcactcgttatccaccagcggatccacaccggagaaaaaccatacccatgccctgactgcgaacgtcgcttttcgtcctcctcccgattggtgtctcataggagagtgcattccggcgagaggccgtacgcatgtgagcattgtgaggctagattttcacagcgatctaccctgcttcaacatcagctcttacacacaggggagaagccatacccatgccctgattgcggtagggctttccgaagatcaggttctctggcaatacacaggtctactcacactgaagagaagcttcacgcctgtgatgactgcggacgacggttcgcctatcccagcctgctcgccagccacagacgggtgcacagcggcgaacgtccttatgcctgcgatctgtgttctaagcgttttgctcagtggtctcacctcgcacaacaccagctgctccacacgggggaaaaaccctttccctgcctggagtgcggccgctgcttccggcaaaggtggtcgttggcagtgcataagtgttcgcccaaagctcccaattgtagtccaaggtcagcgattgggggatcgtctcaaagagggaacgcccactag

SEQ ID NO: 14643 - DNA, 1497 bp, Artificial Sequence
  Description of Artificial Sequence: Synthetic coding sequence
atggcccctccatctgccccgctgcctgcacagggccccggtaaggctcggccaagtaggaagaggggaaggcgaccgcgcgcgctgaagtttgtggatgtcgccgtctatttttcgccggaggaatggggctgtctccgtcccgcacagcgtgctttgtatcgggacgttatgcgggaaacatacggccatctgggtgccctaggctgtgctggacccaaacccgcgctaataagctggctcgagaggaatacagacgattgggaacctgcggctctagatcctcaggaataccccagagggctgacggttcaaagaaagagccggacacgcaaaaagaatggagagaaggaagtgtttccaccaaaagaggctcccaggaagggcaaaaggggacggcgtccatccaagcctagactcatccctagacagaccagcggagggcccatatgtcctgattgtgggtgcaccttcccagaccaccaggccctcgaatctcataagtgcgctcagaacttaaagaaaccatatccctgcccagattgcggaagaagattctcctatcctagcttactcgttagtcacaggcgggcacactcgggcgaatgcccatatgtgtgcgaccaatgcggcaagaggttctcacagaggaaaaacctcagtcagcatcaagtcatccacaccggcgagaaaccctatcattgtcccgactgcgggagatgttttagacggagtcgctcactggccaatcatagaactacacatacaggagagaagccgcatcagtgcccttcatgcggtcgcaggtttgcctacccatccctcctggctatacaccagaggactcacactggcgaaaagccttatacttgtctcgaatgcaacagacggtttaggcagcgaactgctttggtaattcatcaaagaatccacactggagagaagccttatccctgccctgactgtgagaggcggtttagctccagttctcgactggtgtcacatcgacgggttcacagcggcgagagaccatacgcatgtgagcactgcgaggcgcggttcagtcagcgaagtactttgttgcaacatcagttactacacacaggggagaagccctacccttgtcccgattgcggccgtgcctttcgcaggtcaggcagccttgccatacaccgctccactcatacagaagagaagttacatgcctgtgatgattgcgggcgcaggttcgcttacccttcgctgttggcctcccataggcgggtgcattcaggtgaacggccttatgcctgtgatctgtgttctaagagattcgcccaatggtcacacctcgctcagcaccaactactgcacacgggggagaagccttttccttgtttggagcctgtgttgccccctgaggtggtctctgcggtgcacaaatgtagtccaaaggccccaaattgcagtccccggagcgcaattggcggaagctctcagcggggaaacgcgcattag

SEQ ID NO: 14644 - DNA, 921 bp, Artificial Sequence
  Description of Artificial Sequence: Synthetic coding sequence
atggcccagatctccagtggcgggggggggcagtctagatgcctgctgtttgctcttggctcagagatgggctctgagaaggaacaatctccggaaccacacctcccagaagagggagagggaggtaagccttggagagtcgacgacagcgagggctcctggatccccccaggcgagaaggagcacggacaggaatccctaagtgatgaacttcaggaaacacaccccaagaagccatggcagaaggttactgtgcgtgcccgcgagttgggagaccccattgcccaccctagacacgaagccgacgaaaaaccattcatctgtgcccaatgtggaaaaacttttaataatacatccaatctccgaactcatcagcgaatccacacgggtgaaaagccttacaagtgcagtgagtgcgggaaatctttttctagaagtagcaacagaatccggcacgaaaggatccatttggaagaaaagcattacaagtgtccaaagtgtcaggagagctttcggaggcggtccgacctgaccacacaccagcaggatcacctcggcaagcgcccgtatagatgtgacatatgtggaaagtcattctcacagagcgccacccttgccgtgcaccaccggactcacctcgagcccgccccttacatctgttgtgagtgcgggaaaagcttcagtaactcctcctctttcggtgttcatcatcggacccatactggcgagcggccgtatgaatgcacagaatgcggacgcaccttctctgacatcagcaatttcggagcccaccaaaggacccacaggggagagaagccatatagatgcaccgtgtgtggcaagcacttcagcaggagttcaaatctgatacggcatcagaagacccatctgggtgagcaagcgggaaaagacagctcttag

SEQ ID NO: 14645 - DNA, 939 bp, Artificial Sequence
  Description of Artificial Sequence: Synthetic coding sequence
atgagcctgtgctcgcctacccacagcgcagagatgtccttgttcctgcagggcccagaagaaatgctgcctctgtcctctgagggtagcgagatggggtcagaaaaggagcagtcccccgagcctcatctgcctgaggagggagagggtggcaaaccctggcgcgtagacgattccgaaggatcctggataccaccgggcgagaaagagcatgggcaggagtccttaagcgacgaattgcaggaaacccatcccaagaagccttggcaaaaagtgaccgtcagagccagggagctgggggacccaatagcacacccccggcatgaggctgacgagaagccctttatctgtgcgcagtgcgggaagacttttaacaatacctcgaacctgcgcacccaccagaggatccataccggagaaaaaccatacaaatgttcagagtgtggaaagtcatttagcagatccagcaatcggattaggcatgagcgcattcaccttgaggagaagcactataagtgccctaaatgccaggagagcttcaggcgaaggtcggatcttacaacacatcaacaggaccatctgggcaagcgcccctatcgatgcgacatatgtggcaaatcctttagccagtcagctaccctggctgtgcatcaccggacgcacctggagccggcaccttatatatgctgtgagtgtgggaagagctttagcaactcctccagtttcggagtccaccaccgcacgcacacgggagagcgtccatatgaatgcaccgagtgcggtaggactttcagcgatatctcaaactttggagcacaccagagaacacatcgaggtgagaaaccctatcgatgtaccgtgtgtggcaagcatttcagccgtagtagtaatttgaagccttttatccccctatggcgaatggtcttatactctctttag

SEQ ID NO: 14646 - DNA, 921 bp, Artificial Sequence
  Description of Artificial Sequence: Synthetic coding sequence
atggcccagattagtagcggcggtggcggccagtcaagatgcttactatttgccctcggatcagagatgggctcagaaaaggaacaatcacctgagccccacctgcccgaggaaggggaggggggaaaaccttggagggttgatgacagtgaagggtcttggattcctccaggggagaaggaacacggacaggagtcactgagtgatgagctgcaggagacgcatcccaagaagccatggcagaaggtgactgtccgagctagagagctgggagatcccatagcacaccctcgtcatgaggcagacgaaaaaccctttatatgcgcccagtgtggtaagacttttaacaacacaagcaatttgagaacccatcagagaattcacactggggagaaaccatataagtgctcagaatgcgggaaatcattttcacggtcatccaaccggatccgtcacgagaggattcacctggaggagaaacattacaagtgcccaaagtgtcaggagtcatttcggcggcggtctgacctgacgactcatcagcaggaccatctggggaagaggccctacagatgtgacatttgcggcaagtcttttagccagagcgcaacgctcgcagtgcaccacaggacccatttagagccagccccttatatctgctgcgagtgcggcaaatcgttttcgaactccagttccttcggcgtccatcatagaacccatactggcgagcggccatatgagtgcacagagtgcggacgcacttttagcgacatctctaactttggtgctcaccaacgcacccaccgaggagagaaaccatatcgctgtacagtttgcggcaagcacttcagccggtcgtccaatcttatccggcaccagaaaacacatctgggcgagcaggccgggaaagactcatcatag

SEQ ID NO: 14647 - DNA, 855 bp, Artificial Sequence
  Description of Artificial Sequence: Synthetic coding sequence
atgggttccgaaaaagaacagagtcctgaaccgcacttacccgaggagggtgagggcggaaaaccgtggcgcgtggacgacagtgagggcagctggatccctccgggagaaaaagaacacgggcaagagtcgctcagcgacgagctgcaagaaacccaccccaagaaaccgtggcaaaaggtaacggtcagagcccgggagttgggagatcccattgcccacccccgccacgaggccgatgaaaagccatttatctgtgcccagtgcggcaagacattcaataacacgtcaaacctccgcacacatcagcgcatccacactggagaaaaaccctacaaatgttcggagtgcgggaagagcttttctcggtcgtcaaacaggatccgccatgaacgcatccacctggaggaaaagcattacaagtgccctaagtgccaggaatcattcagacgtcgctccgacctgacaactcaccaacaagaccacctggggaaacgcccttatcgctgcgatatctgcggcaaaagttttagccagtcggcaacactggcagtacaccaccgtacacatctggaaccggccccatacatctgttgcgagtgtggcaaatcattttcgaacagcagttcctttggtgttcaccacagaacccacacgggtgagaggccatatgaatgtaccgagtgcggtcgcacattttctgatattagtaattttggagctcatcagagaactcatcggggcgaaaaaccatatcggtgcaccgtctgcggtaaacacttttctagatccagtaatctgattcgccaccagaagacacacctgggcgagcaagcagggaaggattccagctag

SEQ ID NO: 14648 - DNA, 855 bp, Artificial Sequence
  Description of Artificial Sequence: Synthetic coding sequence
atggggagcgaaaaggaacagtcccctgaaccacatcttcccgaagagggcgagggcggaaagccatggagagtggacgacagcgaaggctcatggattcctcccggggagaaagagcatggtcaggaaagtctctccgatgagctgcaagaaacacaccccaagaagccatggcagaaggtaaccgtaagagcacgcgaactgggggaccccatcgcccacccaagacatgaagccgatgagaagccatttatttgcgcgcagtgcggaaaaaccttcaacaatacttcgaacctgcggacacaccagcggattcacaccggcgaaaaaccctacaaatgcagtgagtgcggcaagagcttttctcgctcgtcaaatagaattaggcatgaaaggatccatcttgaggaaaagcattataagtgtcccaaatgccaggagagctttcggcggcggagcgatctgaccacccaccagcaggaccatctgggcaaaaggccttaccggtgtgatatttgcggtaagtctttttcacaaagtgccaccctggccgtgcatcaccggactcacttggagcccgcaccctacatctgctgcgaatgtggcaaatcgttttctaatagcagctccttcggcgttcatcatcggactcacaccggtgaacgtccgtatgagtgcaccgagtgcggtcgtacatttagcgacatttcgaacttcggagcccaccagcgtacacataggggcgaaaagccttacaggtgtaccgtgtgcggaaaacatttctcaagatctagcaacctcatccggcatcagaaaacccacctaggcgaacaagcaggaaaggacagcagctag

SEQ ID NO: 14649 - DNA, 855 bp, Artificial Sequence
  Description of Artificial Sequence: Synthetic coding sequence
atgggtagtgagaaagaacaaagccccgaaccacacctcccggaggaaggcgaggggggtaaaccctggcgtgtcgacgacagtgagggctcctggattcctcccggtgagaaggagcatggacaggaaagcttgagtgatgaactgcaagagactcaccctaaaaagccttggcagaaagtcacggtgcgggcccgtgagctcggggaccccattgcgcatcccagacacgaggccgatgaaaagccatttatttgcgcacagtgcgggaaaacatttaataacaccagcaatctgcggacgcatcagcgaatccatactggagagaagccgtacaagtgctcagagtgcgggaaatctttcagtcgaagctcgaaccgcattagacacgagcgtattcacctcgaagaaaagcactacaaatgcccaaagtgccaggagtcatttcgtagacggtccgatctcacgacccatcaacaggatcacctggggaaaaggccttataggtgtgacatatgcggaaagtcgttctcccagtcagcaacgctggcagttcaccatagaactcaccttgagccagccccttacatctgttgtgaatgtggcaaaagctttagcaactcttcctcttttggagtccatcatcgtactcataccggggagcggccctacgaatgcactgaatgtggaaggactttctcagacattagtaacttcggtgcacatcagcgtacccatagaggtgaaaaaccatacagatgcactgtctgtggaaagcattttagtagatcttccaacctgatccgtcatcagaagactcacctgggggagcaggccgggaaggacagttcatag

SEQ ID NO: 14650 - DNA, 402 bp, Artificial Sequence
  Description of Artificial Sequence: Synthetic coding sequence
atggcccagatcagttcagggggaggcggccagtctcgttgcctgctgttcgctttggtgctcgccatatgcgtacatagccagggctctgagatggggagcgagaaggaacagtctccggagccccatttaccggaagagggcgagggcggtaagccatggagagtggacgactcggaaggttcttggatccctccaggcgaaaaggaacatggccaggagagccttagcgacgaacttcaggagacacaccccaaaaaaccttggcaaaaggtgacagtccgggcccgcgaacttggcgatcccatagcccatcctaggcacgaggctgacgagaagcctttcatatgtgcccaatgtgggaaaacctttaataataccagcaacctgcggacacactag

SEQ ID NO: 14651 - DNA, 948 bp, Artificial Sequence
  Description of Artificial Sequence: Synthetic coding sequence
atgtccttatgcagtccaacacattccgccgaaatgagcctctttctgcagggacctgaggagatgttacctctgtcctctgagggaagcgagatgggtagtgaaaaggagcagtcccctgaaccacacctgccagaagaaggtgagggtgggaaaccctggcgtgtcgacgactctgaggggagctggattccacccggggaaaaagagcatggacaggaatcactgtctgatgagctccaagagacgcatcctaaaaaaccctggcaaaaggtcactgttcgcgcgagggagttgggtgaccccatcgcccacccgagacatgaagctgacgagaaaccttttatctgtgcccagtgcggcaaaaccttcaacaacacatcaaatctccgcacccaccagagaattcatactggagaaaagccctacaagtgctctgagtgcggaaagagctttagccggtcgtctaaccgcatcaggcacgaaagaatacacttagaagagaagcactacaaatgtcctaaatgtcaggagtctttccgtcggcgatccgacctgaccacccaccagcaggaccatttggggaagagaccctaccgatgcgacatatgcggaaagtccttctcgcagtctgcaaccttggctgttcaccatcggacgcatctagaacctgccccatacatctgttgtgaatgtgggaagagttttagcaatagtagcagctttggtgtgcaccaccgcactcatacgggagaaaggccgtacgaatgtacagagtgtgggaggacctttagtgacattagtaactttggcgctcaccaaagaacgcatcgaggtgagaagccttatcggtgtactgtgtgcggtaagcatttctcaagaagcagtaacttaatcagacaccagaagacacacttgggggaacaggcagggaaagatagcagttag

SEQ ID NO: 14652 - DNA, 1560 bp, Artificial Sequence
  Description of Artificial Sequence: Synthetic coding sequence
atggcttcaagcccagcagttgacgtgagctgtcgccgaagagagaagagaagacaactcgatgctaggcggagtaagtgtagaattcgtctggggggacatatggaacagtggtgcttgctcaaagagcggctcggattttctcttcactcacagctggccaaattcctcctggaccgttacacttcctccggctgcgtgctctgtgctggacctgagcctctaccccctaaaggtcttcagtacctggtactcctgtcccacgctcactcgagagagtgctctttggtcccagggttacgaggcccaggggggcaagatggtggcttggtatgggagtgtagcgccgggcacaccttcagctggggccctagcctcagtccgactccttccgaggctccgaagcctgctagtctgccacatactacaaggaggtcctggtgtagcgaggcaacctcaggccaggagctggctgatctggaatcggagcatgatgaaaggacacaggaagcaagactgccgaggcgggtcggacccccgcctgaaacatttccccccccgggggaagaagaaggtgaagaagaagaggataatgatgaagatgaagaggaaatgttgtccgatgctagcctctggacttattcttccagtcccgacgactccgagccggacgcccctcggctcctgccatccccagtcacatgcaccccaaaggagggcgagactccgcccgctcccgccgccctgtccagccccctggctgtccccgccttatcggcaagtagtctctcctcaagagcccctccaccagctgaggtgagagtccagccccagctctcccgaactccacaagccgcgcagcagactgaagccctggcatcaactggatcccaggcccagtctgcgccaacacctgcctgggacgaggacactgctcagatcggtccgaaaaggattcgcaaggccgctaaacgcgagctgatgccttgcgatttccctggctgcggaaggatattcagtaatagacagtatcttaaccatcataagaagtaccaacatatccatcagaagtcgttttcttgtccagagcccgcatgtggcaaatccttcaatttcaaaaagcaccttaaagaacacatgaaactccatagcgatacccgcgactacatctgcgagttctgcgctcggagctttcgaacctcctctaacctggtaattcaccgccgtatccataccggagagaagccactgcagtgtgagatttgcgggtttacatgccgtcaaaaagcatcactgaactggcaccagagaaaacatgccgaaaccgtggctgccttacgtttcccatgtgaattctgtggtaagagattcgaaaaacccgactctgttgccgcccatagatccaaaagccaccccgctttgctcttagcacctcaagagtccccttcaggccccctcgaaccatgcccctcaatatccgctcccggaccacttggctcttcagaagggagtcgccccagcgctagcccccaggctccaaccctcttaccacagcagtag

SEQ ID NO: 14653 - DNA, 1044 bp, Artificial Sequence
  Description of Artificial Sequence: Synthetic coding sequence
atggcaagtagtccagctgtggatgtgtcttgccgccgtcgggagaaacggcgccaacttgatgcccgccggtctaaatgtaggattagactgggcgggcatatggaacaatggtgtctgctaaaggagaggttgggatttagcctgcattcacagctcgccaagttcttgttggaccgatatactagctccggatgtgtcctatgtgcagggccagagccgctgccaccaaaagggctgcaatatctggtcctgctcagcccaagcagtctctcaagtcgggccccccctcctgccgaggtccgagtccagcctcagttatcacggactccccaggcagcgcagcagacagaggctcttgccagcacaggaagccaggcccagagcgcccctacgcccgcatgggatgaggacacagcccaaataggccccaaacggatccggaaagccgctaaaagggaactcatgccgtgcgattttccaggctgtggacgcattttctcaaacaggcagtacttgaatcatcacaagaagtaccagcatatccaccagaagtctttttcgtgtcccgagccagcgtgtggaaagtcatttaatttcaaaaagcatttaaaagagcatatgaagctgcactctgatacccgggattacatttgcgagttctgtgcacgcagcttccgcaccagcagcaatctggttattcatcgcaggatacacacaggcgagaaacctcttcagtgtgagatctgtggattcacatgtagacagaaggccagcctgaactggcaccagaggaagcacgcagagactgtggctgccttgcgattcccttgcgagttttgtggaaaacgctttgagaagccggactcagtggccgcccacaggagcaaaagccatcctgcgctgctcctggctccacaggagagcccttctggcccccttgaaccatgcccctcaataagtgcccctgggcccctaggctcctccgaaggctctcgcccatcagcatctccccaggctccaacgctattgccccagcagtag

SEQ ID NO: 14654 - DNA, 1425 bp, Artificial Sequence
  Description of Artificial Sequence: Synthetic coding sequence
atggcttcatccccagccgtggacgtatcctgcaggagaagggagaaacgcagacagctcgatgctaggcgctcaaaatgtcggatccggctcggtggccacatggagcagtggtgtctgctgaaagagcggctcgggttttccctgcactcacaactggcaaaattcctgctggaccgctatacaagctccggatgtgttctgtgcgccggcccagagccattgccacccaaagggttgcagtacttggtcctgctcagccatgcccattcccgggaatgttccctggtccctggtctgaggggtcctggtggccaagacggaggactggtttgggaatgctcagccggccatacattctcctgggggccatccctgtcaccaacccctagcgaggctccaaaaccagcaagcctgcctcacaccactcgtagaagttggtgctccgaggcgacgagtggccaggaattggctgatctggaaagtgagcatgatgaacgaacgcaggaggcacgactgccttcatctgagccagacgcgcctaggctattgccttctccagtgacgtgcacccccaaagagggcgaaacacctcctgccccagctgctctgtcctcgccattagcagtgcccgcgctgagtgcatcatccctttcatctcgagctccccctcccgctgaggtgagggttcagccccaattatcaaggacacctcaggctgcccaacaaacagaggcactcgccagcaccggatcccaggctcagagtgcacctacacccgcttgggatgaagatacggctcagatcggccctaagcgaatccgcaaagcagccaagcgcgagctgatgccctgtgattttcctggttgtgggagaatctttagtaatcgacagtacttgaaccatcacaaaaagtaccagcacatccaccagaaaagcttcagctgtccagaaccagcctgcggcaagtcttttaatttcaagaaacatctgaaagagcacatgaaactacattccgacactagggattacatctgtgagttctgcgcaagaagttttcgaacgagctccaatctggtcatccatcggcggatccatacgggcgagaaaccccttcagtgcgaaatctgcggcttcacttgccgccagaaagcatccctgaactggcaccagcgcaaacacgccgagacagtcgctgcgctaaggttcccttgtgagttttgtgggaagcggttcgaaaagcctgactcagtggcagcccacagatcaaaaagtcatcccgccctcctcctcgcaccacaggaaagcccctctgggccactcgagccttgtccgtcaatctccgcccccggcccccttggatcgtccgagggctctagaccaagtgccagcccacaggcacccacattgctcccacaacagtag

SEQ ID NO: 14655 - DNA, 291 bp, Artificial Sequence
  Description of Artificial Sequence: Synthetic coding sequence
atggccagctctcccgctgttgacgtgagttgccgacgacgagaaaaacgcaggcagttggacgctcgccgctcaaagtgtcgcattaggttgggaggacacatggagcaatggtgcctactcaaagagcgccttgggttttctcttcactcccaactcgctaagttccttttagatagagcctgtcctgctgcactattccacccccaggtgtcgcatttcactcggaccgcctgtgttacttgcggacttagaggatcttgttctcctccacacggcctctccgagtag

SEQ ID NO: 14656 - DNA, 1425 bp, Artificial Sequence
  Description of Artificial Sequence: Synthetic coding sequence
atggccagctcacccgcagtggatgtgagttgcaggcgccgggagaaacgccgacaactggacgcccggcgatctaaatgtagaatccgactcggcggccacatggaacaatggtgcctgttgaaggagcggctgggctttagcttgcacagccagctcgccaagttcctgctggatcggtacacctcgtccgggtgcgtactgtgcgccggtcctgagcctctcccgccaaaaggcctccagtatttagtcctgctctcccacgcccactctcgtgagtgtagtctggttcccggcctgagggggcctggaggccaggatggcgggttagtgtgggagtgtagtgctgggcatacattttcctggggccctagtctgagtcctactccatccgaagccccaaagcccgcgagtctgcctcataccacaaggcgctcctggtgttcagaggccacaagtggccaggaactcgccgaccttgagagcgaacacgatgagagaacccaagaagcacgactcccaagctcagaacctgatgccccaagactcctgccgagccctgtaacctgcacgcccaaggagggggagactcctcctgcacccgcggccctgtcaagccctctcgcggtgccggctctgagtgctagcagcctgtcaagccgggcgcctccacccgctgaggtgagggtccagccccagctttcaagaacacctcaggccgcacagcagaccgaagctctagcaagcacgggaagccaggctcagagtgcccctacccctgcatgggatgaagatactgcacaaatcggtcctaagcgcattagaaaagccgcaaaacgagagctgatgccttgcgactttcctggatgtggacgcatcttcagcaatcgacagtatctgaatcaccataagaagtatcagcacatccaccagaagtcgttcagctgcccggagccggcctgtggtaagtctttcaactttaaaaagcacttgaaggagcacatgaagcttcacagcgacacaagggattacatctgtgagttttgtgcacggtcttttaggacatctagcaatctggtcatccacaggaggattcacactggagagaagcctttacaatgcgaaatatgtggctttacgtgtcgtcagaaagcttcattgaattggcatcagagaaagcatgccgaaactgtggcggccctgcgcttcccttgcgaattctgcgggaagcggtttgaaaaacctgactccgtggcagctcataggtcaaagtcgcatccggctctcctacttgcaccacaggagagtccctcaggccccctggagccatgtccttctatctctgcccccggaccactgggttcctcggagggctcccgtcctagtgcctctccacaggcgccaacactcctcccacagcagtag

SEQ ID NO: 14657 - DNA, 1575 bp, Artificial Sequence
  Description of Artificial Sequence: Synthetic coding sequence
atgcctcttgttcatatggcctccagccccgcagtcgacgtgtcttgtcgccggagagagaagcgccgccaactcgacgctcgacgtagcaaatgtcgtatcaggctcgggggccacatggagcagtggtgcctgctgaaagaacggctgggattctctttgcacagccagctggctaaatttttgctggataggtatacctcctccggatgcgtcttatgtgctggtccggagcccttaccccctaaaggtctgcagtacctggtgcttctgagtcacgcacacagtcgggaatgcagtctggtgcccggtctgcgcggcccaggcggccaggacggaggactagtctgggagtgtagtgcgggacacactttcagctggggccccagtctgagccccacacccagtgaggccccaaagccagcttctctcccccataccaccaggcggagttggtgctctgaggccacatccggccaggagctggccgatttagaatcagaacatgacgagcggacgcaggaagcacggttgccacggagagttggacctccaccggaaacttttccccctcctggagaagaagagggggaagaagaggaagacaatgacgaggatgaagaggaaatgttgtccgatgcaagcttgtggacttactctagctccccagacgatagcgaaccagacgctccgcgactgctgcccagccccgtgacctgcacccccaaggagggggaaactcctcctgccccagccgccctctcatctcccctcgccgtgcccgccttaagtgcctcttccctgtcctctcgggcccctccccctgccgaggtgcgggtgcagcctcagctatctcggactcctcaagccgcacagcagaccgaggctctggcatctacaggcagtcaggcacagtccgctcccaccccagcttgggatgaagacactgcccagatcggaccaaaaagaatcaggaaggctgccaagcgggaactgatgccttgcgacttcccaggctgtgggcgcattttcagtaacaggcaatacctcaatcatcataagaaatatcagcatatccaccagaaatcctttagttgtcctgaaccagcctgcggaaagtcattcaacttcaagaaacacctgaaggagcatatgaagcttcacagtgatactcgcgattatatatgtgagttctgcgcacggagtttccgaacttcctccaatctggtgattcacaggcgaattcacactggggaaaaacccctacagtgtgaaatctgtggctttacctgtaggcagaaggcttccctaaactggcaccagcgcaaacatgctgaaacagtggcagctttaagatttccttgcgaattttgtggcaaaagattcgagaagcccgactccgtggctgcccatcgctctaagtcccaccccgccttgttgctcgctccccaggaaagcccatctggtccactcgagccatgtccatccatctctgcccctggccccctcggttccagcgagggatctcgcccctccgcttccccacaagcccccactctgctcccacaacagtag

SEQ ID NO: 14658 - DNA, 399 bp, Artificial Sequence
  Description of Artificial Sequence: Synthetic coding sequence
atggcgagtagccccgccgtggatgtgtcgtgccggaggagggagaagcgacgtcagctggacgcccgtaggtccaaatgcagaatcagactcggcggtcatatggagcaatggtgcttactgaaggaacggctgggattctctcttcattcacagctggctaaattcctactggatcgatacacttcttcgggatgtgtcctgtgcgcagggccagagcctttgccccctaagggcctgcagtatcttgtcctcctgtcccatgctcattcccgagaatgtagcctggttccaggacttagagggcctggggggcaggatggcggcttagtatgggaatgctccgccgggcataccttttcctgggggcccagcctctcccccacccccagcgagtag

SEQ ID NO: 14659 - DNA, 1548 bp, Artificial Sequence
  Description of Artificial Sequence: Synthetic coding sequence
atgggcctcctcgcctttagggacgttgccctggaatttagtccagaagagtgggagtgccttgaccctgcccaacgctccctgtacagagatgtgatgttagagaactacaggaacctgatctctctgggcgaggacagcttcaacatgcagtttttgttccattccctggctatgagcaagccagagctgataatttgtcttgaggcccgaaaagagccatggaatgttaatacagaaaaaactgcccggcactctgtgctgtcctcatacctgaccgaagatatcctgccagaacagggattacaggtgtcattccaaaaagtcatgctgcgacgctatgaaaggtgctgtctcgagaagctgcgccttagaaacgattgggagattgttggagagtggaagggacagaaagcgtcctacaatggattagacctgtgttcagctaccacacattccaaaaactttcagtgtaacaaatgcgtcaaggggtttagcaagtttgctaatctcaataaatgcaagatttcccataccggggagaaacccttcaagtgcaaagaatgcggaaatgtctcatgcatgagcctgatcatgacccagcagcaacgcatacacattggagagaacccatatcaatgcaagaaatgcggcaaagctttcaacgaatgcagttgttttactgattgtaaaaggattcacgtcggagagaaacattgcaagtgcgaagaatgtaacaacatcttcaagtcatgttcttctctggctgttgtggagaagaaccacacagaaaaaaaaacctatagatgtgaggagtgcggcaaagcttttaacctgtgtagcgtgctaaccaagcacaaaaaaattcacaccggcgagaagccctataagtgcgaagaatgcggcaagtcgttcaagctctttccatatttaacccaacataagaggattcactctcgagagaagccctacaagtgtgaagagtgtggtaaggtgttcaaacttctgagctaccttacacagcacagacgcattcacacgggagagaagaccttccgctgtgaggagtgcggcaaggcatttaaccagagctcccatcttaccgaacataggaggattcacacaggggagaagccatataagtgcgaagaatgtggcaaggcttttacatggttctcttacctgattcagcataagagaatccacacaggccagaaaccttacaaatgtgaggaatgcggcaaagcgttcacctggttcagctatctgacacaacacaagagaatacacaccggagaaaagccatataagtgtgacgagtgtggcaaagcatttaattggttctcttatctaactaaccacaagaggattcacactggcgaaaagccttacaagtgtgaagagtgcggcaaggcctttggccaatctagccatctgtccaagcacaagaccattcacactagggagaagccttacaagtgtgaagagtgcggcaaagcttttaaccacagcgcccagctggccgtacatgagaaaacccacacatag

SEQ ID NO: 14660 - DNA, 519 bp, Artificial Sequence
  Description of Artificial Sequence: Synthetic coding sequence
atgggactgctggcctttcgagatgtggccctcgagttttcccctgaagagtgggagtgcctggaccccgcccagagaagcctttacagagacgtcatgctagagaattaccggaatctgatcagtctaggtgaggatagtttcaacatgcagttcctctttcactcactggctatgtcgaagcctgaattaatcatttgtcttgaagcacgaaaggagccgtggaacgttaacacagaaaaaacagctagacacagcgtgcttagcagttatttaactgaagacattctccccgagcaggggctacaggtctcctttcagaaagttatgctgagacgatatgaacgctgctgcctggagaagctccgactgaggaacgattgggagatcccttgcgaagacgtccttgcgtctccactcccttccgctatgattctttctttcctgaggcccccccaaaagcagaaacacgtgaagccgacagagccaatccaatctaagacgttgcaatggctgtag

SEQ ID NO: 14661 - DNA, 519 bp, Artificial Sequence
  Description of Artificial Sequence: Synthetic coding sequence
atgggacttttggcatttcgagacgtggctctagagttctcccctgaagagtgggagtgcttggacccagcccagaggtccctctatagagacgtcatgctggaaaactaccgcaacctcatatctctgggcgaagacagttttaacatgcaattcctgtttcattccttggcaatgtcaaagccagaactcatcatctgcctagaagcaaggaaggagccatggaacgtgaatacagagaagacagcaagacactcagttctctccagctacctgactgaggatattctacctgagcagggtttacaggtcagcttccagaaggtaatgctgaggagatacgagcgttgttgcttagaaaaactgcggctcaggaatgattgggagattccatgtgaagacgtcctggctagtcctctgcctagtgctatgattctgtcttttctgcgacccccccagaagcaaaagcacgtgaagcctacagaaccggtgcagtcatccaccattgagttgctttag

SEQ ID NO: 14662 - DNA, 1125 bp, Artificial Sequence
  Description of Artificial Sequence: Synthetic coding sequence
atggaaccgggaggagagccaacgggagctaaggagtccagcactttgatggaatccctggcggccgtcaaggccgcttttttggcccaggctccttctggttcccggtctgctgaagtccaggccgctcagtccacagagccagcagcagaggctggtgccccggaaggcgaaggacacagagggggtccccctagggcactcggatccctgggactgtgcgaaaatcaggaggccagggaacgccccggaggaagccctcggggtcccgtgacatccgagaagaccggcgggcagtccgggctggaaagcgacgtgccccccaacgctggcccgggcgccgaaggagggggctcctggaagggaaggcctttcccttgcggagcatgcggacgctcattcaagtgttcaagcgacgccgcgaaacataggagcattcattcaggagaaaagccctacgaatgttctgactgtggcaaggcttttattcactcttcccatgtggttagacaccaaagggcccactcgggcgagcggccctacgcttgcgccgagtgcgggaaagccttcggccagtcatttaacctgctgcggcaccagcgcgtgcatacaggtgaaaaaccatacgcctgtgccgattgtggcaaggcctttgggcagagatcagacgccgccaaacatagacgaacgcacactggtgaacgattgtatgcctgtggtgagtgcgggaaaaggtttcttcattccagtaatgtggtgcgtcaccgcagaacccaccatggagaaaacccttatgaatgtcgggagtgtggtcaggctttttcacagagttccaatttgttacagcaccagagagttcataccggagagaggcccttcgcctgccaggactgcggacgcgccttcagccggagttcatttctgcgggagcaccggcgcattcataccggtgaaaagccccatcaatgtgggcactgtgggcgggccttcagagctttaagcggcttcttccgccaccagcggctgcatactggcgaaaaaccattcagatgcactgagtgcggacgtgctttcaggttaagtttccacctaatacagcatagaagagttcatggagccgaatag

SEQ ID NO: 14663 - DNA, 324 bp, Artificial Sequence
  Description of Artificial Sequence: Synthetic coding sequence
atggaacctgggggggagccaacaggcgctaaggagagctccacactgatggagagcctggccgctgtgaaggctgcatttcttgcccaggctccatctggttcccgtagcgctgaggtgcaggccgctcagtcgacagaaccagccgcagaggccggagctccagaaggggaggggcacagagggggaccaccacgcgccctcggctcactaggactttgcgaaaatcaggaggcccgggagcggcccggtggtagccctcgaggtcccgttaccagcgagaagactggcggacagtctggtctcgagtccgatgtcccttag

SEQ ID NO: 14664 - DNA, 615 bp, Artificial Sequence
  Description of Artificial Sequence: Synthetic coding sequence
atggaacctgggggagagcctactggagcaaaggagagcagcaccctaatggagtccctggccgctgtgaaggccgccttcttagctcaggcccccagcggatcccggagcgccgaggtccaagccgctcagtcgaccgagccagccgccgaagcgggggctcccgaaggagaaggacatagaggggggccacctcgggcattgggatccctgggactgtgcgaaaaccaggaggccagggaaagacccgggggctcacctaggggacctgttacttctgaaaagaccggtggacagtctggtctcgagtcagacgtaccccctaatgctggccccggcgcagagggcggagggtcctggaagggccgcccctttccatgtggggcctgcggaagatcttttaagtgttcgagcgacgccgccaagcacagaagcatacactcaggggaaaagccctacgagtgcagcgattgcggcaaggcctttattcactcatctcacgtcgtccgccaccaacgtgcccattccggtgaacgaccatacgcatgtgcggaatgcgggaaagcattcggccagtcctttaacctattgagacaccagcgggtgcacacttag

SEQ ID NO: 14665 - DNA, 1638 bp, Artificial Sequence
  Description of Artificial Sequence: Synthetic coding sequence
atgaagcaggaggataaccagggtgtgtgcgcccaccaagattccgaagataagggcatgggctcggattttgaggacagtgaagaccgcgaaggtgaccccgaagaacgcgagatgggaagtaatccacacgataccaataagcgcgagggtcatcccgagcctgagatgggctcgaacccacaggattcccgacatcgggaggcagtccccgatatttgcactgaaggccagctctcagaggaagagggagtgagcgtgcgtggcgaagaagacgatcaaagtggcgtggcagatatggcaatgttccccgggctatcagagtcagactcaataagccgctcactccgggaagatgacgacgagagtgccggagaaaatcgccttgaagaagaagaggaacaaccagccccaccagtcctcccttggcgtcggcatctgtccctgggcagccgccaccgcggagataagccagcccacagaaggtttcatcgcctgcatcatccaatggccgttgacctgggcgagctggacagccttgtagcaagtatcatggatgccccaactatatgtcctgactgtggagagtcgttctctcctggggcagcattcctgcagcatcagcgaattcaccgcctggccgaggccgcagccgccgcctctctggaaccatttggtctggcaggggagtgcgacgccatggtcgggatgatgggggtcggtgtggctggcggttttggagctggccccccattggccagacctcctcgcgagaaaccattccgttgtggcgagtgtggtaaaggcttctcaaggaatacttatctcaccaatcatctgcggctccatacaggggaacggcccaatttgtgtgcggattgtgggaagtcattctcctggagggctgacctgctgaagcaccgacgactccacacaggagagaaaccgtacccctgtccggagtgcggagaggcattttctctgtcatctcacctgctctcccacagaagggctcatgctgccgcctccggcgcgggggccgccgctctgcgaccttttgcatgcggcgaatgcggtaagggtttcgtgcggcgcagtcatcttgcaaaccatcagagaatccacaccggcgaaaagccccacgggtgcggcgaatgcgggaagcggttttcatggcgaagcgatttagttaaacaccaaagagtgcacacaggtgagaagccctatatgtgttccgagtgcggcgaaaccttcagcgtttcaagccatctattcactcacaaacggacgcatagcggagagcgaccttatgtttgccgggaatgtggaaaagggtttgggcgcaacagccatctggtgaaccacctgcgggtccacacgggtgagaagccgttccgttgtggccagtgcgagaagcgattttcagatttttccaccttgacacagcaccagcggactcataccggagagaaaccctatacatgtattgaatgcgggaaaagttttatccagtcttcacatttgatacgtcaccgcagaatccacacaggtaacaaacctcacaagtgcgctggttgcgggaagggttttcgctataagacacatctggctcagcaccaaaagttgcatctttgctag

SEQ ID NO: 14666 - DNA, 1929 bp, Artificial Sequence
  Description of Artificial Sequence: Synthetic coding sequence
atggaagaagaaaggaagaccgctgaacttcaaaaaaacaggattcaggattctgttgttttcgaggatgtggccgtggatttcacacaagaagaatgggcccttctggatttagcccagaggaatctttacagggatgtaatgctggagaattttcagaatttggcatcactcggttatcctctgcatacacctcacttgatctctcagtgggagcaggaagaggacctacaaacggtgaaacgggaactgatccagggcattttcatgggcgaacacagggaagggttcgaaacacaacttaagacaaatgaaagcgtggcctcccaggacatctgcggggagaaaatctcgaatgagcagaagattgttaggtttaaacgaaacgatagttggttctctagcctgcacgaaaaccaagaatcatgcgggatcgattaccagaacaagtcccacgaaaggcatctccgcaaccacatggtggagaacatttacgaatgctacgaggaaaaccaggacggacagactttctcccaggtgcccaatcttgacagcctaaagaggaacactgaagttaaaagctgtgaatgccacgagtgtggaaaggctttcgttgatcattctagcctgaaaagtcacattcgatctcatactggctcaaagccctatcaatgtaaggaatgcggcaaagcgttccatttcctcgcatgcttcaagaaacacatgaaaacacctactgaggagaaaccctatgagtgcaaggagtgtacgaaggcctttagctgcagctccttcttccgggctcatatgaaaattcatattggcaagacaaattacgagtgcaaggagtgcggcaaaggtttctcttgcagcagctccttaaccgaacacaagcggattcattctggtgacaagccttatgagtgcaaagaatgcggtaaggctttctcgtgttcatctagtttgtccaaacacaagaggatacactccggagataagccctatgagtgtaaggaatgtggcaaagccttctcttcatcgagtcatctgatcatccatattagaatccatactggtgaaaaaccttatgagtgtaaagagtgcgggaaagctttctcggaatcgagcaagcttactgtccacggccgcactcatacaggcgagaaaccctacaagtgcaaagagtgcggcaaagcttacaactgtccatccagccttagcattcatatgcggaagcacaccggcgagaaaccctatgaatgcctggaatgcgggaaagcattctacttgcctaccagtctgaacacccatgtgaagaatcagtcgcgcgagaaaccatacgagtgcaaggagtgtggaaaagccttctcttgtccttcttcttttcgggcccacgtgagggaccatactggcaagatccaatacgaatgcaaagaatgcggaaagactttctctcggtcgagcagcctgacagagcatcttaggacacacagcggagagaagccctacgagtgcaaagagtgtggcaaggccttcattagctccagtcacctgactgttcacattcgcacccataccggagagaaaccctacgagtgtaaaaagtgtggcaaggcatttatttatccaagcgcgctgaggatacacatgcgcactcatactggggaaaaaccttacgagtgcaaggagtgcggcaaggctttccgccacagttcctacctgacagtgcatgcgaggatgcacacgggtgagaagcccttcgagtgtcttgaatgtggcaaggcatttagttgcccctcatcattccggagacatgtgcgcagtcatactggtgagaagccatacgaatgtaaagaatgcggcaaggcctttgtttgtcctgcctacttcagaagacacgtgaagacacacacccgcgaaaacatctag

SEQ ID NO: 14667 - DNA, 2229 bp, Artificial Sequence
  Description of Artificial Sequence: Synthetic coding sequence
atgccgtgctgctctcaccgcagttgccgagaggatccaggcacttctgaaagccgagagatggatcccgtcgcatttgaagacgtcgctgttaacttcactcaagaggagtggaccttgttggacattagccagaagaacctcttcagagaggttatgcttgagacctttcggaacttgacttcaataggaaaaaagtggtccgatcagaatattgagtatgagtatcagaacccacgccgatcttttcgcagcctgattgaagagaaggtcaatgagataaaggaggacagccattgcggtgagactttcacccaagtaccagacgatcgccttaatttccaagaaaagaaagcatcacctgaagtgaagtcttgtgactcatttgtgtgtgctgaggtggggatcggcaattcctcctttaacatgtccatccggggggatactggacacaaggcttatgaatatcaggagtacggcccgaaaccctataaatgtcagcagccaaaaaataagaaggccttccggtaccgcccatctattaggactcaagagcgggatcacacaggtgagaaaccatatgcctgcaaggtgtgcgggaaaacgtttatctttcactcctcaattaggcgtcacatggtgatgcattctggcgatgggacttacaagtgcaaattctgtggaaaagctttccattcttttagcctgtatcttatccatgaacggacccacaccggcgagaagccctacgagtgtaagcaatgcggaaaatccttcacatatagcgctacgctccaaatacacgagcgtactcacacaggcgagaagccctacgagtgcagcaagtgcgataaggcttttcactcaagtagctcctatcaccgccatgagcgcagccatatgggcgagaaaccgtatcagtgtaaggagtgtggaaaggcgttcgcatatacctcatcactccggcgacacgaaagaactcacagtggtaagaaaccttacgagtgcaagcagtacggcgagggtctctcttatttgattagctttcagacccatataaggatgaattccggtgagagaccttacaaatgcaaaatctgcggaaagggattttactctgccaaatctttccagactcatgaaaagacccataccggggagaagcggtacaagtgcaagcagtgtggcaaagcctttaacctgagctcgtcctttcgttatcacgagcggattcatacaggggagaaaccttacgagtgcaagcagtgcggaaaagccttcagatcagcaagccaactccgcgtccacggcgggacgcacaccggggagaaaccatacgaatgtaaggagtgcggcaaggcgtttaggagcacatcacacctgagggtgcacggacgaactcacactggagaaaaaccatacgaatgtaaagagtgtggaaaggcctttcgctatgtcaagcacctccagatccacgaacgaaccgaaaaacacatcagaatgccaagcggggagcggccttacaagtgcagcatctgcgagaagggtttctacagtgcaaagtccttccagacacatgagaaaacccatacaggcgagaagccgtatgagtgtaatcaatgcggcaaggccttcagatgttgcaacagtctgcgctaccacgagcgaactcacaccggagaaaaaccttacgaatgtaaacagtgcgggaaggcgttccgatccgcaagtcacctgagaatgcacgagaggacccacactggagagaagccatacgagtgcaaacagtgtgggaaggccttctcctgcgcttctaatctgcggaaacacggcagaacccacactggagagaaaccatatgagtgcaagcagtgcggcaaggcttttcggagcgccagcaacctccagatgcacgagcggacgcatacaggggaaaagccttacgagtgcaaggaatgtgaaaaggctttttgcaagttctcatccttccaaattcacgagcggaagcataggggggaaaagccctatgaatgcaagcactgtggaaacgggttcaccagcgcaaagattctccagattcatgccaggacacacatcggcgagaagcattacgaatgtaaagagtgtggcaaggctttcaattacttttcaagtctccatatccatgctcggacgcacatgggggagaagccatatgaatgcaaggattgcggcaaggcgttctcctag

SEQ ID NO: 14668 - DNA, 1596 bp, Artificial Sequence
  Description of Artificial Sequence: Synthetic coding sequence
atggggttcctccatgtcgggcaagatggtctcgagcttccaacatccggcgacccacccgccagtgcttctcagagtgccggtattacaggggtgagtcatcgcactcagcctccatgcttcgagggcctcacttctaaggatctcgtgcgggaggagaaaacaaggaagcgtaagcgcaaggctaaggagagcggcatggccctgttgcaaggcctgttgactttcagagatgtggctattgagttttcacaggaagagtggaagtgtcttgaccccgcccagcggaccctctaccgagatgtgatgctggaaaattaccgaaacttggtgagcctggacacttcctccaagtgtatgatgaaaatgttcagctctaccggccagggcaatacagaggtcgttcatactggaaccttgcagatccacgcatcccaccatataggggacacttgcttccaggaaattgagaaggatattcacgattttgtttttcagtggcaggaaaacgagaccaatggacacgaagccctgatgacaaaaactaaaaagctcatgtcctcaaccgagagacatgatcagcgccacgccggcaataaacctataaaaaacgagctgggatccagttttcactctcacctgccagaagttcacatattccaccctgaaggcaaaattgggaatcaggtcgagaaggccatcaacgacgccttctccgtaagcgccagccagaggatctcgtgtcgaccaaaaacaagaatttcgaataaataccgcaacaatttcctgcagtcaagccttctgacgcaaaaacgcgaggttcacacacgcgaaaagagcttccagagaaacgagtctggcaaagcgtttaatgggtctagcttactgaaaaaacatcagatcatccacctgggtgacaagcagtacaagtgtgatgtctgcggcaaggactttcaccagaagaggtacctagcatgccatagatgtcacactggtgaaaatccatacacttgcaacgagtgcggaaagaccttctcccacaattccgctttactggtgcacaaagccattcatacgggcgagaagccttataagtgcaatgaatgcgggaaggtgtttaaccaacagagcaatcttgctagacaccacagagtgcataccggggagaagccatataaatgcgaagaatgtgacaaagtgttcagccgaaagtcccatctcgagaggcaccgacggattcatactggggagaaaccttacaagtgtaaagtgtgcgataaggcctttcgccgggacagccatttggcacagcacaccgtaattcacactggggagaaaccttataaatgcaacgagtgtggcaagacattcgtccagaactcatctcttgtgatgcataaggtgatccacaccggcgagaaaaggtacaaatgcaatgaatgcggcaaggtgttcaatcacaagagtaacctggcctgccatcgcagactgcatactggggaaaagccttacaagtgcaatgagtgcgggaaggtttttaataggaagtctaaccttgagcgacatcacaggctacatacagggaagaaatcatag

SEQ ID NO: 14669 - DNA, 1398 bp, Artificial Sequence
  Description of Artificial Sequence: Synthetic coding sequence
atggccctgctccagggactcttaacttttcgagacgttgcgatcgagttttcacaggaggagtggaaatgccttgatccagcacaacgaaccctttacagggacgtgatgctcgagaactatcgcaatctcgtaagcctagacacttcctctaagtgtatgatgaagatgttttccagtactggtcaggggaacactgaggtcgtgcatactggtacactgcagatccatgcttcacaccacattggagacacttgctttcaggagatcgaaaaggacatccacgatttcgtgtttcagtggcaggaaaatgaaactaatggccacgaggcactgatgaccaagactaagaagctgatgtccagcacggaacggcacgatcagcggcatgccggcaacaagcccattaaaaatgagctgggctcttccttccacagccacctgcccgaggtccatatctttcaccctgaggggaaaatcgggaatcaggttgagaaagccataaatgatgccttttcagttagtgcatctcagagaatctcatgtcggcccaagacaagaatttccaacaagtaccgcaacaactttttacagagtagcttgcttactcagaagagggaggtgcatactcgggaaaaatctttccagcgtaatgagtccggcaaagcattcaacgggagttcattgctcaaaaagcatcaaatcatccacctgggcgataagcagtataaatgcgatgtctgcggcaaggactttcatcaaaagagatatctggcttgtcaccgctgtcacactggggagaatccttacacatgcaatgagtgcggaaaaaccttttcccacaattctgccctgcttgttcataaagctattcataccggagaaaagccgtacaaatgtaatgagtgcggcaaggtgttcaaccagcagtccaacctcgcccggcaccatagagtgcacacaggggaaaaaccatacaagtgcgaagagtgtgataaagtgttttcccggaagagtcatctggaacggcaccgcagaatccacaccggggagaagccatacaagtgtaaggtgtgcgataaagcctttcgtcgtgacagtcaccttgctcagcacacagtgatccacacgggtgagaaaccgtataagtgcaacgagtgtggaaagacattcgtacagaatagctccctcgtgatgcataaagtgatccatactggggagaaaagatacaaatgtaatgaatgtggcaaggtttttaaccataaaagtaacctcgcttgtcatcgtcgcctccacaccggtgagaagccctacaagtgtaatgagtgcggcaaggtgtttaacaggaagtctaacctggaacgccaccaccgcctgcacactggcaaaaaatcatag

SEQ ID NO: 14670 - DNA, 1596 bp, Artificial Sequence
  Description of Artificial Sequence: Synthetic coding sequence
atgggatttcttcacgtggggcaagacggattagagctgccgacctctggggaccctcctgcgtctgcctcacagagcgctgggatcacaggcgtgtcccaccgaacccagccaccgtgcttcgagggactcacgtccaaggacctggtgagagaggaaaagacgaggaaacggaaaagaaaggctaaggagtctggaatggcccttctccagggtctactgacattcagagatgtggccatcgaatttagtcaggaggagtggaagtgcctggacccagcacagaggaccctctacagagacgtcatgctagaaaattatcggaacttggtgagtcttgacacatcttccaagtgtatgatgaagatgttttcctccacaggacaggggaatactgaagttgtccacactgggacactgcagatacacgccagtcaccatatcggcgacacctgtttccaggagatcgaaaaagatattcatgattttgtcttccagtggcaggaaaatgagaccaatggacatgaagcacttatgacaaaaacaaaaaaactaatgtctagtaccgaaaggcatgaccagcgtcacgcggggaataaacctataaagaatgagttgggctcttctttccattcacacctccctgaagttcatattttccatccagaaggcaaaatcgggaatcaggtcgaaaaagctataaatgatgccttttcggtgagcgccagtcagcggatcagctgcaggccaaagaccagaatttccaacaagtacaggaacaacttcttgcagagtagtttacttacccagaaacgggaggtgcacacccgagaaaagtcatttcagagaaatgaatccggaaaggcgttcaacggatcaagcctgttaaagaagcatcagattatccatctgggcgacaaacagtataagtgcgatgtgtgcggaaaagactttcaccagaaacggtacctggcttgccaccgatgtcacactggcgagaatccttatacctgtaatgagtgcggaaaaactttctctcataactcggcgctattggtgcacaaggcaattcacacaggagaaaaaccatataagtgtaatgaatgtgggaaagtgttcaatcagcagtccaacttggcccgacaccacagagtgcacactggcgagaagccatacaagtgcgaagaatgcgataaagtgttctcacgcaaatcccacctggagagacacaggcgcatccacaccggagagaaaccttacaaatgtaaggtatgtgacaaggcctttcgccgcgacagtcacctcgcacagcacacagtgatacatacgggcgaaaagccctacaaatgcaacgagtgtggtaagacctttgtccaaaactcttccttggtgatgcataaagtgattcacaccggtgagaaaaggtataaatgcaatgagtgtggcaaggtattcaatcacaaatccaatctggcctgtcataggaggttgcatacaggagaaaagccatacaagtgcaacgagtgtggcaaagtcttcaatcgtaaatccaatttggagagacaccataggctgcatacaggtaaaaagtcttag

SEQ ID NO: 14671 - DNA, 903 bp, Artificial Sequence
  Description of Artificial Sequence: Synthetic coding sequence
atgcacagccttaaaaaagtcacctttgaggatgttgctatcgattttacccaggaagaatgggctatgatggacacttctaaacggaagctatatcgtgacgtcatgctggaaaacattagccatcttgtctcacttggctatcagataagcaaaagctatattattttgcagctggaacagggcaaagagctgtggcgtgagggacgggaatttctacaggaccagaaccccgatcgggagtccgctctgaagaaaaagcacatgattagtatgcatcccatcactcgtaaggatgccagcacttctatgactatggagaattccctgatattagaagatccatttgagtgtaacgactccggagaggattgtacccactcctcaacaatcacacagaggctgcttacgcattccgggaagaaaccatacgtgtctaaacagtgcggtaagtcactaaggaacctcttcagcccaaaaccacacaaacaaatccatactaaggggaaatcttatcagtgtaacctgtgtgagaaggcctatacgaattgcttccggctgagacggcacaagatgacacataccggtgaaaggccgtatgcttgtcatctatgcggaaaagcattcacccagtgttcccatctccggcggcatgagaagactcacaccggcgaaaggccttataaatgtcaccagtgtggcaaggccttcatacaatccttcaatttacgccgacacgagcggacgcacttggggaagaagtgttacgagtgtgacaaaagcggcaaggccttcagccagagtagcggtttccggggcaacaagattattcataccggcgaaaaaccccatgcttgcctcctttgtgggaaggctttctccctgtcctctgatctgagatag

SEQ ID NO: 14672 - DNA, 624 bp, Artificial Sequence
  Description of Artificial Sequence: Synthetic coding sequence
atgcactccttgaagaaggtgacttttgaggatgtggcaatcgatttcacgcaggaggagtgggccatgatggatacatctaaacgcaagctttaccgcgacgtgatgctagagaatatatcccacctggtctccctgggctatcaaatctccaaaagttatatcatcctacagctggaacagggcaaggagctctggagagaagggcgcgagtttttgcaggaccagaaccctgaccgagagtcagctctcaagaaaaaacatatgataagtatgcacccaatcacgcgaaaggatgcctcgacatctatgacaatggaaaacagcctcattctggaagatcctttcgaatgcaatgatagcggcgaagattgtacccatagttctactatcacacagcggttactcactcattctgggaaaaagccatacgtttctaagcagtgcggcaagtctctccgcaacctcttctcccctaaaccacacaagcaaatacatactaagggcaagtcgtatcagtgtaacctctgcgaaaaagcctatacaaattgtttccgcctgagacggcacaagatgacacacacgggcgaacgcccttacgcatgtcacctgtgtggcaagtag

SEQ ID NO: 14673 - DNA, 234 bp, Artificial Sequence
  Description of Artificial Sequence: Synthetic coding sequence
atgcattccctgaaaaaagtcacattcgaagatgtggccattgattttacccaagaggagtgggcgatgatggacacatcaaagaggaagctctaccgggatgtaatgctggagaatatctcccacttggtgtcccttggatatcagatctccaagtcatatattatcctgcaacttgaacaagggaaggagctgtggagagaagggagggagttcttgcaagaccaaaactag

SEQ ID NO: 14674 - DNA, 903 bp, Artificial Sequence
  Description of Artificial Sequence: Synthetic coding sequence
atgcattccctagagaaagtgacttttgaagacgtggccatcgatttcactcaggaagaatgggacatgatggatacaagcaaacgcaagttgtatagggatgtgatgctggaaaacatctcgcacctcgtgtccctagggtaccagattagcaaatcatatatcatcctgcagctggagcagggaaaagaactgtggagggagggaagagtatttctgcaggatcagaatccagatagagagtccgctctcaaaaagaagcatatgatatccatgcaccctattattagaaaagacgcaagcacctctatgactatggagaacagtctgattcttgaggacccgttcgaatataatgacagcggggaagactgcacccactcgagtactatcacccagtgtctactgacccacagcggaaagaagccttgtgtgtccaagcagtgtggaaaatcactgcggaaccttctttctcctaaaccccgtaagcagatccacacaaaaggtaagtcctatcagtgtaacttgtgcgagaaagcctatacaaactgcttttacctgaggcgacataaaatgacccacactggagagcggccatatgcatgtcatttatgcgggaaagcatttacacagtgttctcacctgaggaggcacgaaaagacgcacactggcgagcgcccttacaagtgccaccagtgtggaaaagcctttatccaaagctttaacctaaggcgccacgaaaggacacatcttgggcagaaatgttacgaatgcgacaagtctgggaaggctttctcacagagctctgggttcagagggaataaaattatccatattggcgagaagccccatgcttgtctgctctgcggaaaggccttcagtttatctagtgacctgcgctag

SEQ ID NO: 14675 - DNA, 1116 bp, Artificial Sequence
  Description of Artificial Sequence: Synthetic coding sequence
atggatatggcgcaggagcctgtcacttttcgggatgtcgcgatttactttagcagggaggagtgggcctgcctggaaccatctcaaagagccctatacagggacgtaatgctggacaatttctcttcagtggcagcccttggcttttgcagcccgcgcccagacctggtcagccgtttagaacaatgggaagagccctgggtggaggatagagagcggcccgaattccaggcggttcagcgcggcccacgacccggggccagaaaatccgcagatcccaagagaccttgtgaccaccctgcatgggcgcacaagaaaacccacgtcaggcgcgaaagagctcgcgagggctcttcatttaggaaaggtttccgactggatacagacgacgggcagttgccaagggcagctccagagagaactgacgctaagcctaccgcattcccctgtcaagtgctgactcagcgctgcggacgacggccaggcaggcgagagaggcggaagcagcgcgccgttgagctgtcgttcatttgcggtacatgtggtaaggctttatcctgccattcccgcctcctggcccaccagaccgtacataccggcactaaggcctttgaatgtccagagtgcgggcagaccttcaggtgggcgtccaacctacaacgacatcaaaaaaaccacactagagagaagcccttctgctgcgaggcctgtggtcaggcctttagcctgaaggatcgcctcgcacagcatcgaaaagtgcacaccgagcataggccttactcctgtggggactgcggcaaagcatttaagcagaagtctaacttattaaggcaccagttagtccacacaggcgaaagacctttttactgcgccgactgtggcaaagcattccgtaccaaagagaatctgtcacatcatcagcgcgtacactccggtgagaagccctatacttgcgcagaatgtggaaaatcatttcggtggcccaaaggcttcagcatccatcggagattgcatcttactaagaggttttatgaatgtggtcattgtggcaagggattccggcacctcgggttttttacacgacatcagaggacacacaggcacggtgaggtgtag

SEQ ID NO: 14676 - DNA, 1116 bp, Artificial Sequence
  Description of Artificial Sequence: Synthetic coding sequence
atggatatggcacaagagcctgttacattccgtgacgtggctatctatttttcgcgcgaggagtgggcatgcctggaaccttctcagcgagcgttgtatcgagacgtgatgctcgataatttctcctccgttgccgctctgggattctgttctccccggccagacctggtgagtaggctcgaacagtgggaagagccctgggtcgaagatagggagagacccgagtttcaggccgtgcagcgaggaccacgccctggcgcccgcaagagcgcagacccaaagcgcccttgcgatcatcccgcttgggctcacaagaaaacccacgtacggcgagagcgggccagggaaggtagttcatttcggaaaggatttaggctggacaccgacgacggacaacttccacgcgccgctcctgagcgaaccgacgcgaaacctacagcgttcccctgtcaagtgctgacgcaacgctgtggcagaaggccagggagaagagaacgccgtaaacagagggcggttgaactatccttcatttgtgggacgtgtggaaaggccctgagctgccattctaggttactcgcccatcagaccgtccacaccggaacaaaagctttcgagtgcccagaatgcggtcagacgttcaggtgggcttctaatcttcagagacaccaaaaaaaccatacaagggagaagcctttctgctgtgaggcctgtggtcaggcgtttagcctgaaagatcgcctcgcacagcatagaaaagtccacaccgagcaccgaccctactcttgtggcgattgtgggaaagcctttaaacaaaagtcgaatctgctccgtcatcaactggtgcatactggtgaacgcccgttttactgcgcagattgcggtaaggcatttaggacaaaagaaaatttgagccaccaccagagagtgcactcaggcgagaagccatatacctgtgcagagtgcggcaagagcttcaggtggcctaaggggttttccatccatcgccgcctccatttaacaaagcgcttctatgaatgcggtcactgcggaaagggctttaggcacctaggcttcttcacccggcaccagcggacacatcgtcacggggaagtttag

SEQ ID NO: 14677 - DNA, 1116 bp, Artificial Sequence
  Description of Artificial Sequence: Synthetic coding sequence
atggacatggcccaggaacccgtaacttttagagacgtcgcaatctatttctctagagaggaatgggcctgtctggaaccttctcagcgcgccctgtatagagacgtaatgctggataacttttcctccgttgccgcccttggcttttgtagtccacgcccagatttagtttcacggctggaacagtgggaggagccatgggtagaggatcgggagcggcccgaatttcaggccgtgcagcgaggccctaggcctggtgcgcggaaatccgcagatccgaagaggccgtgcgatcaccctgcctgggctcataaaaaaacacatgtaaggcgcgagagagcgcgtgaaggttctagttttaggaagggtttccggttggataccgacgatggacagcttccacgtgccgcccccgagagaaccgacgcaaagccaacggcctttccttgtcaagtgctgacccaaagatgcggacggagacccgggcgcagagagcgacgtaaacaacgagccgttgagctctcctttatttgtggcacatgcggtaaggccctgtcatgccactctagactccttgcgcatcagactgtccacaccggcaccaaagcgtttgagtgcccggaatgtgggcagacatttcggtgggccagcaatctgcagcgacatcagaagaaccacactcgcgaaaaacccttctgttgcgaggcttgtggtcaggcattctcacttaaagacagattggcccagcaccgcaaggtgcacactgagcatagaccatacagttgtggggattgtgggaaggctttcaagcaaaaatcgaatctgctgcggcatcagttggttcatactggcgagagaccattttattgcgctgactgtggcaaggcctttcgcacaaaggagaacttgtcccaccaccaacgcgtacactccggtgaaaaaccttatacctgtgccgaatgcgggaagtcatttaggtggcccaagggatttagcatccatcgccggctgcatctgaccaaaaggttctatgaatgtggccactgcggtaagggcttccgtcatctgggattctttacccgacaccagcgtacacaccgtcatggggaggtttag

SEQ ID NO: 14678 - DNA, 144 bp, Artificial Sequence
  Description of Artificial Sequence: Synthetic coding sequence
atggatatggcacaggagcctgtgacgttccgagatgttgcaatctacttctcccgggaggagtgggcctgcttggagccctcacaacgagctctgtacagggatgtcatgctggacaacttttccagtgtggctgccctgtag

SEQ ID NO: 14679 - DNA, 240 bp, Artificial Sequence
  Description of Artificial Sequence: Synthetic coding sequence
atggacatggcacaggaaccagtgaccttccgggacgttgcaatctacttctcccgcgaagaatgggcctgcttggagccatcacaacgtgcactctatcgggatgttatgctggacaattttagctccgtggccgcgctggggttctgctcacccaggccagacctggtgagtcgtctcgagcagtgggaggaaccatgggtggaagatcgggaacggcccgagttccaggccgtgtag

SEQ ID NO: 14680 - DNA, 1116 bp, Artificial Sequence
  Description of Artificial Sequence: Synthetic coding sequence
atggatatggcacaggagcctgtaacgtttagggacgtagcgatctattttagtagggaggagtgggcttgtctcgaacccagccagagggctctttacagggacgtcatgctagacaacttctctagcgttgccgccctgggattctgctcccccagaccggacctcgtttcacgcttagagcagtgggaggaaccttgggtagaagaccgggaacgaccagagtttcaggcggtgcagagaggacctagacccggggctcgaaaatcagccgaccccaaacgcccatgtgatcaccccgcatgggcccataaaaaaacgcatgtgcgccgggagcgcgcccgggaggggtcttcattccgcaaaggctttagactcgacacggatgatggccagctgcccagggctgcaccagaaaggactgatgctaaaccaaccgcgttcccctgccaagtcctcacccagcggtgtgggagaaggcctggtcgtagggagcggcgcaagcaacgtgcagtggagcttagctttatctgtggaacttgtggcaaagcactgagttgccatagtcgcctactggcccatcagactgtgcacactgggaccaaagcgttcgagtgcccggagtgcggacagacctttaggtgggctagcaacttacaaagacaccagaagaaccacacgcgtgagaagcctttttgttgcgaggcttgcggccaagcattcagcctcaaggataggctggctcaacatcggaaggtgcatacggaacatcgaccttattcttgcggggactgcggcaaagcattcaagcagaaatccaacctcctccgacaccagcttgtccatacaggcgagagacccttttactgtgctgattgcgggaaggccttcagaactaaggagaacttgtcgcatcatcaaagggtgcattcaggagagaaaccatacacctgcgctgagtgcggtaaatctttccggtggccaaaaggcttttccatacatagaaggttacatctcacgaagcggttttacgagtgcgggcattgcggaaagggatttcgccacctcggatttttcacgcggcatcagagaacgcatcggcacggcgaggtgtag

SEQ ID NO: 14681 - DNA, 1116 bp, Artificial Sequence
  Description of Artificial Sequence: Synthetic coding sequence
atggatatggcccaggaaccagtaacctttcgggacgtggcgatttatttcagcagagaggagtgggcatgcctggagcccagtcagagggcactgtacagggacgtcatgctcgacaattttagctcagtcgcggccctaggtttctgtagtcctcggcctgatctggtgtcacgcttagaacagtgggaagagccttgggtggaagaccgggaacgtccagagttccaggctgtccagaggggcccaaggccaggggcaaggaaatccgcagacccgaagcgtccgtgtgaccatcctgcctgggcgcacaagaaaacccatgtgcggcgagaacgggccagagagggctcctctttcagaaagggtttccgactggatacagacgatggtcaattgccccgagcagccccagagcgtactgatgctaagccaaccgcgttcccctgtcaggtgctgactcagcggtgcgggaggcggccaggcaggagggagaggcgtaagcagcgggcagtagagctatcctttatttgcggaacatgtggtaaggcactgtcttgccacagtcgtctcctggcccaccaaactgtgcatactggaaccaaagcctttgagtgcccagaatgcgggcagacattccgctgggcaagcaatcttcagcgacatcagaaaaatcatacccgcgagaagcctttctgctgcgaggcatgcggccaggcattttcactcaaggacagactcgcccagcatcgtaaggtgcacaccgagcaccgaccatattcttgtggcgattgcggaaaagcttttaagcagaagtccaatttgctgagacatcagctggtgcacaccggtgaacggcccttctactgcgcagattgtggaaaggctttcaggacaaaagaaaacctgtcccatcatcaacgggtgcactccggagagaagccatatacatgtgcagaatgcggcaagtcctttcgatggcccaaagggtttagcatacatcggaggctccatttgacgaagcgattttatgagtgtggacactgcggaaagggatttagacatctggggttcttcaccaggcatcaaaggacccataggcatggagaggtttag

SEQ ID NO: 14682 - DNA, 426 bp, Artificial Sequence
  Description of Artificial Sequence: Synthetic coding sequence
atggatatggctcaagagcccgtgaccttccgggacgtagcaatttacttctcacgcgaggagtgggcatgtttggagccttcccagagggcgctctatcgcgatgtgatgctggacaatttcagcagcgttgccgcactgggtttctgctcaccacgacctgacctagtgtccagactggaacaatgggaggaaccatgggtggaggacagggaacgccccgagtttcaggccgttcagcgaggaccccggccaggcgctcgaaaatccgcagaccctaagagaccttgcgaccatcccgcttgggcccataaaaaaacccatgttaggcgcgagagggcacgggaaggctcttctttcaggaaaggttttcgcttagacaccgatgatggccaactgccccgagcagcccctgagaggacatag

SEQ ID NO: 14683 - DNA, 1692 bp, Artificial Sequence
  Description of Artificial Sequence: Synthetic coding sequence
atggggcctttaacttttatggatgtggccattgaattttccctggaggaatggcagtgcctggacaccgcccaacaaaatctctataggaatgtcatgctggaaaattaccgcaacctggtctttcttgggatcgcggtgagtaacttggacttgatcacctgcttagagcaaggaaaggagccatggaatatgaagcggcatgagatggcggccaaaccacctgccatgtgttcacatttcgcaaaagatttgcggccagagcaatatattaaaaacagtttccaacaagttattttgagacgttacggaaagtgcggctaccagaaaggatgtaagtccgtggacgaacataaactgcacaagggtggtcacaaggggttgaatagatgcgtgaccacgacacaaagcaaaattgtacagtgtgacaaatatgtaaaagtgttccacaaatactctaacgccaaaaggcacaagatccgacataccggcaagaaccctttcaagtgcaaggagtgtggaaagtccttttgtatgctctcccagctcactcagcacgagattattcacacaggagagaagccttacaaatgcgaagagtgcgggaaggctttcaaaaaaagctctaacctgacaaatcataaaataatacacacgggagaaaagccttataagtgtgaggaatgtggcaaggccttcaaccagtcttctacgctgaccaggcataagataattcacactggcgagaaactgtacaagtgtgaagaatgtgggaaagcattcaaccgttcttctaatctcacaaagcacaagatcgtgcacaccggtgaaaagccctataaatgtgaggagtgcggaaaggccttcaagcagtctagcaacctgacaaatcacaagaagattcataccggcgaaaaaccttacaagtgtggagagtgcggcaaagcctttactctaagctctcacctgaccacgcacaaacgcattcacaccggagaaaagccatacaaatgcgaagaatgtgggaaggctttttccgtgttctcaacactcaccaaacacaagatcatccatactgaggaaaagccttataagtgtgaggagtgtggaaaggccttcaaccggagcagtcatcttaccaatcataaagtgattcacacaggagaaaaaccctacaagtgtgaagaatgcggcaaagcttttaccaagagcagtacacttacctatcataaggtgattcatactgggaaaaagccttataagtgcgaagagtgcggaaaggccttttctattttcagcatcctgacgaaacataaggtcattcacacagaagataagccttacaagtgtgaggaatgtggcaagacattcaattactccagcaactttacaaaccataaaaagattcacaccggtgagaaaccctacaagtgcgaagagtgcgggaagagttttattctaagctcacatttaaccactcacaaaattattcacaccggtgagaagccttacaaatgtaaagagtgcgggaaggctttcaaccagtcttctaccttaatgaagcataagataatccacacaggcgaaaagccatacaaatgcgaggagtgcggaaaggcctttaaccaatcacctaatctaactaagcataaaaggatacacaccaaggaaaagccttacaaatgtaaatag

SEQ ID NO: 14684 - DNA, 1926 bp, Artificial Sequence
  Description of Artificial Sequence: Synthetic coding sequence
atggatagcgttgtctttgaagacgttgccgtcaacttcactcaggaagaatgggcactgcttgggccctcccagaagaaactgtatcgagatgtcatgcaggagacctttgtgaatctggcctccataggcgagaactgggaggaaaagaatattgaggaccacaaaaaccagggaagaaaactccgatctcatatggttgaacgtctctgcgagcggaaggaaggtagtcagttcggagagactatctcccagactccaaaccctaaaccaaacaagaagacttttactagagtcaaaccctacgaatgctctgtttgcgggaaagattacatgtgccattcgtcgctgaatcggcacatgcggtctcacaccgagcaccgctcatatgagtatcacaagtacggagagaagtcctatgaatgtaaagagtgtggcaagcggtttagcttcagaagtagtttccgaatccacgaacgcacccacactggggaaaaaccttacaagtgtaaacagtgtggaaaggccttttcttggccgagttcgtttcagatccatgagcggacccacacaggcgagaagccctatgaatgtaaagagtgtgggaaggcatttatatatcacacaacattccgaggccacatgcggatgcacactggtgagaagccgtacaagtgcaaggaatgtggcaaaacattctcacatccgagttcgttcaggaaccacgaacggacccattctggcgaaaaaccctacgagtgtaaacagtgtggcaaagctttcagatattaccagacgtttcaaatccacgaacggactcacactggcgagaagccttaccagtgcaagcagtgcggaaaagccttgtcttgcccgacaagctttcgttctcatgagagaattcacaccggtgagaagccttacaagtgcaagaagtgcggcaaagccttctccttcccaagctcctttcgcaagcatgagcgtattcacaccggagagaagccctacgactgtaaagagtgcggcaaagcctttatctctcttccctcatatagacgccacatgataatgcatacaggaaatggcccctacaagtgcaaagaatgtggcaaggcgttcgactgtccaagtagctttcagatacatgagcggactcatactggagaaaagccctacgagtgcaagcaatgcggaaaggcattttcctgcagcagctcatttaggatgcacgaaaggacacacactggcgagaagccacatgaatgtaagcagtgcggcaaggcctttagttgttcatcatccgtcagaattcacgaacggacacataccggagaaaaaccttatgagtgtaaacagtgtggaaaagccttctcctgcagttccagctttcggatgcacgaacgcattcataccggagagaagccctacgagtgcaagcaatgtggaaaggcatttagcttctctagctcattccggatgcacgagcgcacccatacaggcgaaaaaccatatgagtgcaaacagtgtggcaaagctttttcctgctcaagcagttttcggatgcatgaacgcacacataccggggaaaagccttacgaatgtaaacaatgcggaaaggccttcagctgctcttcttcaatacgcatacatgagcgcactcacactggtgaaaagccatacgaatgtaaacagtgtggcaaggcctttagttgctcctcttctgtgaggatgcatgagaggacacatacgggtgtgaagccatacgaatgcaagcaatgtgacaaggcttttagctgtagtaggtctttcagaatccacgaacgcacacatactggtgagaagccctatgcttgtcagcagtgtggcaaggcttttaaatgtagccggtccttccggatccacgaacgagtccacagcggggagtag

SEQ ID NO: 14685 - DNA, 1926 bp, Artificial Sequence
  Description of Artificial Sequence: Synthetic coding sequence
atggactctgtcgtttttgaagatgtcgctgttaatttcacacaggaggagtgggctttgttgggtcccagccagaaaaaactttaccgcgatgtgatgcaggaaaccttcgtgaatcttgcaagcattggggaaaattgggaggagaagaatattgaagaccacaaaaaccagggacgcaagctgaggagtcacatggtggagcggttatgtgagcgaaaggaaggttcccagttcggcgaaactatcagccagacacccaacccaaaacctaataaaaaaacatttacccgtgtcaaaccttacgagtgctcagtgtgcggaaaggactacatgtgccatagctccctgaatcggcatatgcgctcccacaccgagcatcgctcctacgaataccacaagtatggggaaaagtcttatgagtgcaaggagtgcggcaaaagattttccttccgtagttccttccgaatccatgaacgcacccacaccggagagaagccttataagtgcaaacagtgcggcaaggcattttcatggccttccagctttcagattcacgagagaacccacacaggggaaaaaccttatgagtgtaaagagtgcggcaaagcgtttatctatcacaccacattcagggggcacatgaggatgcacaccggcgagaaaccttacaaatgtaaggaatgcggcaagacgttctcacacccgtcctccttcaggaaccatgagagaacccacagtggcgaaaaaccttacgaatgcaagcaatgtggcaaagcatttcggtactatcagactttccaaattcatgaacgcacccataccggagagaaaccctaccaatgtaagcagtgcggtaaagctctgtcatgtcccacaagttttcgttctcacgagagaattcacaccggggagaaaccttataaatgtaaaaaatgcgggaaagccttctcatttccaagctcgttcaggaagcacgagcgaattcacacaggagagaaaccctatgactgcaaggaatgtggcaaggcttttatcagtcttcctagctatagacgccacatgatcatgcatacgggcaacggtccttacaagtgcaaggagtgcggcaaggcttttgactgtcctagctctttccagatccacgagaggactcataccggtgagaagccttatgagtgcaagcagtgtggtaaggccttctcatgctccagctcttttcgcatgcatgagagaacacataccggcgagaagccccatgagtgcaagcagtgcggaaaagccttcagctgctcttcttctgtgcgaatacacgagcgaacccataccggcgaaaagccttatgaatgtaagcagtgtggcaaagccttttcatgtagctcaagctttcgcatgcacgagcggatccatactggggagaagccttacgagtgtaagcagtgcgggaaggccttcagcttctcaagctcctttcgaatgcacgaaagaacccataccggcgagaaaccttatgaatgtaaacagtgtgggaaagccttctcgtgttcaagcagttttcggatgcacgaacggactcatacaggcgagaaaccttacgagtgtaaacagtgcggcaaagctttctcgtgcagcagctctattcgcatccacgagcggacacatacaggggagaaaccttacgagtgcaaacaatgtgggaaggcattttcttgctcatcctctgttcggatgcacgagagaacccataccggggtcaaaccttacgaatgtaagcagtgcgacaaagctttctcgtgctcgcggagctttcgaattcacgagcggacacacactggtgaaaagccttatgcatgtcaacaatgcggaaaggcctttaaatgctccaggtcttttaggatccacgagagagtgcacagtggcgaatag

SEQ ID NO: 14686 - DNA, 1995 bp, Artificial Sequence
  Description of Artificial Sequence: Synthetic coding sequence
atggagggctttatggactccgggactcagacagacgccgtcgtggtacttagcctcgctcaggccgctgtcctgggtctggtttccgagaatgaactgttcggtgctactatcagtgccgaggccttttaccccgatctgggaccagagctgagcggagcagccatgggagaacccgaaccccctggccccgatgtgtaccagctcgcttgtaatgggagggccttggaggagcctgcagaggaagaggtgctggaagtcgaggctgcctgcgagaagcacaccaggcgcaagaccagacctcccgtgagattggtcccaaaggttaagttcgaaaaggtcgaggaagaagaacaggaggtctatgaggtgtcagtgcccggagacgataaagacgctgggcccgccgaggcccccgcagaggccgcttcaggcgggtgtgatgctctggtgcagtctagcgcagtgaagatgatcgatctgagtgccttctctagaaagcctaggaccctgcggcatctgccaagaacccctcgccctgaactgaacgtggctccctacgacccacactttcctgctcctgcaagagatgggtttccagagccttctatggcactcccaggacctgaggcgttgccgactgagtgcgggtttgagcccccccatctagcacctctaagtgatcccgaggcaccaagcatggaatcgcccgaacctgtcaaaccagaacaggggtttgtttggcaggaggcgagcgagtttgaagcggacacagccggctcaaccgtggaacgccataagaaggcacaactcgatcggttagatatcaacgtgcaaatcgacgatagttacctggttgaagcaggcgataggcagaaacggtggcagtgtaggatgtgcgagaaaagctacaccagcaaatacaaccttgtcacccatatcctcggtcataacggaatcaagcctcactcctgcccacattgctccaagctatttaaacagccctcccacctccagacccatcttctgacccaccagggaacccggcctcacaagtgtcaggtttgccacaaagccttcacccagacctcgcatctaaaaagacatatgctgttgcactccgaagtcaagccgtattcgtgtcacttctgtgggcgaggcttcgcgtacccgagcgagttaaaagctcatgaggtgaaacatgagtccgggcggtgccatgtatgcgtggaatgtggtctggatttcagcactttaactcagctgaagaggcatctagccagtcaccagggacccaccctctatcaatgtctggagtgtgataaatcctttcactatcggtctcagttacagaatcatatgctgaaacaccagaacgtgcgccctttcgtgtgcacagagtgtggcatggagttctctcagatccatcaccttaagcagcactctctgacacacaaaggggtgaaggagttcaagtgcgaggtctgcggaagagaattcacgctgcaagctaacatgaagcgtcacatgctgattcatacttctgtgagaccctaccagtgtcatatatgcttcaagacgtttgtgcagaagcaaacgctgaaaacacacatgatcgtgcacagcccagtgaagcccttcaaatgcaaagtctgtggaaagtcatttaacagaatgtataatcttctgggccacatgcacttgcatgccgggagcaagcctttcaagtgcccttattgctcgtccaaatttaatcttaaaggtaatctctctcgacacatgaaggtgaagcacggggtgatggacattggcttggattcccaggatccaatgatggagctcaccggtacagatccaagcgagctcgacgggcagcaggagatggaggattttgaggagaacgcatatagctatgctagcgtagattcaagtgcggaggcatccgtgctgactgaacaggccatgaaggaaatggcatattacaatgttctgtag

SEQ ID NO: 14687 - DNA, 240 bp, Artificial Sequence
  Description of Artificial Sequence: Synthetic coding sequence
atggaaggattcatggacagcggcacccagacggatgccgttgtggtgctaagcctggctcaggcagccgtgctgggactagtaagcgagaacgagctgttcggggctaccattagcgccgaagctttttaccccgatctaggccccgagctgtctggcgccgccatgggtgagcctgagccacccggaccagacgtataccaacttgcatgtaacggccgagctctggaagaaccctag

SEQ ID NO: 14688 - DNA, 1293 bp, Artificial Sequence
  Description of Artificial Sequence: Synthetic coding sequence
atggaggaagaggagatgaacgatgggagccagatggtcaggagccaggaatccctgacattccaggatgtggcggtagactttactagggaggaatgggaccagctgtatcctgcccagaagaacctataccgagacgtgatgctggaaaattaccgaaatcttgtagccctgggttatcaactgtgtaagcctgaggtgatcgcccagcttgagctggaggaggaatgggtcattgagagggattcactgctcgacacccatcccgatggggagaatcgacccgagattaaaaagtcaacaacgtcccagaacatctcggatgaaaaccagacacatgaaatgatcatggaacggcttgcgggggactcattctggtattcaatcctgggtggactgtgggactttgactatcaccccgaattcaatcaagagaatcataaacgatatctcgggcaggtgactttgacacataagaaaattacacaggaacgctcccttgaatgcaataaattcgccgagaactgcaatctgaatagcaatttgatgcagcagcggatcccgtcgatcaaaatacctctgaactcagacacacagggcaattccataaaacacaactctgatcttatctactatcagggtaactacgtccgtgaaacgccgtacgagtacagcgagtgcggaaaaatatttaatcagcacatcctgctgaccgatcatatccatacagcagagaagccgagtgaatgcggcaaagctttctcccacacgtcaagcctctcgcaacctcaaatgctattaactggcgaaaagccttataagtgcgacgaatgcggcaagcgctttagccagcgaattcatctcattcagcaccagaggattcacacgggcgagaagccgttcatttgtaacgggtgcggaaaggctttcagacagcacagctcctttacacagcacctgcggatccacaccggagaaaagccctataagtgtaatcagtgcggaaaagcattttccagaattaccagtttgaccgagcaccaccgtctccatacaggggaaaaaccatacgagtgcggcttctgtggcaaagcattcagccagagaacccatttgaatcagcacgaacggacccacacgggagagaaaccgtacaaatgtaatgagtgcggaaaggctttctcccaatccgctcacctgaaccagcaccgcaagattcacacacgggagaaattatgtgagtataagtgtgagcaaaccgtccggcatagtcctagttttagttctacttag

SEQ ID NO: 14689 - DNA, 2736 bp, Artificial Sequence
  Description of Artificial Sequence: Synthetic coding sequence
atgtgcagtcatttcacacaggacttcctaccggtacaggggatcgaggacagctttcacaaattgatactccgacgttacgagaaatgcggccatgacaatctgcagcttagaaaggggtgcaagagtatgaacgtctgcaaggtgcagaaaggggtttacaacggaatcaataaatgtctcagcaatacacaaagtaagatctttcagtgcaacgctcgggtgaaggtctttagcaaatttgcaaactctaacaaggacaaaacacgtcatacaggggagaagcactttaaatgtaatgagtgcggcaagtcctttcagaaattctccgaccttacccagcacaagggtattcatgctggcgaaaaaccttacacgtgtgaagaacgggggaaggattttggctggtacacggatctgaaccagcacaagaaaatacataccggcgagaagccgtacaaatgcgaggagtgtggcaaggccttcaatcgctcaaccaatcttactgcacataaacggatccataacagagagaaggcatacacaggggaggaccgtgatagagcgtttggatggagtaccaatctgaatgagtataaaaagattcacaccggcgacaaaccttataaatgtaaagagtgcggtaaggcatttatgcacagttcccatttaaataaacatgaaaagatccatacaggtgagaaaccttataaatgtaaggagtgtggtaaggtgattagcagctccagttccttcgctaagcacaaaaggatccacacgggtgaaaaaccgtttaaatgcctcgaatgcggcaaggccttcaacatctccacaactctcacaaagcacaggaggattcacactggcgagaaaccctatacttgcgaggtgtgcggcaaggcgttcaggcaaagcgcgaacctgtacgtccaccgtagaattcacactggggagaaaccctacacatgcggcgagtgtggtaagaccttccggcaaagcgctaatctgtatgtgcacagacgcatccacacgggagagaaaccttacaagtgtgaagattgcggcaaggctttcggtcggtataccgccctgaaccagcacaagaaaattcatactggtgagaagccctacaaatgcgaggagtgcggcaaagccttcaactcttcaactaatctcacggcgcataagcgcatacacactcgagagaaaccatatacgtgtgaagaccgaggccgggcattcgggttatccacaaacctgaacgaatacaaaaagatccacactggggacaaaccttataagtgcaaagaatgcggaaaggcttttatacacagcctccacttgaataaacacgagaagatacacaccggcaagaaaccgtacaaatgcaaacaatgtggaaaagtgatcacctcatcttcctccttcgccaagcacaaaagaattcacactggggagaaaccgttcgagtgccttgaatgcggaaaagccttcacgtcatccactacactaactaagcaccgtagaatccatacgggtgagaaaccctatacgtgtgaggtctgtggcaaagctttccgacaaagtgccatactctacgtgcatcggcggatccacacgggcgagaagccttacacatgcgaggagtgtgggaagactttcaggcaaagcgccaatctctatgtgcatcgacgcatccacacaggcgagaagccctacaagtgcgaagagtgcggcaaggccttcggaagatataccgacttgaaccagcacaagaaaattcacaccggagaaaaactgtacaaatgtgaggagtgcgggaaggatttcgtgtggtataccgacttaaatcaacaaaaaaagatctacaccggagaaaaaccatataaatgcgaggagtgcggcaaggcatttgccccatcaactgaccttaatcagcatacgaagattctaacaggggaacagtcatacaaatgcgaggagtgtgggaaggcgttcggttggagcatcgctctcaatcagcacaagaagatccatacaggtgaaaagccctacaagtgtgaggagtgcggaaaggccttctcccggtcccgtaatttaaccacccaccgaagggtgcacactagggagaagccatacaaatgtgaagaccggggaagatctttcggatggagcactaaccttaatgagtacaaaaagatccatacaggcgataaactctacaagtgtaaggaatgcggaaaagttttcaagcagtctagccaccttaaccgccacgagaaaatccatacaggtaaaaaaccatacaaatgcaaagaatgcggtaaggtgataacatcctcctcatcttttgccaaacacaagcggattcatacgggggaaaagcctttcaaatgcctggaatgcgggaaggcatttacctcgtccacaaccctgaccaaacaccgtcgaatccacaccggagagaagccttatacatgcgaagaatgcggaaaagcgttcaggcagagcgcaatcctctacgtgcaccgcagaatccacactggggaaaagccatatacgtgtggcgaatgcggcaaaaccttccgccaatctgccaatctttacgcccacaagaaaatacacacaggcgaaaagccatatacctgtggagactgtgggaagacattcaggcagtctgcgaacttatatgcccacaagaaaatccatactggcgacaaaaccattcaagtgtag

SEQ ID NO: 14690 - DNA, 399 bp, Artificial Sequence
  Description of Artificial Sequence: Synthetic coding sequence
atggaaccacttacgtttagggacgttgctatagaattcagtccagaggagtggaagtgtctggatccagcacaacagaacctttacagggatgtgatgcttgaaaactatcgcaaccttgtatctttagcgatgtgtagccactttacccaggactttctacctgtacagggaatcgaagacagctttcataagctgatcttgcgccgctatgagaaattcagcagtttaatttcttcttgtagagtgatttcccacggcctctcccgcggacgcaaccgagcgactgagaaaaacgatctcctcaccacggaggaaccagtggttaagcatagatttgatttacagtacccggaagagatgtggagaaataccgtggtccagaaaggacggaaatag

SEQ ID NO: 14691 - DNA, 2772 bp, Artificial Sequence
  Description of Artificial Sequence: Synthetic coding sequence
atgctcgagaattatcgaaacctggtgtctcttgcaatgtgcagccactttacacaagacttcttgcccgttcagggcatcgaggatagttttcacaaactgatcctgcggagatacgaaaaatgcggccacgacaatttgcagctgagaaaaggctgtaagtcaatgaacgtgtgtaaagtgcagaaaggtgtgtacaacgggattaataagtgtctgagtaacacgcagagcaagatatttcagtgtaatgcccgggttaaagttttttcaaagttcgcgaatagtaataaggacaagactcgtcacactggggagaagcatttcaagtgcaacgagtgcgggaagagcttccagaagttcagcgacctgacgcagcataagggcattcacgccggtgaaaaaccttacacttgcgaagagcggggtaaagactttggttggtataccgatctgaaccagcacaaaaagattcacacgggagagaagccttataagtgcgaagagtgtggaaaggctttcaatagatccactaatctgacagctcataagagaatccacaaccgtgaaaaggcatacactggagaggatcgtgaccgcgcgtttggctggagcacaaatctaaatgagtacaagaagatccataccggagataagccctacaaatgcaaagaatgcgggaaggcatttatgcactccagtcaccttaacaagcacgagaagattcacactggtgaaaaaccttataaatgcaaggaatgtggtaaggtgatctcctcaagctctagctttgcaaaacataagagaatccacacaggcgagaaaccgttcaagtgtttggagtgtggcaaagccttcaacatttccactacccttactaaacaccggcgcatccacactggcgagaagccctatacatgcgaagtgtgtggaaaggccttcaggcagagcgcaaacctgtacgtgcacaggagaatccacaccggagagaaaccctacacctgtggcgaatgcggtaaaacatttcgccaatctgccaacctttacgttcacaggcggatccacactggagaaaaaccttacaagtgcgaggattgcggcaaagcttttgggaggtacactgcccttaaccagcacaagaagattcatacaggagagaagccttacaagtgcgaagaatgcggtaaagcttttaactccagcacgaacctgaccgcccacaagagaattcacacgcgtgagaaaccttatacctgcgaggacaggggcagagcctttggcctgtcaacgaacctcaacgagtacaagaaaatacacactggcgataaaccttataaatgtaaggaatgcggcaaagcttttattcactccctacacctcaacaagcatgaaaagatccataccgggaagaagccctacaaatgcaagcagtgcggaaaggtgatcacctcatcatcttcttttgcaaaacataagcggatccatactggcgagaaacctttcgaatgtctcgaatgtgggaaggccttcacctctagcaccactttaacaaagcatcggaggattcatacgggtgagaaaccctatacttgtgaggtgtgcggcaaagcattcaggcaaagcgcgattctgtatgtccataggcggattcatacgggtgaaaaaccctacacttgtgaggagtgtggcaagacttttaggcaaagcgccaacctgtacgtgcacaggcgtatccatacgggcgagaaaccctacaaatgtgaagagtgcggaaaggccttcggacggtataccgatctaaatcagcacaaaaagattcacactggcgagaaactgtataagtgtgaggagtgtggcaaagattttgtttggtataccgatctgaaccagcaaaaaaagatctataccggggaaaaaccctataaatgcgaggaatgtggcaaggcatttgctcccagcaccgacctcaaccagcatactaagatcctgacgggtgagcagtcctacaaatgtgaagagtgcggcaaagccttcggatggtccattgctctgaaccagcacaagaagatccatacgggggagaagccctataagtgtgaagagtgtggcaaggcctttagcaggagccgcaacttaactacccatcgacgcgtacacaccagggaaaagccttacaaatgtgaagatcgaggacgcagctttgggtggtccaccaatctgaatgagtataagaaaatacacaccggtgataaattgtataagtgcaaggagtgcggtaaggtttttaagcagagcagccacctcaatcggcacgaaaagattcacaccggtaagaagccctataaatgtaaagagtgcggaaaggtcattacatcaagctcttcctttgccaagcacaaacgcatccacaccggagagaagccttttaagtgcctcgagtgtggtaaggccttcacgtcatccaccactcttacaaagcacagacggattcacactggcgaaaagccatatacgtgcgaggagtgcggtaaagcctttaggcagtctgcaatactctatgttcacagaagaattcacactggagagaagccttatacttgtggagagtgtggcaagacatttcggcagtctgctaatctctacgcccataaaaagatccacacgggggaaaaaccatatacttgtggtgactgtggcaaaacattccgtcagagtgcgaacctatatgcgcacaaaaagatacataccggcgacaagaccatacaggtgtag

SEQ ID NO: 14692 - DNA, 2217 bp, Artificial Sequence
  Description of Artificial Sequence: Synthetic coding sequence
atgggtttgcttactttcagggacgtcgcaattgagttttcattggaagaatggcagtgcctggacactgcccagaaaaatctgtatcggaacgtcatgctcgagaactacaggaacctagccttcctcggcatcgcagtgagcaagccagacctgatcatctgcttagagaaggagaaggaaccctggaatatgaaacgtgatgagatggttgacgagcctcccggtatctgcccccactttgcacaggacatctggccagagcagggggtggaggattcctttcaaaaagtgatcctgcggcgcttcgaaaagtgcggtcacgaaaatctacagcttcgcaaagggtgcaaatccgttgacgagtgcaaagtgcataaagagggatataatgggctgaaccagtgcttcaccaccacccagggtaaagcatctcagtgcgggaaatacctgaaagtgttttataagtttatcaatctgaatcgctataagattaggcacaccaggaaaaaaccgttcaagtgcaagaactgtgttaagtcgttctgcatgttttcccataaaactcaacacaagtcaatctataccacagagaagtcctacaaatgtaaggaatgtggaaagactttcaattggagctctacactgacaaaccataagaaaacacatacagaggaaaaaccttacaaatgcgaggagtacgggaaagcgtttaaccaatcctccaattacacaacccacaaggtgacacacacaggagagaaaccgtataagtgcgaagagtgtggaaaggctttctcacaaagttcgaccctgactatccacaaacggattcacacaggggaaaaaccatgcaagtgtgaagaatgtgggaaagctttctcacagccgtccgcgttaacgattcacaaaaggatgcatattggtgaaaagccttacaagtgcgaggagtgcgggaaagcattcgtctggagctcgactctcacccgccataagagactgcattccggtgagaagccgtataagtgtgaagagtgtgccaaagctttctcgcagtttgggcacctgaccacccaccgcattatccacaccggcgagaagccttacaagtgcgaggagtgtggaaaagcctttatttggccctctacgctcacaaagcataaaagaatccatactggggagaagccatacaaatgcgaggaatgcggcaaggcattccacaggagcagcaacttgaccaaacataaaataatccacacaggtgaaaaaccgtacaaatgtgaggaatgtggaaaggcgttcatttggtcaagtaacctcaccgaacacaaaaaaattcacacgagagaaaagccctataaatgcgaagagtgctcaaaagcgttttctcggagctccgctctaaccactcataagagaatgcacacaggcgagaaaccttacaagtgtgaagagtgtggaaaggcctttagccagtcttcgactctgactgcccataagataattcataccggcgaaaaaccttacaagtgtgaggagtgtggcaaagcattcatcctctcttctacgctgtctaaacataagcgcattcacacaggcgagaagccgtacaagtgtgaagagtgcgggaagaccttcaatcagagctccaatctgagcacccacaaaatcatccacacaggcgagaaaccttataaatgcgaagagtgtgggaaagcttttaaccgcagttcaaaccttagtactcataaaattatccatactggggaaaaaccttataaatgtgatgaatgcggcaagtccttcatctggagctcaactctgtttaagcacaagatcatccatacaggcgaaaagccttacaagtgcgaagagtgtgggaaggcttttaaccactctcagatcctcttgcacatccggcacaaacgtatgcacacgggagagaagccctacaagtgtgaggagtgcgggaagagctttaacctgtcgtcaacgttcataaagcataaggtgattcacaccggggtgaagctctacaaatgtgaggaatgcggaaaggttttcttttggagctctgctctgactaggcacaaaaagatccatgcgggtcagcaaccttataaatgggaaaaaattggtaaagcattcaatcagagtagccatctgacgaccgacaagatcacacatatcggggagaaaagctataagtgtgagtag

SEQ ID NO: 14693 - DNA, 327 bp, Artificial Sequence
  Description of Artificial Sequence: Synthetic coding sequence
atggggctgttgacctttagagacgtggccatcgagttcagcctggaagaatggcagtgcttagacactgcacagaaaaatctgtacaggaatgttatgctggaaaattacaggaatctagcttttctagggatcgccgtttctaaaccggacctgataatctgtctggagaaagagaaagagccttggaacatgaagagagatgagatggtggatgagcctcctggcctggcagtatcgaatccagatctgatctcctgcctggagcagatcaaagaaccctggaacgtgaaacggcacgaaaccgtggttaagtacagtgggtag

SEQ ID NO: 14694 - DNA, 270 bp, Artificial Sequence
  Description of Artificial Sequence: Synthetic coding sequence
atgggtttactgacgttcagagacgtggcaattgaattcagtctggaagagtggcagtgtctcgacacagctcagaagaacctgtatagaaacgtaatgctggaaaattaccgcaatctggctttcttgggtattgctgtgagcaaaccagatttaatcatatgcctggagaaggaaaaggaaccctggaacatgaagagagacgagatggtcgacgagccccctgacggcgttagcctgtgccatcctggttggtcagccgtggcgtag

SEQ ID NO: 14695 - DNA, 234 bp, Artificial Sequence
  Description of Artificial Sequence: Synthetic coding sequence
atgggccttctcacttttcgagatgtggcaattgagttttccctcgaagagtggcagtgcctcgacaccgcccagaagaatctttacaggaatgtgatgctggagaactataggaacctggcctttttgggcattgccgtctccaagccagatctgattatctgcctggagaaggaaaaggaaccatggaacatgaagcgggacgaaatggtagacgagcccccaggtcgatag

SEQ ID NO: 14696 - DNA, 1851 bp, Artificial Sequence
  Description of Artificial Sequence: Synthetic coding sequence
atgggtttgcttaccttccgcgatgtggctatcgaattctcactcgaagaatggcagtgtctagacactgcccagaaaaacttgtacagaaatgtaatgctggagaactaccggaatctagcattcctggggattgcagtttctaagccagacctcattatttgcctagaaaaagagaaggagccatggaatatgaagcgagatgagatggtggatgagccacctggcatttgcccgcattttgcccaggacatttggcctgagcagggcgtggaggactccttccagaaagtaatactgaggcgctttgaaaagtgtggccacgaaaatctccagctgagaaagggttgtaagagtgtcgacgaatgtaaggtgcataaggaagggtacaatggattaaaccagtgctttaccacaacgcagggaaaggcgtcccagtgtggtaaataccttaaggtgttttacaagttcattaatctcaatcgctacaaaatcagacatactcgaaagaagccctttaaatgtaaaaattgtgtgaagagtttctgtatgttctcccacaaaacacagcataagagcatctacacgaccgaaaagagttacaagtgcaaggagtgtggaaagacctttaattggtcgagcactctcacaaaccacaaaaaaacacacaccgaggagaagccctacaaatgcgaagagtacgggaaagcttttaaccagagcagtaactacactacccacaaagtcactcatacgggtgaaaagccatacaagtgcgaggaatgtggcaaagccttttctcagtcaagcactctcaccatacacaagcggattcatactggagaaaaaccatgtaagtgcgaggagtgcggtaaggccttcagtcagcctagtgcccttactatacataagagaatgcacatcggcgaaaagccatacaaatgcgaggaatgcggtaaagctttcgtgtggagtagcacccttaccaggcacaaacgtttgcactcaggagaaaaaccatacaagtgcgaggaatgtgctaaggcattttcacagtttggacatcttaccacccatagaatcattcacacaggtgaaaagccttataaatgcgaggaatgtggtaaagccttcatctggccgtccaccctaaccaaacacaagaggatccacaccggcgagaaaccatataagtgcgaagaatgcgggaaggctttccataggtcttcaaatcttacgaaacacaagataattcacaccggcgaaaaaccctataagtgcgaggaatgcggcaaagcgttcatttggagcagcaatcttacagaacacaaaaagatccacacacgggagaaaccatacaaatgcgaggagtgctccaaggccttctcaagatcaagcgccttaacaacccacaaacgaatgcatactggggaaaaaccatacaaatgcgaggagtgcggcaaggcattctcgcagagctccactttgacagcccacaagatcatacacacaggagaaaagccctacaagtgtgaggagtgtggtaaagcctttatcctgtcttccactctgtctaagcataaacggatccacacaggggagaaaccatataagtgtgaagagtgtggcaagacattcaaccagtcatcaaacctgagtacacacaagatcatccacacaggggagaagccttataaatgcgaagaatgtggcaaggctttcaacagaagttcaaacttgtctacccacaaaatcatccacactggagaaaaaccatataagtgtgacgaatgtgggaagagctttatctggtcctctaccctgttcaagcataaacggatccacacctag

SEQ ID NO: 14697 - DNA, 3759 bp, Artificial Sequence
  Description of Artificial Sequence: Synthetic coding sequence
atgcccggagcccccggctctctcgagatggggccccttacatttagggacgtgactatagagttcagtcttgaagaatggcagtgcctcgacactgtgcagcagaatctctatagggacgtgatgctcgagaattatcgcaatctcgtgtttttagggatggcagtgttcaaaccagaccttattacttgcctgaaacaaggcaaagaaccgtggaacatgaagcgacatgagatggtcacaaaacctcctgtcatgagaagccactttacacaggacttatggccagaccagagtactaaggattcatttcaggaggtgatccttaggacgtatgcccgctgtggacacaaaaatctacgccttcggaaagattgtaagagtgccaacgagggcaagatgcacaaagagggctataataagcttaatcagtgtaggaccgctactcaaagaaaaatcttccaatgcaacaagcacatgaaagtttttcataaatatagcaaccgcaacaaggtgcggcacacgaagaagaagacctttaaatgtataaaatgctctaaaagcttcttcatgctgagctgcctgatcagacacaaaagaatccacattagacagaatatttacaaatgcgaggagcggggcaaagcattcaaatccttctccaccctgacgaagcacaagattattcacacggaagacaaaccttacaaatataaaaagtgcgggaacgcctttaagtttagcagcactttcactaaacataagcgcattcatactggagagactccatttcggtgtgaggaatgcggcaaagccttcaatcagtccagtaacttgactgatcacaagcggattcacaccggcgaaaagacatataaatgcgaggaatgtggcaaggctttcaaggggagctctaattttaatgcccacaaagtgatacataccgcagagaagccgtataagtgcgaggactgtggcaagaccttcaaccacttctctgctctgcgcaaacacaagatcatccacaccgggaaaaagccttacaagcgagaggagtgcggaaaggcattcagtcagtcctctaccttgagaaaacatgagatcatccacaccggtgaaaagccgtataagtgtgaagagtgcgggaaggctttcaagtggagcagcaaacttacagtccataaagtcgtccataccggcgaaaaaccatataaatgcgaagagtgtggcaaagccttttctcaattctccacactgaagaagcacaaaattatccacacaggcaaaaagccttataaatgcgaagagtgcggaaaggcgttcaacagcagttccactctgatgaagcacaagataatccatactggagaaaagccatataagtgcgaagaatgcggaaaggctttcagacaatcatcccatctcacacgtcacaaggcaattcataccggcgaaaagccttacaaatgcgaggagtgcgggaaagcctttaaccattttagtgatttacgtcgccataagatcattcataccggcaagaagccatacaagtgcgaggaatgtggaaaggcatttagtcagtctagcacactccggaaccaccagatcattcacacgggcgagaaaccttacaaatgcgaggaatgtgggaaggcgttcaaatggtcctcaaaactcactgtgcacaaagtcattcataccggagaaaaaccttgcaagtgtgaagaatgtggcaaagcttttaaacacttttccgccctgcgcaagcataaggtcattcacactagggaaaaactgtacaagtgcgaggaatgtggaaaggcgtttaataattcgtcaatcctcgctaagcataaaatcatccataccggtaagaagccctataaatgtgaggaatgcggtaaggcatttagacagagctctcaccttactcgtcacaaagctattcatactggggagaaaccttacaaatgcgaggagtgcgggaaagctttttcccacttctctgctctaaggcggcataagattatccacactggcaaaaaaccctataaatgcgaagagtgcggaaaagctttcagccacttcagcgccctgcggcgtcataagataattcatacgggggagaaaccatataaatgcgaagagtgcgggaaggctttcaagtggagcagcaagctgactgttcacaaggttatacacaccgcagagaagccatgtaagtgtgaagagtgtggaaaaagctttaaacacttttctgcactccggaagcacaaagtcattcatacaagagagaagctgtacaagtgcgaggagtgcgttaaggctttcaactccttttctgctttgatgaagcacaaggttatccacacaggcgaaaagccctacaagtgtgaagagtgcggaaaggcatttaaatggagttcaaagctcactgtacataaggtgatccacacaggtgaaaaaccttgtaagtgtgaggagtgtggaaaggcatttaagcatttttcggctcttagaaaacacaaggtgatacacaccggcaaaaagccttataaatgcgaagagtgtggaaaagcgtttagtcagtcctcatctctccggaagcacgaaataattcacagcggcgaaaagccttacaaatgtgaggagtgcggaaaggcgttcaaatggctgtcaaaattaactgtgcacaaggtgatccacacagcagagaagccgtgtaagtgcgaagaatgtggtaaggccttcaaacatttttcagcgctgcgaaagcataagataatccacaccggaaagaaaccttataaatgcgaagaatgtgggaaagcatttaatgactcttcaacccttatgaaacataaaatcatccacacaggaaaaaagccgtataaatgcgccgagtgtggcaaggctttcaagcagagctcccacttaacaagacacaaggcgatccacaccggggaaaagccttataagtgtgaggaatgcggaaaagattttaataattccagcactctgaaaaagcataaactgatacatacgcgcgagaagctttataagtgtgaagagtgtgtcaaggccttcaataatttttctgccctcatgaaacacaaaatcatccacacaggcgagaagccctataagtgcgaagagtgtggaaaagcctttaagtggagcagtaagctgacagaacataaggtcattcataccggtgagaaaccctgtaagtgtgaggagtgcgataaggcctttaagcacttctccgccctgcgaaaacacaaggtaatccacaccggaaaaaagccctaccagtgcgacgagtgcggcaaggctttcaataactcatcaacgttgactaaacacaaaattatccataccggggagaaaccctataagtgtgaggagtgcggcaaagcattttcgcagtcaagcatcctgactaagcacaagataattcatagcgtcgagaagccatacaagtgtgaggagtgtggcaaggctttcaaccagtcctcacatctgacacgacataaaacaatacacacaggcgagaaaccctacaaatgtgaggagtgcgggaaggcgtttattcagtgcagctacctgattcgccataagactatccacacaagggagaaacctactaacgttaagaaggtgcccaaactcttgagtaaccctcatacccttcttgacaaaacgatccacacaggtgagaaaccgtataaatgtgaggagtgtgctaaggccttttag

SEQ ID NO: 14698 - DNA, 1512 bp, Artificial Sequence
  Description of Artificial Sequence: Synthetic coding sequence
atgggggcactgacgttcagagatgttgccattgagttctcattagaggagtggcagtgtcttgataccgaacaacagaacctgtatagaaacgttatgctggacaactatcgcaacctagtttttcttggcatcgcggtttcaaaaccagatctcattacctgtttagagcaagagaaggagccctggaatctgaagactcacgacatggttgcaaaacctccagttatttgcagccacatcgcccaagatctctggcccgagcagggcatcaaggattactttcaagaagtcattctaaggcagtacaaaaaatgtaggcacgaaaacttgcttttgcggaaaggatgtaaaaacgtcgacgaatttaaaatgcataagaaagggtataaccgccataaccagtgcctgaccacttcgcacagtaaaatctttcagtgtgacaagtacgtgaaggtattccacaaattctcgaatagtaatcggcacaagattcggcatacctccaagaagccgttcaaatgcaaggagtgtggaaagctgttctgcatactgtctcatctggcacaacacaaaaaaatccacactggagagaagagctataagtgcgaggaatacgggaaggcattcaatgaatccagtaattgcacgacccacaagcgaataactgagaaaaaaccttataaatgtaaagagtgtggaaaggcatttaattggttcagtcattttacaacacacaagagaatccacactggcgaaaagccctatcagtgcgagaagtgtgggaagttttttaatcaatccacaaacttaacaacccacaaaagaatacatacaggggaaaagccttataagtgtgaggagtgtggtaaggccttcaaccagagttctaacctcacagagcataaaaaaatccacacgaaggaacagccgtacaagtgtgagaaatgcggtaaggcatttaagtggtcctccacgctcaccaagcataaaagaatccacaatggtgaaaaaccttacaagtgcgaagagtgtggcaaagcatttaatcggtcttctactcttaaccggcataaaattacacacaccggaggcaagccctataagtataaggagtgcgggaaggcgtttaatcaatccagtacgctcacaatacacaagatcatccatacagtcgagaaattctacaaatgcgaggagtgcggaaaggcgttctcgcgaatctcccatcttaccactcataaacggattcacacaggcgagaaaccctacaaatgtgaagagtgtggtcgggcatttaatcaaagcagcaccctcacaacgcacaaacgtatccatacaggggaaaagccatatgaatgcgaggagtgcgggaaagctttcaatagatcctccactctgactacacataagatcatccattccggcgaaaagatttacaagtgtaaggaatgtgggaaggcatttagacgcttcagccatctcacccgtcataagaccatccacacttag

SEQ ID NO: 14699 - DNA, 1758 bp, Artificial Sequence
  Description of Artificial Sequence: Synthetic coding sequence
atggagctgctgaccttccgcgacgtggccatcgaattttctcctgaggaatggaagtgtttagacccggcccagcaaaacctgtacagagacgtgatgctcgagaactatagaaacctgatttctttaggggttgccatatcaaaccccgatctggtcatctacttagaacagcggaaggagccctacaaggtaaaaatccacgaaaccgtggcaaaacaccccgcagtctgctctcacttcacacaggactttcttccagtacagggcatagaggacagcttccataaactcattctgcgcagatatgagaagtgtgggcacgaaaatctggaacttaggaagagctgcaagaggaaggtccagaagggaggctataatgagttcaaccagtgcctgagtactattcagagcaagatctttcagtgtaatgtgcacgtgaaggtgtttagcacctttagtaatagtaatcagagacggattcggcataccggcgagaagcacttcaaggagtgtgggaaaagcttccagaagttctccgacttaacccagcatcaaggcattcacgcgggagagaaaccgtacacctgcgaggagtgcggcaaagacttcaaatggtacctcattttcaacgaatatgagatcatccacaccggcgagaagcctttcacatgcgaagagtgcggaaacatattcactacatcgtccaacttcgcgaagcataaggtgcacaccggagaaaagagctataaatacgaggagtgcggcaaggcattcaatcgtagctcgaccctgaccaagcacaaacggatacatgctgaagaaaagccattcacctgtgaggagtgcggtaagataattactagcagttccaatgtcgctaaacataagaaaattcacacaggagagaaactgtataaatgtcaagagtgcgggaaggtttttaaccgctctaccacactgacaaaacataatcggattcacaccggagagaaaccctacacctgcgaggagtgcggaaaggctttctcccggagctccgtgctcaacgagcacaaaaggattcatacaggagaaaagccttataaatgcgagcagtgcggtaaagcctttcgtcagtcggccactttaaataaacataagtccatccacactggcgaaaaaccgtatacatgtgaggaatgcggcaaagccttctcgcgatttaccaccttaaatgaacacaaacgcatacacaccggagagcggcctcataagtgcgaagaatgtggcaaagcctttggatggtccaccgacctcaataagcacaaaattatccacaccggagaaaaaccctacaaatgtgaagagtgtggtaaggcgtttgggtggtctgcatacctgagtaagcataaaaagatacatacaggtgaaaaaccttacagatgcgaggagtgcggcaaggcttttctgtgcagcagggctctgaacaagcacaagaccattcatacaggggagaagccgtatgaatgtgaggaatgcggaaaggctttcggttggagcacctaccttagtaagcacaagaagattcacaccggagaaaaaccttacaggtgtgaggaatgcggtaaggccttccgccgcagtcgggtgcttaacaaatataagacgatccacacaggtgacaaaacgcccaagtgcaaaggttgcgggaaagcattcaagtggtcctcctacctgaatcagcacaataaaatttacacaggcgagaagttatag

SEQ ID NO: 14700 - DNA, 1284 bp, Artificial Sequence
  Description of Artificial Sequence: Synthetic coding sequence
atgggcgtgttgacctttagagacgtggccgtggaattctcacccgaggagtgggagtgtctggacagcgcccagcagaggctgtaccgggacgttatgctagaaaattacgggaacctggtgagtctcggcctcgccatcttcaaacctgacctgatgacctgtctggagcagcggaaagagccttggaaagtaaagcgtcaggaagctgtggccaaacaccccgccgggtcctttcacttcactgcagagatcttacctgaccatgatatcaaagactctttccagaaagtcattctgcgcaaatacggatcatgcgatttaaacaacctgcacctaaaaaaggactaccagtccgtcggaaactgtaagggtcagaaatcttcttataatggcctgcatcaatgtctgagtgcaacccactccaagacttgccaatgcaacaagtgtgggcgtgggtttcagctgtgcagtatatttactgagcacaaggatatcttctcgcgcgagaagtgtcacaagtgtgaggagtgtggtaaggactgtaggctcttctcagactttacgagacacaaaaagatacacaccgtggagcgttgctacaaatgcgaagaatgcggaaaggcttttaagaagttctcgaatctgacagagcacaagagggtccacacaggagaaaagccgtacaagtgcgagggttgcgggaaaaccttcacatgcagctccacgttagtcaagcacaagcgcaatcatacaggggaccggccttacaagtgtgaagagtgtggaaaggcatttaaatgtttcagcgacctgaccaatcacaagcgcattcacacgggcgaaaagccatataaatgtgaggagtgtaacaaagcgtatcggtggttcagtgacttggcgaagcacaagatcatacacacaggcgataaaccatatacatgcaacgagtgtgggaaagccttcaaatggttttccgctttgtccaaacacaaacggattcatactggtgaaaagccctacatatgtgaggagtgcggaaaggccttcactaggtccagtacacttttcaatcataaacgcattcatatggaggagcggccttataagtgcgaagagtgcagtaaaacgttcaaatgcttttcagatttgaccaatcacaagcgaatccacacaggcgaaaagccttacaagtgtgaggagtgtggtaaggcttcttcctggttttcccatttaatcagacacaagagaatccatacacgcgagaaactacacaagtgctag

SEQ ID NO: 14701 - DNA, 1284 bp, Artificial Sequence
  Description of Artificial Sequence: Synthetic coding sequence
atgggagtgttgacatttagggatgttgcggttgaattctcccccgaagagtgggaatgtcttgacagtgcacagcagcggctttaccgcgacgtaatgttggagaattatggaaatctggtgagtctaggactggccatattcaagccagacctcatgacatgcctggaacagcgtaaggaaccgtggaaggtgaagcgccaggaggcagtggctaagcaccctgcaggctctttccacttcacagcagagattcttcctgatcacgacatcaaggattctttccagaaggtgatccttagaaagtacgggagttgtgacctcaataatctccacctaaaaaaagattatcagagcgtgggaaattgtaagggccagaaatcctcctataatggcctacaccaatgccttagcgccactcattccaagacatgccagtgcaacaagtgtggccgcggcttccagctctgttctatattcacagaacataaagacatcttctctcgtgaaaagtgtcacaaatgtgaggagtgtggaaaagactgtagactgtttagcgatttcaccaggcataagaagatacacaccgttgagcgctgttataagtgcgaagagtgcggcaaagctttcaaaaagtttagtaatctgacagagcacaaacgtgtgcataccggcgaaaaaccatacaaatgcgaaggatgtggcaagacctttacatgtagttctacactcgtgaaacacaaacgcaaccacactggagaccggccctacaaatgcgaggagtgcggcaaggcttttaaatgttttagtgatctgaccaaccacaaacggattcatacgggggaaaagccctataaatgcgaggaatgtaataaggcctaccggtggttcagtgacctcgctaagcataagataattcataccggggacaagccgtacacgtgtaacgagtgtggaaaagccttcaagtggttcagcgctctatctaaacataagcgtattcacaccggggagaagccttacatctgcgaggagtgcggtaaggcatttactcggagcagcactctatttaatcataagcggatccatatggaggagcgaccatataaatgcgaggaatgctcgaagaccttcaagtgcttcagcgacctcactaaccataagagaattcatacaggcgaaaagccttacaaatgcgaggaatgtgggaaggcctcatcctggttttcacatctgattcgtcataagcgaattcacaccagggagaagctgcacaaatgttag

SEQ ID NO: 14702 - DNA, 414 bp, Artificial Sequence
  Description of Artificial Sequence: Synthetic coding sequence
atggatgatctgaggtatggcgtctacccagtaaaaggcgccagcgggtatcctggcgcagagaggaatttgctggaatacagttattttgaaaagggcccgcttacctttagggacgtcgtaattgaattctctcaggaggagtggcagtgcttagacacagctcagcaggacctgtacaggaaggttatgctagagaacttcaggaacctcgtcttcctggggattgacgtgtccaaacccgatttaatcacttgtctggaacagggaaaggatccatggaacatgaaacggcatagtatggtcgcgaccccacctgagtccggcgtgctgaagttccctaccattatcatactgctgagccgctgctttttccagtcagttaatatctgttttatttatctggaaccatag

SEQ ID NO: 14703 - DNA, 354 bp, Artificial Sequence
  Description of Artificial Sequence: Synthetic coding sequence
atggacgacctgagatacggcgtctacccagtcaagggcgccagcgggtatcccggcgctgaaaggaacctcttagaatactcctattttgaaaagggccccttgacattccgggacgtggttattgaattctcacaggaggagtggcagtgcttggataccgcccagcaggatctctataggaaggtgatgctagagaatttcagaaatctcgtgttcctgggaattgatgtctcaaagcctgatctgatcacatgcttggaacagggaaaagatccttggaacatgaagcgacatagcatggtggccactcctcccgacggtgtatcccttttatttcctaggcccgaatag

SEQ ID NO: 14704 - DNA, 582 bp, Artificial Sequence
  Description of Artificial Sequence: Synthetic coding sequence
atggcccaagcttctcttctggcctgtgagggactggcaggcgtttcattggtccctacagctgcgtctaagaaaatgatgttatctcagattgcttctaagcaggccgagaacggagagagagccgggtcacccgacgtgctcagatgttcttcacaaggccatcgtaaggattctgacaaaagccgctcaaggaaggatgacgattctctaagcgaggcatctcactcgaagaagacagttaaaaaggtcgtcgttgttgagcagaatggctcatttcaggtgaagattccaaaaaatttcgtgtgcgagcactgctttggcgctttccggagttcctaccacctgaagcgccacatcctcatccataccggtgagaaaccatttgaatgtgacatctgcgacatgcggttcatccagaagtaccacttagaaagacacaagagggttcattccggcgaaaaaccgtaccagtgcgaacggtgtcatcagtgcttctcccgcactgatagactgcttcgacataagaggatgtgccaggggtgccagagtaagacctctgatgggcaattctctttatag

SEQ ID NO: 14705 - DNA, 2337 bp, Artificial Sequence
  Description of Artificial Sequence: Synthetic coding sequence
atgaatctgactgaggactgcatggtgtttgaggacgtggccatctacttctcacaggaggagtggggaattcttaatgatgcccagcgccacctgcacagcaatgtgatgctggagaacttcgccctgctgtctagtgtgggctgttggcatggggcaaaggacgaagaggtgccttcgaaacaatgcgtgtcagttagagtgctccaggtgacgattcccaaacccgctctttctaccctcaaggctcaaccttgcaaaatgtgcagctcaatactgaaagatatcttacatctagctgaacatgatggaacacaccccgagcagggactgtacacctgcgccgcagaacacgacctgcaccagaaggagcagatcagggagaaactcactcgctccgacgagtggagaccaagtttcgtcaatcattccgcccacgtgggtgagcgaaatttcacatgtacccagggcgggaaggacttcacggccagcagcgatctgttacagcagcaggtgttgaacagcggctggaaactctaccgagacacccaggacggcgaggcattccagggcgagcagaatgacttcaattccagccagggggggaaagacttttgccaccaacacggactgttcgaacatcaaaaaacccacaacggggaaagaccttatgagttctccgaatgcggggaactgttcaggtacaacagtaacttaataaaatatcaacagaaccatgcgggggagcgtccttacgagggcacagaatacgggaaaacatttatccgtaaatcaaacctggtccagcatcaaaagatacactcagaggggttcctctcgaagcgttccgaccctatcgaacatcaagagattctttctaggccaactccctacgagtgcactcaatgcggtaaggcgtttctgacacaggctcatctcgtgggacaccagaaaacgcatactggcgagcaaccctacgaatgcaataaatgcggcaaatttttcatgtacaacagcaagcttatcaggcatcagaaagtccacaccggcgaaaggagatatgaatgctcggagtgtggcaaactgttcatggacagtttcaccctaggtcgtcaccaaagggtgcataccggcgaacggccttttgagtgttctatttgcggtaaatttttcagccaccgctctacactcaacatgcaccagagggtccacgccggcaagcggctgtacaaatgtagcgagtgtggaaaagccttttcactcaagcacaacgtcgtccagcacttgaaaattcatactggggagcgcccttatgaatgtaccgaatgtgaaaaggcgttcgtgagaaaaagccatttggtgcagcaccagaagatccatactgacgcattttcaaaacgatccgacctgatccagcacaaaagaattgacatcagacccaggccgtatacatgctccgaatgtggaaaggctttcctgacccaggcacatttagtgggccatcagaaaatccataccggggagagaccgtacgaatgtactcaatgtgcaaaagctttcgtgcggaagagccatttggtgcaacatgagaaaatccacaccgacgcattcagtaaaaggagcgatctcattcagcacaagagaattgacttgaggcctcggccctacgtttgctcggaatgtggcaaggccttcctgacacaggcacacctggatggacaccagaaaatacaaacaggcgaaagaagatacgagtgcaacgagtgtggaaaattcttcctcgacagttataagctggttattcaccagagaatccacacaggggagaagccatacaagtgtagcaagtgcggcaaattctttagataccgctgcacactgagtcggcatcagaaggttcacactggtgaacggccatacgagtgcagcgaatgtggaaagttcttccgagacagttacaagctgattatccaccaacgagtgcacaccggcgagaaaccctatgagtgctcaaattgcgggaagtttctgaggtaccggtccactttcattaagcatcacaaggtttgtaccggcgagaagccacatgaatgcagcaaatgtcgcgagctttttcgtaccaagtctagtctcataattcaccagcaatcccacacgggtgagagtccattcaagctgagagagtgcggaaaggatttcaacaagtgcaatacggggcagagacaaaaaacgcatacaggtgaaagaagttatgagtgtggtgagagtagcaaggtgtttaagtacaactcctcactgatcaaacaccaaatcatacacactggaaaacgcccctag

SEQ ID NO: 14706 - DNA, 1194 bp, Artificial Sequence
  Description of Artificial Sequence: Synthetic coding sequence
atgatgttccaggaccctgtggcctgcgaagatgtggctgtgaacttcacccaagaagaatgggctctgctggacatttcccaacgaaagctgtatagggaggtgatgttggagacttttagaaatctgacttcaatcgggaagaagtggaaggaccaaaatatcgaatacgaataccagaaccccagacggaattttcgcagtctcatcgagggaaatgtgaacgagattaaagaggatagtcactgtggcgagacttttacccaggtgcccgatgaccggcttaactttcaggaaaaaaaagcgtcccctgaagctaaaagttgtgacaattttgtttgtggagaagtaggaataggaaactcatccttcaacatgaatattcggggagatattgggcacaaagcctacgagtaccaggattacgctcccaagccttataagtgtcaacagccaaaaaaggccttccgctatcacccttcctttagaacccaggagcgtaatcatacaggcgagaaaccctatgcttgcaaggagtgcgggaagacatttatcagccactccgggatccggagacgaatggtgatgcattcgggcgacgggccatacaaatgcaagttctgcggaaaagctgtccattgtctcagactgtatttgatccatgaacgaacacacacgggcgaaaagccatatgaatgtaaacagtgcgtcaagagcttcagctatagcgctactcatcgtatccatgaacgtacccacactggcgaaaagccctatgaatgtcagcagtgcggaaaggccttccactccagcagttcctttcaggcacataagaggactcacacgggtgggaagccctacgaatgcaagcagtgtggcaaatccttttcatggtgtcactccttccaaatccatgaaagaacacataccggcgagaagccttgcgagtgttccaaatgcaacaaagctttcagaagctatcgttcctacctgcgccacaagaggtcccacacaggcgagaaaccatatcagtgtaaagagtgccggaaggcgtttacatatccaagtagcctgcgcaggcacgagcgcacccatagcgctaaaaaaccatacgagtgtaaacagtgcggtaaggcgctctcatataagttcagcaataccccaaagaatgccctgtggcgcaagaccttgtag

SEQ ID NO: 14707 - DNA, 1185 bp, Artificial Sequence
  Description of Artificial Sequence: Synthetic coding sequence
atggaccctgtagcctgcgaagacgttgcagtgaactttactcaggaagagtgggcactgttggacatctcccagcgaaaactctaccgcgaggtcatgctggagacgttcagaaaccttacaagcatcggaaagaagtggaaagatcagaatattgaatatgagtaccagaatccccgccgaaatttccggtcactcattgagggaaacgtcaacgaaatcaaggaggactcccactgcggcgaaacttttacgcaggtgccggacgaccgactaaacttccaggagaaaaaagcttccccagaggcgaaatcctgcgacaacttcgtttgtggggaagtcggcataggcaacagctcttttaacatgaatattcggggagacattggtcataaggcctatgagtatcaggattatgcacccaagccctataagtgccagcaaccaaagaaggcgtttagataccatccttctttccggacccaggaaaggaatcatactggcgaaaaaccctacgcctgcaaagagtgtgggaaaaccttcatcagtcattcaggtatcaggcgccgaatggtgatgcactctggggatggaccttacaaatgcaaattctgtggcaaagccgtacactgcctgaggctgtacttgatacacgaacgcacccataccggcgaaaaaccttacgagtgcaaacaatgcgtgaaaagtttttcctactctgctacccataggattcacgagcggacccacaccggcgagaagccctacgaatgtcaacagtgtggcaaagcgtttcactcatccagcagctttcaggcgcacaagaggacgcacaccggggggaagccatacgagtgtaaacaatgcggaaagtcctttagctggtgtcacagctttcagatacacgagagaacacataccggtgagaaaccctgtgagtgcagtaagtgcaacaaagcttttcgttcctaccggtcatacttacgtcataaaagatcccacaccggggagaaaccctatcagtgtaaggaatgtaggaaagcgtttacttatccatctagcctccgcagacatgaacgcacacactccgccaagaagccctatgagtgcaagcaatgtggcaaagccttaagttataaatttagcaataccccaaaaaatgcattgtggcggaaaactctgtag

SEQ ID NO: 14708 - DNA, 1245 bp, Artificial Sequence
  Description of Artificial Sequence: Synthetic coding sequence
atgccatgctgttcccatcggagttgcagggaggaccccggaaccagtgagtcccgcgagatggatcctgttgcctgtgaggatgtcgctgtaaattttactcaagaggagtgggctctcctggacataagccaacgaaagttatacagagaagtgatgctagagacattcaggaatttgactagtatcggaaaaaagtggaaggaccagaatatagagtacgagtatcagaatccacgtagaaactttcgatcgctgattgaaggtaacgtcaacgagattaaagaagattctcattgcggcgaaaccttcactcaagtgcctgacgataggctgaattttcaggaaaaaaaagcctctccagaggccaaaagctgcgacaacttcgtttgcggcgaggtggggattggcaatagttccttcaacatgaacattcgaggagatataggccacaaagcctacgaatatcaggactacgccccaaagccatacaaatgccagcagcccaagaaggcttttaggtatcacccttcttttcgaacgcaagaaagaaatcacaccggcgagaaaccctacgcttgtaaggagtgcggcaaaacatttattagtcattctggcatacggcgcaggatggtgatgcatagtggggatgggccatacaagtgcaagttttgtgggaaagctgtgcattgccttagactatacttaattcatgagagaactcataccggcgaaaaaccatatgagtgtaaacagtgtgtaaaaagcttttcctattccgccacccatcgtatccacgagcgcacacataccggggagaaaccctacgagtgccaacagtgcgggaaagcatttcatagttcaagttcgtttcaggcccataagcgcacgcacaccggcggcaagccttacgagtgcaagcagtgtggaaagagtttttcgtggtgccacagtttccagattcacgaaaggacccacacaggcgagaagccctgcgaatgtagtaagtgcaacaaggcgttcagatcttacaggtcttatttgcgccacaaacggtctcacactggagagaagccgtatcagtgcaaagagtgtcggaaggcatttacgtacccatcatcactgcgtagacacgagaggacccattccgcaaaaaagccatacgaatgcaagcagtgcggtaaggccctgagctacaagttttccaacacgccgaaaaatgcactgtggagaaaaacactttag

SEQ ID NO: 14709 - DNA, 819 bp, Artificial Sequence
  Description of Artificial Sequence: Synthetic coding sequence
atgaacatcagaggagacatcggacacaaagcatatgagtaccaggactatgcccccaagccttataaatgccagcagcctaaaaaagcctttaggtaccacccttccttccgaacacaagaacggaaccacaccggtgagaagccctacgcatgtaaggagtgcggcaagacttttatctctcatagtggcattaggcgccggatggtcatgcatagtggtgatgggccttataagtgcaaattctgtggcaaagctgtccattgtctcaggctctatcttattcacgagagaacacacactggcgagaagccttatgagtgcaaacaatgtgttaagagtttcagttacagcgccacacatcggattcatgaacggacacataccggagaaaaaccttatgagtgtcagcagtgcggtaaagccttccatagtagctctagtttccaggcccataaaagaactcataccggtgggaagccctacgaatgtaaacagtgtggcaaatctttttcgtggtgtcattccttccagatccatgagaggacccatactggcgaaaaaccatgtgagtgttctaaatgcaacaaagcttttcgatcatacaggagctaccttcgccacaagaggtcgcacacgggggagaagccctatcagtgcaaggagtgccgaaaggctttcacatacccaagctcgctgaggaggcacgagcggacacactctgcaaagaaaccatatgagtgtaagcagtgcggcaaagcacttagctataagtttagcaacacccccaagaacgctctttggaggaaaaccctgtag

SEQ ID NO: 14710 - DNA, 1227 bp, Artificial Sequence
  Description of Artificial Sequence: Synthetic coding sequence
atggctccccctctcgccccgctccctccacgcgaccccaatggcgcaggcccggagtggcgcgagcccggcgccgtctcctttgctgacgtggcggtatatttttgcagagaagaatgggggtgtctgaggccagcgcagcgtgctctatacagagatgttatgcgggaaacctatgggcacttaagcgctctcggtatcggcgggaacaagcctgcactgatttcttgggtggaagaggaagccgaactgtggggcccagcagcccaggacccagaagttgcaaagtgtcagacccagaccgaccccgcagacagtcgtaataaaaaaaaggaaaggcagcgcgagggaactggagccttagagaagcctgatccggtcgcagccggctcccccggactgaagtccccccaagcacccagtgccggacctccatatggatgggagcagctgtctaaggctccccacaggggacggccatctctatgcgcccacccccccgtgcctcgagcagatcaacgacacgggtgctatgtctgcggaaagtcttttgcctggcgctcgactctggtggagcacgtatattctcacaccggtgagaagcccttccattgtacagattgtgggaagggattcgggcacgcatcttcgttaagcaaacaccgcgccattcatcgcggtgagcgcccccatcggtgcctggaatgcggtagggcctttacccagcggtcagcactgacgagccatctccgggtgcatacaggagaaaaaccctacggatgtgccgactgcggtcgtcggtttagccagtctagtgctctctatcaacaccgtcgggttcatagcggcgaaacccccttcccttgtccggattgcgggcgtgcctttgcgtatcctagcgatctccgccgccacgtgagaacccacactggggagaagccgtacccctgtccagattgtggtaggtgtttcaggcaaagtagcgaaatggctgcccataggcggactcactcaggagagaagccctacccttgtcctcagtgtggccgcagattcggccagaagagtgctgtagctaaacaccagtgggtccatcgacctggcgcaggtggccatcgcgggagggtcgcggggcgcctgagcgtaacactgaccccaggacatggggacctggaccctcctgtgggctttcaactgtatccagagatttttcaggagtgtggttag

SEQ ID NO: 14711 - DNA, 1224 bp, Artificial Sequence
  Description of Artificial Sequence: Synthetic coding sequence
atggcgccccctctcgctcccttacctccccgcgatccaaacggggcaggacctgaatggagggagccaggcgctgtctcttttgctgatgtggcagtctacttctgccgcgaagaatggggctgtctcagacctgcccagagggcgctatatagggatgtgatgcgcgagacatatggccacctctccgcacttgggatcggcgggaacaagcctgcgctcatcagttgggtcgaggaagaggcggagctttggggacccgccgcgcaggatccagaggtcgccaaatgtcagacccagactgatcccgactcccgaaacaaaaaaaaagaacgtcagcgggagggcactggggcacttgaaaaacccgatccagtcgcagcaggcagtccaggattgaagtcgccccaagcaccgagtgcaggtccaccatacggatgggagcagctgagcaaagcaccccacagaggtaggccttctttgtgcgcgcatcctcctgtgcctcgggccgatcagcgccacggatgctatgtgtgcggaaaaagctttgcctggagatccacactagtggaacatgtatactctcatacgggcgagaagccattccactgcacagactgcgggaagggatttgggcatgcatcgagcctctccaaacaccgagcaattcatcggggtgagaggcctcaccgatgcttggagtgcggtcgagctttcacacagcggtcagctctcacaagtcatctgagagtgcacaccggagagaagccatacggttgcgccgactgtggccgacgctttagtcagtcttcagccctgtaccaacataggcgggttcacagtggcgagacaccatttccttgtcccgattgtggccgggcctttgcatatccgtctgacctccggcgacacgtgcgcacacacacaggcgaaaagccatacccgtgcccagactgtggtcgctgttttcggcagtcatcagagatggcagcacacaggcggacacattccggcgaaaaaccatacccatgtccacaatgtggcagacggttcggccagaaaagcgcagtggcgaaacaccaatgggtgcatagacctggtgctggaggacataggggcagagtggccggcagactgtcagtgaccctgacccccggccatggcgaccttgacccaccggtgggatttcaactgtatccagaaatcttccaggagtgcggctag

SEQ ID NO: 14712 - DNA, 21 bp, Artificial Sequence
  Description of Artificial Sequence: Synthetic coding sequence
atgatgaaggaattctcttag

SEQ ID NO: 14713 - DNA, 1572 bp, Artificial Sequence
  Description of Artificial Sequence: Synthetic coding sequence
atggccctgcctcaaggtctgctgaccttcagagatgtggctattgagttctcgcaagaggaatggaagtgtttggaccccgctcagcggacgctctatagagacgttatgctagagaactataggaatctcgtgtccctggacatcagctcaaaatgcatgatgaaagagttttctagtactgctcagggaaatagagaggtcttccatgcgggaacgtcacagcgccacgaatctcatcacaatggggacttttgcttccaggatatcgacaaggatatccacgacattgaattccaatggcaggaggacgagcgcaatgggcacgaagccctgatgacgaagattaaaaagctgaccggcagcaccgagaggtacgatcaaaattatgctggaaacaagcccgtaaaatatcagctcggattctcgttccacagccacttacctgagctgcacatctttcacacagaagagaagatcgacaaccaagtggtaaagtccattcacgatgctagcctcgttagtacagcacaacggatctcctgccgtcctgagacccacatttctaacgactacgggaacaatttcctgaacagttccctgttcactcaaaaacaggaggtgcacatgcgagaaaagtctttccagtgtaatgacagcgggaaagcctacaattgcagtagcctcttgcgcaaacatcagctgatccacctgggtgagaagcaatataaatgcgacatttgtggcaaggtgttcaactctaaacgatacgtagcacgacacagaagatgtcacactggggagaaaccatacaaatgtaacgagtgcggaaagacattcagccagacttattatcttacttgtcatcggaggctacacacaggcgagaaaccttacaaatgcgaggagtgtgataaggcatttcactttaagtcaaaattgcaaatccataggcgcatccacactggcgaaaaaccctataaatgcaatgaatgcggcaagaccttctctcaaaaaagctatctaacttgtcaccgcaggctccacaccggagaaaaaccttacaagtgcaatgaatgtgggaaaaccttttctcgcaagtctcacttcacttgtcaccaccgcgtccacaccggcgaaaaaccctacaaatgcaacgagtgcagtaagaccttttcacataaaagctctctgacctaccaccgcagactgcacaccgaagagaagccctacaagtgcaacgagtgtggaaagacttttaaccagcagctgacacttaatatctgtcggctacacagcggcgaaaagccgtacaaatgcgaagaatgcgataaggcgtattcctttaagagcaacctggaaattcatcaaaagattcacactgaggagaacccgtacaagtgtaacgagtgtggcaaaactttctcccggacttcctcccttacctaccaccatcgtctacacacaggtcaaaagccttacaagtgcgaagattgtgacgaagctttctcttttaagtccaacctggagcgacatcgacgcatttataccggagagaagcttcatgtctag

SEQ ID NO: 14714 - DNA, 387 bp, Artificial Sequence
  Description of Artificial Sequence: Synthetic coding sequence
atgatgaaggaatttagttcaacagcacagggcaatagagaagtctttcatgcaggaacaagtcagcgccatgaatcgcaccacaacggtgatttttgctttcaagacatcgataaggacatccacgatatcgagttccaatggcaggaggacgagcggaatggtcacgaggcactgatgacaaaaattaagaagctgactggctctactgagagatacgatcagaactatgctggaaacaagcccgtgaaatatcagttaggcttctcatttcactcccacctccccgagcttcacatattccacacagaggaaaagatagataaccaggtggtcaaatccatccacgatgcctcacttgtgtctacggctcagagaataagctag

SEQ ID NO: 14715 - DNA, 1416 bp, Artificial Sequence
  Description of Artificial Sequence: Synthetic coding sequence
atgctctgcgaaggcgaagcccagaagcgtaaagccgaggagagcggcatgcccctgacccagggccatcttaccttcagggacgtggcaatcgaattcagccaggaagaatggaaatgccttgatcccgtgcaaaaggccctctatagagacgtcatgctggaaaactaccgtaatctggttagcctggggatttgcctgcccgacttatctataatctcaatgatgaaacagagaacagagccttggactgttgagaacgaaatgaaggtcgcaaaaaacccagaccggtgggagggcatcaaggacatcaacaccgggcgttcttgtgctgttaggtccaaagcagggaacaaaccaattactaatcaactggggctgaccttccagctgcctttacccgaacttgaaatcttccagggcgagggcaagatttacgagtgtaaccaggttcaaaagttcatttcacactccagtagcgttagcccgttgcagcgcatatattccggagtcaaaacgcatatcttcaataaacatcgcaatgattttgtcgactttccactgctgtcccaggagcagaaggctcacatacgccgcaagccatacgaatgtaacgagcaggggaaagtctttagggtgtcatcttcactgcctaaccaccaggtgattcatacggccgataagcccaatagatgtcatgagtgtggcaagactgttcgggataaaagtgggttggcagaacactggagaattcgtactggagagaagccatacaagtgtaaggaatgcggcaaattgtttaaccgaattgcatacctggctaggcatgagaaggtccatacaggtgagtccccttataaatgcaacgaatgcggtaaagtgtttagcagaataacctatttggtgcggcaccagaaaatccacaccagggagaagccccacaaatgtaacaagtgtggcaaggtttatagttcgtccagctatcttgctcagcactggagaatccacacaggtgaaaaactgtataagtgtaataaatgcggaaaagaatttagcgggcacagcagtctcaccacacacctgttaattcacactggagagaaaccatataaatgcaaagagtgtgataaagctttccgccacaaattctccctgaccgtgcatcaaagaaatcataacggcgagaaaccttataagtgtcacgagtgtgggaaggtttttacccaggtgagccatctggcaagacaccagaaaattcacaccggagaaaaaccgtataaatgcaatgagtgcggaaaagtgtttacccagaactctcaccttgctaatcaccagagaatccacacaggtgagaagccgtacaagtgccatgtatgcggcctctctctgtggtcgggcaaagaaagcgttaggtag

SEQ ID NO: 14716 - DNA, 1407 bp, Artificial Sequence
  Description of Artificial Sequence: Synthetic coding sequence
atggcccagctgaggaggggccacctgacattcagagacgttgctatcgagttttctcaggaggaatggaagtgcttggatccagttcagaaggcactgtaccgtgatgtgatgctggaaaattacagaaatctggtctccctgggaatatgtcttcccgatctgagtattatctctatgatgaaacagagaacggaaccctggactgttgagaacgagatgaaagtggccaaaaatcccgatagatgggaggggatcaaagatattaacaccgggcgcagttgcgctgtacgatccaaggcgggaaacaagccaatcacaaatcagctgggcctaacctttcagctgcccctccctgagcttgaaatctttcagggcgaaggcaaaatctacgagtgtaaccaggttcagaaattcataagccactctagtagcgtgtcgccactgcagcgtatttactccggcgtgaaaacgcacatttttaacaagcataggaacgatttcgttgattttccattgctctctcaggagcagaaagcacacatccgaagaaaaccatacgaatgcaacgagcaaggcaaggtgttcagagtaagctcatctctgccgaatcatcaagtgattcatactgctgacaaacccaacagatgccatgaatgtggtaagaccgtacgtgataagtccggactggccgaacattggcgcatcaggaccggcgagaaaccttataaatgcaaggagtgcggcaagctgtttaatagaatagcgtacctcgcacgtcatgaaaaagtgcacactggcgaatccccctataagtgcaatgaatgcggaaaggtgtttagtagaatcacctatctggtgaggcatcagaagattcatacccgcgagaaacctcacaagtgcaacaagtgtggcaaagtctattcatcctcatcctatctcgcccaacactggcgcatccacaccggtgagaagctgtataaatgtaataaatgtggaaaagagtttagcggtcattccagcctcactacacacctgctgattcatacaggtgaaaagccttacaaatgtaaggaatgcgataaagcgttcagacacaaattctccttgaccgtgcaccagcggaaccacaacggtgaaaagccttataaatgccacgagtgcgggaaagtgttcactcaagtgtctcacctggctaggcaccaaaagatccacaccggcgagaaaccctacaagtgtaacgaatgcggcaaggtgttcactcagaactctcacctcgctaaccaccaaagaattcacactggcgagaaaccttacaagtgtcacgtgtgcggcaaagtgttcagacactctagctggtttgttcaacaccagcggtcggtgcacgagagagttctcactaactag

SEQ ID NO: 14717 - DNA, 1623 bp, Artificial Sequence
  Description of Artificial Sequence: Synthetic coding sequence
atggaaagggaagctctaccttggggattggaacctcaggatgtgcagagttccgacgaaatgcgctcgccggaggggtatctcaggggcaatatgagtgagaatgaagaggaggagatttcacagcaggaaggctcgggagattacgaagtcgaggagatcccatttggattagaaccgcagagccctgggttcgaaccccagtcacccgagttcgaaccccagtcccctaggttcgaaccggagtctcccggctttgagtcccgcagtcctgggctcgtcccaccctcaccagagtttgccccgagatcacccgaaagcgatagtcagtcacccgaatttgaaagtcaatctccaagatacgaaccccaatctccgggttatgagccccgcagtccaggatacgagccgagaagccccggatacgagagtgagtcatctagatatgaatcgcaaaacacagagcttaaaacccagtccccagagttcgaggcacagtcttccaagttccaggaaggcgcggagatgcttctcaatcctgaagagaagagtcctctcaacatttccgtgggtgtccaccctctggatagttttactcagggatttggggagcagccaactggggacctacccattggtccgccgttcgaaatgcctactggtgccctgctgtccacaccccagttcgagatgctccaaaaccctttggggctgacaggcgccttacgggggcccggcagaagaggagggcgggcacgaggcgggcaaggacccagacctaatatctgcgggatatgcgggaagtctttcggcaggggctccaccttgatccagcatcagcgcatccacactggagagaagccttataaatgcgaggtttgtagtaaggcctttagccagtccagcgatcttatcaagcatcaaagaactcacacaggtgaaagaccatataaatgccctcgttgcggaaaagcgtttgcagactcttcgtatcttctgagacatcaacgcactcattctggacagaaaccatacaagtgccctcactgcggaaaggcatttggggacagcagctacctactccgtcatcagcggacgcacagtcacgagagaccctatagctgtaccgagtgcggtaagtgttactcccagaacagctcacttagaagccatcagcgggttcacaccgggcagcggccattcagctgcggcatatgtggcaagagcttctcccagcgtagcgccttgatcccgcacgcgcgttctcacgcgagagagaagccatttaaatgccctgaatgcggaaaacggtttggacagagtagtgttctggctatccacgcaaggacccatcttccaggccgaacctacagctgccccgactgtgggaagacattcaaccgctccagcacacttatacagcaccagcggtcacatacgggcgaaagaccctatcggtgtgcggtctgcggtaaggggttctgccggtccagcacactgcttcagcaccacagggttcatagcggagaacgcccgtataaatgcgacgactgtgggaaggcattttctcaaagctcagacctgatccgccaccagagaacgcacgcagcaggccgaagatag

SEQ ID NO: 14718 - DNA, 1362 bp, Artificial Sequence
  Description of Artificial Sequence: Synthetic coding sequence
atgtcagagaacgaggaggaagaaatcagccagcaggaaggttctggcgactatgaggtggaagagattcccttcggtctggaacctcagagccccgggtttgaaccgcagtcccccgaattcgagcctcagagtccacgctttgagcccgagtctccgggcttcgagtctcggagccccggcctggtcccccccagccccgaatttgcccccaggagtcctgaaagcgactcgcagtctccggagttcgaaagccagagcccacggtacgagccccaaagtcccggctatgagccaaggtctcccggttatgaaccccggtcacctggctatgagagcgagtccagcagatatgagtctcaaaataccgagctgaaaacccagagtccggaattcgaggcgcagagtagtaagttccaggagggggccgaaatgcttcttaacccggaggagaaatcccccctgaatatctccgtcggagttcaccccttggactcgttcacccagggatttggagagcagcctactggggatctacctattggtcccccgttcgagatgcctaccggggccctgctcagtaccccgcagtttgagatgctgcagaatcccttgggccttaccggggctttgagaggtcccggccgacgaggagggagagctagaggcggacagggtccaaggcccaacatttgtggtatttgtggcaaatcattcggccggggatcgactcttatacaacatcagcggacccactctggccagaaaccttataagtgcccacattgcgggaaagcatttggagactcttcctatctcctgagacaccaaagaacacattcacatgagcggccttactcctgcactgagtgtgggaaatgttactcacagaacagttcactgagaagtcaccagcgcgtgcatacagggcaacgccctttcagctgcgggatctgtgggaaaagtttctctcagcggagcgccctcattcctcacgccagatcccacgctcgcgagaaacccttcaagtgccctgagtgcgggaagagattcggtcagtcctcggtcttagctatacacgccagaacacacctcccggggagaacctacagctgtcctgactgcggcaagactttcaacagatccagtaccctgattcagcatcagagatcccatactggtgaacggccttacagatgtgccgtctgtggcaagggcttctgtagatcctctactctgttacagcaccacagagttcacagcggcgagaggccatacaaatgtgatgattgtggtaaagcgttctcccagtcaagcgatttaattcggcaccaacgcactcatgctgctggacgcaggtag

SEQ ID NO: 14719 - DNA, 2076 bp, Artificial Sequence
  Description of Artificial Sequence: Synthetic coding sequence
atgatggctgaaaataacctgaaaatgttgaaaatacaacagtgtgtggttgcgaacaagttaccacgcaatcggccatacgtctgtaacatttgcttcaagcatttcgaaactcctagcaaactagcccgacactacttgatacacacagggcagaaaccgttcgaatgcgacgtctgtcacaaaacattcaggcagctggtgcacttggaacgccaccaacttactcattcccttccttttaaatgtagcatctgccagcgtcacttcaaaaacctaaagacctttgtcaagcaccaacagcttcacaacgagacttaccagaacaacgtaaaacaagtgcggagactgctggaggccaagcaggaaaagtccatgtacggcgtgtataatacattcaccaccgaagaaaggtgggccctgcatccatgctccaagtccgaccctatgtattcaatgaagcgccgcaagaacatccatgcatgtactatctgcggcaagatgtttccgagccagtctaaactcgatagacacgtcctaatccataccggacagcgaccgttcaagtgtgtgctgtgtaccaagtcgtttaggcagagcacccacttaaagatccaccaactgacccattccgaagaacgtcctttccaatgctgcttctgccagaagggcttcaaaattcagtctaagctgttgaaacacaagcaaatccatacaagaaataaggcattccgtgccttgctattgaaaaaacggagaacagagagcaggccactgcctaataaactcaacgcaaaccaaggcggattcgagaatggcgagattggggagtctgaggagaataacccgctggacgttcattcgatttatattgtcccattccagtgccccaagtgtgagaaatgctttgaaagcgaacagatcctgaatgagcattcctgtttcgctgctcgcagtggcaagattccctcgcggtttaagcggtcctataattacaagaccattgtgaaaaaaattctggccaaactcaagcgcgcacgatccaagaagctggacaatttccaatctgaaaagaaggtatttaagaagtcttttctgcgcaactgcgacctcatcagcggggagcagtcttctgagcaaacccagcgaacgttcgtaggctctttgggtaagcatggtacctacaaaacaatcggaaacagaaagaagaagaccctcaccctgccctttagctggcagaacatgggcaagaatctcaagggtatactgactacagagaacattctctcaattgacaattctgtcaacaaaaaagatctctcaatctgcgggagttccggagaggagtttttcaacaattgtgaagtcctgcaatgtgggttttcagtaccccgggagaacattcgaaccagacacaaaatttgcccgtgtgataagtgtgaaaaagtgtttccaagtatcagcaagttgaaacgacattacctcatacacaccgggcagaggcccttcggctgcaatatctgtggaaagtccttccggcagagcgcacacttgaagagacatgaacagacacacaatgaaaagagcccctacgcatccctttgccaggtggagttcgggaacttcaataatctgagcaatcactctggaaataacgtgaactacaatgcctcccaacagtgtcaggcccccggagttcagaaatatgaggtttctgagtccgaccagatgtcaggtgtgaaagcagaatcacaggattttattcctggcagcaccggccaaccttgcctgcccaacgtgcttctggaatccgagcagtctaaccccttctgttcttattcagaacaccaggagaagaacgacgtgttcttatataggtgcagtgtttgtgccaagtcctttcggagcccttcgaagctggagcggcattatttaattcatgcaggccagaagccctttgagtgctccgtttgcggcaagacgtttagacaagctcctcattggaaaagacaccagctgactcattttaaggagcgtccccagggcaaggtggtcgcactcgatagtgtgatgtag

SEQ ID NO: 14720 - DNA, 399 bp, Artificial Sequence
  Description of Artificial Sequence: Synthetic coding sequence
atgatggcggaaaataatctcaagatgctgaagatacaacagtgtgtggttgcgaacaaacttccacgtaaccggccctacgtctgtaatatatgcttcaagcacttcgagacgccctccaagttagctcgccattacctcattcatacgggtcaaaaaccattcgaatgtgatgtttgccacaaaacatttcgccagctggtgcaccttgaaagacatcagcttacacactctctcccattcaaatgttccatttgccagagacacttcaaaaaccttaagacctttgttaaacaccagcagttgcacaacgaaacctaccagaataacgtgaaacaggtccggaggctgctcgaggccaagcaagaaaaatccatgtacggggtctataatacctag

SEQ ID NO: 14721 - DNA, 954 bp, Artificial Sequence
  Description of Artificial Sequence: Synthetic coding sequence
atgcccggagagcagcaagcagaggaagaggaagaggaggagatgcaagaagaaatggtgctgcttgtgaagggggaagaggacgaaggtgaggagaagtacgaggtcgtcaagttgaagattcctatggacaacaaggaggtgcctggggaagcccccgccccctctgccgatcctgctcggccacatgcatgccctgactgcggaagagcgttcgccagacgcagtacgctggccaagcatgcccgaactcatacaggagagcggcctttcggttgcacagaatgtggccgccgctttagccagaaatccgccctgacaaaacatgggcggactcacactggtgaaagaccctacgagtgtccagaatgcgacaaaaggttttcggcagcttcgaatctgcggcagcatcgacgacgccatacaggtgagaagccctatgcctgcgctcactgtggcagaagattcgctcagtcttctaactacgcacagcaccttcgagtccacactggcgagaagccgtacgcatgccccgactgcggcagggctttcggggggagtagttgtctggcccggcacagaagaacacacaccggcgaaagaccttatgcatgtgcagactgcgggacccgcttcgctcagagctcagctttagctaaacacaggcgcgttcatactggcgaaaaaccccacagatgtgccgtgtgcgggcgccgtttcggacacagaagtaacctggcagaacatgcgcggacgcacacgggagagaggccatatccttgtgctgaatgcggcaggcgtttccgcttgtcttcccatttcatccgccatcggcgggcccacatgcgccgtcggctttacatctgcgccggctgcggtagagatttcaagctgccacccggggcaaccgcagctaccgccactgagagatgccccgaatgcgaaggttcctag

SEQ ID NO: 14722 - DNA, 954 bp, Artificial Sequence
  Description of Artificial Sequence: Synthetic coding sequence
atgcccggtgaacagcaggccgaggaggaggaggaagaggagatgcaggaagagatggtgcttctcgtgaagggggaagaggatgaaggcgaggagaagtacgaagtggtgaagctgaagattccaatggacaacaaagaggtgccaggggaagcacctgctcccagtgccgatcctgctcgaccgcatgcgtgccctgactgcgggcgcgccttcgcgcggcgttctaccttagccaaacatgcaaggacacatacaggtgagaggccatttggatgtaccgaatgtggccgcagatttagccagaaatctgcactcactaagcatgggaggacccatacaggagagcggccttacgagtgcccagaatgtgataagcgtttctctgctgcgagcaacctgcgacagcatcgcaggcgccacacaggggagaagccttacgcgtgtgcccactgtggccgccggttcgctcaatcgtcaaactacgcccagcatctgagggtgcatactggggagaaaccgtacgcttgtcctgactgtgggcgtgcattcggcggtagttcgtgtctggccagacacaggcgtacacatactggcgagcggccttacgcctgtgcagactgtggtacgcgctttgcccagagttccgctcttgcaaagcatagacgtgttcataccggtgaaaagccgcatcggtgcgctgtgtgtggccgaagattcgggcatcggtcgaacctggctgagcatgctaggacacacactggcgaacggccatatccatgtgccgagtgcggtaggcgcttccggctgtcttcacacttcattcgacatagaagggcccatatgaggaggagactttacatctgcgctggctgtgggagagattttaaattgcctcccggcgctacggccgcaacggccactgagcgttgtcccgaatgcgaggggtcgtag

SEQ ID NO: 14723 - DNA, 1245 bp, Artificial Sequence
  Description of Artificial Sequence: Synthetic coding sequence
atgaattccgaagtcatagttgatcccatccagggccaagtgaactttgaggatgtctttgtatatttttcccaagaggagtgggtcctgctagacgaggcccaaaggctgctctatagggacgtcatgcttgagaactttgctctgatggccagcttagggcatacctcctttatgagccatattgtcgccagcttggtgatgggctccgagccttgggttcccgactgggtggacatgactctggcagtggccactggctgctggcatggcatggaggacgaggagataccgttcgagcagagcttctctatcggtatcttctccgcaaatctccatcagcaccagaagcaacattccggcgaaaagccctttcgatccgacaagagtcgcccatttttactgaacaattgtgcagtgcagtccatggaaatgtcgttcgtaacaggcgaggcatgcaaggattttcttgcgtcatcctccatattcgagcatcatgctcctcataatgaatggaagccccacagcaacaccaaatgtgaggaggccagccactgtggtaaacggcactacaagtgtagcgagtgcggcaaaaccttctccagaaaggactccttagtgcaacaccaacgcgtacatacgggcgaacgaccctacgagtgtggcgagtgtggcaaaaccttcagtaggaagcccatccttgcccaacaccagagaattcacaccggcgaaatgccctacgagtgtggaatctgcggaaaagtgttcaaccactcaagcaacctcattgtgcatcaacgcgtgcatacgggggccaggccttacaaatgctccgagtgcggcaaggcttattcacacaagagtacgctagttcagcacgagtcaatacacaccggagaacgcccatatgaatgcagcgagtgtggaaaatatttcggccataaataccgtttaattaagcattggtccgtgcatacaggtgcacgcccgtacgagtgcatagcctgcggcaagttcttttcgcagtcctcagacctcattgcacatcagcgcgtacataacggtgagaagccttacgtgtgttccgaatgtggaaaagctttctcacacaagcatgtccttgtgcaacaccatagaatacacaccggggaacgaccctacaaatgttcagagtgcggcaaagccttccgccagcgagcatccttgatccggcactggaaaatacatacaggagaacggccctag

SEQ ID NO: 14724 - DNA, 735 bp, Artificial Sequence
  Description of Artificial Sequence: Synthetic coding sequence
atggcggccgcggaaccaatggggccggcacaaggacaggtgaactttgaagatgttttcgtctactttagccaggaggagtgggtacttttagacgaggctcagagattgctataccgtgatgttatgctggagaattttgctcttatggcctcgcttgggtgttggcacggaatggaagacgaggagattcctttcgaacagtcattctccatcgggatgtcccagattcgtattccaaaaggaggaccatcaactcagaaagcgtacccctgcggcacatgcggcttggtgctgaaggatatattacacttggcagaacatcaggagacacatcctggacagaagccctatatgtgcgtcctgtgcgggaagcaattttgcttcagcgcaaatttgcatcagcaccagaagcagcactcaggcgagaagcctttccggtccgataaatctagaccatttttgctgaataactgcgcggttcagagcatggagatgtccttcgtgacaggggaagcctgtaaggacttcctggccagtagttccatttttgaacatcatgcaccgcataacgagtggaagcctcacagcaataccaaatgtgaagaagctagccactgcgggaaaagacactataagtgctccgagtgcgagaaaacggctgccaattatcgtgagtatgatcccagcaaaggaacttctacttgcgtttccattactctggcaccgttatag

SEQ ID NO: 14725 - DNA, 1470 bp, Artificial Sequence
  Description of Artificial Sequence: Synthetic coding sequence
atggcggccgccgagccaatgggacccgcgcaagtgccgatgaacagcgaggttatagtcgaccctatacagggccaagtgaactttgaggacgtgtttgtatacttctctcaggaggaatgggtgctgctggacgaagcccagcggctcctctacagggacgttatgttagagaatttcgccttgatggcaagcttgggacacacctctttcatgagtcacatcgtcgccagccttgtcatgggtagcgaaccatgggtgcctgactgggtagacatgacactcgcggttgctactgagacgccaggtggttccgatcctggctgttggcacggtatggaggacgaggagatccccttcgagcagtctttttccataggtatgtcacagatcagaatccccaaagggggtcccagtacacagaaggcctatccctgtggcacttgcggcctcgttctaaaggatatactacatctcgccgagcatcaggagacccacccaggacaaaagccgtatatgtgcgtgctttgcgggaagcagttctgcttctcagccaatctgcatcagcaccagaagcagcatagtggggagaaaccatttcgctccgacaaatccagacccttccttcttaataactgcgcagtccaaagtatggagatgagttttgtcactggggaggcgtgtaaagatttcctcgcgagctctagtatcttcgaacatcatgccccccacaatgagtggaagcctcacagtaacactaaatgtgaggaagcctctcactgtggcaaacgccactacaagtgctctgagtgcggcaaaactttcagtcgcaaagattctttagtacagcaccagcgggtgcacactggtgagcgtccatacgaatgcggagagtgtgggaagacctttagtcgcaagccaatcctggcccaacaccaacgaattcataccggcgaaatgccttacgaatgcggaatctgcgggaaggtgtttaaccactccagcaacttgattgtgcatcaaagagtgcacactggggctcgcccgtataagtgttccgagtgcgggaaggcctatagccacaaaagcactctcgtgcagcatgagtctatccatacaggtgagcggccttatgagtgttctgaatgcggaaaatactttgggcataagtacagactgatcaaacactggagcgtacatactggcgcccggccttacgagtgcattgcctgtgggaaattcttcagccagtccagtgatctgattgcgcaccagagagtgcacaatggcgaaaagccctacgtctgttcggaatgcggcaaggcattcagtcacaagcatgtgctggtccagcatcataggattcatacaggtgagcggccctacaaatgctctgaatgcggcaaggccttccggcagagggcatcgctgataagacattggaaaattcacaccggggagaggccttag

SEQ ID NO: 14726 - DNA, 1347 bp, Artificial Sequence
  Description of Artificial Sequence: Synthetic coding sequence
atggcagccgccgaacctatgggccctgcacaggtgcccatgaatagtgaagtcatcgtggatcccatccagggccaggtgaacttcgaagatgtatttgtgtacttcagccaggaggaatgggtcctgctggacgaggcccagcgtctcctgtacagagatgttatgctggaaaacttcgctttgatggcctctctcggatgctggcatgggatggaagacgaggaaattcccttcgaacagtctttttcaatcggaatgtcccaaatcagaattcccaaaggcgggcccagcactcagaaggcttacccctgtgggacatgtggactggtgctgaaggatattctgcacctggcagaacaccaggagacacatcccggccagaaaccttacatgtgcgtgctgtgtgggaagcagttttgctttagcgccaacttacaccagcatcagaaacaacactctggagaaaagcccttccggtcggacaagagccgaccattccttctgaacaattgcgccgttcagtccatggagatgtccttcgtgaccggagaggcctgcaaggatttcttggcatctagctctatcttcgagcaccatgcgccacacaatgagtggaagccccattcaaacaccaagtgcgaggaagccagtcactgcggtaaacgacattataaatgtagcgaatgcgggaagaccttcagtcggaaggacagcctggtccagcatcagcgggtgcatacgggggagaggccgtacgaatgtggagagtgcggtaaaacattttcacgaaaacccattctggctcagcaccaaaggattcatactggtgagatgccgtatgaatgcggcatttgtggaaaggtctttaatcatagttccaacctaattgtccatcagagggtccataccggcgcgcgcccctacaaatgcagcgaatgcggtaaagcctatagtcacaagagcacactggtccaacatgaaagcattcatacaggggagcgcccctatgaatgtagcgaatgtggcaagtactttgggcataaatacaggctaattaagcattggtccgtgcataccggcgcgaggccctatgaatgcatcgcctgcggaaagttcttcagccaaagttctgatctcatcgcccaccagcgggttcacaacggcgagaaaccgtatgtctgtagcgagtgcggcaaggcttttagtcacaaacatgttcttgttcagcaccaccggatccatacaggagagcggccctataaatgttctgagtgtggcaaagcctttagacagagggcctcactgattcggcactggaagattcataccggcgagcgcccttag

SEQ ID NO: 14727 - DNA, 1134 bp, Artificial Sequence
  Description of Artificial Sequence: Synthetic coding sequence
atggaagacgaagaaatcccttttgaacagtccttttctattggcatgtctcagattagaatccctaagggtggtcctagcactcaaaaagcttacccctgtgggacgtgcggactggtcctgaaagacatactgcacttagcagaacaccaggagacccatcccggacaaaaaccttatatgtgcgtcttgtgcgggaaacaattctgttttagcgctaacctgcaccagcaccagaagcagcatagcggcgaaaagccttttagatccgataagagtcggccctttctactcaacaactgtgctgtgcaaagtatggagatgagcttcgtgaccggcgaagcatgcaaagattttctggcgagctcatctatttttgaacaccatgccccacataatgaatggaaacctcactctaacacaaagtgcgaagaagcttcgcattgtggtaaacggcattataagtgttcagagtgtgggaaaaccttctctcggaaggactccttagtccagcaccagcgtgtgcacactggcgagagaccgtatgagtgcggggagtgcggcaaaaccttctccaggaaaccgatcttggctcagcatcagagaatccatacaggcgagatgccttacgaatgtggcatatgcggaaaggtgttcaatcatagctccaaccttattgtgcaccagagggttcacactggagcccgcccctataaatgttcagagtgtgggaaggcctactcccacaagtctacactggtgcagcatgaatccatccatacaggagagagaccatacgagtgttctgagtgtgggaagtattttgggcacaaatatcgtttgatcaagcactggtctgtgcacacgggtgctcggccgtacgaatgtatagcctgtggcaaatttttcagtcagtcgagcgacttaatagctcaccagcgagtgcataacggagaaaaaccctacgtctgttctgagtgcgggaaggcgtttagccacaaacacgtcctagttcaacaccatcgtattcataccggggagcgtccctacaagtgtagtgaatgcggtaaggctttccgccagagagcatcactgatcagacactggaagatacacactggggaaagaccctag

SEQ ID NO: 14728 - DNA, 1329 bp, Artificial Sequence
  Description of Artificial Sequence: Synthetic coding sequence
atggcagcggccacactacgggaccctgcacaacaggggtatgtgactttcgaagatgtggcagtgtatttctctcaggaagagtggaggctgctggatgatgcccagcgactgctttaccggaatgtcatgctcgagaactttactctattggcctctctcggcctggcaagttcaaaaactcacgagattacccagctcgagtcatgggaggaaccattcatgccggcttgggaagtggtcactagtgcgattctacgcggatcttggcagggggctaaagccgaagccgcggccgaacagtccgctagtgtggaagtcccctcctctaatgttcaacagcatcagaagcaacactgtggcgagaagcctctgaagcgacaggaaggtcgcgtaccggttctgcgatcctgtagagtccatctgtccgagaagtcactgcagtccagggaggtcggcaaggacttgctgacctctagcggggtcctgaagcaccaagtcacacatactggcgaaaagagccaccggagcagtaagtcaagggaagcatttcacgccggtaaacgacattacaagtgttcagagtgcggaaaagccttcggacagaagtacctgctggtgcagcaccagcggctccacacaggagagaagccatatgaatgctcagaatgtgggaagctcttttcccataaaagcaacctattcatccatcagatagtgcacaccggagagcggccctacggctgctcagattgcggcaaatctttttcgaggaatgcggacttgattcagcatcagagggtccatactggggagaagccgttcacatgcagcgaatgcggaaaagcctttcgacataactcaaccctggtccagcatcacagaatccacaccggagtgaggccatacgagtgctccgagtgcggcaagctgttttcctttaattcgagccttatgaaacaccagagagttcatactggtgagcgaccctataagtgcagcgagtgtggaaaattctacagccacaagtccagtctcattaatcattggagggtccacactggggagcgcccttatgagtgctcagagtgcgggaagttcttctctcagagttcttcccttatgcagcaccggaaggttcatacaggagagaagccgttcaagtgcaacgaatgcggccgtttctttagcgaaaacagcagtctggtgaagcatcagagagtacacactggagccaagccatacgaatgtcgggagtgcggtaagtttttccggcatagctcttcactagtgaaacataggcgaattcacacgggtgagatacaatag

SEQ ID NO: 14729 - DNA, 423 bp, Artificial Sequence
  Description of Artificial Sequence: Synthetic coding sequence
ggctccgtggccgcacctcgggtggcccgggcattgagctctgtggtggtgagtccaccccaagccccaatggcggccgctactctcagggacccggcgcagcagggttacgtgacctttgaagatgtggccgtctatttcagccaagaggagtggcgcctccttgacgacgcacaaaggctcctatataggaacgtgatgctggaaaatttcaccctgctggcttcactaggattggcatcatctaagacccacgagatcacacaactggaaagttgggaggagccttttatgcccgcgtgggaagtcgtgactagcgctattctccgagtgtggcttcgaaacaggtctgcaaatctgctcacacagattttcttccccaatcgacaaccacaagtggctcccgagcagggccgagaatag

SEQ ID NO: 14730 - DNA, 1452 bp, Artificial Sequence
  Description of Artificial Sequence: Synthetic coding sequence
atgtggcttgggaccagcggcaagtcaggactgcccggccactgtctggaaaatcccttacaggagtgccatcccgctcaactagaagagtgggcgctgaagggtatctcacggccttccgtcattagccagcctgagcaaaaagaggaaccttgggttctgcctttacagaattttgaagcacgaaaaattccgcgggagtcccataccgattgtgaacaccaggttgcaaaactgaatcaggataattccgagactgccgaacagtgtggaacatcttcagaacgtactaacaaggacctttcccataccttatcttggggagggaactgggagcaagggctcgaactggagggtcagcatgggaccttgccaggagaggggcagctcgaaagcttctctcaggaaagagatctcaataagctgttggatgggtacgtgggcgagaagccgatgtgtgccgagtgcggaaaatccttcaaccagagctcatatttgattcggcacctgaggactcataccggcgagcggccttacacctgtatcgaatgtggtaaggggtttaaacaaagctccgacctggtgactcatagacgcacccatacaggtgagaagccctaccagtgcaaaggctgtgagaagaagtttagtgatagtagtacactcattaagcaccaacgtacccacaccggagaacggccgtatgagtgtcccgaatgtggcaaaaccttcggtcggaagccacacttgattatgcatcagcggacccacacgggagaaaagccatacgcctgtctggagtgccacaaatccttctctcgcagttctaactttattacccaccaaaggacacatacaggagtgaaaccgtatcgctgcaatgactgcggagagtctttttcacagagctccgacctgattaagcaccagcgcacccataccggggaaaggccttttaaatgtcctgagtgtggcaagggattccgtgactccagtcacttcgtggcccatatgagcacacatagtggagaaagacccttctcctgccctgattgccacaagtccttcagccagagttcacaccttgtaacacatcaaaggacacacacaggagagcgcccctttaaatgcgaaaattgcggaaaaggcttcgctgatagcagcgcgctgatcaaacaccagcgaattcacacgggtgaacgaccatacaagtgtggagaatgcggaaagagttttaatcagtctagtcattttattactcatcagagaatccacctgggcgaccggccgtatcggtgccccgaatgcggcaagaccttcaatcagcggtcccactttttaacccaccagcgcacacacaccggagagaagcccttccactgttccaagtgcaataagtccttccgccagaaggcacatctgctatgccatcaaaatacccatctgatttag

SEQ ID NO: 14731 - DNA, 240 bp, Artificial Sequence
  Description of Artificial Sequence: Synthetic coding sequence
atgtggttaggcactagcggcaagtccggtctgcccggccattgcctagagaatccgcttcaggaatgtcaccccgctcaactcgaggagtgggctctgaaaggtatcagtcgtccttccgtaatcagccagccagagcagaaggaagagccgtgggtgcttccattgcagaacttcgaagctagaaaaattcctagggagtctcacacggattgcgagcaccaggttgctaaactctag

SEQ ID NO: 14732 - DNA, 1614 bp, Artificial Sequence
  Description of Artificial Sequence: Synthetic coding sequence
atggaaagcggacttgccgggaatgggaccggagccggcctggtgatgaaagttaaacaagagaagcccgagcgcttgctgcagactctcgccccccaggccatgcttgtcgaaaaagacaaggaaaacatattccagcagcatagagggctgcctccacgacagacaatgggacgtcctcgagccctcggagggcaagaagagagcggctccccccggtgggcccctccaactgagcaggacgccggcctagctggtagggcgccaggcagcgcctccggccctttatctccctccctttccagtggcgaggggcattttgtctgtctggattgcggaaaacgcttcagttggtggagctcactcaagatccaccagcggactcatactggcgaaaagccctatctgtgcggtaaatgcggcaaatcatttagtcaaaaaccaaacctagcacgacaccagcgtcatcacacgggtgagaggcctttctgttgccctgagtgtgccaggaggttctctcagaaacagcatctactaaaacatcagaagacccacagccggccagccacccatagctgtcccgagtgtgagagatgtttcagacaccaggtgggcctgcgcatccaccagcgggcacacgcgagggatcgtcagggttctagagctggcctgcacgaacttattcaggacgccgccgctcggcgtgcctgtcgcctgcagcctgggcccccccggggcaggcccgaatgggcctggcttggactctgtcagggctggtggggtcagcccggggctcgcgcagccgtgtccggcccagaaggccctggcgagccccggcagttcatttgtaacgaatgtggaaaatcattcacctggtggagctctctcaatatccaccagcgcatccacaccggcgaacggccttatgcctgccccgaatgcgggagacgtttcagtcagaagcccaatctgactcggcacctcaggaatcatactggtgagcggccccacccatgcccgcactgtggacgcggattccggcaaaagcagcatctgttgaaacacctccgcacccaccttccaggagctcaagctgccccatgtcctagctgcggaaaaagctgtaggagtcgggcagctctcagggcccatcagcgggcccatgccgtggctgagccagccgttccagccggagagcctggcgaccagccacaggcagaggccattcctggactggctgcacggcctagaagcagccagagatcccctggggctagggatacgctctggggccgggggcaggccgggcttgctgggcctggtgagccaaggcagttcatatgcaacgagtgtggtaagtcattcagttggtggtctgctttgaccatacatcaaagaatccacactggtgagaggccttacccttgccctgagtgtgggcgccgcttcagccagaagcctaacctcacaaggcaccgccggaaccacactggcgaaagaccttacttgtgcccagcgtgtggaaggggattcagtcagaaacagcacctgctcaagcatcagcgcgtgcaccgcgcagcacccgcgtgctcacccaaagaagaagctagatag

SEQ ID NO: 14733 - DNA, 435 bp, Artificial Sequence
  Description of Artificial Sequence: Synthetic coding sequence
atggagtctggtttggcagggaacggaacaggggcaggccttgtgatgaaagtgaaacaggaaaagcccgagagactgctgcagacccttgccccgcaggcgatgcttgtggagaaagataaggagaacatctttcagcaacaccggggcctgcccccccggcagacaatgggcagaccccgggccttggggggacaggaagaaagcggcagccccaggtgggcaccccctaccgaacaggatgccgggctcgctggaagggctccagggtcggccagcggccccctttccccatccctcagtagtggcgaaggccatttcgtgtgcttagactgtggcaaaaggtttagctggtggtccagcctaaagattcatcagcggacacacactggggagaaaccttatctatgcggaaagtgtggaaaaagtttttag

SEQ ID NO: 14734 - DNA, 501 bp, Artificial Sequence
  Description of Artificial Sequence: Synthetic coding sequence
atggagagcggcctggccgggaatggcaccggagcaggtctagtaatgaaggtgaaacaggagaaacccgagagattactccaaaccttagcaccacaagctatgctagtcgaaaaagataaggagaacatattccagcagcaccgtgggctcccacccaggcagaccatgggcagacctcgggcactcggcggacaagaggaatcagggagcccccgttgggccccaccaacagagcaggacgctggccttgccgggcgggccccaggctcagcatccggcccactctcacccagtttgtctagtggagagggccattttgtctgcttagactgtggtaaacgcttctcatggtggtcatcattaaagattcaccaaagaacccatactggagagaaaccttatctctgtggaaagtgtggaaaatcttttagccagaaacccaatctggcacggcaccagcgccaccacacaggggaacgccccttctgttgcccttag

SEQ ID NO: 14735 - DNA, 1557 bp, Artificial Sequence
  Description of Artificial Sequence: Synthetic coding sequence
atggccgcggccgccttacggccacccgcccagggcacggttacattcgaggatgttgccgtgaactttagtcaagaagagtggagcctactgagtgaggctcaaagatgcctgtatcatgacgtcatgttggagaacttgactcttatcagctccctggggtgctggtatggtgcaaaggacgaaactccatcgaaacagacactgtccatccagcaggagtctcctctcaggactcactggactggagtttgcaccaaaaaggtgcatctgtggggcatgtgtggacctctcctgggggatattctgcatcagggcacccagcataaccagaagctgaatggctttggtgcctatgagaagaaactggacgacgacgcaaaccaccaccaagaccagaaacagcatatcggagaaaagagctatcgtagcaacgccaaaggtacttcgtttgttaagaattgcaaattccatatgagccacgaacccttcattttccatgaggtgggcaaagattttttgagttccctaagactgctgcagcaggaggacatacacacttctggaaagagtaacttcgaaacaaagcatggaatcccccttcagggggggaaaacacactatatctgcggtgaaagtacaataccctttagcaataaacattctctcgtccttcaccagaggctgctcccgagggaagggccttacgtctgctctgactctggaaagtttacgagcaaaagtaacagttttaataaccaccagggagttcgcaccggtaagcggccttaccagtgcgggcaatgcgatgaatccttttggtacaaagctcatcttaccgagcatcagcgcgtccacaccggagagcgcccttacgaatgcggagaatgcgacaagagcttttcacacaagcactcactggtggaccaccagagagtgcatacaggtgaaagaccatatgaatgcgatgagtgcggaaaatcgttctcgcataagcggagtctggtacaccatcagcgcgtgcacaccggcgagcgcccttaccagtgtggggagtgtggcaaatccttcaaccacaaatgcaatctgatacagcaccagcgggtacatacaggggagcgacccttcgagtgtaccgcttgcggtaagctgtttcgatccaacagtcatctgaaggaacaccagagagttcataccggcgagcgtccatatgagtgcaaggaatgtcggaagtctttcaggtacaagtcccacctgactgagcatcagagggtccacacgggcgaaagaccttatgaatgtagggaatgcggaaagtgttttcaccagaagggtagtctgattcaacatcagcaaatccattcaggtgagaggccgcacgagtgcggagagtgcggtaaatgcttccaccagaaagggagtctgatcaggcaccagcagattcattctggcgaacgaccccatgaatgtggggagtgtgggaagtgttttcgccagaaggggaacctgatcaagcaccagagggtccacacaggcgagcgacatcatgagtgctag

SEQ ID NO: 14736 - DNA, 2064 bp, Artificial Sequence
  Description of Artificial Sequence: Synthetic coding sequence
atgctcgagaattacgagaacctggcaagcgtgggccaccacctctttcagccttccgtgatttactggcttgagcaagaagaagagctgagagcaggccggcgagccgttctgcaagagtggaggctgaaaaccaagggccccgctctcagacaggataggtcatggtttcgggcatccaacgaaacacaaacagctaggtctcacaatgggggacagctgtgtgatcgtacgcagtgcggtgaagccttcagcgagcatagtggtttatccacacatgttcggacccagaatactggcgatagttgtgtctctaaccactacgaaagagacttttttatcccttgccagaaaaccctttttaaaatcggcgagcaattctccgtgctggggcagtgcgggaaggcctttagcagtacacctaatgtagtttcgcaacaggcctgcacacgggatcgaagtttggattactcatcttgcggtgaggttttccttaatcagtcttacctgcaggccagagcaggctcccacaacggagaggagacatggaagtggaagccttgtggaaaggccctcacacattccatgggttgcgctactccggttgagatgcatgctgtgagaaatccccacgtctgcagggagtgcggcaaggcctttagatatacagcttaccttaccggaagagttcaggtacatccaggcgagaagccatgcgagctggaagaatgtggcaaagcttctcctgtctccagttctctcactcagcacgtgcgaatccatgcagccgagaagccatgcgaatgtaaagaatgtgggaaagcattcaccggattaagcggactgtcaaagcacgtgcagactgatccaggccagaagccctatgagtgcaaggactgtggaaaggcttgtggtggcttttatctgctgaacgagcacggcaagacccacactagagagaaacccttcgcttgcgtagtttgcggtaaatatttccgtaattcctcctgtttgaacaaccacgtgaggattcatactgggattaagccgtacacttgtagctactgtgggaaggcttttacggtccgttgcggactcacgcggcatgtgcgaactcacaccggggaaaagccgtacacatgcaaggactgtggcaaggccttctgtaccagcagtggactgacagagcatgttagaactcacacgggtgagaagccctacgaatgtaaagattgtggaaagtcattcactgtttcctcctccctgacggaacacgcacgaattcacacgggcgaaaagccatacgaatgcaaacagtgcggcaaggcttttacgggacgctcgggactcacaaagcacatgcgtacccatacaggcgagaaaccctatgagtgcaaagattgcggaaaggcatacaaccgggtgtatctgctcaatgagcacgtgaaaacacacaccgaagaaaaacccttcatctgcaccgtgtgccgaaagagttttcgcaactcgagttgccttaacaagcacatccagattcatactggcatcaagccctacgagtgcaaggactgtggcaaaacttttactgtctcatcatccctcaccgagcatattcgtacgcacactggcgaaaagccttacgaatgtaaagtgtgcgggaaggcctttactacaagtagccacttgatcgtgcacatacggacccatacaggtgaaaaaccttacatctgcaaagagtgtggaaaggccttcgcctcatccagtcatctgatcgagcacagacgcacccatactggtgagaagccttatatatgtaacgagtgtggcaaggccttccgggccagttcccacctacacaaacatggacgaatccacacaggccagaagccatacaaatgtaaggagtgtggcaaagcatataaccggttttatctgctcaaggaacatctgaaaacctataccgaggagcaagtattcgtgtgtaaggactgtggaaagtcattcaagaactcctcatgtctcaaccaccacactcagatccacaccgacgagaaacctttttag

SEQ ID NO: 14737 - DNA, 2190 bp, Artificial Sequence
  Description of Artificial Sequence: Synthetic coding sequence
atggccgccccagacctggcccacgggggccatgtgtcccgggactccgtttgcctgcacgaagaacaaacccaggccgcaggaatggtagcgggctggcttatcaactgctaccaggacgctgttaccttcgacgacgttgctgttgatttcacgcaggaggaatggacgctgttggatccgagccaacgggacctctatagggacgtgatgctggaaaactacgaaaaccttgcctccgtggaatggaggcttaagaccaagggacctgcattgcgacaggacagatcatggttccgcgcaagtaatgaaacgcagaccgctcgaagccataatgggggtcagctgtgcgatcgtacacagtgtggtgaggctttttcagagcattccgggctaagtactcatgtgagaacccagaatactggggacagctgtgtgagcaaccattatgagagagacttttttataccctgccagaagactctcttcaagattggagaacagttcagtgttctgggccaatgcggaaaggccttttcctctacgccaaacgtcgtgtcacaacaagcctgcacccgggatcgaagtctcgattacagcagctgtggcgaggttttccttaatcagagctacttacaggcaagagctgggtcacataacggcgaagaaacatggaagtggaaaccctgcggcaaagcgctgacccactcaatgggctgtgcaacccctgttgaaatgcatgctgtacgtaacccccacgtgtgccgggaatgcggtaaggccttccgatacaccgcctatctcaccgggagagtccaagtccaccccggagagaagccctgtgagctagaggaatgcgggaaagcatctcccgtatcaagctctctcacccaacatgtgaggattcatgctgcagagaagccctgtgaatgtaaggaatgcggcaaggcgttcaccggcctgagtggactgtctaagcacgtgcagactgaccccggccagaaaccatacgaatgtaaagactgtggcaaggcatgtggtggtttctacctgctgaatgaacacggcaaaacccatactagagaaaaacctttcgcatgcgtggtgtgcgggaagtattttcggaacagctcttgtctcaacaaccacgtacgtatccacacaggaatcaaaccttatacctgctcctactgtggcaaggcgttcacagtgagatgtgggctgactcgacatgtgcgcacccacactggagagaaaccctatacatgtaaggattgcgggaaagccttttgtacgtccagtggcctgactgaacatgtgaggactcatacaggagagaagccatatgagtgcaaagattgcggaaaatcctttaccgtgagtagtagcctgactgagcacgcccgcatccacaccggcgaaaagccctatgaatgcaagcagtgcggcaaagccttcaccgggagatctggcctgactaagcatatgaggacccacaccggggagaagccatacgagtgcaaagattgtggaaaagcttacaaccgggtgtacctcctgaacgaacacgtcaagacacacaccgaagagaaacccttcatttgcacagtatgccgcaagtcatttcgtaacagcagttgcctgaataaacatattcagatccacacagggattaagccttacgagtgcaaggattgcggcaagacgtttaccgtgtcctcctctctgacagaacacatacgcactcacacaggagaaaaaccatacgagtgcaaggtgtgcggcaaggcctttacaacctcctcgcacctgattgtccacatcagaacacacactggcgagaagccatacatttgcaaggaatgtggtaaagcttttgcaagctcttctcacctgatcgagcatcggcggacacacaccggtgagaaaccttatatctgcaacgagtgcggcaaggcatttagagcgtcgtcacaccttcataagcatggccgcatccatacaggccagaagccatacaagtgtaaagagtgcggaaaggcatacaaccgtttttatttgctgaaggagcacctgaagacttatactgaggagcaggtgttcgtgtgcaaggactgcggcaagagctttaagaactcatcatgtctcaaccatcacacgcagatccacaccgatgaaaagcctttctag

SEQ ID NO: 14738 - DNA, 1926 bp, Artificial Sequence
  Description of Artificial Sequence: Synthetic coding sequence
atggttcacggaagtgtgacttttcgcgatgtcgcgattgacttcagccaggaggagtgggagtgcctgcagcccgaccaaaggactctctatcgggatgtgatgttggaaaattattcccatctgatatctctcgggagcagcattagcaaacctgatgttataacactcctggaacaggaaaaggagccttggatggtagtgaggaaggaaacgtccaggagatatcctgatctcgaactgaaatacggcccggagaaggtatcccccgagaatgacacctccgaggttaacctgccaaaacaggttattaaacaaattagcaccaccctaggcatagaagcgttttactttcgcaatgattctgagtatcgacagtttgaaggcctgcaggggtatcaggagggtaacatcaaccagaagatgattagctacgagaaattaccgactcacacacctcacgcgtctctgatctgcaatacacacaagccatatgagtgtaaagagtgcggcaagtactttagcagaagtgcaaacttgatccaacaccagtcaattcacacgggggagaagccttttgagtgcaaagagtgtggcaaggcctttaggctacatatccaattcactcgtcaccagaaattccacaccggggagaaaccattcgagtgcaacgagtgcgggaaagcatttagtttgctgaccctgctcaacaggcacaagaacatccataccggggaaaagctcttcgaatgcaaagaatgtggaaaaagctttaataggtcgtccaacctcgttcagcatcaaagcatccatagcggtgtcaagccttatgagtgcaaggagtgcgggaagggcttcaaccgcggcgcccacctgattcagcatcagaaaatccatagcaatgaaaagccgtttgtctgcaaggagtgcgggatggctttcagataccattatcagctaatcgaacattgtcagattcacacaggggagaagccttttgaatgtaaggagtgtggaaaggcctttactctgcttacaaagctcgtgcgacatcagaagatccacacaggggaaaaaccatttgaatgtcgcgagtgcggtaaggcattttccttgttgaaccaactgaacagacacaaaaacatacacacaggggagaagcctttcgaatgtaaagagtgtggcaagtctttcaacagatcctctaatctggtgcagcaccagtctattcacgccgggattaagccatacgaatgtaaggagtgtgggaaagggttcaaccggggggcccacctgatccagcaccagaagatccacagcaacgagaagccctttgtctgcagagagtgcgaaatggccttcagataccactgtcagctgatcgaacactcccgtatccataccggcgataagccattcgagtgtcaggactgcggaaaagcctttaatcgcggtagcagcttggtccagcatcagagcattcacacaggtgaaaagccatacgaatgtaaagaatgtggaaaagcgttcagactctacctgcagctaagccagcatcagaaaacacacacgggggaaaaacccttcgagtgcaaagaatgtggcaaatttttcaggcgcggatctaatctaaatcagcaccggtctatccacacagggaaaaaaccatttgagtgcaaggaatgtggaaaagcatttagacttcatatgcatctgattcgccatcaaaaattgcacacaggggaaaaaccctttgagtgcaaagaatgcgggaaggcttttagactccatatgcagctaatccgccatcagaagctgcatacaggcgaaaaaccatttgagtgtaaagaatgcggtaaggttttcagccttccgacccaacttaaccgacacaagaatatccacaccggggagaaagccagctag

SEQ ID NO: 14739 - DNA, 477 bp, Artificial Sequence
  Description of Artificial Sequence: Synthetic coding sequence
atgggccggtccccccgcaaaattgaccaattttgtaattcatccaacatggtgcacggatcagtaacattccgtgatgtggccatcgacttcagtcaggaagagtgggagtgcttgcagcctgatcagcgcacattatatagggatgtaatgctggaaaactactctcatctcatatcgctcggcagctccataagcaaaccagatgtcatcaccttgcttgagcaggagaaggaaccttggatggttgtacggaaggaaactagcaggaggtatccagacctggaacttaagtacggaccagaaaaagtgagtccagaaaatgatacttcagaggttaatttgcccaagcagataagctctcttgcttcaaagccctcgtttaccgccatccacatacagcggcggattcattgcaggatctgtatagccttcggatacctcagtctagtttactgtagcctggagatcctgtag

SEQ ID NO: 14740 - DNA, 348 bp, Artificial Sequence
  Description of Artificial Sequence: Synthetic coding sequence
atggttcacggttccgtgacattccgagatgtggccattgacttctcgcaagaagagtgggagtgccttcagcccgatcagcgcaccctatatcgcgatgtgatgttggagaattactcgcacttgatttcgctcggctcctccatttccaagcctgacgtcatcacccttctcgagcaggagaaggagccttggatggttgtccggaaggaaacctcacggagatacccagacctggaactaaaatatggacctgagaaggtatcaccggaaaatgacacttcagaagtgaacctgcctaagcaggtaattaaacagaagaaaggcaagaaaaagaagaagaaatag

SEQ ID NO: 14741 - DNA, 1926 bp, Artificial Sequence
  Description of Artificial Sequence: Synthetic coding sequence
atggtgcacgggagtgtcacctttagagacgttgccatcgatttctcgcaagaagagtgggaatgtctgcagcctgatcaaaggacgctgtatcgagacgtcatgctcgaaaattattcacacctgatttcactagggtcttccatttctaaaccagacgtgatcactttactcgagcaggaaaaagagccctggatggtggtgcggaaagagacatctaggaggtatcccgacctggagctcaaatacgggcctgagaaagtcagcccagaaaatgacacctccgaggtaaatcttcccaagcaggttattaaacagatctcgactactctcggaattgaagccttttatttccggaatgactcggaatatcgccaatttgaaggcctccaggggtaccaggaaggcaatatcaaccagaagatgatttcctacgagaagctgcctactcacactccacatgcctcgctcatttgtaacacccataagccttatgagtgcaaagagtgcgggaaatatttctctagatcagctaatcttattcagcaccagagcattcataccggcgagaagccattcgagtgcaaagagtgtggaaaggctttccgactccatatccagtttacaaggcatcagaagtttcataccggcgaaaagccattcgagtgcaacgagtgcggcaaggcattcagtctcctgacgctgctgaaccgccataagaacatccacactggcgaaaaactgtttgagtgtaaagagtgcggaaagtctttcaaccgctctagcaatctggtgcagcatcagtccatacattccggcgtcaagccgtacgagtgtaaagagtgtgggaaaggatttaaccggggggctcacctgatccaacaccagaagatccactctaacgaaaaaccatttgtgtgtaaagaatgcgggatggcattccggtaccactaccagctgatcgaacactgtcaaattcacacaggggaaaagcccttcgagtgtaaagagtgcggtaaagcctttactctgctcacaaaattagtgagacaccagaagattcacacgggggagaagccatttgagtgccgagagtgcggaaaggccttcagtctgcttaatcagttgaatcggcataaaaacatccacaccggcgagaaaccttttgaatgtaaagaatgcggaaaatcattcaacaggagttccaacctggtacagcaccagtccatccatgccggcattaagccgtacgagtgtaaagaatgcggcaaaggattcaaccgtggtgcccatctcattcagcaccagaagatccatagcaatgagaagcccttcgtgtgtagagagtgtgaaatggcgttccggtaccattgtcagctcatcgagcactctcggattcacaccggggataaaccctttgaatgccaagattgcggaaaagctttcaatagagggtcaagtctggtgcagcaccagagcatccatacaggggaaaagccctatgaatgtaaggagtgtgggaaagctttcagactgtacctgcagctctctcagcaccagaagactcatacgggggagaagccttttgagtgtaaagaatgtggcaaattctttagacgcggaagtaatctgaaccaacaccgatcaattcataccggaaagaaaccctttgaatgtaaagaatgcggtaaagcctttagattgcacatgcatctaataagacatcaaaagctacatacaggtgagaagccatttgagtgtaaagagtgtgggaaagcgttcagactccatatgcagctgatccggcaccagaaactacacacgggagagaaaccttttgaatgtaaggaatgcggcaaggtgttctcactccctacacagctcaataggcataagaacattcacactggcgagaaggcttcttag

SEQ ID NO: 14742 - DNA, 1929 bp, Artificial Sequence
  Description of Artificial Sequence: Synthetic coding sequence
atggtacacggatccgtgaccttcagagacgtggccatcgatttttctcaggaagagtgggaatgcttacagcctgaccaaaggaccttatatcgcgacgtcatgctggaaaactattcacacctgatcagtcttgccggttcaagcattagtaaacctgatgtcatcaccttattggagcaagagaaagagccttggatggtagtccggaaagagacgtctcgaagatacccagacttagaactgaagtatggaccagagaaggtctccccagagaacgatactagtgaagtgaacctccccaaacaggtgatcaaacagattagtaccactctgggaattgaagctttttactttagaaacgattccgagtatcggcagtttgaagggttgcagggataccaggaggggaacatcaaccagaagatgattagctacgagaagctgcctacacacacaccacacgcaagtttgatttgtaatacacataaaccttatgaatgtaaagaatgcggtaagtacttttccaggtctgccaatttaatccagcaccagtctatccatacaggggaaaaaccatttgagtgcaaggagtgcggtaaggctttcaggctgcatattcagtttactcggcaccagaaattccacactggcgagaagcccttcgaatgtaacgaatgtgggaaggcattcagcttgctgacccttctgaaccgccacaagaacattcacacaggcgaaaagctattcgagtgtaaggaatgcggaaaatccttcaatagatctagcaatctggtacagcaccagtcaatccactcaggtgttaaaccctacgagtgtaaggagtgtggaaaaggttttaatcggggcgctcacctgatccagcaccagaagatccactctaacgagaagcccttcgtctgcaaggaatgtggaatggcttttcggtaccattaccagctcatcgagcactgccaaattcacaccggggagaaacctttcgagtgcaaggagtgcggaaaagctttcacactgctgacgaaactggtccgacatcagaagatccacaccggcgaaaaacccttcgagtgccgagaatgcggtaaggcttttagtcttctcaatcaattaaaccgccacaagaacattcacacaggtgagaagccgtttgagtgcaaggagtgcggcaagtctttcaatagatcaagtaacctggtccagcaccaatccatacacgcaggtatcaagccttatgaatgtaaggagtgtggaaaggggtttaaccgcggcgcccatttgattcaacaccaaaagatccactcaaatgagaaacccttcgtgtgccgtgagtgcgagatggccttcaggtaccattgtcaactgatagaacacagccgcattcacaccggcgacaaacccttcgaatgccaggactgcggaaaggcattcaacagaggttctagccttgttcagcatcagtctattcacactggcgaaaagccctacgaatgcaaggaatgtggaaaggcattccggctctatctgcagctgtctcaacatcagaaaactcatactggagagaaaccttttgaatgcaaggagtgcggcaagttcttcaggcggggatccaatttaaatcaacaccgttcaattcacacaggcaaaaaaccctttgagtgtaaggaatgtggcaaagcgttcagactccatatgcatttgatacgacatcagaagttgcacaccggcgagaagccatttgagtgtaaagagtgtggcaaggcattccgactgcatatgcagttaattcggcatcagaagctccacaccggagaaaagcccttcgaatgcaaggaatgtggaaaagtcttttctcttcccactcagctgaatagacacaaaaatattcacactggcgaaaaagccagctag

SEQ ID NO: 14743 - DNA, 1926 bp, Artificial Sequence
  Description of Artificial Sequence: Synthetic coding sequence
atggtgcacgggagcgtgactttcagggatgtggccattgacttttctcaggaggaatgggaatgcctccagccagaccaacgtacattgtacagagatgtgatgctcgagaactacagccatctcatcagcttgggtagttcaatctcgaaacctgatgtcattacactgctggagcaagaaaaagagccctggatggtagtgcgtaaagaaacgagtcgaaggtatccagacttagagcttaaatatggaccagaaaaggtgtcccccgaaaacgacacatcagaggtcaatctaccgaaacaggtgatcaaacaaattagcacaaccctgggtatcgaggcattctactttagaaacgattctgaatatcgacaattcgaaggtctgcagggttaccaggagggcaacatcaaccagaaaatgattagctatgaaaagctaccaacgcatacaccccatgcatcccttatctgcaacactcataaaccttacgaatgcaaggagtgcggtaaatacttttctcgatctgctaatcttatacaacaccagagcattcacacaggtgagaaacctttcgaatgtaaggagtgcgggaaggcctttaggctgcacatacaattcacccgtcaccagaaatttcacaccggagagaagcctttcgagtgcaatgagtgtggaaaggccttttcactgctcacattactgaacagacacaagaacattcataccggtgagaagctgtttgaatgcaaggagtgtggcaagagtttcaaccgatctagtaatttagtgcaacatcagagtatacacagtggggtgaagccctatgagtgcaaggagtgtggcaagggctttaatcgaggagcccatctgatccagcaccagaaaattcactcaaacgagaaaccttttgtgtgtaaggagtgtggcatggctttcagataccattatcagctcatcgagcactgtcaaattcataccggcgagaaaccattcgaatgcaaggaatgtgggaaggcttttaccctgctgactaaattggttcgccatcagaagattcataccggggagaagccttttgagtgtagagagtgcggcaaggccttctctttgctgaatcagctgaacaggcacaagaatatacatacaggtgagaagccctttgagtgcaaggagtgcggcaaaagcttcaaccgaagttctaatcttgtgcagcaccagtctatccacgccggtatcaaaccgtacgagtgtaaggaatgcgggaagggtttcaacagaggcgcccatctgatacaacatcagaaaatacatagcaacgagaaaccttttgtgtgcagggagtgcgaaatggccttcaggtaccactgtcagcttatcgaacattcaaggatccacacaggagacaagcctttcgaatgccaagactgcggaaaggccttcaatcggggaagctcattagttcagcaccagagcatccatactggggagaaaccctacgaatgcaaagaatgcggcaaggctttcagactatacctccaactgtcacagcatcagaagacccacaccggagagaaaccgttcgaatgcaaggaatgcggcaaattttttcggcggggatctaatctgaaccagcaccgctcgatccataccggcaagaaacctttcgaatgtaaggaatgtggcaaagcgttccggcttcatatgcatctgataaggcaccaaaagcttcacaccggggagaagccattcgaatgtaaggagtgtgggaaggcctttagactgcacatgcagcttatacgccaccaaaaattacacacaggggaaaaaccctttgagtgcaaggaatgcggaaaggtattcagtctgcccacgcaactaaaccgccacaaaaatatccacacaggggagaaagcaagctag

SEQ ID NO: 14744 - DNA, 16218 bp, Artificial Sequence
  Description of Artificial Sequence: Synthetic coding sequence
atgggggcgctgtggtcatggtggatcctgtgggcaggcgccacccttctttgggggttgacacaagaggcctccgtcgacttgaagaatactggtcgggaggaatttctgacagctttcctccagaattaccagttggcgtatagcaaggcgtaccccagactgctgatcagctccctatctgagtcccccgcttccgtctccattctatcacaggccgacaatacctctaaaaaggttacagtgcgccctggggagtcagtgatggtgaatattagtgcaaaagccgagatgataggtagtaagatctttcaacatgccgtggtgatacattctgattacgccatatccgttcaggcgctgaatgccaagcctgataccgccgagttgacactcctcagaccaatacaggcgcttggtaccgaatacttcgtcttgacgcctcccgggactagtgccagaaatgtgaaagagtttgcggtcgtggccggtgctgctggcgcctctgtatcagtgacactgaaaggaagtgttacatttaatgggaagttctaccccgcaggtgatgtccttagggtgaccctgcagccatacaacgtggctcagctgcagagtagcgtggatctttccgggtctaaagtgaccgccagcagtcccgtggcagtcctgtcagggcattcctgcgcccagaagcatacaacatgcaatcacgtagttgagcagctgcttcccactagtgcttggggcacccattacgtggttcccaccctagcatctcagtcgaggtatgatctagcattcgtggtggcttcccaggccactaaactaacgtacaaccatggcgggatcacaggctctagaggcctgcaggccggcgacgtggttgaatttgaagtgaggccgtcctggcccctctacctcagtgctaacgttggcatccaggtgcttttatttggcacgggtgctatccgcaacgaagtcacttatgatccatacctggtgttgatcccggatgtagctgcttactgcccagcctacgtggtgaagagcgtccctgggtgcgagggcgttgctttagtggttgctcagaccaaagcaataagcggcctgacaattgatggtcacgctgtaggagcaaaactcacctgggaagccgtgccgggcagtgagttctcttacgctgaggttgagttaggaacggcggatatgatacacacagccgaagctaccacaaacctgggccttttaacattcggcctcgctaaggccatcggctatgctaccgcagcagattgcggacgaacagtactgagccctgttgaaccctcctgtgagggcatgcagtgcgctgccggacagcgatgtcaagtcgtggggggtaaagctgggtgcgtcgcggagtccacagctgtatgccgggcacagggcgatcctcactataccaccttcgatgggagacggtacgacatgatgggcacctgctcctacactatggttgaactctgctctgaagatgacacccttccagcgttctcggtggaagcaaagaatgaacacagaggtagcagacgtgtgtcttatgttggcctggttacagttagagcatacagtcatagtgtgagcttgacccggggagaggtgggatttgtacttgttgataaccagagaagtagacttcctgtgtccctctctgaaggtagactccgcgtatatcaatcaggacctagagcagtggtggaactcgtatttgggcttgtggtcacatacgattgggactgccaactcgcgctgagccttccagctcgctttcaggaccaggtctgtggactctgtggcaactacaatggtgaccctgctgacgattttctgaccccagatggcgctctggcaccggacgcagtggagttcgcttcttcttggaagctggatgacggcgattatctttgcgaggatgggtgccagaacaactgcccagcctgcacccctggacaggctcagcattatgagggggaccggctgtgcggtatgctgacaaagctggatgggccattcgctgtctgccacgatacactcgaccccagaccattcctggaacaatgtgtctacgatctgtgcgtggtggggggggaacgccttagtttgtgtcgcggcctttccgcctacgcacaggcttgtctggagcttggtatttctgttggcgactggcgctctccagccaattgcccattgtcttgtcccgccaactctcgctatgagttgtgcggacccgcatgtccgacttcttgcaatggggcggctgcaccgtctaattgttcaggccgcccatgcgtagagggatgtgtttgtctgcccggattcgtcgccagcgggggtgcctgtgtgccggcttccagctgcggctgtacattccagggcctgcaattagcccctgggcaagaagtgtgggccgacgagctctgtcaaagacgctgtacatgtaacggtgctacccaccaggtcacttgtagggataaacagagctgccctgccggcgagaggtgctcagtgcaaaacggactgcttggttgctatcctgaccgtttcgggacgtgccagggatccggcgacccccattatgtcagtttcgacgggagacgcttcgacttcatggggacatgcacctatctgctagtgggctcctgcgggcagaatgccgccctccccgcattccgcgttctcgtggaaaacgaacaccgtggctctcagacggtgagctacaccagagccgtgagggtagaggccaggggggtgaaagttgcagtgcgtcgggaatatcccggacaggtgttggtagatgacgtgctacagtacctccccttccaggccgccgatggtcaagtccaggtatttcggcagggacgggatgctgtggtgcgaaccgatttcggacttacagtcacctacgattggaatgcaagagtgaccgctaaggtccccagtagctacgcagaggcactctgcgggctatgtggaaactttaatggggaccccgctgacgatttggcactgcgcggaggtggccaagccgccaacgcactcgcgttcggcaacagctggcaggaagagacacgcccagggtgcggtgcaaccgagcctggcgactgccctaagttggactctctggtcgcacagcagctacagtctaaaaacgaatgtggaatcctcgcagatcccaagggtccatttcgcgagtgtcacagtaaacttgacccgcagggagccgtacgggactgcgtgtacgataggtgtctgctgcctggacagtctgggcctctgtgcgacgccttggccacctacgcggctgcgtgccaggccgccggggctactgtccacccctggcgaagtgaggagctctgcccattgagctgtcctccccactcgcactatgaagcttgtagctacgggtgcccgctaagctgcggagacctacccgtgcctggcggttgcggcagcgagtgtcacgagggctgcgtgtgcgacgagggatttgccctgagcggcgaaagttgcctacctttggcctcctgtggctgtgtgcatcagggcacttatcacccacccgggcagacattctatccagggccaggatgcgactcattgtgtcattgccaagagggagggcttgtgtcatgcgaaagctcttcatgtggccctcacgaagcatgtcaaccatctggaggttcactcggttgtgtggctgtgggaagtagcacctgtcaagcatccggtgacccacactacactacattcgatggcaggcgctttgattttatgggcacgtgtgtctacgtcctcgcccagacttgtgggaccagaccagggctgcatcgttttgcggtactccaggagaatgtggcctggggaaatggtcgggtgtccgtgactcgcgtgatcaccgtgcaggtggcaaacttcactcttagacttgaacagcgccagtggaaggtgactgtgaatggcgtagacatgaagttacccgtcgtgcttgcaaatgggcagataagggcgagtcaacatggctccgacgtggtgatcgagacagattttggattacgggtagcctatgacctggtgtactacgtcagagtgacggtgccgggcaattactatcaacagatgtgcggactctgcggaaattataatggcgatccaaaggatgactttcagaaacccaacggctctcaagcaggcaacgcaaacgagtttgggaattcatgggaggaggtcgtccctgattctccgtgtctgcccccgacaccgtgcccacccggcagtgaggactgtattcccagccataagtgcccaccagaactggaaaagaagtatcaaaaggaggaattctgtggtcttctttcctccccaactggcccgctgtcatcatgtcacaaattagtggacccccaggggccactgaaggattgtatatttgatctgtgtctcggggggggcaacctcagcatcctgtgtagtaatattcacgcctacgtaagtgcatgtcaggccgctggcggtcatgtggagccctggcgaaccgaaaccttctgcccgatggaatgtccccctaactcacattatgaattatgcgccgatacttgctcccttggctgttcggctctgagcgcgccgccacagtgccaagatggatgtgctgaggggtgtcagtgtgatagcgggtttttgtacaacggtcaggcctgtgtccctatccaacagtgcgggtgctatcataacggcgtgtactacgagcctgaacagacagtccttatcgacaattgtaggcagcaatgtacctgtcatgccggtaaggggatggtttgtcaagaacattcttgtaagccaggccaggtatgtcagcccagcggggggatactcagctgcgtgaccaaggacccttgccacggcgtaacctgccggccgcaggaaacgtgcaaggaacagggagggcagggagtctgtcttcccaactatgaagctacgtgttggctctggggggatccgcactaccatagctttgatggaagaaagtttgattttcaaggaacgtgcaactatgtgttggcgacaaccggctgccctggagtcagtactcagggactgacacccttcactgtgacgaccaaaaatcagaataggggaaatccagccgtgtcctacgtgagggttgttacagtggcagccctaggtacaaacattagcattcacaaagacgagattggtaaggtgagggtcaacggggtactgaccgcactgcccgttagtgtggccgatgggcgcatatctgttacccaaggagcgtccaaggctctgcttgtcgccgattttggattgcaggtgagttacgactggaactggagagtggatgtcaccctcccaagctcctatcatggggcagtgtgtggcctgtgcggaaacatggaccgcaacccaaataatgatcaggtgtttcctaacgggacacttgcaccatccattccaatctgggggggaagttggcgagcaccaggctgggaccccctctgctgggacgagtgtcgcggaagctgcccaacttgcccagaggataggctggagcagtacgaggggcccggcttctgtggccctcttgctcccggtaccggcggcccctttactacttgccacgctcacgtgcccccagagtccttctttaagggatgtgtcttggacgtgtgtatgggcggcggagatcgggacattctttgcaaagccctagccagctacgtagctgcatgccaggcggccggagtcgtgattgaagactggcgcgcgcaagtgggctgtgagattacgtgtccagaaaatagccattacgaggtgtgcggaagcccctgccccgcctcatgccccagccctgcgccactgactacccctgctgtgtgcgagggaccttgtgtagaagggtgtcagtgcgacgcaggcttcgtgttgtctgctgatcggtgtgtgccactgaataatggttgcggctgctgggctaacggcacttatcacgaagccggttccgaattttgggccgacggaacatgcagccagtggtgccgctgcggcccgggaggagggtccctagtgtgtacccccgccagttgcggactgggtgaggtgtgcgggcttttgccgagtgggcagcatggatgtcagcccgtgtccacagccgagtgtcaagcctggggcgacccacattatgtgactctggatggccatagattcaatttccagggtacatgcgagtacttattgagcgccccttgccatggcccccctctgggcgccgaaaattttacagttaccgtagccaatgaacacagagggtcccaggcagtgtcctatactagatctgtcacactacaaatttacaatcacagcctgacactgagtgcccgatggccccgtaagctgcaagtcgacggggtcttcgttactctcccattccaactggattctctcctgcacgcccatctcagtggcgccgatgtggtggtgaccactacgagcggtctcagcttggccttcgatggggattctttcgtgaggctgagagtacccgcagcctatgctggatccctgtgtgggttgtgtggaaattacaaccaggatcctgctgacgacctgaaggcggttggaggtaagccggcagggtggcaggttgggggtgcacaagggtgcggagaatgtgtgagcaagccttgcccctccccttgcacaccggagcagcaggagtcattcggcgggccagacgcctgtggggtcatcagcgcaaccgacggaccactcgctccgtgccacggtctggtgccccctgcccagtatttccaggggtgcctacttgatgcatgtcaagtgcagggtcaccctggcggactgtgtcccgccgtggctacctatgtcgctgcatgccaagccgccggagctcagctccgcgagtggcggcgacctgatttttgccccttccagtgccccgcccacagccactacgagctgtgtggcgacagttgtcctgggtcctgccccagtctttccgctccagaaggctgtgagtccgcttgcagggaaggctgcgtgtgcgacgccgggtttgtgcttagtggcgatacttgcgtaccagtgggccaatgcggttgtcttcacgacgaccggtattatcctctgggccagacgttctaccctggccccggatgtgacagcctctgtcggtgcagagaaggtggggaagtgtcttgtgagccaagctcatgcgggccacatgagacatgtcgtccatccggtggatcgttgggctgcgtcgccgtaggaagtaccacctgtcaggcatccggagatccacactacaccactttcgatggccgaagattcgacttcatgggcacgtgtgtatacgtgctggcccaaacatgcgggaccaggcctgggctgcaccgattcgcagtcctccaagagaacgtggcctgggggaacggtcgcgtgtctgtaactcgtgtcatcactgtgcaagttgccaactttactctacgcctcgaacagagacagtggaaagtaactgtgaacggtgtcgacatgaagcttcccgtcgttctggcaaatggacaaatccgtgcaagtcagcatgggtctgatgtagtgattgaaactgactttggcttgcgagtggcgtacgacctggtctactacgtccgcgtgacagttcctgggaattattaccagctgatgtgcggtctctgcggcaactataacggcgacccaaaagacgatttccaaaagccgaatggttctcaggccggcaacgccaacgaatttggcaattcttgggaagaagtggtccccgacagcccatgtctgccccccccgacttgcccacccgggtctgaaggttgcatacctagcgaggagtgtccacccgaactggaaaagaagtatcagaaagaagaattttgcgggctgctgagctcacccacaggcccactttcttcttgtcataagctcgtggaccctcaaggccctctgaaagattgcatatttgacttgtgtctgggcggaggcaacctcagcatcctatgttcaaacatccacgcttacgtgtccgcctgtcaggctgctggaggccaggtggaaccctggcggaacgagaccttctgtcccatggagtgcccacaaaattctcactatgagctctgcgctgatacctgcagtttggggtgttctgcgttatcagcccccctccaatgcccagacggttgtgctgagggatgtcagtgcgattctggcttcctatacaatggccaggcatgtgtccctattcaacagtgcggatgttaccataatggggcctactatgaaccagaacaaaccgtgctaatcgacaattgcaggcaacagtgtacttgtcatgtcggcaaggtggttgtgtgtcaagaacattcttgtaaaccggggcaggtgtgccagccatctggaggaatcctgtcttgcgtgaataaagatccctgtcacggcgttacctgtcggcctcaggaaacatgcaaagagcagggaggccaaggcgtgtgtctacctaactatgaggcaacctgttggttgtggggagatccgcactaccattctttcgacggccgaaagtttgacttccagggcacatgtaactacgtactggcaacgacaggctgtcctggggtgtccacacagggtcttaccccgttcaccgtgaccactaagaatcagaataggggtaaccccgcggtgtcatacgtgcgtgtcgttacggtcgcagccctcggaaccaatatcagcattcataaagatgaaattggaaaggtgagggtgaatggagtcctcaccgccctcccagtatctgtggcagacggaaggatatccgttacacagggagcatctaaggctcttctggttgctgattttgggctccaagttagctatgattggaactggagagttgatgtgacgcttccttccagctaccacggggctgtctgtgggctgtgcgggaacatggaccgaaaccctaataatgaccaagtcttcccaaacgggaccctagcaccgtccatccccatttggggcgggtcatggagagcccccggctgggaccccctgtgttgggatgagtgcagggggtcttgtcccacatgtcctgaggacaggctcgagcaatacgaagggcctggtttctgtggccctctggcgccgggcacgggtgggccctttacaacctgccacgctcatgtgcctccagagagcttttttaaaggatgtgtgctggatgtctgcatggggggcggggaccgcgacatcctctgcaaggccctggcaagttatgtggcagcatgtcaggcagctggcgttgtcatcgaggactggagggcgcaagtgggctgcgagataacatgccccgaaaactcacactacgaagtttgtggacccccttgtccagccagctgcccatcaccagcgcctcttactactcccgctgtgtgtgagggcccttgcgtcgaaggatgccaatgcgatgcgggattcgttctgtctgccgatcgctgtgtccccctgaataacggctgtgggtgctgggcaaacggaacttaccacgaggccggctcagaattctgggcagacggcacatgcagccagtggtgtagatgcgggcccggaggagggtccctcgtgtgcactcccgcgtcatgcggtcttggggaggtctgtgggcttttaccaagcggtcaacatggttgtcagccagtgtccacagcagaatgccaggcttggggggatccccattatgtgaccctggacggacacagattcgactttcagggcacctgtgagtacctcctgtcagccccctgccacgggccaccattgggcgcagaaaacttcacagtgaccgtcgccaatgaacaccggggcagtcaggccgtcagttacacccgcagcgtcaccttgcagatctacaatcactctctgactctgtctgcccggtggcccaggaaactccaggtggacggagtgttcgttacccttccttttcagctggattcgcttttacatgcccacctctcaggcgcagacgttgtagtgactacaaccagtggattaagccttgcttttgacggtgattcttttgtcagactgcgggtccctgccgcatacgcagggtctttatgcggcctttgcggcaattacaatcaggatccggctgatgatctcaaggctgtcggaggaaaacccgccggctggcaggtcgggggcgcgcagggctgcggcgaatgtgtcagtaagccgtgcccctccccttgtacacccgagcagcaggagtcctttgggggtcccgacgcatgcggagtgatctcagcaactgacgggcccctggcaccttgtcacggacttgtgccccctgctcaatactttcagggatgcttgcttgatgcttgtcaggtccagggccaccccggaggcctgtgccctgcagtcgcaacatatgttgctgcttgtcaggccgcaggagctcagctgagggaatggaggcgccccgacttctgtccttttcaatgtccagcccacagtcattacgagctgtgtggagactcatgccccgggtcatgtccttctttgagtgcccccgaggggtgcgagagcgcgtgcagagaaggctgtgtctgcgacgccggcttcgtgcttagtggtgacacctgcgtcccggtaggtcaatgtggctgcctgcacgatgaccggtactacccactgggccagactttttacccaggaccaggctgcgacagcctgtgccgctgcagggaagggggggaggtgtcctgtgagccctccagctgtggacctcatgagacttgccggccatctggaggctcccttgggtgtgtggctgtcggatcaaccacctgccaggcctcaggtgatccccactatacaaccttcgacggccaccggttcgactttatgggaacttgcgtttacgtattagcacagacatgtgggacaaggcccggcctacataggttcgcagtcctgcaggaaaacgtggcctggggaaatggaagagtgtcggtgacacgcgtaattaccgttcaagtcgctaactttactcttcgtttggaacagcggcagtggaaggtgactgtgaatggagttgacatgaagctcccagtggttctggcaaatggacagattcgggccagtcagcacgggtctgatgtagtaattgaaacagactttgggctgagagtggcgtatgacttggtgtactatgtgcgggttaccgtgccaggtaactactatcagctgatgtgcggcctatgcggaaattacaatggcgacccaaaggacgatttccagaagcctaacggatcgcaggctggaaacgctaatgaatttgggaattcctgggaagaggtcgtgcctgactccccctgtctacctcctcccacatgtccccccggcagcgccgggtgcatcccctccgataagtgcccacctgagctcgaaaaaaagtatcaaaaggaggagttctgcggcttactgagctctcccaccggaccattgtcctcatgccataagcttgttgaccctcaaggaccactgaaggactgtatcttcgatctatgtctcgggggaggaaatctgagtatcctctgttccaatatacacgcatacgtatccgcgtgtcaggcggcaggcgggcacgtagaaccttggaggaacgaaacgttttgcccaatggagtgtccccaaaactcccactatgagttatgcgcagacacgtgtagcttagggtgcagcgccctctctgctccgttgcagtgtcccgacggatgcgcggagggatgtcagtgcgactcaggctttttatacaacggacaagcctgtgtacctatacagcagtgtggctgctatcacaatggcgtctattatgagcctgagcagactgtcctcattgataattgtcgacagcagtgtacctgtcatgtgggaaaggttgtggtgtgccaggaacatagttgcaagccgggccaggtctgccagccttctggtggcattctaagttgcgttaccaaggacccctgccacggagtaacctgtcgcccccaagaaacctgcaaggaacagggaggacagggagtgtgccttccaaattatgaagctacctgttggctgtggggcgatcctcactatcactcctttgatggacgcaagttcgattttcagggaacctgcaattatgtcctcgctacaacaggatgtccgggcgtctcaacccagggtctgacgcctttcaccgtgaccaccaaaaaccagaatcggggcaaccccgcggtcagctacgtccgggttgtaactgtagcagctctgggcaccaacatttccatccacaaagacgaaatcggaaaggtgagagtgaatggagtgctgacagccttgcctgtaagtgtggcggacggtaggatctcagtcgcccagggcgcaagcaaggccctgttagttgccgattttggccttcaggtatcttacgattggaactggcgagtcgatgtgactctgccctcttcctatcacggagcggtttgtggactgtgcgggaatatggaccgcaatccaaacaatgaccaggtcttccctaatggaacactagctccttccatcccaatttgggggggtagttggcgcgcacctgggtgggaccctctctgttgggacgaatgtagagggtcttgtcccacctgccccgaggatcggctcgagcagtacgaggggccgggtttttgcggtccattatccagtgggaccggggggccgttcacaacatgtcatgcccacgttccgccggagtcttttttcaagggatgcgttcttgacgtgtgtatggggggcggcgaccgcgatattttatgcaaagctctggcttcatatgtcgcggcatgtcaggcagccggagtcgtgatagaggattggcgtgcgcaggtcggatgtgagattacttgccccgaaaattcccattacgaagtgtgcggacctccctgtcccgccagctgcccttcaccagccccactcacaaccccggctgtgtgcgaaggcccctgtgtggaaggatgccagtgcgatgccgggtttgtgctgagcgccgaccggtgtgtccccctaaataacggttgcggatgctgggccaatgggacataccacgaggctggttcagaattttgggctgacggcacatgttctcagtggtgcaggtgcggcccagggggcggaagcctcgtgtgcactccagccagttgcggactcggcgaagtgtgcgggcttctgccgtccggccagcatggctgccagcccgtgagtaccgccgaatgccaggcttggggagaccctcactatgttactctggatggccatcggtttgatttccaaggtacctgtgagtatttgctgagtgccccctgtcacggcccccccctgggtgccgagaactttacagtgacggtcgctaacgaacaccggggtagccaagctgtttcgtatactaggagtgtcaccttgcaaatctacaaccactccctgactctgtctgcacggtggccaagaaaacttcaggttgacggcgtgtttgttgcactgccattccaacttgactctcttcttcatgcccacctatcgggtgccgacgtggtggtcaccaccacctcagggctttcacttgcgttcgacggcgacagctttgtcaggttgagagtgcctgcggcgtatgccgcctccctttgcgggctgtgcggcaactataaccaagaccctgcagatgacctcaaggctgtgggaggcaaacccgccggctggcaggtgggaggtgcccagggttgcggagaatgcgtcagtaaaccatgtccctccccctgcactcccgaacaacaggagagctttggtgggccggatgcctgcggagtgattagtgcaaccgatggtccccttgcaccctgccatggcttggtgccacctgcccaatacttccagggttgtttattagatgcgtgtcaagtgcagggacatcctggaggcctctgtccggcagtcgcaacttacgttgccgcctgtcaggccgcaggtgcccagctgggtgagtggagaagacccgatttttgtccattgcagtgtcctgcacactcacactatgaactgtgtggagattcttgccccgtcagttgtccaagcctgagcgcccccgaggggtgtgagtcagcttgcagggaaggctgcgtttgcgacgctggcttcgtgcttagcggagacacctgcgtaccagttggccagtgcggttgcctgcacgacgggaggtactacccattgggcgaagtcttctacccgggaccagagtgtgaaaggagatgtgagtgtggtcctgggggccacgttacatgtcaggaaggcgcggcgtgcgggcctcatgaggagtgtagactcgaggatggcgtacaggcttgtcacgccactggttgtgggcgatgtctggccaacggaggcatccattatataacattggatggtcgggtatacgatctgcatggatcgtgtagctatgtcttggctcaagtgtgccaccctaaaccgggcgatgaggacttctcgattgtgctggagaaaaacgccgccggtgatttacagcgtcttctggtcacagttgccgggcaggtagtctctctggcgcagggccagcaggtgactgtggatggcgaggccgtagccctgcctgtggctgtcgggcgggtccgcgtgacagccgagggacgaaacatggtcctgcagacgactaaggggttaaggctgttatttgatggagatgctcacctattaatgagtataccttctccattccggggaaggctgtgcggactttgtgggaattttaacgggaactggtctgatgatttcgtactccccaacggatctgcggctagttcagtagagacattcggggccgcctggcgcgcgccaggtagttccaaaggctgtggagagggatgtggcccccagggatgccctgtgtgccttgctgaggaaaccgccccatatgaaagtaacgaagcatgtggccaactacggaaccctcagggaccatttgccacatgtcaagcagtattgtctccctccgagtattttaggcagtgcgtgtacgacctctgtgctcagaagggcgacaaggcttttctttgccggtctttggcagcctacactgccgcttgccaggcagccggggttgctgtaaaaccctggcggaccgactccttctgtccactccactgtcccgcccactcccactattcgatctgcacccggacttgtcagggttcttgtgccgccctctcaggtttaaccgggtgcactacaaggtgttttgagggttgtgaatgtgatgatcgcttcctgctgagccagggtgtgtgtatacctgtgcaggactgtggctgcacccataacgggcgctacctccccgtcaattcgagcctgctcacctcagattgcagtgagcgctgttcttgcagctcatctagtggcctgacttgccaggccgccggatgtccaccagggcgggtatgtgaggtgaaagctgaggcccgtaactgttgggctacccgcggtctttgtgtcctgagtgtcggcgctaatttaacgactttcgacggggccagaggggccacgacgtctccaggagtttatgaactatcgtccagatgtccggggctgcagaataccattccttggtaccgggtcgttgcagaagtgcagatctgtcatggaaagaccgaggcagtcggacaggtccacattttctttcaagatggtatggtaacactcacaccgaataaaggagtctgggtcaatggcctgagagtggacctgcctgctgagaagctcgcttccgtaagcgtttctcgtacgcctgatggttcgctcctggtacggcagaaagctggcgtgcaagtgtggctgggagctaatggcaaagtggctgtaatcgtgtcaaacgaccacgctggcaagctttgcggtgcctgcgggaactttgacggggatcaaaccaacgactggcatgactcccaggagaagcctgcaatggaaaagtggcgggctcaggacttctccccttgctatgggtag

SEQ ID NO: 14745 - DNA, 2502 bp, Artificial Sequence
  Description of Artificial Sequence: Synthetic coding sequence
atggttcacggatcagtcacctttcgcgatgttgccatcgatttctcccaagaagaatgggagtgtttgcaaccggatcagcgcacactgtatagagacgtgatgctggagaattattcccatctaatctcccttggatcatcaatcagtaagccagatgtaataaccctgctcgaacaggagaaagagccctggatagtggtgagtaaagaaacttctcgatggtatcctgacctagagtccaaatatggccctgagaagatctctcccgaaaacgatatattcgagattaacttgccaaagcacgttatcaagcaaatctctaagactctgggcctggaagccttctacttcaggaatgattcagagtatagaagccggttcgagggccggcaagggcaccaagagggttacatcaatcagaaaataatcagctacgaagaaatgcccgcttatacacatgcctcgccaattcacaatacccacaagccatacgagtgcaaagagtgtggaaagtactttagctgcggttccaatctaatccagcatcaaagtatccacacaggggagaaaccctacaagtgtaaggaatgcgggaaagcattccagcttcacatacagctcactaggcatcagaaatttcacaccggagagaaaacatttgagtgcaaagagtgcggcaaagcattcaatttgcctacgcagttaaatcgccataaaaacatccacacggtgaagaaattattcgagtgcaaggagtgtggcaaatccttcaaccgctccagcaatcttacccaacaccagagcatccatgctggagtcaagccctatcaatgtaaggagtgcgggaaggccttcaaccgaggcagcaacctcatccagcaccagaaaatacactccaatgaaaagccgtttgtatgccgcgagtgcgagatggccttcagataccattaccagctgatcgagcactgtcgcatacataccggggagaagccatttgagtgtaaggagtgtcgcaaagcctttactctgcttactaagttggtgcgtcaccagaagatccacatgggtgagaaaccattcgagtgtagagagtgcggtaaggctttcagcctgctgaaccagttgaacagacacaagaacatacatacgggagagaagccttttgaatgtaaagaatgtgggaagtccttcaacaggtcatccaacctcatacagcaccagtccatccacgccgatgtgaagccttacgaatgcaaggagtgtgggaagggattcaaccgaggcgccaatctgatccagcatcagaagattcactcgaacgaaaaacctttcgtgtgtcgcgaatgtgagatggcctttagataccactaccaactcatccagcattgccaaatccatactggtggaaaaccctttgagtgtaaagagtgtgggaaagccttcagcctgctgacacagctcgccagacataaaaatatccacactggggaaaagcccttcgagtgtaaagattgcggcaaagcttttaatcggggcagtaaccttgtgcagcaccagagcattcataccggcgaaaaaccttacgagtgtaaagagtgtggtaaggccttccggctccatctgcagctgtcacagcatgagaagactcatactggcgagaagcccttcgaatgcaaagaatgcggtaagttctttcgcaggggttctaatctgaatcagcacaggtcaatccacacaggaaaaaaaccttttgaatgcaaagaatgcggcaaggcttttcggctgcatatgcatctgatccgccatcagaagtttcacacaggcgaaaagccttttgagtgcaaagaatgtggcaaggcattttcgctgcatacacagctgaaccaccacaagaatattcacacaggagaaaagcctttcaagtgcaaagagtgcgggaagtcatttaatagggtgtccaatcttgtgcagcaccagtccatccacgcaggagtcaaaccctatgaatgcaaggaatgcggtaaggggttctcgcgcgtgtctaatctcattcagcaccaaaaaacacatagcagtgcgaagccattcgtctgtaaggagtgcaggaagaccttcaggtatcactatcaattaaccgagcactaccgcatccacacaggagaaaagccattcgagtgtaaggagtgcggtaaagccttcggcctgcttacccagctcgcccaacatcagattatccataccggggaaaaacccttcaaatgcaaggagtgcgggaaagctttcaacaggggctccaatctggttcagcctcagagcatccacacaggtgagaaaccttacgagtgcaaagaatgtggaaaagcgtttcgcctgcacctgcaattaagcctgcatcagaagctcgtgcaggtgaggaaccctctaaatgtgaggaacgtgggtcagccctccgacatctcgtccaacttgttgaatatccggaagttcatcctgggttag

SEQ ID NO: 14746 - DNA, 618 bp, Artificial Sequence
  Description of Artificial Sequence: Synthetic coding sequence
atgaatacatttcaggcctcagtaagctttcaggatgtgaccgtggagtttagccaagaggagtggcagcatatgggcccagtggaacgaactctgtatagagatgtcatgctagagaactactcccacctcgtctcagtcggatactgttttaccaagcccgaattgatcttcacacttgaacagggcgaggatccttggctcctcgaaaaggagaagggatttctctccagaaattctcccgaggattcccagcctgacgaaatcagcgagaagtcccccgagaatcaagggaaacatctgcttcaggtccttttcacgaataagctgctgacaacagagcaagagatttcagggaaaccgcacaaccgcgacataaatatctttcgggcccggatgatgccctgtaaatgtgatattgccggctctgcgtgccagggcttgagtctaatggctcctcactgccaatatagcaaggaaaaggcccacgaacggaatgtgtgcgacaaatggctgatctctatcaaagacgggcgtactaacacacaggagaagtcttttgcatattcgaagattgtgaagacactgcaccataaagaggaggtgatccagcactag

SEQ ID NO: 14747 - DNA, 2100 bp, Artificial Sequence
  Description of Artificial Sequence: Synthetic coding sequence
atgaatacattccaggcatcagtgagctttcaagacgtgacagttgagttctcacaggaagagtggcaacacatgggccctgtggagcgcaccctgtacagggacgtgatgctcgaaaactactcccatcttgtgtccgtcgggtactgctttaccaaaccagagttaatcttcactcttgaacaaggagaagacccctggctgcttgagaaagaaaaaggctttctgtccaggaattctccggaagactcccagccagacgaaatctccgagaaatcccctgaaaaccaagggaagcacctgttgcaagttctgtttacaaataaactcctgacgaccgagcaggagatctcgggcaaacctcataaccgggacattaatatttttcgggccagaatgatgccctgcaaatgcgatatcgctggcagtgcctgtcagggcctgagcttaatggcaccccattgccagtatagtaaagaaaaagcccacgagaggaacgtgtgcgacaagtggctgatatcgattaaagacgggcgcactaacactcaggaaaaaagctttgcctattctaagattgttaagactctacatcataaagaagaagttattcagcaccaaaccattcagacgctagggcaggatttcgaatataatgagtcaagaaaagctttcctggaaaaagccgctctggtgaccagcaactccacccaccctaaaggcaagagctacaacttcaacaagtttggcgagaacaagtacgataaaagcacctttatcatccctcagaatatgaacccggagaaaagccattatgagttcaacgataccggcaactgtttttgtcgcataacacataaaaccctcacaggggggaaatcctttagtcaaaagtcccacatccgggagcaccaccgcgtgcatattggtgtcaagcccttcgagtacggcaaatccttcaatcggaactccaccctgccagtgcaccagaggactcacgccactgacaaatatagcgactatcacccttgcactgagacgtttagctatcagagtacattttcagtgcaccagaaggtgcacatccgcgccaagccttatgaatataacgagtgtggcaagtcctgttcgatgaattctcacctcatctggccacagaagtctcacaccggtgagaagccctacgagtgtcctgagtgcggaaaagcattcagtgagaaatcgcggctgcggaaacaccagcggactcataccggagagaagccgtacaagtgcgacggttgcgataaggcgttttccgctaaaagtggcttaagaatccatcagcggactcataccggagaaaagccattcgagtgccacgagtgcggaaagagctttaattacaagtctatcttgatcgtgcaccagcgcacccacactggcgagaaaccctttgagtgtaacgagtgtggcaagtccttctcccacatgtccggcctgaggaaccatagaagaacccataccggcgaacggccgtataaatgcgatgagtgtgggaaagcttttaagttaaaaagcggcctgcggaaacaccacaggactcacaccggggaaaagccttataagtgcaaccagtgtggcaaggccttcgggcaaaagtcccaactgaggggacatcaccgtatacacaccggcgaaaaaccttataagtgcaatcactgtggcgaggccttcagccagaagagtaatctgagagttcatcacaggacccacactggtgaaaagccataccaatgcgaggaatgcgggaagaccttccgtcagaagtctaatttaagaggacatcagaggacccatacaggcgagaaaccctacgagtgtaacgagtgcggcaaggctttttctgagaaatcagttctacggaagcaccaacgtacacatacaggcgagaagccttacaactgtaatcagtgcggggaagccttcagccagaaaagtaatctgcgggttcatcagcgcacacatacgggagagaaaccatacaagtgtgataaatgcggaaggacgttcagccagaaatcatctcttagagaacatcagaaagcccaccctggcgactag

SEQ ID NO: 14748 - DNA, 1704 bp, Artificial Sequence
  Description of Artificial Sequence: Synthetic coding sequence
atgatgccttgcaaatgcgacatcgctggaagcgcttgccagggtctctctctgatggctcctcactgccagtactcgaaagaaaaagctcacgaacggaatgtttgcgataagtggctgattagtatcaaagacggtaggacaaacacccaggagaagagcttcgcctacagtaagattgtgaagaccctgcaccataaggaggaggtcatccaacatcagacaatacaaactctggggcaggatttcgagtacaacgagagtagaaaggccttcctcgagaaggcggcactagtgacaagtaattctacacaccctaagggcaaaagttacaacttcaacaagtttggagagaataagtacgacaaaagtacttttataatccctcagaatatgaatccagagaaatcccactatgaattcaacgatactgggaattgcttttgcaggattactcacaagactctgacaggaggaaaatcattttcccagaaatcccacataagggaacaccaccgggtgcatatcggggtcaagccgttcgaatacggcaagtccttcaatcggaattcaacccttccagtccaccagcgcacccacgccaccgataagtacagcgactaccatccttgtacagaaacttttagttaccagtcgaccttcagcgttcatcagaaagttcacatccgtgctaaaccgtacgaatacaatgaatgtgggaaaagctgcagtatgaactcacatttaatttggccacagaagagccatacgggagaaaagccatacgagtgccctgagtgtggtaaagcgttcagtgagaagtcacgtctccgcaagcaccaacggactcataccggcgagaagccttataaatgcgatggctgtgataaggccttctccgcaaaatccgggctgcggatccaccaacgaacccacactggtgagaaacccttcgagtgccatgagtgtggaaagtcttttaactacaagtccattcttatagtgcatcagcgtacccatactggcgaaaagccttttgaatgcaatgaatgcggcaagagtttctcccacatgtcaggacttcggaatcaccgccggacacacaccggcgagaggccatacaagtgcgacgaatgcggtaaggcctttaaactgaagtccggactgagaaagcaccatcgcacgcatacgggggagaaaccttataagtgcaaccaatgtgggaaagcattcggacaaaagtcccagctcaggggtcatcaccgcattcacaccggcgagaagccctacaagtgcaatcactgtggtgaagctttcagccaaaagagtaatcttagggtgcatcaccggacgcacactggtgaaaaaccgtatcaatgcgaagagtgcggaaaaacgtttcggcagaagtccaacttacgcggccatcagaggacccatacaggggagaagccctatgaatgcaatgaatgtggcaaggccttctcggagaaatcagtgctgagaaagcatcagaggactcacacaggggaaaagccttataattgcaatcagtgtggagaggcgttcagccagaaatctaacctgagagttcatcaacgcacccatactggtgagaagccctacaaatgcgataagtgcggacgtaccttttcccagaaatctagtttgagagaacaccagaaggcccacccaggcgactag

SEQ ID NO: 14749 - DNA, 972 bp, Artificial Sequence
  Description of Artificial Sequence: Synthetic coding sequence
atggccgccgctcggcctgaagcacagagtcgaagctctccaactccagaaagccgcagtcaggaaccactggacttggtcctcgttccggatgattgcaggcccggcactcctccctctgacctgattgagattcaggttgtgaaggtcactgacacgactctcgtgccagagccgcctgagccaggaagctttcattgcgctctgtgtcccgctgcgttccgcctggtgtccgagttgctgttccacgaacacggacatcttgctggggcggaggggggagggcaaggtggtgacccttcccggtgtcacgtctgcgggcacagttgccccggtcctgcctcactccgagcacattactctttacacaccggcgaacggccctacagatgtgccctctgcccccgggccttcaaggccttggccccattgctaaggcaccagcacagacatggcgtggagcccggtacttcgcgccggccgcccgacactgccgcagtggcagaacagagaccgggggtcgccccagagagggctgaggttgtgatggccgcggcggctgcaggggccgccgtagggaagcccttcgcgtgtagattctgtgccaagccatttcgccgtagctctgatatgagggaccacgagcgcgttcacactggcgaacgaccttatcactgcggtatctgcggcaaggggtttacacaaagctcagtgctgagtgggcatgcacggatccatactggagagagaccttttcgatgcacattatgcgatcgcaccttcaacaattcctctaacttcaggaaacaccagaggacccatttccacggcccaggcccaggactgggagactcgggtggacagcttggatccagcgccgcagagggatcagggagtggctgtggtgtaggcgatcctgccgaggagggccgcggcgaaacagcaaaagtgaaggtagaggccgatcagtag

SEQ ID NO: 14750 - DNA, 1218 bp, Artificial Sequence
  Description of Artificial Sequence: Synthetic coding sequence
atgggacccccactggcacctaggccagcccatgtacccggcgaggcaggccctcgtcgaactagagaatccagacctggtgctgtgtcttttgccgatgtggctgtgtattttagccctgaggagtgggagtgtctgcggccggcccagagggctctgtaccgggacgtgatgagggaaacatttggccacttgggagcgctggggttcagcgttcccaagccagcgttcatcagctgggtggagggggaagttgaagcgtggagccctgaggcacaagatccagatggagagagcagtgccgctttctcaagagggcagggccaagaggcagggagtcgagatggcaatgaagagaaggaacggctgaagaaatgtccaaaacagaaagaagtcgcacacgaagttgctgtcaaggaatggtggccatccgtggcgtgcccggagttttgcaacccaaggcagagtcctatgaacccatggctgaaggataccttgacccggcgcctgccgcattcatgcccggactgcggtcgtaactttagctatccgagcctgcttgcctcgcaccagagagtgcacagtggtgagagaccattttcatgtggacagtgccaggcgcggttttctcagaggagatacttgttgcagcatcaattcatccacactggcgaaaaaccatatccttgtcctgactgcggtcgaaggtttagacaacgcggctctctggctattcacaggagagcacacacaggcgagaagccttatgcatgttccgactgcaaatctagatttacgtatccctatctgttagcaatccaccagaggaaacacaccggggaaaaaccttacagctgtccagactgctcacttagattcgcatataccagcttacttgctatccataggcgcatccatactggtgagaagccttacccttgtccagattgcggacggcgttttacttatagtagcctcctactcagtcacaggcggatccatagcgactcccggcctttcccctgcgtggagtgtgggaagggttttaagcgcaaaaccgccctggaagcacatcggtggattcaccgctcctgtagtgaacggagggcctggcagcaggccgtggtaggtcgctcagaaccaatccccgtccttggaggtaaggatccacccgtgcactttaggcactttcccgacatcttccaggaatgcggttag

SEQ ID NO: 14751 - DNA, 1113 bp, Artificial Sequence
  Description of Artificial Sequence: Synthetic coding sequence
atgcctgcagccagtgcagagggacctgttccggggagagatgccggggacctgagaccccccggccgcgccggccgcgctcactgtttcagcttcgccgggtttagcgtgccgaagcccgcctttatctcttgggtggagggggaagttgaggcgtggagcccagaagctcaggatccagacggggagtccagcgctgcctttagccgtggccagggccaagaggctggttcaagggacggaaacgaggaaaaagagaggttgaaaaagtgcccaaagcagaaggaggttgcccacgaagttgctgttaaagagtggtggccgtcagtggcctgccccgagttctgtaatccacgccagtcacccatgaatccatggttaaaggacaccttgacacggcggctcccacattcctgtcctgactgcggtagaaactttagttatccctctctcttagccagccaccaaagggtgcatagtggggaaaggcccttcagctgcggtcaatgccaggctagattctcacagagacgatatctgcttcagcaccagttcatccacacaggagagaaaccatacccatgcccggattgcgggcgtcgcttccgccaacggggctcgttggctatccacagacgcgcccatacaggagagaaaccttacgcatgttccgactgtaagtctaggttcacgtacccttacctcctcgcgatccaccagcgaaagcacaccggagagaaaccatattcttgtcccgattgttcactgcgctttgcctacacatccctcctagcgattcatagaaggatacacaccggcgagaagccctatccatgtccggactgcggaaggcgcttcacctacagctctctgcttctgagtcataggcgaattcactctgatagcaggccctttccatgcgttgagtgcggcaagggatttaaaaggaaaacagcactcgaagctcaccgctggattcatcggagttgcagcgagaggcgggcttggcagcaagctgtagtgggtaggtcagagcctattccagttttagggggcaaggacccgccagtgcacttcaggcacttcccagatattttccaagagtgtggctag

SEQ ID NO: 14752 - DNA, 1173 bp, Artificial Sequence
  Description of Artificial Sequence: Synthetic coding sequence
atgggacctccattggcccctcgcccagcccacgtgcccggggaggcaggcccacgcaggacaagagaatcgcgaccaggagcagtgagctttgctgacgtggccgtttattttagtcctgaagagtgggagtgcctcagaccggcccagcgcgcactgtaccgggacgtgatgagagagacattcggccatttaggagctctaggcttctctgttcccaagcccgctttcatcagctgggtggaaggcgaggttgaggcttggagcccagaggctcaggacccagacgggagtcgtgacgggaacgaagaaaaggagcgcctgaagaaatgcccaaaacagaaggaggtggctcatgaggtagccgtgaaagaatggtggcccagcgtcgcttgcccagagttttgcaacccccgtcagtccccaatgaatccttggctgaaagatacattgacgagacgcctgccacactcctgccctgactgtggtagaaacttctcttaccccagcttgctggcctctcatcagcgagtgcactcgggggagaggcctttttcttgcgggcaatgtcaggccaggttttcacagcggaggtatctgctgcagcaccagttcatccacactggcgagaagccttatccatgtcctgattgtggccgtagattcagacagagggggagcctcgcgatccatagacgcgcccacacaggcgagaagccctatgcgtgcagcgattgcaaatctcgcttcacatacccctatctgctggccatccaccagcgcaagcacacaggcgagaaaccttactcctgccccgactgctccctgagattcgcctacacttccctgctggccatccaccgtcgcattcacaccggcgaaaagccttacccttgcccagattgtggtagacgtttcacctacagctccctgttgctctcacatcgacgtatacatagtgactcgcgtccttttccatgtgtggagtgcgggaaagggttcaaaaggaagacagccctggaggcccatagatggatccaccggtcttgttccgaacggcgagcgtggcagcaggccgtcgtcggacgcagtgagcccattccagtcctggggggcaaagacccacctgtccacttccgccacttccctgacatcttccaggagtgtggatag

SEQ ID NO: 14753 - DNA, 2238 bp, Artificial Sequence
  Description of Artificial Sequence: Synthetic coding sequence
atgaggtcaaattatgagacactggtgtctttggatgacggtctgcctaaaccagagcttattagctggatcgagcatgggggcgaaccatttagaaagtggagggagtctcaaaaaagcgggaatatcatctgctcctccgtggacatgcatttcgatccaggatttgaggaacagttattctggggctcccaacaggccatgaactccggcaagaccaaatcccacttccagctcgatccggagagtcagtgtagtttcgggtccttcgtaagcttccggccagatcagggcatcacacttgggagcccgcagcgtcacgatgctcgtgcccctcctcccctcgcttgtggacctagtgagtctactttgaaggaaggaatccctggcccgcggaatcttgacctgccagggctatgggatgtgccggcatgggagagtacacagcatccgtggcctgtctgcggtgagagctgctgggaaaacaatcatttggtgatgcatcagagaggccacagcaaagaccggacccggcgagcctgggagaagttcaacaaaagagctgagacacagatgccgtggagcagtcctcgagtgcaacggcattttcgctgtggggtgtgtggaaaaagctttcggaggaaattgtgcttactccgccacctcgctgctcacaccggacgtggaccatttagaaatgctgacggcgagatgtgcttcagacatgagctgactcatccttctcatcgacttccacagcagggagaaaagcctgcacagtgcacaccctgtgggaaacgtagccttcccgtggatagcacccaggcccgccgttgtcaacattctcgagaaggcccagccagctggagagagggccggggagcctcatcctctgttcatagtggccagaagccagggtcccgcctccctcaggaaggtaattcacaccaggagggagatacagaagctctacagcacggtgcagagggcccatgtagctgcagcgagtgtggagaacggtcccccatgagcgcccggttagccagcccttgccgggctcatacaggcgagaaacctttccagtgtgcacactgtacaaagagattcagacttcggcggcttctgcaggtgcaccagcatgctcacgggggggaacgaccctttagttgcagaaaatgtggcaaaggatttgctaagcagtgtaagttgacagagcacattagggttcactctggggagaaaccgttccgctgcgcaaaatgcgggcggaatttcagacaacgtggacagcttctgcgccaccaaaggctacacacagacgagaaaccatttcagtgccccgaatgtggattatcattccggcttgagagcatgctcagagcacatagattgaggcatgggggggagcgacccttctcttgctctgaatgtgggcgtggattcacccaccagtgcaaactgcgagaacacctccgggttcatagcggggaaagaccctttcagtgtctaaaatgtgacaagcggttccgcctcaagggcattctcaaggcccatcagcatacacatagtaaggagcgcccattttcatgtggtgaatgtggcaagggatttacacgccagagtaagctgaccgagcatttgcgggtgcattcgggagagaggccgtttcaatgccccgagtgcaataggtcattcaggctcaaggggcagttactgtcccaccagagattgcacactggtgagagaccttttcaatgtcctgaatgcgataagcggtaccgggtcaaagctgacatgaaggcacatcagcttctgcatagcggggagatgcccttttcatgcgaatgcggcaaggggttcgtcaagcattccaagctcatcgaacacattaggacacacacaggtgaaaagccatttcagtgcccgaaatgtgacaagtcctttagactgaaagcccagctgctgagtcatcaagggttacataccggagagcgtccatttcattgccctgagtgtgacaaaaatttccgcgagagggggcatatgctccgccaccagcggattcaccgtcctgagcgtccgtttgcctgcggagactgcgggaaaggatttatctacaaaagcaaactggccgaacacattagggtccataccaaatcgtgtccagctcctaacgaactcgatatcaagaagaggcttagtcagctgttcgccatgatcgaggccgattggtcctag

SEQ ID NO: 14754 - DNA, 2349 bp, Artificial Sequence
  Description of Artificial Sequence: Synthetic coding sequence
atggccgaaccccctcgcttgcctctcacgtttgaagatgtagcaatttatttctccgagcaggaatggcaggacctggaagcctggcaaaaggagctctacaagcatgtgatgcgttcaaattatgagaccctggtatctctcgacgacggccttccgaaacctgaattaatctcgtggatcgagcatgggggcgaacccttcaggaagtggagagagtcccagaaaagtggtaacatcatctgttcaagcgtggatatgcactttgaccccggatttgaagagcagctcttttgggggagtcagcaggcaatgaactctggcaagactaagtcgcattttcagctcgaccccgagagccagtgttcatttggtagctttgtctcctttcggcccgatcaggggattaccctgggttccccccagaggcatgacgcccgggcacccccgcctcttgcatgcggcccgtcagagtccaccctgaaagaaggcatccctggcccacgaaatcttgatctgcccggcttatgggacgttcctgcctgggaatccacccagcatccatggcccgtctgcggagagtcttgctgggaaaacaatcatctggtcatgcatcagcgcggccactccaaggaccgcactaggcgggcttgggagaagtttaataagcgggcagaaacccagatgccctggtcttccccaagggttcagcggcacttccgatgcggggtctgtggaaagagcttcaggcgcaagttatgtttactccggcacttggctgcacatacgggccgggggccctttaggaacgcggacggggagatgtgctttcgtcatgagctcacacacccctcgcatcgcctcccacaacaaggtgagaaaccagcacagtgcactccttgtgggaagcgatcattaccagtggattcaacccaggctcggcgctgccagcattctcgagaggggccagccagttggagggaggggcggggagccagttctagtgtccactccggacagaagcccggcagtcgcttgccccaagaaggcaactcacatcaggaaggtgacacagaggcacttcagcatggcgctgaggggccctgctcttgtagtgaatgcggcgagagatctcctatgagcgcccggttggcctctccatgtagagctcacaccggcgagaaacctttccagtgtgcccactgcacgaaacgattcagattacggagactcctgcaagtgcaccagcacgcccacggcggcgagaggcccttcagctgccgtaaatgcggaaagggattcgccaagcagtgtaaactcaccgaacatatacgggtacatagcggagaaaagccttttaggtgtgccaagtgcggacgaaacttccggcaaagagggcagctgctaaggcatcagcgcttgcacacagacgagaaacctttccaatgtccagagtgcggactctcgtttaggctcgaatccatgttgagggcgcatagactacggcacggtggagagcgtcctttttcttgttctgaatgtgggagaggcttcacccatcagtgtaaactgagggaacacctccgggttcattccggcgagcgcccctttcagtgcttgaagtgtgacaagcgattccgccttaagggcatcctgaaggctcaccagcacacacactcgaaggagcgacctttctcttgtggggaatgcgggaaggggtttacacgacaaagcaaactgacggaacacttgcgtgtccactcgggtgagcggccattccagtgtccagagtgcaatcgaagtttcagactgaaaggccagttactgtcgcatcagcggcttcacaccggcgaacgccctttccaatgcccggaatgtgataagcggtatagagtcaaggccgatatgaaggcacaccagctgctccacagtggagaaatgcctttctcatgcgaatgtggtaagggttttgtgaagcactccaaactgatcgagcacatacgcacacacaccggcgaaaagcctttccagtgcccaaagtgcgataagagctttagactcaaagcacagctgctttcacatcaaggcctgcataccggtgaaaggccatttcactgccccgagtgcgataaaaactttcgggagaggggacatatgctgcggcaccaacggattcatagaccagagagacccttcgcctgtggcgattgtggaaaaggctttatatacaagagtaagctggctgaacacatacgcgtccacacgaagtcttgcccagccccaaacgagctcgacatcaaaaagagactgtctcagctctttgcaatgatagaggccgattggagctag

SEQ ID NO: 14755 - DNA, 1056 bp, Artificial Sequence
  Description of Artificial Sequence: Synthetic coding sequence
atgcattttgaccccggctttgaagagcagctgttctggggatcacagcaagctatgaattccggcaaaactaagtctcattttcagctggatccagagtcacaatgttcatttggatccttcgtgagtttccgcccagatcaagggatcaccttggggagccctcaacggcatgatgctcgggctccacctcccctcgcctgcggcccatccgagagcaccctcaaggaaggaattcctggcccaagaaatcttgacctacccggactgtgggacgtccctgcatgggaatccacccagcatccatggcctgtctgtggagagtcctgttgggagaacaaccacctggttatgcaccagcgcgggcatagcaaagacaggacccggcgcgcttgggagaagtttaacaagagagctgagacacaaatgccttggtccagcccccgcgtccagcgacatttcagatgcggggtctgtggaaagtccttccgccggaaactgtgtctgttaagacacttggccgctcatacaggtcgcggtccatttcggaacgccgacggcgagatgtgcttcagacacgagctcactcatccttcacacagacttccacagcagggagagaaacccgcccagtgtactccatgtgggaaacgcagtctccccgtcgactccactcaagctcgccgctgtcaacactcccgagaaggaccagcatcctggagggaggggaggggagctagttctagcgtgcactcaggccagaaacccggttccagactcccccaggaggggaactcccaccaagagggagataccgaagcactacagcatggggcagaaggaccatgctcatgtagcgagtgcggggagagatcccccatgagcgcaagactggcgtccccttgcagagcccacaccggagaaaaacccttccagtgtgcccactgcaccaagagattcaggcttcgccgcctccttcaggtccaccagcacgcccatggtggcgagaccgtgctgctccaggaggtctggcagggactccgtcaggcggtttag

SEQ ID NO: 14756 - DNA, 1152 bp, Artificial Sequence
  Description of Artificial Sequence: Synthetic coding sequence
atggaattgcgcgaggaggcttggtcccccgggccactcgattctgaggatcagcaaatggcatcccacgaaaacccagttgatatcctgattatggacgatgacgatgtcccatcctggccaccaaccaaacttagtccaccacagagtgcgcccccagcaggaccacctccaagaccacggcccccagccccttatatctgtaacgagtgtgggaagtctttctcgcactggagcaaactgacacggcaccagcggactcacactggtgagcgccccaacgcctgcgctgattgtggtaaaaccttttcacaatcctcccatctcgtccaacaccgaaggatccatactggggagaaaccctatgcatgcctggaatgtggcaagcgcttctcctggagctcgaatcttatgcaacatcagcggatccataccggggagaagccctatacgtgtcccgactgtggcagatcattcacccaaagcaagtcgctcgctaaacaccggcgatcccattccggattaaaaccgtttgtctgcccccggtgcgggcgcggattctcgcagcccaaaagcctcgctaggcacctaaggctgcatcccgaactctctggcccaggcgtggccgccaaggtcttggctgccagcgtccggagagccaagggccccgaggaggctgtggcagcagacggggaaatcgctatccccgtgggtgatggcgagggaatcattgtggtgggtgcacctggagagggggccgcggccgccgcagccatggctggggcgggcgcaaaagccgctgggccccgatcccgccgcgctccagctccaaagccgtacgtttgtctcgaatgcggaaagggcttcggccacggagcagggttactggcccaccagagagcacaacacggagacggcttaggcgccgcagggggagaggagccagcacacatttgtgtggagtgtggggagggctttgtgcagggtgctgcgcttagacgccataaaaagattcacgctgtcggtgccccctcggtctgcagcagctgcggtcagtcatactaccgcgccggtggcgaggaggaagatgacgatgacgacgaggcagcaggaggccgctgccccgagtgtcggggcggcgagggtaggtag

SEQ ID NO: 14757 - DNA, 1848 bp, Artificial Sequence
  Description of Artificial Sequence: Synthetic coding sequence
atgaacgtgcggatcctgcgccgccaccttgtgttccctttcattttcattgtgatcaaggagctgactctggaaggaactccaatgaacgtcaataatctggagaaccctctcgatgccccacagaatttcaagtgtatgcaaggtctgtctgtcgagaagccgtataaatgtaaaaaatgcgagaaggcatttaataatctctccagcttccaaatacacgagagaatgcatcgcggcggaaagtaccatgcttgtaaaggtagtggtaatacttacagattttcaggcttttaccatagacacaaaatgcctcacgctggaggtaagttctatggctgcaaaaagtgtggcaaggctttcatcagcttctgtgcctttagataccaccagagaactcatacaaaggaaaagccatatgcttgcaaacaatgcgggaaagcatatatcagctacactagcttccaatatcaccagctgaatcacaccggcgctaagtgctacgagtgcaagcaatgtggcaaggggtttgacctgcccaattcgattaggtaccacgagatgactcatacaggggaaaagccacatgagtgtaaacagtgtggcaaaacctttaggtgtgcaagcagtttgaggatccatggcaggactcacaccggcgaaaaaccttacgagtgcaaacagtgtgggaaggttagcaggtattggtccggcctccaggttcatgaagtgactcacatcggaaagaagctatatgagtgtaaggagtgcggtaagtcatattactcctcgggctcatttctcaaccacaaaaggatccatacacgggaaaaatcttacgaatgcaaagagtgcggaaaggccttcgggaaccccatcagcttccagaaacatgagggatcacacagaaagtggaaaccttatgaatgtaaggagtgtggcaaagtgttctcattctcatctagcttacgaagacatgaacgcacccatacagaaaagctgtgcgagtgtaaacagcacggtaaaggattttttcataggtcctgccctagacacatgaagatcgatacgggagagattcttcacaaacgtaagatccggggcaaagtgtttcattccccctctagctttcagacctgtgaacggagccacacaagggagaaacggtataagtgtaaacagtgtgggaaaccattcatctactttaacgcgttccagcgccaccaaagaagccatacgggtgaaaacccttacgagtgcaaacagtgcggaaaggcctgtattagctcgaccgccttccaatgccgggaactgtctcacacaggtgcaaagcgatacaagtgtaaacaatgtgggaaaggcttcaacctcccatcgtccatccgctaccacgagatgacgcatactggggagaaaccatacgaatgcaagcagtgcggaagggccttccgctctgcttcccacctcaggactcacgagcgcacccatatcggggagaaaccctacgagtgcaaacagtgcggaaaagtgtataggtattggagcggcctgagaatccatgggctcacgcacattggtaaaaaaccttatgagtttaacgacagaggaaaaagtttctatagctctaatttctttttgaatcacaaacgggtgcatacgagggtcaaaacatatgagtgcaaagagtgtggtaaggccttcgacaaccctacttcgtttcaaaagcacgaggggagtcaccgcaaggggaagtcctacgagtgcaaggagtgcgggaaagtgttttctttctctcgttcctttcggagatacgaaagagctcacaccggggagaagccttgcgaatag

SEQ ID NO: 14758 - DNA, 780 bp, Artificial Sequence
  Description of Artificial Sequence: Synthetic coding sequence
aggtctcacactagggaaaagaggtacaagtgtaagcagtgcgggaagccattcatctacttcaatgccttccaacggcatcagagatcccataccggcgaaaatccatacgagtgcaaacagtgcggcaaagcttgcatttcaagcactgcctttcaatgccgagaactgtcgcacaccggagctaagcgctataaatgcaagcagtgtggaaaaggattcaacttgccatcctctatccggtatcatgagatgactcacactggcgagaagccttacgagtgtaagcagtgcgggagggcttttcggtccgcgtcgcacttaaggacccacgagcgtactcacattggcgagaaaccttatgagtgtaagcaatgtggcaaagtttatcgctactggagtggcctgagaattcatggtctgacacatatcgggaaaaaaccctacgaatgtaaagagtgcgggaaagcttttgataacccaacaagcttccagaagcatgaaggaagccatcgcaaagggaaatcctatgagtgcaaagagtgtggcaaggttttctcctttagccgttctttccggcgacatggaaggatgcacacgggggaaaagccatacgagtgcaaaaactgcggtaaggcattcaccagtgccaagtcactgcaaaatcacggacggacccacactggtgaaaaaccgtgcgaatgcaaacagtgcggcaaagcctttatatgctcatcttcttgtcagaggcatgaggagacccactccgtgaacatgtag

SEQ ID NO: 14759 - DNA, 1278 bp, Artificial Sequence
  Description of Artificial Sequence: Synthetic coding sequence
atgttccccccagccagagggaaggagttgctctcttttgaggacgtagccatgtacttcacacgagaagaatggggccacttgaactgggggcaaaaggatctctatagggacgtgatgctggagaactaccgaaatatggttctgttaggatttcaattccctaagccagagatgatatgtcagctggaaaactgggacgagcaatggatcctagacctccctagaaccggcaaccggaaggcatcgggcagcgcgtgcccgggaagcgaagctcgccacaaaatgaagaaactgactcctaagcagaaattttcagaggatcttgagagttacaaaatttccgtggtgatgcaggagagtgccgagaagctgtcggagaagctccataagtgcaaggagtttgtcgacagttgccgacttacattccccacatccggagatgagtactcccgaggctttttacagaacttgaatctgatccaggaccaaaacgcccagacacgctggaagcagggtcgctacgatgaggatggaaagccattcaaccagaggagcctcctactgggacacgagaggatcctcacacgggcaaagtcatatgagtgcagtgaatgcgggaaggtgatcagaaggaaagcttggtttgatcaacatcagcgaatacactttctggagaatcccttcgaatgcaaggtgtgcggccaggcatttcgacaaaggagtgccctcaccgtgcataaacagtgccacctgcagaacaagccatatcggtgccatgactgcggcaagtgctttagacaattagcatacctagtggagcacaagagaatccacacgaaagaaaaaccatacaagtgtagcaagtgcgagaagacattttcccaaaactccacccttattcggcaccaggtaattcacagtggggagaaaagacacaaatgtctggagtgtggaaaggcttttggccgccattctacactgctctgtcatcaacagatccacagcaaacctaacacacacaaatgttccgagtgtggacagagcttcggacgcaacgtggacctcattcagcaccagcgcatacatacaaaagaagaattcttccagtgcggggagtgtggcaagacgttctcgttcaagcgaaacctcttcagacatcaggtgatacacacaggctcccagccctatcagtgtgttatatgcgggaagagctttaaatggcatacctcattcatcaaacaccaaggcacacacaaagggcagatctcaacctag

SEQ ID NO: 14760 - DNA, 189 bp, Artificial Sequence
  Description of Artificial Sequence: Synthetic coding sequence
atgtttccgcctgcgcgtggcaaggagctacttagcttcgaggatgtggctatgtactttacgcgggaagaatggggacacctgaactggggccagaaggatctctatcgagatgtaatgctggagaactatagaaatatggtcctgttggtttactttcagtttgacgcagctatcccgttatgctag

SEQ ID NO: 14761 - DNA, 1911 bp, Artificial Sequence
  Description of Artificial Sequence: Synthetic coding sequence
atggcccacctcatgatgtttagggatgttgctgtcgatttttcacaagaggaatgggaatgcttagatctggaacagcgcgatttatacagggatgtgatgctggaaaattactcaaacatggtaagtctcgggttttgtatctatcaacctgaggcctttagcctgcttgaaaagggcaaagagccttggaagattctccgggacgagacacgcggtccctgccctgacatgcagtctaggtgtcagacaaaaaagctcctccccaaaaatggaatttttgagagagagatcgcacagctggagatcatgcgcatttgcaaaaatcactctctggattgcctttgctttagaggcgactgggaagggaatacacagtttcagactcttcaggataaccaggaagagtgcttcaaacaagttatcaggacatgcgaaaaacgcccaaccttcaaccagcacaccgtcttcaatctccatcagcgtcttaatacgggggataaactgaacgagttcaaggagcttggcaaggcgttcattagcggatcagaccatacacagcaccagctcattcatacctcggagaagttctgtggggacaaggagtgtggcaacacttttctgcctgatagcgaggtcatacaataccagaccgtccacacagtgaagaaaacatacgagtgtaaggaatgcggcaaaagcttcagcctgagaagtagtttgactgggcacaagaggattcatacgggcgaaaagcctttcaaatgcaaggattgcgggaaggccttccgttttcatagtcaactcagcgtgcataagagaatccatacaggagagaagtcttacgagtgtaaagaatgtggaaaggccttcagttgcgggtcggatctgacaaggcaccagcggattcacactggagaaaaaccttatgaatgcaacgaatgcaggaaagcattttcccagcgctctcatcttattaagcatcaacgcattcacacaggagaaaagccatacgagtgcaaagaatgtgggaaggcctttacaaggggatcgcacctcacacagcaccagaggatccacacaggagaaaaatctcacgaatgcaaggagtgtggaaaagcctttatacgagggtcaaatttagctcagcaccagaacgttcatgtgggcagaaaaccctacaaatgcgaaaagtgcggcaaagcttacatttggagctctcaccttgccaggcatcagcggattcacacgggcagaaaaccttacgaatgtaagcagtgcggcaagacattcacttgggcatcatacctcgcacagcatgagaagatccataacgagagaaaatcttatgaatgtaaggaatgcggcaaaaccttcctgcatggttctgagtttaaccggcatcaaaaaatccacactggcgaacggaattacgagtgcaaggaatgtggcaaaactttttttaggggttccgagcttaacaggcaccaaaagatacataccggcaaacggccgtacgaatgcgaggaatgtggtaaggccttcctgtgggggagccaattaactcgccaccaacgtatgcatacaggggaggagccatatgtttgcaaagagtgtggtaagtcttttatctggggttcacagctgaccaggcacaaaaaaatacatactgacgcagagccctacggctgcaaaaagtcctctcatatcttcagccaccattcctacttcaccgagcaaaaaattcacaacagcgcaaatctttgtgagtggactgactacggcaacacttttagccatgagtccaacttcgcccagcaccagaatatttacaccttcgagaagagttacgagttcaaagatttcgaaaaagcattttcttccagtagccacttcatatctctgctctag

SEQ ID NO: 14762 - DNA, 408 bp, Artificial Sequence
  Description of Artificial Sequence: Synthetic coding sequence
atggctcacctgatgatgtttcgcgacgtcgccgtggacttcagccaggaagagtgggaatgcctggacctggagcagcgagatctgtaccgggacgtaatgttggagaactactcaaatatggtttccttagggttttgcatctaccagcccgaagccttcagcctgctcgagaaagggaaagagccctggaagatcctgcgggacgagactcggggaccgtgtcctgacatgcagtctcgatgtcagaccaagaaactgcttcccaagaacggcatctttgaacgggaaattgctcagctggaaattatgcggatctgtaagaaccactcgctggactgtttatgtttcagaggcgactgggaaggaaacacacagttccagactctccaagacaaccaggaatag

SEQ ID NO: 14763 - DNA, 150 bp, Artificial Sequence
  Description of Artificial Sequence: Synthetic coding sequence
atggcacacctgatgatgtttcgggatgtggcggtggatttcagccaggaggaatgggaatgcttagacctcgagcaacgggacctctaccgggacgtgatgctggagaattactcaaatatggtgtctctgggcttctgcatttactag

SEQ ID NO: 14764 - DNA, 540 bp, Artificial Sequence
  Description of Artificial Sequence: Synthetic coding sequence
atggcgcatttgatgatgttccgagacgtcgcagtggacttctcccaggaggagtgggagtgcctggaccttgagcaacgcgatttgtaccgcgacgtcatgctcgagaattacagcaacatggttagcttgggcttttgtatttatcagcccgaggcattctccctcctggagaagggcaaagagccatggaagatcctgcgtgatgaaacaaggggtccttgtcccgatatgcaaagcagatgccaaaccaagaaattgctgcctaagaatggtatttttgagcgtgagattgcacagctggaaattatgcggatctgcaagaatcattctctggactgcctttgcttccgcggggattgggagggaaacacccagtttcaaacacttcaggataaccaggaggagtgtttcaaacaagtgatccgtacatgcgagaagcggcctactttcaatcagcacacagtcttcaatctgcaccagaggttgaataccggtgataaactcaacgagtttaaagagctcgggaaggcattctag

SEQ ID NO: 14765 - DNA, 1731 bp, Artificial Sequence
  Description of Artificial Sequence: Synthetic coding sequence
atggactcggtcgcgtttgaagatgtctcagtctcattctctcaggaggaatgggcccttctggccccaagccagaagaagttgtatcgggatgtgatgcaggaaacattcaagaatctggcctccataggggaaaaatgggaagaccccaacgtagaagaccagcacaagaatcaggggaggaatctccggtctcacaccggtgagcggctgtgtgaaggcaaggagggatcccagtgtgctgaaaatttctccccgaatctgagcgtcacaaagaagacagctggcgtcaagccctatgagtgcaccatctgtggcaaggcctttatgagactgtcttccctgactcgtcacatgcgatcccacacaggatacgaactctttgagaaaccctacaaatgtaaagagtgcgagaaggccttctcctatttaaagagttttcagcgacacgagaggagtcacacaggagaaaagccttataaatgtaagcagtgcggaaaaactttcatctaccaccagccctttcagagacatgaaaggacccatatcggtgagaaaccctatgaatgtaagcagtgcggtaaagcccttagttgctctagtagtctccgagtacatgagcgaatccatacaggcgaaaagccatacgaatgcaagcagtgcgggaaggcgttcagttgcagctcgtctattcgggtgcacgagcggactcatacaggtgaaaaaccttatgcatgcaaggaatgtggcaaagctttcatcagtcacacctctgttttaacccatatgattacgcacaatggcgaccggccctataagtgtaaagagtgcggcaaggcttttatcttcccaagctttttaagggtacacgagagaatccatacaggcgaaaagccttacaagtgtaagcagtgtggaaaggccttcagatgctcgacttcgatccaaattcatgagagaattcacacaggtgagaagccctacaagtgtaaggagtgcggtaaatcattcagcgccaggccagctttccgagtccatgttcgcgttcacacaggggagaagccctataagtgcaaggaatgtggaaaggcattttccagaatatcttactttcgcatccacgagagaacacacaccggcgagaagccctacgagtgcaaaaaatgcggaaaaactttcaactaccccttggacctaaaaattcacaagagaaaccacaccggcgagaagccctacgagtgcaaagagtgtgcgaagacgtttatcagtctggagaattttaggaggcatatgataacgcacacaggcgacggaccttacaaatgtagagactgcgggaaagtctttatttttccatccgccctgagaacccatgagagaacacacaccggtgagaagccgtacgagtgcaaacagtgcggcaaagcctttagctgttcctcctacattcgcattcacaagaggacccatacgggggaaaaaccctacgagtgtaaagagtgcggaaaggctttcatatatccaacatctttccaaggtcatatgcgcatgcataccggcgagaagccatacaagtgtaaggagtgcggaaaagcatttagtctccatagcagcttccagcggcatacccgtatccacaattacgagaaaccccttgagtgcaaacagtgtggaaaagccttcagtgtgtctactagtttgaagaagcatatgagaatgcacaacaggtag

SEQ ID NO: 14766 - DNA, 1434 bp, Artificial Sequence
  Description of Artificial Sequence: Synthetic coding sequence
atggatagcgttgcatttgaggacgttagcgtttcatttagccaggaggagtgggctcttctcgccccgagccagaagaagttgtaccgggacgtgatgcaagaaactttcaagaacctggcctctatcggagaaaaatgggaggatcctaacgtcgaggaccagcacaagaatcagggtcgcaatttaagaagccatacgggtgagagattgtgtgaagggaaggaaggctctcagtgtgcggaaaactttagtcctaacttatctgtaacaaagaagaccgccggtgtcaagccatatgaatgcacaatttgcggaaaagccttcatgcgccttagttcgcttacacgccacatgcggagtcacacagggtacgagctctttgagaagccttacaagtgtaaggagagcggagagaaaccctacaaatgcaaacagtgcggtaagacgtttatttatcatcagcccttccaaagacatgaaagaacccatataggagaaaaaccttatgaatgcaagcagtgtggcaaggctttgagctgcagctcttcactgcgcgtgcacgagcgcattcacactggggagaagccctatgaatgtaagcagtgcggcaaggcattcagttgctcatccagcatcagagtacatgaaagaactcacaccggggagaaaccttacgcctgtaaggagtgcggaaaggcctttatcagccatacatctgttctcacgcatatgattacgcataacggtgatagaccctacaagtgtaaagaatgcggcaaagcgttcatctttccaagtttcttgagggtgcatgagaggatccacaccggggaaaagccttataagtgcaagcaatgtggaaaggctttcagatgttccaccagcatccaaatccacgagcgaattcacactggcgaaaagccatacaagtgcaaagagtgcggtaagtccttcagcgccagaccagctttccgggtccatgtgcgagtgcacacaggagaaaagccttacaagtgtaaggagtgcgggaaagccttctccaggatttcctacttcaggatccacgagcggactcacaccggtgaaaagccttatgagtgtaagaagtgtggtaagaccttcaactaccctctcgatctgaagattcacaagaggaatcacactggcgagaagccatacgagtgcaaagattgtggaaaagtgttcatatttccctcagccctacgcactcacgagcgaacccacaccggtgagaaaccctacgagtgtaaacagtgcggaaaggcctttagctgtagttcttatatcagaattcacaagcggacacacaccggggagaaaccatacgaatgtaaagaatgcggaaaagcgttcatctatcccacatcatttcagggccatatgcggatgcacactggagaaaagccatag

SEQ ID NO: 14767 - DNA, 1635 bp, Artificial Sequence
  Description of Artificial Sequence: Synthetic coding sequence
atgcaggagacctttaagaatctggcctcaatcggcgagaaatgggaagatccaaatgtggaggaccagcacaagaaccaaggcaggaatctgcggtcccatacaggcgaacgcctttgcgaaggcaaggaaggtagccagtgcgccgagaatttctctcccaacctgagtgtgactaaaaaaaccgctggcgtgaaaccgtacgagtgtacgatctgtggcaaggcatttatgaggctctcgtccctcacccggcacatgcgctcgcacaccggttacgaattgtttgaaaaaccgtacaaatgcaaggaatgcgagaaggcgtttagttatctgaagtctttccagcggcacgaaagaagccacacgggtgaaaaaccctacaagtgtaagcaatgtggaaagacctttatctatcaccagccttttcagcgccatgagcgcacccacatcggggaaaaaccatacgagtgcaagcaatgtggcaaagctcttagctgttcatcgagcctccgggtccacgagagaattcatactggcgaaaagccgtatgagtgtaagcagtgcggaaaggcattctcatgtagttcatctatacgggttcacgagaggactcacaccggggaaaagccttacgcgtgcaaggagtgcgggaaagcgtttatttctcatacatccgttctcacccatatgatcacccacaatggggaccgtccatacaagtgtaaagaatgtgggaaggcctttatcttccccagtttccttcgggtccatgaaaggattcataccggcgaaaagccttacaaatgcaaacaatgcggcaaggccttcagatgctccactagcattcaaattcacgagcgtatccataccggagaaaaaccctacaagtgcaaagaatgtggaaaaagcttctccgcccgcccagccttcagagtccatgttcgcgttcatactggcgagaagccttataagtgtaaagagtgcggaaaggcgtttagtcgcatcagttactttcggattcatgagaggacacacaccggagaaaaaccttatgagtgcaaaaagtgtggcaaaaccttcaattatcccttggatctgaagatccataaaaggaaccacactggggaaaagccctacgaatgcaaagaatgcgcgaaaacatttatcagcctcgagaacttccgccgtcatatgatcactcacactggagatggcccttacaagtgccgtgattgcggcaaggtgttcatctttccgagtgccctgagaacccatgaaaggacacacacaggggaaaaaccctatgagtgtaaacagtgcggaaaagctttctcctgttctagttacatccgtattcacaaacgtacacacacaggtgaaaagccttatgagtgcaaggaatgcggcaaggcatttatttaccccaccagctttcaggggcacatgcgaatgcatactggagagaaaccttataagtgcaaagaatgcggaaaagccttctcgctgcacagcagttttcagagacacacaagaatccataactatgagaagcccctggagtgcaagcaatgtggcaaagcattctcagtgagcacgagtttaaagaagcacatgcggatgcacaatcgttag

SEQ ID NO: 14768 - DNA, 1404 bp, Artificial Sequence
  Description of Artificial Sequence: Synthetic coding sequence
atgagactgtcttccctgacgcgccacatgaggtcccacacaggatacgaactctttgagaaaccttataaatgtaaagaatgtgaaaaggccttcagttacctcaaaagcttccagaggcatgagcgcagccatacaggcgaaaagccctacaagtgtaaacaatgcggcaaaacgtttatatatcatcagcccttccagcgacacgaaagaacccacataggtgagaaaccttatgagtgtaagcagtgtggaaaggcattgagctgcagctcttcgctgcgcgtgcatgaacgcatccatacgggcgaaaaaccctacgagtgcaaacagtgtggaaaggccttttcttgcagctcatccatcagggtgcacgagcgcactcacactggcgagaagccttacgcctgcaaggagtgcggtaaggcatttatcagccacacatcagtcctgactcatatgattacgcacaacggcgatcgaccttacaagtgtaaagagtgcggtaaggctttcatttttccctcatttctccgcgtgcacgaaagaatacacacgggggaaaagccgtacaaatgtaaacagtgcggtaaggcattccgctgtagcacgtccatacaaatccacgagcgaatccatacgggggaaaaaccatataagtgtaaggagtgcgggaagtctttcagcgcacgcccagctttccgcgtgcacgttcgggtacacacaggagagaagccctacaagtgtaaggagtgtggcaaagccttcagtcgtattagctacttcagaattcatgaacggacccataccggagaaaaaccttacgaatgcaaaaagtgtggtaaaacttttaactaccccctggacttgaaaatccataagagaaatcacacaggggagaagccatacgagtgcaaggagtgtgctaagacattcatcagtttggagaatttccggcgacacatgattactcatacgggcgatggaccttataagtgcagagactgcggaaaggtttttatattcccgtcggcactgcgaacgcacgagaggacgcacacaggagaaaagccctatgaatgcaagcagtgcgggaaggctttttcttgcagtagctatatccggattcacaagaggacacatactggcgagaagccttacgagtgtaaagaatgcggcaaggctttcatttatcccacatcttttcagggacatatgcggatgcacactggcgagaaaccgtacaaatgcaaagagtgtggaaaggcctttagcctccactcatcgtttcagagacacacccggatccataattacgaaaaacctctggagtgtaagcaatgtgggaaagccttcagcgtcagcacatccctcaagaaacacatgcgaatgcataacaggtag

SEQ ID NO: 14769 - DNA, 1035 bp, Artificial Sequence
  Description of Artificial Sequence: Synthetic coding sequence
ctcgctgagcaccagaccacccatccgcggcagaaaccctttgtgtgtgaggaaagcggtgatgcattcaataacaagagcactctggtacagcaccaacgaatacatagccgcgaacgtccttatgagtgttctaagtgcggcattttcttcacctatgctgcagacctaacgcagcatcagaaagttcacaaccggggcaagccgtacgaatgctgtgagtgcggcaaattcttctcacagcattcctctctagtgaagcatcgccgagtccatacgggcgagtccccacatgtgtgcggagactgcggcaaatttttctcaaggtcttccaatttaattcagcacaaaagagttcatacaggggaaaagccttacgagtgttccgactgcgggaaattttttagtcagagatccaacctgatccatcacaagcgggtccacaccggacggtctgcccatgaatgttctgaatgtggcaaatcttttaactgtaacagctcattaatcaagcactggcgggtacatactggtgagcgaccatataagtgcaatgaatgtggcaagttctttagccatatcgccagtctgatccagcaccagatagtgcatactggggaaagacctcacggctgcggggagtgtggaaaagcttttagcagaagttcggacttgatgaagcatcagagggtgcacacgggggagagaccctacgagtgcaacgaatgtggaaagttattttctcagtctagctctttgaattcacacagacgcttgcatacaggcgagcggccttaccagtgctctgagtgcggcaaattcttcaaccaatcctccagcctcaataatcatagaagattgcatacaggggagcgaccttacgagtgctcagagtgtggtaagacgtttagacagcgctccaatttgaggcagcacctcaaggttcacaaaccagatcgaccctacgagtgctctgaatgcgggaaggcgttcaaccagcgccccacactgatacgtcaccaaaaaattcactag

SEQ ID NO: 14770 - DNA, 1899 bp, Artificial Sequence
  Description of Artificial Sequence: Synthetic coding sequence
atggcggctgccgcattaagagatcccgctcaaggctgtgtgacattcgaagacgtgacaatctatttcagccaggaagaatgggtgttattggatgaagcccagcggctgttgtattgtgacgtcatgctcgagaacttcgccttgattgctagcttggggcttattagtttccgaagccacattgttagccagctcgaaatgggcaaggagccttgggttcctgattccgttgacatgacctccgcaatggcaagaggagcttatggccggcccgggtccgacttttgtcacggcaccgagggaaaggatctcccatctgagcacaacgtgtccgttgagggcgtagctcaggacagaagcccggaagctaccctctgcccccaaaaaacctgtccttgcgatatctgcggcctccgcctcaaggatatactgcatctcgctgagcatcagactacgcatcctagacagaaaccgttcgtgtgcgaggcatatgtgaagggttccgagttctccgcgaacctacccaggaaacaggtccaacaaaacgtgcacaatcccatcagaacagaggaggggcaggccagcccagtgaaaacatgtcgcgaccacacatccgatcagctgagcacatgtagggaggggggaaaggatttcgtggccacagcaggatttttgcagtgcgaggtgacacccagcgacggcgaaccacacgaggccactgaaggtgtggtcgactttcacattgcacttagacacaacaaatgttgtgaatctggcgatgcttttaataataaatccacactggtccagcaccagcgcattcatagcagggagaggccttacgagtgcagcaagtgtggcatctttttcacctacgccgctgacctgacccagcaccaaaaggttcataatagaggcaaaccatatgagtgttgcgaatgtgggaaatttttcagtcagcactccagcctggtgaaacaccgacgggtccacaccggggaatccccacacgtgtgtggagattgtggcaagtttttcagtcgatcctctaacctgatccagcacaagagagtgcataccggggaaaagccctacgaatgttcggactgtggcaaattctttagtcagaggtccaatctgattcaccacaaacgagtacacacaggccgttcagctcacgagtgctcagaatgcgggaagtccttcaattgcaattcatccttgattaaacactggcgggtgcacacaggagagaggccctacaagtgtaacgaatgcggaaagtttttctcacatatcgcctcattaatccagcaccaaatcgtgcacactggagagcgcccccacggctgcggagagtgcggtaaggccttctccaggagttctgacctcatgaaacaccagcgggttcacacaggcgagcggccctatgagtgtaatgaatgtggcaaactcttttctcaatcgagctccctcaactctcataggcggctgcacacgggcgagaggccttatcaatgctctgaatgtggaaaattttttaaccagagctcctcactcaataaccataggaggttgcacacgggcgaacgcccatacgagtgtagtgagtgcggcaagaccttcaggcagaggtcaaacctgcgccagcaccttaaggttcataagccggaccgtccatatgaatgcagtgaatgcgggaaggcgttcaaccagaggcctactctgatccgccatcagaaaattcacatccgcgaacgttctatggaaaacgtcttgttgccctgcagccaacacacccctgagatttccagtgagaaccgcccctatcagggcgcggtgaactataaacttaagttagtgcatcccagcacccatcctggcgaggttccctag

SEQ ID NO: 14771 - DNA, 1836 bp, Artificial Sequence
  Description of Artificial Sequence: Synthetic coding sequence
atgcaggagactatcagaaatttggattgtgtagggatgaaatggaaggatcagaacatagaggatcagtaccgttatccccgcaagaacctcaggtgtcgtatgctggagagattcgtagaatcaaaggatggcacgcagtgtggggagacaagttcacagatacaagactctattgtcactaaaaatactctgccaggcgttggcccttatgagagcagaatgtctggggaggtcatcatgggccacagttccctgaactgctatatcagagtcggggcgggtcataaaccatatgaataccatgaatgtggggagaaacccgatactcacaagcaacggggaaaggccttctcgtaccataacagtctgcagactcacgaaagacttcacactggcaagaaaccatataattgcaaggaatgcgggaagtctttcagctctttgggaaacctacagcgccacatggccgtccagcggggcgatgggccatataaatgcaagctctgtggtaaagccttcttttggccttccctgctccatatgcacgagcgcacacataccggcgaaaagccctacgaatgcaaacagtgttctaaggccttcagcttctactccagctatttgcggcacgagaggactcataccggcgaaaagctgtacgagtgtaaacaatgttctaaagccttcccagattactcctcttgcctgaggcatgagcggactcatacagggaaaaagccatacacatgcaaacagtgtggcaaggcgtttagtgcctcaacttcgttgcgtaggcacgaaacaacgcataccgacgagaaaccatacgcctgccagcagtgtggaaaagcattccatcaccttggcagtttccagcgccacatggtgatgcacacacgggatgggccccacaagtgtaaaatctgcggtaagggtttcgactgtcctagctcgctcaagtcacatgaacgcactcatactggtgaaaagctatacgaatgtaagcaatgcggcaaagccctctcccattccagttccttccgacgccatatgacaatgcacaccggtgatggaccgcacaaatgcaaaatttgtgggaaagccttcgtctaccctagcgtgtttcagagacatgagaagactcacacggccgagaagccatacaaatgtaagcagtgcggtaaagcataccgcatatcaagctcgcttagacgccatgagacgacccacaccggggagaagccttataaatgcaaatgtggcaaggcctttattgacttttacagtttccagaatcacaaaaccacacacgcgggcgaaaagccctacgagtgtaaagagtgtggcaaagctttttcatgctttcagtatctgtcccaacaccgtcgaacccacacgggcgaaaaaccctatgagtgcaacacttgcaagaaagccttctcacattttggcaatctgaaggtgcatgagcggatccattctggagaaaagccatatgaatgtaaagagtgtggtaaggcattcagctggctaacttgtttcctgcggcatgagagaatccatatgagagaaaaaccctatgagtgtcagcagtgtggtaaagcttttacacactccaggttcctgcaggggcacgaaaagactcatactggggaaaacccttatgagtgcaaagaatgcggtaaggctttcgccagtcttagtagccttcaccgtcacaagaagacgcactggaagaagactcatactggggagaatccttatggctgtaaagagtgcggcaaggccttcgcatcacttagcagcctgcatcggcataaaaaaacccattag

SEQ ID NO: 14772 - DNA, 1932 bp, Artificial Sequence
  Description of Artificial Sequence: Synthetic coding sequence
atggcgtcagttgccctcgaggatgtggccgtgaactttacgagagaggaatgggcgctgctcggcccctgtcaaaagaatctgtacaaggatgtcatgcaggaaaccatccggaatcttgactgcgtcggtatgaagtggaaagatcagaatattgaagaccaatatagatatccaagaaagaatctaagatgtcgaatgctggaacgtttcgtcgaaagtaaagatgggactcaatgtggcgagacaagttcccagatccaggactctatcgtcacaaaaaatacactccccggcgtgggtccatacgaaagcagaatgagtggtgaggtgatcatgggccattcatcactgaactgctatatacgtgttggcgctggccacaaaccctatgaatatcacgagtgtggggagaagccagacacccacaagcagcgaggaaaggccttctcttaccataactctctacagactcacgagcggcttcatactgggaaaaagccatacaactgtaaagagtgtggtaaaagcttctcctctctggggaacttgcagcgtcatatggctgttcagcggggcgacgggccatacaaatgcaagctttgcggcaaggcgttcttctggccttcattgctgcacatgcacgaaagaacacatacgggcgagaagccatatgaatgcaagcagtgttctaaagccttctctttttattccagctatctgcgtcatgagaggactcataccggggagaagttatacgagtgcaagcagtgttcaaaagcttttcccgactatagttcttgcctgcgccatgagcgcacccacactggcaaaaagccttatacttgcaaacaatgtgggaaagctttctcggcctcaacatccctacgaagacacgagaccactcataccgacgagaaaccttacgcgtgtcagcagtgcggaaaagcctttcaccacctcgggtcattccagcgccacatggtgatgcacacacgggacgggccccacaaatgcaagatttgcggaaaaggctttgactgcccctcctcactgaagagccacgaaaggacccacacaggcgaaaagctgtacgagtgcaaacagtgtggcaaagctctgtctcactcgtctagcttcaggcgccacatgacgatgcacactggcgatggcccccataagtgtaagatttgtggcaaggcattcgtatacccatctgtgttccaaaggcacgagaaaacacataccgccgaaaagccctacaagtgtaaacagtgcggtaaggcgtaccggatctcgtcctcgcttcgtagacacgaaacaacacacaccggagagaagccttacaaatgtaagtgtggcaaggcctttatagacttttacagctttcagaatcataaaacgacgcacgcaggagagaagccttacgagtgcaaggagtgtggcaaagctttcagttgcttccagtatttgagccagcacaggcgtactcacacaggagagaagccatatgaatgcaatacctgtaagaaggccttcagccattttgggaacctgaaggtgcatgagagaattcactctggcgagaagccatacgagtgcaaggagtgtggcaaagcattctcatggctgacatgcttcctgaggcatgagaggatccacatgagagaaaaaccttatgagtgccaacaatgtggaaaagcttttactcactccagattcttgcaaggtcacgagaaaacccacaccggagaaaacccctacgaatgcaaagagtgtggtaaagcttttgccagcctgtcttcccttcaccgtcacaagaagactcattggaaaaaaacccacaccggcgaaaatccatacggctgcaaggaatgtggaaaggcattcgctagtctgagcagtctgcacagacacaaaaaaacacattag

SEQ ID NO: 14773 - DNA, 1995 bp, Artificial Sequence
  Description of Artificial Sequence: Synthetic coding sequence
atgccactgagggacaaatactgccagaccgatcaccatcaccacggatgctgtgagcccgtttatatcctcgagcccggtgatcccccactgcttcagcagcctctgcagaccagtaaatccggaatccagcaaatcatagaatgcttccgcagtggcaccaagcaattgaaacatattctcttgaaggatgtcgacacaatcttcgagtgtaaactctgccgctccttgttccgcggactgcccaacctgattactcacaaaaagttttattgcccgcctagtttacagatggatgataatctgccggacgtgaacgacaaacagtcccaggcaataaatgacctcctggaggctatctacccaagcgtggataagagagagtacatcatcaaactcgagccaatcgaaacaaaccagaatgctgtgtttcagtatatttccagaacagataatcctattgaggtgacagaaagtagttccacgccggagcagaccgaggtccagattcaggaaacctctaccgaacaaagcaagaccgtccccgtgactgatactgaggttgaaactgtcgaaccaccgccagtagagattgtgactgacgaggtggcgccaacatccgacgagcagccgcaggaatcccaggccgacttagagacttcggataactcggatttcgggcatcagctgatctgttgcctctgtcgtaaagagttcaatagtagacgaggcgtccggagacacatccgaaaagtgcacaaaaaaaaaatggaagagctaaaaaagtacatagagacaagaaaaaaccctaaccaatcctctaagggtcgttccaagaacgtgcttgtaccattatcgcgatcctgccccgtatgctgtaaatcattcgcgactaaggccaacgtccgcagacattttgatgaagtccatcgaggtctgaggcgcgacagtatcaccccagatatcgctaccaagccaggacagccactttttctggactctatttccccgaaaaagtcttttaaaacaaggaaacaaaaatccagctctaaagcagagtacaacctgactgcatgtaaatgccttctttgcaagcggaagtattcgtcacaaatcatgctgaaaagacacatgcagatcgtacacaaaataactctgtccggcacgaatagtaaaagggagaaaggacccaacaatactgctaattcatctgaaatcaaggtcaaggtggaaccagccgattccgtggaaagctcacctccttctattacccattctccccagaatgagctcaagggcacaaatcatagcaacgagaaaaagaacactcccgctgctcagaaaaataaggtgaagcaggattctgaaagcccaaagagcacatctccttcggccgcgggaggtcaacaaaaaaccagaaaaccaaagctgtccgctggtttcgactttaagcagctatattgtaagctctgcaaacggcagttcacatccaagcagaacctaaccaagcatattgaacttcacaccgacgggaacaacatctacgtcaagttctacaagtgccctctgtgtacctatgaaacgcgtcgcaaacgggacgtgatcagacatattacagtggtgcacaagaagagctcacggtatctgggaaagatcactgcttccctcgagattagggcaatcaaaaagcctattgacttcgtcctgaataaagtagccaagcgtggccctagccgggatgaggcaaaacattcagactctaagcatgatgggacttctaacagccctagtaaaaaatatgaagtggctgatgttggaatcgaggtgaaggttaccaaaaattttagcctgcaccgttgcaacaagtgtgggaaagcgttcgccaaaaagacgtacttagaacaccacaagaagacacacaaggctaatgccagtaattcgccagagggtaacaagacaaaaggcagaagcacccggagtaaggctctggtgtag

SEQ ID NO: 14774 - DNA, 1995 bp, Artificial Sequence
  Description of Artificial Sequence: Synthetic coding sequence
atgcccctgagggataagtactgccagactgatcatcatcatcacggatgttgcgagcccgtgtatatcctggaacctggcgatcctccactcttacagcaacccctgcaaacaagcaaaagcggcatccagcagattatagagtgcttccgctctggcacgaagcagctgaaacatatcctgctgaaggacgtggacaccatcttcgaatgcaagctgtgccggagcctgtttcgcggactccctaacctgatcactcataaaaaattttattgtcctccatccctgcagatggatgacaacttgccggacgtcaatgacaagcagagccaggctatcaacgatttgcttgaagctatctatccaagtgtggacaagcgcgaatacatcatcaagctggaacccatcgagactaaccagaatgcagttttccaatatatttctagaacagacaaccctatcgaggttacggaatcctcgagcacacctgaacagactgaagtccaaatccaagagaccagcacagagcagtcgaaaactgtgccagttaccgatactgaggtggagacagttgaacctccacccgtggagattgtgacagacgaggttgccccaaccagcgatgaacagcctcaggaatcacaggctgacttagagacgtctgacaattcggattttgggcaccagctaatttgctgcctctgtagaaaagagttcaactccaggagaggagttcggcgccacattcggaaggtgcacaagaagaagatggaggaattaaaaaagtatatcgagaccaggaaaaaccctaatcagtcctcgaagggtcgatccaaaaatgtcttagtgcctctttcccgctcttgtccggtctgttgcaaaagtttcgccaccaaagctaacgtccggcggcacttcgacgaagtgcacagaggactgcgccgtgacagtattacacctgatatcgccacaaagcccggccagccactgttcctcgacagcatttcccccaaaaaaagcttcaaaactcggaagcagaaaagtagttctaaagcagagtacaacctcacagcttgtaaatgtcttctgtgcaaaagaaaatatagtagccagatcatgctgaagcgccacatgcagatcgttcacaagatcactctgtccgggacaaattccaaaagagagaaggggcctaacaacaccgcaaacagttctgagatcaaggtgaaagttgagccagcagattccgtggaatcatccccccctagcattacccatagtccacagaacgagctcaaagggaccaatcatagtaatgaaaagaagaatactcccgcagctcaaaagaataaagtgaaacaggactctgagtccccgaagtccacttccccctccgcggccggcgggcagcaaaagactaggaagccaaagctctctgcgggctttgactttaagcagctctactgtaaactttgcaagaggcagttcacatcaaagcaaaacctgactaagcacattgagctgcataccgatgggaacaatatctatgtgaaattttataagtgtccgctgtgcacctatgagactagacgtaaaagggatgtgatccgacatatcacagttgttcataagaagtccagtagatatctcggcaaaataacagcatctttggagatcagggcaatcaagaaaccaattgatttcgttctgaacaaagtcgccaagagaggccccagcagagacgaagccaagcactccgatagcaagcacgatgggacttctaactctccaagcaaaaaatacgaagttgccgatgtgggtatcgaagtgaaggtgaccaaaaattttagcctccatcggtgcaacaagtgtggtaaagcttttgcaaaaaaaacttatcttgaacaccataaaaaaacccacaaggctaatgcttcaaatagtcctgaagggaacaagactaagggtcggtccacgcgctctaaggcactcgtgtag

SEQ ID NO: 14775 - DNA, 1995 bp, Artificial Sequence
  Description of Artificial Sequence: Synthetic coding sequence
atgccattacgcgataaatattgccagacagatcaccatcatcatggttgctgcgaacctgtctatattcttgagcctggtgaccccccccttttacagcagccactccagacgtcaaagtcgggtatccagcagattatcgagtgcttccggtctggtacaaagcaactgaagcatattctattgaaagatgtggacactatcttcgaatgcaagttgtgccgctccctttttcgcgggctgccaaacctgatcactcacaaaaaattctattgccccccctcactgcagatggatgacaatctgcccgacgtcaacgacaagcagtctcaggcaataaatgatttactagaagccatatatccttcagtggacaaacgcgaatatattattaagctagaaccaatcgagacaaatcagaatgcagtgtttcagtatattagcaggacagataatccgatcgaggtgacagagtcaagcagcacccccgaacagacagaagttcagattcaagagacctctacggagcagtcaaagactgtcccagtcaccgatactgaggtcgaaactgttgaaccaccacccgttgaaatcgtcacggatgaggtcgcaccaacttcagacgagcaacctcaggagagccaggcagatctcgagactagtgacaactctgactttggtcatcagttaatttgttgcctgtgccggaaggaatttaacagccggaggggtgtgcggaggcacattagaaaggtacataagaagaaaatggaagaattaaagaaatatatcgaaaccagaaagaatccgaatcagagttccaagggccggagcaagaatgtactggtgccgttgagccgcagttgccctgtgtgctgtaagtccttcgccacaaaggctaatgtgcggcgccacttcgacgaagtgcatcgagggctccgccgggattccatcacccccgatatcgcgactaagcctgggcaaccactgtttctggattccatttcccctaagaagtcgtttaagacaagaaaacagaagtcatcttctaaagccgagtacaacctcaccgcgtgtaagtgtctgctgtgcaaacgcaagtactcttcccaaatcatgctcaagcgtcacatgcagatagtgcataagataacactgtccggtactaactccaaacgggaaaaaggacctaacaacaccgctaacagcagtgagataaaggtgaaggtagaaccagctgactctgtggaatcctctccacccagtatcacacacagcccccaaaacgagctgaagggaactaaccactccaacgagaagaagaatacgccggccgctcaaaaaaacaaggtgaagcaggactccgaatccccaaagtccacaagcccttctgccgccgggggacagcagaaaactagaaagcccaaactcagcgctggcttcgatttcaaacaactgtactgcaaattatgcaagcgtcagtttacatctaagcagaatctcaccaaacacatcgaattgcatacagacggaaacaacatttacgtcaagttttacaagtgccctttgtgtacctacgagactcggcggaagcgcgacgtgatccggcacattacagtagttcacaagaagtcttctaggtacctgggaaaaattacggcttctctggaaatacgggctatcaagaagcctatcgatttcgtgctgaataaggttgccaagcgcggaccatccagagacgaggcaaaacacagtgattcgaaacacgatggtacctctaactccccttctaaaaagtacgaggtggccgatgtggggatcgaagttaaggtgaccaaaaacttcagtctgcatcggtgcaataaatgtggtaaagcgtttgctaaaaaaacatatctcgagcaccacaagaaaactcataaggctaacgccagcaattccccagagggaaataagactaaaggacgatctactcggtcgaaagcccttgtctag

SEQ ID NO: 14776 - DNA, 729 bp, Artificial Sequence
  Description of Artificial Sequence: Synthetic coding sequence
atgcctctgagagataagtactgtcagacggaccaccaccaccatgggtgctgtgaaccagtgtatatcctggaacccggagatccccccttgctgcagcaacctctgcagacatccaaatcagggattcagcagattatcgaatgcttccggagcggtacaaagcaactgaagcacattctgctcaaggacgtcgatacaatttttgaatgtaagctgtgcaggtccctgtttcgggggttgccaaatcttatcactcacaagaagttttactgtcctccctcactgcagatggatgacaatcttcccgacgtgaatgataaacaaagtcaagccattaacgatctgctggaggccatttaccctagcgtggataaaagagagtacattatcaagttggagcctattgaaacaaaccagaatgctgtatttcagtatatatctaggaccgataaccctattgaggtcacagaaagctcttccactcctgagcaaactgaggtgcagatacaagagacttccacagaacagtctaagaccgtgccggttaccgacacagaggtagagactgtcgagccaccacccgtcgaaatcgtgaccgatgaggtcgcccctacaagcgatgagcagcctcaggaatcgcaagctgacctggaaacaagtgacaactccgattttggacaccaactcatctgctgcctgtgtcgcaaggagtttaatagccggtag

SEQ ID NO: 14777 - DNA, 393 bp, Artificial Sequence
  Description of Artificial Sequence: Synthetic coding sequence
atgccgctgcgagacaaatactgccagaccgaccaccaccatcatggctgttgtgaacctgtgtacatcttggaaccaggtgatccccctctgcttcagcagcctctgcagacgtcaaagtctggtatccaacagattatcgagtgcttcaggagtggcacaaagcaactaaagcacatcctgttaaaggacgtggacacgattttcgaatgtaaactgtgccgctcacttttcaggggactgccaaatttaatcactcacaagaagttctattgcccacccagtctccagatggacgataacctccccgatgtgaacgataaacagtcccaggccattaatgacctccttgaggctatctacccctctgtcgacaaacgtgagtacatttag

SEQ ID NO: 14778 - DNA, 297 bp, Artificial Sequence
  Description of Artificial Sequence: Synthetic coding sequence
atgcctcttagggataagtattgtcaaacagatcatcatcaccatggctgttgtgaacctgtgtacattttagaaccaggagatccccccctcctccagcagcctcttcagaccagcaaatcaggtattcaacagatcattgagtgcttccggtcaggcaccaaacagttaaaacacatcctactgaaagatgtcgatactatctttgagtgtaagctatgtagaagccttttccgagggctacctaaccttataacacataaaaaattctactgtcctccttctctgcagatgtag

SEQ ID NO: 14779 - DNA, 1485 bp, Artificial Sequence
  Description of Artificial Sequence: Synthetic coding sequence
atgcagggcgaacgtttgcgacctggcctggatagtcaaaaagaaaagttacctgggaaaatgtctcccaaacatgatggcctggggaccgcagactctgtttgtagtagaattatccaggatagagtgtccctgggcgacgacgttcacgattgtgactcacatggatccggaaaaaatcccgttatccaggaggaagaaaatattttcaaatgcaatgaatgcgaaaaagtcttcaacaaaaagcggctgctcgctcgccatgagcgtatccatagtggggtcaagccgtatgagtgcaccgagtgcgggaaaacattcagcaaatcgacatacttgctccagcatcatatggtccacacaggagagaagccatacaaatgcatggagtgcggaaaggcgttcaaccgaaaatcccacctgacccagcatcagcgaattcactctggggaaaagccatacaaatgtagcgagtgtggcaaggctttcacccataggagtacttttgtcctacacaaccgttcgcacaccggagagaagccattcgtgtgcaaagaatgcggcaaagctttccgggatagacctggctttatcaggcattacatcatccatagtggtgaaaatccttacgagtgttttgagtgtggcaaagtatttaagcatagatcatatctgatgtggcatcagcagacccataccggtgaaaaaccatacgaatgctccgagtgcgggaaggcattttgcgagagcgccgcacttatccaccattatgtcatacataccggcgagaagccattcgagtgcctggaatgcggcaaggcttttaatcacaggagctaccttaaaaggcatcagaggatccatacaggtgaaaagccttatgtgtgtagtgagtgcgggaaagcattcactcactgttccacattcatcctgcacaaaagagcccacacgggagaaaaaccttttgaatgcaaggagtgcgggaaggcattcagcaatcgagcagacctgatacgacatttttcgattcacacaggggagaagccatacgaatgtatggaatgcggcaaagctttcaatcgcaggtctggactcacgagacaccagcgcattcacagcggggagaagccctatgaatgcatagagtgtggcaaaacattctgctggtcaactaacctgatacggcactcaatcattcatactggagaaaagccctacgagtgtagcgaatgtgggaaagcattcagtcggtcatcaagcctgacccaacaccaacgcatgcacactgggcgaaatcccatttctgtcaccgacgtgggtagaccttttacctccggacagaccagcgttaatattcaggagctgctattgggaaagaacttcctaaacgtgactaccgaggagaacctgctccaggaagaagcttcctacatggcctccgaccgaacctatcaacgcgaaactccgcaggtctctagcctctag

SEQ ID NO: 14780 - DNA, 1884 bp, Artificial Sequence
  Description of Artificial Sequence: Synthetic coding sequence
atggctatggctttgactgatcccgctcaggtctccgttacatttgacgacgtggcggtgaccttcacccaagaggaatggggacagctcgacttggcccagcgaaccctgtaccaggaggttatgctggagaactgcgggttacttgtatccctcgggtgtccagtgcctagacccgagctcatctatcacctcgagcatgggcaggagccctggactcgcaaagaggatttaagtcaaggaacatgtcctggtgataaggggaagcccaagtcaaccgaacccacgacctgtgaacttgcactctccgagggaatctccttctggggacagcttacacagggtgcatctggtgactctcagctcgggcaaccaaaagaccaggatggctttagtgaaatgcagggcgaaagattgcgtcccggactggacagccagaaggagaagctgccaggaaagatgtcaccaaaacacgacggcctgggtaccgccgactccgtctgctctcgaattattcaggatcgggtcagtttaggggatgatgtgcatgattgcgatagccacggcagtggcaaaaaccccgtgatccaggaagaggaaaatatttttaaatgcaatgaatgtgaaaaggtgttcaacaagaagaggctgttagcccggcacgaacgcattcactccggtgtgaagccttacgaatgcactgagtgcggtaaaacttttagcaaatccacgtatttgctgcagcaccacatggtccacaccggggaaaaaccctacaagtgcatggaatgtggaaaagcttttaatcggaaatctcacctgacacagcaccagaggatccacagtggcgaaaagccctacaaatgttccgaatgcggcaaggccttcacacaccgttcgactttcgtcctgcataaccggtctcataccggtgaaaaaccgttcgtttgcaaagagtgtggtaaggcctttcgtgatcggccagggttcataaggcactacataattcactcgggcgagaatccatatgagtgttttgagtgcggaaaggtatttaaacataggagttacttaatgtggcaccagcagacccatacaggtgagaaaccctatgagtgttctgaatgcggtaaggcattttgtgaaagcgctgctctgatccaccactatgtgatccacacaggcgaaaaacctttcgagtgtctggaatgcggcaaggcatttaaccaccgaagttacctgaagcgccaccagcgcattcacaccggcgaaaaaccatacgtgtgttcggagtgcggtaaagcttttacacactgttcaacgttcatcttgcacaaacgtgcccacacgggggaaaaaccatttgagtgcaaggagtgtggtaaggcattcagcaacagggcagacttaatacgccacttctctattcacacaggagagaagccttatgaatgcatggagtgcggtaaggcattcaaccggcgcagcggcctaacacggcatcaaagaattcactcgggcgaaaagccctacgaatgcattgaatgtggaaagacattctgctggtctactaacctcatcaggcactctattatacatacaggcgagaagccctatgagtgctctgaatgtggcaaagccttttcccgctcctcctctcttacacagcaccaaaggatgcatacgggaagaaaccccatcagtgttacggatgtgggacgccctttcacttcgggccaaacctctgtgaacatccaggagctgctgctaggaaagaacttcctgaacgtcacgaccgaagagaacttgctgcaggaggaggcatcctatatggcaagtgatagaacataccagcgggagaccccacaggtaagctctctgtag

SEQ ID NO: 14781 - DNA, 1485 bp, Artificial Sequence
  Description of Artificial Sequence: Synthetic coding sequence
atgcagggtgagagacttagacccggtctggatagccagaaggagaaacttcctggcaagatgtccccgaagcatgatggcctgggaaccgctgatagtgtttgtagcagaatcatccaggacagagtcagcctgggagacgacgtacacgattgcgactcccacgggtcaggaaagaaccccgtgattcaggaggaggagaacatctttaaatgtaatgagtgcgagaaagtttttaacaagaagaggttgctggcccgccacgagagaatccatagcggagtgaaaccatacgagtgtacagaatgtggaaagacgttcagtaagagcacctatcttctgcaacaccacatggtgcacactggcgagaagccctacaagtgtatggaatgcggcaaagcatttaatcggaagtctcacctcactcaacaccaacggatccattcgggagaaaaaccctataagtgtagcgaatgtggtaaagcattcactcaccggagcaccttcgtgctccataaccggtcacatactggagagaaaccattcgtgtgtaaggagtgcgggaaagcattcagggataggccagggttcattagacactatataattcactcaggcgagaatccttacgaatgtttcgaatgcggaaaagtcttcaagcaccggagctacctgatgtggcaccaacagacacatacaggtgaaaagccttatgagtgcagcgaatgtgggaaggccttttgtgaatcggccgctttgatccatcattacgtgatccacactggtgagaagccattcgagtgtctcgaatgcggcaaggctttcaaccatcgctcttacttgaaacgtcaccagcggattcataccggggaaaagccttacgtgtgctccgagtgcgggaaagcctttacccactgttccacctttatcctgcataagcgtgcccacactggcgaaaagccattcgaatgtaaagagtgcggcaaagcattctccaaccgggcggatctgattagacacttttctattcacactggggaaaagccatatgaatgcatggagtgcggaaaggcgtttaatcgccgctccgggctcacacgccaccaaagaattcatagtggggagaaaccctatgagtgcattgagtgtggcaagaccttttgctggagtaccaacttgattagacactctatcatacataccggggaaaagccctatgaatgttcagagtgtggtaaagctttctccagaagctcaagtttgacccagcaccagagaatgcacaccggacgcaacccaatcagcgttacagatgtggggcgtccattcacaagtggtcagacatcggtgaatatccaggaactgttgttaggcaagaactttctgaacgtgaccacagaggagaacctgctccaggaggaggcatcgtatatggcgtctgaccggacttaccagcgagaaaccccgcaggtgagttctctgtag

SEQ ID NO: 14782 - DNA, 153 bp, Artificial Sequence
  Description of Artificial Sequence: Synthetic coding sequence
gcccccttactctcttgtataacaggcgccacattagagactctgtgtgtacagcgggtcaaggccttccgggatcgccctggctttatccgccattatattattcattctggcgagaacccctacgagtgcttcgagtgtggcaaagtctag

SEQ ID NO: 14783 - DNA, 2712 bp, Artificial Sequence
  Description of Artificial Sequence: Synthetic coding sequence
atgttacgagaagaggcggcccagaaaagaaaagggaaggagtcaggcatggcactgcctcagggcagactgacttttagagacgttgcaatagagtttagtctggctgaatggaagttccttaaccctgcgcagcgggccctgtaccgagaggtgatgctggagaattaccgcaacttggaggctgtcgacatctctagcaagcacatgatgaaggaggttctttcaaccggccaaggtaatcgggaagtgattcacacgggcaccctgcaacggcaccagagctaccatattggtgacttttgctttcaagaaatagagaaagaaattcataacatcgagtttcagtgtcaggaagatgagcggaacggccacgaggccccaactacaaagattaagaaattgacaggatcaaccgatcagcatgaccaccggcatgctgggaacaaacccataaaggatcaactcgggagctctttttacagccatcttcccgaactccacatatttcaaattaagggggagattgcaaatcagctggaaaaatcgacctctgacgctagttccgtgtccaccagtcagagaatcagttgcagaccacaaattcatatatctaataattatgggaataatcctctgaatagctcccttctgcctcagaagcaggaagtgcacatgagagagaagagcttcccttgcaacgaatctggcaaagcttttaactgtagttccctactcaggaagcatcaaatccctcacctaggagacaagcagtataagtgtgatgtgtgtggcaaactatttaaccataagcagtatctcgcatgtcatcgaaggtgccacaccggggagaagccatataagtgtaaggaatgcgggaagtccttttcctacaaaagcagccttacctgccaccatcgtctgcatacaggagttaaaccttacaaatgcaatgagtgcggaaaagtgttcagacaaaacagcgccctcgtcattcataaagctatacacactggagaaaagccctacaagtgtaacgagtgtggaaaggcttttaaccaacagtcccacctctcgcggcaccagagactacataccggagtgaagccttacaaatgcaagatttgcgagaaggcgttcgcctgccattcttatctggctaatcacacacgcatccactcgggagagaagacttacaagtgtaatgaatgtggcaaagcttttaaccatcagagctcactggccaggcatcacatactgcacacaggggagaagccatataagtgtgaagaatgtgataaggttttcagtcagaaatcaacactggagaggcacaagcggatccacaccggggaaaagccatataagtgtaaagtgtgtgacaccgccttcacatgcaatagccagctggccagacacagaaggatccataccggcgaaaagacatacaaatgtaacgagtgtagaaaaaccttctcgcgtagatcttccttactgtgtcacaggcggctgcactccggcgaaaaaccctacaagtgcaaccaatgtggcaatactttccggcacagggcgagtctggtgtaccatcgccggttacataccctagaaaagtcctacaagtgcaccgtgtgtaacaaggtgttcatgaggaactctgtcctggcggttcatacacggatccacacagccaaaaagccttataagtgtaacgagtgcggcaaagctttcaatcagcagtcacacctatcccggcataggcgcctccatactggcgagaaaccttacaaatgcgaagcgtgcgataaggttttcgggcagaaatcggcgctggagagccacaaaaggattcatacaggagaaaagccttaccggtgccaggtgtgtgacacggcctttacttggaattctcagctggccaggcacactcggatccatactggcgagaagacctacaagtgtaacgaatgtggaaaaacatttagctacaaaagtagcctggtgtggcacaggcgcctccatggtggggagaagagttacaagtgtaaggtgtgtgataaggcctttgtttgccgatcctacgtggcgaaacatactaggatccatagcggcatgaagccctacaagtgtaatgagtgtagcaaaactttttccaaccgcagttctctggtgtgtcacagacgaattcatagcggggagaaaccctataagtgtagcgaatgcagcaaaacatttagtcagaaagctacactgctatgccacagacggctccatagtggagagaaaccctacaaatgcaacgattgcgggaacacatttagacactggtcaagcctcgtgtatcacaggcggttgcatactggagaaaaatcatataagtgcaccgtgtgtgataaagcattcgtgcgtaattcctatctcgcccggcatatccgcatccacacagccgaaaagccctataagtgcaatgagtgcgggaaggcgttcaatgagcagagccacctttcacgtcaccacagaatccatacgggcgaaaagccatacaaatgtgaagcttgtgacaaagtgttctcccgcaaaagtcatctgaaacgtcaccgcatcatccacaccggagaaaaaccctacaaatgtaatgagtgtggcaaggcgttttcagatcgctcaactttgatccatcatcaggccatccatggaattgggaaatttgattag

SEQ ID NO: 14784 - DNA, 1854 bp, Artificial Sequence
  Description of Artificial Sequence: Synthetic coding sequence
atggccttaccccaaggtctgctcaccttccgcgacgttgccatagagtttagccaggaggagtggaagtgtctggacccagcccagcgcactctatatcgagacgtgatgcttgagaactatcggaatctggtgtctttggacatatccagcaaatgcatgatgaaggagtttagcagcacagcccaaggcaaccgcgaagtaatccatactgggacccttcagcgacacgaatcccaccacaccggtgattttaggttccaggaaatcgataaggacattcacaacctagaatttcaatggcaggaggacgagagaaattctcatgaggcgcctatgaccgagattaagaaactgaccgggagcgcagacagatacgatcagagacacgcaggaaacaaaccgatcaaagatcagctgggcagctcctttcatagccacctccctgagctccacatgttccagacccaaggcaaaattggaaatcaagtggagaaatctatcaacgatgcctcctcaattagcacttcccagagaatcagctgccgtcctaagacacatatttccaacaactacggcaacaattttagaaactcgtcacttcttacccaaaaacaggaggtgcatatgcgcgagaagtccttccaatgcaacgaaagcggaaaagcattcaactacagctcactgctgaggaagcaccagatcatccacctcggcgagaaacaatacaaatgtgacgtgtgcggaaaggtgttcaaccgcaagaggaatctagtctgtcatcgcagatgccatacaggcgagaaaccctatcgctgcaatgaatgcggcaaaaccttttctcagacctacagcctcacatgccatcggagactacacacaggcgaaaaaccatacaaatgtgaggaatgtgacaaagctttttctttcaagagcaatcttaaaagacatcgccgaattcacgctggcgagaaaccttataagtgtaatgagtgcggcaaaacctttagccaaacctcatctttgacatgccatcggcggctgcacactggggaaaagccattcaaatgtaacgaatgtggtaagaccttctcccgcaagtcatcactgacatgccaccaccgacttcacacaggtgagaagccctataaatgtaacgaatgtggaaaaacttttagccaagaactgacactcaaatgccacagacgcttacacacgggggagaagccttacaagtgcaatgagtgtggcaaggttttcaataaaaaagccaatctcgctcgacaccatagacttcacagtggtgagaagccgtacaagtgcactgaatgcgtaaagacattttcacgcaatagcgctctggtaattcataaggccattcatattggggaaaaacgctataagtgcaacgagtgcggaaagaccttcagtcgcatcagcgctttagttatccatactgcaatacatacaggcgaaaagccctacaagtgcaatgaatgcggcaaggggttcaatcgaaaaacgcacctagcttgccaccaccggctgcacacgggagaaaagccttataaatgtaacgagtgcggtaaagtgttcaacagaaagacccatctggcccatcaccatagactccatactggggacaagccttacaaatgtaatgagtgcggcaaggtatttaatcaaaaggcccatctggctcgacaccaccgcctgcatacgggggagaagccttacaagtgcaatgagtgtggaaaagtgtttaaccagaaggcaaacctggctcggcatcataggctgcacaccggcgaaaaaccttataaattcaatgaatgcggaaaagccttcaactag

SEQ ID NO: 14785 - DNA, 183 bp, Artificial Sequence
  Description of Artificial Sequence: Synthetic coding sequence
atggccctgcctcaaggactgttgacttttagggacgtggcaatagagttcagtcaagaagaatggaagtgcctcgacccggcccaacggacattataccgtgatgtcatgctggaaaactacaggaatcttgtgtctcttgaattgagcggcgagtgtcccctggctgctccagcctcctag

SEQ ID NO: 14786 - DNA, 1956 bp, Artificial Sequence
  Description of Artificial Sequence: Synthetic coding sequence
atgctgagggaggaggccacgaagaagagtaaagaaaaggaacccggcatggccctgccccaaggccgtttgacttttagagacgttgctatagagttctcactcgaagaatggaagtgcctcaatccagcccagagagccttatatcgtgccgttatgctagaaaattatcggaatcttgaatttgtggatagcagcctgaaaagcatgatggagttttcaagcaccaggcactcaataaccggggaagtgatccacaccggtaccctgcagcgacataaaagccaccatataggagatttttgcttccccgagatgaaaaaggacatccaccatttcgagttccaatggcaggaagtggagcgcaatggacatgaagcccctatgactaagatcaaaaaattgacggggtccaccgatagaagcgatcaccgacacgcagggaacaagcccataaaagatcaactgggactgtcgtttcatagtcacctgcctgagctacatatgttccagactaagggcaagatttcaaaccagcttgacaagtctataggggcatcaagcgccagcgagtcccaaaggatatcatgcagattgaagacacacattagcaacaagtacgggaagaactttctgcattcctcctttacgcagatacaggagatatgcatgcgagagaaaccctgccagagcaacgaatgtggcaaggcgtttaattactcttcactcctgaggaggcatcatatcactcattccagagagagggagtataagtgtgacgtgtgtgggaagatttttaaccaaaaacagtatatcgtatatcaccatcgctgtcacacaggagagaaaacttacaaatgtaatgagtgcggcaagaccttcacacagatgagctctctggtgtgtcataggaggctccacaccggcgagaaaccgtataagtgcaacgaatgtggcaaaaccttctctgagaagagttctctgaggtgccatcggagacttcacacaggcgaaaaaccttacaaatgcaatgagtgtggcaagacctttggtcgcaatagtgcactggtcatccacaaggctatacatacaggggagaagccttataaatgtaatgagtgcgggaaaacattcagccagaaaagctctctccagtgccatcatatcctacacacgggcgaaaagccctacaagtgcgaggagtgtgacaacgtgtatattcggaggtcccacctggagcgacatcggaaaatccatacaggggaaggatcttacaagtgcaaagtatgcgataaggtctttagatctgacagttacctggctgaacaccaaagagtccacacaggcgagaagccatacaaatgtaacaagtgcggccggagtttctcacggaaaagttctctccaatatcatcacacattgcacacaggcgaaaagccgtatacatgtaacgagtgtgggaaagtgttctcccgtagggaaaaccttgcacgacaccaccgtctgcatgcaggtgagaagccatacaagtgcgaagagtgcgataaagtcttttcaagaagatcacacctagagagacaccgaagaatccacaccggcgaaaaaccgtacaaatgcaaagtgtgcgacaaggcgtttcgaagcgattcatgcctggctaaccacacaagggtgcataccggagagaaaccttacaagtgcaacaaatgtgctaaggtttttaaccagaaggggatcctcgcacagcaccagcgagttcacacaggggagaaaccatataaatgtaacgaatgtggaaaggtgttcaatcagaaggccagtttggctaaacaccagagagtgcacacggctgagaaaccatataagtgtaacgaatgtggtaaggcattcactggccagtcaacactaatccaccatcaggccattcacggttgtagggaaaccctgcaaatgtag

SEQ ID NO: 14787 - DNA, 702 bp, Artificial Sequence
  Description of Artificial Sequence: Synthetic coding sequence
atgttacgggaagaggctactaaaaagagcaaagagaaggagcccggcatggccttgccccagggcagattgaccttcagagatgtggccatcgagttctccctcgaagaatggaaatgtctgaacccggcccagagagcattatatcgtgccgtcatgctggaaaactatcgcaacttagaatttgtggacatcagtagtaaatgcatgatgaaggaattcagctcaaccgcccaggggaatactgaagtcattcatacgggaacgcttcagaggcacgagagtcaccacatccgtgacttttgtttccaggaaattgagaaagacatccacaatttcgagtttcagtggcaggaggaggagcgtaacggccacgaggcccctatgaccgagattaaggagctgactgggtccaccgaccgccacgaccagcggcacgccggcaacaaacctatcaaggatcagctgggaagctcctttcacagccatcttcctgagctccacatctttcaaccagaatggaagattgggaaccaggtggagaaaagcattattaatgcatctctgattttgacatctcaacggattagttgtagtcccaagacacgcatttcaaacaactatggcaacaactcacttcactcttccctacctatacagaaattagggtctactcatgagaggaagatctttcccatgtag

SEQ ID NO: 14788 - DNA, 1956 bp, Artificial Sequence
  Description of Artificial Sequence: Synthetic coding sequence
atgcttcgtgaagaggcgaccaaaaaatcaaaggagaaggagccgggcatggctcttccccagggacgcctcacgttccgcgacgtggccatagagttttcccttgaggaatggaaatgtctgaatcccgcacagcgtgctctttaccgcgctgtgatgctggagaactataggaacttggagttcgtcgatagcagcctcaaaagcatgatggaattttccagcactcgacactcaatcacgggggaggttatccacactggaacactgcagagacataagtctcaccacattggggacttttgttttcctgaaatgaagaaagacattcaccactttgaatttcagtggcaggaggtcgagcgcaatgggcacgaagcgcccatgaccaagattaagaagctgacaggctccactgatcggagcgatcatcggcatgcaggaaataaaccaattaaggatcagctgggcctctcctttcattctcacctgccagaattgcacatgttccagacaaaggggaaaatttcaaatcagctggacaagtccattggggcctccagcgcctcagagtcccaacggatttcttgccgtctcaaaactcatattagcaacaaatacggtaagaacttcctgcattcttcatttacccagatccaggaaatttgcatgcgggagaagccttgccagtcaaatgaatgtgggaaggcctttaattactcgtcgctgctgaggcggcatcacattacccacagccgcgagcgggaatacaaatgtgatgtgtgtggcaagatcttcaaccagaaacaatatatcgtgtatcatcatagatgccacaccggggaaaaaacttacaaatgcaatgagtgtggtaagacttttactcagatgagtagtctagtgtgccacaggcggctccatacaggtgaaaaaccatataagtgcaacgagtgtgggaagacgttctcagagaagtcttccttgaggtgccatcgtagactgcatacgggtgagaaaccatataaatgtaacgagtgtgggaagacatttggacggaactcagctctcgtgattcataaggccattcatacgggagaaaaaccttacaaatgtaatgagtgcgggaagaccttctcacaaaaaagttctctccagtgccatcatatcctacacacaggggagaagccctataagtgtgaagaatgtgataacgtctatattcgtagatcacacctcgaaaggcatcgcaagattcataccggagagggaagttataagtgcaaggtgtgcgacaaggtttttcggtcagatagctaccttgcagagcaccagcgggtgcacactggagagaagccctacaaatgcaacaagtgtggtaggagtttcagcagaaaatcatctttgcagtaccaccataccctccacactggggaaaagccttatacctgtaacgagtgcggcaaagtctttagcagacgcgaaaacttggcacgccaccaccggcttcacgctggcgagaaaccttacaagtgtgaggagtgtgataaggttttctccaggcgttcacatctcgagcgacacaggcgaattcacactggggagaagccctataaatgtaaagtgtgcgataaagcttttcggtcagattcctgcctggccaatcacacccgcgttcacaccggagaaaagccatacaagtgtaacaagtgcgccaaggtctttaatcaaaaggggattctggcccagcaccaacgggtccataccggagagaagccctataaatgcaatgagtgcggcaaggtcttcaaccagaaggctagtctggccaaacaccagcgggttcatactgccgagaagccgtacaagtgcaacgaatgcgggaaggcttttacaggccagagcacccttatccaccaccaagctatccacggatgtagagaaactcttcagatgtag

SEQ ID NO: 14789 - DNA, 345 bp, Artificial Sequence
  Description of Artificial Sequence: Synthetic coding sequence
atgttacgagaagaggctaccaaaaagagcaaagaaaaggagcctgggatggcactcccacagggccgtctgaccttccgcgatgtagctatcgagttcagcctggaagagtggaagtgtctgaatcctgctcaacgcgccttgtaccgtgctgttatgctcgagaattatcgaaatctggagttcgtggacagctccctgaagtctatgatggaattttcatccactcgacactctattactggcgaagtgatccatacaggcaccctgcagcggcataagagtcaccacatcggtgatttttgctttccggagatgaagaaagacattcaccatttcgagtag

SEQ ID NO: 14790 - DNA, 495 bp, Artificial Sequence
  Description of Artificial Sequence: Synthetic coding sequence
atgatgaaagagttttcctcgaccgcacaggggaacaccgaagtgattcataccggaaccctgcagcggcatgagagccaccatataagagatttctgcttccaggagatcgagaaggacattcacaacttcgaattccagtggcaggaagaagagcggaacggacacgaggcccccatgaccgagattaaggaactcaccggaagcaccgacagacacgatcagcgccatgccgggaataagcccatcaaggatcagttgggcagttcatttcatagccacttaccagaactgcatattttccagcccgagtggaagattgggaaccaagtcgaaaagagtatcataaatgccagtttaattctcacctcccagcgcataagttgctccccaaagactcgaatatctaacaactatgggaacaatagcctgcactcgtcattgcccatccagaagcttggcagcacccacgaaagaaaaatcttccccatgtag

SEQ ID NO: 14791 - DNA, 1599 bp, Artificial Sequence
  Description of Artificial Sequence: Synthetic coding sequence
atggccctccgcagtgtaatgttctcggacgtgtctatcgacttcagccccgaggagtgggaatacctggacctcgagcagaaggacctataccgggacgtgatgctggagaattattctaatctggttagcctaggatgcttcatcagcaagcccgacgttatatccagtctggagcagggtaaagaaccatggaaggttgtgagaaaaggacggcgacagtaccccgatcttgagaccaaatacgagactaagaagctgtccctagaaaacgatatctacgaaatcaacctatcacaatggaaaatcatggaacggattgaaaatcacggactgaaggggctcattctcaaaaacgattgggaatcaacaggaaagattgaaggccaggagcggccccaggagggctacttttccagcgtaaagatgccaagtgaaaaggttagctcctatcagaagcggacaagcgtgaccccacatcagcggctgcacttcgtggataagccctacgagtgcaaagagtgcggcaaggcctttcgtgttagacaacagttgaccttccatcaccgtattcacacaggagagaagccttacgagtgcaaggaatgcggtatggcctttcgccagactgcccacctaaccagacaccagcggctgcacagtggagagaagctttatgagtgcaaggagtgcggggaagcgttcatctgcggagcagatttgcgcgttcaccagaaaatgcacatcggcgagaaaccctacgagtgcaaggagtgcgggaaagccttccgggtgcgaggccagctcaccctccatcagagaattcatactggcgagaaaccatacgtgtgcaaggagtgcggaaaggctttccggcagtatgcccatctcacaaggcaccagaaacttaattcggcagacagattgtacgagtgcaaagagtgcggcaaggccttcctgtgcggatctgggctccgcgtacaccataagctgcatacgggcgagaagccctatgagtgtaaagagtgtggaaaagctttccgggtaagacagcaactgacactgcatcagcgcatccacacaggggagaagccttacgaatgcaaagaatgtggaaagactttctcgcgtggttatcacctgatcttgcatcaccggatccacactggggaaaaaccatacgagtgtaaagaatgttggaaggcatttagccgttactctcagctcatctcacaccagagcattcacatcggggttaagccctacgattgcaaggaatgtggaaaggcctttcgactactctctcagctgacccagcaccagtctatccatattggtgaaaagccatataaatgtaaggaatgtggcaaggcttttaggctgcgccagaagcttaccctccaccagagtatccacacaggagagaaaccttttgagtgtaaggagtgtagaaaggccttcaggttaaattcatccctgattcagcatctgagaatacattccggagagaaaccatatgagtgtaaggagtgcaagaaagccttccggcaacactcacacctcacccaccatcttaaaatccataatgtcaaaatctag

SEQ ID NO: 14792 - DNA, 1599 bp, Artificial Sequence
  Description of Artificial Sequence: Synthetic coding sequence
atggccctaagaagtgtaatgtttagcgacgtgagcatcgatttctcacctgaggagtgggagtatctggatctagaacagaaagatctttaccgtgatgtcatgctggagaattacagtaacttagtctcactaggcctgcttcttttaagttttattagtacactggaaatgctgctcctgctagtcaaagagaactccatgtgcttgttgtcatgcttcattctggacctcgagactaagtatgaaaccaagaagctcagcttggagaacgatatctatgagatcaacctgagccagtggaaaatcatggagaggattgagaaccacgggctcaagggtctcattcttaagaacgattgggagtccacaggcaagattgaagggcaggagaggccccaggaaggttacttctcctcagtgaaaatgccatccgagaaagtgagcagctatcagaagaggacttcagtgacacctcatcagaggctccattttgtggataagccctacgagtgtaaggagtgtgggaaggccttcagggtccgccagcaactgacatttcatcaccgcatacacaccggtgaaaaaccgtacgaatgcaaagaatgcggtatggccttccggcagaccgcccatctaacgagacatcagagactccattcaggggagaagctgtatgagtgcaaggaatgcggcgaggctttcatttgcggagctgaccttagggttcaccagaagatgcacattggagaaaaaccatacgagtgtaaagagtgcgggaaagctttcagggtaaggggacagctgaccctccaccagcggatccatactggagagaagccctacgtatgtaaagagtgtggcaaggccttcagacagtacgcccatctcacccgtcaccagaagctgaactctgccgaccggttgtacgaatgcaaggagtgcgggaaagcattcctgtgtggatctggcctgagagtccaccataagcttcacacaggcgaaaagccctacgagtgcaaggaatgtggcaaggcgtttagagttcgacaacagctcactctgcatcaaagaatccatacaggcgagaagccttacgaatgcaaagagtgcggtaagaccttcagtcggggatatcaccttattcttcatcataggatccataccggggagaaaccgtatgagtgtaaggagtgttggaaagccttttccaggtatagccagctgatatcacaccagagcattcatatcggggttaagccttatgactgtaaggagtgcggcaaggcatttcggctgttatcccaactaactcagcatcagtccattcacatcggggagaaaccttacaaatgcaaagagtgcgggaaggctttcaggctacggcaaaaacttactcttcatcagtcaattcacacaggtgagaaaccatttgagtgtaaggaatgccggaaagctttcagacttaattctagcctcatccagcacttgcgcatccattctggagaaaagccctatgaatgtaaggagtgtaaaaaagcatttagacagcatagtcatctcacacatcacttgaagatacacaatgtaaaaatttag

SEQ ID NO: 14793 - DNA, 1833 bp, Artificial Sequence
  Description of Artificial Sequence: Synthetic coding sequence
atggacagcgtcgcttttgaggacgttgctgtgaatttcacacaggaggagtgggccctcctgggaccatcccagaaatcactctaccggaatgtaatgcaggagactatccggaatctggactgtattgaaatgaaatgggaagatcagaatataggcgaccagtgtcagaacgccaagcgcaacttacgcagtcacacttgtgagattaaagacgatagtcagtgtggagagacttttggacaaattcctgattcaatcgtgaacaaaaatactcctcgcgtgaacccctgtgactccggcgagtgtggagaggtggtgctcggtcactcatcccttaactgtaatatccgggtggacaccggccataaatcctgtgaacaccaagagtatggcgagaagccctacacacataagcagagggggaaagccatttcccatcagcattcctttcagacccacgaacgccctccgaccggcaagaagcctttcgactgtaaagagtgcgctaaaacgttttcgtcattaggcaacttgcgtagacatatggcagcacatcatggcgatggcccatacaagtgcaaactgtgcggcaaagctttcgtgtggccttcactgtttcacctgcacgaacgcactcacaccggcgaaaaaccctatgaatgtaagcagtgtagcaaggcctttcccttctactccagttacctgcggcatgagcggatccacactggtgaaaaagcctatgaatgtaaacagtgttcaaaagctttccccgactatagtacatacctgagacacgaacggacccacaccggagaaaagccttacaaatgcactcagtgcggcaaggccttttcgtgttactactatactaggctgcacgaaaggactcacacaggagagcaaccttatgcttgtaagcaatgcggcaagaccttttaccatcacacatccttccgacgccacatgatcaggcacaccggagacggacctcataagtgcaaaatatgtggaaagggcttcgactgcccctcgtccgtcagaaaccatgagacaacgcacacgggcgaaaagccgtacgagtgcaaacagtgtgggaaagttctgtctcactcttcaagcttccggagccacatgatcacacatactggggacgggccacagaagtgtaagatatgtgggaaggcgttcgggtgcccttccctttttcagcgacacgagagaacacatactggtgaaaagccatatcagtgcaaacagtgtggcaaagcgttttccctggcaggcagcttacgcaggcacgaggccacgcatacaggtgtcaaaccttataagtgtcagtgcggtaaggcattctccgatctatctagtttccaaaatcacgagacgacacacactggcgagaagccatatgagtgtaaggaatgcgggaaggccttttcatgttttaagtatctatcccagcataagagaactcacacagtagagaagccatacgagtgcaaaacctgtaggaaggcttttagccatttcagtaatcttaaggtgcatgagaggatccattctggcgaaaagccctacgaatgtaaggagtgtggaaaggctttctcatggctgacatgtctgctgcgacacgaacgcattcataccggggagaaaccgtatgaatgcctgcagtgtggcaaagccttcactcgcagcaggttcttgcggggccatgagaagactcacacaggcgagaagttgtacgagtgcaaagagtgtggcaaggctcttagcagtctcaggtccctgcatagacacaagaggacacattggaaagataccctatag

SEQ ID NO: 14794 - DNA, 1410 bp, Artificial Sequence
  Description of Artificial Sequence: Synthetic coding sequence
atgaagtgggaggatcagaacatcggtgatcagtgccagaacgccaagagaaacctaaggtcccatacttgtgaaatcaaggacgactctcagtgtggggaaacttttggtcagattcctgactcgatcgtaaacaaaaacacacccagggtcaatccttgtgattccggggagtgtggagaagttgtactcggccactcgtctcttaattgtaacatcagagtggatacaggccacaagagttgtgaacaccaggagtacggcgagaaaccttacacacacaaacaaaggggtaaggccatcagccatcagcattcttttcagacccatgagagaccaccgactggcaaaaagccgtttgactgcaaagaatgtgccaagacctttagtagtctgggtaatttgaggcgccacatggctgcccaccacggagatggaccatacaaatgtaagctgtgcggcaaggcttttgtgtggccttcgcttttccatctccacgaacgcactcacaccggggagaaaccgtacgagtgcaagcagtgctctaaggctttcccattctattcttcgtacctaaggcatgagagaatccacaccggagagaaagcctatgaatgtaaacagtgcagcaaggcttttccggactacagcacgtacctgagacatgaaagaacccacacaggcgagaagccctacaagtgcacccagtgtgggaaagccttctcctgttactattacacgcgactccatgagcggactcacaccggagagcaaccctatgcctgtaaacagtgcggtaaaaccttctatcatcatacgagcttcaggagacatatgattcggcatacgggtgacgggccgcacaagtgtaaaatatgtggcaaaggctttgattgcccatcctccgtgagaaaccacgagaccacccacacaggagagaagccgtacgaatgtaagcagtgtggcaaggttctaagccactcaagctctttccgttcacacatgatcactcacacaggagatgggcctcagaaatgcaaaatatgcggaaaagcattcggctgtccatcacttttccaaagacatgagcggacacataccggagagaagccctaccagtgcaaacagtgcggtaaggcatttagcctggccggctctctgcgaaggcacgaagcgactcataccggtgtcaaaccatataagtgtcagtgcggcaaggcattcagcgatctttcttcattccagaatcatgagacaacacacacaggcgagaagccctatgagtgcaaagagtgtgggaaggcatttagctgctttaaatacctgagtcagcataagcggacacacacggtggagaaaccatatgaatgcaagacctgtcgtaaggcattcagtcatttctcaaattag

SEQ ID NO: 14795 - DNA, 1287 bp, Artificial Sequence
  Description of Artificial Sequence: Synthetic coding sequence
atggcggcacaccacggagacggaccctataagtgcaaactatgtggcaaggcctttgtgtggcctagtttattccacttacatgaacggacccacacaggggagaagccctatgagtgcaagcagtgctccaaggcattcccattctacagctcctatctgcggcacgaacgcattcacacaggcgaaaaggcttacgagtgtaagcagtgcagcaaggccttccccgactattcaacctaccttcggcacgagcggactcacaccggggaaaaaccctacaagtgcacacagtgtggaaaggccttttcctgctattactatacgaggttacacgagagaacacacactggagaacagccatacgcctgcaagcaatgtggaaagactttctaccatcacacgagctttcgtagacatatgattagacacaccggagatggcccccataagtgtaagatctgtggcaaaggatttgattgtcccagctcagtcagaaaccacgagacgactcacaccggcgaaaaaccatatgagtgtaagcaatgcggtaaagtgttatcacactcctcatccttcagatcacacatgatcacccataccggcgacggacctcaaaagtgtaaaatctgcggtaaagcgttcggatgcccgtcgctctttcagagacatgaaaggactcatactggagagaaaccttatcagtgtaagcagtgcgggaaggccttctctctggccggctccctcaggcgccacgaggctactcatactggcgtgaaaccctataagtgccaatgcggcaaggcatttagtgacctgagtagttttcaaaatcatgagacaacccacaccggcgagaagccatatgagtgcaaggagtgtggaaaagcgttcagctgctttaaatacctgagccaacacaaaagaactcataccgtggaaaagccttacgagtgtaaaacttgtcgcaaggccttcagtcacttctcaaacctcaaggttcacgagcgcattcactcaggagaaaagccatatgaatgtaaagagtgtggtaaggccttcagctggctcacctgtcttttgagacatgaacgaatccacacaggcgaaaagccctacgagtgcttacagtgtgggaaggcattcacacgcagcaggttcctacgcggacacgaaaagactcatacaggagaaaagctgtacgaatgtaaggagtgcggcaaagcgctttccagtctgaggtcactccacagacataagaggactcactggaaggacaccctgtag

SEQ ID NO: 14796 - DNA, 3243 bp, Artificial Sequence
  Description of Artificial Sequence: Synthetic coding sequence
cccagccggcagaaaaagaaaaagaagaagctgacatctgacgtctctcggcaggaggaagcagagggagagctttcagaaggggaacactggtacggaaattctagtgaaacaccctctgaggcctcctatggtgaggttcaagagaattacaaattgtccctggaagatagaattcaggagcagtctacttctcccgacacctccctcggttctactactcctagctcacacacactcgagctggtggctctggactccgaagtcctgagggattccttgcagtgtcaggatcatctctctccgggggtgagttctctgtgtgacgacgaccccggatcgaacaagcccttgtcaagcaatctccgccgcctgcttgaagcaggctctcttaaattagatgccgccgcaaccgcaaacggtcgggtggaaagccccgtgaacgtgggctctaacttgagtttcagcccgccctctcaccacgcacaacagctgtctgtgctggctcggaagttggcggagaagcaggaacaaaacgaccagtacaccccgtctaatagattcatttggaaccagggcaagtggctcccaaatagcacaactacttgcagtctgagcccagactcagcgatcctgaagctcaaagcggctgcaaatgctgtactccaggacaagagcctgacaagaaccgaagagacaatgcggttcgagtcattctcttcgccgttctcctcacagagtgcttcgagcactctggcagccttgagtaagaaggtgagcgagcggagccttacgcccggtcaggaacacccccctccagcctccagctttcttagtctggctagcatgacctctagcgctgcactgctcaaagaggtggctgccagggccgctggttccctcctcgcggagaagagctccctcttgcctgaggatccactgccccctcccccttcagaaaagaagcccgagaaggttactcccccacctccaccaccgcccccccccccccccccacctcctccacagtcgctcgagctattgctcctgcctgtgcccaagggcagagtgtcaaagccgtcgaactccgcatctgaagaggagagcggaaagcccttccagtgccccatctgcggcttggttatcaagcggaaatcctactggaaaaggcatatggtgattcatactggactgaaatcacaccagtgtccactgtgtccgttcagatgtgcccggaaagataatctgaagtcccacatgaaggttcaccagcatcaggatagaggagaaactttccaatgccagttatgcccctttacctcgtcgcggcacttttcactgaaactgcatatgcgatgccaccaacacttcctgcggacagaagctaaggttaaagaggaaatacctgaccctgacgtgaagggaagtccacatctcagtgatagcgcatgtctgggccagcagagagaaggcggtgggactgaactggtgggcacaatgatgacatccaacacacccgagcggacatctcagggaggagccggcgtctcgccactactggtgaaggaggaaccaaaggaggataacggactcccaacctcattcacactgaatgcagcagaccgccccgccaaccataccaaactcaaggatccatctgagtatgtggctaattctgcctctgctctgttttcccaggatatatcagtgaagatggccagcgactttctgatgaaactgtcagccgcgaatcagaaggagcctatgaacctaaactttaaggtgaaggaggagccaaaggaaggggaatctctctccacaacactgcccagaagctcgtacgtcttctcacccgaatccgaggtatccgcccccggggtgtccgaagacgcgctcaagccccaagaaggcaagggctctgtcttaaggcgcgacgtgagcgtcaaggccgcttccgagctcctgatgaagttatctgctgagtcctataaagagactcagatggtgaaaattaaggaagaaccaatggaagtagacatacaggactcccacgtttctattagtccctcacgtaacgtgggctactccaccttaattgggagggagaagaccgaacccctacaaaagatgcccgaaggacgggtgccccctgagaggaacttgttttcacaagatatcagtgttaagatggcctctgagctcctgttccagctgtcggagaaggtctctaaagagcacaatcacactaaagagaatacaatccgaactacaactagccccttcttttcagaggacacatttcgccagagcccattcacatctaattctaaagagttactgccgagcgattcagtgcttcacggaaggatctcggcccccgagactgaaaagatcgtgctcgaggccgggaatggcctcccctcctggaagttcaacgaccagctcttcccctgtgatgtttgtggaaaggtgttcgggcggcagcagaccctgtctcgacacctgtcccttcataccgaggagagaaaatacaagtgtcatttgtgcccatacgccgccaagtgtcgtgccaatctgaaccagcatctgacagtccacagcgtcaagctagttagtacagataccgaggatatcgtgtctgccgtgacgagcgagggctcggatgggaagaaacatccttattattactcttgtcacgtatgcgggttcgagacagaattgaatgtacagttcgtgagccacatgtccctgcacgtcgacaaagagcaatggatgttctcgatatgttgtactgcctgcgactttgttactatggaagaagccgagatcaagacacacatcggtacaaagcacaccggcgaggataggaagaccccatcagagtcaaactcacccagcagctctagtttgtccgcgctcagcgatagcgccaattcaaaagacgacagtgacggaagccagaaaaataagggggggaacaacctactcgtcatttccgtcatgccagggtcccagccctctttgaactccgaggaaaagccagaaaaagggttcgaatgtgtcttctgcaacttcgtgtgcaagaccaagaatatgtttgaacggcacctccagattcatctcataactaggatgtttgaatgcgacgtttgccataagttcatgaaaacacctgaacagctgctggagcataagaaatgtcatacggtccctaccggcggcctgaattcgggtcaatggtag

SEQ ID NO: 14797 - DNA, 2196 bp, Artificial Sequence
  Description of Artificial Sequence: Synthetic coding sequence
atgccaagacggaagcaggagcagcctaagaggctgccaagcccctctgaggaagaatctgggaagcccttccagtgcccgatttgtggactggtgatcaagcgcaagagctactggaagcgtcatatggttatacacacagggcttaagtcacatcagtgcccgctgtgcccctttaggtgcgcccggaaggacaatctcaaatcacatatgaaggtccatcaacatcaggaccgtggagaaacctttcagtgccagctatgccctttcaccagtagtaggcatttcagtctcaagcttcacatgcgatgccaccagcactttttacggacagaggctaaagtgaaagaagaaattccagatcctgatgttaaaggtagcccacacctgtcagattcggcttgcctcggccagcagcgcgagggaggaggcactgagctggttggcactatgatgactagcaacacgccagagcgcacatcacaagggggggctggagtaagtccactcctcgtgaaggaagagcctaaggaggataacggattacccacttcctttaccctgaacgctgctgatcgtccggcaaaccacactaaactgaaggatccaagtgagtatgtcgcaaacagcgcctctgcgctgtttagccaggatatttccgtcaagatggcttcagatttcctgatgaaattgagcgcggcgaaccagaaggagcccatgaacctgaattttaaagttaaagaagaacctaaagagggtgagtccctgagcaccacactgcctcgctctagttatgtcttttctccagagtcagaggtctccgccccaggggtgtctgaagatgcactgaagccgcaagagggcaaaggctccgttctgaggcgcgatgtgtccgtgaaggcagctagcgagctcctgatgaaactgagcgcggaatcgtataaggagacccagatggtcaagatcaaagaggagcccatggaggtggatattcaggactcgcatgtctctatttctccaagcaggaacgttggttatagcactttgatcgggagagagaaaaccgaacccctgcagaagatgcctgagggtcgcgtgcctcctgaacggaacctgttctcccaggatattagcgttaagatggcaagtgagctcctttttcaattgtctgagaaggtgtcaaaagagcacaaccacaccaaagaaaacacaatccgcaccactacctccccctttttcagtgaggacactttccgtcagtccccgtttacctccaacagcaaagagctcttgcctagtgatagcgttctgcacggacggatctcagccccagaaaccgaaaagatcgtcttggaggccggcaacgggcttccgtcatggaagttcaatgatcagctgttcccttgtgacgtctgtggtaaggtatttggcagacagcaaaccctgagccgacacctgagtctgcatacggaagagcgcaagtataaatgccatctttgcccgtacgctgctaaatgccgagcaaacttgaatcaacacttgaccgtccattctgtgaaactggtgtccaccgacacagaggacattgtttctgcggtgacatcagagggctcagacgggaaaaaacacccatactactactcatgccacgtctgtgggtttgaaactgagctgaacgtccagttcgtctcccacatgagtttgcacgtagacaaagagcagtggatgttttccatttgttgcacagcctgtgattttgtaactatggaggaggccgagatcaagacgcatattgggactaaacacaccggagaggatcggaaaactccctccgaaagcaacagtccgagcagctcaagcctgtcagccttatcagactctgctaattctaaagacgattctgacggatctcagaagaacaaaggcgggaacaacttactcgtgatttcagtgatgcccgggtctcagccctccctgaattccgaggaaaagcccgaaaagggcttcgagtgcgtgttctgcaattttgtgtgcaagacaaagaatatgtttgagagacacctgcagattcaccttataactcggatgttcgaatgcgacgtatgtcacaagttcatgaagaccccagaacagctgcttgagcacaaaaagtgccacacagtccccactggaggcctgaagcgtggtgcctggtag

SEQ ID NO: 14798 - DNA, 3246 bp, Artificial Sequence
  Description of Artificial Sequence: Synthetic coding sequence
atgccgcgaagaaagcaggaacaaccaaagaggttgccaagccacgtctcccgccaggaggaggcagagggagagcttagtgaaggagagcattggtatggaaactctagtgagaccccttccgaagccagctacggggaggtccaagagaactataagctctccctggaggatcgcatccaggagcaatccacctcgcctgacacatcactcgggagcactaccccctcctcccacaccctcgaactcgttgcactggattccgaggtcttacgggactctctgcaatgtcaagatcatctgagccccggggtgtccagtctgtgcgacgacgaccctggaagcaataaacctctgtcatctaatctgcggaggttgttggaagccgggtccttaaagctggacgcagccgcaacagcaaatggccgggtcgagagccctgttaatgtcgggagcaacctgtccttctccccgccgagccatcatgcccagcaactttcagtcctcgccaggaagttggctgagaagcaggagcagaacgaccaatacacaccttccaatcgcttcatatggaaccagggcaaatggctgcctaacagtactactacctgctcattaagcccagactctgctatactcaagctcaaggctgctgccaacgccgttctacaggacaagtcccttactagaaccgaagagaccatgaggtttgaaagcttttcatcccctttttcctcgcagagcgcaagttcaacgctggccgccttgagtaaaaaagtgagtgaaaggtccttaacgcccggacaggaacatccacctcccgccagtagttttcttagtttggcctctatgacatcatctgccgctctcttaaaggaagtcgccgcccgggcagcgggctccctgttagcagaaaagtccagcctgctccccgaggaccctttgccccctccaccttccgagaaaaaaccggaaaaggtgaccccacctcctccaccccccccaccacctccccccccccctcccccccagagcttagaacttctgcttctgcccgtccccaaaggtcgcgtctcgaagccctccaactctgcatccgaggaagagtccggcaaaccgttccaatgtcccatctgcggactggtgatcaagcgtaagtcttactggaaacgccacatggttatccacaccggtctgaagtcgcaccagtgcccactctgtccattccggtgtgcacgaaaggataatctgaaaagccacatgaaggtacaccagcatcaagatcgcggcgaaacctttcagtgtcaactatgccctttcacctccagccgtcatttcagcttgaagcttcacatgagatgccaccagcatttccttagaacagaggccaaagtgaaagaggagattcctgatcccgacgtcaagggcagcccacatctgtcagactctgcatgcttgggtcagcaaagggagggcggcggcacggaacttgttggaaccatgatgaccagcaacacccccgaacgaacttcccagggcggcgcaggggtctcaccgctgctggtgaaggaagaacctaaagaggataatggactcccgacgtccttcacgttgaatgcggccgaccgtcccgccaaccataccaagcttaaagaccctagcgaatatgtggcgaattcagcaagcgcccttttctcccaggacatcagtgtgaagatggccagcgatttcctcatgaagttgtcggccgctaatcagaaagagccgatgaatctaaacttcaaggtaaaagaagagcccaaggagggggaatctctttctacaactttaccaaggagcagctacgtcttcagtcctgaaagtgaagtatcagcccctggcgtgagcgaggatgcgcttaagccacaagagggtaaggggtccgtcctgcgacgcgatgtcagtgtgaaggcagccagtgagcttcttatgaagctgagtgccgaatcgtacaaggaaacacagatggtgaaaatcaaagaggaacccatggaagtggatattcaagattctcatgtcagcatcagtcccagtcgtaatgttggatacagcaccctaataggtagggaaaagacggaacccctgcagaaaatgcctgagggacgtgttcccccggaacgcaacctgttcagccaggatatttcggtcaaaatggctagcgaacttctctttcagctgtcggagaaggtgtctaaggagcataaccacactaaagagaataccatcaggactacaacatctccattttttagcgaggatacgttccgacagagccccttcacctcaaattctaaggagttactgccaagtgactctgtgctccacggtagaattagtgcccccgagaccgagaagattgtgcttgaagcgggcaatggtttgccaagctggaagtttaacgaccagctgttcccctgcgacgtgtgcgggaaggtgttcgggcggcagcagacactgagtcgtcatctttccctgcatacagaagagcgaaagtacaagtgccatctctgcccatacgcagccaagtgccgcgcgaatctgaatcaacatctgacagtgcacagtgttaaactggtctccacggacactgaagatatcgtatctgcggttaccagcgaaggctctgacggcaagaaacatccctactactactcatgccatgtttgtggcttcgagaccgaactgaacgttcaattcgtaagtcacatgtccctccacgtcgacaaagagcaatggatgttcagtatctgctgcactgcctgcgactttgtcaccatggaagaggcagagattaagacccacatcggcactaagcacacaggcgaggatcgaaagactccatccgagagcaacagtcccagcagcagcagtctctccgccttatcggattctgccaattccaaggacgatagtgatggatcgcagaagaacaaggggggtaataacttgctcgtgatatcagtcatgccagggagtcagcctagtctgaacagcgaggagaagccggagaagggttttgagtgtgtcttttgcaactttgtttgtaaaaccaagaatatgttcgagcgacacctgcagatccatttgattaccaggatgtttgagtgcgacgtatgccataaattcatgaagactccagaacagctcttagagcacaaaaaatgtcatacagtgcctaccggtggcctcaattcaggtcagtggtag

SEQ ID NO: 14799 - DNA, 2196 bp, Artificial Sequence
  Description of Artificial Sequence: Synthetic coding sequence
atgcctcgacggaagcaggagcagcctaagagacttccgtcgccgagtgaggaggaatcgggcaagccatttcagtgtcctatctgcggattggtgatcaagaggaagtcttactggaagaggcacatggttatccatacgggcttgaaatctcatcagtgcccactgtgtcctttccgttgcgcacgcaaggacaatctgaagagtcacatgaaggtgcatcagcatcaggaccgcggagaaacttttcagtgtcagctctgtccatttacaagcagcagacatttctccctgaaacttcacatgaggtgccaccagcactttctgagaaccgaggcaaaggtcaaagaagaaatcccggaccccgatgtgaaaggaagcccccatctgtccgacagtgcctgtctcggccagcagcgcgaaggggggggaacggagcttgtcggcacaatgatgacatctaacactccagagcgtaccagtcagggcggcgccggcgtttcccccttgctggttaaggaggagcctaaggaggacaacggtcttcctactagctttacgctgaacgccgctgaccgccctgctaaccacacaaagctcaaggaccctagcgaatatgtcgcgaactcagcttcagccctctttagccaagacattagcgttaagatggcttctgattttttaatgaagctatcagctgcaaatcaaaaggaaccaatgaaccttaattttaaggtgaaagaagaacccaaggagggcgagagtctgagtacaactctccccaggtctagttatgtgtttagcccggagagtgaagtctccgcacccggagtgtcggaagatgcactcaagcctcaagagggcaaggggagcgtgctgaggagggatgtcagcgttaaggccgccagcgagctgcttatgaaactgtcagccgagtcttataaagaaacccagatggtcaagatcaaagaagaaccaatggaggtggacatccaagactcacacgtttccatttcgccttcacgcaatgtgggttactctactctgatcggacgcgaaaagaccgaacctctgcagaagatgcctgaaggaagagtcccccctgagcgaaacctcttctcccaagatattagcgtcaaaatggcaagtgaactactcttccagctgagtgagaaggtctccaaggaacacaatcacacgaaggagaacaccatacgcacaaccacgagcccatttttctctgaggatacgtttcggcagagcccgtttacatccaattcaaaagagctgctcccaagcgattctgtgctccacggccggatctctgcacccgaaactgagaaaattgtcctggaggctggcaacggactgccgtcctggaagttcaacgaccagctgtttccttgtgatgtttgtggaaaagtgtttggaaggcagcaaactctgagcaggcatctctccctccataccgaggagaggaagtataaatgccacctctgcccttacgccgctaagtgtcgagccaacctcaaccagcatttaaccgtgcattctgtgaagcttgtgtcaacagacaccgaggacatcgtgagtgccgttacgtctgaaggatcagacggaaagaagcatccttattactatagctgtcatgtctgcggattcgagactgagctgaacgtccaatttgtcagccatatgagcctccatgtagacaaggagcagtggatgtttagtatctgctgtacagcctgcgacttcgtgacaatggaggaggctgaaataaagacccatatcgggacaaagcacaccggagaagacaggaagaccccatcagagtctaattccccatccagctcgtccttgtctgcgctttctgattcggccaactccaaggatgactccgatgggagtcagaaaaataaggggggcaacaatctgctagttattagcgtcatgcctggaagccaaccctcgctgaattccgaagaaaagcccgagaaaggctttgaatgtgtcttttgtaactttgtctgcaaaactaagaatatgttcgagagacacttgcagatccatctgatcacccggatgtttgagtgcgatgtttgtcacaaatttatgaagactccagagcaactgttggagcacaaaaagtgtcatacagtcccaaccggagggctgaattcgggacaatggtag

SEQ ID NO: 14800 - DNA, 3234 bp, Artificial Sequence
  Description of Artificial Sequence: Synthetic coding sequence
atgcctagacggaaacaggaacagccgaaacgcttacctagtcacgtatctcgtcaggaagaggcggaaggtgagctcagcgagggagagcactggtacggcaactcttcagagacacctagtgaggcatcttacggcgaggtgcaagagaactacaagcttagtttggaggacaggattcaggagcagagcacaagcccggacacctccctgggctcaacaactccatcttcccatactctcgagctggttgccctcgactccgaggtactccgggacagccttcagtgtcaggatcacttgtcgccaggcgtatctagtctatgcgacgatgatcctggatcgaacaagccactttccagtaacctccggaggcttctcgaggctggcagcctgaagctggacgcggccgccactgccaacggcagggtggagtcccccgtcaacgtaggcagtaatttgagtttttctccgcctagtcatcacgcccagcagctgtctgtcctcgctcgcaaacttgccgagaaacaggagcagaatgaccaatacacgcccagcaaccgcttcatttggaatcagggcaagtggctgcccaattccacaaccacctgctctttatccccagattccgcaatcttgaaactgaaagcggcagccaatgctgttctccaggacaagtccctgaccaggaccgaagaaacgatgcgttttgaatcattttcgtctccattctcctcccagagcgccagctccacactcgcagctttgagtaaaaaggtcagcgagcgcagcctaactccaggccaggaacacccgcctcctgccagctcctttcttagtctggcaagtatgaccagttcagccgccttgttgaaagaagtggccgccagagccgccggaagtttgttggcggagaagtcttctctgctccctgaggaccccctacctccccctccaagtgagaagaaaccggaaaaggtgaccccacccccacctccaccacctccaccccctccaccccccccgcctcagagcctggagttgctcctgctgccagtgcccaaggggcgggtctccaagccatcaaacagtgcgtccgaagaagaaagcggcaagccttttcagtgccccatctgcgggctggtgatcaaaagaaagtcctactggaaacggcacatggtgatccacacaggcttaaaaagccatcagtgtcccctgtgtcctttccgctgcgcccggaaggataatttgaaaagccatatgaaggtgcaccagcaccaagataggggcgaaacgtttcaatgccaattatgtccctttacatcaagccggcatttctcgcttaagttgcacatgagatgccaccagcacttcctcaggaccgaggcaaaagtcaaagaggagatacctgacccagacgtgaaaggctcacctcatttatctgattccgcgtgtctggggcagcagagagaaggcggaggaaccgaactggtcggcacaatgatgacgagtaacacacctgagagaacgagtcagggcggagcaggcgtctctcccctgctggtcaaggaggagcccaaagaagacaacgggttgcctacatcctttactttgaatgctgcagatcgtcccgcaaatcacaccaagttgaaagacccctccgagtatgtggccaatagtgcttcggccctgttttcccaggatatctcggtcaaaatggcaagcgatttcttgatgaagctgtctgccgctaaccagaaggaacccatgaacctaaactttaaagtgaaggaggaacccaaagagggcgaatcattgtctacgaccctcccgcgctcttcgtacgtatttagccctgagtcagaggtctcagcaccgggggtcagtgaagacgccctgaaacctcaagagggaaaaggcagtgtgctccggcgggatgtttccgtgaaggcagctagcgaactgctgatgaagctctccgcagaatcctataaagagacgcagatggtgaagattaaagaggaacctatggaagtagacattcaggattctcacgtttccatctctccaagtcgtaacgtggggtattcgacattaattggccgggaaaagaccgaaccactgcaaaaaatgccggaaggccgcgtgccccctgagagaaacttgttcagtcaggatattagtgtaaaaatggctagcgagctcctttttcagctcagtgaaaaggttagcaaggagcacaatcatactaaagagaatacaataagaaccactactagtccattttttagcgaagacacctttcgacagtctcctttcacctctaactctaaggaactccttcctagtgattccgtgttgcacggtcggatcagcgccccagagacagagaagattgtactagaagctggaaacggcctgccaagctggaagtttaatgatcagttgttcccatgcgacgtttgtggcaaagtctttgggagacagcaaacgttgagccggcatctctcactccatacagaagagagaaagtataagtgtcacctgtgcccctacgctgcaaaatgtagggccaacctcaatcagcacctgactgtacactccgttaagctcgtttcgacggacaccgaggacatcgtctctgccgtgacctctgaggggagtgacggaaagaaacacccttactactacagctgccacgtgtgtggatttgagaccgaactaaatgtccaatttgtgagtcacatgtcacttcatgtggacaaggagcagtggatgttctcgatttgttgtactgcgtgcgatttcgtgacgatggaggaagctgaaatcaaaacgcacatcggaacaaagcacaccggagaagatcgtaagacgccgagcgagagcaactcacccagttctagctcattatccgccttgtctgattcggcaaattcaaaagatgatagcgacggcagccagaagaacaaagggggaaacaacctgcttgttatttcagtgatgcctggctctcaaccaagtctgaattcggaggaaaagccagaaaaagggtttgagtgtgtgttctgtaatttcgtgtgcaaaactaaaaacatgtttgaacgtcacctgcaaattcatctcatcactaggatgttcgaatgtgatgtctgccataagttcatgaaaacacccgagcagctccttgagcataagaaatgccacacagttccaaccggtggcctgaaatag

SEQ ID NO: 14801 - DNA, 1299 bp, Artificial Sequence
  Description of Artificial Sequence: Synthetic coding sequence
atgcctcacagcccccttatatcaattcctcacgtgtggtgccaccctgaagaggaggagaggatgcacgatgagctattgcaagcggttagcaagggacctgtgatgtttcgggacgtcagcatcgatttttcccaggaggaatgggaatgcctagacgccgatcagatgaatctgtacaaagaggtgatgctagagaatttcagcaacctggtctcggtcgggctatctaatagcaagcccgccgtgatctctctcttggagcagggaaaggaaccctggatggtcgatagagagctgactcgcggactgtgcagcgatctagaatcgatgtgcgagaccaagatcctgtctctaaagaaacggcacttcagtcaggttattatcacccgcgaagatatgtctacattcatccagccgacgttcttgatcccaccccagaagaccatgtcagaggagaaaccctgggaatgcaagatttgtggaaagacgtttaatcaaaattcccaatttattcaacatcagcgcatccactttggagagaaacattacgagagcaaggagtatgggaaaagcttctccagggggagtttagtgacaaggcaccagagaatccatactggaaagaaaccatacgagtgcaaggaatgtggtaaagcatttagctgttccagttatttcagtcaacaccagcgcatccatacaggggaaaagccttatgaatgcaaagagtgtgggaaggctttcaagtactgctcgaaccttaatgatcatcagcgcatccacacaggagagaagccttatgagtgtaaagtatgcggtaaggcctttactaagtcctcacagcttttcttacatctccgaattcataccggagagaagccatacgagtgtaaagagtgcgggaaggcatttacacagcattctcgccttattcagcaccagcggatgcacaccggcgaaaaaccctacgagtgcaagcagtgcggaaaagctttcaactctgctagcaccctgacgaaccatcacaggattcacgccggcgaaaaattatacgaatgtgaagagtgccggaaggcattcattcagtcctccgagctcatccagcaccagaggattcacacagatgagaaaccctatgagtgcaatgaatgtggcaaggcatttaacaagggttcaaaccttacacggcatcaaaggatccacactggcgagaaaccttacgattgtaaggagtgtggaaaggcattcggcagccgcagcgacttaatcagacacgagggaatccatacaggatag

SEQ ID NO: 14802 - DNA, 1299 bp, Artificial Sequence
  Description of Artificial Sequence: Synthetic coding sequence
atgccccattcccccctgatctcaattccccatgtgtggtgccacccagaagaagaagaaagaatgcatgacgagctgctccaggctgtgtccaagggcccggtgatgttcagggatgtgagcatagacttctctcaagaagaatgggagtgtctggacgccgatcagatgaatttgtataaagaggtgatgctggagaacttcagcaatcttgtatctgtgggtctgagcaacagcaaaccggccgtcatctccttattagagcaaggcaaggagccctggatggtagacagggaacttacccgcggcctgtgctctgatttggagagcatgtgcgaaacaaagattctgtccttgaagaagaggcacttttcgcaggtcatcattactcgcgaggacatgtctacatttattcaacctacattcctaatccctccccagaagacaatgagcgaagagaaaccctgggagtgtaagatctgcgggaagacattcaatcaaaatagtcagtttatacagcaccaaaggatacactttggcgaaaaacattatgagtctaaagaatacgggaaaagctttagccgaggctccctggtgactcgccaccaacggatccatactggcaagaagccctacgaatgtaaagagtgcggcaaggccttttcctgctccagttactttagccagcatcaacgcatccatactggcgaaaaaccgtacgagtgtaaagagtgcggaaaggccttcaaatattgttcaaatcttaacgaccatcagaggatccacactggcgaaaagccgtacgagtgtaaggtttgcggtaaggcttttacgaagagctcacagctctttttgcacctgagaatccataccggggagaagccttatgagtgtaaggagtgtggcaaggccttcacgcagcacagccggcttattcagcaccagcgaatgcatacgggagagaaaccctacgagtgtaagcaatgcggaaaagccttcaactccgcttccactctgacaaaccaccataggattcacgcgggagagaaactctacgaatgtgaggagtgtaggaaggctttcatacaaagttcagagctgatacagcaccagcggatccatactgacgagaagccgtacgagtgtaatgagtgtggaaaggcctttaacaaagggtccaacctgactcgccaccaacgcatacacaccggagagaagccctatgattgtaaggaatgcggtaaagcttttggatcacggagtgacttgattcgccacgagggcatccatacggggtag

SEQ ID NO: 14803 - DNA, 2811 bp, Artificial Sequence
  Description of Artificial Sequence: Synthetic coding sequence
atggctctgactcaaggacctctcactttccgtgacgtcgccattgagttttctcaggaagagtggaagagccttgatccagtacagaaagctctgtattgggacgttatgttggagaattatcgcaatctggtattcctgggaattctgcccaaatgtatgacgaaggagttacctcctataggcaactctaatacaggtgagaaatgtcaaacagttactctggagcgacacgaatgctatgacgtcgaaaacttctacctgcgtgagattcagaagaacctccaggacttggaatttcagtggaaagacggcgaaatcaattataaagaggtgccgatgacctataagaacaacctcaacgggaaaaggggacaacatagccaagaagacgttgagaataaatgcatcgaaaaccagctgaccctgagttttcagagccgccttactgagcttcaaaaatttcagacagaaggcaagatttatgagtgcaatcagtccgagaagacagtaaacaactctagcctggtgtcaccacttcagcggatcctgccatcagtccagactaatatctcaaagaaatacgaaaatgaatttttgcagctgtctctgcctactcagctagagaaaacacatatccgagaaaaaccctacatgtgtaaaggttgcgggaaggcatttagggtgtcgtctagtctgattaaccaccagatggtccacacaacggaaaagccctataagtgcaacgaatgcggaaaggccttccaccggggcagcctgctgacgatccatcagattgtccacaccaggggcaaaccctaccagtgcggagtgtgtggaaagattttcaggcaaaactcagatctagtgaatcacaggaggagtcacactggggagaaaccatataagtgtaacgagtgcgggaaatccttctcccagtcgtataacctggcaatccaccagcgtatccacactggcgagaaaccctacaagtgtaatgaatgcgggaaaacattcaaacagggcagctgcctgaccacccaccaaatcatacacactggcgaaaagccttaccaatgcgacatttgtggcaaagtgtttcgccaaaactcaaacctggtgaaccatcagcgcatccacacgggcgagaaaccatataagtgcaacatctgtggaaagtccttcagccagagctcaaacctagccactcatcagaccgtgcactccggaaataaaccttataaatgtgatgaatgtggaaagaccttcaagcgcagttcttccctcaccacacatcagattattcacaccggtgagaaaccttatacctgtgacgtgtgcgataaagtcttcagtcagcggtctcagctggcgaggcatcagcggagccatacaggagagaaaccgtacaagtgcaacgaatgtgggaaagttttctcccagaccagccatctcgtcggacatcggagaatccacaccggtgagaagccatacaagtgcgataagtgtggtaaagcgttcaaacagggcagtctgctcactcgccataagatcatccacaccagggagaaaagatatcagtgcggggaatgcggcaaggttttcagtgagaattcctgtcttgttcgccacctgcgcatacatactggcgaacaaccttacaaatgtaatgtgtgcgggaaggtttttaattacagtggtaacctaagcatccacaagagaatacacactggcgagaaaccttttcagtgcaacgagtgcggcaccgtgttccgcaattatagttgcctggcccgccacttgagaatacatacaggacagaaaccttacaaatgtaatgtttgtggcaaagtgtttaatgacagcgggaatctatctaatcataagagaattcacacaggggagaagcccttccaatgcaatgagtgcgggaaggtcttctcatactactcttgcttggcccggcatagaaagatacacaccggcgaaaagccctacaagtgcaatgattgcgggaaggcatatacgcagcggtcttctcttaccaaacacttgattatccacacgggagagaaaccatacaattgcaatgagttcggcggcgctttcatccagagctcaaaactcgcaagatatcatcgcaatcccaccggcgaaaagcctcacaagtgctcccactgtggcagaacattttctcacattacagggctgacctatcaccagcgcagacacactggcgagatgccttacaagtgtattgaatgtggacaggtctttaatagtacttccaatctggcaagacataggcggatccacaccggcgaaaagccttacaagtgtaatgagtgtggcaaggtattcaggcaccagtccacgcttgcacggcatagaagcatccatacgggggagaagccttacgtgtgcaacgaatgtgggaaggccttcagggtcagatccattttggtgaaccaccagaagatgcacactggcgataagccctataagtgcaatgagtgcggcaaagcttttattgagcgttctaaacttgtgtaccaccagaggaaccacacaggagagaagccgtacaaatgcattgaatgcggtaaagcattcgggagattttcctgtctgaacaaacatcagatgatccactctggagaaaagccatataagtgcaatgagtgtggcaaatcctttatatcaaggagcggactgacgaagcatcagacgaaacacactgccgagtccctcaaaacgaagtttaacgttgaaaagccacttgacgtgctccttacctccggttttaaatag

SEQ ID NO: 14804 - DNA, 534 bp, Artificial Sequence
  Description of Artificial Sequence: Synthetic coding sequence
tccctaccaactcagttggagaagacacacatcagagaaaaaccatatatgtgtaagggttgcggtaaagcctttcgtgttagttcatctttgatcaaccatcagatggtacataccacagagaaaccatataagtgcaatgagtgtgggaaggcattccatcgggggtcgcttctaactattcaccagatagtccacacacgaggaaagccttatcagtgcggagtttgtggcaagattttcaggcagaacagcgatctggtgaaccacaggcgctcacatacaggagagaaaccctataaatgcaacgagtgtgggaagagcttcagtcagagctacaatctggcaatccatcagaggatacatacaggggaacagccatataagtgcaatgtctgcggtaaagtcttcaattacagcgggaacctttcaatccacaagcggatacataccggtgaaaagcctttccaatgcaatgagtgcggcaccgtattccggaattactcctgcctggcccgccaccttcgtatctag

SEQ ID NO: 14805 - DNA, 1596 bp, Artificial Sequence
  Description of Artificial Sequence: Synthetic coding sequence
atggaggcgcccgcccagaaagcagggcagggcggtcttcccaaggccgacgctcagggcgctagcggcgcacgcgagaaacgccccgaggaacctaggccacttgaggaggatcgggctggtagtcgccccacccagaaaggagatttgcggggtgctgccgggggcagaactactccacctggcggggggagccgcggatgcagcctgggggtctccccagggcccgggacaaggcatagcgctgggacaagacctttggtccgagaaccttgcggaccaaccagtagccagaatcccgagctagtaattcctgaaggcctgcaagcccgggaaggtccttgtcggtcccctgcgagaggcggcgattgctcaaggaacagttgcttggcatggcacagaggagctcccgccggtgaaactcctcccgtatgcgacccgtgcccagagaggatacagaatcaccccagaacgcagttgtgtgaggtgcacaccgattgctggccctgtcaacctggcaccggggccccaacgtgccctcggacacccaagcctaccagcaggggccgcaacccattggtagagcaaccccgtgcatgcgcttgcggggaggcttttgcatggagagcactgagaatcccacaggagagactccaggcaacagaggaacctagaccatgtgcgaggtgtgggaaacggttccgccccaaccagcagcagcaagctggaaagagcccacctgtgtgcccagagtgtggacagaccagtaggccacgaccaattgtgcctgacccgcctgcccagcgcctctatgcctgtgacgaatgcggaaaagcgttcactaggacttctagcctgctccagcaccagcgtatacacacaggggaaaggccctatgaatgtgctgaatgtgggaaggcctttgttcggtgttccggcctatatagacaccagaagacccacagcgcggaaaggcacaggaggggtcccgtgcttgccagacgggctttccgcctggggtgtccgccttgtggtgattacagcgagcggtccccacggagaggctctggggccggcgaaaaaccgtacgaatgtgccgattgtgctaaagcttttgggctgtttagccacctcgtcgagcacaggagagtgcacacaggagaaaagccctatgcatgtccagagtgcggcaaagcattcaaccagcggtccaatttgagcagacatcagagaacacactcttccgcaaagccctatgcatgccctctgtgcgagaaagcattcaagggcagatctgggctagtacagcaccaacgcgcacataccggagaacgaccatacgggtgctccgaatgtggcaaaacatttcgaggatgctcggaattgcgccagcatgaaaggctgcatagtggagagaagccttacatctgcagggactgcggaaaggcgttcgtcagaaactgttccttggtgaggcatctaaggacccacacgggagaacgcccttatgcttgtggtgattgtggccgggctttcagccagagatcaaacttgaatgagcatcgcaaaaggcatgggggtcgcgccgcaccatag

SEQ ID NO: 14806 - DNA, 1596 bp, Artificial Sequence
  Description of Artificial Sequence: Synthetic coding sequence
atggaagcgcccgcccagaaagccgggcagggcggactgccaaaagcggatgcccagggcgcatctggggcacgggaaaaaaggccggaggagcctagaccactggaggaagatagggctggatccagaccaacgcagaagggtgatctgaggggcgcagcaggagggcggacaactcctcccgggggcggctctagaggctgctccctcggagtgagtccgggccctggtacacggcatagcgctggaacccggcccttagtgcgcgaaccttgtggacctacgagcagtcaaaaccccgaactggtcattcccgagggtctccaggcccgggagggcccctgtaggagtcctgcacgtgggggcgactgcagccgaaattcatgtttagcgtggcacagaggagcacctgcaggagagaccccccctgtgtgcgacccctgccccgaacgcatccagaaccacccaagaacgcagttgtgcgaagtccataccgactgctggccatgccagccaggaacaggcgcccccacctgccccaggacgcccaaaccaacatctcgcggccgaaaccctctcgtagagcagcctcgcgcatgcgcctgcggcgaggcatttgcatggcgcgctctgcggataccgcaggagcgcctgcaggccacagaagagccccgcccctgtgcacgttgtggtaaaaggtttaggcccaaccagcagcagcaagcagggaaaagcccgcccgtctgtccagagtgcggtcagacctccaggccaagacccatcgtccccgatccacctgcacagcgcctgtatgcatgcgacgaatgcggtaaggccttcacacgcacatccagcctgctgcagcatcaaagaatccatactggcgaaagaccttacgaatgcgcagagtgcggcaaagccttcgtacggtgctctggattatatagacatcagaagacccatagcgcggagcgtcatcgcaggggcccagtgctagcccgacgtgccttcagactggggtgtcctccctgtggagactacagcgaacgatccccgaggagaggtagcggtgctggagaaaaaccctatgaatgtgcggattgtgccaaggctttcggcttgtttagtcatctggtagagcaccggagagtgcacactggcgaaaaaccatatgcctgccctgagtgcggaaaggccttcaatcaaagaagcaacctttcgagacatcagcgtacccactcttcagccaagccttacgcatgccctctttgtgaaaaagcatttaaaggcaggagcggactggtgcagcaccaacgggcccacaccggagaaagaccatatggctgctccgagtgcgggaaaacattccgcggctgctctgagcttcggcagcatgagaggctgcacagcggagagaaaccttatatctgccgggactgcggaaaggcctttgtgagaaactgcagcctggtgcggcatctccgcacgcacacaggagaaaggccctatgcatgtggggactgtgggagggcattttctcagcggtctaatctgaacgagcatcggaaaagacacggcggcagagctgccccgtag

SEQ ID NO: 14807 - DNA, 2217 bp, Artificial Sequence
  Description of Artificial Sequence: Synthetic coding sequence
atgaccatgctccaggaaagtttttcttttgatgatctgtccgtagactttacccagaaagagtggcagctgctggacccatcccagaaaaatctctataaggacgtgatgttagagaattactcctcgctagtgagcttgggatacgaggtcatgaaacctgatgtcatctttaaactggagcagggagaggaaccctgggtcggtgatggcgagattccctcgagcgactcccccgaagtctggaaagtcgatggaaacatgatgtggcaccaggacaaccaggacaagcttaagatcatcaagcgggggcacgaatgtgacgctttcgggaaaaacttcaatttgaatatgaatttcgtaccactacgcaaatctaattccgagggggacctggacgggcttattctgaagcaccatttagatcttttgataccaaagggggactatggcaaagccgaaagcgacgacttcaatgtttttgataatttctttctccactctaaaccggaggataccgatacctggctaaagtactatgactgcgacaaatataaggagtcctacaaaaaatctcaaataatcatataccacaggaatcgactcggggagaagttatacgaatgctcagagtgtcgcaagagattcagtaaaaagccgtcactaatcaagcatcaatccaggcacattcgggacattgccttcggatgcggcaattgcggcaagaccttcccccagaagtctcaatttataacccaccaccgcactcacacgggagaaaagccatataattgcagtcagtgcggaaaagcgttttcccagaagtctcaactgacctcgcatcagaggacacatactggtgaaaagccctatgaatgtggcgaatgtgggaaggctttctcccgcaagtcgcatctgatatctcattggcgaacgcatactggtgaaaaaccctacggctgcaacgagtgtgggagagccttcagcgagaagtccaacctaataaatcaccagagaatccacactggagagaagcccttcgagtgtcgcgaatgcgggaaagctttctctcgaaagtcccaactcgttacccaccatcgcactcacacaggcacgaagcctttcggttgtagtgattgtcgcaaagcatttttcgaaaaatccgagcttataaggcatcagaccattcacaccggggaaaagccgtacgagtgtagtgagtgtcgaaaggcctttagagaaaggtcctctctgatcaatcatcagcgaacccatacaggtgagaaaccccacggatgtatccagtgcggcaaggccttcagccagaagagccacctcatctctcatcagatgactcataccggcgagaaaccttttatttgctccaaatgtggaaaggccttctcccgcaaaagccagctggtgcggcaccagcggacacacaccggggagaagccgtatgaatgtagtgagtgtggcaaggctttctctgaaaagctcagtctgacaaaccaccagcgtatccacacaggggagaagccctacgtctgctctgagtgtggcaaagctttttgtcagaaaagccatctaataagccaccagcggacccatactggcgagaagccctacgagtgttctgaatgtggaaaagcctttggcgagaaatcgagccttgctactcaccaacgtacccacaccggagagaaaccttatgaatgcagagactgcgagaaagccttcagccaaaaatctcaattgaacacccatcaaaggattcatacgggcgaaaagccctacgaatgcagtctgtgtagaaaagcatttttcgagaagtcagagctgatccggcaccttcgtacacatacaggggagaagccatatgagtgcaatgaatgtcgcaaagcatttcgtgaaaaatccagcctgatcaatcaccagagaattcataccggggagaagcctttcgagtgtagcgagtgtgggaaagcgtttagtcgaaaatcccatctgattccccaccagaggacccatacaggcgaaaagccttatggctgctcagagtgtaggaaagcatttagtcagaaatcacagcttgtgaaccaccagaggattcacacaggggagaagccctataggtgtatcgagtgcggcaaagcgttctctcagaagtcacagctcatcaatcatcagcggacgcacacagttaaaaaatcatag

SEQ ID NO: 14808 - DNA, 2217 bp, Artificial Sequence
  Description of Artificial Sequence: Synthetic coding sequence
atgaccatgctacaggaatctttttcctttgatgacttatccgtcgattttacccaaaaggagtggcaactgctggatccgtcacagaagaatctttataaggatgtgatgcttgagaactactcttcactggtcagtttagggtatgaggtgatgaagcccgatgtaatctttaaactggagcagggcgaagaaccatgggtaggtgacggcgagatcccctcctcagacagcccagaagtgtggaaggtggacggtaatatgatgtggcatcaggacaaccaggataagcttaaaatcatcaagcgcggccacgagtgcgatgcctttggtaagaactttaacctcaacatgaatttcgtgcctcttcgcaagagcaattcagaaggcgaccttgacggccttatattgaagcaccacctcgatctactgatccctaagggagactatgggaaggctgaaagcgacgatttcaacgtcttcgacaactttttcctccacagtaaaccagaggatactgacacctggctgaaatactacgactgtgataagtataaagaatcctataagaagagccagatcatcatttaccacaggaacagattgggggagaaactctacgagtgtagtgaatgccggaagcgcttctcgaaaaaaccctcactgatcaaacatcagagccgccacatcagggatatcgccttcggttgcgggaattgcggtaaaacattccctcaaaagtcacagtttatcacacaccaccgcacacacaccggggagaagccctataattgcagtcagtgtggaaaagcctttagccagaagtcacagctcacctcccaccagagaacgcacaccggggaaaagccttatgagtgtggcgaatgtggtaaagccttcagtcgaaaatctcatctaatctcacactggaggactcatacaggcgaaaagccatatggatgtaacgaatgcggtagggctttttctgaaaagtccaacttgattaaccaccagaggattcacacgggtgagaagcctttcgagtgtagagaatgtggtaaggccttttccagaaagtctcagctggttacccaccatagaacccatactggaacaaagccatttggttgtagcgactgtaggaaggcttttttcgagaagagtgaactcattcgccatcagaccattcacaccggagaaaagccctatgaatgctccgagtgtaggaaagccttccgagagcggagctctctgatcaatcaccaaaggacccacaccggcgaaaaaccccacgggtgcatccaatgcggcaaggccttttctcagaagtcacatcttataagtcaccagatgacccacaccggcgagaagcctttcatttgcagcaagtgtggcaaagctttcagtagaaagagccagctggtgagacaccagcgcactcacactggagagaagccatacgagtgtagtgagtgcggtaaggcgttctccgagaagttgtccctgactaaccatcagcgcattcacaccggcgagaagccttatgtgtgcagtgaatgcgggaaggcattctgtcagaagagtcaccttattagtcaccaacgcacccacactggagaaaaaccgtatgaatgcagcgaatgcggtaaagcttttggagagaagagttcactggccactcatcagagaacccacacaggcgaaaaaccctacgaatgccgggactgcgagaaagcatttagccagaagtcacagctcaacacccaccagcgcatccacactggcgagaaaccttacgagtgttccctttgtcggaaagcatttttcgagaagagtgagctcatccggcatctgcgtacccatacaggcgagaagccctacgaatgtaacgagtgtcggaaggccttcagggagaaatcttcacttatcaaccaccagcgcattcatacaggggagaagccatttgaatgttcagagtgcggaaaggcgttttcaagaaagagtcacttgattccccatcaaagaactcacaccggcgaaaagccctatggctgctcggaatgccgaaaggccttttcccagaaatcgcaactggtcaaccaccagaggatccacaccggggaaaagccttataggtgcatcgaatgtggaaaagcgttctcacagaaatcccagctcataaaccaccaaagaacacataccgttaagaaatcttag

SEQ ID NO: 14809 - DNA, 210 bp, Artificial Sequence
  Description of Artificial Sequence: Synthetic coding sequence
atgaccatgcttcaggagagtttttcatttgacgacttgagtgttgacttcacacaaaaggaatggcagctgctggacccctcccaaaaaaatctgtataaggacgttatgctcgagaactactccagtttagtgtctctgggctatgaagtcatgaagccagacgtgattttcaaactcgagcagggcgaggaaccatgggtgggctag

SEQ ID NO: 14810 - DNA, 2217 bp, Artificial Sequence
  Description of Artificial Sequence: Synthetic coding sequence
atgaccatgctgcaggagtccttctcttttgacgatctgagcgtggatttcacgcagaaagagtggcagctgctcgatccatcacagaaaaacctgtacaaagacgtgatgcttgagaattactccagccttgtctcactgggatatgaagtgatgaaacctgacgtgatcttcaagcttgagcaaggtgaggagccatgggtgggtgacggggagatcccttctagtgatagcccagaggtgtggaaggtggacggaaatatgatgtggcatcaggataaccaggataagctcaagataatcaagagaggtcatgagtgtgatgccttcggaaagaattttaatttgaatatgaatttcgtacccctgcgaaagtcaaatagtgaaggtgacctggacggtttgatcttgaagcatcacctggaccttctcattccaaaaggtgactatggcaaagccgagagcgacgatttcaacgtgttcgacaacttcttcctgcacagcaagcccgaagatactgatacttggctcaagtattatgactgcgacaaatacaaggagtcttacaagaagagccagattattatctatcacagaaaccgcttgggcgagaaactctacgaatgcagtgagtgtaggaagcgctttagcaagaagccctcattaatcaagcatcagtcgagacacatccgggacatcgcatttggatgcggaaactgcggcaaaacttttccacagaagtcacaatttataacccatcaccgaacccataccggcgagaagccctacaattgtagccagtgcgggaaagcattttcgcaaaagtcccagctgacatctcaccagcggacccacacaggtgagaagccgtacgagtgcggcgaatgtgggaaagcatttagtcgaaagtcccacctgatctcccattggagaacgcatactggtgagaagccctacgggtgtaacgaatgcgggcgggccttctccgagaagtcaaatctgattaatcatcagcgcattcatacgggggaaaaacccttcgagtgcagggaatgcggtaaagcattctctcgcaagtcacagctcgtcacccatcacaggactcatactggaactaaacccttcggatgttctgactgtaggaaggcattttttgagaagagcgagctcatacggcatcaaacaatccacacaggtgagaagccatacgaatgctccgagtgcagaaaggcctttagggaacggagctctctgattaatcatcaaagaacccacaccggtgaaaagcctcacggttgtattcaatgcgggaaggcctttagccagaaaagccatctgatctcgcatcaaatgacacacacgggtgagaaacctttcatatgctctaaatgtggaaaagcgttctctcgaaaatcccaactcgtgagacaccagaggacccacacaggtgagaagccatacgagtgctcagagtgcggtaaagccttctcagaaaagttatcactcacaaatcaccagcggatccacaccggcgaaaagccttacgtatgtagcgagtgcgggaaggccttctgtcagaaaagccacctgatcagtcaccaacgaacccacaccggggagaagccttatgagtgttctgaatgcggtaaggcattcggtgaaaagagctctctagccactcaccaaagaacacatacaggggaaaaaccgtacgagtgtcgcgactgtgaaaaagcattttcccagaagtcgcaactgaatactcaccagcgaatccacaccggtgagaagccttatgaatgctcactgtgccgaaaggccttttttgaaaaaagcgaattgatccgtcaccttcggactcatactggcgaaaaaccttacgagtgtaacgagtgtcgcaaggcgttcagggaaaaaagtagcctgatcaaccaccagcgaatccacaccggagagaagcctttcgaatgcagcgagtgcggaaaagcttttagccgcaagtcacacctcattccgcatcagcggacacatacgggggaaaagccctatgggtgtagtgaatgccgcaaggccttctcccagaagtcccagctggtgaaccatcaacgcatacacacaggggagaagccatatcgctgtatcgagtgtgggaaggcctttagtcagaagtcacaactcatcaatcaccagagaacccacacagtgaagaaaagttag

SEQ ID NO: 14811 - DNA, 168 bp, Artificial Sequence
  Description of Artificial Sequence: Synthetic coding sequence
atgactatgctccaggagtctttcagcttcgatgatctaagcgtcgactttacccagaaggagtggcagctgctcgatccctcacaaaagaacctgtataaagacgtgatgctggaaaattattcttccctggtgagcctcgggtacgaggtcatgaagcccgactag

SEQ ID NO: 14812 - DNA, 2217 bp, Artificial Sequence
  Description of Artificial Sequence: Synthetic coding sequence
atgacaatgttacaggagtcattctcctttgacgatctcagcgtggatttcacgcagaaggagtggcagctgctggacccatctcagaaaaatctctacaaagacgtgatgctggaaaactattcgagcctggtgtctcttgggtatgaagtcatgaagccagatgttatttttaaactggaacagggcgaggaaccttgggtcggagacggcgaaattcctagctcagattcccctgaggtctggaaggtggacgggaacatgatgtggcaccaagacaatcaggacaagctgaaaattattaagcgcggccacgaatgcgatgcttttgggaagaacttcaatctcaatatgaattttgtgcctcttcgaaaatcgaactccgaaggcgatcttgacggcctaattttaaagcaccatctggatttactgattccaaagggcgattatgggaaggccgagtccgacgactttaatgtttttgacaatttctttctacatagcaagccggaggataccgacacctggctgaaatactatgactgcgataagtataaggaatcgtacaagaaatcacagataatcatctaccatagaaacaggcttggagagaagctctatgaatgcagtgaatgtagaaaaaggttcagtaaaaagccatcattgatcaagcaccagtccagacacattcgggacatagcctttggatgtggaaactgcggaaagacatttccccagaaatcccagtttattactcatcacagaacacataccggtgaaaagccgtataactgtagtcagtgcgggaaggcgttcagtcaaaaatctcagttaacttcacatcagcgaacacataccggggagaagccttacgaatgcggtgaatgcgggaaagcctttagccggaagtcacatctgatttcccattggcgcacccatactggtgagaagccttacgggtgcaacgagtgtggtcgggccttttctgagaaatcaaatctcatcaaccaccagcggatccacaccggtgaaaagccgttcgaatgtcgcgagtgcggcaaagcattctctagaaagagtcaactcgtgactcaccacagaacacacactggtacaaagccatttgggtgtagtgactgtagaaaagctttctttgaaaaaagcgagctcattcgccatcaaaccatacatacgggcgaaaaaccttacgaatgcagtgagtgccgaaaggcatttagagaacgtagttcacttatcaaccaccagagaacccacaccggcgaaaaaccacacggctgcattcagtgcggcaaggcgttctcacaaaagtcacatctgattagtcaccagatgacccatacaggggagaagccctttatctgttctaagtgcggaaaggccttttctaggaagtctcagctggttaggcatcagaggacacacacaggagaaaaaccctatgagtgttcagagtgtggaaaggcattttctgagaaactgagcttgaccaatcaccagcgcatccacacaggagagaaaccttacgtgtgctctgagtgtggcaaagcgttctgtcagaagagccacctaataagtcaccagaggacccataccggcgaaaagccttatgagtgcagtgaatgtggcaaggcttttggagaaaagtcctctctcgccacccatcagcgtacacacacaggtgaaaaaccatacgaatgcagagattgcgagaaggcttttagccaaaaaagtcaactgaatacacaccagcgaatccacacgggcgagaagccgtacgaatgctctctgtgtcggaaggcctttttcgagaaatctgaactgattagacacctccgcacccacaccggagagaagccctacgagtgtaatgaatgccgaaaggctttccgcgagaaaagttccctgattaatcaccagcgcattcatacaggcgagaagccttttgaatgtagcgaatgtggcaaggcattctcgcggaagtctcatctgatcccacatcagcggacacacactggtgaaaagccctacggttgtagtgagtgcaggaaggccttcagccagaagtctcagctggtcaatcatcagaggatccacactggggaaaaaccttaccggtgcatcgagtgcggcaaggcattttcacaaaaatcccagctaattaaccaccaaagaacacacaccgtcaagaagtcctag

SEQ ID NO: 14813 - DNA, 711 bp, Artificial Sequence
  Description of Artificial Sequence: Synthetic coding sequence
atgactatgctgcaggaatctttcagcttcgacgacctgagcgtagactttacacagaaagaatggcaattgttggatccaagccagaagaacctgtataaggacgtcatgctggaaaattactcctctctggtatcattgggatacgaggtgatgaagcctgacgtgatcttcaagctggaacagggggaggaaccgtgggtgggagatggggaaattccaagctccgactcaccagaggtctggaaagtggatggtaatatgatgtggcatcaggacaaccaggacaagctgaagattattaagcgggggcacgagtgcgatgcctttgggaagaactttaatctgaacatgaacttcgttcccctcaggaagagtaactccgaaggagatctggatggattgatcctgaaacaccacttggatctgttgatccccaaaggggactacgggaaggccgaaagtgatgatttcaacgtttttgataatttcttcctgcacagtaagccagaggacacagatacctggttgaaatactatgattgtgacaagtataaggagagttacaagaagagtcagattattatttaccatcgcaatcgtctgggtgagaaactgtacgaatgctcagagtgtagaaagaggttctcaaagaagccttctctgattaagcaccagtcacggcatattagggacatcgccttcggatag

SEQ ID NO: 14814 - DNA, 204 bp, Artificial Sequence
  Description of Artificial Sequence: Synthetic coding sequence
atgactatgctgcaggagtcgttcagtttcgacgacctttctgttgacttcacacagaaggagtggcagctgctggacccctcacagaagaacctgtataaggacgtgatgcttgaaaactacagttccctggtgtcgctcggatacgaagtgatgaagcccgatgtcatctttaagctggagcaaggtgaggaaccctggtag

SEQ ID NO: 14815 - DNA, 237 bp, Artificial Sequence
  Description of Artificial Sequence: Synthetic coding sequence
atgaccatgttacaggaaagtttctcctttgacgatctgtctgtcgactttactcaaaaagaatggcagctgctcgatcctagccaaaaaaatctgtacaaggacgtgatgctagagaactatagctctcttgtgtcgctgggatatgaagtgatgaagcccgatgtgatctttaagttggaacaaggggaagagccctgggtgggcgacggcgaaatcccttcttctgactcatag

SEQ ID NO: 14816 - DNA, 2214 bp, Artificial Sequence
  Description of Artificial Sequence: Synthetic coding sequence
atgaccatgttgcaggaaagtttcagcttcgatgacctgagtgtggacttcacccagaaggaatggcagctcttagacccaagccagaaaaatctctacaaggatgtcatgttggaaaactactcctccctcgtgtccttgggttatgaagtgatgaagccagatgtgattttcaaactggagcagggtgaggaaccatgggtgggagacggcgaaatccctagctcagattcccctgtgtggaaggttgacggaaatatgatgtggcaccaggataatcaggacaagctgaaaattatcaagaggggtcacgagtgtgatgcctttggcaaaaactttaatttgaatatgaatttcgttcccctgagaaagagtaatagtgagggcgacctggacgggctgattctgaagcatcatctcgatttactcatacctaaaggcgactacggaaaggccgaatccgacgattttaatgtcttcgacaatttttttctgcactctaaacctgaagatacggacacatggttgaaatactacgattgtgacaaatacaaggagtcatataagaagagtcagattatcatttaccaccgcaaccgattgggcgaaaagctgtatgaatgctccgagtgtcgaaagcgtttctcaaagaaaccctcgctgatcaagcaccaatctaggcacattagggacattgcctttggttgtggcaattgcggaaaaactttcccccagaagagccagtttatcacccatcacagaacccatactggagagaaaccatacaattgctcacagtgcggcaaggcctttagccaaaaatctcagctgacgtctcaccagaggacccataccggcgaaaagccctacgagtgcggagaatgtggcaaggccttctctcggaagtcccacctgatttcacattggagaacacatacaggggaaaaaccatacggatgtaatgagtgcgggcgcgctttctccgagaagtccaacctgatcaaccaccagcgcatacatacaggggagaaaccctttgagtgtcgggagtgcggtaaagcattcagtcgtaagtcacagttggtcacccatcaccgtactcataccggcacaaagccttttggctgctccgactgtaggaaagctttttttgagaagagtgagctgattcggcatcagacaatccacacaggcgagaagccttacgagtgctccgaatgcaggaaagcattccgcgagaggtcgtcgctcattaaccatcagcgaacacacactggtgagaagcctcacggatgtatccaatgcggtaaagccttttcgcagaaaagccacctaatatcgcatcagatgacgcatacaggagagaagccattcatttgctctaagtgtggaaaagcattcagcagaaagtcccagttggtgcgtcatcagcgaacccatacgggagaaaaaccctatgaatgcagcgaatgcggaaaagcctttagtgagaaactgtctctcaccaatcatcaaaggattcatactggggagaagccgtatgtgtgctccgaatgtggaaaagctttttgtcagaagagccacttaatcagtcaccagcgcacccataccggggaaaagccatatgaatgttcggaatgcggcaaggcgtttggtgagaaaagctcgctggccacccaccaacgcactcataccggagaaaagccctacgagtgtagagattgtgaaaaagccttctcccaaaaatctcagcttaatacacaccagcgaatacataccggcgagaagccatatgagtgctccctgtgtagaaaagcgttctttgagaaaagcgagctgataaggcatctccggactcataccggagagaaaccatatgaatgcaatgagtgtaggaaagcctttcgagagaagagctccttaataaatcatcagcgtattcatacaggggaaaagccctttgaatgtagtgaatgtggcaaggcattctctcgaaagagccatcttatacctcatcagcggacgcatacaggagaaaagccctacggatgttctgaatgccgtaaggctttctcccagaaatctcagctggtgaaccaccagagaatccatactggtgaaaaaccctatagatgtattgaatgcggaaaagctttctcacaaaaatcacaactcatcaaccaccaaagaacgcatactgtcaagaaaagctag

SEQ ID NO: 14817 - DNA, 21 bp, Artificial Sequence
  Description of Artificial Sequence: Synthetic coding sequence
atgacgatgcttcaggtctag

SEQ ID NO: 14818 - DNA, 1503 bp, Artificial Sequence
  Description of Artificial Sequence: Synthetic coding sequence
atgctggagggacacgagagctacgatactgagaacttctacttcagggagataaggaagaacctccaggaagttgactttcagtggaaggacggagagataaactacaaagagggtcctatgacccataaaaacaacctgacagggcagcgggtccggcatagccagggtgacgtggaaaataagcacatggagaatcagctgatcctgcggttccagtccggcctgggcgaactgcagaagttccagacagctgaaaaaatttatggctgtaatcagatcgaaaggaccgtgaataactgctttcttgctagtccattacagcggatctttcccggcgtacaaaccaacattagccggaagtatggtaacgactttctgcagttgagtctgcccacccaggatgagaagacccacattcgggagaagccctatattgggaatgaatgcggtaaggctttccgagtaagctcaagcctcattaaccatcagatgatacacaccactgagaagccctatcgctgtaacgagtccggcaaagcattccatcggggctctttgctgacagtacatcagatagttcataccagaggtaagccttaccagtgcgacgtgtgcggccgtattttccgacagaactccgacctggtgaaccatcgccgaagccacactggtgacaagccttatatttgcaacgagtgcggcaaatcgttcagtaagagtagtcatctagcggtgcatcagaggatacatacaggcgaaaagccctataagtgcaacaggtgcggaaaatgtttctcccagtcaagtagcttagcaacacaccagactgttcacactggcgataaaccctacaaatgcaacgaatgcgggaaaactttcaaacggaacagcagtctgactgcccaccacattatacatgccggaaaaaaaccatacacatgtgatgtttgcggaaaagtcttctatcaaaactcccagctggtccggcaccagataatacataccggtgaaaccccctataaatgtaacgaatgcggcaaagtcttccgataccggtcagggttggccaggcattggtctattcacacgggagaaaagccctataagtgcaatgagtgcggcaaggccttccgtgtgcgctctatattgttgaatcaccaaatgatgcataccggagagaaaccctataaatgcaatgaatgtggcaaagcatttatcgaacgcagcaatctagtttatcaccagaggaaccatactggcgaaaagccctacaaatgcatggaatgtggcaaggctttcggtcgcaggagctgtctgaccaagcatcaaagaatacactcatcagaaaagccttataaatgcaatgaatgtgggaagagctacatcagcaggagcggcttaacgaagcaccaaattaagcatgctggggaaaatctaaccactaagctcaacgttgaaaggcctttagacgtcgtccttaccagcggcatccccaagtag

SEQ ID NO: 14819 - DNA, 2775 bp, Artificial Sequence
  Description of Artificial Sequence: Synthetic coding sequence
atggcattgcctcagggttccttgacctttcgtgatgttgccgtggagttctctcaagaggagtggaagtgtctggatcccgtccagaaagcattgtaccgcgacgttatgcttgaaaattataggaatctgggctttctaggcctatgcctgccagacctgaacatcatttccatgctcgaacagggaaaagagccctggactgttgtgagccaggtgaaaatagcccgcaaccccaactgtggcgaatgtatgaaaggagtgattacagggattagtcctaaatgcgtgattaaggaactccctccaatccaaaatagcaacaccggggagaaattccaagcagtgatgctagagggccatgaaagctacgacaccgaaaatttctatttcagagagatacgcaagaacctgcaagaagtggatttccagtggaaggatggggagattaactacaaggaagggcctatgacccacaagaataacctgacagggcaaagggtcagacacagtcaaggcgacgtggagaataaacacatggaaaaccagctcatcttacggttccagtccggactaggggaactacagaaatttcagacagcagaaaaaatctacggatgcaatcagatcgaaaggacagtaaataactgttttctggcctcacccctacagaggatctttcccggtgtgcaaacaaatatttcgcgcaaatatggtaatgacttcttacagctctcactccccacccaggacgaaaaaacacatataagggagaagccctacatcggtaatgaatgtggcaaggcctttcgggtctctagctcactaataaatcaccagatgatccacacaaccgagaaaccgtatcggtgcaacgaatctggcaaggccttccaccgcggctctctcctcacagtccatcagatagtccacaccagagggaagccttaccaatgtgatgtctgcggcaggattttcaggcaaaacagtgatctggtgaatcatcggcggtcccataccggtgacaagccctacatttgcaacgagtgcggaaaatccttttctaagagcagccacctggccgtgcaccagaggatccacacaggcgaaaagccttacaagtgcaatagatgcggtaagtgcttttcccagagctccagcctggccacacatcagacagtacacaccggagataaaccgtacaagtgcaacgagtgcggtaaaaccttcaaaaggaatagctctctgaccgcccaccatattattcacgccggaaagaagccttatacctgtgatgtgtgcggtaaggtgttttatcagaacagccagctagttcggcaccagattattcacacgggtgaaaccccctataaatgcaatgagtgcggtaaggtctttttccagcgaagccgcttagccggccacagacgcattcataccggcgagaagccatataagtgcaatgagtgcggaaaggtcttctctcagcactctcacctggccgtgcatcagcgggtgcacacaggcgaaaagccctataaatgcaatgagtgtggaaaagcctttaactggggcagcctcctgacagttcatcagagaattcataccggtgagaagccctacaaatgcaacgtatgtggcaaggtgttcaactacggcgggtacctgtcggtgcacatgcgatgccacaccggcgaaaaacccctccattgcaacaaatgtggtatggtatttacctactactcctgcctggcgcgccatcagcgtatgcacaccggcgagaaaccttacaaatgtaatgtgtgtgggaaggttttcatcgactcgggaaatctaagcatccacagaaggagccacaccggggaaaagccattccagtgcaacgagtgcgggaaggtgttttcatattactcatgtctggcccggcataggaaaatccacaccggcgaaaagccttacaaatgcaatgattgtggaaaggcatacacccaacgatcatctctcactaaacacctggtgatacacaccggagagaatccctaccattgcaacgaattcggagaggcattcatacagtcatctaagctcgcccgctaccacagaaatcccaccggggagaagccccacaaatgttcggagtgcggtcggaccttcagccataagacctcactggtttatcaccagcgacggcatacgggcgagatgccatacaaatgcatcgaatgcgggaaggtgtttaatagtacgaccaccctggcccgacatagacggatccatacaggagagaagccctacaagtgcaatgagtgtggcaaggtgtttcgatacaggtctggcttggctcgccactggtccatacatacgggcgaaaagccctacaaatgtaatgagtgtgggaaagcgttcagagtaaggtcgattctcctcaatcatcagatgatgcacaccggcgagaagccctacaaatgcaacgagtgtgggaaagctttcattgaacgcagcaatctcgtttaccaccaaagaaaccatacgggagagaaaccgtataagtgtatggagtgcggaaaggcgttcggaaggagatcctgcctcaccaaacaccagcgcattcacagttccgagaagccctacaagtgtaacgaatgtggaaaaagctatattagtaggtcaggccttaccaagcaccagatcaaacatgctggcgaaaatcttactacaaagcttaacgtcgagaggcccctggacgtggtcctgacctcaggcattccaaaatag

SEQ ID NO: 14820 - DNA, 2427 bp, Artificial Sequence
  Description of Artificial Sequence: Synthetic coding sequence
atgctagaagggcacgaatcgtatgacaccgagaacttctactttcgagagattagaaagaacctgcaagaggtagattttcagtggaaagacggtgaaatcaattacaaagaggggccaatgacacacaagaataatttaacgggacaaagagtaaggcacagtcaaggggatgttgaaaataagcacatggagaatcagctcatcctacgctttcagtctggtctgggagagttacagaaatttcagacggcagagaagatttatggctgtaaccagatcgaacgcactgtcaacaactgtttcctcgcctctcccctccagcgtatattccccggcgttcagaccaacatttccagaaagtatggcaatgatttcctgcagctgtcactgccaactcaagacgagaaaacgcatatccgggagaagccttacattggaaacgagtgcggtaaagccttcagagtgtcgtcatccctgatcaaccaccaaatgatacacactacggagaagccgtataggtgcaatgaaagcgggaaggcgttccacagagggagcctgctgaccgtccaccagatagtccacacaaggggtaaaccgtaccagtgcgatgtctgtgggagaatctttaggcagaacagtgacttagtgaaccaccgcagatcccatactggcgacaaaccttatatatgtaacgaatgcggcaagtctttttctaagagtagtcaccttgcggtccaccagcgcattcacaccggagaaaaaccctataaatgcaatcgatgcgggaagtgcttctctcagtcctctagtctagccacacaccagaccgtccataccggagacaaaccatataaatgcaacgagtgcggcaaaacatttaagcgcaattcatctctcaccgcgcaccacattatccacgccggcaaaaaaccctatacgtgcgacgtttgtggcaaagtgttctatcagaacagccagctggttcggcatcagattattcacaccggtgagaccccgtacaagtgtaacgaatgtggcaaggtctttttccagcgcagcagattggcaggccaccgccgaattcacactggtgagaaaccctataagtgtaacgagtgcgggaaagtcttctctcagcattctcatctggccgtgcaccagcgcgttcacaccggtgagaagccttacaagtgcaatgagtgcgggaaagccttcaattgggggtccctcttaaccgttcaccagcggatacatacaggggagaaaccgtacaagtgcaatgtgtgcgggaaggttttcaactatggcggctacctctcagtgcacatgcggtgccacaccggcgagaaacctctgcattgtaacaagtgtggaatggtttttacatattacagctgtctggcccgacaccagcggatgcacactggagaaaagccttataagtgtaacgtgtgtgggaaggtgttcatagacagtggcaacctgtcaatccataggcgctcccacacaggggaaaagcctttccaatgtaacgagtgcggaaaggtgtttagttactatagctgcctggcaaggcaccggaaaattcataccggagagaagccgtataagtgtaacgactgtgggaaagcctacacccagaggtcctccttgaccaagcatctcgtgatccacactggggaaaacccttatcactgtaacgagtttggggaggcttttattcagagttccaaactggctcggtatcacaggaatccaactggcgagaagcctcacaagtgttctgagtgcggcagaacattttcccataaaaccagtcttgtttaccatcagcgccgacatacaggggaaatgccatacaagtgtatagagtgcggaaaagtgtttaattccaccacaactctggcccgtcacagaagaatccacacaggggagaagccatacaaatgtaacgagtgcggcaaggtgtttcgttatcgctcaggcttagccagacattggtcaattcacacaggggaaaaaccctacaaatgcaacgaatgtggaaaagcctttcgggtgcggtctatattactgaaccaccagatgatgcatacaggtgagaagccctataaatgtaatgaatgcggcaaagctttcatcgagaggtcaaatctggtataccatcagagaaatcatactggagaaaagccatacaagtgtatggaatgtggcaaagccttcgggaggagatcctgtcttaccaagcatcaacgtattcattccagcgaaaagccctataagtgcaacgaatgtgggaagtcctacatttctcgcagcggcttgactaaacaccagattaaacacgccggtgagaacctgactaccaagcttaacgtggaaaggccccttgacgtggtactcaccagcggcatcccaaaatag

SEQ ID NO: 14821 - DNA, 2001 bp, Artificial Sequence
  Description of Artificial Sequence: Synthetic coding sequence
atggacctcgtggctttcgaggatgtggcagtaaactttacgcaggaggaatggtcgcttctcgaccccagccagaagaacctgtatcgcgaagttatgcaggagactctccgaaaccttgccagcataggtgaaaagtggaaagaccaaaacatcgaagaccagtataaaaatccacgcaataatctccgctcattactcggcgagcgtgtagacgaaaatactgaagaaaaccattgtggtgagactagctcacagatacctgatgacactctgaacaaaaagacttcaccaggcgtgaagtcctgcgagtctagcgtgtgcggggaagtattcgttgggcattccagcctcaacagacacattcgggccgacaccgcccataaaccgtctgagtatcaggagtatggacaggagccgtacaagtgccagcagaggaaaaaggcttttcggtgccatcctagtttccagatgcaagaaaaggcccataccggggaaaaactttatgattgcaaggagtgtgggaagaccttcatcagccacagctcaattcagagacacatgattatgcacaacggggatgggacatacaagtgcaaattttgtggcaaggcatgtccctgtctgagtatctatctcatccatgagcgggtgcataccggggaaaaaccatacaagtgcaagcagtgcggaaaggcgttcagctactcaacatccctgcaaatacatgaaaggacacatacaggcgaaaaaccttacgaatgcaaggaatgcggtaaggccttcgggtccccgaactctttatacgagcacagacgtactcatacaggcgaaaagccctatgaatgtaaacagtgtgggaaagccttccgctggttccacagtttccagattcacgaacggactcactccgaggaaaaagcatacgaatgcaccaaatgcggtaaagctttcaagtgtccttcctatctgtgtcgacacgaagttacacactcaggaaagaaaccttgcgaatgtaaacagtgcggcaaggctctgagctaccttaactttcaacggcacatgaagatgcatacacgaatgcggccttacaagtgtaaaactgttgagaaacctcttatcctgcctgtccggttcgaagatatgaaagaattgactcttgaacggaatctcatgaatgcatcaacagtagtcaaacccagtatagtaccggttcccttcactattatgaaaggacttaccctggagaggaaccccatgaatgtctcctccgttgtgaagccatccttcctccctttaccctttgatattatgaagggacttactctggagaggaatagaatgtctgtgagcaacgtcggtaaacccagcgacctaccacacactttcaagtgtatggaggggttaactctgaaaagaaatcccatgaatgtcagttccgtcgtgaagccttctttctttcccttaccttttgatatcatgaagggattaacccttgagcgtaatccgatgtcggtttcgaacgtaggaaaaccctcacatttgccccacactttcaagtgcatgaaagggttaactcttgagagtaattgcatgaacctgaacaatgtgaaaaagcctctggatctctccgaaacattcaagttcatgaagcgacatacacttgagcgcaatcccattagaaatatggaaaagcatagcacaattagcctgccatttaaatatatgcaacaatgtacggaagaccgtatgcccatgaatgttaaatccgtcacaaaacacagctacttaccccggagctttgagtacatgcaggagcacactctggaacgaaatccgatgaacgtgcgaaatgcagagaaacggtctattatctttttgctgtgcgtgtatacaaaagggtgcacgctcgagaggaatcacatcaatgttcgcatcgtgggcaagcactccgtctgcctcgtgcccttcgtggatataaaggggctcacactggaatag

SEQ ID NO: 14822 - DNA, 1035 bp, Artificial Sequence
  Description of Artificial Sequence: Synthetic coding sequence
atggatctcgtggcctttgaggacgtggctgtgaactttactcaagaagagtggtctctgctcgacccttcccagaaaaacctttatcgcgaggtaatgcaggagactttaagaaaccttgcctcaattggagaaaaatggaaagaccagaacatcgaggaccagtacaaaaatcccagaaataatttgaggtcgctgctgggagagagagttgacgagaatacagaagagaaccactgcggggagacctcttcgcagatccccgacgatacactgaataaaaaaacaagcccaggggtgaagtcatgcgaatcttctgtgtgtggtgaagttttcgttggacactcttccctaaatcggcacatccgggctgacacctgtcacccaagcttccaaatgcaggagaaagcgcacactggtgaaaagctctatgattgcaaagagtgcggaaagacatttatctcacactcctctattcagaggcacatgataatgcataacggcgacggtacctacaagtgcaagttctgcggaaaagcatgcccgtgtttgtctatctacttaatccacgagcgggtgcacactggggaaaagccatacaagtgtaaacagtgcggtaaggccttcagctattccacttccctgcagattcatgaaaggacacatacgggagagaaaccctatgagtgcaaagagtgtggaaaggccttcggtagccccaacagcctgtacgagcaccgccggacccacacaggtgagaagccctatgagtgtaagcagtgtgggaaagctttccgctggttccattcttttcagatccatgaacgcacccactcagaagaaaaggcctatgagtgtaccaagtgcgggaaggcctttaaatgcccttcttatttatgtaggcacgaggtaactcattcgggtaagaaaccttgtgagtgcaagcagtgcgggaaggccttgtcctacctgaactttcagcgccacgaacgcacccacaccggagagaaaccttacgagtgcaaacattgctag

SEQ ID NO: 14823 - DNA, 1578 bp, Artificial Sequence
  Description of Artificial Sequence: Synthetic coding sequence
atggacctcgtggcctttgaggacgttgcagtcaactttacgcaggaggaatggagcctgctggacccctcgcagaagaatttatacagagaggtcatgcaggaaaccctgcgtaacctcgcctccataggagagaagtggaaggaccagaacatagaagaccagtataagaaccctaggaacaatctgcgcagtctgctgggagagcgagtggacgaaaataccgaagagaatcattgcggcgaaaccagcagccagataccggatgatactctgaacaagaagacaagcccaggcgttaagtcttgtgaatcctccgtgtgcggggaagtgttcgtgggccactcttctctcaacagacatattagagccgacaccgcccataaaccgtccgagtatcaggaatacggccaggaaccatataagtgccagcagcgcaaaaaggcctttcgttgtcatccgagcttccaaatgcaggaaaaggcacataccggcgagaaactgtatgactgcaaggaatgcggcaagacttttatctctcattcctccatccaacggcacatgatcatgcataacggcgatgggacctacaagtgcaagttctgcggcaaggcctgcccttgtctctctatttacctaattcatgagcgggtgcatacaggagaaaagccatataaatgcaagcagtgcggaaaagcatttagctattctacctccctgcagattcacgagcgcacccatacaggagaaaaaccttacgaatgtaaagagtgtgggaaggcttttggttccccaaactctctttatgagcataggcgcactcatactggggagaaaccttatgaatgcaaacagtgtggcaaggccttccggtggttccactccttccagatacatgagcggacccactcagaagaaaaggcctatgaatgcactaaatgcggcaaagcgttcaaatgcccctcctacctgtgccggcatgaggttacgcatagtgggaagaaaccatgtgaatgcaaacagtgcggaaaagcgctttcctatttgaatttccagcgccatatgaagatgcacactaggatgcgaccttataagtgtaagacggtcgagaagcccctgatcctgccagtgcgatttgaggatatgaaggagttaactcttgaacgtaacctcatgaacgcgtctactgtcgtgaaaccaagtatagtacccgttcctttcacaataatgaaaggactgacactcgaaagaaatcccatgaacgtttcaagtgtagtgaagccctccttcctcccactcccttttgacatcatgaaaggcctcacactagagcgaaaccgaatgtctgtttctaacgtaggaaagccatcagatcttcctcatacctttaaatgtatggaaggcctgacgttgaagagaaatccaatgaacgtctctagcgtggtcaagcccagcttttttccactgcctttcgacattatgaaagggctgacattggagagaaatcccatgagcgtgtccaacgtcggcaaaccctcccacctgccccatacgttcaaatgcatgaagggccagtag

SEQ ID NO: 14824 - DNA, 183 bp, Artificial Sequence
  Description of Artificial Sequence: Synthetic coding sequence
ttgtctctgcctcaggggctcctcactttcagggacgtagccatcgagttctcacaggaggagtggaagtgcctggatccagctcagcgaactctctatagggatgtgatgctggagaattaccgaaacttagtctcactgggcagctctgcggtatgcgacctgggctccccccagccatag

SEQ ID NO: 14825 - DNA, 2661 bp, Artificial Sequence
  Description of Artificial Sequence: Synthetic coding sequence
atggcactgtcccagggactgctaacctttcgcgacgttgcgatcgaattcagccaagaggagtggaagtgtctggaccccgcccaacgaaccctgtatagagatgtgatgctggagaactacaggaacctcgtcagcttagacatttccagtaagtgtatgatgaaagaattctcaagcacagcccaaggcaacacagaggtcatccacactgggaccctgcagcggcatgaaagacaccacatcggggacttctgtttccaggagatggagaaagatattcatgattttgaatttcagtggaaagaagacgagagaaatagtcacgaggctcctatgacggaaattaagcaactgacaggatcaaccaatcgccacgatcagcggcacgcaggaaataaaccgattaaagatcagctcggtagttcgttccattcccatcttccggagcttcatatgttccagacggaaggcaaaatcggcaaccaagtcgaaaaatccatcaatagtgcctccctggtatctactagccagaggatatcatgcaggcctaaaacccatatttcaaagaactatgggaataattttttaaactcatccctgcttactcagaagcaagaagttcacatgagggaaaagtcctttcagtgcaatgagtccggtaaagcctttaactactcctctgtactgcgcaagcaccaaataattcacctgggggctaaacaatataaatgcgacgtatgtgggaaggtcttcaaccaaaaacgttaccttgcttgtcaccgacgatgccatactggcaagaagccttacaaatgcaacgactgtgggaagacattttctcaggaactgactcttacctgccatcatagactgcacaccggagaaaaacattacaaatgcagtgagtgtggtaagaccttctcaaggaacagcgctctggtgatacataaggcaatccacaccggcgagaagtcctacaagtgtaacgagtgcggcaaaaccttctctcagacgagttatctggtgtatcatcggaggctgcacacgggcgagaagccgtacaaatgtgaggagtgtgacaaggctttctcattcaaatctaatctcgagaggcacaggaagattcacacgggcgagaagccctacaaatgtaatgaatgctcccgcacctttagtcgcaagtcatcgctcacgagacatcggcgcctgcatacaggtgagaagccatacaaatgtaacgattgtggcaaaacattcagccagatgtcaagtctggtttaccatcgacgcctgcacacaggagagaaaccctataaatgtgaggagtgtgatgaggcgttttcatttaaatctaacctggagcggcaccggcggatccatacaggcgagaaaccatacaagtgcaacgattgtggcaagactttttctcagaccagttccttggtctatcatcggcggctgcacaccggggagaaaccctacaaatgcgaggaatgcgatgaggctttctcgttcaagtccaacctcgagcgccaccgcattattcataccggggagaaattgtacaaatgcaatgaatgcggcaagaccttcagtcgtaagtcatcactgacaagacattgcaggttgcacactggagaaaagccttaccagtgcaacgagtgcggcaaggcattcaggggccagagcgcactgatttaccatcaagccattcacggcatcggtaaactgtacaagtgtaatgattgtcatcaggtctttagcaacgccacaaccattgccaatcattggcgtatccacaacgaggagagatcctacaagtgtaatcgatgcggaaagttcttccgtcaccgctcatacctggccgttcactggcgaacacactctggtgagaagccgtacaagtgcgaggaatgcgatgaggccttctccttcaaatccaacttgcagcgacaccgcagaatccataccggagagaagccatacaaatgtgaggagtgtgataaggttttttcaaggaagagttccctcgaaaaacacagacgaatccacaccggggagaaaccctacaagtgtaaagtgtgtgacaaggccttcggtcgcgatagtcacttagctcaacacactaggatccataccggagaaaaaccatacaagtgtaatgaatgcggaaagaattttaggcataactcagccttggtgatccacaaagcaattcactcaggcgagaaaccctacaagtgcaacgagtgtggcaagaccttcaggcacaattcggccctggagatccacaaagcaatccatacaggcgagaagccttataaatgtagcgagtgcggaaaggtgtttaatcggaaagccaacctttcaaggcaccaccgcctgcacaccggcgaaaagccgtacaagtgcaacaaatgtggcaaggtctttaatcaacaggcccacctggcatgccaccatcggattcataccggtgagaagccatacaaatgcaatgagtgcggtaagacatttcgtcacaattcagtcctcgtaatccacaagacaatccacacaggggaaaaaccatacaaatgcaatgaatgtgggaaggtatttaatcgcaaggccaagttggcaaggcaccaccggatacacactggcaagaagcattag

SEQ ID NO: 14826 - DNA, 2913 bp, Artificial Sequence
  Description of Artificial Sequence: Synthetic coding sequence
atggccctgtcacaagggttactgactttcagagacgtggctattgagttcagccaggaagaatggaagtgcctggatcctgcgcagagaacattataccgggacgttatgctagagaattaccgcaacttggtgtccttggatatctcttccaagtgcatgatgaaagagttctcttccactgctcagggcaacactgaggtgattcacaccggtaccctacaaaggcatgagagacatcatatcggagacttctgtttccaggagatggagaaggacatccatgactttgagtttcagtggaaggaagatgaacggaactcccatgaagctcccatgacagagataaagcagctgacagggagcacaaacagacatgaccagagacacgcaggcaacaagccaatcaaggaccagcttggctctagcttccatagtcatctccctgaactgcatatgttccagaccgagggaaagatcgggaaccaggtagaaaaatccattaacagcgccagcctagtgtccaccagccagaggataagctgtcgaccaaagactcacatctcaaagaactacggaaacaatttcctgaactccagcctactgacccagaagcaggaggtacacatgagagaaaagtcattccagtgcaacgaaagtggcaaggcatttaattatagcagtgtgctgagaaagcaccagatcatccacctgggggccaagcagtataagtgcgatgtgtgtggtaaggtcttcaatcagaaaaggtatcttgcgtgccaccgtcgttgtcacaccggcaaaaagccttataaatgtaatgattgcggtaaaacattcagccaagaactgacgttgacttgccatcatcgcctgcatacaggggaaaaacattacaagtgttctgaatgtggcaaaacctttagccgcaactctgccctcgtgatccataaagctatacataccggggagaagtcctacaaatgtaacgagtgtgggaaaaccttcagccagacttcttacctggtgtaccaccgtcggctgcacaccggcgaaaaaccatataagtgcgaggaatgcgacaaggctttttcctttaagtccaatttggagcgacatcgaaagattcatacaggggaaaagccgtacaagtgtaacgaatgctcacgcacattcagtcggaagagctcactgacaaggcacagaagactacataccggggaaaagccttacaagtgtaatgactgcgggaagacttttagccaaatgagcagcctcgtgtatcatagaaggttgcataccggtgagaagccttacaagtgtgaggagtgtgatgaggcattttcttttaaatccaatttggaaaggcataggcgcatacacacaggagagaaaccgtataagtgcaacgactgtggcaaaacgttctcacaaacctcgtccctggtgtatcatcggcggcttcataccggtgagaagccttacaaatgcgaagagtgcgacgaggcctttagtttcaagtcaaacctcgaacgccacaggataatccacactggagaaaagctgtacaagtgcaacgaatgcgggaagacctttagtcggaaatccagtttaacacgacattgtagactgcacacaggagaaaaaccataccaatgcaatgaatgcggaaaagcttttagaggccagtctgctcttatctatcaccaagctatccacgggatcggtaaactctataagtgcaatgattgtcaccaggtcttctctaatgcaactactatcgccaatcactggagaatccacaatgaggagcgcagttataaatgcaataggtgcggtaagttctttagacacaggtcctacctggccgttcactggaggacgcatagcggtgaaaaaccatataaatgtgaagagtgtgacgaggcattcagcttcaagagcaacctccaacgccatcgccgcatacacaccggggagaagccttatcgttgcaacgagtgcggtaaaacatttagccgtaaatcgtacctgacctgtcaccggcgcctgcacactggcgaaaaaccctataagtgcaacgaatgtggaaagactttcgggcggaacagcgccctgatcattcacaaggccatccataccggagaaaagccttacaagtgcaatgagtgcgggaaagcgtttagccagaaatcatcactcacatgccacttgagattgcacactggggagaaaccatacaagtgtgaagaatgcgataaagttttctcacggaagagctccttggaaaaacatcgtagaatccacaccggcgagaagccctataagtgcaaggtatgcgacaaggcgtttggaagggactcgcatcttgcgcagcatactcggattcatacaggcgagaaaccatataaatgcaatgagtgtggaaagaattttcgccacaacagcgcgctggtcatccataaagcgattcatagtggtgaaaagccatataaatgcaacgagtgcgggaaaacttttcggcacaacagtgcattggagatccacaaagcgatccatactggggagaaaccgtacaagtgtagcgaatgcggcaaggtctttaacagaaaggctaatctgtcaagacatcaccgcttgcacaccggcgagaaaccctacaagtgtaataagtgtggcaaggtgtttaatcaacaggcccacctggcgtgccatcacagaatccacacaggtgaaaagccttataagtgtaacgagtgtggaaagacgttcaggcacaactccgtcctagtaattcacaagaccatccacaccggcgagaagccttataaatgcaatgagtgtggaaaggtgttcaaccggaaggctaaactggcccggcaccatagaattcacacaggaaaaaaacactag

SEQ ID NO: 14827 - DNA, 1602 bp, Artificial Sequence
  Description of Artificial Sequence: Synthetic coding sequence
atggatagctcccagcatctggtgaccttcgaggacgtggcagtagattttacacaagaagagtggacccttctcgaccaggcccaacgtgatctctacagagacgtgatgttggagaattataaaaacttaattatcctcgcggggtccgaactgttcaaacgaagtcttatgtctggactcgaacagatggaggagctgaggacaggagtcacaggggttttgcaagaactggatttacagcttaagactaaagggtcccccttattgcaagacattagtgccgaaagatcacccaacggcgttcagctggagagaagcaatacagcggagaaactctacgactctaatcattcgggcaaggttttcaacgaacacccctttctcatgacccacatgataactcacataggcgagaagacatcagaggacaatcaatctggcaaggccctccgaaagaattttccccactccttttacaagaagagccacgccgaggggaagatgccaaagtgtgtgaaacatgaaaaggcctttaaccagtttcctaatctgaccagacagaacaagacccacacacaagaaaagctgtgtgagtgcaaagattgttggcggacattcctcaaccaatcttctctgaaactccacatcaggagccataacggtgacaagcactatgtgtgtaaggaatgtggtaaagcgttttctaatagttcacatctcatcggacatggaaggattcacagtggcgagaagccgtatgtgtgcaaagaatgcgggaaggccttcactcaatccactggactgaagctgcatattcggacacattctggcgagaagccatacaagtgcaaagagtgtggcaaagcattcactcacagcagctatcttactgaccataccaggattcattcaggcaagaagccatatgtctgcatggagtgcggcaaagctttcacaagatccacgggcctcattctgcacatgcggattcacacaggggagaagccatacgaatgtaaagagtgcggtaaggctttcatccattcctcttacctgacaaaacatgtccggatccatagtggcgagaagctctacctgtgcaaggcctgcgggaaggcattcactagatcatccggtctcgtgcttcacatgcgcactcacacaggcgaaaaaccatatgagtgcaaggaatgcggtaaggcatttaacaacagcagcatgctgtctcagcacgttagaattcataccggtgagaagccatacgaatgtaaggagtgcggaaaggccttcacccagagctccggcctatccacccatcttagaacacatacaggcgagaaagcgtgtgaatgtaaagagtgtggaaaggctttcgccagatccactaatctcaatatgcacatgaggacccacactggagaaaagccctacgcatgcaaggagtgtggaaaagcttttagatattctacttacttgaacgttcacacacggacgcatactggagctaaaccatatgaatgtaaaaaatgtggaaagaatttcactcaaagtagcgccctggcgaagcaccttcgaacgaaagcgtgcgagaaaacttag

SEQ ID NO: 14828 - DNA, 1899 bp, Artificial Sequence
  Description of Artificial Sequence: Synthetic coding sequence
atgcttcgcgaggaggccgcccagaaaaggaaggagaaggagccgggtatggccctgcctcagggccatcttacattccgcgatgtggctattgagttctcactggaagagtggaaatgtttggacccaacacagcgggctctctatcgcgccatgatgttggaaaattaccgcaatctccactctgtggatatttcctcaaagtgcatgatgaaaaagttcagctcaacggcacagggcaataccgaagtggatacgggtactctcgagagacacgagagtcatcatatcggtgacttttgctttcagaaaatcggtaaagatatccacgattttgaatttcaatggcaagaagataagaggaattcccacgaggctacaatgacacaaatcaagaaattgactggatcaaccgaccggtacgacaggagacaccccggcaataagccaataaaagaccagctggggctgtccttccactcacaccttcctgagctgcacattttccagaccaaaggcaaggtggggaaccaggtggagaaaagcataaatgatgcttcatcagtgctcacgtctcagcgcattagtagccggcccaagatccatatttcgaataactacgaaaacaatttctttcacagttctctgctgaccctgaagcaggaagtgcacattagagagaagtcttttcaatgtaacgaatccggaaaagcctttaattgtagctccttacttagaaaacaccagatcatctacctcggaggcaagcagtataagtgcgacgtttgtgggaaagtattcaatcagaaacggtacctggcatgtcatcataggtgccatactggcgagaagccttataagtgtaacgagtgcggtaaggtttttaatcagcagtcaaatctggcgtctcaccaccgcctgcatacgggggaaaaaccctacaagtgtgaagaatgcgacaaggttttttcacgcaaatccaatctggaaaggcatcggaggattcacacaggcgaaaagccatacaagtgcaaagtgtgtgagaaggccttcaggcgtgactcccacttgacccagcacacccggattcacaccggtgagaaaccctataagtgcaacgagtgcggcaaagccttcagtgggcagtccacactcattcatcatcaggcaattcacggaatcgggaagctgtacaagtgcaacgattgccacaaggtgttctcgaatgccaccacgatcgccaatcattggagaatccacaacgaagagcgttcctacaaatgcaataagtgcggtaagttttttcgccggcggtcctacttggtcgtccattggcgtacacacactggcgagaagccctacaagtgtaatgaatgcggcaaaaccttccatcacaactcagccctggtcattcacaaggccatccacaccggcgaaaagccctacaagtgtaatgaatgtggaaaaacattcagacacaacagtgcactagtaatccacaaggccatccacaccggggaaaaaccctacaagtgtaacgaatgcgggaaagtcttcaatcagcaagctaccttggcacggcaccatcgattgcacaccggtgagaaaccatacaaatgcgaggaatgcgacacagtgttctccaggaagtcccaccacgagacacataagcgcatccacactggagagaagccatacaagtgcgatgattttgatgaagccttttctcaagcctcgagttatgccaaacagcgcagaatccatatgggggaaaaacatcataagtgcgacgactgtggcaaggccttcactagccacagccatcggatacggcatcagcgcatccacacggggcagaagtcctacaaatgccacaagcggggaaaggtatttagttag

SEQ ID NO: 14829 - DNA, 1122 bp, Artificial Sequence
  Description of Artificial Sequence: Synthetic coding sequence
atgtctttacggaggcacattggaaatccagaatacctgatgaagcgcatcccccaaaaccctcgatatcaacatattaaatccagactcgatactggaaactccatgactaaatatactgaaaagttagaggagatcaagaagaactatcggtacaaaaaagatgagttgttcaagcggcttaaagtcacaacattcgcccagttgataatacaagtggcgtccctgagcgaccagacgttggaggtaactgccgaggagatccagcggttggaggataacgacagtgccgcttcggatcccgatgccgaaacgacagcacgcaccaacggtaagggtaatcctggtgagcagagtccctcccccgagcagtttataaataacgcgggagctggcgattctagtcgatctactttgcagagtgtcatcagcggagttggggagctagatttggacaaggggcccgtcaaaaaggcagagccacacacaaaggacaagccctaccctgactgccccttcctgctgctggatgtgagagatagggactcatatcagcagtgtcacatcgtgggggcatattcgtaccccattgccaccctgagtaggactatgaatccctacagcaatgatatactagagtataagaacgcccacggaaaaatcattatactgtacgatgacgacgagcggcttgcaagccaggcagctaccaccatgtgtgagcgggggtttgagaatctgtttatgctgtcaggtggccttaaggttttggctcaaaagtttcccgagggcctcattacagggtccttacccgcttcctgtcagcaagcacttccgccgggcagtgcgaggaagcggtcaagcccaaagggtcctcctttaccagccgaaaataaatggaggttcacccccgaggacttgaagaagattgagtactatctggaggaagaacagggtcctgcagatcatccatctcggttgaaccaggcaaattcctccgggcgcgagtccaaggtgccaggtgcaaggagcgcccaaaatttaccgggtggggggccagctagtcactcgaatccaaggtcccttagttcgggacatctacagggaaaaccctggaaatag

SEQ ID NO: 14830 - DNA, 1692 bp, Artificial Sequence
  Description of Artificial Sequence: Synthetic coding sequence
atggcccggagattgcttccagctcacgtgcaggaaagtgtgacatttcgtgatgtcgctgttttcttttctcaagatgagtggttgcatctggactccgcccagagggccttgtaccgcgaggtcatgctcgaaaactactctatcctggtgtctctcggcattctcttttccaagcccaaagttattagtcaactagaacaaggggaagacccatggatggtagaatccggagtgccacaaggagcacacctcggatgggaatcattgttcggaaccattgtcagtaaagaggagaatcaagaagtcatgaagaagctcatcatagatggtactttcgacttcaagctcgaaaagacttatataaatgaagataagctggagaaacagcagggaaaaaagaaccggctgttttccaaagttctggtcactatcaagaaagtttacatgaaagaacggtcttttaaaggagtggagtttgggaaaaatctggggttgaaaagcagtctgatccggaaaccacgcatcgtgtctagggggcgacgcccaaggtcccagcagtattcagtgctgttcaaacagttaggcgtaaacacagtgcgtaaatgctataaatgtaatatttgcggcaagatcttcctacattcctcttctcttagcaagcaccagcgaatacacacaggtgaaaagctctacaagtgcaaggagtgtaggaaagcattttcccagagctcctccctgacgcagcatcttagagttcacactggagagaagccttatatctgcagcgagtgtggcaaggctttttcatttactacatctctgattggacaccagaggatgcataccggggaacgcccgtacaagtgcaaggagtgtggtaagacatttaaaggaagctcaagcttgaataaccaccagcgcatccatacgggggagaagccctataaatgtaacgagtgtgggcgagcgtttagccagtgctccagcttgatccagcaccaccggatccatacgggagaaaagccgtatgaatgtacgcagtgtgggaaggctttcacatccatctcacggctttcccgccatcaccggattcacaccggggagaagccttttcactgtaacgagtgcggaaaggtgtttagctatcattctgctctcatcatccaccagcggattcacaccggggagaaaccgtacgcctgcaaagagtgtggcaaagcctttagccagagctcggccctgatccaacaccagcggattcacactggggagaagccatacaagtgcaatgagtgcggaaaggcttttagctggatctcccgcttgaacatccatcatcgcatccacaccggtgagaagccgtacaattgtaaggaatgcggcaaggctttctcctctcactcaggcgttaatactcatcggaagattcacacaggtgaaaaaccctataagtgtaacgactgtgagaaggccttcaaccagtccagcgcattgatccaacaccagcgcatccacaccggagaaaagccatacaattgcaaggtctgtggcaaagcattccgccaaagcagcagtctcatgacccacatgcgaattcatactggtgagaaaccctacaaatgcaaagagtgtggaaaggccttcagccagagttctagccttaccaatcaccagcggacccataactag

SEQ ID NO: 14831 - DNA, 126 bp, Artificial Sequence
  Description of Artificial Sequence: Synthetic coding sequence
atggctagacgccttcttccagctcacgtccaggagtcagttacattcagagacgtagctgtgttcttctctcaggacgagtggctccacttggactcggcgcaaagggcactttaccgcgagtag

SEQ ID NO: 14832 - DNA, 405 bp, Artificial Sequence
  Description of Artificial Sequence: Synthetic coding sequence
atggcacgtcgactactccccgcccacgtgcaggaaagtgtgacctttcgggacgtggccgtgttcttctcccaggacgaatggttacacctcgattccgcacagcgcgccctctatagggaagtgatgctcgagaattatagcatcctggtgtcattaggaattttgttttctaaaccgaaagtcatttcacaactggaacaaggcgaggatccatggatggtggaaagcggagttccccaaggggctcatctgggctgggaaagcctctttgggaccatcgttagcaaagaggagaatcaggaggtcatgaagaaactgattatcgacggaacctttgattttaaattagaaaagacctatatcaacgaagacaagctggaaaagcagcaggggaaaaaatag

SEQ ID NO: 14833 - DNA, 1713 bp, Artificial Sequence
  Description of Artificial Sequence: Synthetic coding sequence
atgcctggggaaaccgaggagcctcgcccacctgagcaacaggatcaggaaggcggcgaagctgccaaggctgcgccggaagagccccagcagcggccgcccgaggccgtagccgccgcgcctgcggggacaacatccagtagggtgttacgcggaggccgcgaccgcggacgggctgcagcggctgcggccgccgccgccgtctcccggcgacgcaaggctgaatatccacgcagaagacggtcttcacctagcgctcgaccaccagatgtgcctgggcagcagccccaagccgctaagagtccgtctcctgtccagggaaaaaagagtcccagattgctctgtattgagaaggtcactacagataaagacccaaaagaggagaaggaggaagaagacgactcggctcttccccaagaggtgtctattgccgcatcacgaccatctagggggtggaggtcatctcggacctccgtgagtcggcatagagacactgagaatacccgctcctcgagaagtaaaactggttccctccagttgatttgcaagtccgaacccaatactgatcaactggattatgatgtgggtgaggagcatcagtcaccaggaggaatctcctctgaagaagaggaggaggaagaagaagagatgcttatcagtgaagaagaaatcccctttaaggatgacccacgagacgaaacctacaagcctcatttagagcgcgaaaccccgaagcctagacgaaaatcaggtaaggttaaggaggaaaaggagaagaaggagattaaagttgaggtcgaggtagaggtgaaggaggaggagaacgaaattagggaggacgaagagccccccagaaaacgggggcggcgcaggaaagacgacaagagccccagactgcctaagcgccgcaagaaacctcccatccagtacgtgcgttgtgaaatggaaggatgtggcaccgttctcgcccacccccggtacctgcagcatcacattaaataccaacatctcctcaagaaaaaatacgtctgtccgcaccctagctgcggccgcttatttcgcctgcagaagcagcttttacgccatgctaagcaccacactgatcaacgcgactatatctgtgaatactgtgcaagggcttttaagtctagtcacaatctcgccgttcatcggatgatccataccggtgagaaaccattgcagtgcgaaatctgtgggttcacttgtcgtcagaaggccagcttgaattggcatatgaaaaaacatgatgccgattctttctaccagttctcctgcaatatttgcggaaagaagttcgagaagaaagattcagtcgtggctcacaaagctaagagtcatcccgaggtattgatcgctgaggcactagccgctaatgctggcgcactgataacctcaacggacatccttggaaccaacccggagtctctgacacagccctctgacggacaaggcttgccattgttgcccgagcccttaggcaattcgacgtcgggtgagtgtctgctgttggaggctgaaggtatgtcaaaatcgtactgtagtgggacggagagggtgagcctgatggcggacgggaagatctttgttggcagcggttcctccggcggtaccgaaggtttggttatgaacagcgatatcctgggtgccacgaccgaggtgttaatagaggactctgactcagccggaccatag

SEQ ID NO: 14834 - DNA, 1590 bp, Artificial Sequence
  Description of Artificial Sequence: Synthetic coding sequence
atgcctggagagaccgaagagcctaggccccccgaacaacaagatcaagaaggaggggaggcagcaaaagccgccccagaggaaccccaacagaggcctccagaggctgtggccgccgctccagctggcacaacctcctccagagtgctgagaggggggagggataggggacgtgcagccgccgccgccgcagcggccgcggtctcacggcggcgcaaagctgagtatccaaggaggcgacgctcctcaccctcagcgaggcccccagacgtgccaggtcaacagccccaggcagccaaaagtccgagccccgtgcagggcaagaagagcccaagactgctttgtattgaaaaagtaactacagacaaagaccccaaggaggagaaagaggaggaagacgatagcgctttgccacaagaggtcagcattgccgcctcccgcccctctcggggctggaggtccagtcgcacgtctgtctctcgccaccgcgatacagaaaacactcggagtagccgcagcaaaacggggtctttgcagcttatctgcaaatccgaacctaatactgaccagctagactacgacgtaggggaggaacatcaatctccaggcggaatctcatcagaagaagaagaagaggaggaggaggagatgctgatatctgaggaggagatacctttcaaggacgaccccagagatgagacctacaagcctcacctggaaagggagactccaaagccgcgacgaaagtcaggaaaagtgaaagaagagaaggaaaaaaaggagataaaggtcgaggtcgaagtcgaagtcaaagaggaggagaatgagatcagagaagatgaggaaccccccaggaagagggggaggcgaaggaaggacgataaatcccctcgcctccctaaacgccgcaaaaagcccccaatccagtatgtcaggtgtgagatggaggggtgcggaacagttcttgcacacccacgatacctgcagcaccatattaaatatcagcacctgcttaaaaagaaatacgtatgtcctcatccttcctgtgggaggctgttccgtttgcagaagcagctcctgaggcatgccaaacaccataccgatcaacgggactatatctgtgaatactgcgcaagagctttcaagagttcccacaacttagcagttcaccggatgattcacactggggaaaagcccctgcaatgtgaaatctgtgggtttacatgcagacaaaaagcaagtctaaattggcacatgaaaaaacatgatgctgacagcttctaccagttcagttgcaacatttgtgggaagaaatttgaaaagaaagatagcgtggttgctcataaggccaaatcccacccagaggttctgattgccgaggccttggccgccaatgccggggccttaatcactagcacagacatcctcggaaccaaccccgaatccctgactcagccatctgatgggcaggggctgccgctgctgcccgagcccctgggcaacagtaccagcggggagtgcctcctgcttgaggccgagggtatgtctaaatcgtattgctccggcaccgagagagctagacataggtag

SEQ ID NO: 14835 - DNA, 1464 bp, Artificial Sequence
  Description of Artificial Sequence: Synthetic coding sequence
atggcagctgctgcgctacgcgccccaacccaggtcacggtatctccagaaacacatatggacttgacaaagggctgcgtaaccttcgaggatatcgctatttacttctctcaagatgagtggggtctgctcgatgaggcccagcggctgctctatctcgaagtgatgctcgagaacttcgctctggtagcctccttgggttgcggacacggtactgaagatgaggagacccccagcgaccagaacgttagcgttggggtgagccagtctaaagctggcagttctactcaaaaaacacagtcctgcgaaatgtgcgtgccggtgttaaaagacatccttcacttagccgatctgcccggccagaagccttatctggtgggcgagtgcacaaatcaccatcagcaccagaagcaccatagtgctaaaaagtctctgaagagggatatggaccgggcctcctatgtgaagtgctgtctcttttgcatgagcttaaagccctttcggaagtgggaggtagggaaagatcttccagctatgctcagactgttgcgatctctggtgttcccagggggtaaaaagcctggcacaattactgagtgtggagaggatatcaggagtcagaagagccactacaaaagcggcgagtgcggcaaggctagcagacacaagcatacaccagtgtaccacccacgtgtgtacactggcaagaagttatatgagtgttccaagtgtgggaaagcatttcgaggaaagtactcacttgtgcagcaccagcgcgttcacactggcgagcggccatgggagtgtaatgaatgcgggaaatttttcagtcagacttcacacctcaatgatcaccgccgtatccacacaggcgaaagaccttacgaatgcagcgagtgcggaaagcttttcaggcagaattcgtccctggtggaccatcagaagattcacaccggggcccgaccctatgaatgcagccagtgtgggaagagctttagtcaaaaagctacactcgttaaacaccagagggtacacactggagaacggccgtacaaatgcggggaatgtggtaattcttttagtcagtcggctatcctcaatcaacacaggaggatacacacgggagcgaaaccctatgagtgtggccagtgcggaaagtccttcagtcagaaagcgactttgatcaagcaccaacgggtccacaccggggagcgaccctacaagtgtggcgattgcggaaaatcattctcccagagtagcattctaattcaacacagacggatccacactggtgcaaggccatacgagtgtggtcagtgcgggaagtctttctctcagaaaagcggtctcatacagcaccaggtggttcacacgggtgaacgcccctacgagtgcaataaatgtggcaactcattctcacaatgtagctccttgatccatcaccagaagtgccataatacctag

SEQ ID NO: 14836 - DNA, 1317 bp, Artificial Sequence
  Description of Artificial Sequence: Synthetic coding sequence
atggatctaacaaaaggatgcgtgacctttgaggacattgccatttacttcagccaagatgagtggggtctacttgacgaggctcagcgcctgctgtatttggaagtcatgctagaaaattttgctctggttgcttctctggggtgcggacacgggacagaggatgaggagactccttccgatcagaatgtgagcgtaggcgtgtcccaatccaaggctggaagctcgacgcaaaagacacagagttgtgaaatgtgcgtgcctgttctgaaggacatactgcacttagcagacctgccaggccagaaaccatacctcgtgggtgagtgtaccaaccaccatcagcaccagaagcaccactctgcaaaaaaatcgctgaagcgggatatggaccgtgcgtcctatgtgaagtgctgcctgttttgtatgtccctaaagcccttccgcaaatgggaagttggtaaagatttgcctgctatgctgaggcttttgcgcagtctggtgtttcctggcggtaagaagccggggacaattactgagtgcggtgaagatattcggtcccagaagtcccattataagtccggcgaatgcggcaaggccagtcgacacaaacacacacctgtgtaccacccccgagtttacacaggcaagaaactatacgagtgcagcaagtgtggaaaggcattcagaggcaagtattcactggtccagcaccagcgcgtccacacgggggagcgtccctgggagtgcaatgagtgtggcaagttcttttctcagaccagccatttgaatgatcatcgaaggattcacacaggcgaacgtccgtacgagtgttctcagtgtggaaagtccttttcccagaaggctaccctggtgaagcaccaacgggttcataccggggagagaccttataagtgtggtgagtgtgggaacagttttagccagtctgctatcctgaatcagcacaggcgcatacacaccggcgccaaaccttatgagtgcggccagtgtggaaaatcattttcccagaaggcaacactcattaagcatcagcgagtacatactggggaacgcccatacaagtgtggcgactgcgggaagtccttttctcagtcctccattctcatacaacataggaggattcacaccggggcaagaccttacgagtgcggtcagtgtgggaaaagttttagtcagaaaagtggcttgatccagcaccaagttgtgcacaccggcgaaagaccttacgagtgcaacaaatgtgggaacagcttctcccaatgctcatcccttattcaccaccaaaaatgccactag

SEQ ID NO: 14837 - DNA, 1425 bp, Artificial Sequence
  Description of Artificial Sequence: Synthetic coding sequence
atggccgcagccgccctgcgtgcacccacgcaggggtgtgtaacctttgaagacatcgctatctatttcagccaggacgaatggggcttactagacgaggcgcagcgattactctatctggaggtaatgttggagaatttcgccctggtagccagtcttggttgtggccatggaactgaggatgaggaaaccccttctgaccaaaacgtcagtgtcggcgtatctcagagcaaggcgggaagtagtacccagaaaacccaatcttgcgagatgtgcgttccagtcctgaaggatatcctgcacttagcagacctccccggacagaaaccctacctggttggggagtgtaccaatcatcaccaacaccagaagcatcatagcgctaaaaaaagcctcaagcgtgacatggaccgagcctcgtacgtgaagtgttgtctgttttgcatgtcccttaagccttttagaaaatgggaggttgggaaggacctgccagcgatgctcagattattgagatctttagtctttcctggagggaaaaagccaggcaccatcacagaatgcggggaggatatccgcagccagaagtcacattacaagtctggggaatgtggaaaagcatctaggcataagcacacaccagtatatcacccccgcgtgtacaccggaaagaaactgtacgagtgtagcaaatgtggcaaggcctttcgtggcaagtactccttggtccaacaccaacgtgtacatacaggagagcgcccttgggaatgtaacgagtgtgggaaattcttttcacagacctcacacctgaatgaccaccggcgaatccataccggcgagaggccctatgagtgctcagagtgcggcaagctgtttaggcaaaacagctcgctggttgatcatcagaagatccacacaggagcacgtccatatgaatgtagccagtgcgggaaatccttcagccagaaggccacgctcgtgaaacatcaaagggtccacacaggagaacggccctacaaatgtggcgagtgcggaaattctttttcgcagagcgctatcctgaatcagcacaggagaatccatactggcgccaagccgtatgagtgcggtcaatgtggcaagtcattcagtcagaaggcgaccctgatcaaacatcagcgagttcacacaggcgagaggccatataaatgcggcgattgcggtaaaagcttttctcagagcagtatactcatacaacatcgaagaatccatacaggcgctcgcccatatgaatgtgggcagtgtggaaaatcattttcacagaagtctgggcttattcagcaccaggtggtgcacactggggaacgaccttatgagtgcaataaatgtggcaacagcttctctcagtgcagttcactgatccaccaccagaagtgccataatacatag

SEQ ID NO: 14838 - DNA, 1464 bp, Artificial Sequence
  Description of Artificial Sequence: Synthetic coding sequence
atggccgctgcagctttgagggcccctactcaggtcaccgtctctcccgaaacccacatggatctgaccaaggggtgcgtgactttcgaggacattgccatttatttcagccaagacgaatggggtcttctagacgaggctcagcggctcctctatctggaagtgatgttagagaacttcgctctagtcgctagtctgggctgcggacatgggacagaggatgaggagacccctagtgatcagaacgtctccgtcggtgtgtcacagtcaaaggccgggtcaagtactcagaagacccagtcctgtgagatgtgcgtcccagtgctcaaagatatactgcacctggcagatctccctgggcagaagccttatctggtgggtgagtgtacaaaccatcaccagcatcagaagcatcattccgccaagaaatctctgaaacgggatatggaccgagccagttacgtgaagtgctgtctcttttgtatgtcattgaaacccttccggaaatgggaggtcggaaaagatcttccggccatgcttcggcttctcaggtctcttgtcttccccggcggaaaaaagcccggcaccatcactgagtgcggtgaagatatccgcagccagaaaagtcactacaagtcaggagagtgtggcaaagcttcacggcataaacacacacctgtgtaccaccctcgcgtgtacacaggcaagaaactatacgagtgtagcaagtgcggtaaggctttcaggggcaagtatagcctggtgcagcaccagcgggttcacaccggagaacgcccgtgggaatgtaacgagtgtggcaaatttttctcccagacaagccatttgaacgaccatcggaggatccacactggcgagcgaccgtacgagtgttcagagtgcgggaaactgttccgccaaaactccagcctcgtagaccaccagaagattcacacaggtgcgcgaccttacgaatgctctcagtgtgggaagtctttctcccagaaagccacattggtgaagcaccagagagtccatactggggagaggccgtataaatgtggagaatgcggcaactctttttcccagtccgccatcctgaatcaacacagaaggatccacacaggtgccaagccatacgagtgcggccaatgcggcaagagtttttctcaaaaggctacacttatcaagcaccagagagtgcataccggggagcgaccgtacaagtgtggcgactgcggaaagtctttttcacagtctagcatactgatccaacatcggcgcatccacactggagctcgcccttatgagtgcggacaatgtggcaagtcattctcgcagaagtcgggattaatccagcaccaggtcgtccatacgggggagaggccctacgagtgtaacaagtgtggtaatagtttttctcagtgctcctcgcttattcatcatcagaagtgccataatacatag

SEQ ID NO: 14839 - DNA, 1692 bp, Artificial Sequence
  Description of Artificial Sequence: Synthetic coding sequence
atgatgaccgccgagtcaagggaagccaccggactgagccctcaagctgcacaggaaaaagacggtattgtaattgttaaagtcgaagaggaggatgaggaggaccacatgtggggccaagatagtaccttgcaggacacacctcctccagatcccgaaatcttcagacagcggttcaggaggttctgctatcagaatacgtttggaccacgtgaggccctgagtcgactcaaggagctttgccatcagtggctgcgacccgaaattaatactaaagaacagatactggagctgctcgtgctcgagcaatttctctcgatcctccctaaggaactacaggtgtggctgcaggagtaccgccccgactctggggaggaagcggtaacgttgcttgaggatttggaactggatctgtcgggccagcaagttccaggtcaggtgcatggaccggaaatgctggcaaggggaatggtgccccttgatcccgttcaggagagtagctcgtttgacctccatcacgaggcaacacagtcccattttaagcattcctcacggaagccgcgactcctgcagagtagggctctacctgccgctcacatccctgcaccacctcacgaaggctctcccagggaccaagcgatggctagcgctttgttcacagctgacagccaggctatggtcaagatcgaggatatggccgtttcactgattctggaagaatggggatgccaaaacttggccaggcgcaacctgtctcgggataatcgccaggagaactatggatccgcctttccacagggtggcgagaaccggaatgaaaatgaggagtccactagtaaagccgagacgtcagaagatagcgcctctaggggcgaaaccacgggcagatctcagaaagaattcggcgaaaagcgagatcaggaaggaaagacaggtgaacgccagcaaaagaatccagaagagaagacacgaaaggagaaacgagacagcggacccgccataggcaaagataagaaaaccataacaggagaacgggggcctagagagaagggtaaaggtttagggcggagttttagtctctcaagtaacttcaccaccccagaagaagttcctaccggcacaaaatcacacagatgcgacgagtgcggcaagtgcttcacaagatcctcgagtctgattagacacaaaatcatccatacgggcgagaaaccttacgagtgctccgaatgtggaaaggccttttccctgaacagcaatctggtgctccaccaacgcatccatacaggcgagaagccccacgaatgcaacgagtgtgggaaagccttttcccattcctctaatctcattctccatcagcgcatccattccggggagaaaccatacgaatgtaatgagtgcggcaaggcattttcccagtctagcgatcttactaagcatcagaggatacacaccggcgagaagccatacgagtgttctgaatgcgggaaggctttcaacaggaacagctatttaattcttcatcggcgaattcacaccagagaaaagccctacaaatgcacgaaatgtggtaaagcattcacacgctctagtaccctgactcttcaccataggattcatgcgcgggaaagggccagtgagtattcccccgcaagccttgacgccttcggggcctttctgaaaagttgcgtgtag

SEQ ID NO: 14840 - DNA, 1584 bp, Artificial Sequence
  Description of Artificial Sequence: Synthetic coding sequence
atgtgggggcaagatagtaccttacaagatacccctccacctgatcccgagatattcagacagcggtttcggagattctgttaccagaacactttcggcccccgtgaagctctgtccagacttaaggagctctgtcaccagtggctgcggcctgaaatcaatacaaaggaacagatcctcgaactgctggtgctggaacagttcctcagtatccttcccaaggagctgcaggtctggctgcaggaatacaggcctgattcaggcgaggaggctgtgactctgctggaggatcttgaattagacctgagtgggcagcaagtacctgggcaggtgcatggtcccgaaatgctcgccaggggaatggttccattggatcctgttcaagagagcagcagttttgacctccatcacgaagccactcagagccacttcaaacactcttcccggaagccccgtctgctccagtcaagggcgctccccgcggcccatattccagctccaccacatgagggttcccctagagatcaggccatggcctccgccttattcaccgctgactcacaggccatggttaaaatagaagatatggcagtgtcgctgatcttagaagagtgggggtgtcagaatttggccaggagaaacttgagcagggacaacagacaggaaaactacggaagcgcctttcctcagggtggcgagaatcggaatgagaatgaggagtcaacaagcaaggccgagacaagtgaggattctgcatcaaggggtgagactacggggcgaagtcagaaagagtttggggagaagagggaccaagaagggaagacaggggaaaggcagcaaaaaaaccctgaggagaagactagaaaagagaagcgcgattctggcccagcaattgggaaagataaaaaaactataacaggcgaaagaggccccagggagaagggaaagggcctaggccggtctttctcactctcatcaaacttcaccactcccgaggaagtccccaccgggacgaagagccacagatgcgacgaatgcgggaaatgttttacccgcagctccagcttaatccggcacaagattatccacacgggcgaaaaaccctacgagtgttccgaatgtggaaaggctttttcccttaactccaacctggtcttgcaccagagaattcatacaggcgaaaagccccacgagtgcaacgagtgtgggaaagccttttcacattcttccaacctcatcttgcaccagcgcatccattcgggggagaaaccttatgagtgcaatgaatgcggaaaagccttttcgcagtccagtgacctcaccaaacatcaaagaatccatactggggagaagccttatgagtgtagcgagtgcgggaaggccttcaacagaaactcgtatcttatcttacacagaaggatccacacgcgcgagaaaccttacaaatgcacgaaatgtggcaaggctttcactaggtcttcaaccttgaccttacatcatcgcattcacgcaagagagcgagcgtccgagtattcacccgcctccctcgatgcattcggcgcattcctgaagtcctgtgtttag

SEQ ID NO: 14841 - DNA, 378 bp, Artificial Sequence
  Description of Artificial Sequence: Synthetic coding sequence
atgatgacagcagaaagtagggaagcgactggactgagcccgcaggcagcccaagaaaaggacgggatcgtcatcgtcaaggtggaggaggaggatgaagaggaccatatgtggggccaggattccactctgcaggacacacctcctccggatcctgagattttcaggcaacgattcaggcgcttctgctaccagaacacatttggccctcgtgaggccctctctaggcttaaggagttatgtcaccagtggctgagacctgagataaacactaaagaacagatactcgaattactggtgctcgagcaattcctcagcattctgcccaaggaactgcaggtctggctgcaagagtaccgccctgattcaggcgagtag

SEQ ID NO: 14842 - DNA, 1053 bp, Artificial Sequence
  Description of Artificial Sequence: Synthetic coding sequence
atggctagtgctctcttcacagccgactcacaggccatggtgaagatcgaagatatggctgtctcccttatacttgaggagtggggatgtcaaaacctcgcacgcagaaatctgtcccgggataaccggcaagaaaactacggatctgccttcccccagggtggcgaaaatagaaatgaaaacgaagagtcaacgtctaaggcagagacaagcgaggattccgcttctcgaggcgagaccaccggaagatcccagaaggagtttggagagaagagggatcaggaaggaaagacgggggaaaggcagcagaaaaatccagaggaaaagacccgcaaggaaaagagagatagcgggcctgccatcggaaaggacaaaaagacaattacaggcgaacggggtcccagagagaaggggaaaggattaggacgctcattctcactttcctctaattttacgacacctgaggaagtgcctacaggtacgaagtcccacagatgcgacgagtgtggaaagtgcttcactagatcctcgtctctgattagacacaaaattatacacacaggagaaaagccatacgagtgctcagagtgtggaaaagctttcagccttaattcaaacttagtgctgcaccagagaattcacaccggagagaaaccccacgaatgcaacgaatgcggaaaagccttctcacactcatccaacttaatcctacaccagcgcatccacagcggggaaaaaccatacgagtgcaatgagtgcggtaaggccttctctcaatcttccgacctcacgaaacaccagcggatccatactggggaaaaaccctatgaatgctcagaatgtggaaaggccttcaacagaaattcttacctgatccttcatagacgtatccatacgagagaaaagccatataagtgcaccaaatgcggcaaagcctttaccagatcatcaacactcacattgcatcaccggatccacgcgagagaacgggccagtgaatactctcctgcatctctggacgcattcggagcattcttgaaatcctgtgtctag

SEQ ID NO: 14843 - DNA, 2904 bp, Artificial Sequence
  Description of Artificial Sequence: Synthetic coding sequence
atggcagtggctctggattctcaaatcgacgcacccttggaggttgaagggtgcctgattatgaaagtagagaaggaccccgaatgggcaagtgagccgatcctagagggcagtgacagtagcgagacattcaggaaatgtttcaggcagttttgttacgaagatgtcactggacctcatgaggcgttcagtaaactctgggagctttgttgtaggtggcttaaacctgagatgcggtccaaggagcagatcctggagctgcttgtaatagaacagttcctgactattctccccgaaaagatccaggcttgggcccagaagcagtgcccacagtccggcgaggaggccgtggcacttgtcgtccatctggaaaaagagaccggtaggctgcgccagcaggtgtcgtctcctgtgcatagggagaagcacagtccactgggcgcagcctgggaggtagccgattttcagccggagcaggtagaaacacagccccgggcggtttcacgcgaggagcccggcagtctgcacagtgggcaccaggagcagctgaatcggaaacgcgaacgtagaccccttccaaagaatgcaaggcccagtccctgggttccagcactggcggatgagtggaataccttggaccaggaagtcaccactactcgactgccagccggaagccaggagccggtaaaggacgtgcatgtagcccgggggtttagctacagaaagagcgtgcatcagatacctgcgcagagggacctctaccgtgactttagaaaggagaatgtaggaaatgtcgtctccctaggttctgctgtgagcacgagcaataaaatcacacggctggaacagaggaaggagccctggacactcggcctccattctagcaataaacggagcatccttaggtctaattacgtgaaagagaagtctgtccatgcgatccaggtgcctgctagatcagcgggcaagacctggagggagcagcagcaatggggattagaggatgagaagatcgctggtgtgcactggtcatacgaagagacgaagacgttcttggctatactcaaggaatcccgcttctacgaaacactccaggcgtgccccagaaattctcaggtttatggcgccgtagctgaatggctccgcgagtgcggattcctgcgtactcctgagcaatgtcgaacaaagtttaagtcgctacagaaatcttatagaaaggtaagaaatgggcacatgttagagccatgtgcctttttcgaagacatggacgctctcttgaacccagcagctagggccccctccacagataaacccaaagagatgatcccagtgccgagactgaagcggatcgccatttccgccaaagaacacatctctttagtcgaggaggaagaagcagccgaggattcagacgacgacgagattggtatcgagtttatacggaagtccgaaatccatggcgctcccgtcttatttcagaacttgtccggggtgcactggggttacgaggaaacaaaaaccttcctggatattcttcgcgagacccgcttctacgaagctctgcaggcgtgccaccggaagtccaaactgtatggtgctgtcgcagagcagttacgcgagtgcggtttcctgcgcacacctgagcagtgccgcacaaagttcaagtcacttcagaagtcgtaccgtaaagtgaagaacggccatgttttggaaagctgtgccttctataaagagatggatgccttgatcaatagtagagctagtgcccctagtcccagtacccctgaggaggtgccaagccccagtcggcaagaaaggggcggaatcgaagtcgagccacaggaacctacgggttgggagccagaagaaacatcacaggaggcggtaattgaagattcttgttccgaacggatgtcagaggaagagatagtgcaggagcctgaattccaggggcctccgggcttgctccagagtcccaatgacttcgagatcggctcttccatcaaggaagacccgacgcaaatcgtgtacaaggacatggagcagcatcgcgcactcattgagaaatcaaaacgagttgtgagccaaagcacagatccatctaagtacagaaagcgagagtgtatctcaggaaggcagtgggagaatttgcagggaatccggcagggaaagccgatgtctcagccccgcgatctgggcaaggccgtggtgcaccaacggcccttcgttggcaagaggccttaccgcctcctgaagtatggagagtcattcggcagaagtacgagactcatgtgcaggatgacccatcacaaggagaacccatacaagtgcggagtatgtggcaagtgcttcggccgtagtagatcactgatcagacatcagagaatccatacaggggagaaaccattcaagtgtctcgactgcgggaagagttttaacgatagctcgaacttcggcgcccaccagagaatccacacaggggaaaagccatatcgctgtggagagtgtggaaagtgtttttctcagagtagcagcttaatcatccaccaacggacgcatacgggggagaaaccctaccagtgtggcgagtgtggcaagagctttacgaactcttcccactttagtgcccatcgacgggtgcatactggagagaacccgtacaaatgcgtagactgtgagaaaagctttaacaattgcactagattccgggaacacaggcgcattcatactggtgagaaaccctacggttgtgcccagtgcggcaagcgatttagtaagtcctcagttcttaccaagcaccgggaggtccacgtccgcgaaaaacccctccctcatccaccttccctttattgtccagagaatcctcataagggcaagactgacgaatttcgcaagaccttttag

SEQ ID NO: 14844 - DNA, 2511 bp, Artificial Sequence
  Description of Artificial Sequence: Synthetic coding sequence
atggccgttgcactggactcccagattgatgcccctctggaagtggagggctgtctcatcatgaaggtggagaaagatcccgagtgggcttccgagccgatcctcgagggaagcgattcaagtgaaacgtttcgcaagtgctttcgccagttttgttacgaagacgtgaccggaccacacgaggctttttcaaagctgtgggaactctgctgtaggtggctgaagcccgagatgcgctcaaaggagcagatcttggagctgctggttatcgagcaattcttgacgattctgccggaaaaaattcaagcttgggcccagaagcagtgccctcagagtggcgaggaagcagtggccctcgtggtacatctggagaaggagaccggcagattacgccagcaggtgtcgtcgcctgtgcaccgtgaaaagcacagccctctgggggccgcttgggaagtggccgactttcagcccgaacaggtggaaacccagccacgcgcggtctctagggaggaacccggctctttacattctggccatcaggagcagctgaaccgaaaaagagagaggcgcccactccctaaaaatgcccgaccatccccctgggttcccgccttggcagacgagtggaacacactagatcaggaggttacaacaactcgcctacccgccgggtctcaggagcctgtgaaggatgtccatgtggcccgtggcttttcttaccgcaaatctgtgcatcagataccagcccagagggacttgtatagggatttccggaaagagaacgtcggaaacgtggtgagcttgggttccgccgtctcgacctcaaataagattacacgcttagagcagcggaaggagccatggaccctgggcctgcatagcagcaataaacgaagcatcctgagatcgaactatgtgaaagagaagagtgttcatgccattcaagtcccagccaggtccgctggcaagacttggcgggaacagcaacaatggggtttagaagatgagaagattgccggcgtgcattggtcttatgaggagacgaagacatttttagccatactgaaggaatccaggttttacgagacacttcaggcctgtcccaggaacagccaggtctatggagctgtggccgaatggctcagagagtgtggcttcctcagaaccccagagcagtgtcgaaccaaattcaagtccctccaaaaaagctatcgtaaagtcagaaacgggcatatgcttgagccatgcgctttctttgaagatatggacgccctgctgaatccggctgctagggcacctagtaccgataaacctaaggagatgatacctgtcccacgcctcaaacgaattgctataagtgccaaagagcatattagcctggtggaggaagaggaggccgctgaagactctgatgacgatgaaatcggtatagagttcattcggaagtctgagattcatggagctcccgttttgtttcagaacctgagcggtgtgcattgggggtacgaagagacaaagacatttcttgacatcctgcgcgagacccgtttctatgaggccctgcaggcttgccaccgtaaatccaagctttatggggccgtggcagagcagctccgagaatgtgggttcctgagaactccagagcaatgccggactaaatttaaatctctgcagaaaagttaccggaaagtgaagaatggccacgtccttgagtcctgtgcgttctataaagagatggatgcccttatcaattcaagggccagtgcgcctagccccagcacccctgaggaagtgccttccccttctcgccaggaacggggtggcattgaagtcgaaccgcaggaaccaaccggatgggaacccgaggagaccagccaagaggcagtgatcgaagactcatgctccgaaagaatgtctgaggaggagattgtgcaagaacctgagttccaggggccacctggactgctgcagtctccgaatgacttcgaaatcggctcctcaatcaaggaggaccccactcagattgtttataaggatatggagcagcatagagccctgatagaaaagtctaagagggttgtcagccagagcacagacccatcaaagtaccggaaaagggaatgtatttctggaagacaatgggagaatcttcagggcattcggcaaggcaaaccaatgtcccagccaagggacctgggaaaggcagttgttcaccagagaccattcgtgggaaagcgcccgtaccgcctgctcaagtatggcgaaagcttcgggcggtctacacgccttatgtgccggatgacacatcacaaggagaatccttataagtgcggagtctgtggcaaatgcttcggaaggtccagatcacttattaggcaccagcgaatacacaccggggaaaaacctttcaaatgcctcgactgtggaaaatcgttcaacgattctagtaatttcggagctcatcaaagaatccacaccggagaaaagccatcgatcagcgtactcccttag

SEQ ID NO: 14845 - DNA, 2520 bp, Artificial Sequence
  Description of Artificial Sequence: Synthetic coding sequence
atgattatgaccgaatctagggaagtgattgatctcgaccccccagccgagacttcccaggaacaggaagacctgttcattgtgaaggtggaagaggaggactgtacgtggatgcaagagtacaatccgccaacatttgaaaccttctatcagcgatttcgccactttcagtaccatgaggcctcaggacctagagaagccttgtctcagctccgcgtgttatgttgcgaatggcttaggccagagttacatacgaaggagcagatcctcgaactgttggtgctggagcagttcctgacgatccttcctgaagagttccagccttgggtgcgggagcaccatcctgagagtggcgaggaggcagtcgcagtcatcgagaacatacaaagagagctggaagaacgcagacaacagattgtagcttgccccgatgtgctgccgcgaaagatggccactccaggcgctgttcaggagagttgttcccctcaccccctgaccgttgatacccaacctgagcaggcaccacagaagccccggctattggaggagaacgccctgcccgtactgcaagtgccatccctgccgctgaaggattcacaggaactgaccgcttctctactatccaccgggtctcagaaattggtaaagatcgaagaggttgccgatgtggccgtgtctttcatcctcgaagagtggggtcacctagatcaatcacagaaaagtctgtaccgcgacgaccgaaaagagaattatggatccattacgagcatggggtatgaatcccgagacaacatggagctgatagtgaaacagatttcagacgattcagagtctcactgggtggccccggaacacacagagcgtagtgtaccccaggaccccgacttcgctgaagtgtctgacctcaaggggatggtgcagcgctggcaggtgaaccctacggtgggcaaaagccgccagaacccaagtcagaaacgggatctggacgctattactgacatcagccccaagcagtccacccacggagaaagaggccacaggtgctctgactgcggtaaattctttctgcaggcttccaatttcatccagcaccgacggatccacacaggggaaaaaccctttaagtgcggcgagtgtggaaaatcatacaaccagagagtgcacctgacccagcaccagagggtgcacactggcgagaaaccctacaagtgtcaggtttgtggtaaagcctttcgcgttagtagccaccttgtccagcatcattctgtgcactccggggagcgaccctatggctgtaacgagtgtggcaagaattttggccggcatagtcaccttatagagcacctcaaacggcatttccgcgaaaagagccaacggtgctctgataagaggtcaaagaatacgaaactgagtgtaaaaaagaagatatccgaatactcggaggccgacatggagcttagtggaaagactcaacgtaatgtttcccaagtgcaggattttggagaggggtgtgagttccaggggaaactggataggaagcaggggattcctatgaaggagatactggggcagccatcttcaaaacgaatgaattacagcgaggttccctacgtccacaagaagagcagtaccggcgaaaggcctcacaagtgcaatgaatgcgggaaatcattcattcagtctgcacaccttatacagcaccagaggatccacactggtgagaagcccttccgatgtgaagagtgcggcaagtcgtataatcagcgtgttcacctaacccagcatcagcgcgtgcatactggggaaaaaccatatacctgccctctgtgtggaaaagcgttccgtgtgcggtcacacctggtgcagcatcagagtgtgcattccggcgaacggccatttaaatgcaacgagtgtgggaagggattcggtcgaagatctcatcttgccggccacctgcgactccacagtcgcgaaaaaagccaccagtgccgtgagtgtggagagattttcttccagtatgtgagcttgatcgagcatcaggtattacatatgggacaaaagaacgagaagaacgggatctgcgaggaagcgtacagctggaacttaactgtgatcgaagataagaagatcgagcttcaggaacagccctaccaatgcgatatctgcggcaaagcattcggatattctagcgacctgatccagcattatcggactcacaccgccgagaagccctatcagtgtgatatatgcagggagaacgtgggccagtgctctcacaccaagcagcaccagaagatatattcaagtaccaaaagtcaccaatgtcacgagtgtggccggggattcactctcaaatctcacctcaaccagcaccagcgtattcacaccggagagaaacccttccaatgcaaggaatgtggaatgaatttctcttggtcgtgtagcctcttcaagcacctgagaagtcacgaacgcacggaccccattaatacgctgagcgtcgagggaagccttttgtag

SEQ ID NO: 14846 - DNA, 2520 bp, Artificial Sequence
  Description of Artificial Sequence: Synthetic coding sequence
atgatcatgactgagagccgtgaagtgatcgacttggatccgcccgccgaaaccagtcaggaacaggaagacctgttcatagtcaaggtggaggaagaagattgtacttggatgcaggagtataatcctccaacatttgaaactttctaccagagattcagacatttccagtatcacgaagcaagcggcccccgggaagctctcagccagctccgggtcctctgctgtgagtggctgaggccagaattgcacacgaaagaacagattctcgaactcctcgtgttggagcagttcttgaccatcctccctgaggaattccagccatgggtgcgggagcaccacccagaaagcggcgaagaggcagtggccgtcattgagaacatacagcgggaactagaagaaagacgacagcaaattgtggcgtgtcccgatgtcctgcctcgcaagatggctacccctggtgctgtgcaagagtcctgctcacctcacccactgacagtggacactcagcctgaacaggccccccagaagccccggctccttgaggaaaacgcattgcctgtgttgcaggtgccctctctaccacttaaagatagccaggaactcactgcttccttactcagcacaggatcgcagaaactggtcaagatcgaggaagtcgccgatgtggccgtctcctttatcttggaagagtggggacatctggatcaatctcagaaatctctgtatagagacgatcggaaggaaaattatggatccatcacatccatggggtatgagagccgagataacatggagttgatcgtaaagcagatcagcgacgattctgagtcccactgggtggctcctgagcacacagaacgtagcgtgcctcaagaccctgatttcgccgaggtaagtgacctcaagggaatggtccaacgctggcaggtaaatcccaccgtcggcaagtccaggcaaaacccctctcaaaagcgagatctcgacgcaatcaccgatataagccccaagcaatccacacacggcgaacggggccatcggtgcagtgattgcggtaagttcttccttcaggcctccaattttatccagcataggagaattcacactggcgagaagcccttcaagtgcggggagtgtggcaagtcatataatcagagagtgcacctgacccagcatcagagggtgcatacaggggagaagccctacaagtgccaggtgtgcgggaaagcctttcgcgtcagcagccacctggtacaacatcactctgtccactccggggagcgcccctatgggtgtaacgagtgtgggaagaattttggtcgccatagccacctgattgaacacctaaagaggcactttcgtgagaaatcgcagcgctgtagtgacaaacggtctaaaaatactaagctttctgttaaaaagaaaatttccgagtatagtgaggctgatatggagctgagcgggaaaactcaacgcaacgtctctcaagtccaggacttcggcgagggatgtgagttccaaggtaaactggaccggaagcaaggcattccaatgaaggagatcctcggccaaccctcctccaaaaggatgaattatagcgaggtaccctacgttcataagaagtctagtacaggcgagcgcccacataaatgcaacgagtgtgggaaaagcttcattcagagtgctcaccttatccagcatcaacgcattcataccggagaaaagccatttagatgtgaggagtgcggcaaatcttacaaccagagagttcatctgacccagcaccagcgggtacacaccggagagaaaccctacacctgtcctctctgcggcaaagcctttagagtgcggagccatttagtgcagcatcaaagtgttcactccggcgaaaggccgtttaaatgcaatgaatgcggcaagggcttcgggaggcgaagtcacctggctgggcacttaagactacattcacgcgagaagtcgcatcaatgtcgggaatgcggggaaatttttttccagtatgtttcactaatagagcaccaggtgttgcatatgggccaaaagaatgagaagaacggaatctgcgaagaagcctacagttggaatctgaccgttatcgaggacaagaagattgaactgcaggaacaaccctatcagtgtgacatctgcgggaaggcctttggatattcgagtgatctaatccaacactacagaacgcataccgccgaaaagccctaccagtgcgatatatgtcgcgaaaacgtggggcagtgctctcataccaagcaacatcagaagatctattctagtacaaagagccaccagtgccatgaatgcggcagaggattcactctgaagtcacatctcaaccaacaccaacgcatccatactggcgagaagccattccagtgtaaagaatgtggtatgaacttttcttggagttgcagcctgtttaagcatcttagatctcacgaaagaacagatccaatcaacactttgtccgttgagggctccctgctctag

SEQ ID NO: 14847 - DNA, 291 bp, Artificial Sequence
  Description of Artificial Sequence: Synthetic coding sequence
ttccgccactttcagtaccacgaagcaagcggaccaagggaagctcttagtcagttaagggtactgtgttgcgaatggctacggcccgagttgcacacgaaagaacaaatcttagagttgttggtactggaacaatttctaacgatcctacccgaagaatttcaaccctgggtgagagagcaccatcccgagagcggggaggaagctgtcgccgtgattgagaacattcagcgagaactagaagaacggcgccaacaggtctctcgggcgcagtggctgaccttagtgtag

SEQ ID NO: 14848 - DNA, 2520 bp, Artificial Sequence
  Description of Artificial Sequence: Synthetic coding sequence
atgatcatgaccgagtccagagaagtgatcgacttggacccgccggcagagaccagtcaagaacaggaggacctcttcatcgtgaaagtagaagaggaagattgcacttggatgcaagagtacaatccccccacattcgagactttttaccaaaggtttcgacacttccagtaccatgaagcttcaggccctcgtgaagcattaagccaactgcgggtactctgctgtgaatggctacgcccagaacttcacacaaaggagcagattctggagctgctggtgcttgaacagtttttgaccatccttcctgaagagtttcaaccctgggtcagagagcatcaccctgaatccggcgaagaagccgtggcagttatcgaaaatatccagagggaattggaagagagaaggcagcagattgtggcctgtccagacgttcttccccgcaagatggcaactcctggtgcagtccaggagagttgttctcctcaccctctcacagtcgacacccagcctgaacaggcacctcagaagccccgactgttggaagaaaacgcattgcccgtgcttcaggttcctagtctgcctttgaaggatagtcaagagctgaccgcatccctgctgtccacagggagccaaaagctggttaaaatcgaggaggtcgcggacgtcgccgttagcttcattcttgaggagtgggggcacctggaccaatcgcagaaatcactgtatcgcgacgaccggaaggaaaactacggcagcatcacttccatggggtacgagtctcgggataatatggagcttattgtgaaacagatttcagatgatagcgagagccactgggttgctcccgaacacacggagagaagcgtgcctcaggaccctgatttcgccgaggtttctgatcttaagggtatggtgcagcgctggcaggttaatccaactgtggggaagagtagacaaaacccctctcagaagagagatctcgatgcaatcacggatatttcaccgaagcagagtacacacggcgaacggggccaccgctgctcagactgcggcaagttctttctccaagccagtaatttcattcagcacagaagaatccacactggagaaaagccgtttaaatgtggcgagtgcggcaaatcatacaaccagcgtgttcacctgacccaacaccagcgcgtgcatacgggggagaaaccatacaaatgccaggtctgtggtaaggccttcagagtgtcatcccacctggtgcagcaccactccgtacattcaggcgaaagaccttacggttgcaacgaatgcggtaaaaacttcgggcgccacagtcacctcattgaacatctgaagcgacattttcgcgagaaaagtcagagatgcagcgataagcggtccaaaaacaccaagctgtcagtgaaaaagaaaatatcagaatattctgaagctgatatggaactgtccggaaagacgcagcggaatgtgtcccaggtgcaggactttggagaaggttgtgagtttcaaggaaaactcgatagaaaacaggggattccgatgaaggagatattggggcaaccaagctccaagaggatgaactattcggaggtgccttacgtgcataaaaagtcaagcacaggtgagcgcccccacaagtgtaatgagtgcggaaagagcttcatccagagtgctcacctcatacagcaccagaggattcataccggggaaaagccttttcgatgcgaagaatgcgggaagtcttataatcaaagggtccacctgacacaacatcagcgtgtacacactggggagaagccctacacctgcccactgtgcggaaaagcctttcgggtgagaagtcatctggtgcagcatcagtctgtgcacagcggagagcggccattcaagtgtaacgaatgtggcaaagggtttggccggagaagtcaccttgctggacacctccgtctccatagtcgcgagaaaagccatcagtgcagagaatgcggtgagatattttttcagtatgtgagtctgatcgaacatcaggtactgcacatgggccagaaaaacgagaaaaacggaatctgtgaggaagcatactcttggaatctgacagtgattgaggataaaaagattgaactgcaggaacagccatatcagtgcgacatttgtgggaaggcctttggatacagctccgacctgatacagcactacaggacccacactgccgagaaaccataccagtgcgacatctgcagagaaaatgtgggacagtgcagccacactaagcagcatcagaaaatctacagcagtactaaatctcaccagtgccatgaatgcggccggggatttacactcaagtcccatctcaaccagcaccagcgcattcatacaggagagaaacctttccagtgcaaggagtgtggcatgaactttagctggtcctgtagcctgttcaagcacctgcgcagccatgaacgcaccgatcccattaatacactgagtgtggagggctcgctcctttag

SEQ ID NO: 14849 - DNA, 2301 bp, Artificial Sequence
  Description of Artificial Sequence: Synthetic coding sequence
atgataatgactgaaagccgggaagtgattgatctcgatccgcctgccgaaacaagtcaggagcaagaggacctgttcattgtcaaagtagaggaagaggactgtacctggatgcaggagtataatcctccaacattcgagaccttctatcagaggtttcgacatttccaataccacgaggcctctggtcccagagaggcactgtctcaactacgcgttctgtgctgcgaatggctcaggccagagctccacaccaaggaacagatacttgagctactagttctggaacaattcctcaccattttaccagaagagttccagccttgggtaagggagcatcaccctgagtctggcgaggaggccgtggcggttattgagaatatccaacgggaactggaggagagacggcagcagatagtcgcctgcccagatgtcctgccacgcaagatggctacgccaggcgccgtgcaagagagctgttccccccacccactgacagttgatacacagcccgagcaggcaccgcagaaaccccggctcctcgaagaaaacgctttgcccgtgcttcaggtaccaagtctgcctctgaaggactctcaagagttgactgcaagcctcctttctacaggatctcagaaactggttaaaatcgaggaagttgccgacgtggccgtgagctttatactcgaagagtggggtcacctcgatcagtctcagaagagcctgtaccgggatgatcgaaaagaaaattacggcagcattacctccatgggctacgaaagtcgtgacaatatggagctgattgttaagcagatcagcgacgatagcgagtctcattgggtggcgcctgagcatacagaacggtcagtgcctcaagaccccgactttgctgaagtgagtgatctcaagggcatggtgcaacgctggcaagtcaaccctactgtcgggaagagccggcagaatcctagccagaaacgcgacctggacgctatcacagatatttctcctaaacagagcacccacggggagagaggacacagatgttcagactgtggtaagttcttcttgcaagcttctaatttcatccagcatcgacggatacatacaggagagaaacctttcaaatgtggagaatgcgggaagagctataatcagcgggtacatttgacacagcatcaacgagtccatacaggggaaaaaccttacaaatgccaggtctgcggtaaagccttccgagtgtcttcgcacttagtacagcatcattccgtgcattccggggaacggccttacggatgtaatgagtgtggcaaaaatttcggacgccactctcatctcattgagcatctgaaacggcactttcgggaaaagagtcaacggtgcagcgacaaaaggtcaaaaaataccaaactgtcagtaaagaagaagatctccgagtatagcgaagcagacatggaattgagcgggaagacgcaaaggaacgtctcgcaggtgcaggactttggagagggatgtgagtttcaggggaaactcgaccgcaagcagggcattcccatgaaggaaattttaggtcagccatcctcaaaaagaatgaactatagtgaggtaccgtacgtgcataagaaaagcagcactggtgagaggccacacaagtgcaacgagtgcggtaaatcatttattcagtctgcacatcttatacaacaccagaggattcatacaggtgaaaaaccctttagatgcgaggaatgcggaaagagttacaaccagcgagtgcatttaacgcagcatcagcgggtccacaccggagagaagccttatacctgcccgttgtgcgggaaggccttcagggtgcggtcacatcttgtacagcaccaatctgtgcactcgggggagaggccgtttaaatgcaatgagtgtggtaagggtttcggcagacgttcccatttggctggacatctccgtctgcattcccgtgagaagtcccatcaatgcagggaatgcggcgagatcttctttcagtacgtaagcctgattgagcaccaggtcctacacatggggcagaagaacgaaaaaaatggaatctgcgaggaagcctatagttggaacctaacagtgatagaggacaagaaaatcgagcttcaggagcaaccataccaatgtgatatctgtggcaaagctttcggctattctagtgacctgatccagcattacagaacccatactgctgagaagccataccagtgcgatatctgtcgtgtggtgatttataggatgtccttttcgcttcactgttcctgggactag

SEQ ID NO: 14850 - DNA, 1446 bp, Artificial Sequence
  Description of Artificial Sequence: Synthetic coding sequence
atgcggggattaccccggaaaagagaggcatggacacagccccaccctctggaagccctgtatgagagcctccgggttcttgaaaaggacacatctgcgactagccagagtgtaaacggatcgcctcaagctgagcagccctctctggaatccacatccaaggaggctttcttttcccgggttgaaacattttcatcactaaaatgggctggtaagccatttgagctgagccctctggtatgtgccaagtatgggtgggttacagtcgagtgcgacatgctgaaatgttcttcttgtcaagccttcctgtgtgcatcactgcagcccgcatttgacttcgacagatataagcaaaggtgtgccgagctaaagaaagctctctgtaccgcgcacgaaaaattctgcttttggcccgactccccttccccagacaggtttggcatgcttccgttggacgagccggcaatcctagtctccgagtttttggaccgattccagtccctttgccatctggacttgcagctgcccagtctacggcccgaagatctgaagacaatgtgtctgaccgaggacaaaatctctttattactgcatctcctggaggacgaacttgatcatagaactgacgaacgaaaaactactatcaagctcggcagcgatattcaagtgcacgtgacagcctgtattttatctgtctgtggatgggcctgctcgtcttccctggagtcgatgcagctaagccttatcacctgtagccagtgtatgcgtaaggtgggattgtggggcttccagcaaatcgaaagtagcatgaccgacttggacgcttcctttggtctgacctcaagccccatacccggcctggaggggaggccagaacggctcccactcgtccctgagtctccacgcaggatgatgaccagatcccaggacgcaaccttctcccctggctccgagcaagcagagaaatcgccaggccctattgtaagcagaacaaggtcttgggactccagtagcccagtcgatcgcccagaacctgaagccgcctccccgactacccggacaagaccagtcacgcgatctatggggaccggcgataccccgggacttgaggtccccagcagccctctgcgcaaggccaagagggctcggctgtgctccagcagttcaagcgatacttcttctagatctttctttgacccaaccagccagcatcgggattggtgcccttgggttaatatcaccctgggcaaagagagtagagaaaacggtggaacggaacctgacgcatccgctcccgccgagcctggttggaaggcagtgcttaccatcctgttagcacacaaacaatctagccaaccagcggaaactgattcgatgtcactgtctgagaagagtaggaaagtttttcgcatcttcaggcagtgggagagtctttgcagctgttag

SEQ ID NO: 14851 - DNA, 1509 bp, Artificial Sequence
  Description of Artificial Sequence: Synthetic coding sequence
atggccgcgccctgcgagggccaggcattcgcagttggggtcgaaaagaactggggcgccgtagtgagatctcccgagggcactccacagaagatcaggcaactcatcgacgaagggatcgcacctgaggaaggtggcgtggatgccaaggacacatctgcaacttcacagtctgtgaatggcagccctcaagctgagcagccttctctggaatccacatctaaggaagccttcttttcgcgggttgaaactttcagcagcctgaagtgggccggaaaacctttcgaattgagtcctctggtgtgtgccaaatatggatgggttactgtggagtgcgacatgttaaaatgctcaagttgtcaggccttcctatgtgcctccctgcagcccgctttcgacttcgatcgctataagcagcggtgcgccgaacttaagaaagcactgtgtactgcacacgaaaagttttgtttctggcctgactcgccatctcctgatagattcggaatgcttccattggacgagcctgctatcttggtctccgaatttctggacaggttccaatctctttgccacctggacctgcaattgccaagtcttaggccagaggacctcaagacaatgtgcctcacggaggacaagatctccctgctactccatttactcgaagatgagcttgatcatcgcacggacgagaggaagacaacaatcaagctcgggtctgatatacaggtgcacgtgaccgcctgcattctgagcgtgtgtggctgggcctgctcctcttcactggaatccatgcaactgtccctcattacttgcagccaatgcatgcggaaagtgggactgtggggcttccaacagatagagtctagcatgaccgacctggacgcatcatttgggctgaccagttctcccatccctggactggaaggccgccccgagagactccctctagtgcctgagagccctcgcaggatgatgactaggagccaagacgccactttctccccagggtccgaacaggccgagaagagcccaggcccgatagttagccgaacccgcagctgggatagttcctctcctgtcgaccgcccagagcctgaagctgccagtccaacaacccggacccgacctgttacacgatctatggggactggggatactccagggcttgaggttcctagctctcccctgagaaaagcaaaaagagcgcgtctgtgctccagttccagctccgataccagcagcaggagcttctttgatcctacatctcaacacagagactggtgcccttgggttaatatcacgctcggcaaggagagccgggaaaatggcgggaccgaacctgacgcttcagcaccggcagaaccaggatggaaagcagtcctgaccattcttctggcacataaacagagttcccagccggccgagactgactctatgtcactatcagaaaaaagccgcaaagtgtttcgtatttttcggcagtgggagtctttatgttcatgctag

SEQ ID NO: 14852 - DNA, 1296 bp, Artificial Sequence
  Description of Artificial Sequence: Synthetic coding sequence
atggcggctccgtgcgaaggccaggctttcgctgtaggggtggaaaaaaattggggcgctgttgtgcgctcacccgaagggacgccccaaaaaattaggcagctgatagacgagggcatcgcacctgaggagggcggggtggacgccaaggatacatccgccacttcccagagcgtaaatgggtccccccaggccgaacaaccttcgctggagagcaccagcaaggaggccttcttctcgagagtggagaccttcagctccctgaaatgggctggcaaaccctttgaactgtcacccctagtttgtgctaagtacggttgggtgactgtggagtgcgatatgttaaaatgtagctcttgccaggccttcctctgcgccagtttgcagcccgctttcgacttcgacagatacaagcaacgctgtgcagaactcaaaaaggccctgtgtaccgctcacgagaaattttgtttctggcccgattctccatcccccgacagattcggtatgctgcctctggatgagccggctatcttagttagtgaatttctggacagatttcaatccctctgccatctggacctgcagctgccttctttgcggccagaagatctgaaaaccatgtgcctgaccgaggacaagatctccctgctcctgcacctgcttgaagacgaactcgatcatcgtacagacgagcggaaaacaaccataaaactgggcagtgacatacaggtgcatgtgaccgcatgcatcttgagcgtttgtgggtgggcctgcagctctagtctggaaagcatgcagctgagtctgattacctgtagtcaatgcatgcgtaaggtgggcctgtggggctttcagcagatagaaagttcaatgaccgatttggacgcatcatttggacttacctcaagccccattccaggcctggagggcaggcctgaacggttgcccttggtccctgagtcaccccgtcggatgatgacacgttcccaggatgctaccttctctcctggctctgagcaggacacttcctctcgctcgttcttcgatcccactagtcagcaccgtgactggtgcccgtgggtgaatataacgctagggaaagagtcccgggagaacggcggtacagaacccgatgcgagcgcacccgcagagcctgggtggaaggcagtgttaactattctcttggcgcacaagcagtcctcccagcctgccgaaactgattcgatgagtctttccgaaaagagccgcaaggttttccgcatatttcgccagtgggagagcctgtgctcctgctag

SEQ ID NO: 14853 - DNA, 1596 bp, Artificial Sequence
  Description of Artificial Sequence: Synthetic coding sequence
atggatgaagagtccctcgagagtgcactacaaacctatagggcccagttacagcaggtggagctggctctgggcgccggactggattcttccgaacaagctgacctgagacagctccaaggcgacctgaaggagctaatagagctgacggaagcatctctggtgtccgtccgcaagtcctcactcctggccgcgttagatgaagaacgacctggccggcaggaagatgccgaataccaggcctttagagaagccattaccgaagcggttgaagctcctgccgcagccagggggtccggaagcgaaacagtgccaaaggcagaagccggacctgaatccgcggcaggagggcaagaggaagaggaaggtgaggacgaagaagagctgtctggtacgaaagtctccgctccctattactcgagctggggtacccttgagtaccataacgctatggttgttggcacagaggaggcagaagacgggagcgcaggcgtcagggtcttgtacctatacccaacccacaagagtttaaagccatgtccattctttctggaaggcaaatgccggttcaaggaaaactgcagatttagccatggacaagtggtgtcactggacgagttgcgaccctttcaggatcccgacctgtccagcctacaggcagggagcgcctgcctggccaagcaccaggacggcctgtggcatgcggcacgcattacagatgtagataatggttactacaccgttaagtttgatagtctgttgctcagggaggctgtcgtagaaggtgatggtattctcccacccttgcggacagaggccaccgaatcggattctgactccgacggaaccggcgactcttcttacgcgcgcgtggtggggtcagacgccgtcgatagtgctcagagttcagccctgtgcccaagcttggctgtggtgggtagtgatgcagtggactctggaacctgtagttctgcattcgcaggttgggaagtccatactcgaggtattggatctaggctgctgacgaagatggggtatgaattcggaaagggccttggacgtcatgctgaggggagagtggaacctatacacgccgttgtgttgccaagagggaagtctctcgaccaatgcgtcgaaaccctgcaaaagcaaacccgcgtcggcaaagccggaaccaataagcccccaaggtgtcgtggtcggggcgcacgacctggagggagacctgccccgcggaatgtcttcgactttctcaacgaaaagctccagggtcaggctcccggggcactcgaggcaggagctgcaccagctggtcgacggtctaaggacatgtatcatgcctccaaaagtgccaaaagggcactgtctctccggctgttccagacagaagagaaaatcgagcgtactcagagggacatccgcagtatccaggaagctttggccaggaatgcaggcaggcactctgtggcaagcgcccaactgcaggagaagctcgctggcgctcagcgacaactgggacagctccgcgcgcaggaggctggcctgcaacaagaacagaggaaagccgacacacataagaaaatgacagagttttag

SEQ ID NO: 14854 - DNA, 1536 bp, Artificial Sequence
  Description of Artificial Sequence: Synthetic coding sequence
atggacgaggaaagtttggaaagtgctctgcagacatatcgtgcgcaactgcagcaagttgagcttgccctgggcgctggcctggactcatccgaacaggctgatctacgtcagcttcagggcgatctgaaagaattgatagagcttaccgaagcaagcctggtgtctgttcggaaaagctcgttgctggctgcgctggacgaagagagaccgggcagacaggaggatgccgaataccaagctttccgggaggctatcactgaggctgtcgaagcgccggccgccgcccgcggatctggctccgagacagtgccgaaagcggaggctggcccagaatcggctgccggcggccaggaggaggaagagggcgaggatgaggaagagttgagcggaaccaaagtttctgccccctactacagcagctggggtactctggagtaccacaatgctatggtggtggggactgaggaggctgaggatggcagcgcaggggtgagggtgctgtatctgtatcccactcacaagtccctgaaaccttgcccattcttcctcgagggcaagtgccggttcaaagagaattgtaggttttcccacggccaggtggtctctttggatgaactgaggcctttccaagatcctgatctgagttcgctgcaggcggggtcagcctgtttagcaaagcaccaagatgggctctggcacgccgcccggattaccgacgttgacaatggatactataccgtgaaattcgacagtctcctgctgagggaggctgtcgtggaaggtgacggaatcctcccacctttgcggacagaggccaccgagagtgattctgactctgacgggactggagacagcagctatgcccgggttgtgggttctgacgccgtcgacagcggcacatgctcatccgccttcgccggatgggaagtgcacacgcgtggaattggatccaggttgctgactaagatgggctatgaattcggaaagggactaggccgacatgcagagggaagagtggagcccatccatgccgtagtccttccacgaggaaaaagtctcgaccaatgcgtggagaccttacaaaaacaaactcgcgtcgggaaggctggaaccaacaagcctccgagatgcagaggcagaggcgctcgtccgggaggacgacccgcaccacgcaatgtgttcgatttcctaaatgaaaaattgcaggggcaggcacccggagccctggaggctggcgcggcgcctgcagggcgccgttccaaagatatgtaccacgcaagtaagtctgcaaaaagggccctgagcctccgcttgtttcagaccgaggagaagattgaaaggactcaacgtgacattcgcagcatacaggaagccctggcacgtaacgccggccgacattctgtggcttccgcacagctgcaggagaagttggccggcgcccagcgccaactgggtcagctcagagctcaggaggccggcctgcagcaagaacagaggaaagctgacacacataagaagatgactgagttctag

SEQ ID NO: 14855 - DNA, 1509 bp, Artificial Sequence
  Description of Artificial Sequence: Synthetic coding sequence
atggatgaggagagtttagagtcagccctccaaacttatagagcccagttgcaacaggtcgagctggctctgggcgcaggcctggattcatctgaacaggccgaccttcggcagctccaaggagatcttaaggaactgatcgaattgactgaggcctctctcgtgtctgtcagaaagtcctctctcctcgcagcactggatgaagagcgccctgggcgacaggaggacgccgaatatcaagcattccgcgaggctatcaccgaagcagtggaagctcctgccgcagcgcgcgggtcagggtccgagaccgtgccaaaagcagaagccggcccagagagtgccgcaggcggccaggaggaggaggagggtgaggacgaagaagagctaagtgggaccaaggtctcagctccatactattcctcctggggcaccttagaataccataatgccatggttgtcggcaccgaagaggcagaagatggatcagccggcgtccgagtcctgtatctgtaccctacacataagtctctcaaaccctgtccgttttttctcgagggaaaatgcaggtttaaagaaaattgcaggtttagtcatgggcaggtggtctctcttgacgagctgcgcccatttcaggatcctgatttgtcaagcctccaggcaggctccgcatgcctggccaaacatcaagacggactatggcacgcagccaggattaccgatgtggacaatggatattacactgttaagtttgactccctgctccttagggaggcagtcgttgagggcgacggcatcctcccacccctgaggaccgaagcgaccgaatccgacagcgactctgacgtcgtgggcagcgatgcggttgactctgggacttgctcttccgccttcgctgggtgggaagtgcatacccgaggcattgggagtcgattgctcacaaagatgggctacgagtttggtaagggcttggggcggcacgctgaagggcgtgttgaacctatccacgcggtagtgttgcctcgtggcaagtcccttgaccagtgcgtcgaaactctgcaaaagcagacgcgggtagggaaagctggcactaacaaaccaccaaggtgccggggaaggggggcccgacccggcgggcggccagcacctagaaacgtgttcgattttctcaacgagaaattgcaagggcaggcccctggtgctttagaggctggcgcagcaccagccggccgccgatccaaggacatgtaccacgctagcaagagtgccaaaagggctctctccttgaggctctttcagactgaagagaaaatcgagcggacacagcgcgatatccgtagtatccaggaggctcttgctagaaatgccgggcgccactcggtggcatccgcccagctgcaggaaaaactagcaggcgctcaacgccagctagggcagctgcgcgctcaggaggccggtctgcagcaggaacagagaaaagccgacacccataagaagatgaccgaattttag

SEQ ID NO: 14856 - DNA, 1536 bp, Artificial Sequence
  Description of Artificial Sequence: Synthetic coding sequence
atggatgaggagtctctcgagtctgccctgcagacttacagggcccaactgcaacaggtggaactcgcactcggtgctggactcgactcctccgagcaggcagaccttcggcagctccagggtgatctcaaagagctcatagagcttacagaggcttccctagtatctgtgcgaaaaagctctctgcttgcggcactcgatgaagagcgcccaggtcggcaggaggacgccgaataccaggccttcagggaggccattactgaggccgtcgaggcacccgccgcggcgcgtgggagcggctccgaaaccgttccaaaagctgaggccggacccgaatcagcagctgggggacaggaggaagaagaaggggaggatgaggaggaactgtccggtaccaaagtcagcgctccgtattatagctcctggggaactcttgaataccataatgcaatggttgtggggacagaggaagccgaagatggctccgcaggagttcgggtattgtacctgtatccgacccacaagagtctgaagccctgtccttttttcctggaggggaaatgccggtttaaagaaaattgtaggttcagccacggacaggtggtgtccctcgatgaattacgcccctttcaggatccggacttgagctcattgcaggccggttccgcttgcctagctaaacatcaagacggcttgtggcacgccgcaaggattacagacgtcgacaacgggtattatactgtcaaattcgactctctgctgctccgagaggcggttgtggagggagatggcatactgccacccttgaggacagaggccacggaatccgatagcgatagcgacggaaccggtgattcttcttatgccagggtggtgggctctgacgcagtggatagtgggacctgtagctccgcgtttgctggatgggaggtgcatacccgcgggattgggagtagactcctgacgaaaatgggttatgagttcggcaaaggccttggtagacacgctgagggccgggttgaacccattcatgcagtggtgctcccccggggcaaaagcttggaccagtgtgtagagactctgcaaaagcagactcgcgtgggcaaagccggcacaaataaacctcccagatgtcgtggtcgcggagcccggcccggtggtaggcccgccccaaggaacgtattcgactttcttaatgaaaagttacaaggccaagctcctggtgctcttgaggccggcgctgctcctgcaggccgtagatccaaggatatgtaccacgcttcgaaaagcgctaagagggcgctttccttgaggctgttccaaacagaggaaaaaatcgaaaggacacagagggacataaggtcaattcaagaggcgctggctcgtaacgccggacgtcacagcgttgcatcagcccagcttcaggagaagcttgctggtgctcagcggcagttgggccagctgcgtgcacaagaagcagggctgcaacaagaacagaggaaggcagatacacataaaaagatgacagagttttag

SEQ ID NO: 14857 - DNA, 294 bp, Artificial Sequence
  Description of Artificial Sequence: Synthetic coding sequence
atggacgaggaaagcctggaatctgccctccaaacgtaccgtgcgcagctgcagcaggtcgagctcgccttaggagccggtctcgactcctcagaacaagcagatttgaggcagctgcagggcgaccttaaggagctgatcgaactgactgaggcgtcgctggtatcagtccgaaaatcttcacttctagctgctctggatgaggagagaccaggaaggcaggaggacgcagaataccaggctttccgggaagctatcactgaagctgttgaggccccagctgcagcacgatag

SEQ ID NO: 14858 - DNA, 1536 bp, Artificial Sequence
  Description of Artificial Sequence: Synthetic coding sequence
atggatgaggagagcttggagtccgcgctccagacatatagagcccagctgcagcaggtagaattggcactgggtgctggcctagacagcagtgagcaggcagacctccggcagcttcagggggacttgaaggaactaatcgaactcactgaagcatctcttgtgagtgtgaggaagtcgagtctgttagctgcccttgatgaagaaaggcctgggaggcaagaagacgccgaatatcaggccttccgggaggccatcaccgaggctgtggaggcccctgcagcagccagggggtccgggagtgagacagtgccaaaggccgaggcaggaccggaaagcgccgctggaggacaggaagaagaagaaggagaagacgaggaggagctttcggggactaaggtttctgcgccttactatagcagctggggcaccttggagtaccacaatgcaatggtagtaggcaccgaagaggctgaggacggttcagctggggtgcgcgtgctgtacctatatcctactcacaaatcccttaagccttgccccttttttctggagggaaagtgtaggttcaaggagaattgcagattcagccatggccaggtcgtatcattagacgagctccgcccttttcaggaccccgacctgagtagtctgcaggctgggagcgcctgtttggctaagcatcaggacggcctgtggcacgctgcgcgcatcaccgatgtcgacaacggttattatacggtcaagttcgactcactcctactgcgtgaggccgttgttgagggcgacggaattctgccccctctgcgaacagaagcgaccgaatctgattccgactcagacggaaccggcgatagctcttacgcccgggtggtcggcagcgatgctgtggactccggcacctgtagctctgctttcgctggatgggaagtgcacactcggggcattgggtctcggctccttacgaaaatgggatacgagtttggcaaagggctcggccgtcatgccgaagggagagtggagcccatacacgctgtcgtgttgccccgcggcaaaagcctggaccagtgtgtcgagacgctccagaagcaaaccagggtcggtaaagcgggcaccaataagcctccccgctgtcggggtaggggagcaaggcccggcggcagacctgccccacgcaacgtgtttgatttcctaaacgaaaaattacaaggccaggcccccggggcgttggaggcaggcgctgctccagcagggcgcaggagtaaggatatgtaccacgcatccaagtcggcgaaacgcgcgctgtcactgagactttttcagacggaagaaaaaattgagcgcacacagcgtgatatccgaagcattcaggaggccctcgcgcggaatgcagggaggcatagcgtggctagcgcacagttgcaggaaaaactggcaggagctcaaaggcagctggggcagctgagggcccaggaggctgggctccagcaggaacaacgaaaggcagatactcataagaagatgacagagttctag

SEQ ID NO: 14859 - DNA, 1419 bp, Artificial Sequence
  Description of Artificial Sequence: Synthetic coding sequence
atgaacaattcccaggggcgtgtgaccttcgaggacgtcactgtgaatttcacacagggggaatggcagcgtctgaaccccgaacaacggaacctgtatcgggacgtcatgttggaaaattacagcaatctggtctccgtggggcagggggaaactactaaaccagatgtaattcttaggctggaacaaggaaaagaaccctggcttgaagaggaagaggtgttaggtagtggtcgcgcagaaaagaacggcgatataggagggcagatctggaagcctaaggatgtcaaggaatctttggcaagagaagtgcccagtatcaacaaagagaccttgacaacgcagaagggagtggagtgcgacggctccaagaagatcttgccacttggtattgacgatgtgagttcactgcagcattatgtgcagaacaacagccacgatgacaacggctataggaagctggtcggcaacaacccctcgaaattcgtaggtcaacaattgaaatgtaatgcttgcaggaaactcttctcttcgaagagcagactgcagagccatctgcgcaggcatgcgtgtcagaagccgttcgagtgccactcatgcggcagagccttcggagagaagtggaaactggataagcaccagaagacacatgccgaggagcgcccgtataaatgcgaaaattgcgggaacgcttacaagcagaagtctaatctattccagcaccagaagatgcataccaaagaaaaaccttaccaatgcaagacctgcggcaaagccttctcatggaaatcttcatgcatcaatcacgaaaagatccacaatgccaaaaaatcatatcagtgcaacgagtgcgagaaaagctttcgccagaactccacactgattcagcataagaaggtccacacaggacaaaaaccgttccagtgtaccgactgcggcaaagcatttatctataagtcagatctagttaaacatcagcgcatccatactggcgagaagccttacaagtgctcaatctgtgaaaaagcattttctcagaagagtaatgtgatcgaccacgaaaagattcacactggcaagcgagcctatgaatgcgacctctgcggcaatacctttatccagaagaaaaacctaatccagcataagaaaatccacacaggggagaagccctatgaatgtaaccggtgcggcaaagcttttttccaaaagtccaatctccacagtcatcagaagacccattctggcgagagaacataccgttgctcagaatgtgggaaaaccttcatcaggaagctgaatctcagcttgcacaaaaagacccataccggacagaagccatacgggtgtagcgagtgtgggaaagcttttgctgatcgatcttatctcgtccgtcaccaaaaaagaatccacagcaggtag

SEQ ID NO: 14860 - DNA, 1917 bp, Artificial Sequence
  Description of Artificial Sequence: Synthetic coding sequence
atggagagttgttcagtaaccagattagagtgcagcggagcgatcagcgcccactgcagcctccatcttcctggcagcagtgactcccccgcgagcgccagccagatagccggcaccactgacgcaatctggaatgagcaggaaaaggctgagcttttcacagacaagttttgtcaggtgtgtggtgtgatgctgcagtttgagtcccagcgaatctcccattatgagggggagaagcacgcccagaacgtgtctttttacttccagatgcacggtgagcagaatgaggtgccaggaaaaaagatgaagatgcacgtggagaacttccaggtgcatagatacgagggcgtcgacaagaataagttctgtgacctgtgcaatatgatgtttagtagccccctaatagcccagtcgcattacgtcgggaaggtgcacgccaagaagctaaagcaactgatggaagagcacgatcaagcctcacctagtggcttccagcctgagatggccttttctatgagaacatacgtgtgtcacatttgttcgattgcctttacttcgctagatatgtttaggtcccatatgcaggggtccgagcaccagataaaagaatccatcgtgatcaatctggtcaaaaatagcaggaaaacccaggacagttaccagaacgagtgtgctgactatattaatgtccaaaaagccagaggcctggaggctaagacttgtttcaggaaaatggaggagtcttcattagaaacacgccggtaccgagaggtcgttgactcgcgacctaggcatagaatgtttgaacagcgactgcccttcgagacctttcgtacctacgctgctccttacaacattagccaggccatggagaagcagctccctcattcaaagaaaacctacgatagctttcaggacgagctagaagactatatcaaagttcaaaaagccagaggtctcgaccctaagacatgtttccggaagatgagagagaattcagtcgatacgcacggatatcgcgagatggttgactccggaccacgctcacggatgtgcgagcagcgatttagccacgaggcttctcagacttaccaacgaccctatcacatctctcctgtcgagtcccagctgccacaatggttacctacccactctaagcggacctacgacagctttcaggacgaattagaggattatattaaagttcagaaggcacgcggtctggagcctaaaacatgctttaggaagattggggactcctcagttgagacacatcgaaatcgcgaaatggtggacgtacggcccaggcaccgtatgctcgaacaaaaacttccgtgtgaaacctttcagacttattcaggaccctattcaatcagccaggtggtggaaaaccaactcccacattgtctgccagcacatgacagtaaacagcggctggactccattagttattgccagctgactagggattgtttccctgagaagccagtaccattatccttaaaccagcaggaaaacaactcaggatcatactccgtggaatctgaagtgtacaagcacctgagttcggagaacaacacagccgatcatcaagctggccacaagcagaagcatcagaaacggaaacgccacctggaagagggaaaagagcgcccagagaaagagcagtccaagcataaacggaaaaaatcctacgaggacacagatctggacaaggacaagagtatcaggcagcgcaaacgcgaggaagatcgtgttaaggtttcgtccgggaagttgaagcaccgtaagaagaagaaatcacatgacgtcccaagtgaaaaggaagaacgaaagcaccggaaagagaagaagaagtccgtggaggaacggacagaagaagagatgctgtgggacgagagcatcctggggttctag
